United States Patent 9,061,059 (MODIFIED POLYNUCLEOTIDES FOR TREATING PROTEIN DEFICIENCY) - sequence listing, part 127

SEQ ID NO: 246014 - DNA, 3333 bp, Artificial Sequence
  Description of Artificial Sequence: Synthetic coding sequence
tgcagccattcagacgtcggcgagcgcacctcccctatcccacagcagcggcctctgcaatcccacgcggagatggccggaaatcacagactcggcctcgaggcaggcgatacagatgaccccccacggattacacagaatcccgtgatcaatggaaacgtggctttgtctgatggacacaataccgccgaggaggacatggaagacgacacctcatggcgtagcgaagctaccttccagttcaccgttgagaggttttcaaggctgagtgaatcagttctctctccgccttgttttgtgaggaacctgccctggaaaataatggtgatgccacgattctatcccgacaggcctcaccaaaagtccgttgggtttttcctgcagtgtaacgctgaatccgattctacaagctggtcttgccacgcccaggcggtcctgaaaatcatcaattacagggacgacgagaaatctttttccagaagaatctcccacttgttcttccataaagagaatgactggggtttctccaattttatggcatggtcagaggtgacagatccagagaagggcttcatcgatgacgataaggtgacattcgaggtctttgtccaggccgacgctcctcacggcgtggcatgggacagcaagaaacacacaggttatgtgggcctgaagaaccagggtgccacgtgctatatgaatagcctactgcaaacactcttctttaccaaccagctgagaaaggctgtgtatatgatgccgacagagggcgacgattcatccaaaagtgtacctcttgccctccagcgagtattttacgagttgcagcattccgataagcctgttggtaccaagaagctgaccaagtccttcgggtgggaaactctggacagcttcatgcagcacgacgttcaggagttgtgccgtgtcctgttagataatgtcgaaaacaagatgaagggaacctgcgtggaagggactattcctaaattattcaggggtaaaatggtgagctacatccagtgcaaggaggtggattatagaagcgaccgccgagaggactattatgacatccagctcagtatcaaaggaaaaaaaaatattttcgaatctttcgtggactatgtcgcggtcgaacagcttgacggcgataataagtatgacgccggtgaacacggcctgcaagaggccgagaagggtgtcaaatttctaacactgccccctgtgctgcatttgcagctaatgcgcttcatgtacgacccacagacagaccaaaatataaaaattaatgaccgcttcgagtttcccgaacaactcccgctggacgaatttctccagaagaccgaccctaaggatcccgctaactatatccttcacgccgtcctggtgcatagtggtgataatcatgggggacactatgtggtctacttaaacccaaagggcgatgggaagtggtgcaaatttgacgatgatgtggtgtcccgctgtaccaaggaggaggccattgaacacaattatggaggtcatgacgacgatctgagtgtaaggcactgtactaacgcatacatgctggtttacatccgggagtctaagttgtccgaagttctgcaagccgtcacagaccatgatattccccagcagctcgtagaaaggttgcaagaggaaaagcgcatcgaagcccagaagaggaaggaacgtcaagaggctcacctgtacatgcaggtgcaaattgtcgctgaggatcagttttgtgggcaccagggaaatgatatgtacgacgaggagaaagtcaagtacaccgtgtttaaggtgctgaaaaactcgtcccttgcagagttcgtccaatcgctgagccagaccatgggctttcctcaggaccagattagactgtggccgatgcaagcacggtccaacggaacgaagcgtcccgctatgctggataatgaagccgacggaaacaagacaatgatcgagttgagtgataacgaaaacccctggacaatcttcctcgagacagttgatcccgaactggccgcttcaggtgccactttaccgaaatttgataaagaccacgacgtgatgctgttcctgaagatgtatgatccgaagaccaggtcactgaactactgcggacatatctacactcccatttcttgcaagattcgtgatctcctccctgttatgtgtgatagggctggcttcatccaggatacatcccttatactgtacgaagaagtgaagccgaatctgactgaaagaattcaggactacgacgtctccctcgacaaggctttagatgagttgatggatggggatataattgtttttcaaaaggacgaccccgagaacgacaattctgagctgccaacggcaaaggagtacttccgggacctctaccatcgggtagatgtgatcttctgtgacaagacaatcccgaatgatcctggcttcgttgttacactcagcaatcggatgaactattttcaggtggcgaagaccgttgctcagagactgaataccgacccgatgctgttgcaattcttcaaatcccaggggtaccgagacggccctggtaatccattgcgccataattatgaaggtacactacgggatctgcttcagttcttcaaacctcggcagcccaagaagctctattaccagcagctgaagatgaaaattactgactttgagaatagacgcagcttcaagtgcatttggctcaattctcagtttagagaggaagagataacgctctacccagataaacatggatgcgtccgggaccttctcgaggagtgtaaaaaggcagtcgaactgggcgagaaggccagtggcaagctacgtttactcgagatcgtttcttacaagatcataggtgttcaccaggaggatgaactgctggaatgcttgtcccccgctacaagtcggactttccggattgaagaaatacccctggatcaggttgatatcgacaaggaaaatgaaatgttggtcacagttgctcactttcacaaggaagtttttggaacatttggtattccatttctattacgaattcatcagggcgaacattttagggaagttatgaaaaggatccagagcctgttggacatccaagaaaaagaatttgaaaaattcaaattcgccattgtgatgatgggccgacaccaatacatcaatgaagacgagtatgaggtcaacctaaaggatttcgagccacaaccaggcaatatgtcccacccccgtccctggttggggctggatcactttaataaggcccctaagcggtcaagatatacctatctggagaaggcaattaagatacacaattag

SEQ ID NO: 246015 - DNA, 3012 bp, Artificial Sequence
  Description of Artificial Sequence: Synthetic coding sequence
atggttatgcctagattttaccctgatagacctcatcagaaatctgttggcttcttccttcagtgtaatgccgagtctgactctaccagctggtcttgccatgctcaggccgtattgaaaattatcaattacagagacgatgagaaaagtttctccagacgtatctcgcacttgttctttcataaagaaaatgattggggcttctccaacttcatggcatggagcgaagtcacagatccagagaaaggtttcatagatgatgataaggtcacattcgaggtctttgtgcaggctgatgcgcctcatggcgtggcgtgggacagcaaaaagcataccgggtacgttggccttaaaaaccaaggagccacgtgctacatgaatagcctccttcagacactgttttttaccaatcagttaagaaaggcagtttatatgatgccgacagagggagacgatagtagcaaaagtgtccccttggccttgcagagggtcttttacgaactgcagcattctgataagccagtaggtacaaaaaaactaactaagagctttggctgggagacacttgattcatttatgcagcacgacgtacaagaattgtgccgcgtgcttttagataatgttgaaaataaaatgaaaggcacgtgtgtggaaggcacaatccctaagttgttcaggggaaagatggtgtcatatatccaatgcaaagaggtggactatcgaagcgacaggcgggaagattattacgacatacagttaagtattaaaggtaaaaaaaatattttcgagtctttcgtcgactacgttgcagtcgagcagctggatggggataacaaatacgatgcaggcgagcatggtttacaggaggcggaaaagggcgtgaaatttttgacgctcccccctgttcttcacctccagctgatgcgcttcatgtacgatccacagaccgaccagaatatcaagatcaacgataggttcgagttcccagaacaactgccacttgatgaatttctgcagaagacggatccaaaagacccggcaaactatattcttcatgcggtcctggttcattcaggcgacaaccatggaggtcattacgttgtgtacttgaatccaaagggagatggcaaatggtgtaagtttgacgatgatgtcgtgagcagatgcaccaaagaagaagcaatcgagcataattatggcggacacgatgatgaccttagcgtgcgtcattgtacaaatgcctacatgcttgtgtatattcgtgagagtaaactgtctgaggtcctccaggcggtcaccgatcacgatatcccgcagcagctggtggagcggttgcaggaagaaaaacggatcgaggctcagaaacggaaggagaggcaggaggcgcacctctacatgcaagtacagatcgtcgctgaagatcagttttgtggccaccaggggaatgacatgtatgacgaggaaaaagttaagtatacagttttcaaagtgttgaagaactcaagcctggcagaatttgtgcagtctttatcacagacaatgggttttccccaggaccagattcgtctctggccaatgcaagccagaagtaatggcacaaagaggcctgcaatgttagacaatgaagcagatggaaataaaacaatgatcgagttgtctgataatgagaacccttggacaatctttctggaaactgttgatcctgaactcgcagcgtctggtgcaaccctgcctaaatttgataaggaccacgatgtgatgctgttcctcaagatgtacgatcccaagacccggtctctcaactattgcgggcacatctatacccccatatcctgtaagataagggacttgctgcccgtgatgtgtgatagggcaggatttatccaggacacctccctgattctatatgaggaagttaaacccaatcttacagagcggattcaggattacgatgttagcctcgataaggctctcgacgagttgatggacggcgacatcatcgtttttcagaaagacgatcctgaaaacgacaatagcgagctgcccactgccaaggagtacttcagggacctgtaccacagagttgacgtaattttctgcgataagacgatcccgaacgaccccggttttgtggtcactctcagtaaccggatgaattacttccaggttgccaaaaccgtggcccaacggctgaataccgatcctatgctgctccagttcttcaagtcacaggggtatagagatggcccaggtaacccgctgcgtcacaactatgagggcacactgcgcgacttgctgcagttcttcaaacctcggcagccaaagaaactttattaccagcagttaaagatgaaaattactgactttgagaataggcggtctttcaagtgcatttggttgaattctcagtttcgcgaggaggagatcactctttatcccgataaacatggctgtgtgagggatctgctcgaggagtgcaagaaggctgtggaactaggcgaaaaagccagtggcaagctgaggttgctcgaaattgtcagctacaagatcattggcgttcatcaggaggatgaactcctcgaatgcctgagcccagctacttcacgcacctttcgcatcgaagagatccccctggatcaggtcgatatagacaaagagaacgaaatgcttgtaaccgtggcccactttcacaaagaggtgtttggcacatttggaatccctttcctcctgagaattcaccagggcgagcactttcgggaagtgatgaaaaggattcagagcctgctcgatatccaggagaaggaattcgaaaaattcaaatttgcgatcgtgatgatgggaagacaccagtacattaatgaggatgaatatgaagtgaacctgaaggatttcgagccgcagccaggcaacatgagccatccgagaccttggttaggccttgaccattttaataaggccccaaagcggtcccggtacacgtaccttgaaaaggcgatcaaaatccacaattag

SEQ ID NO: 246016 - DNA, 1530 bp, Artificial Sequence
  Description of Artificial Sequence: Synthetic coding sequence
atggaggacgacacttcttggcgcagtgaagccaccttccaattcactgtggagcggtttagccggctttccgagtcagtcctttcccctccttgcttcgtcagaaacttaccttggaaaatcatggtcatgccaaggttttaccctgacagacctcaccagaaaagtgtcggcttttttctgcagtgtaacgccgagagtgactccactagctggtcctgtcatgcgcaggccgtactgaaaatcattaactaccgtgacgatgaaaagtcattctcacggaggatatcccacctgttctttcacaaagaaaatgactgggggttctctaactttatggcctggagcgaagtgacagaccctgaaaaaggctttatagatgatgataaagtcactttcgaggtgtttgttcaggccgacgcccctcacggtgttgcgtgggatagtaagaaacatacgggttatgtcggcctgaaaaaccaaggcgctacatgttatatgaatagcctcctccaaacccttttttttacaaatcagttgaggaaggctgtctatatgatgccaacagaaggtgacgattcctccaagtctgtgcccctcgccttacagcgcgtcttctacgagctgcagcattctgacaaaccagttggtactaaaaagctcacaaagagcttcgggtgggaaaccctggattctttcatgcagcacgatgttcaggagctctgtcgggtgttacttgataacgtagaaaacaagatgaaaggcacctgtgttgaaggaacgatccccaagctgtttaggggtaagatggtgagctatatccagtgcaaagaagtggactataggagcgacaggcgggaagactactacgatatccagctatccattaaggggaagaagaacatcttcgagtcctttgtcgactacgtggccgttgaacaactggatggagataacaagtacgatgcaggcgagcacgggcttcaggaagccgagaaaggagtgaaatttctcacattgcccccagtgctacacctgcagctgatgagattcatgtatgacccacagacagaccagaacatcaagattaacgacagatttgaattccctgaacagctaccactggacgagttcctgcagaagaccgaccctaaagatcctgccaattacatcttgcatgcggtgctcgtacacagcggcgataatcacggagggcactacgtcgtgtatttgaatcctaaaggggacggtaagtggtgcaagtttgatgacgacgtcgtgtctcggtgtacaaaagaggaggcgattgagcataattatggcggtcatgacgatgacttgtctgttcgacattgcacaaacgcatatatgttggtctacatccgagagtcaaaactgaccgtggggggtgccattacccggagagagaaggacagagggtctgaagcagagggggctgcagggtcgcccagtctgtacgcctctgcagattctagacgtgggccagtcctctggcctccccgagagtag

SEQ ID NO: 246017 - DNA, 7712 bp, Artificial Sequence
  Description of Artificial Sequence: Synthetic coding sequence
atgactgccacaacaaggggcagtcccgtgggaggaaatgacaaccaaggccaggccccagacggccagtcccagcctccgttacagcagaatcaaacgtctagccccgattcctctaacgagaatagccctgctactccgccagatgagcaaggccagggcgacgcgccaccccagctcgaggatgaggagcctgcgtttccccacacagatctcgccaagttagatgacatgattaataggccacgatgggttgtgcccgtgctcccgaagggagaacttgaggtcctcctggaggctgctatcgatctgtccaaaaagggcctagatgtcaagtctgaagcatgtcagagattttttcgggacgggctgactatctcctttaccaagatcctgacagacgaggcggtatccggttggaagttcgagatccaccggtgtatcataaacaatactcaccgcctcgtggagctgtgcgtggccaagctaagccaggactggtttcccttactcgagttgttggcaatggctcttaacccgcattgtaaatttcacatttataatgggaccagaccatgtgagagcgtcagttcgtcagtgcagctccccgaagacgaacttttcgcgaggagcccagatccgaggagtccaaagggctggctggtggacctactcaacaaatttgggaccctgaatggatttcagattctgcacgatcggttcatcaacgggtccgcactcaatgttcagatcatagccgctctaatcaagccgtttggacagtgctatgaatttctgacattgcacacagttaaaaagtacttcctaccaataattgaaatggtgccccagttcctggaaaacctcacggatgaagaattgaaaaaggaggctaagaatgaagcaaaaaacgacgcattgagcatgattataaaaagcctcaaaaatctggctagcagagtgcctgggcaggaggaaacagtgaagaatctagaaatctttagacttaagatgatcctgcgcctcctgcaaatatcctccttcaatggcaagatgaatgccctgaatgaggtgaataaagtgatttcttcagtgagttactacacgcatcgccacggcaatcccgaggaggaggagtggctcacagctgagcgtatggccgaatggatccagcagaacaacattctgtccattgtgctgcgagactcactgcaccaacctcaatatgtggagaaactcgaaaaaatcttgaggttcgtgatcaaggagaaggctttaaccctccaagatctggataacatctgggccgcacaagccggtaagcatgaggccatcgtcaagaacgtgcatgacctactggccaagctggcctgggatttctcaccagagcagctggatcacctttttgattgcttcaaagccagctggactaacgcctccaagaagcagagggagaagttattggaactgatcaggaggctggccgaagacgacaaggacggagtcatggcccacaaagtgttgaatctcttgtggaatctagctcactccgacgatgtgcctgtggacataatggatcttgccctgtctgctcacataaagattctcgattacagctgttcccaggatagagatacccaaaagattcaatggatcgaccgctttattgaagaacttcggaccaatgacaaatgggtcataccagctctaaaacagatcagggaaatctgttcactgtttggcgaagcgcctcagaatctctcacagactcagcgctcacctcatgtattctacagacacgatttgatcaaccaactgcagcataaccacgcactggtcacattggtggcagagaatctcgccacctatatggagagcatgaggctctatgccagagaccacgaggattacgatccccagaccgtgagactggggtctaggtactcacatgtgcaggaggtacaggaacgtctaaatttcttgaggttcctacttaaagacggccagctgtggctgtgtgctcctcaggcgaaacagatttggaagtgccttgcagagaatgcagtgtatctctgtgaccgcgaggcgtgctttaagtggtactcaaagttgatgggcgacgagcccgacctggatccagacatcaacaaagactttttcgaatccaacgtgctccaactggatccaagcctgctcacagagaacgggatgaaatgcttcgagcgcttttttaaggccgttaactgcagggaggggaagctggtggccaaacggagagcctatatgatggatgacctcgagctcataggactcgactacctgtggagagtggtgatacaatcgaacgacgacattgccagtagagctatcgatttgctaaaggagatatacacaaatctcgggcctagactgcaggtgaatcaagtggtgatccacgaagattttattcagtcctgtttcgatcggctgaaggccagttatgacactttgtgcgtcctggacggtgacaaggattctgtcaactgcgcacgacaggaggccgttagaatggtgcgagtcctgacggtcctccgggagtacattaacgagtgtgatagcgattatcatgaggagaggactatcctgcctatgagccgcgcttttcggggtaaacatctttcttttgttgttcgctttccgaaccaggggaggcaggtagatgatctggaagtttggagtcacacaaatgatacgatcggttcggtacgacgatgtatactcaacagaattaaagctaatgtggcccatacgaagatagaattgttcgtaggtggggagctgattgatcccgcagatgaccggaagctcattggccagttaaacctcaaagataaaagcctcattaccgccaaattaacccaaatcagcagcaatatgccaagctccccagatagcagttctgacagttccaccggatcacccggaaaccacggcaatcattactccgatggcccaaaccctgaggtggagagctgcctgcccggagttataatgtcgctccacccccgatacatctcgttcttatggcaggtagctgatctcggttcgagtctgaacatgccgccactccgtgacggtgctagggttctaatgaagctaatgcctcccgactccacaactattgaaaagctccgtgccatttgcttagatcatgctaaactgggcgaatccagcttgtcaccaagcttagacagcctgttcttcgggccatccgccagtcaggtcctatacctgacagaagtggtgtatgctctcctgatgcctgcaggggctccactggcagacgacagcagtgacttccagttccactttctgaaatcaggaggcttacccttggtcctcagtatgctgacccggaataactttctaccaaacgccgatatggagaccagacggggagcctacctgaacgctctgaagattgctaagctgcttctgaccgccatagggtacggacacgtgagggcggttgcagaagcttgccagcccggtgtagagggcgtcaatcctatgacgcagattaaccaggtaactcacgatcaggccgtggtactgcaatcggctctacaatccatacctaaccctagtagtgaatgtatgctgcggaatgtgtcagtgcggctggcacagcaaatttccgacgaagccagcagatatatgccggacatctgcgtcatcagagctatccaaaagatcatctgggcatccgggtgcggaagccttcagctggtcttctcccccaatgaggagattactaaaatctatgagaaaactaacgcaggcaacgaacctgacctcgaagacgagcaggtgtgctgcgaggctctggaggtcatgaccctgtgcttcgccttaattcctacggcactggacgcactcagcaaagagaaagcctggcagactttcatcatcgatctgctgttgcactgtcacagtaagactgtcaggcaggtcgctcaagaacagttttttctgatgtgcactagatgttgtatggggcaccggccactcctcttcttcattacacttctgtttacagtgctaggctccacagctcgagaaagggcgaagcatagtggagactactttacacttctaagacacctgctcaattacgcctataactctaacataaatgtgccgaatgccgaagtactacttaataacgagattgactggctgaagagaatccgggacgacgttaagcggaccggggagaccgggattgaggaaacaatcttggaaggccatctcggcgtgaccaaggaattgctggccttccagacgagcgagaaaaaatttcatattgggtgcgaaaaggggggagccaatttgatcaaagaactgatcgacgactttatattcccagcttccaatgtctacttgcagtacatgagaaatggtgagctgcccgcagagcaggctatcccggtgtgtgggagtcctcccaccatcaatgctgggttcgagcttctggttgcgctcgcagtgggctgtgtacggaacctgaaacagattgtggattccctgacagagatgtactatattggcacagccataacaacgtgcgaagcactgaccgagtgggaatacctgccccctgtaggcccacgcccacccaagggcttcgtgggcctcaagaacgcaggcgctacctgttacatgaattcagttatacaacagctgtatatgatacccagcatcaggaacggaattctcgccattgagggaactggctctgatgtggatgacgacatgtccggcgatgagaaacaagataatgagtcgaatgtggatccacgggatgacgtcttcgggtatccacagcaatttgaggataagcccgctctgtccaaaactgaggataggaaggagtataatattggggtgttgcggcaccttcaggtgatttttggacacctggccgcaagtagactccagtattatgtcccacgcggattctggaagcagttcaggctatggggtgaacccgtaaacctgagggaacagcacgacgcgcttgagttcttcaattccctggtcgattctttagatgaggcccttaaagcccttggtcatccggcaatgctctcaaaggtgttggggggaagctttgctgaccagaagatatgtcaagggtgccctcatagatatgagtgtgaggaatctttcaccacacttaacgtggatattcgaaatcaccagaatctgttagacagtctagagcagtatgtgaagggcgaccttctggaaggggctaacgcctatcactgtgaaaagtgtaataaaaaggtggacacagtgaaaaggttgctaataaagaagttgccacctgtcttggccatacaactcaagcgttttgattatgactgggagagagagtgtgccataaaatttaatgactactttgagtttccgagagaattggacatggaaccttacacggtggctggagtcgccaagcttgagggcgacaacgtgaaccccgaaagccagttgatccaacagagcgagcagtccgagtccgagacagccggatcaactaagtaccggcttgtgggcgtactggtgcacagcgggcaggcatctggcggacactattactcttatattatccagaggaacggcggagacggagagagaaaccgctggtacaaattcgacgatggagatgtgaccgagtgtaagatggatgacgacgaggaaatgaagaaccagtgcttcggtggagagtacatgggtgaagtgttcgaccatatgatgaaacggatgtcataccgccgacagaaacgctggtggaatgcttatatcttgttttacgagagaatggatactattgatcaagatgatgagctgataaggtatattagcgagttagctattaccactcggcctcaccaaatcatcatgccttctgccattgagcgctccgtccggaagcagaacgtgcagttcatgcacaatcgcatgcaatacagtatggaatatttccaattcatgaagaaactgctgacctgcaatggtgtgtacctgaatcctcccccaggccaggatcacttacttcctgaggccgaggaaattaccatgattagtatacaactcgcagcaaggtttctcttcactacaggctttcacaccaaaaaggttgttaggggaagcgcctcagactggtacgacgcactgtgcattctgctgcgccactctaagaacgtacggttctggttcgcccataacgtactctttaacgtgtccaacagattctctgaatatcttctggagtgccctagtgcagaagtgaggggggcattcgcaaagctgatagtgttcatcgcccacttcagtcttcaggacggcccttgcccctccccatttgcaagcccaggccctagctcccaggcgtacgacaatcttagcctctctgaccatcttctccgtgccgttctgaacctcttaaggcgcgaggtcagtgagcacggaaggcacctgcagcagtacttcaatttatttgtgatgtacgccaatctgggagtggcagaaaagacacagctcctcaagctgtccgtgccagcaacctttatgctcgtaagtctggatgaggggcctgggcctcctattaagtatcaatacgcagagttgggcaagctgtacagtgtagtgagccaattgatccgctgttgtaatgtgtcatccagaatgcaatctagtatcaatggaaacccacccttgcctaatccctttggcgatcccaatctgtcccagccaattatgccaattcaacagaatgtggccgatatcctgttcgtgaggacaagttatgttaagaaaatcattgaggattgcagcaactccgaagagactgtgaaactcctgagattctgttgctgggaaaaccctcagttttcttccacagtgctatcagagctgctgtggcaggtagcctacagttacacttacgaactccgtccatatcttgatctcctgttacagatcctgttaatcgaagacagctggcagacacaccgcatccacaacgccttgaaagggattcccgacgatcgagatgggctgttcgatactatccagagatctaaaaaccactaccagaaaagggcatatcagtgcatcaagtgtatggtggccttgttttccaactgccccgttgcttaccagattctgcagggaaacggcgacctgaagagaaaatggacatgggcagtagaatggctgggcgacgagttggaaaggagaccttatactggaaatcctcagtatacctacaataactggagtcccccagtgcagagcaatgagacgtccaacggttactttttggagcgctctcacagtgctcgcatgacgttggctaaggcctgtgaactctgccccgaggaagttaagaaggctacctctgtgcagcaaatcgaaatggaagaaagtaaggagccagacgaccaggatgctcctgacgagcatgaatcccctccccctgaagacgcccctctgtacccacactctcctggatcacagtatcaacaaaataaccacgtgcatggccagccctacactggacccgctgcccaccacatgaacaatccccagcgcacaggacagcgcgctcaggagaattacgagggatcagaggaagtctcccctcctcagacaaaagatcagta

SEQ ID NO: 246018 - DNA, 7664 bp, Artificial Sequence
  Description of Artificial Sequence: Synthetic coding sequence
atgacagctaccacaagggggtccccagtgggaggcaatgataatcaaggccaagcccctgacggacaaagccagcctccactgcaacaaaaccagacctcatcacccgacagctctaatgaaaactcccctgcaacacctcctgacgagcaggggcagggagacgcgccaccacagctggaggacgaagagcctgctttccctcatactgatctcgccaagttagatgacatgattaacagacccaggtgggttgttcccgtgcttcctaaaggcgaactggaggtactgctggaggcagccatagatttgagtaagaaggggttagacgttaaaagtgaggcatgtcagcggttctttcgcgacgggctcaccatctctttcacaaagattctcacagatgaggccgtgtcaggctggaagttcgagatccataggtgcatcattaacaatacacaccggctagtggagctgtgtgtcgccaagctgtctcaggactggttcccattgctggagttactcgccatggccctgaacccacattgcaagtttcacatctacaatgggacgagaccttgcgagagcgtctcctcctccgtccagcttccggaagacgaactatttgcaaggagccctgatccacggagccctaagggctggctggtggatctgttgaacaagtttggtacgcttaatggatttcaaatcttgcatgataggttcatcaatggcagcgcactgaacgtgcagataattgccgcattgattaagcccttcggacaatgttatgaattccttactcttcataccgtgaagaagtattttctccccataatagaaatggttccacagttcctcgagaacctcaccgacgaggaattgaagaaggaggctaagaacgaggctaaaaatgacgcactctcgatgataattaagtctctgaagaatttagccagccgagtgccgggtcaggaagaaaccgtgaaaaacctggagatctttcggcttaagatgattctgagactactgcaaataagtagctttaacggtaagatgaatgccctgaatgaagtcaataaagtcatctcttccgtctcctattatactcatcgacacggcaatccagaagaggaggaatggttgacagccgagaggatggccgagtggatccagcagaacaatatcctgtctatcgtactgcgggattctcttcatcagcctcagtatgttgaaaaattagagaagatccttcgattcgtcatcaaagagaaagcactgaccctgcaggatctcgacaatatctgggcagcacaggcgggtaagcatgaagcaattgtgaagaacgtccacgatctcttagccaagctggcttgggatttctctccggaacagttagatcacctctttgattgcttcaaggcttcttggaccaatgcctcaaaaaagcaacgagaaaaactgctggaactcatccgtcgactagccgaggatgacaaagatggcgtgatggcccacaaggttcttaatttgctgtggaatcttgcccacagcgatgatgtgcccgtggacattatggacctcgctttaagcgctcacataaaaattctagactacagctgttcccaggacagggatactcaaaaaatccaatggatcgatcgcttcatcgaggaactcaggacaaacgataagtgggttattcctgctctgaagcaaatccgagaaatatgcagtcttttcggggaggccccacagaatctcagccagacgcagcgaagccctcatgttttctaccgacacgatctgattaaccagctgcagcacaaccatgctctcgtcactttggtcgctgagaatttagcaacctacatggaaagtatgcgcctgtatgcaagggatcatgaggattatgatccccagaccgtcagattgggaagccggtactctcacgtccaggaagtccaggagcgcctgaacttcctccgttttcttctgaaggatggtcagctctggttgtgcgctcctcaagcgaagcagatctggaagtgtttagccgagaacgctgtgtatctgtgcgaccgggaagcatgcttcaagtggtactctaagcttatgggcgacgaacccgacctcgacccagatatcaataaggacttttttgagtctaacgtgctccagctggatccttccctcctcaccgagaacggcatgaaatgcttcgaacggttcttcaaagccgtgaattgtagggaaggtaagctcgtcgcaaagcgcagagcatatatgatggacgaccttgaactcatcggcttagattatttgtggagagttgtgattcagtcaaatgacgacatcgctagtcgggctatcgatcttctgaaagagatctatacgaacttagggcctagactacaggtcaatcaggtggtcatccacgaagactttatccagtcttgtttcgaccgcctcaaggccagctatgacaccctatgcgtattagacggtgataaagacagtgtgaactgcgcacggcaggaagcagttaggatggtccgtgtcttgacagttctgcgcgagtacattaacgagtgtgacagcgactatcacgaggaacgcacaattctaccaatgtctcgggcttttcggggaaaacatctcagtttcgtcgtgagattccccaaccaggggagacaggtagacgatctggaagtgtggagccacacaaacgacaccatcggaagtgtgaggagatgcatacttaatcgtataaaggccaatgtagcccacacaaagatcgagctcttcgttgggggtgaactgatcgatccagctgacgatcgaaagcttatcggacagttgaatctaaaggacaagagcctgatcacagcaaagctgacccaaatttctagcaatatgcctagctcaccagactccagttcggatagctctacagggagtcctggcaaccacggtaatcattattccgacggccctaatcctgaagttgaatcttgcctgcctggtgtgattatgtcgctccaccccaggtacatctcatttctatggcaggttgctgacctcggaagttccctgaacatgcccccattaagggatggtgccagagtcctgatgaaacttatgcccccagatagcaccactatcgaaaagcttcgcgctatttgcctggaccatgcaaagctcggcgaatcaagcttgtcaccgagcttggactctctgttttttgggcctagcgcaagtcaggttctctatctgaccgaggtcgtgtacgcactactgatgccagctggtgctcctttagcggacgatagctccgactttcaatttcattttctaaagtctgggggtttaccccttgtactgagcatgttaacccggaataacttcctgccaaatgcagacatggagactaggcggggagcatatttgaacgcattgaaaatcgcgaagctgttattaacagcaatcgggtatggacatgtccgggctgtggcagaagcctgtcagcccggtgtcgaaggagttaacccaatgacccagatcaatcaggtaactcacgatcaagccgtggtgttgcagtcagcccttcagtctatccccaatcctagctcagagtgtatgttgagaaatgtgtctgtgcggttggcccaacaaattagcgacgaggcctccagatacatgcccgatatctgcgtgatccgagccatccagaagataatttgggcatcggggtgcggatctctacagctggtcttctcaccaaacgaggagatcactaagatatatgaaaaaaccaacgcaggcaacgagccagacctagaggacgagcaagtgtgctgcgaggcgttggaggttatgaccctctgttttgctctcatccccacagccctggacgcattgtctaaggagaaggcctggcaaactttcattatcgaccttcttctccactgccactccaagacagtcagacaggtggcccaggagcagttctttctcatgtgtactcggtgctgtatgggccaccgcccactgctgttcttcattacactcttgtttaccgtactcgggtctaccgcaagagaaagagcgaagcacagtggggattattttaccctcctgagacaccttcttaattacgcttacaactctaacatcaatgttccaaatgccgaagttttgttaaataatgaaatcgattggctaaagcgtattagggacgatgtcaagagaacaggagaaacgggtattgaggaaaccatccttgaggggcatctgggcgtaaccaaagagctcctggcatttcaaacctctgaaaagaagtttcacatcggatgcgaaaaaggtggcgctaatctgatcaaggaactgatcgatgattttatcttccctgccagtaatgtgtacttgcagtacatgagaaacggcgaactgcctgccgaacaagccatcccagtctgcgggagcccacctacaatcaatgccggatttgagctgctggttgcgttagcagttggttgcgtgcggaatttgaaacagattgtcgattccctgactgagatgtactacattggaacagcaatcacaacctgtgaagctctcacagagtgggagtatctacctcccgtgggacctagaccacctaaaggtttcgtcggtctcaagaacgccggagccacttgttatatgaattccgttatccagcagctatatatgatcccctcaattagaaatggcattctcgcaatagaagggactggctccgacgtcgacgatgatatgtcaggtgacgagaaacaggataacgagagcaacgtcgatccccgtgacgacgtctttggatacccacaacaattcgaagataagcctgcactgagcaagacagaagacagaaaggaatataacattggagttttgcgccatctgcaggtgatattcgggcacctggccgcatcgaggttgcagtattacgtgcctcgaggtttctggaagcagttccgtctctggggtgagcctgtgaacctgcgcgaacagcacgatgctctagagtttttcaacagtctcgtggattccctggatgaggccctgaaagccttagggcatccagccatgctgagtaaagtcctgggcggatcctttgctgaccagaaaatttgccaaggttgcccccataggtatgaatgcgaagagtctttcactaccttgaatgtagacattagaaatcaccagaatcttctagactctctagagcagtacgttaaaggcgacctgctggagggggctaacgcctaccactgcgaaaagtgtaacaaaaaagttgacaccgtaaaacggctcctgatcaaaaagctgcccccagtcctggctatccagctgaagcgcttcgactacgactgggaacgggaatgcgccatcaaattcaatgactactttgagtttccaagggaactggacatggagccttacaccgtagccggagttgccaagctggagggagacaatgtcaaccccgagtctcagttgattcaacagagcgaacaatcagagtccgagacggccggtagtacaaagtatagactggtgggcgtccttgtacattcgggccaagcttcaggcggacactactatagctatatcatccagcgtaacggaggagatggtgagcggaatcgatggtataaatttgacgatggcgacgtgacagagtgtaagatggatgatgatgaggaaatgaaaaatcagtgcttcggtggtgagtatatgggagaggtatttgatcacatgatgaagcgcatgtcctatcggaggcagaagagatggtggaacgcatacatcctgttctacgagcgcatggacaccattgaccaggacgacgagttaatccggtacatttcagaactggcaatcaccacccgccctcatcagattatcatgccctctgcaattgaacggagcgtccgcaagcagaacgtacagttcatgcataaccgcatgcagtacagcatggagtactttcagtttatgaagaaactattgacctgtaatggcgtgtatttaaacccacccccagggcaagaccatttgcttcctgaagcggaggaaatcaccatgatctccatccaattggccgctagatttctgttcacaacgggattccatactaagaaggtcgtcaggggttcggcgagtgactggtatgacgcgctttgtatcctcttgaggcactcgaaaaacgtccgcttttggtttgcccataacgttctttttaatgtgtctaacagattctctgaatacctgttggagtgcccttcggctgaagtgcgaggcgctttcgcgaagctgatagtgttcattgcccacttctccctccaagatgggccttgtccaagcccattcgcctcccccggtccctcgtctcaagcttatgataatctcagcctatcagatcacctcttaagggccgttctaaatttgctgaggcgggaagtttctgaacatggcagacacctgcagcagtatttcaacctcttcgtgatgtatgccaacctcggcgttgccgagaagacccagcttctgaagctcagtgtgccagcaaccttcatgttggtgtccttagacgagggtcctgggcctccaatcaaatatcagtatgccgagcttgggaaattgtactccgtggtgtcacagctcatccggtgttgcaatgtgagctcacgtatgcagagctcaatcaatggcaacccacccctgccaaacccctttggcgatccaaatctaagccagccaatcatgcctattcagcaaaacgttgccgatattcttttcgtgcggaccagctacgtgaagaaaattattgaggactgcagtaattctgaggagaccgtgaaactcctccgcttttgctgctgggagaatccacaatttagttcaaccgtgttgagcgaactgctgtggcaggtggcctatagctacacctacgagctgagaccctaccttgatctgctccttcaaatcctcttaattgaagactcatggcagacgcaccgcattcataacgctctgaagggtattcctgatgacagggatggattatttgataccatacagcgcagcaagaaccactatcaaaagcgggcataccagtgcatcaagtgtatggtagctttgttctccaattgccccgtcgcatatcagattctgcagggtaacggcgatctgaaacgaaagtggacctgggcagtagaatggttgggcgatgagttggagcgacgcccttacaccgggaatccacaatatacatataataactggtcccccccagtacaaagcaacgaaactagcaatggttactttctggagagaagccactccgccaggatgaccctcgcaaaagcatgcgagttgtgccccgaagaggaacccgatgatcaagatgcgcctgatgaacatgagagtccacctccagaagacgcgcctctgtacccacactctcctggcagtcagtaccaacagaacaaccacgtgcatggtcagccctatacggggccagctgctcatcatatgaataatccccagcgcacagggcagcgagctcaggagaactatgaaggaagtgaagaggtgtcacccccacagactaaagatcaata

SEQ ID NO: 246019 - DNA, 7667 bp, Artificial Sequence
  Description of Artificial Sequence: Synthetic coding sequence
atgaccgccataactcacggaagcccggtaggaggcaatgacagtcagggccaggttctcgatggccagtcacagcatcttttccaacaaaatcagacctcaagtcccgacagtagcaacgaaaatagcgtggccacaccgccacctgaagagcagggacaaggagacgcacctccccagcacgaggatgaggagccagcatttccacatacagaactagccaatctggacgatatgatcaatcggcctaggtgggtcgtacccgtgttgcccaaaggggaattagaggtcctgcttgaggctgccattgatctgagcgtcaagggtctcgatgtgaagtcggaagcctgtcaaaggttttttcgggatggactgacaattagtttcaccaagatattgatggacgaggccgttagcggctggaagttcgaaattcatcggtgtatcatcaacaatacccatcggctcgtggagctgtgtgtggctaagttatcacaagattggtttccgttgctcgagcttctagctatggcgctaaatcctcactgtaaatttcacatctataacgggacacgtccatgcgaactcatcagctccaacgctcagctcccggaggacgaattgttcgccagatccagcgacccgaggtctccaaagggctggcttgtcgacttgatcaacaagtttggaacgttaaatggatttcagatcctgcatgaccggttttttaatggctctgcactgaatattcagatcattgccgcactgatcaaacccttcgggcagtgctacgagtttctgtcacagcatactttgaaaaaatactttatccccgtgattgaaatagtgccccacttattggaaaatcttaccgacgaggagctgaagaaagaggcaaaaaatgaagccaagaacgacgcattgtctatgataatcaaatccctaaagaaccttgccagcaggatatccggccaggatgagactataaaaaacctcgaaattttccggttgaagatgattctgcggctgctccagatcagctcctttaacggaaagatgaacgccctcaacgagattaacaaggtcatttcaagtgtatcatattatactcaccgacacagcaacccggaggaggaggagtggctgactgcagagaggatggccgagtggatccaacagaacaatatacttagcatcgtgctccaggattcgctacatcagcctcaatacgttgaaaaactggaaaagattttgcgattcgttatcaaagagaaggccctgacactgcaggacctggataatatctgggcagcccaggccggaaagcatgaggctatcgtcaaaaatgttcatgatcttctggctaaactggcctgggattttagccccggacagctcgatcacttattcgactgcttcaaggctagttggaccaacgcatcgaagaaacaacgggagaaactgttagaactcattcgcaggctggcagaagacgataaggacggtgtgatggcacacaaagtcctgaatcttctgtggaacttagcacaatctgatgacgttcctgttgacattatggacctagctttgtctgcccatatcaaaattctcgattattcctgttctcaagacagagatgctcagaaaatacagtggattgatcatttcatagaggaactccgaaccaacgataagtgggtcatccccgcactgaagcagattagggagatctgcagtttattcggggaggcgtctcagaacctttcacagacacaacgctcccctcatattttctacaggcacgacctgattaaccagctgcagcaaaaccacgcactggtgacattagtggcagaaaacctggctacatacatgaactcaatccgactctacgctggagaccacgaagactatgaccctcaaactgtcagactggggtcccgttacagccatgtccaggaggtacaggaacggctcaacttcctgagattcctgctcaaagacggccagttgtggctctgcgcaccccaggcaaagcagatttggaaatgtctcgcagaaaacgctgtgtatttgtgcgatagagaggcatgtttcaaatggtatagcaaacttatgggggacgaacccgaccttgatccagacatcaacaaagacttctttgaatcaaacgtgctgcagcttgatccatctctgctgacagaaaacggtatgaaatgtttcgagcgcttcttcaaagccgtcaactgcagggaaagaaagctcatagcaaaacgacggtcatatatgatggacgatctggaattaataggtctggattacctctggcgagtcgttattcagtcttccgacgagattgccaacagggccatcgacctacttaaggagatttacaccaatctcggaccacgtctgaaagcgaaccaggtagtgatccacgaagacttcatacagagctgctttgaccgcttaaaagcaagttatgatacgttgtgcgttttcgacggggacaagaatagtattaactgcgcgagacaggaggctatcagaatggttagggtgctgacagtgatcaaggaatatattaacgaatgcgactccgattaccacaaagaaaggatgattctgcctatgtctcgagcttttagaggaaaacatctgagcttgatcgtgaggttcccaaatcaaggacgccaagttgacgagctggacatttggagccacacaaatgatacgattggcagcgtgcggagatgtatagtgaacaggatcaaagccaacgtcgcccacaaaaaaattgagctcttcgtgggaggcgaactgatcgactctgaagatgataggaagctaataggacagctaaatctcaaagataaatctctgatcacagccaagttgacacagattaattttaacatgccctctagcccggacagcagtagtgatagctccacggcttcccctggcaaccaccgaaaccattacaacgacggccctaacttggaggtagagtcatgtctgcccggagtcattatgtccgtgcatccgaggtacatctcattcctgtggcaggtcgctgacttggggtctaatttgaacatgccccctctgcgcgatggagcaagggtcctgatgaagctgatgccacccgaccgcaccgcggttgaaaaactccgtgctgtttgcttggatcacgcaaagttgggagagggcaagctgtcaccaccactggattcactgtttttcgggcctagtgcctctcaagtgctatatctgacagaagttgtctacgccctcctgatgcctgcaggagttcccctgactgatggcagcagtgattttcaggtgcatttcctcaaatcaggagggctcccccttgtgctgtccatgctcattcggaacaatttcctgcccaacacagacatggagactcggcgtggagcatacctgaatgcacttaaaatagccaagctgctgctcaccgctattggatacggccacgtgcgcgctgtcgccgaagcgtgccagccggtagtggatggaaccgatcccatcacgcagattaaccaggtgacccacgaccaggccgtggtgttacagagcgcactgcagagcataccaaatccatcttcggagtgtgtcctgaggaatgaatccattttactcgcccaggagatttctaatgaggcctctcgctatatgcctgacatctgtgtgattagggctatccaaaaaattatctgggctagtgcttgtggagctctcggccttgtgttcagtcccaacgaagagatcacgaagatttatcagatgaccacaaatggctcaaataagttggaggttgaggatgaacaggtatgctgtgaagccctggaggtgatgaccttgtgtttcgcccttttaccaaccgcgcttgacgcgctcagcaaggagaaggcctggcagaccttcatcatcgacctcttactgcattgtcctagcaagacggttcgccagctggcacaggagcaattctttttgatgtgcacacgatgctgcatggggcacaggcctctgcttttttttatcaccttgttgtttacaatcttgggttcaacggcaagagagaaaggaaaatacagtggcgattattttacgctgctccgccatttgctgaactacgcttataacggaaacataaacatcccaaacgccgaggtcctgctcgttagtgagatagattggctgaagcgcatccgtgataatgtaaagaatacaggcgagaccggagtggaagagcccatcctcgaggggcaccttggcgttacaaaagagctgctggcctttcagaccagcgaaaagaaataccatttcggctgcgagaagggcggagcgaatcttattaaagagctcatcgatgacttcatctttccagcgagtaaagtctacctgcagtacctgcgcagtggcgagctcccagcagagcaagcgatccccgtttgtagttctccagtaacaatcaatgcgggttttgaattgttggtcgcacttgccataggttgcgtgcgcaatctgaaacagatcgtggattgcctcacggaaatgtattacatgggaactgcgatcacgacatgcgaggccttgacggaatgggagtatctaccgccagttgggcctcggcctcctaaaggtttcgtgggtctgaagaacgccggagccacctgctatatgaatagcgtaatccagcaactttatatgatccctagcattaggaattctatcctagccattgagggtacgggcagcgacctccacgacgacatgttcggggacgaaaaacaggatagtgaaagtaacgtggatcccagagacgatgtcttcggctatccacatcagttcgaggacaaacctgcgctgagtaagactgaggatcgcaaagaatacaatattggggtcctgagacacctccaggttatttttggccatctggctgcttcacaactgcagtattatgtgcctcgcggtttctggaaacagttccggctgtggggggaacccgtgaatttgcgagagcaacacgacgctcttgagttttttaactctttagttgattccctggacgaagcactgaaagcactgggacaccctgcaatcctgtccaaggtgttagggggaagtttcgcagaccagaagatctgccagggctgtcctcatagatatgagtgtgaggaaagtttcaccacactgaacgtggacatccgaaaccaccagaacttattggattccttggagcagtatattaagggcgatctgcttgagggagctaatgcttatcattgcgaaaaatgtgacaaaaaggtggatacagtgaaaagattactgattaaaaaattgcctagggttttagcaatacagctaaagcgcttcgactacgattgggagcgggagtgcgctattaagttcaatgactattttgagttccccagggagctcgatatgggaccttataccgttgccggtgttgcaaacttggagagggacaatgtgaattcggagaatgagctgatcgagcagaaggagcagtcggataacgagacagccggtggcaccaagtaccggctggtcggggtgctggtacatagcggccaggcctctggtggccactactacagctatattattcagaggaacgggaaggacgaccaaactgatcattggtacaagttcgacgacggcgatgtaaccgaatgtaaaatggacgacgacgaggaaatgaaaaatcagtgtttcggcggagagtatatgggggaggtgtttgaccatatgatgaaaagaatgtcttacaggcgccaaaagcggtggtggaatgcctatatcctgttttacgagcagatggacatgatcgatgaagacgatgaaatgatacgatatatcagcgagttgaccatcgccagacctcaccagattatcatgtcgcctgctatagagcgttcagtgaggaaacagaacgtcaagtttatgcacaacagactgcaatatagcctcgagtacttccagtttgttaagaagctgcttacctgtaatggcgtgtacctgaaccccgcaccagggcaggactacttgctcccagaagctgaggaaatcactatgatttcaattcaactcgccgctcgcttcctttttacaactggtttccatacaaagaagattgtgagagggccagcatccgattggtatgatgcactgtgcgttctgctgagacatagcaaaaacgttaggttctggtttacgcacaacgtactgttcaacgtgtctaatagattctcagagtacctgcttgagtgcccctccgccgaggtgcggggagccttcgcaaagctgattgtgttcatagcccatttctcgttacaggatgggagttgcccaagtccctttgcttcccctgggccttcttcacaggcctgcgacaaccttagtctttcagaccacctactgagggccacactcaacctcctgcgcagagaagtgagtgaacatggacatcatctgcagcaatatttcaacctgttcgtgatgtatgctaacctgggcgtggccgagaaaactcagctgctgaagttaaacgtgccagctacttttatgcttgtaagcctcgacgaggggccagggcctccaattaaataccagtacgccgagctagggaaactctacagcgtggtctctcagcttatcagatgttgcaacgtgagctccacgatgcaatccagtattaatggcaatcctcccctgcctaacccatttggtgacctgaatctgagccagcctattatgccaatccagcagaacgtacttgatatcctgttcgtgcgtacatcatatgtaaagaagattatcgaggattgtagcaacagtgaggacactatcaagttgctgcgcttctgttcctgggaaaaccctcagttttcatcaacagtactcagcgagcttctctggcaggtagcatactcttatacctatgaattgcgaccatacctcgaccttctgttccaaatcctcctgatcgaagacagttggcagacccatcggatccataacgcactgaagggtattcccgacgatcgagatggcctgtttgacactatccagagaagcaagaatcattaccaaaagcgcgcataccagtgtattaaatgtatggttgctcttttcagcagctgccccgtcgcctatcagatactgcagggcaacggcgatttgaagcgcaaatggacctgggccgtggaatggttaggcgatgagttggagaggcgcccatataccggaaacccccagtactcttataataactggtcaccgcctgttcagagcaacgagaccgccaacgggtatttcctggagcgctctcattccgctaggatgacgctggccaaggcatgcgagctctgtccagaggaggaacccgacgaccaagacgccccagatgaacacgagccctctccttctgaagatgctccgttgtatccgcattctccagcctctcaatatcagcaaaataaccatgtacacggacagccttataccgggccagcggctcatcatctgaacaatcctcagaagacgggtcaacggacccaagaaaactacgagggcaacgaggaagtcagttctcctcagatgaaagatcagta

SEQ ID NO: 246020 - DNA, 714 bp, Artificial Sequence
  Description of Artificial Sequence: Synthetic coding sequence
tgactgctgaagactgcagtgacccagaggatcccctctaactattttgccttcgcactggggcgtatcctgtcatcccacctactctctagtgccaacttctcagggcgaattcataacgccctgaaaggtatccccgacgatcgagatggtctattcgatactatccagcggtccaagaaccattatcagaagcgcgcttatcagtgcatcaagtgcatggtagctctctttagcagttgcccagtcgcctaccagatattacagggtaacggtgacctgaagaggaagtggacatgggccgtggagtggctcggggacgagcttgagaggaggccgtatactggaaatcctcagtactcttacaacaattggtcacccccagtgcaaagcaatgaaacggccaacggatatttcctggagcggtcccattctgctcgcatgacattggcaaaggcttgcgagctgtgcccagaggaggagcccgatgaccaggacgccccagatgagcacgaaccttcaccttccgaggatgctccactttatccgcactcaccagcaagccaataccagcagaacaaccatgtacatgggcaaccctacactggccctgccgcacatcatctgaacaaccctcagaagaccgggcagaggacccaagagaactacgaaggcaatgaagaagtgtcctcccctcagatgaaggatcagtag

SEQ ID NO: 246021 - DNA, 3201 bp, Artificial Sequence
  Description of Artificial Sequence: Synthetic coding sequence
atgacggaccaagagaacaataacaatatatccagcaacccttttgcagctctgtttgggagtcttgctgatgctaaacagtttgccgctattcagaaggaacagctgaaacagcaatccgacgagctgcctgcaagcccagacgattcggataactccgtttccgagagccttgacgagtttgactactccgttgcagaaatatccaggagctttaggagccaacaggagatttgcgaacagctgaatataaaccacatgattcagcgtatatttcttataacgctggataatagcgacccttctctgaagagtggaaacggcattcccagccgatgcgtctacctcgaggaaatggccgtggaactggaagaccaagattggttggacatgagcaacgtggagcaggccctcttcgccagactcctcctgcaagacccgggaaatcatctgattaacatgacctctagcacaacactgaacctgtcagccgacagagacgctggcgagcgccacatattctgttacctgtactcatgtttccaacgggctaaagaggagattaccaaggttcctgagaatttactgccttttgctgtccagtgcaggaacctcacggtctccaatacacggactgttttgctaacacctgagatttacgtggatcagaacatccacgaacagcttgtcgatctgatgctcgaagcaatacaaggagcccacttcgaagatgtaactgagttcctggaggaagtgattgaagccctgatcctggacgaggaggtgcgcactttcccagaggtgatgattcccgtatttgatattctgcttggtaggattaaggacctggagttgtgtcagatattgctttatgcctacctagatatccttctgtattttacacggcaaaaagatatggcaaaggtgtttgtggaatacatccagccaaaagatcctacaaacggccagatgtaccagaaaactctgcttggagtgattttaagcatctcgtgcctcctgaaaacccctggtgtcgttgagaaccacggctacttcctgaaccccagtaggagtagtccacaggagatcaaagttcaagaggcaaatatacatcagtttatggctcagttccatgagaagatctatcagatgctaaagaatctgctccagctatcaccagagaccaaacattgtatcttgtcctggcttggcaattgtctccacgcgaatgctggaagaactaagatatgggctaaccagatgcctgaaatcttcttccagatgtacgcatcagacgcatttttcctgaatcttggagccgctttgctgaagctgtgtcagcccttctgtaaacctaggtccagccggctcctcacatttaaccccacctactgtgccctcaaggagcttaacgacgaagaaaggaagattaagaacgtgcacatgcggggacttgacaaagagacctgcctgatcccggcagtccaggaacccaagtttccccagaactataacctcgtgacagagaacctggccctgacggagtacaccctgtatctgggctttcatcgcctacacgatcaaatggtgaagattaatcagaatctgcaccgcctgcaggtggcctggagagacgctcaacagagtagctctcccgcagctgataacctgagggaacagttcgagagacttatgacaatttatctgtccaccaaaacagccatgactgagcctcaaatgttgcaaaactgtttgaatttgcaagtctccatggctgtgcttctggttcaactagcaattggtaacgagggttcccaacctatcgagctcactttcccactccctgatggatactctagccttgcttatgtgccggagttctttgccgataacctgggcgatttcttaatcttcctcagaagatttgcagacgacatcctggagactagcgccgattcacttgagcatgtattgcactttatcaccatcttcaccggctctatcgagcgcatgaagaacccccatctgcgcgctaaactggcagaggtgctagaagccgtgatgccccatcttgaccagacccctaacccgttagtgtcatccgtgtttcatcggaaacgggtcttttgcaatttccagtacgctcctcaactggcagaagcgttaattaaagtctttgttgacatcgagttcaccggggacccacatcagtttgagcagaagtttaactatagaagacccatgtaccctattctgcgctatatgtggggaacagacacttatcgggagtccataaaagacctcgccgactacgcgagcaaaaatctcgaggctatgaaccccccactgttcctgagattcctgaacctcctgatgaatgatgccatttttttgctggacgaagctattcaatacctgtccaaaataaagattcaacaaattgaaaaggatcgaggggagtgggattcactgacaccggaagcgaggagagagaaggaggctgggctgcagatgtttggacagcttgctcggttccacaacatcatgtcaaacgagacgatcggaactctcgcatttctgaccagcgaaataaagtccctctttgtccacccattcctggctgagagaattattagtatgctcaattatttcctgcagcacctagtcggtcctaaaatgggggctcttaaggtgaaggatttctctgagttcgattttaagcctcagcagctggtgagcgacatctgtaccatctatctcaacctgggggacgaagagaacttttgtgcaaccgttccaaaagatgggcgatcctactcacccactctcttcgcacagacagtgcgtgtcctgaaaaagatcaataaacccggaaatatgatcatggctttttcaaatctcgcagagaggataaagagcctcgctgatctccagcagcaggaggaagaaacctacgccgatgcctgtgacgagttcctggatcccattatgtcaaccttaatgtgtgaccccgtcgtactccctagctctcgtgtaaccgttgaccgcagcaccattgcgagacatctgttaagcgaccagaccgacccgttcaataggtcccccttgacaatggaccagattcggccaaacacagaacttaaagagaaaatccagcggtggctggcagagcggaaacaacagaaagagcagcttgagtag

SEQ ID NO: 246022 - DNA, 3222 bp, Artificial Sequence
  Description of Artificial Sequence: Synthetic coding sequence
atgaccgaccaggagaacaacaacaacatctccagcaacccgttcgccgcactgttcggatccctcgccgacgcaaagcaattcgccgctatccagaaagaacagttgaagcagcagagcgacgaactgcccgcaagccctgatgacagtgataactctgtttccgagtctctggacgagttcgactatagcgtcgctgaaatttcacgcagctttcgatcccagcaggagatctgtgagcagctgaacatcaatcacatgattcaacggatattcttgatcacgctggacaactccgatccttctctgaaatccggaaacggtattcccagtcggtgcgtgtatttggaggaaatggccgttgagttagaggaccaggactggttggacatgagtaacgttgaacaggcgttgttcgccaggcttctgttgcaggatcccggaaaccatctaatcaatatgacaagttctactactctgaatctttctgcagacagggacgccggagagaggcatatcttttgttatttgtactcatgctttcagagggctaaggaagagataactaaagtgcctgaaaacctgctgcctttcgccgtgcagtgtagaaacctgacagtgtccaatacgcgtactgttctgcttacccctgaaatttatgtagaccaaaatatccatgagcagctggttgatctgatgctggaggccatacaaggggctagggagtacatgaacaagatatattttgaggatgtaaccgagttccttgaggaggtgatcgaggccctgattttagacgaagaggttaggactttccccgaggtgatgattcctgtgtttgatattctacttgggaggataaaagatttggagttgtgccagatcctgctctatgcgtacctggacatcctgctctactttacccgccagaaggacatggcaaaggttttcgttgagtatatccagccaaaggatcccacaaacggacagatgtaccagaagacgttgctcggggtcatcctgtcaatctcttgcctactcaaaaccccaggagtcgtggaaaatcacgggtatttcctgaacccttcgcggtcatccccgcaggagattaaagtgcaggaggcaaatatacaccaattcatggcacagtttcatgaaaagatttatcagatgctaaagaatctgctgcagctgagccccgaaaccaagcactgcatactctcatggctgggaaactgtctccatgccaacgctggacggacaaaaatttgggccaaccagatgccagagattttctttcagatgtacgctagcgacgcattttttctgaatctgggcgctgcactgcttaagctctgccagcccttctgtaaacctagatcatcacgactactgacttttaatcccacttattgcgcgctcaaagagttaaatgatgaggagaggaagattaaaaacgtccatatgagaggcctggataaggagacctgcttgatccctgccgttcaggagcccaagtttccacagaactacaacctcgtgacggaaaacttagcattgacagaatatacgttatacctcgggtttcaccgccttcacgaccagatggtgaaaatcaaccagaacctccacagacttcaggtggcttggagagatgcccaacagtcttcgagtcctgctgctgacaatctgagagaacagtttgaaaggctgatgacgatttacctgagtaccaaaactgcaatgactgagccacagatgctgcagaattgcctgaacctgcaggtttctatggcagtgcttctggtgcagctcgccatcgggaacgagggcagccagcctatcgagctaaccttccccctgcccgacggctactccagcctggcatatgtgcctgagttctttgcggataatctcggtgatttcctcatctttttgcggagattcgccgatgacatcctagagacctcggccgattcacttgagcacgtgctacattttataacaatctttaccggatccatagaacggatgaagaaccctcacctgcgggcaaaactggctgaagtgctggaggcggtgatgccccacctggaccagacccctaacccccttgtttcctccgtgttccaccgcaagcgggttttctgcaatttccaatacgcccctcagcttgccgaggctctgatcaaggtgttcgtggacatcgagttcactggcgaccctcaccagtttgaacagaagttcaattacagaaggccaatgtatcccatcctgcggtatatgtggggaaccgacacttacagggagtccatcaaggacctggcagattacgcatcaaagaacctagaggccatgaaccctccgttgtttctacggttcctgaacctgttgatgaacgacgctatctttctgcttgacgaggctattcagtatctcagtaagattaagatacagcagatagagaaagataggggagagtgggattccctgacccctgaggcacgcagagaaaaagaggccggtctccagatgttcggccagctcgcccgtttccacaacataatgtccaacgagaccatcggcacactggcctttctgaccagtgagataaagtcgttatttgtgcaccccttcctggctgagcgcataatcagcatgctcaactactttttacagcaccttgttggacctaagatgggcgctcttaaggtgaaggatttttcagagttcgattttaagccccagcagctcgtttctgatatttgcacgatctatcttaatctcggcgacgaggaaaacttctgcgccaccgttcctaaagatggaaggtcctactctcccaccttattcgcccagactgtgagagtcttaaagaaaattaataaaccaggaaacatgatcatggcattcagcaacctggcggagcgcattaagagcctcgctgacctgcagcagcaggaggaggagacctacgccgacgcctgtgatgagtttctggaccctattatgagtactctcatgtgtgatccagtggtgctgccaagcagtcgtgtgaccgtggatcgctcaactattgccagacacctactcagtgatcagaccgaccccttcaatcggtccccactcaccatggatcagatccgcccaaacactgaactgaaagagaaaatccagcggtggctcgctgagcgtaagcaacagaaggagcagctcgaatag

SEQ ID NO: 246023 - DNA, 1617 bp, Artificial Sequence
  Description of Artificial Sequence: Synthetic coding sequence
atggttaagattaatcagaacctgcaccggctccaggttgcatggagagacgctcagcagagttcctccccggctgccgacaacctgagagagcagttcgaacggttgatgaccatctacttgagcactaagacggccatgaccgagccccagatgctgcagaattgcctcaacctccaagtttctatggcggttctgctggtccaattggctatcggaaatgagggtagtcagcctattgagctgacatttccactgccggacggctacagtagtctggcctatgttccagagttctttgctgataatctgggcgacttccttattttcctccgccgattcgcagacgatattctcgaaacttccgctgattcactggaacacgtgctgcatttcatcacaattttcacgggaagcattgagagaatgaagaaccctcacctgcgcgctaagctggctgaggtgctggaggcagttatgcctcacctcgatcagacccccaatccgctggtgtcaagcgtgtttcacaggaagcgcgttttttgcaacttccaatacgctcctcagcttgcagaagctctgatcaaagtgttcgttgatatcgagttcactggagatccacaccagttcgagcagaaatttaattaccgtagacctatgtacccaattctccgatatatgtggggcactgacacatacagggagtccattaaagatctggcagattacgcatcgaagaacctagaagcaatgaaccccccactgtttctgcggttcttgaatcttctgatgaacgatgcgatattcctcctggacgaagcaattcaatacctgtcaaagatcaagatacaacaaatcgaaaaggacagaggtgagtgggatagtctcactcccgaagcaaggcgagaaaaggaggctggacttcagatgttcgggcagttagcgcgattccacaacatcatgagcaatgagaccatcgggaccctggcattccttacaagtgagattaagagcttatttgtgcatccatttttggcagaacgcatcatctccatgctgaattactttttacagcatctggtgggccctaagatgggggcactgaaggtgaaggacttttccgagttcgacttcaagccccaacagttggtaagcgatatctgtactatttaccttaacctaggagacgaggagaatttctgcgcgaccgtgcccaaggacggcagaagttacagccccacactctttgcccaaacggtgagagttctcaagaagattaacaaaccgggaaacatgatcatggcattctccaatctagccgaacggatcaaatccctcgcggacctgcagcaacaggaggaggagacttacgccgacgcctgtgatgaattcctggatcctattatgagcacactaatgtgcgatccagtcgtacttccaagttctcgagtcacagtcgacagatccacaatcgcacgccatctcctgagcgaccagactgatcctttcaaccgaagccctttgaccatggaccagatccgtccaaacactgagctcaaggaaaagatccagcgttggcttgctgagaggaagcagcagaaggagcagctcgaatag

SEQ ID NO: 246024 - DNA, 3522 bp, Artificial Sequence
  Description of Artificial Sequence: Synthetic coding sequence
atggaggagctctcagccgatgagatcaggagaagaagactcgccagattggccggaggccagacgtcccagcccactacacccctgacatctccgcaacgtgagaatccgcctgggcctcctatcgctgcctccgcacccggtccatctcaaagcttgggcctgaatgtgcacaacatgacacccgcaaccagcccgattggggcttcaggcgttgcccataggtctcagagctctgaaggtgtctcctccttgagttcaagcccaagcaactccttggagacacaaagtcaaagcctgtcgcggtcccaatccatggacatagacggggtatcgtgcgaaaaatctatgagccaggttgacgtggatagcggaatcgagaacatggaggtggacgagaacgaccgccgagaaaagcggagtcttagtgacaaagagccatcgagtggccctgaagtgtcggaggagcaagccctgcagctggtgtgtaagattttcagagtcagctggaaggacagagaccgggacgtcattttcctgagttctctgagcgcccagttcaagcaaaatccaaaagaggtattctccgatttcaaagatctcatcggccagatcctgatggaggtactgatgatgtcgacacaaacccgagatgagaacccattcgccagcctaactgcaacaagccagcccattgcagccgcagcgcgttctccagatcgtaacttgctactgaacacaggaagtaaccccggtacttcgcctatgttctgtagtgtggcctccttcggcgctagtagcttaagctccctgggggcttctggtggagcatctaactgggattcctatagcgatcactttaccattgagacatgtaaggaaacagacatgctcaattatctcattgaatgtttcgacagagtggggatagaagaaaagaaagctcccaaaatgtgcagccagccagccgtcagccagctgttgtcgaatattaggagtcaatgtatcagtcacacagccctcgtcctccagggcagcttaacccaaccccgatcactacagcagccatcatttctggtgccttatatgctgtgtcgcaatctgccgtacggtttcattcaagaacttgtacggaccactcatcaagacgaggaagtctttaaacaaatcttcattcctattcttcaggggcttgccctggcggctaaagaatgctcattggactctgactatttcaaatatcctctcatggctcttggggaattatgtgagacaaagttcggcaagacacaccccgtgtgcaatctcgttgcctccctccgcctgtggctgccaaagagcctgagcccaggttgcggacgggaactgcagcggttgtcctacctgggcgcttttttctccttttcagtttttgccgaagacgacgtgaaagtcgtcgagaagtactttagcggtccagccattacactggaaaacactagggtggtctctcagagccttcaacattatctggaattgggaaggcaagagttatttaagattttgcattctattttgctcaatggcgaaacaagagaagcagctctaagctacatggccgctgtggttaatgcaaatatgaagaaggcacagatgcaaacggatgatcgtctcgtgtccaccgatggtttcatgctgaactttctctgggtgcttcaacaactttcaaccaaaataaagctggaaaccgttgacccgacctacatttttcacccaaggtgtcgaattactctgcctaacgatgagacacgagttaacgccaccatggaagacgtcaatgactggctgaccgagttgtacggcgaccagccccctttctccgaacccaagttccctacagagtgcttttttctcacgctgcatgctcaccacttgtctatattacccagttgcagaagatatatacgacgactgcgagccatccgggaactgaacagaaccgtggaggatctaaaaaacaatgagtctcaatggaaagattcaccgctcgcgacccgccatagggagatgctcaagcgctgtaagacccagctgaagaaactggtgcggtgcaaagcttgtgccgacgcaggcctactggacgagtcgttcctgagaagatgtcttaacttctacgggctgctgattcagctattgctgaggatcctcgacccagcttatccagacataacactgcctttgaactctgacgtaccgaaggtattcgccgctctgcctgaattttatgtcgaggacgtggcagagttccttttttttattgttcaatattcaccccaggctttatacgagccatgcactcaggacatcgtgatgttcctggtggtaatgctctgcaaccagaattacatccgcaacccttatctggtggctaaactcgtagaggtgatgttcatgactaatccggctgtccagccaaggacgcagaaattctttgagatgatcgaaaatcatcccttaagtacaaaactgcttgtaccatctctcatgaaattctacaccgatgtggagcacacgggcgcaacatctgagttttacgacaagtttaccatcaggtaccatatctcgaccatctttaagtcactgtggcagaatatcgcccatcacggaaccttcatggaggaatttaactccggtaagcaattcgtcagatacatcaacatgctgattaatgataccaccttcctgctggacgaatccctggagtcactcaagagaatccacgaggttcaggaagaaatgaagaacaaagagcagtgggatcagttaccaagagaccagcagcaggccaggcagtctcagctggctcaggacgaacgtgtgagtaggtcatacctggctttagcaacagaaaccgttgacatgttccatattttgaccaagcaggtccaaaagccatttctgagacctgagctgggaccacgcctggccgctatgctcaacttcaacttgcagcagctgtgtggaccaaagtgccgggatcttaaggttgaaaaccccgagaaatacgggttcgagccaaagaaactgctcgaccaactcaccgacatatacctgcagctggactgcgccagatttgccaaagcaatagccgacgaccagcgcagctacagtaaggaactcttcgaagaagtcatttcgaaaatgcgcaaggccggaatcaagagcaccattgctatcgaaaaattcaaactgctggccgagaaagtggaggaaatcgtagcaaagaacgctagagctgagatcgattactccgacgcacctgacgagtttcgggaccctctcatggacaccttgatgaccgacccagtgagacttccctccggtactatcatggatcgctccattatcttgcgccacctgttgaacagcccaacggaccctttcaatcgtcaaacccttacagaatccatgttagaacccgtgcccgagctcaaagaacaaatccaagcatggatgagggaaaagcagaactctgatcattag

SEQ ID NO: 246025 - DNA, 3909 bp, Artificial Sequence
  Description of Artificial Sequence: Synthetic coding sequence
atggaagagctcagtgcagacgagatcagaagacgacgtctggctcggctagctggaggacagacttcacaacctaccacccccctgacttcccctcagcgggagaatccccctggacctccaatcgctgcttctgcgccagggccttctcaaagccttgggttgaacgtgcataatatgacccctgccacatcacctatcggagccagcggtgtcgcacatcggagccagagtagcgaaggggtgtcctctctctcatctagtccatcaaattcccttgaaactcagtctcagtcacttagcagatcgcagagcatggatatcgacggcgtgtcgtgcgaaaaaagtatgtctcaggttgatgtggactctggcattgagaacatggaggttgatgagaacgatcggagggaaaagcggagcttatccgataaggagccctcctcaggacctgaggttagtgaagaacaggccctccagctggtctgtaaaatatttagggtcagctggaaggatagagacagggatgtgatctttttgagtagcctgagtgctcagttcaagcagaaccccaaggaagttttcagcgacttcaaggatcttatagggcagatcctgatggaagttctgatgatgtccacacaaactcgggatgaaaaccccttcgctagcctgactgccacgtcccaacctatcgccgcagcagccaggtcccccgacagaaatcttctgttaaacaccggctccaacccagggactagccctatgttctgctctgtggcttcatttggagccagttcattgtcgtctttgtatgaaagtagccccgctccaaccccatccttctggtcctcagttcctgttatgggcccatcactggcgtcaccttcgcgcgctgcctcgcagctcgctgtgccaagcacacccttaagtccccactcagcggcatccgggactgcagccggaagtcagccaagttcccccagatatcgaccttatacagttacacatccatgggctagttctggcgtgtccattctcagttcctccccctctccacctgccttggcaagctcccctcaggcagtgccagcgtcctccagtcgtcagaggccatcaagcactgggcctccactgccgccagctagcccttctgctactagccggagaccaagctccctccgtatctctcccagtttgggggcaagcggaggtgcctctaattgggattcctactctgatcactttaccatagagacttgcaaagaaactgatatgctgaactacctgatcgaatgctttgaccgggtgggcatcgaagaaaagaaggccccaaagatgtgtagccaacccgcagtgagtcaactgctgtccaatattcgctcccagtgtatctcgcataccgccttggtcctgcagggcagcctgacgcagcccagaagccttcagcagccttcctttctggtcccttatatgctgtgcaggaacctgccatacggtttcatccaggagctggtgaggaccacccatcaggacgaagaggtgttcaagcaaatatttatccctattctacaggggctagccttagcagccaaagagtgttccctggattctgactactttaaataccctctgatggcactcggcgagctctgtgagaccaagttcgggaaaacccacccggtctgcaacttggtggcaagtttacgcttatggctgccaaaatccttgagtcccggatgcggacgcgagctgcagcggctcagctatctcggcgctttcttttcattcagtgtcttcgctgaagatgatgttaaagtggttgagaagtatttctccgggcctgcaattaccttggaaaacacaagggtggtgtcacaaagcctacagcattatcttgaacttggcaggcaggaactgtttaagatccttcactccattctccttaacggggagaccagggaggccgcactgtcttatatggccgcagtggtcaacgctaacatgaaaaaagcccagatgcagacagacgacagactggtaagtactgatggattcatgctgaacttcttatgggtactgcaacagctttccacgaaaataaagctggaaactgtggatcccacttacattttccatcccaggtgccgaataactttgcccaacgatgaaacccgagtgaatgctaccatggaggacgtcaacgattggctgaccgagctctatggtgaccagcctccgtttagcgaacccaaatttcctactgagtgttttttcctgactctgcacgcccaccatctgtccatcctaccgagctgccggcgttatatacgtagactgcgtgccataagggaacttaatcgaaccgtggaggatctgaagaacaatgaaagccaatggaaagattcgcctctggctactcgacatagggaaatgctgaagcgctgcaaaacacagctgaagaagttagtgaggtgtaaagcatgcgcggatgctggactgctggatgaatcgtttctgaggagatgtctcaatttttacggcctgctgattcaactgctgctaagaatccttgaccctgcttatccagatatcacattaccactcaattccgatgtaccaaaagtgttcgccgcactgccagagttttatgtggaggacgtggcagaattcctgttttttatagttcagtatagtccacaagctctgtatgagccatgtacacaagatattgtcatgtttctggtcgtaatgctatgtaatcagaactacataaggaacccttatctcgtggcaaagctcgtggaggtgatgttcatgaccaaccctgcggttcaaccgaggacccagaagttttttgagatgatcgagaaccatcccctgtcgactaaactactggtgccaagcctaatgaagttctatacagatgtcgagcatacaggtgctacttcggaattttatgataaattcaccattagataccacatcagcacgattttcaaaagcctgtggcaaaacatcgcccatcatggtacatttatggaagaattcaacagcggcaaacagtttgtgcgctatattaacatgttgataaatgacacaacctttctgcttgatgagtcattggaatccctcaagcgaattcacgaagtgcaggaagagatgaaaaacaaggagcagtgggaccagctgccacgggatcaacagcaggcccgacaaagccagcttgcacaagatgagagggtctctcgcagttacctggcactggcaactgaaacagtggacatgtttcacattttgacaaaacaggtgcagaaaccattccttcgcccagaactcggacccagactcgcggcaatgttaaattttaatctgcagcagctgtgcggtcctaaatgtagggacttaaaggtcgagaacccagagaagtatggttttgagccaaaaaagctattggaccaacttaccgacatttacctgcagttagactgcgccaggttcgccaaggcgatcgctgacgatcagcgcagctactccaaggagttgttcgaagaagtcatttctaaaatgcgtaaggctggcattaaatctactattgcgattgagaaatttaaactcttggccgaaaaagtggaagagattgtggcaaagaatgctcgtgcagagatagattactcagacgcccctgacgagttccgggacccactcatggatactctcatgaccgatccagttaggttaccatctggcactataatggatcggtcgattattttgcgccaccttctcaattccccaaccgacccttttaatcggcagaccctgacagaaagtatgttggagcccgtccctgaactaaaagagcagatacaagcctggatgagagagaaacaaaacagcgatcattag

SEQ ID NO: 246026 - DNA, 303 bp, Artificial Sequence
  Description of Artificial Sequence: Synthetic coding sequence
atggaagaactgagtgctgacgagataaggcgaaggcgactagcacgtctggcgggaggacagacctcccagcctactacaccccttaccagtcctcaacgggagaatccaccaggcccacccattgccgctagtgcccctgggcctagccagagtctgggcctcaacgtgcataatatgactcctgctactagtcctatcggggcttccggcctcggcatcatttcagatgataagatgatcaaaactgaatttggaagcgccgactttatgaaccttgttgacggctttaagatcaaatag

SEQ ID NO: 246027 - DNA, 3186 bp, Artificial Sequence
  Description of Artificial Sequence: Synthetic coding sequence
atgtcgcaggtcgatgtggactctggaattgagaacatggaagtggatgaaaatgaccgcagggagaagagatctctgtccgacaaggagcctagttccggccctgaggtgagtgaggaacaggcactgcagctcgtttgtaagattttccgagtcagctggaaggacagggatcgagacgttatttttctgagctctctgagtgcccagtttaaacaaaaccccaaagaggtgttttccgatttcaaggacctcatcggccagattctgatggaagtcctgatgatgagcacacagactcgggatgaaaaccctttcgcttccttaacagccacatcccagcctattgcagccgctgcacgcagccccgaccgtaacctgttgttaaatacgggatcaaatccaggaacaagcccaatgttctgctccgtggcctcatttggcgcatctagtctcagctccctgggagcatctggaggggctagcaactgggatagttattctgatcactttacgattgaaacctgcaaagaaacagatatgctgaactacttaattgaatgctttgacagagttggcatagaagaaaagaaagcacccaagatgtgtagccagcctgccgtgagtcagctactctccaatattcggtctcagtgcatctctcacactgctctagtactgcaaggaagtctgacgcagcctcgttccctgcagcagcctagcttcctggtgccgtatatgctgtgcagaaatctgccgtatggtttcattcaggagctggtccgaactacgcatcaggatgaggaggtgtttaaacagattttcattcctattcttcagggacttgccctggcagcaaaggaatgcagcctcgactctgactacttcaagtacccgttgatggcgctgggagagttgtgcgaaacaaagtttggcaaaacccacccagtctgcaacttggtcgcaagtctaaggctgtggctgcccaagagcctctctccgggttgtggcagggagctccagagactgtcctacctgggagctttttttagcttctccgtcttcgcggaagacgacgtaaaggtagtggagaaatactttagcggccctgccataactctcgagaacacaagagtggtcagccagagcctccaacattacctggagctgggcagacaggaattgtttaagattcttcactctatactcttgaatggagaaacaagagaagcagccctgagctacatggccgctgtagtgaacgcaaacatgaagaaagctcaaatgcagactgacgacaggctggtatctaccgatgggttcatgttgaactttttgtgggttctacaacagctgtctactaaaattaagctcgaaaccgtcgaccccacatacatttttcaccccaggtgccgcattaccctacctaatgacgagactcgggtaaacgccactatggaagacgtcaatgattggctaacagagttgtacggcgatcagcctccgttctctgagccaaagttcccaacagagtgtttcttcttaaccctccatgcacatcacctgagcatcctcccctcctgccgacgttatattcgtagactccgggctatcagggagcttaatcgaaccgtcgaagacttgaagaacaacgagtcccagtggaaagattctcctctggccacacgacatcgggagatgctgaaaagatgcaaaacgcagctgaaaaagctggtccgctgtaaggcatgcgccgatgcaggcctactagatgagtctttcctgcgcagatgtctgaatttttacgggctcctgattcagcttctgctccgcatcctcgacccggcataccctgatatcacactcccactaaattccgacgtgccaaaggtcttcgccgcactgcccgagttctacgttgaggacgtcgccgagttcctgtttttcatcgtccagtactctccccaggcgttatacgagccctgtacccaggatatagtcatgttcttagtggtcatgctgtgtaatcagaattacatccgtaatccgtacctggttgcaaagctcgtagaagttatgttcatgaccaatcccgcagtacagcctaggacccagaagttcttcgaaatgatcgaaaaccacccactgtctacgaagttgctggtgccatccctgatgaagttttataccgacgttgagcacaccggcgctacttccgaattttatgacaaatttaccatccgctatcatatctccaccatttttaagtccctatggcagaacatcgcccaccatggcacattcatggaagagttcaattctgggaagcagttcgttcgttacatcaatatgctgatcaacgacacgaccttcctgctcgacgaatcactcgaatctttgaaaagaatccatgaggtgcaagaggagatgaaaaacaaggagcagtgggaccagttgccaagggaccaacagcaggcgagacaatcccagttagcccaggacgaaagagtgtcaaggagttatctggcactagctacagaaaccgtggatatgttccatatcttgacaaagcaggtacagaagccctttttgaggcctgagctgggcccaaggcttgcagccatgctgaatttcaacctgcagcaactgtgcggccctaaatgccgcgatctcaaggttgaaaatcccgagaagtacgggtttgagcccaaaaagctgttggatcagcttactgacatctatttacaactggactgcgccagatttgctaaggccatagcggatgatcagcgcagctacagcaaggagctgttcgaagaggtgatcagcaagatgaggaaagcgggaatcaagtctaccatcgccatcgaaaagttcaagcttctggcagaaaaggtcgaagagattgtggcaaaaaatgctagggcagagattgactactccgatgcaccagacgagttcaggggaaagtggacacacccactgatggataccctgatgacagatcctgttcggctgccaagcggcaccattatggaccgcagcatcattctccgccacctgctcaactcccccacggatccattcaaccggcagaccttgaccgaaagcatgcttgagcctgtccctgagctgaaggagcagatacaggcctggatgcgtgaaaaacagaatagcgatcattag

SEQ ID NO: 246028 - DNA, 513 bp, Artificial Sequence
  Description of Artificial Sequence: Synthetic coding sequence
atgcccggtgaggtccaggcgagctacctcaagagccagagcaaactttcagacgaaggccgacttgagccacgcaaatttcattgcaagggcgtcaaggtccctagaaattttcgcctgcttgaagaactggaggaggggcaaaagggcgttggcgatgggacagtgagttgggggcttgaagatgatgaggatatgaccctgacgaggtggactgggatgatcatcgggccaccacgcacaatttacgagaacaggatatactctttgaaaattgagtgcgggcctaaatatccggaagctcctccgtttgttcgcttcgtaactaagatcaatatgaatggggttaactcttccaacggagtggtcgatcctagagcgatttcagtcctggcaaagtggcagaactcatactctatcaaagtcgtgttacaggagctccgaaggctgatgatgtccaaggaaaacatgaaactcccacagccgccagagggacaatgttacagtaactag

SEQ ID NO: 246029 - DNA, 312 bp, Artificial Sequence
  Description of Artificial Sequence: Synthetic coding sequence
atggagaaagggctcaataccaagaactttaccgagcaaaccatttacgagaaccgcatctatagcctcaaaattgagtgtggacccaagtaccccgaggcccctccctttgtcagatttgtgaccaagattaatatgaacggcgtaaattcctccaatggcgtggtggatccgagagccatttcggtgctggccaaatggcaaaactcctatagcatcaaggtagtgttgcaagagctaagacggttgatgatgagcaaggagaacatgaagctcccacagcccccagaggggcaatgttattctaactag

SEQ ID NO: 246030 - DNA, 444 bp, Artificial Sequence
  Description of Artificial Sequence: Synthetic coding sequence
atggctgcaacaaccggctccggagtgaaggtgcccagaaattttcggcttctggaagagttggaagaaggccagaagggcgtcggtgatggaactgttagttggggcttagaggatgacgaagatatgaccctaaccagatggacgggaatgattatcgggccaccacgaactatctacgaaaataggatttattctctcaagatcgaatgcgggcctaaatatccggaagctcctccttttgtgaggtttgtgaccaaaattaatatgaacggcgtgaacagctcaaacggggtcgtggacccaagagctatctctgtccttgccaagtggcaaaactcatacagcatcaaggtcgtgcttcaggagctacggaggctaatgatgagtaaagagaacatgaagctgcctcagccaccagagggtcagtgctactcgaattag

SEQ ID NO: 246031 - DNA, 513 bp, Artificial Sequence
  Description of Artificial Sequence: Synthetic coding sequence
atgccaggggaggtgcaagcctcctaccttaaatcccagtccaaattaagcgacgagggacgactcgagccccgtaagtttcactgcaagggtgtgaaggttccaagaaatttccggcttcttgaggaactggaggaagggcagaaaggcgttggagacggaactgtaagctggggattagaagatgatgaagacatgacactgaccagatggacaggaatgattattggaccaccccgaaccatttacgaaaatcgcatctactctctgaagatcgagtgtgggccaaaataccccgaggcaccgccatttgtgcgcttcgttactaaaattaacatgaatggtgttaatagcagcaacggggttgtcgatcctcgggcaatatcagtcctcgccaagtggcagaacagctattcaattaaggttgtgctgcaggagttacgaaggctgatgatgtcaaaagagaacatgaaactgcctcagcccccagaagggcaatgttattcaaattag

SEQ ID NO: 246032 - DNA, 312 bp, Artificial Sequence
  Description of Artificial Sequence: Synthetic coding sequence
atgaaggaagacctcaatctggaaaatttcactgctaagactatctacgagaaccgcatctactctctgaaaattgagtgtggacctaaataccccgaggctcctcctttcgtccggtttgtgactaagatcaatatgaatggggtgaattcaagtaatggtgtagtggacccgagagccatctcggttctggctaaatggcagaattcgtattcaattaaagtggtcctgcaagaattgcggaggcttatgatgtctaaggagaatatgaagcttcctcagcccccagaggggcaatgctattccaattag

SEQ ID NO: 246033 - DNA, 312 bp, Artificial Sequence
  Description of Artificial Sequence: Synthetic coding sequence
atgaaggaggatctcaatctggaaaactttaccgctaagacgatttatgaaaatcgcatatatagcctgaaaattgaatgcggaccaaaataccctgaggcccctcctttcgtgagatttgttaccaaaattaatatgaatggggtcaacagtagcaacggcgttgttgatcccagagcgatcagtgtactggccaaatggcagaactcctattcaatcaaagtggtgctgcaggagcttagaaggctgatgatgtccaaggaaaatatgaagctccctcagccccctgagggccagtgctacagcaattag

SEQ ID NO: 246034 - DNA, 318 bp, Artificial Sequence
  Description of Artificial Sequence: Synthetic coding sequence
atggccgcaaccactgggtccggagtaaaggtccccaggaacttccgcctccttgaagaactggaagagggacagaaaggggtgggtgatggcaccgtttcatggggattggaagacgacgaggacatgacacttacccgttggactggtatgattataggcccacccagggtggacccgagagctatcagtgtgttggcgaaatggcagaactcatacagtattaaagtggttttacaggagctccgacggctgatgatgagcaaagagaatatgaagctgccacagcccccagagggtcagtgttattctaattag

SEQ ID NO: 246035 - DNA, 369 bp, Artificial Sequence
  Description of Artificial Sequence: Synthetic coding sequence
atgtccactccagctcgcagacggctgatgcgcgattttaagaggctccaggaggatccgcctgccggagtgtcaggggctccgagcgaaaataatataatggtgtggaatgccgtgatattcggaccggaaggaacccccttcgaagatgtctacgccgatgggtccatttgtctcgacattctgcagaatagatggtcccctacatacgatgtgtcctctatactgacgtcgatccaaagcctccttgacgaaccaaaccccaatagccctgcaaattcacaagcagcacagctgtaccaggaaaataagcgagagtatgagaagcgcgtctcagcaatagtcgaacaaagctggagggactgctag

SEQ ID NO: 246036 - DNA, 459 bp, Artificial Sequence
  Description of Artificial Sequence: Synthetic coding sequence
atgtccacccccgctagacgccgactgatgcgagactttaagcgactccaggaggatccacctgctggtgtcagcggagcgcctagtgagaataacattatggtttggaatgcagtgatcttcggtcccgagggcacgccttttgaggacggcaccttcaaactgacgatcgaattcactgaggaatatcccaataagcccccaactgttcgctttgttagtaagatgtttcaccctaacgtctacgccgatggttcaatctgccttgacattctgcagaacaggtggagcccaacgtatgatgtgagcagcatcttgacaagtattcagtccctgcttgacgaacctaacccaaactcccccgcaaattcacaggccgctcaactataccaggaaaataaacgtgagtatgaaaagcgggtgagcgccatcgtagagcagagctggcgggattgttag

SEQ ID NO: 246037 - DNA, 234 bp, Artificial Sequence
  Description of Artificial Sequence: Synthetic coding sequence
atgtttcatccaaacgtttatgctgacggatcaatctgtctggatattctgcagaatagatggtcccctacgtatgacgtcagttcaatccttactagtatacaatctttgcttgatgaaccaaatcccaactcgccagctaattctcaggccgctcagttatatcaggaaaacaaacgagagtacgagaaacgcgttagcgccattgtggaacagagttggcgagactgctag

SEQ ID NO: 246038 - DNA, 459 bp, Artificial Sequence
  Description of Artificial Sequence: Synthetic coding sequence
atgtcgacacccgcacggagaagacttatgcgtgacttcaagcgacttcaggaggaccctcccgtcggggtgtccggggcaccgtcagagaacaatatcatgcagtggaatgcagtcattttcgggcctgagggtaccccttttgaggacgggacatttaagctcgtgattgaattctcagaggagtacccaaataagcctcccacagtaagattcctgagcaaaatgttccacccaaacgtctacgccgacggatcgatttgcctggatattctgcagaataggtggtcaccaacttacgacgtgtcttctatcctgaccagtatccaatctctgcttgacgagcccaacccaaatagtcctgctaattcacaggcagctcagctctatcaggagaacaaacgggaatacgagaaaagggtgtctgctatcgttgagcagagctggaacgacagttag

SEQ ID NO: 246039 - DNA, 153 bp, Artificial Sequence
  Description of Artificial Sequence: Synthetic coding sequence
atggcgagtcagaacagggaccccgctgcaacttcagtggccgcagctagaaagggcgctgaaccctccggtggggctgcccgaggcccagtggggaaaagactacagcaagaactgatgactctgatgaaccctacccttattgtgccatag

SEQ ID NO: 246040 - DNA, 486 bp, Artificial Sequence
  Description of Artificial Sequence: Synthetic coding sequence
atggcttctcagaatcgcgacccagcggcaacctctgtggcggctgcccgtaagggtgctgagcctagcggaggcgctgcgaggggcccagtcggaaagagactgcagcaggagcttatgaccctgatgatgagcggtgacaaggggatttccgccttccccgagtcagacaatctttttaagtgggtagggaccatccacggagctgccggtactgccgtcgggagtatcagaacgagcagcaccgtgtgcttgctgtccggccctcgcgaaactcaagatagctccaaacctctggtctggggcctaggctgggatatgagactgctcttagaacttactcttcagctttttctccagatgccagaaccgaatatcgattcacccctcaatacacatgccgcagaactctggaagaaccccactgccttcaaaaagtatctccaggagacctactccaaacaagtgactagccaggagccctag

SEQ ID NO: 246041 - DNA, 453 bp, Artificial Sequence
  Description of Artificial Sequence: Synthetic coding sequence
atggcctcacagaaccgtgaccccgcagctacgtcagtagcggctgctcggaaaggggctgaaccaagcggcggtgccgctagaggtccagtgggcaagcggctccagcaggagttaatgacactgatggtttacgaggatctgcggtacaagctgagcttggagttcccttcagggtatccgtacaacgctccaaccgtgaaattcctgacaccctgctatcatcccaacgttgacactcaaggaaacatctgcctggatattctgaaggagaagtggtcagcgctctatgacgtgcgtaccatactgctctccattcagtctctgctgggcgaaccaaatattgatagtccgctcaatacccatgccgctgaactttggaagaacccaaccgcctttaaaaagtatctccaagaaacatattcaaaacaggtaaccagccaggaaccttag

SEQ ID NO: 246042 - DNA, 540 bp, Artificial Sequence
  Description of Artificial Sequence: Synthetic coding sequence
atggccagtcaaaatcgcgaccccgctgccacgtctgttgcggctgccagaaagggggctgagcccagcggtggagccgctcggggaccagtgggaaagcgtctccagcaggaactgatgaccttaatgatgtcgggagataaggggatctccgcctttcctgagagcgataacctgtttaagtgggtgggcacgattcacggggcagcgggtacggtctatgaagatctgagatacaaactaagtctcgaattcccatccggctatccatacaacgcacctaccgtgaagttcctaacaccatgttaccaccccaacgtggacacacagggtaacatctgcctggatatcctcaaagagaagtggtccgccctgtacgacgtgagaacaatcttattgagtatacagagtctgcttggggaacctaatatcgattcgcccctgaatacccacgccgctgaactttggaagaatcccacagccttcaagaagtatctgcaagagacttactctaagcaggtgactagtcaggaaccgtag

SEQ ID NO: 246043 - DNA, 423 bp, Artificial Sequence
  Description of Artificial Sequence: Synthetic coding sequence
atgacccttatgatgagtggtgacaaagggatttctgctttcccagagtctgacaatcttttcaaatgggtaggcaccattcatggcgcagccggtaccgtctacgaagatctgagatataaattatccctcgagtttccctcaggctatccgtataatgccccaacagtcaagtttctcacgccatgctatcacccaaatgtagacactcagggcaacatctgtctcgatattctgaaagaaaaatggtctgctctgtacgatgtccgtacaatccttctgagtattcagtctctgcttggggaaccaaatatcgactcacctctgaatactcatgccgctgagttatggaagaatcccacagcttttaaaaaatatttgcaagaaacctactcaaaacaagtcaccagccaggaaccatag

SEQ ID NO: 246044 - DNA, 423 bp, Artificial Sequence
  Description of Artificial Sequence: Synthetic coding sequence
atgacgcttatgatgagtggagataaggggatctcggcttttccggagagtgataatctttttaagtgggtgggaactatccacggtgccgcaggcactgtgtacgaagaccttcggtacaaactgagcttggagtttccaagcggatacccgtacaatgcgcctacagttaaatttctcactccttgttaccacccaaacgttgacacccagggcaatatatgtctcgatattctaaaagagaaatggtcggctctttatgacgtgcgaaccattctgcttagcattcagagcttattaggcgagcccaacatcgactccccactcaacacgcacgctgccgagctgtggaagaatccgaccgcgttcaagaagtaccttcaagagacctatagtaagcaagtcacatcccaggaaccttag

SEQ ID NO: 246045 - DNA, 114 bp, Artificial Sequence
  Description of Artificial Sequence: Synthetic coding sequence
atggccgctagcgctgccgagaccagggtgtttctggaagtgcggggacagctccaatctgctctgctaatactcggcgacagagtgtcaccctattgcccatgttggtcttag

SEQ ID NO: 246046 - DNA, 1170 bp, Artificial Sequence
  Description of Artificial Sequence: Synthetic coding sequence
atggccgctagtgccgctgagacacgagtgttcctggaggtacggggtcagctacagtccgcattgctgatcctgggagagccaaaggagggcggaatgcccatgaatataagcataatgccgtctagcctacaaatgaagaccccggaagggtgcacagaaattcagctaccagctgaggtccggcttgttcctagttcctgtcgcggtctgcagttcgtcgtcggggacggcttgcacctgagattacagacacaggccaagctcggcacaaaactgatcagcatgttcaaccaatcctcccaaacccaggagtgttgcacgttctactgtcagagctgtggcgaagtgatcattaaagaccgaaaattactgcgcgtgcttccgctgccctctgaaaactggggcgcactagtgggagaatggtgttgccaccccgaccccttcgccaataagtctttgcaccctcaggaaaacgattgtttcattggagattcgttcttcttggtgaatttgagaacatccctctggcagcagcggccagaactgtcccctgtggaaatgtgctgtgtgtccagcgacaatcattgtaaactggaaccaaaggctaacaccaaggtaatttgcaaaagatgtaaggtgatgctgggtgaaaccgtttcatctgagacaactaaattttacatgacagaaatcatcatccagtcatccgagaggtcatttcccattattcccagaagctggtttgtgcagagcgtgatcgctcagtgccttgtgcagctgtcctcagccagatcaacgttccgctttactatccaggggcaagacgataaggtgtacattctgctctggctgctgaacagcgactcactggtaatcgagtcacttcgcaatagtaaatatattaaaaagttccccctcctagagaacacgtttaaagctgacagtagttcagcctggtcagcggtcaaggtactgtatcagccatgtataaagagcaggaacgagaaactggtgtccctgtgggagtctgacatttcagtccacccactgactctccccagtgcgacatgtctggaactgcttctgatactctcaaagtctaatgctaacctgccttcttccttgagaagagtgaattctttccaggtcgcttttctgaagatgtag

SEQ ID NO: 246047 - DNA, 444 bp, Artificial Sequence
  Description of Artificial Sequence: Synthetic coding sequence
atggccctcaaaaggatccagaaagagctgtccgatctgcagagggacccaccggcacactgcagcgccggaccagtgggcgatgatctttttcattggcaagctactatcatgggccctccagacagcgcttatcagggcggagtgttcttcctgacagtccactttccaacggattacccattcaaacccccaaagatcgcctttacaacgaaaatttaccatccgaacatcaactctaatggttctatctgccttgacatactccgcagccagtggagcccagccctgacagtttcaaaagtgctgctatcgatttgtagcttgttgtgcgacccaaacccggacgatcccctggtacctgacatcgcccagatctacaaatcagacaaggagaagtataatcggcacgcccgtgagtggacacaaaaatacgccatgtag

SEQ ID NO: 246048 - DNA, 606 bp, Artificial Sequence
  Description of Artificial Sequence: Synthetic coding sequence
atgagcactgaggcacagagagtcgatgattcaccttcgacatcagggggttccagcgacggggaccaacgagagtccgtgcaacaagagccagagcgggaacaggtccagccaaaaaaaaaagaaggcaagatttcctccaagaccgctgctaagctctctacttcggcaaagaggattcagaaggaactggctgagatcacattagatcccccaccaaattgttccgccggtccaaagggggacaatatatacgaatggagatccacaattttaggtcctcccggatccgtgtatgagggcggtgtgttttttctagatatcacatttagccccgactacccgttcaagccgcctaaggtgaccttcaggactagaatctatcactgcaacatcaatagtcagggagtgatctgcctcgatatactcaaagataactggtcacctgcactcacgatctctaaggtgctgctttccatatgctccctgctgaccgattgcaacccggctgatcctttggtcgggagcattgctactcaatatatgacgaatcgagcagagcacgatcggatggcacggcagtggaccaaacgctatgccacgtag

SEQ ID NO: 246049 - DNA, 606 bp, Artificial Sequence
  Description of Artificial Sequence: Synthetic coding sequence
atgtcaacggaggcccagcgtgtagatgactctccttccacaagcggaggcagctccgatggagatcaaagagagtccgtgcaacaggagcctgagcgtgaacaggtccagccaaagaagaaggagggaaagatctcttccaaaactgccgcaaaactgtctactagcgctaagcggatccaaaaggaactggctgaaataacgctggaccctccccctaactgcagcgccggaccaaaaggcgataatatctatgaatggagaagtaccattctcgggcctcctggatctgtatacgaaggaggggtcttcttccttgacatcacctttagccccgactaccccttcaagcccccaaaggtgacgtttagaactagaatctatcattgcaacataaacagtcagggagtgatttgcctcgacatactgaaggataattggtcccccgctctgaccatcagtaaggtgctgctctcaatatgttcattgctgacagactgcaaccctgccgaccccctggttggcagcatcgcaacacagtacatgaccaacagggctgagcacgaccgaatggctcggcagtggactaaacgatatgccacctag

SEQ ID NO: 246050 - DNA, 624 bp, Artificial Sequence
  Description of Artificial Sequence: Synthetic coding sequence
atgagcagcgaccgccaacgctccgacgatgagagcccatccaccagttcggggtccagcgacgcagaccaaagagaccctgccgctcctgagcccgaagaacaggaggaaagaaagccctccgcgactcagcagaagaagaacacaaagctgagctccaagaccactgcaaagctctctacttctgccaagagaatccagaaggaacttgccgagatcacgctcgacccccctccgaactgcagcgccggaccaaagggtgacaatatttacgagtggagatccactattctgggtccgcctggcagcgtctacgagggaggagttttcttcctagacatcactttttcttccgattaccccttcaaacctcccaaggtcaccttccggacacgcatttaccactgcaacattaactcgcaaggcgtgatctgtcttgatatcttgaaagacaactggtcaccagccttgacgatttccaaagtcctgctctcgatctgttctctgctgactgactgcaatcctgccgaccccttagtgggctccatagccacccagtatctgaccaatcgggctgagcatgatcggattgcaaggcaatggactaagcgctatgcaacgtag

SEQ ID NO: 246051 - DNA, 624 bp, Artificial Sequence
  Description of Artificial Sequence: Synthetic coding sequence
atgagctcagatcggcagcgatctgatgatgagagcccttctacctcttcagggtcctcagacgcggatcaaagagacccagccgctcccgaacctgaagaacaggaggaaagaaagcccagcgccacacagcagaaaaaaaacactaaattatcttctaagacaacagccaagctctcaacctcggccaaaagaattcaaaaagaattggcagaaatcaccctggaccctcctcccaattgctccgctggccctaaaggcgacaatatctacgaatggagatccactatattgggcccaccgggatcagtgtacgaggggggagttttttttctggacatcacattcagctctgattaccccttcaaaccccctaaggtcacgttccggactcggatataccattgcaacatcaattcacaaggcgtgatttgcctcgacattctgaaggacaactggtccccagctcttaccatttcaaaagttcttttgtctatctgtagcctactgacagactgtaaccccgctgatccactggtcggctctatcgctactcagtatctgacgaatcgggcagaacacgatcgaatcgcaagacagtggaccaaaaggtatgctacatag

SEQ ID NO: 246052 - DNA, 624 bp, Artificial Sequence
  Description of Artificial Sequence: Synthetic coding sequence
atgagcagcgataggcagcggtccgatgatgagtcccctagcacctcttctggctcctctgacgccgaccagagagaccctgctgcgcctgagccagaggaacaggaggagcgcaagccatccgccacacagcaaaaaaagaataccaaattaagtagcaaaaccaccgctaaactgtccacatcagctaagcggattcagaaagaactcgcagaaatcactctggatcctccacccaactgctctgcaggcccaaaaggcgacaacatctatgagtggaggagcaccattcttggaccacccggaagtgtctacgaggggggagttttttttcttgacattaccttcagctccgactatccattcaagccccctaaagtcacttttcgaacaaggatctaccactgcaacattaatagtcaaggcgttatttgcctcgacatactcaaggacaactggtcgcccgcattgacaatttcaaaagtccttctttccatctgctctctgctcacggactgtaatcccgcagatccgctcgtgggatccatcgctacacagtacttgaccaaccgggctgaacacgacaggattgctaggcagtggactaagagatacgctacgtag

SEQ ID NO: 246053 - DNA, 624 bp, Artificial Sequence
  Description of Artificial Sequence: Synthetic coding sequence
atgtcttctgaccggcagaggtccgatgacgagtcaccaagcactagcagcgggtcatctgatgcggatcaaagagatcctgctgccccagaaccggaggaacaggaagaacgtaagccatccgccacccaacaaaaaaaaaataccaagctcagcagtaagaccacagccaagctgagtaccagcgccaagcgcatccagaaggaattggcggaaatcactttagacccaccgccaaattgtagtgcgggacctaagggagataatatctacgagtggcgttctaccattttaggcccaccagggtctgtgtatgagggtggggtctttttcttagacatcaccttttcctccgactatcccttcaagccgcctaaagtgacattcagaacacgaatctaccactgcaacattaattctcaaggggtaatatgccttgatatcctgaaagataattggagtcccgcactcacaataagtaaagtgcttttgtctatctgttctctgcttaccgattgcaatcccgcagaccctttggttggatctatcgcaactcaatacctgaccaaccgggctgagcacgacagaatagctaggcaatggacaaaacgttacgccacttag

SEQ ID NO: 246054 - DNA, 528 bp, Artificial Sequence
  Description of Artificial Sequence: Synthetic coding sequence
atgagttctgatagacagaggagcgatgatgagagcccttcaacatcgtccgggagctccgatgccgatcagagggaccccgcagctcctgagcccgaggaacaggaagaacgcaaaccatccgcaacacagcagaagaagaatactaagctctcaagcaaaactactgcgaagttgtccacgtctgctaaaaggatccagaaagagttggccgaaatcactttggaccctcctccaaattgtagcgccggtcctaagggggacaatatttacgagtggcggtccaccatcctgggaccaccgggatcggtctatgagggtggtgtcttctttctcgacattacattctcttcggattatccctttaagcctcctaaggtaacttttcggactagaatttatcactgtaacatcaactcgcaaggtgttatttgtctcgatatcctgaaggacaattggtcccctgcgctaaccattagcaaggtactgctcagcatctgcagcctgctgacagattgtaatccttag

SEQ ID NO: 246055 - DNA, 528 bp, Artificial Sequence
  Description of Artificial Sequence: Synthetic coding sequence
atgagcagtgaccgtcagaggtctgatgacgagagtccctctaccagctctgggtcatccgatgctgaccagcgagacccggcagcccctgagccagaagagcaggaagagagaaagccaagcgctacccagcaaaagaagaacacaaagctgtctagtaagacgactgccaagctcagcacatcagcaaaacgaatacagaaggaactcgctgagatcactctcgatccccctccaaactgctccgccggtcctaagggggataatatttatgagtggcgcagcacaatcttgggccctcccggatctgtgtatgagggaggtgtgttcttcctggacatcacattttctagtgactacccattcaaaccaccaaaggtgacattccgaaccaggatttatcactgtaacatcaacagccaaggagtgatctgtttggacatcctaaaagacaactggtctcctgctcttactatctcaaaagtcctcctgtctatttgttccctgttgaccgactgcaacccctag

SEQ ID NO: 246056 - DNA, 528 bp, Artificial Sequence
  Description of Artificial Sequence: Synthetic coding sequence
atgagttctgatcgacagcggtccgatgatgagagcccaagcacaagttctgggagcagcgatgctgaccaaagagacccggcagccccagagccagaagagcaggaggaacgtaaaccatctgcaacacagcagaagaagaataccaaactgagttccaaaaccactgctaagttgagcacgtccgcaaagcggatccagaaggaactggccgagattacgctcgatccaccacctaactgttcggctgggccaaaaggagataatatatatgagtggagatcaactatcctgggacctcccggaagcgtctacgaaggcggagttttctttctcgacatcactttctcctccgactatccatttaagccgccaaaggtaacgtttagaacacgcatctatcattgtaatataaactcccagggagtgatttgtcttgatattctgaaagacaattggtccccagcccttacgattagcaaggttctgttgtccatctgtagcctgttgactgattgcaacccttag

SEQ ID NO: 246057 - DNA, 414 bp, Artificial Sequence
  Description of Artificial Sequence: Synthetic coding sequence
atgaatgaagagaattttttcgagtgggaggcgctgataatgggcccagaagacacatgcttcgaattcggcgtcttcccggcaatcctaagttttccactcgattaccccttgtctccacccaaaatgcgcttcacatgtgagatgttccaccccaacatttacccagatggtagggtatgcatctctatcctgcacgcccctggagacgatcctatgggatacgagagctctgctgagaggtggtctccagtgcagtccgtggagaagatcctgcttagtgtggtgtcaatgcttgcggagccaaatgacgaatccggagcaaacgtggacgcctccaagatgtggcgcgatgacagggagcagttctacaaaatcgcgaaacaaatcgtccagaagtctctgggtctttag

SEQ ID NO: 246058 - DNA, 498 bp, Artificial Sequence
  Description of Artificial Sequence: Synthetic coding sequence
atggcgggaaccgccctcaaaaggctaatggccgagtacaagcagctcacactgaatcctcccgaaggaattgttgctgggcctatgaatgaagagaacttttttgaatgggaagccctcattatgggtcctgaggatacttgcttcgagtttggggtgtttcccgctatactgtcattcccactggactatcccctgtcccccccaaaaatgcgattcacctgtgaaatgttccatcctaatatctaccctgatggacgggtctgtatctccattctgcatgcacctggggatgatccaatgggttacgagtcatctgcagagaggtggtctccagtacaatctgtggaaaaaattctactgagtgtggtctcgatgttggcagagccaaatgatgagagcggcgctaatgtggatgccagcaagatgtggcgggatgaccgagagcagttctacaaaatagccaagcagatcgtgcagaagtctctgggactgtag

SEQ ID NO: 246059 - DNA, 552 bp, Artificial Sequence
  Description of Artificial Sequence: Synthetic coding sequence
atgagttctccctcacctggcaaacgtcggatggacacggacgtggtcaagctaatagaaagcaaacacgaggtgactattctgggcggactgaacgaatttgtggtgaagttttatggcccacaaggcacaccctacgaggggggagtttggaaggtccgcgtggatctcccagacaagtatccctttaaaagcccctccattgggtttatgaataaaatcttccacccgaacattgatgaggcaagcggtacagtctgcttggatgtgattaatcagacatggacagcactctacgatttgacaaacatattcgaaagctttctccctcagcttttggcttatccaaaccctatcgatccgctcaacggggatgcagctgccatgtacttgcatcgtcccgaagagtacaaacagaagatcaaggagtacatacagaagtacgcaacggaggaggcactgaaggagcaggaggagggcaccggtgattcgagctcagagagtagcatgtcagatttttctgaggatgaggcccaagacatggaactctag

SEQ ID NO: 246060 - DNA, 459 bp, Artificial Sequence
  Description of Artificial Sequence: Synthetic coding sequence
atgagctcaccctcccccggtaagcgaaggatggacactgatgtcgtaaagttaatcgagtcaaaacatgaggtcactatactcgggggactgaatgagttcgtggtgaagttctatggtcctcagggcacaccgtacgaagggggagtgtggaaggtgcgcgtggatctgccagataagtatcctttcaagtctcccagtatagaccttacaaacatcttcgagtcttttctgccccaattgctcgcgtatccaaatcctattgatccattgaatggagacgctgctgccatgtacctacatagaccagaggaatataagcagaagatcaaggagtacatccagaagtacgctacagaagaggcactcaaggaacaagaggaaggaaccggcgactcctccagcgagagtagcatgtcagacttctccgaggacgaagcacaggacatggaactgtag

SEQ ID NO: 246061 - DNA, 477 bp, Artificial Sequence
  Description of Artificial Sequence: Synthetic coding sequence
atgtcgggtatcgcactctctcgcctggctcaggaaagaaaggcctggcggaaggaccacccattcggattcgtcgccgttccgaccaagaatccggacggcacgatgaacttaatgaactgggaatgtgccatccctggaaagaaagggacaccgtgggaggggggattgtttaagctgcggatgttgttcaaagacgactacccaagcagccctcccaagtgtaagtttgaacctcctctgttccatcctaatgtctaccctagcgggaccgtgtgtctttccattttggaagaagataaggattggcgtccagccattacgattaagcagatcttacttggcatccaggaacttctgaatgagccaaacatccaggatcccgcacaggccgaagcttatactatttactgtcagaaccgagtcgagtacgaaaagagagtccgggctcaggcaaagaagttcgcgcctagctag

SEQ ID NO: 246062 - DNA, 477 bp, Artificial Sequence
  Description of Artificial Sequence: Synthetic coding sequence
atgtctggaattgcattgtctcggttggctcaggagcgtaaagcctggcgcaaggatcatcccttcggattcgtggctgtccccactaagaatcccgacggcacaatgaacttgatgaactgggaatgtgccatccctggaaagaaaggcacgccatgggaagggggtttgtttaaactgaggatgctgttcaaggacgattatcctagcagccctcccaagtgcaagtttgagccccctttgtttcacccgaacgtatacccctccggcacggtgtgcctcagcatcttagaggaagacaaagactggcgtcctgcaattaccataaagcaaatcctgcttggtatccaggagcttttgaatgagcccaacatccaagatcccgcacaggcggaggcgtatactatttactgccagaaccgtgtggaatacgagaaacgcgtgagggcccaggcgaaaaagtttgccccaagttag

SEQ ID NO: 246063 - DNA, 477 bp, Artificial Sequence
  Description of Artificial Sequence: Synthetic coding sequence
atgtccgggatcgctctgtccagactggcgcaggaacgaaaggcctggcggaaagatcatcccttcggttttgtggctgtgccaacaaagaatcccgatggcacaatgaatctaatgaattgggagtgtgctattccagggaaaaagggaaccccatgggaagggggactgtttaaactgcgtatgctgttcaaagacgattatcctagctccccgccaaagtgcaagttcgaacctccgttgtttcacccgaatgtgtatccttctggcaccgtatgtttaagcatcctcgaggaagataaggattggcggcctgctatcacgataaagcagattctgctgggaatccaggagttactgaatgagccaaatatacaggatcctgcccaggcagaggcatatacgatctattgtcagaacagagtagagtatgaaaaaagagtgagagcccaggccaaaaaatttgcgccttcctag

SEQ ID NO: 246064 - DNA, 477 bp, Artificial Sequence
  Description of Artificial Sequence: Synthetic coding sequence
atgtccggcatcgcactgtcgcgactggcccaggagagaaaggcgtggcgtaaagaccacccctttggctttgtcgccgtgccgactaagaatcctgatggcactatgaatttgatgaactgggagtgtgccattcctggcaaaaagggcaccccctgggaggggggactttttaaattgagaatgctttttaaggacgattacccttcttcacctccaaaatgcaagtttgagcctcctttgtttcaccccaatgtgtatccaagcggaaccgtgtgtctgtcgattcttgaggaggacaaagactggcggccagccatcaccatcaaacagatcttactcggcatccaagaactgctcaacgagcccaacattcaggaccccgctcaggccgaagcgtacaccatctactgtcagaaccgtgtggagtacgagaagcgagtcagggcacaagctaagaagtttgctccgtcgtag

SEQ ID NO: 246065 - DNA, 477 bp, Artificial Sequence
  Description of Artificial Sequence: Synthetic coding sequence
atgtctggcatagccctttctcggctagcccaggaaagaaaagcctggcgtaaagatcaccctttcgggttcgtggccgtgcctaccaagaacccagacggcacaatgaaccttatgaattgggagtgtgccattccaggcaagaaagggacaccatgggagggtgggctgtttaaactgagaatgttatttaaggacgactaccctagctcaccccctaaatgtaagttcgagcccccactcttccaccctaacgtctatccaagtggtacagtctgcctctctatccttgaggaagacaaggattggcggccagccattactatcaagcaaatcctgttagggattcaggagctgctaaacgaacctaacattcaggacccagctcaggcagaagcctacactatctactgtcagaaccgagtagagtacgaaaaacgggtgcgtgctcaggcaaaaaaattcgcacctagctag

SEQ ID NO: 246066 - DNA, 477 bp, Artificial Sequence
  Description of Artificial Sequence: Synthetic coding sequence
atgtcgggcattgcactaagcagattggcccaagagagaaaggcttggcgcaaagatcaccccttcggcttcgtggcggtgccgacaaaaaacccggacggaaccatgaacctgatgaattgggagtgcgccatcccaggcaagaagggcaccccgtgggaagggggtctgttcaaactgcgcatgttgtttaaggatgactacccttcctcaccccctaagtgtaagtttgagcctcccctgttccatccaaatgtttatccttccgggactgtatgcctttctatcctggaggaagacaaggactggcggccagccattactattaaacagattctactagggattcaggagctgttgaatgagcccaatatacaagaccccgctcaagccgaagcttacaccatttactgtcagaatcgggtggagtacgagaagagggtgcgcgctcaggccaagaagttcgctccctcttag

SEQ ID NO: 246067 - DNA, 465 bp, Artificial Sequence
  Description of Artificial Sequence: Synthetic coding sequence
atggcggcatcccggaggctgatgaaggagctcgaggagattcgcaagtgcggcatgaagaatttccgcaacatccaggtggatgaggctaacctgttgacttggcagggcctgattgtccctgacaacccaccttatgacaagggggcatttcgtattgaaattaactttcccgctgagtatcccttcaaaccgcctaaaattacctttaaaacgaagatctatcatcccaacattgacgaaaagggacaagtgtgcctgcccgtgatcagcgccgagaattggaagcccgctacaaaaaccgaccaggtgattcaatcccttatagccctggttaacgatcctcaaccagagcatcccttgagggccgacctggccgaagagtattcaaaggaccgaaagaagttctgcaaaaacgccgaagaattcaccaagaaatacggggaaaagagacccgtggattag

SEQ ID NO: 246068 - DNA, 639 bp, Artificial Sequence
  Description of Artificial Sequence: Synthetic coding sequence
atgcaggtggctgccggaactcggggagatacgcggttgcaggaggtcgccctgctgcctcagctgttcgatctcctggttctgggccaaaggagggccagactcctccgccaggtccccagcgcgctggcgggtaaagatctggctcaattacaggctggagctaccctcgccggatatagacgcgctcacggcccagaggaattggaggagatcaggaaatgtggaatgaaaaacttccgaaacattcaggtggacgaagccaatctcctgacatggcagggtctcatagtgccagataacccgccatatgacaagggagcattcaggatcgagattaacttccctgccgagtatccatttaagcctcctaaaatcaccttcaaaactaaaatctatcaccctaacatagatgagaaaggccaggtatgtttgcccgtgatttcggctgaaaattggaagccagctactaaaactgaccaggtcattcagtctctgatcgctcttgttaatgatccccagcccgaacatccgctacgagctgaccttgccgaggagtacagcaaggacaggaaaaaattctgtaagaatgccgaggaatttaccaagaaatatggggagaagagacccgtggactag

SEQ ID NO: 246069 - DNA, 369 bp, Artificial Sequence
  Description of Artificial Sequence: Synthetic coding sequence
atggcagcctcacgcagactgatgaaagataacccaccttatgataaaggggctttcagaatcgaaatcaattttccagccgaatatccatttaagcccccaaagatcacattcaagacaaagatctatcaccctaacatcgacgagaagggacaggtttgtctgccagttatatctgccgaaaactggaagccagcgacgaagacggaccaggttatccagtccctgatcgcactagttaacgacccacagcctgaacatccactgagggccgatctagcagaggaatactccaaagaccgcaagaaattctgcaaaaacgctgaggaattcacaaaaaagtacggagaaaagcgtccagtagactag

SEQ ID NO: 246070 - DNA, 462 bp, Artificial Sequence
  Description of Artificial Sequence: Synthetic coding sequence
atgatggcatctatgagagtcgtcaaagaacttgaagatttacaaaagaagcctcccccatacttaaggaacttgtcttccgacgacgccaatgtgctcgtgtggcacgctttacttttgcccgatcagcccccttaccatctgaaggcctttaacctacgcatctcatttcctcccgaatacccttttaagccacctatgataaaattcaccactaagatctaccaccctaatgtcgacgaaaacgggcagatatgcctgcctatcatctcaagcgagaattggaaaccctgtaccaagacctgccaagttttggaagctttgaacgtgctcgtgaacaggcctaatatccgcgagcctctacgcatggaccttgctgaccttctcacacagaatcctgagttgtttcgtaagaatgccgaagaattcacactccggtttggggtggatagacccagctag

SEQ ID NO: 246071 - DNA, 264 bp, Artificial Sequence
  Description of Artificial Sequence: Synthetic coding sequence
atgattaagttcacaacgaaaatttaccatcctaacgtggacgaaaatggacagatctgtttgcctattatttcaagtgaaaactggaaaccctgcaccaagacatgtcaggtgctggaagccttaaacgtgctcgtaaacagaccgaacatcagagaaccactgaggatggacctcgcggacttactcactcagaacccagagctgtttcggaaaaacgccgaagaattcacgctgagattcggagttgacaggccctcctag

SEQ ID NO: 246072 - DNA, 198 bp, Artificial Sequence
  Description of Artificial Sequence: Synthetic coding sequence
atgatcaagtttactacgaagatctaccaccccaacgtggatgagaacgggcagatttgcttgcccatcatcagctcagaaaattggaagccatgcaccaagacatgccaggtactggaggccctcaatgtcctggttaatcgtcccaatataagggagcccctgagaatggacctcgcagatctgttgactcagtag

SEQ ID NO: 246073 - DNA, 1128 bp, Artificial Sequence
  Description of Artificial Sequence: Synthetic coding sequence
atgtctgtttctgggttaaaggcagagttaaagtttctcgcatcaattttcgacaaaaaccacgagcggttcagaattgtgagctggaagctggacgaattacattgccaattccttgtgccacagcagggatccccacactccctacccccaccgttgacgctccattgcaatatcactgagagctacccttcaagcagccctatctggtttgtagattctgaggaccctaatctcaccagcgtcctggagaggctggaggacactaagaataataatttattgcgacagcagttaaagtggctcatttgtgagctgtgttctctgtacaatctgccgaagcatctcgacgtagagatgcttgaccagccgctacctaccggtcagaacgggaccacagaggaggtgacatccgaagaagaagaagaagaagaggagatggccgaagacatagaggacttagatcattacgaaatgaaggaggaggagcctatcagtggaaagaagagtgaagacgaggggatcgagaaggaaaacctcgcaattctcgagaaaattcgtaagacccaacgccaagaccacctgaatggcgcagtgagtggttccgtgcaggcttccgataggttaatgaaggagctgcgagacatttaccgctcacagtcatataagaccggaatctattcagtagaactcattaatgattcactctacgactggcatgtaaagctgcaaaaggtggacccagatagtcctctccattcagacctgcagatcttaaaggaaaaggaaggtatagaatatatcctccttaacttcagcttcaaggataatttcccctttgaccccccttttgtccgcgtggtgctcccagttctgtccggagggtatgtcctagggggaggagctctgtgtatggaattactgactaagcaaggctggagctcagcatacagtatcgagagcgttattatgcaaatcaacgccaccctggttaagggtaaagccagagtgcagttcggggctaacaagaatcaatacaacctcgctagggcacaacaaagttataactcgattgtccagatccacgagaaaaatgggtggtacactcctcctaaggaggatggttag

SEQ ID NO: 246074 - DNA, 945 bp, Artificial Sequence
  Description of Artificial Sequence: Synthetic coding sequence
atgtcagtctccggtctgaaggccgagctgaagttcctggcctcaatctttgataagaaccacgaaaggtttcgaatagtcagctggaaacttgatgagttacattgccagtttcttgtgccacagcaggggtctccacacagcttgcctccacctctcacactccattgcaacattactgaatcttaccctagttcctcgcccatctggtttgtcgattccgaggatcccaacctcactagcgtcctggagagactggaggacacaaagaacaacaatctgctgaggcagcagctgaagtggctgatatgcgaactttgctccctgtacaatctgccaaagcaccttgacgtggagatgctggaccagcctctcccaactggccagaacggaaccaccgaggaggtcacctcggaggaggaggaggaagaagaagagatggcagaagatattgaagacctggaccactatgagatgaaagaagaagaaccaatcagtggcaaaaagagcgaggatgagggaatcgaaaaagaaaacctggccattctcgagaaaatacggaagactcagcgccaggatcatttaaatggggctgttagcggctccgtgcaggcgagcgatcgactgatgaaggagctgcgcgatatctatcgcagccaatcatacaaaactgggatatattccgtggaactgattaatgatagtctgtatgattggcatgttaagctacaaaaagtggaccccgactcccctcttcactccgatcttcagatcctgaaagagaaggagggaatcgaatacatcctgttgaatttctccttcaaggacaacttcccatttgatccccctttcgtgcgagtcgttctgcctgtgctctctggcggactagtccacccctcgaagggcagatggctcaacgtcctgaccgtcgtgtgtctggactag

SEQ ID NO: 246075 - DNA, 1080 bp, Artificial Sequence
  Description of Artificial Sequence: Synthetic coding sequence
atgcgtatggactccctaacagaagaaaaactggaatgccggctttggtgctgtctatctgatccatcccctcccggactggccgctcgctgctgcgtcctggaacgatcaatcgtgccctcattaaggcaggagtcctacccctcttcaagcccgatctggtttgtggactctgaggacccaaatctaaccagcgtgctcgaacgtctggaggataccaagaataacaatctgctgcgacagcaactgaaatggttgatttgcgaactgtgttctctgtacaatttgcccaagcatcttgacgtcgaaatgctggatcagcccttgcccacgggacagaacggcaccaccgaggaagtgacgtcagaggaggaggaggaggaagaggaaatggctgaagacattgaggatctggaccattatgaaatgaaggaggaagagcccatctcaggaaagaagtccgaggacgaaggaattgaaaaggagaatctggctatactggaaaagattaggaagacacaacggcaggaccaccttaatggtgccgtgagtgggagcgtgcaggctagcgatcgcttgatgaaagagctcagggacatttatcgttcacagtcctataaaaccggtatctacagcgtggagcttatcaacgacagcctttacgattggcatgtaaagttacagaaagttgacccagacagtcctctccatagtgatcttcagattctgaaggaaaaggaagggattgagtatattctgcttaacttctctttcaaggacaattttccgttcgatcctccctttgtccgggtcgtgctccctgtactctcagggggatatgtattgggtgggggagccttgtgcatggagctgcttactaagcaggggtggtctagtgcctatagtatcgagtccgtgatcatgcagatcaacgcgactctggtaaaggggaaggcccgagtgcagttcggagctaacaagaaccagtataatctggctcgagcccagcagagctacaactccatcgttcagattcatgagaagaatgggtggtatacacccccaaaagaagatggatag

SEQ ID NO: 246076 - DNA, 1080 bp, Artificial Sequence
  Description of Artificial Sequence: Synthetic coding sequence
atgaggatggattccctgaccgaagaaaagttggagtgccgtttatggtgctgtttgtctgatccgtcgccccctggcttagctgctcggtgctgtgtgctggagcgctcgattgtgccgtctctcagacaggaatcctatccgtcatccagccctatttggttcgtagactctgaggatcccaatctgacatccgtcctggaaagattagaggacacaaagaacaataatctgttaaggcagcaactgaagtggctgatatgcgaactctgtagcctgtacaaccttcccaagcatcttgacgtcgaaatgttggatcaacccctgccgacagggcagaacggaactaccgaggaggtcactagtgaggaagaagaggaagaggaggaaatggccgaggatatcgaggatttagatcattacgagatgaaagaggaagaacctataagtgggaagaagtccgaggacgaggggatcgaaaaggagaatttggccattctggaaaagatccgtaagacacagaggcaagatcacctgaatggcgcagtgtccgggtccgtgcaagcttcagataggctgatgaaggagttaagagacatctaccgctctcagtcctacaagaccggaatctactcagtagagcttatcaatgactctctgtacgattggcatgtgaaactgcagaaggtcgatcccgatagccctctgcactccgatctgcaaatattgaaagagaaggaagggatcgaatacattttacttaactttagtttcaaagacaatttcccctttgaccctcctttcgttagggttgtcctgccggtgctgtccggtggatacgtgctggggggaggggcactgtgcatggaattacttaccaaacagggctggagcagcgcctattcaatcgaatctgtgattatgcagatcaatgcaaccctggtcaagggcaaggctagagttcagtttggcgctaacaagaaccagtacaaccttgccagggcccaacagagctataatagcatagtgcagatccatgagaaaaacgggtggtatactcctcccaaggaagacggctag

SEQ ID NO: 246077 - DNA, 717 bp, Artificial Sequence
  Description of Artificial Sequence: Synthetic coding sequence
atggcacagcaacagatgaccagctctcagaaggcgcttatgctagagcttaagtcactccaggaagagccagtggaaggcttcagaattaccctggtggatgagtctgacttgtataactgggaggtggccatcttcgggccacccaataccctgtatgagggcggttattttaaggcccacattaagtttcccatcgattacccttatagcccccctacctttagattcttgacaaagatgtggcaccctaatatctatgaaaatggcgacgtgtgtattagcatcttacacccccctgtcgatgacccccaaagcggggagttgccttcagagcgttggaatccaacccagaatgtgaggactatcctcttgtctgtgattagcttactgaatgaacccaacactttcagtcccgcaaatgtggatgcgtcagtcatgttccgaaagtggcgagattcaaaggggaaagataaggagtatgctgaaatcatcaggaagcaggtctctgcaacaaaagccgaagccgagaaggacggagtgaaggtgccaactacactggctgaatactgtatcaagacaaaagtgcctagcaatgacaatagcagtgacctgctgtacgacgatctgtatgacgacgatatcgacgacgaagatgaagaggaggaagacgccgactgttatgatgatgatgatagtgggaacgaagaatcctag

SEQ ID NO: 246078 - DNA, 669 bp, Artificial Sequence
  Description of Artificial Sequence: Synthetic coding sequence
atgaattctaatgttgagaatttaccccctcacatcattcgtctggtgtataaggaagtgacaactcttaccgccgacccacctgacggaattaaggtgttccccaatgaagaagatttaaccgatttgcaagtgaccattgaaggccctgaagggactccatatgccggtggtctttttagaatgaaacttctgcttggcaaggatttccccgcaagcccaccaaagggttatttcttgacaaaaatttttcatcccaacgtaggagccaatggagagatatgtgtgaatgtgctcaagagggactggacggcggaactcgggattagacacgtgctgttgaccatcaaatgtctgctgattcaccccaatcctgaatccgctctgaatgaggaagccggtcggctgctcctggagaattacgaggagtatgctgctcgtgccaggctgctgaccgagatccacggcggagcaggcggtccatctggtagggccgaagcagggcgagctttggcctcaggaacggaggcaagttccacagacccaggcgctcccggtggacctggaggtgctgagggacctatggctaagaagcatgcaggagagcgcgataagaagttggcagcaaagaagaagaccgacaagaagcgcgctttaaggcgtctgtag

SEQ ID NO: 246079 - DNA, 594 bp, Artificial Sequence
  Description of Artificial Sequence: Synthetic coding sequence
atgcagagggcttccaggctcaagagagagctgcacatgctagctaccgagccacctcctggcattacttgttggcaagacaaggaccagatggacgatttgagagcgcagatcttgggaggagcaaacactccttatgagaagggcgtgttcaagcttgaggtgattattccagaaagatatccctttgagcctccccaaataagattcctgacgcccatttaccatccaaacatagattccgctgggcgaatttgcctggatgtcctgaaattgcctcctaaaggggcatggaggccctccctgaatatcgccacagtcctgactagcatccagctactgatgagcgagccaaatcctgatgacccactgatggctgacatctcatccgagttcaaatacaacaaaccagcattccttaagaacgcacgccaatggacggagaagcacgcgcgtcagaagcagaaggccgacgaggaggaaatgctggataacctgcctgaggctggggactcccgcgtacacaactccacccagaagagaaaagccagccaactcgtcggaattgaaaaaaagttccaccctgacgtgtag

SEQ ID NO: 246080 - DNA, 489 bp, Artificial Sequence
  Description of Artificial Sequence: Synthetic coding sequence
atggcatcaatgcagaccaccggtagaagagtggaggtttggtttcccaagcgtctgcagaaggagctccttgcactccagaatgacccaccccctggaatgactttaaacgaaaaatctgtacagaactccatcacccagtggatcgtggacatggagggcgcacccggaacactctacgagggtgagaaattccagctgctgttcaaattttcttcacgttatcctttcgatagcccccaggtgatgttcaccggagaaaatataccagtacacccacatgtgtatagcaacggtcatatttgtctctctattctgaccgaggattggagccccgctctgagtgtccagagcgtctgcctctcaatcattagtatgctctctagctgtaaggagaagagaaggcctccagataattcgttttatgtgagaacttgcaataaaaatcccaaaaaaacaaaatggtggtaccacgacgatacatgttag

SEQ ID NO: 246081 - DNA, 480 bp, Artificial Sequence
  Description of Artificial Sequence: Synthetic coding sequence
atggcttccatgcaaaaaagactgcagaaagaactgctcgccctgcaaaatgatcctcctccaggcatgacgttgaacgagaaatctgttcagaatagtatcacacagtggatcgtggatatggagggagcgccaggaacactctatgaaggcgagaaattccaactgttgttcaagttctccagtaggtacccattcgatagcccgcaggttatgtttacgggggagaacatccccgtgcatccacacgtatattctaacggccacatttgtcttagcatactgactgaggactggtctccagccctgtcagtgcagtcagtttgcctgagcataatttccatgctgagtagctgcaaggaaaagagacggcctcctgacaactccttctatgtaagaacttgtaacaagaaccccaagaaaacaaaatggtggtaccacgagcttaaaagcgctttcattctctcaataacagattag

SEQ ID NO: 246082 - DNA, 456 bp, Artificial Sequence
  Description of Artificial Sequence: Synthetic coding sequence
atggcctctatgcagaagcggctgcagaaggaactcctggccctgcagaacgatcctcccccaggaatgaccctaaacgaaaagtccgtacagaatagcattacacagtggattgtcgatatggagggtgccccaggcacactttatgaaggggagaagttccagctcttatttaagttcagcagccgctatccattcgacagccctcaggtgatgttcaccggagagaacattccagtccatcctcatgtatattcaaatggccacatttgtcttagcattctgacagaggattggagccctgcactcagtgtgcagtccgtgtgtctaagcatcatttctatgcttagctcttgtaaggaaaagcgtagaccacctgataattcattttatgtccgaacttgtaacaagaatcccaagaagaccaaatggtggtaccatgacgacacctgttag

SEQ ID NO: 246083 - DNA, 354 bp, Artificial Sequence
  Description of Artificial Sequence: Synthetic coding sequence
atgtcctccaatgttccggctgatatgatcaatctgcgtctcatcctcgtgtccggtaaaactaaggagtttctctttagcccgaatgatagcgcatctgacatcgctaaacatgtatatgacaactggccaatggattgggaggaggagcaggtcagttctcccaatattctcaggctgatctatcaggggaggttccttcacggcaacgttacacttggcgctctcaaactaccattcggtaagaccactgttatgcacctagttgctcgggagacactgcccgaaccgaactctcagggacagagaaacagggaaaagacaggcgagtccaactgttgcgttatcctttag

SEQ ID NO: 246084 - DNA, 474 bp, Artificial Sequence
  Description of Artificial Sequence: Synthetic coding sequence
atgcagctgacagtgaaggctctgcaggggcgagagtgctccttacaggtaccagaagatgaactggtgtccacactcaagcagctcgttagcgagaaattgaacgtgcccgtcagacagcagaggctgctgtttaagggcaaggccctcgccgatggcaaacgactgtcagattactcaatcggccctaatagcaaactgaacctggtggttaagcccttagaaaaggtactactggaggagggcgaggcccagcggctggccgacagcccaccccctcaggtctggcagctgataagtaaagtgcttgctcgacacttttctgctgccgacgccagtagagtgcttgaacagctccaacgtgactacgaacgatctctatcacggctcacactggacgacattgagagactagccagtcggttcctgcaccccgaagtcacggagactatggaaaaaggattcagcaagtag

SEQ ID NO: 246085 - DNA, 525 bp, Artificial Sequence
  Description of Artificial Sequence: Synthetic coding sequence
atgtttctaactgtgaagctgctccttggtcagcgatgcagtctcaaggtatccggtcaagagtccgtagcaactctgaagcgcctggtatcccgaagactgaaggtccctgaggagcagcaacacctgctgttcagaggacagttactggaagatgataaacacctgtccgactattgtattggccctaatgcgagtattaacgtcattatgcaaccactggagaaaatggctctgaaagaagcccaccagccccagacccagcctctctggcatcagctcggtctggtgctggctaagcactttgaaccccaagatgccaaagctgtcctgcagctgctgagacaggagcatgaggaaagactacagaagatttctcttgagcacttggagcaactcgctcagtatttgttggcggaagaaccgcacgtggagcccgctggggagagggagctagaggcgaaagcaaggcctcagtcctcttgtgacatggaggaaaaagaagaagcagccgcagatcaatag

SEQ ID NO: 246086 - DNA, 222 bp, Artificial Sequence
  Description of Artificial Sequence: Synthetic coding sequence
atgattgaagttgtctgtaacgataggctgggaaagaaggtccgagtgaagtgcaatacagatgacactataggtgaccttaagaaactgattgccgcacaaacaggcacacgatggaacaagattgtattgaaaaaatggtacactatctttaaggaccacgtgagtctcggcgattacgaaatccatgacggcatgaatttggaattgtattaccagtag

SEQ ID NO: 246087 - DNA, 222 bp, Artificial Sequence
  Description of Artificial Sequence: Synthetic coding sequence
atgatcgaggtcgtatgtaacgaccgtctggggaagaaagtgagggtgaaatgcaacacagatgataccatcggcgacttaaaaaaactcatcgccgctcagacgggaactcggtggaacaaaattgtgttgaagaaatggtacaccattttcaaagaccatgtgtcactgggagactacgaaatccacgatggaatgaatctggaattgtattatcagtag

SEQ ID NO: 246088 - DNA, 1143 bp, Artificial Sequence
  Description of Artificial Sequence: Synthetic coding sequence
atgagcctgtcagactggcaccttgcagtgaaacttgctgatcagccactgactcccaagagcatcctgaggttgcccgagactgaattaggtgagtactcacttgggggttatagtatcagcttcctgaagcagctgatcgccggtaaattgcaagaatccgtacccgatccagaattgattgatctgatttattgtggcagaaagctgaaagatgatcagaccctggatttctatggaatccaaccaggaagcaccgtccacgttctccgcaagagctggcccgaacccgaccagaagcccgaaccggtcgacaaggtggctgcaatgcgtgagtttagggtgctgcacacagccctgcacagctcatcgtcctatcgtgaagctgtcttcaagatgttatctaataaagagagtctggatcagatcatcgtggctactccgggactgtccagcgatccaatcgctctcggtgttctgcaagacaaggatctgttttccgtgtttgccgacccaaatatgttagacacgctggttcctgcacacccagctctggtaaacgccatagtgctggtgttgcattccgttgcaggctctgccccaatgccaggtaccgactcctcgagtagatcaatgccctcttctagctaccgtgacatgcccggtggatttctgttcgaaggtctctccgacgacgaagacgacttccaccccaacacaaggagtaccccaagcagctcgacgccatcttcgaggccagcctccctgggttactctggggctgctggccctcgacccataacgcaatcagagcttgccacggctcttgcgctggcctcgacccctgagagctcctcacatacaccaactccgggaacacagggccattccagcggcacctcccccatgtcttccggggtgcagagcgggacccctattaccaacgatctattttctcaggcactacaacacgcccttcaagcttctggccagcctagcctccaaagccaatggcagccccagttgcaacaactgagggacatgggcatccaggatgacgagctgtctctcagggcgctgcaggccacgggcggagacattcaggcagcccttgagctcatattcgctggcggagcaccatag

SEQ ID NO: 246089 - DNA, 1143 bp, Artificial Sequence
  Description of Artificial Sequence: Synthetic coding sequence
atgtcgctgagcgattggcacttggctgtgaaactggctgaccagcccctgacaccaaagtcaatcctccgtctgcccgaaaccgaacttggcgaatacagtctgggcggttatagcatctcattcctcaaacagctgatagccggtaaactgcaagaatccgtgcccgacccggaactgatcgatctaatatactgcggacgaaaactgaaggacgaccaaactctggacttttacggcattcaacctggaagtaccgtgcacgtgttgcgcaaaagttggccagagcccgatcagaaacctgaaccagtagataaggtagctgccatgcgggaattccgggtgctccacactgcccttcacagcagttcctcatatagagaggctgtgtttaagatgctttccaacaaggagtcactcgatcagattatagtggcgacccccggtctgagctccgaccccattgctctcggcgtgctgcaagataaggatctgttttctgtctttgctgatccaaacatgctcgacacacttgtcccagctcatcctgccctggtgaatgcaattgtgctggtgctgcactccgtggccggtagcgcacctatgccaggcacggactcatcaagcaggtctatgccgagcagctcttatcgcgacatgccaggagggttcctgttcgaagggctgtctgatgatgaagatgacttccaccccaatacgcgttctaccccaagttccagtacaccatcctccagacccgcaagtctcggttatagtggagccgctggaccaaggccgattacccaatctgagctggccactgcactcgcactcgcctccactccggaaagtagcagccacacccccacgcccggaactcaaggccactcttcaggcactagccctatgtcatccggagtccagtcaggcacacccattactaatgacttgttcagccaagcgttgcagcacgccctccaggcctctgggcagccatcattgcagagccagtggcagccccaactgcaacaactaagagatatgggcatacaggatgacgagctaagcttacgcgctctccaggccacaggcggtgacatccaagcagctctagaactcatttttgccggaggtgccccttag

SEQ ID NO: 246090 - DNA, 957 bp, Artificial Sequence
  Description of Artificial Sequence: Synthetic coding sequence
atggccctcccaataatagttaagtggggcggtcaggagtactcggtcacgacattaagcgaagacgacactgttcttgacttgaaacaattcctgaaaacattgaccggcgttctaccagaaaggcagaagctgctaggtctcaaggttaaagggaagcctgctgaaaatgacgtcaagttaggggcactgaagctgaagcccaataccaagatcatgatgatgggtacccgagaggaatcgctggaggatgtgctcggcccaccccctgacaacgacgatgtagttaatgatttcgacatcgaggatgaagtcgtggaggtggagaaccgtgaggagaaccttctcaaaataagccgccgagttaaggagtacaaggttgaaatcttaaacccccctcgcgaggggaagaagctcctcgtgctcgatgtggattacaccctgttcgatcatagaagctgtgcagaaacgggggtggagctaatgcgcccatacttacatgaattcctgacatcagcatacgaagattacgacattgtcatatggtccgcaactaacatgaaatggattgaagctaaaatgaaggagctcggcgtttctactaacgccaattacaagatcacattcatgttggactctgccgcaatgatcaccgttcatacgcctcgcaggggacttatcgatgttaaacccttaggcgtcatttggggcaagttcagtgagttttactctaagaagaacaccattatgttcgacgatatcggtagaaactttctgatgaaccctcaaaatggactaaaaatacggccatttatgaaagcccatctcaatagagataaggacaaagaacttctcaagctcacccagtacctaaaagagattgccaaacttgatgactttctggacctgaatcacaaatactgggaacgctatctgtcaaagaagcaggggcaatag

SEQ ID NO: 246091 - DNA, 1923 bp, Artificial Sequence
  Description of Artificial Sequence: Synthetic coding sequence
atggcattgtcccgcggattgcctagggaactggctgaggccgtggccggagggcgagtgctcgtggtgggcgcaggcggtattgggtgcgaactcctaaagaatcttgtgcttacagggtttagtcatatcgatctgatcgatttggatacgatcgatgtgagcaacctaaaccgtcaatttctattccagaagaaacacgtgggaaggtcgaaggcccaggtggcaaaggaatccgtactccagttctaccccaaggccaacattgtggcctatcacgatagtattatgaatccagactataacgtggagttcttcaggcaattcattttagttatgaatgcgctggacaatcgagcagcgagaaaccacgtcaaccgcatgtgtctggctgccgatgtgccacttatcgaaagcggcaccgctggctatttagggcaggtaaccaccataaagaagggggtgacggagtgttatgagtgccatccaaaacccacccagcggacttttcccggatgcacgattcgcaacactccatccgaacccatccattgcatagtgtgggcgaaatatttgttcaatcagctctttggcgaagaggatgccgatcaagaggttagtccagacagagcagacccagaagcagcatgggagcccaccgaggccgaagcacgcgctcgggcaagtaatgaggatggtgatatcaagaggatcagtacgaaagagtgggccaaaagcactgggtacgatcccgtaaagctgttcacgaaactcttcaaggatgacatccggtatctgctgacgatggataagctttggcgcaagaggaagccaccagtgccccttgattgggctgaagttcagagccagggcgaagagacaaatgctagtgaccaacagaacgagcctcagctcggcctgaaggaccaacaggtactcgatgtgaagtcttatgccaggcttttttcgaaatcgatcgaaaccctgagggtgcacctcgctgaaaagggagacggggcagagctcatatgggacaaagatgatccttctgccatggattttgtgacaagtgcggcaaatctgcgcatgcatatcttcagtatgaacatgaagagcaggttcgatattaagtcaatggccggaaacattatcccagcaattgctactaccaatgctgttatagccggactgattgtgctcgaaggcctgaaaatcctgtcaggaaaaatagaccagtgtagaacaatctttctcaacaaacagcccaacccacgcaaaaagttgcttgtcccatgtgcgttagacccacctaatccaaactgctatgtttgcgcatccaaacctgaggtcacggtgcggttaaacgtgcataaggtgaccgtgctcaccttgcaagataagattgttaaagaaaagttcgcaatggtcgcacccgatgtacagattgaggacggcaagggtactatcctgataagcagcgaggaaggcgaaactgaggctaacaaccacaagaagctgtccgaatttggtattcggaacggctcccgcctgcaggcagacgattttttgcaggattacactctcctgattaacatcttgcattcggaagacctcgggaaggatgtggagttcgaggtcgtgggggacgcgccagaaaaggtgggccctaagcaagcagaagatgctgcaaagagtatcactaacggctctgacgacggtgcacaaccatcaacatccacagcacaagaacaggacgatgtcctcatcgtggactcagacgaagaggacagcagcaacaacgctgacgtgtccgaggaagagcgttcccggaaacggaaattagacgaaaaggaaaatctgagtgctaagcgcagtagaattgagcagaaggaagaacttgacgacgtgattgccctggattag

SEQ ID NO: 246092 - DNA, 1635 bp, Artificial Sequence
  Description of Artificial Sequence: Synthetic coding sequence
atgaaccctgattataatgtcgaattcttcaggcaattcatcttggtaatgaacgccttagataaccgcgctgcgcgaaaccacgttaatcgcatgtgcttagccgctgacgtcccgctgattgagtcagggacagctggatatctcggtcaggtcaccacgataaaaaaaggcgtgacagagtgttacgagtgtcacccaaagcccacccagagaactttccccggatgtaccatacgtaacaccccttcagaaccaattcattgtattgtgtgggcaaaatacctgtttaatcagctttttggtgaggaagatgccgaccaggaagtttcaccagatcgcgctgatcccgaagcagcgtgggagcctactgaagcggaggcgcgtgccagggctagtaacgaggacggagacattaagcgtatctccacaaaggagtgggcaaaatccacaggttatgacccagtcaagctgtttaccaagctcttcaaagacgacattaggtacctgctgactatggacaagctgtggaggaagcgaaagcctcccgtgcctctagattgggctgaggttcagtcacaaggcgaagaaacaaacgcttcggatcagcaaaacgaacctcagctgggtctgaaggatcagcaggttctggatgtaaagtcttatgctaggctgttttctaagtccatcgaaacactgcgggtgcatcttgccgagaagggtgatggcgctgaactgatttgggataaggacgacccatccgcaatggatttcgtgaccagcgccgcaaacctgcgcatgcatatcttttctatgaatatgaagagccggttcgacatcaagtctatggctggtaacatcatacccgctatcgctactactaacgccgttattgccggattaattgtgttagagggactaaaaattttaagcggtaagattgatcaatgtagaacaatcttcctcaacaagcaaccaaacccaaggaagaaactgttagtaccttgtgccctcgatcctccaaatccaaactgctacgtgtgcgcaagcaaacccgaagttaccgttaggttgaacgtgcataaggtgaccgtgcttactctccaggacaagatcgtgaaggagaaatttgctatggttgcccctgacgtccaaatagaagatgggaaagggaccatcctcatcagcagtgaggagggcgagaccgaggccaataaccacaagaagctctccgaatttggaatacggaacggatcacgattacaagccgatgactttctgcaagattacacgctccttatcaacatcctgcactccgaagatctgggtaaggatgttgagtttgaagtggtaggcgatgcaccggagaaggtcggcccaaagcaagcagaagacgccgcaaagtccattacaaatgggagtgacgacggggctcaacctagcacttctacagcacaggaacaggatgacgtgctcattgtcgactctgatgaggaggacagttctaataacgcggacgtgagtgaagaggaaagatcacggaaacgtaaacttgacgagaaagagaaccttagtgccaaacgctcaagaatcgaacagaaggaagaactggacgacgttatagccctggattag

SEQ ID NO: 246093 - DNA, 879 bp, Artificial Sequence
  Description of Artificial Sequence: Synthetic coding sequence
atgtgtctggcggcagacgtgcccctaattgagtctggcactgctggatatctaggccaagtgacgacaataaagaagggggttacggaatgctatgagtgccatccgaagcctacccaacggacgttcccaggatgtacaatccggaataccccctcggagcctattcactgcatagtttgggccaaatacctatttaaccagttgtttggtgaagaagatgcagatcaggaagtgtcccctgaccgggctgaccccgaggcagcgtgggagcccacggaagcggaggctcgcgcaagagcatctaatgaggacggagatattaaacgtattagcacaaaggagtgggctaaatccacgggttatgacccggttaagctctttaccaaactgtttaaagatgacattaggtacctcttaacgatggacaaactgtggcggaaaagaaaacccccagtcccactagattgggccgaggtacaatcgcagggggaggagacaaatgcttctgaccagcagaacgaaccccaacttggactgaaggaccagcaagttcttgacgtgaagtcctacgctcgactgttctcaaagtcgattgagactctgcgcgtccatctcgccgaaaagggcgatggcgctgagctaatttgggataaggacgatccctcagcaatggactttgtcacatcagctgcgaatctccgcatgcacatcttctcaatgaacatgaaatcccgatttgatattaagtctatggcagggaatattattcccgctattgccaccacaaatgccgtgattgccggtctgatcgtcctggagggccttaagatcttgtccggcaagatagaccagtgcagaacggacttttttgagtag

SEQ ID NO: 246094 - DNA, 1047 bp, Artificial Sequence
  Description of Artificial Sequence: Synthetic coding sequence
atggcattgaaaagaatgggtattgtctccgattacgagaagatccgaactttcgctgtggcaatcgtgggggtcggcggtgtgggctctgtgaccgctgagatgctgacacgctgtggcataggcaagttgctgctttttgactacgacaaagttgaactcgccaacatgaacagactgtttttccagcctcaccaggctggcctgagcaaagtccaagctgctgagcacacccttagaaacatcaaccctgacgtcctgttcgaagtccataattataacatcacaacagtggaaaatttccagcactttatggatcgcatttccaatggaggactggaggagggtaagcctgtggacctcgttttgtcatgtgtggacaactttgaagcccgaatgacgataaacactgcctgtaacgagctgggccagacctggatggagagtggcgtgagcgagaacgcggtatctggacatatacagctgataattccaggtgagtcagcgtgctttgcctgcgctccaccacttgtcgtggcagccaacatcgacgagaagaccctgaaaagagagggcgtctgtgctgcgtctctccccactactatgggagtggtggctggaatattagtgcagaatgtactaaagtttctactaaacttcggtactgtgtccttctatttggggtacaacgccatgcaggatttctttcctactatgagcatgaagcctaatccccagtgtgacgataggaactgtcgcaaacagcaggaggaatataaaaaaaaggtagcggctctaccgaaacaggaagtgatccaggaagaagaggaaatcatccatgaagacaatgagtggggaatcgaactggtatccgaagttagtgaagaggaactaaagaacttctccggcccagtgccagacttacctgaaggcatcactgtggcttacacaattcccaaaaaacaggaggactccgtaacggaactgaccgtggaggactccggagagagcctggaggacctcatggctaaaatgaaaaacatgtag

SEQ ID NO: 246095 - DNA, 1215 bp, Artificial Sequence
  Description of Artificial Sequence: Synthetic coding sequence
atggccgagagtgtggagagacttcagcagagggtccaagagctggaaagggagctggctcaggaacgcagcttgcaggtgccccgtagcggcgatggcggaggaggcagggttcggatagagaaaatgtcctctgaagttgtggactcaaatccctatagccgactgatggcccttaagagaatgggaatcgtctcagattacgaaaaaatcaggactttcgctgttgcgattgttggtgtgggcggagtcggatctgtcaccgctgagatgttaacacggtgtggaatcggaaagctgttgttgtttgactatgataaggtcgagctagccaatatgaaccgactgttctttcagccccatcaggccggactgtccaaggtacaagcagctgagcacacgctgcgcaacatcaacccggatgtgctgttcgaggttcataattacaacattacaactgtggaaaattttcaacatttcatggacaggatatcgaatggcggacttgaagaagggaaaccagttgacctggttctctcatgtgtggataatttcgaagctcgcatgacaatcaacactgcatgcaacgaattaggccaaacttggatggaatccggggtgagcgagaacgctgtcagcgggcacatccaactgattatccctggcgagtctgcctgttttgcctgtgcccctcccctcgtggtggccgcaaacattgacgagaaaaccctcaagcgcgagggtgtgtgtgctgcatctctccctacaacaatgggtgtggtcgcagggatcctggtgcaaaacgttctgaagttcctcctgaattttggaaccgttagtttttatctggggtacaacgcaatgcaagattttttccccaccatgtctatgaagccgaaccctcagtgtgacgaccgaaactgtcgcaagcagcaggaagagtataaaaagaaagtggctgccctgcctaaacaggaggtcatacaggaagaggaagaaatcattcacgaggataacgaatggggtatcgagctggtgagtgaggtaagtgaagaggagctgaaaaatttcagtggtcccgtccccgacttgcccgaaggcattacagtagcttataccatccccaagaaacaggaggacagtgtgactgagctgacagttgaagatagtggtgagtctctggaagacttaatggccaagatgaaaaacatgtag

SEQ ID NO: 246096 - DNA, 2379 bp, Artificial Sequence
  Description of Artificial Sequence: Synthetic coding sequence
atgtggattcaggtgaggaccatggatggccgtcagacacacacagtcgactcactatcaagactgaccaaggtggaggagctgagaaggaaaatacaagaactgtttcacgtggagcccggactgcaacgcttgttctaccggggaaaacagatggaggacggccacaccttgtttgactacgaggtgcgcctaaatgacacaattcagctgctcgtgaggcagtcccttgtcctaccccactccaccaaagagagagattcggaactcagtgacacggatagcggttgctgtcttggtcagtccgagagcgacaagtcatccacacatggcgaagcggctgccgaaaccgattcccgccctgccgacgaagacatgtgggatgagacggaactaggcctgtacaaagtgaatgagtacgtggatgccagggacactaatatgggcgcatggttcgaggcacaggtggtgagggtaacccggaaggctccctcccgcgatgaaccatgctcttcaacttctagaccagccctggaggaagatgtgatttaccacgttaagtatgacgactaccctgagaacggcgtcgtgcagatgaacagcagagatgtccgcgctagagctcggaccatcattaagtggcaggatctagaggtgggccaggtggtgatgttgaattacaatcccgacaaccctaaggagagaggattctggtacgatgccgaaattagccgcaaacgtgagaccagaaccgctcgagagctttacgctaatgtcgtactcggggacgatagtctaaatgattgcagaatcatattcgtcgatgaggtatttaagatcgaaagacctggagaggggtccccgatggtcgataacccgatgagacgcaagtctgggccaagctgtaagcattgtaaggatgacgtaaatcgcttatgtcgggtgtgtgcatgccatctgtgtggtgggcgtcaggatccggacaagcagctgatgtgcgatgagtgtgacatggctttccacatttactgcctggatcctccgttaagcagcgtaccctctgaagacgaatggtactgcccagaatgccgaaatgatgcctccgaagtagtgctggcaggcgagcggctccgggagagtaagaagaaagctaagatggcttcagctacaagcagttctcagagagactgggggaagggaatggcctgcgttggacgtaccaaagagtgcactatagttcccagcaaccattacggtcccattcctggcatccccgttggtaccatgtggcgttttagggtgcaggtaagcgaatctggggtccaccgccctcacgtggctggtatccacggaagatcaaatgatggcgcatattccctggtgctggcgggaggctacgaagatgatgtggaccatggaaacttcttcacatacaccggaagcgggggaagagacctttctggaaataaacggaccgcggagcagtcctgtgaccaaaaactcactaatacgaaccgcgctctcgccctcaactgtttcgccccaattaatgaccaggaaggcgcagaggcaaaggactggaggagcggtaagccggttcgggtagtgcggaacgttaagggtggtaagaactcgaaatatgcgccagccgaaggcaatagatatgacggaatctacaaagtggtcaagtattggccagagaaggggaagagcggtttcctggtgtggagatacctgcttcggagagacgatgatgagccgggtccatggactaaagagggcaaggaccgcattaagaagctgggtctcaccatgcaataccctgaaggatatctggaggcactcgccaacagggaaagagagaaagaaaactccaaacgagaagaagaggagcaacaggaaggtgggttcgcctcaccccgaactggaaaggggaagtggaagcggaagagcgctggaggcggtccttcccgcgcaggacctcgccgtacaagcaaaaagaccaaggttgagccgtattcgctcaccgcccagcagtcctcacttattagggaagataaatccaatgctaagctttggaatgaggtcttggcctctctgaaggaccgcccagcatctgggtctcctttccagctgtttctgagcaaggttgaagagaccttccagtgcatctgttgtcaagaacttgtattccggcctatcaccacagtgtgccagcataacgtctgcaaggattgtctggaccgtagctttagggctcaggtattttcctgcccggcatgcaggtatgaccttggcagaagctatgcaatgcaggtcaaccagccccttcagacagtcctgaatcagttattccccggttatggtaacgggagatag

SEQ ID NO: 246097 - DNA, 1224 bp, Artificial Sequence
  Description of Artificial Sequence: Synthetic coding sequence
atggctagtgcaacttccagcagtcagcgggactggggcaagggaatggcttgtgtggggaggactaaggagtgcacaattgtcccttccaatcattacggacccattccagggatccccgtgggaacgatgtggaggtttcgcgttcaggtaagtgagtcgggagtacacaggccacacgtggctggtattcacgggcgatccaatgatggagcttacagcctggttttggctggaggctatgaggacgatgtggatcacggcaactttttcacctatacgggctcaggtggacgggacttatccggcaacaaacgcacagccgaacagtcttgtgatcaaaagctaacaaacactaaccgcgcattggctttgaattgcttcgcgccaattaacgatcaggaaggtgccgaagcgaaggactggcgctcagggaaacccgttcgcgtggtgagaaacgtgaaaggcggaaagaatagtaagtatgccccagcagagggcaacagatatgatggtatttacaaagtcgtgaaatactggccggaaaaaggcaaatcaggattccttgtgtggagatatctgctccgcagggatgacgatgaacccggaccctggacaaaagaggggaaggacagaattaaaaaactgggattaactatgcagtaccctgaaggatacttggaggcactggctaatagagagcgggagaaggagaactccaagagggaggaagaagagcagcaggagggagggttcgcttctccacggaccggaaagggcaagtggaagcgaaaatcagcagggggagggccttccagagccggaccacgcagaacatcgaaaaaaaccaaggtcgaaccttattctctgactgctcagcaatcgagtctgattagagaggacaagagcaacgctaaactttggaacgaggtactagcaagcctgaaagaccgtccggcttccggcagccctttccagttgttcttgagtaaagtggaggaaacgtttcagtgcatctgttgtcaggaacttgttttcaggccaatcacaacagtatgtcagcataacgtttgcaaggattgcctcgaccggtccttcagggcgcaagtgtttagttgtccagcctgccggtatgatctgggacggtcttatgccatgcaggtgaatcagccattacagacagttctcaaccaactatttcccggttacggcaacggtcggtag

SEQ ID NO: 246098 - DNA, 2418 bp, Artificial Sequence
  Description of Artificial Sequence: Synthetic coding sequence
atgggggtatttgcggtaccaccactctcagccgataccatgtggatacaggtgcgcactatggacggtcggcagactcatacagtggattctctctctcgcttgaccaaggtcgaggagctccggaggaaaattcaggagctgtttcacgtggagccgggattgcagagactgttctaccgaggaaaacaaatggaggatggccatactctctttgattatgaggtgcggctgaacgacaccatacagctgttagtgcgacagagcctcgtgctcccacactccacgaaggagagagacagcgaattgtctgatacggattccggctgttgcttgggtcagagcgaatccgacaaatcttcaacccacggcgaggccgcagctgaaaccgatagccgcccagcagacgaagatatgtgggacgagacagaactgggactctacaaagtcaacgaatacgtggacgcacgggacaccaatatgggcgcttggtttgaagcgcaggtggtgagggtgactcgcaaagctccctcccgcgacgagccatgcagctccacttcccgacccgcactggaggaggacgtgatttaccatgtgaagtatgatgactaccccgaaaacggggtggtccagatgaacagccgagatgtccgggctagggctagaaccatcatcaaatggcaagacctggaagtggggcaggttgtcatgctcaattataatccagacaaccccaaggaaaggggcttttggtatgacgccgagatcagccggaagcgggagaccagaacggcccgagagctgtatgccaacgtggtgttaggagatgatagcttgaacgattgtcgtatcatttttgtggatgaagtatttaaaattgaaaggccaggagaaggctcgcccatggtggataaccccatgcggcgaaaatcaggaccatcttgcaaacactgcaaagacgatgttaacagactatgccgggtgtgcgcttgtcatctttgtggagggaggcaagatccagataaacagctgatgtgcgatgaatgtgacatggccttccacatctactgcctggatccccctctgagcagcgtaccctcagaagatgagtggtactgtcccgagtgccggaatgacgcctccgaagtcgttctggccggtgaaagactgcgggagagcaagaagaaggccaagatggcctcagctacttcatccagtcagagagactggggaaaaggcatggcttgcgtcggccgaacaaaagaatgtacaattgtgcctagcaaccattatgggccaatcccaggcattcccgtaggcaccatgtggcgattccgggtccaggtcagtgaaagtggtgtgcacaggccgcacgtagccggtatccatgggaggtctaatgacggtgcatattctctggtgctggcagggggatatgaggatgacgttgaccacggcaattttttcacttataccggctccggcggaagagatttgagcgggaacaaaaggacagccgaacagtcatgtgaccaaaagctgacaaacaccaacagggctcttgccttaaactgctttgctccaatcaacgaccaggagggcgctgaggcaaaagactggcgtagcggcaaacctgttagggtggtgaggaacgtcaaaggagggaaaaactccaagtacgcaccggcagaaggtaatagatatgacggcatctataaggtggtgaaatactggcctgagaaaggaaaatcaggatttctggtctggcgatacctgctgagacgggacgacgacgagccgggtccctggaccaaagagggcaaggacaggataaagaagctcgggctgactatgcagtaccctgagggctatctcgaggcccttgcaaatagggagcgcgagaaggagaactctaaacgggaagaggaggaacagcaagaggggggttttgcctcgcctagaacgggcaaaggtaagtggaagcggaaaagtgctggcggagggccaagccgtgcaggaccaaggaggaccagtaagaaaactaaggtggaaccttattccctgaccgcccagcagtccagtctgataagagaggacaaatctaacgcaaagctgtggaatgaggtcctggcctctctgaaagaccggcctgcaagcggttcaccattccagctgtttctgtcaaaagttgaggagacattccaatgcatctgctgccaggaactcgtcttccggcctatcactacagtctgtcaacataatgtgtgcaaagactgtttggatcgatcgtttagggcgcaggttttctcatgcccagcgtgccggtatgatttagggaggagttacgctatgcaagtcaaccagccactgcagactgtgttgaaccaactgttccccggatacgggaatggcagatag

SEQ ID NO: 246099 - DNA, 2379 bp, Artificial Sequence
  Description of Artificial Sequence: Synthetic coding sequence
atgtggatccaggtaaggactatggatgggcgtcagacccacacagtggacagtttgagccggttgactaaagtggaggagcttcggcgaaaaatacaagagctctttcacgtggagcccggactgcaacgcctcttctaccgaggaaaacaaatggaggacggacacactttgttcgattacgaggtgcgcctgaatgatacaattcagctcctcgtgcgacagtcactggtgcttccccattccaccaaggaaagggactccgagctgagcgacaccgatagtgggtgttgcctcggacagtctgagtccgataaatcaagtactcacggtgaggctgccgctgaaaccgattctcggcctgcagacgaggatatgtgggacgaaactgaactagggctgtacaaggtgaatgagtacgttgatgctcgggatacaaacatgggagcatggtttgaggcacaggtggtccgcgttactcggaaagccccttcccgcgatgagccctgttctagcaccagtagacccgcactggaagaggatgtgatctaccatgtcaagtacgatgactatcccgaaaatggcgtggtgcagatgaactccagagacgtacgggcacgagcccgaacaattataaagtggcaagatcttgaagtgggacaggtggtcatgctgaactacaatccagacaatcccaaggagaggggcttttggtatgacgcagagatctcaagaaaaagggagacaaggactgccagagaactgtacgcaaatgtggtacttggcgatgactccctgaatgattgtcgcatcatctttgtggacgaggtctttaagattgagcggccaggcgaggggagtcccatggttgacaatcctatgcgcaggaaaagcgggcctagctgcaagcactgcaaggatgacgtgaacaggctgtgcagggtgtgcgcttgtcatctctgcggcggaaggcaggatccggataagcagcttatgtgtgacgaatgcgacatggcgttccatatctattgcctggatccaccattatccagcgtaccaagcgaagacgaatggtattgtccagaatgcaggaatgacgccagtgaggtcgtattggccggtgagcggcttcgggagagcaaaaagaaagctaaaatggcctccgctacctccagctcccagagagattggggcaagggcatggcatgcgtcggacgcacaaaagagtgtacaatcgtaccctctaatcattacggcccaattcctgggatcccagtaggcacaatgtggcgctttagggtccaggttagtgaaagcggagtgcaccgccctcacgtggccggaattcatgggcgaagcaatgatggcgcttatagtctcgtcctcgctggcggatatgaagacgacgtcgaccatggcaacttctttacctacaccggctccggagggcgagatttgtctggtaacaagcggaccgcggagcagagctgtgaccagaagcttaccaacacgaatagagccctcgcgctgaattgctttgcgcctattaatgaccaagaaggcgctgaggccaaggattggcgttcaggcaagccagtgcgcgtggtacgcaatgtgaagggcggaaaaaactcaaaatacgcaccggcagagggaaatagatatgacggaatctacaaggtcgtgaaatattggcctgagaagggcaaaagcggttttctggtatggagatacctactgcgtcgagacgacgacgagcctggaccttggacaaaagagggcaaggaccgaatcaagaaattgggccttaccatgcaatacccagagggctacttggaggccctggcaaatcgcgagcgggaaaaagagaactcaaagcgtgaagaagaggagcagcaggaagggggttttgcctctcccagaaccggcaagggaaagtggaagaggaagagcgccggaggcggacctagtcgcgctggtccgcgtcgtacctccaaaaaaactaaggtcgaaccatactcgctcacggcacagcaatcttccctgatccgtgaagacaagagcaatgcaaagctctggaacgaagttcttgcaagtctcaaagataggcccgctagtgggagcccatttcaactcttcctgtccaaggtggaagagaccttccaatgtatctgctgtcaggagctagtctttcgacctataacaaccgtctgtcaacacaacgtctgtaaagattgcttggatcgatctttccgagcccaagttttttcatgtcctgcctgccggtacgatttgggacgctcatacgctatgcaggtgaaccaacccctgcagactgttttgaatcaactattccctggctacggtaacggtaggtag

SEQ ID NO: 246100 - DNA, 2379 bp, Artificial Sequence
  Description of Artificial Sequence: Synthetic coding sequence
atgtggatccaagtccgcacaatggacgggcgtcagacccacacggtggactctctgagccggctgaccaaagtggaagaattaagacgtaagatacaggagttattccacgtggagccgggactccagaggctgttctatagaggaaaacagatggaggacggacataccttatttgactatgaggtcaggctcaatgacacaatacaactcttagtcaggcagtcgctggtgttgccccactccaccaaggagcgagacagcgaactttctgacacagattcaggatgttgcctgggccaaagtgagagtgataagtcatctacacacggggaggcggctgccgagacagacagcagacccgctgacgaggacatgtgggatgaaacagaattggggctgtataaagtcaatgagtacgtggatgcccgagacacaaacatgggtgcctggtttgaagcccaggtggttagggtgacccgcaaggccccatctcgggatgaaccatgtagtagcacaagcagaccagctcttgaagaggacgtgatttaccacgtgaagtatgacgactaccccgaaaatggcgtcgtgcagatgaactcccgagacgtgagagccagggcgagaaccatcattaaatggcaggatctagaggtgggacaggttgtgatgctcaactacaatcctgataaccctaaggagcgagggttttggtacgacgccgaaatcagtagaaaacgcgagacccggacggcacgcgaattgtacgctaacgtggttttaggcgacgattctctcaatgattgtagaattatcttcgtggacgaagtcttcaaaatcgagcgacctggtgagggcagcccaatggttgacaatcctatgcgcaggaagtctgggcctagctgtaagcactgtaaagacgacgtgaatcggctctgccgcgtgtgcgcctgccatctctgtggtggtagacaggacccggacaagcagctaatgtgcgatgagtgcgatatggccttccacatctactgcctcgatcccccactgagtagcgtgccatcagaggacgagtggtactgtccagagtgtcgtaatgacgcctccgaggtggttctggctggggaaaggctgagagaatcgaaaaaaaaagccaaaatggccagcgctacttccagctcacaacgcgattggggaaagggaatggcatgtgttgggagaacaaaggagtgtacaattgttcctagcaaccattacgggccaatcccgggaataccagtggggacgatgtggcggtttagagtgcaggtatcagaatcaggggttcacagaccccacgtcgccggaatacacggtagaagtaacgatggcgcttacagtcttgtgctagccggaggatatgaggatgacgtcgaccatggaaatttcttcacttataccggaagcggaggcagggacttatctgggaacaaaagaaccgccgaacagtcgtgtgatcagaaactaacaaacacgaacagagccctggctctaaactgttttgccccaattaacgatcaggaaggtgccgaagcgaaggactggagatccggaaagcctgttcgagtggttcgtaatgtgaaaggcggtaagaattctaagtatgcaccagccgagggcaacagatatgacggtatttacaaggttgtcaagtactggcccgagaagggcaaatccggtttcctagtctggagatacctgctacggcgagatgatgatgaaccgggtccctggacgaaggaggggaaagacagaattaagaagttgggcctgactatgcaataccctgaaggatatcttgaggcccttgctaaccgtgagagggaaaaggagaattctaaacgggaagaggaggaacagcaggagggcggttttgcctcgccaaggacgggtaagggaaagtggaagaggaagagcgccggaggaggtccttcccgtgctggacctagacgaacaagcaagaagacaaaggtggaaccatacagtctgactgctcagcaatccagcctcattcgggaggataaatcaaatgccaagctatggaacgaggtgctcgcctcgctgaaggacaggcccgcatccggctctccctttcagctctttctaagcaaagttgaggagaccttccagtgtatctgctgccaagagctggtgtttcggccaattaccactgtctgccagcacaatgtgtgcaaagactgtctggaccgctctttcagagcccaggttttctcatgtcccgcttgcaggtacgacctgggcaggagttatgccatgcaggtaaatcagcccctgcagaccgttctgaatcagttgtttccaggctacggaaatggcaggtag

SEQ ID NO: 246101 - DNA, 3240 bp, Artificial Sequence
  Description of Artificial Sequence: Synthetic coding sequence
atgaagagctgcgcagtgagtctcactaccgcagctgtggccttcggagatgaggccaaaaagatggctgagggtaaggccagcagggagagcgaagaagaatcagtttctctgacagtggaagaaagggaagctttaggtggaatggactctagactgttcgggttcgtgcggctgcacgaggatggagcccgtaccaaaaccctgctgggtaaggccgtgcggtgctacgaatcgctgattctgaaagcggagggcaaggttgagagcgatttcttctgccagctgggacattttaatttactgctcgaggattactccaaagccctgtctgcttaccaaaggtactattcactgcaagctgactactggaaaaatgcagcatttctctacggtctggggcttgtgtacttctattacaatgccttccattgggctataaaagcctttcaggatgtcctgtatgttgatccttccttttgcagagcaaaggaaatccatctgcgcctcggcttgatgtttaaagtgaatactgactacaaatcctccctgaagcactttcagcttgccctcatcgattgcaacccttgcaccctgtctaacgctgagatccagtttcatatcgcccatctctatgagacacagcgtaagtaccactctgccaaggaagcctatgaacaattgctgcagaccgagaacctgcctgcgcaggtgaaggccactgtattgcaacaactgggctggatgcaccacaacatggatctggtcggcgataaagccacaaaagaaagttacgccattcaatacctgcagaagagcctcgaagccgatccgaattcaggccagagctggtacttcctcggccgttgttatagcagcattggaaaagttcaggacgcatttatctcttacagacagtctatcgataagtcagaggcatctgctgatacctggtgctctattggtgtgttatatcagcagcagaatcagccaatggatgctctgcaagcatatatttgcgctgtccagttggaccatggacacgcagctgcttggatggacctcggaaccttatatgagtcctgcaaccaaccccaggatgccattaaatgctatcttaacgccgcacgatcaaaacgctgttctaacacctctactctggctgcaagaatcaaattcctgcagaatggctccgataactggaatggcggtcagtccttgagtcaccatcccgttcagcaggtgtacagcttgtgcctgacaccccagaagctccagcatctcgagcagctgagggcgaacagagataaccttaatcctgcacagaaacatcaattggagcaactggagtcccaattcgttttaatgcagcagatgcgtcacaaagaagtggcccaggtccggacaacagggattcacaacggggctatcaccgactccagtctacccactaatagcgtctctaacaggcagccccacggagccttgaccagggttagcagtgtctcacagcccggagtgcggcctgcttgcgttgaaaagctgctttcctccggtgcgttctccgccggttgcatcccatgcgggacgtcaaagatactcgggagtactgacacaattctgctcggcagcaattgcatcgcgggttcagaaagtaacggcaacgtgccctacctgcagcaaaatacccatactctgcctcacaatcatacagacctgaatagctccaccgaagaaccctggaggaaacagctgagtaactcggcccaagggctccataaatcacagtcaagttgtctgagtggacccaatgaggaacagcctctgttctcaactgggagtgctcagtaccaccaggctacctcaaccggtatcaaaaaggctaacgagcacctgacactgccctctaacagcgttccgcaaggtgacgccgactctcacctgagctgccacaccgccactagtggtggtcagcagggaataatgttcacaaaagagagcaagccttccaagaacagaagtcttgtgcccgagacgagccgtcacactggagacacatcgaatgggtgtgccgatgtgaaaggtctctccaatcatgtacaccagctgatcgctgacgctgtttcatcacctaatcacggggattcgcccaacttacttatagccgataaccctcagctgtccgcactactgattgggaaggcaaatggaaatgtaggcactggtacctgtgacaaggtgaacaacatccatccggcagtgcacactaagacagaccactctgtcgccagcagcccgagttctgccatttccacagcaacgcccagtccaaagtccacagagcagcgttcaatcaactccgtgaccagccttaacagtccccattcggggttgcatacggtcaacggggaggggctgggaaaatctcagagctccaccaaggtagaccttccactagcctctcacaggtctacttctcagatacttccatccatgagtgtgtcaatttgtcccagcagcaccgaggtccttaaagcttgtcggaatccgggtaaaaatggcttgagtaattcatgtatcctactggataagtgtccgcctccacgcccacccacatccccctatccaccattgcctaaggataagctgaaccctcccactccaagcatctaccttgagaataagcgcgatgccttttttccccctctccaccagttctgcactaatccaaaaaaccctgttactgtcattcggggattggctggagccctgaagcttgatcttggactcttcagtactaagacactggttgaagctaataatgagcacatggtcgaagtcaggactcagctattacagcctgccgacgagaactgggacccgacaggcactaaaaagatctggcgttgcgaaagtaacaggagccacaccaccatcgctaaatatgcacaatatcaggcgtctagctttcaggaaagcctgcgcgcaggtatgcagtggtgtgatctgagctccttacaaccaccccctcccggttttaagcggttctcacatctgtcactgccaaactcttggaactatcgccaccttcccagctgtcccacaaacttctgcatcttcgtggaaacgggcttccaccacgtggggcaggcttgcctggagctgttgacatctgggggactgctggcgtcagcctcacaatcagcagggataaccggggtatcgcaccacgccagatag

SEQ ID NO: 246102 - DNA, 4044 bp, Artificial Sequence
  Description of Artificial Sequence: Synthetic coding sequence
atgaaatcctgtgcggtgagcctgaccaccgcagccgtcgcttttggtgatgaagcaaaaaagatggcagaaggcaaggcctcaagggaatccgaagaggagtctgtctcactgactgtggaagaacgtgaagctctgggaggcatggactcccgcctgtttggattcgttcgtctgcacgaggacggcgctagaactaaaaccctgctcggaaaggctgtgcggtgttacgagagtctgattctcaaagccgagggcaaagtggaaagtgatttcttttgccagcttgggcactttaatctgctgctggaggactattccaaagccctttcagcctaccagcgctattactccctgcaagccgactattggaagaacgcagccttcctttatggcttaggcctagtgtatttttactataatgcttttcactgggcaataaaggcattccaggacgtgctgtatgtagacccctctttctgtcgcgcaaaagaaatccacttgcggctgggactgatgtttaaagtcaatactgactacaagtcaagtcttaagcattttcaattagcgttaatagactgtaatccatgtaccctttcaaatgcggagatacagtttcatattgcccacttatacgaaactcagcgtaagtaccactcagctaaagaggcctacgagcaactcctgcaaacagagaacctacccgcacaggttaaagcaaccgtactgcaacaactgggctggatgcaccataatatggatttagtaggcgacaaggcaaccaaggagtcgtacgcgattcagtacttgcagaaaagcctagaggccgaccctaattccggccagagctggtattttcttgggcgttgctactcttccataggaaaggtgcaagacgcattcataagctaccgtcaaagcattgacaagagcgaagccagcgctgacacgtggtgttctatcggtgtgctgtaccagcaacagaatcagcccatggatgctttacaagcgtatatttgcgcagtacagttggaccatggacacgctgcagcatggatggacctggggacattatacgaatcctgcaaccagccacaggatgcaattaaatgctacctaaatgccgctcgctcaaagaggtgctccaacaccagcacgttggccgcaaggattaaatttctgcagaacggctctgataattggaacggaggtcaatctctgtcccaccaccctgtccaacaggtgtattcactgtgcctcacaccacaaaagcttcagcacctggagcagctcagagccaatagagataatctcaaccccgctcagaagcaccaactggagcagttagagagccagttcgtcctgatgcagcagatgcgacacaaggaagtcgcacaggtcaggactaccggcatccacaatggtgcaattactgacagtagcctgccaaccaatagcgtcagcaacaggcagccgcatggcgcactcactcgtgtgtcttcggtttctcagccaggggtcaggcccgcatgcgtggagaagcttctgtcatcaggggcattttccgccggatgcattccctgcggaacatccaagattctcggcagtacagacacaatcctcctagggagcaattgcatcgctgggagtgagagcaatggaaacgtaccatatctgcagcagaatactcacacattaccacataatcatacagacttaaatagctccaccgaggaaccttggcgaaagcagctgtcgaacagcgcccaaggccttcacaaatcccagtccagctgcctctcagggcctaacgaagagcaacctctgttctccacaggctcagcccagtaccatcaggcgacaagcactggaatcaagaaggccaacgagcacctgactctgccctccaacagtgtcccacaaggagatgccgatagtcacctgagctgccatacggccacctctggaggtcagcagggaatcatgttcaccaaagaaagcaaacccagtaagaatcgtagcttagtgcctgagacttcccggcacaccggggacacaagtaatggatgcgccgacgtgaaaggtctatccaatcacgttcaccagctgatcgccgacgctgtgtcaagtccaaatcacggcgattctcccaatctcctgattgcagataacccacagctctctgccctgctgatcggcaaagccaatggcaatgttggcacggggacctgtgacaaagtcaataatatccacccagctgtccacaccaagaccgatcattccgtcgccagctctccctccagcgccatcagtactgcaacaccaagtccaaagtccaccgaacagagatcaattaattcagtgacctctctcaattctcctcactccggcttgcacacagttaatggggagggtctcgggaagtctcaatccagcacaaaagtcgacttacccctcgctagtcaccggtccacctcgcagattcttccctcaatgtcggtttcaatctgccccagtagtacagaagtgctgaaagcctgtcgaaaccccggaaaaaacggtctgtctaactcctgtatactactcgacaagtgccctcctcctagacctccaaccagtccatatcctccacttcccaaggacaaactgaatcccccaacgccatcgatttatttagaaaacaagagagacgccttctttccccctttacaccagttctgcacaaaccctaagaatccggtcactgtaataaggggcctggctggcgcattaaagcttgacctggggctgttttctacaaaaaccctagtggaagccaacaatgaacacatggtcgaagttagaacgcagctgctgcagcctgctgatgagaattgggaccccaccggcaccaagaaaatctggaggtgcgagtctaacaggtctcatacaacaatagccaagtacgctcagtaccaagcaagtagttttcaagagagccttcgggaggaaaatgagaaaagaactcagcataaggaccattcagacaatgaatctactagctccgaaaattctggcagacggagaaaaggtcctttcaaaaccatcaagttcggaactaatattgacttatccgacaacaaaaagtggaagctccagctccacgaactgaccaaactacccgctttcgctcgggtcgtgagcgcagggaatctgctgacccatgtaggtcacacaattctgggcatgaatacagtccaactgtatatgaaagtgcccggttctcgaaccccaggtcaccaggagaacaataacttttgctcggtcaatatcaacattggtccaggcgactgcgaatggttcgtagtccccgaggactactggggcgtactaaatgacttctgtgaaaaaaataacctcaacttcttaatgagcagttggtggcctaacctcgaagacctctacgaggctaatgtcccagtttaccggttcattcagcggcctggcgacctcgtctggattaatgcaggcaccgttcactgggtccaggccgtcggttggtgtaacaatatcgcttggaacgttggacctcttactgcctgtcagtataagttagccgtggagagatacgaatggaataagttgaaaagcgtcaagtcccctgtacccatggtccacctgtcctggaacatggccagaaacatcaaggtgagcgatcctaagctcttcgaaatgattaagtactgtctgctcaaaatcttgaagcaataccaaacccttcgcgaggccctggtagcagcaggcaaagaagtcatttggcacggccgaactaatgatgaaccagcgcattattgtagcatctgtgaagtagaggtctttaacttgcttttcgtgactaacgagtccaatacgcaaaaaacttatattgtgcactgccacgactgtgccaggaagacttccaagtctttagaaaacttcgtggttctggagcagtacaagatggaggacctaatccaggtgtacgaccagttcaccctagccctgagtctgagctctagtagttag

SEQ ID NO: 246103 - DNA, 3723 bp, Artificial Sequence
  Description of Artificial Sequence: Synthetic coding sequence
atgaagtcatgcgccgtatctttaaccacggccgctgtggctttcggggatgaggccaaaaaaatggctgaaggcaaagcatctagagaaagtgaagaggagtctgtctctttaaccgttgaggagagggaggccttgggagggatggacagcaggctgttcgggtttgtgcggctgcatgaggacggggctcgcaccaaaaccctgttaggaaaggctgtgagatgctacgaaagccttatattaaaggctgagggaaaggtggagagcgattttttctgccaactcggccatttcaacttgctcctagaagactattccaaagccttatccgcctaccagcgatattactcactgcaggccgactactggaagaacgcagcctttttgtacggcttagggctggtgtatttttactataacgcctttcactgggcaatcaaggctttccaggacgtgctatacgtcgacccttcattctgccgggctaaagagatccatctcagactcggcctcatgttcaaagtaaatacagactataaatccagtctgaaacacttccaactggccctcatcgattgtaatccttgtaccctcagtaacgccgagatccagttccatatcgcgcacctgtatgaaacccaaagaaaataccacagtgctaaagaggcttatgagcagctgttacagactgagaacctgccagcacaggttaaggccacagttctgcagcaactcggctggatgcatcacaacatggacctggttggcgacaaggcaacaaaggagagttatgcaattcagtatctccagaagtctctggaagctgacccgaatagcgggcagtcttggtactttctggggaggtgctattcaagtatcggtaaagtgcaggacgctttcattagttacagacaaagtattgacaagagtgaagccagcgccgacacatggtgctctattggggtcctctaccagcagcaaaatcagcctatggacgcactgcaggcatatatctgtgccgtgcagctcgatcacgggcatgccgctgcttggatggacctcggcaccctgtatgagtcctgcaaccagccacaggatgccatcaaatgttacctaaacgccgcacgaagcaagaggtgctcgaatactagtaccctggccgcaagaattaaattcctacaaaacggaagtgacaattggaacggagggcagtcactttctcaccaccccgtgcagcaggtctatagcctctgtctgaccccgcagaagctgcagcacctcgagcagctccgtgccaaccgcgataatcttaaccccgcacaaaaacaccaactggaacagttggagtcacaattcgtgctgatgcagcagatgcgtcataaggaggtggctcaggtgaggaccactgggatacataatggggcaattaccgatagctctctgccaaccaactcggtctccaatagacagccacacggcgctctaaccagggttagctccgttagccagcctggggttcggcctgcttgtgtagaaaaactgttgagctcaggtgccttcagtgctggttgtattccctgtggcacctcaaaaatcttaggaagtactgacacgattcttctggggagcaattgtattgccggatctgagtcaaatggtaacgtgccatatctacagcagaacacacacaccctcccccacaatcacaccgatctcaatagcagcacggaggagccatggcgtaaacagttatctaactcagcccagggactccacaagtcacagagtagttgcctgagcggcccaaacgaagagcaaccactattctcaaccgggagtgctcagtaccatcaggccacgtccacagggattaagaaggcgaatgagcacctgactttaccttccaatagcgtccctcagggagatgccgactcgcacttgtcgtgccacactgccacctcgggaggccagcagggaatcatgtttaccaaggaaagcaagccaagcaaaaatcggagtcttgtgccagaaaccagtaggcatacaggcgatacttctaacgggtgtgcagacgtgaaaggactgtcaaaccatgttcatcagttgatcgccgacgccgtttcctctcccaaccacggggactctcctaatctgctgatcgccgacaatccccagctatcagctctgctgatagggaaggccaatggaaacgttggtaccgggacatgtgataaagtaaataacattcatcccgctgtgcatacaaagacagaccacagcgtcgcaagctccccctcctcagcaatctctaccgccacacccagccctaagtcgacagaacagagatctattaacagcgtgacgagcctaaatagccctcattcggggctacatactgtcaacggagagggcctggggaaatcccagtcttctaccaaggtggacttgcccctcgcttctcaccgctcaaccagccagatactgccatctatgtccgtgtcaatttgtccatcatctaccgaagtgctaaaagcgtgtcggaaccctggcaaaaatggcctgtctaactcatgtattttactggataaatgccccccaccaagacctcccacgtctccctatccgcctcttcccaaagacaagctaaacccgcctactcccagcatctacctcgagaacaagcgggatgcattctttcctccacttcatcaattttgcaccaacccaaagaatcccgtgactgtaattaggggcctcgccggtgccctgaaactagatctcggacttttctccactaaaactttggtggaagccaataacgagcatatggtcgaagtccggacgcagctgctgcagccagccgatgaaaactgggaccccactggcaccaagaagatttggaggtgtgaatccaacaggtcccacactaccatcgccaagtatgcccagtaccaggccagtagcttccaagagtccttacgcgaagagaatgagaaaagaacccagcacaaagatcacagcgataacgaatccacatcgagcgagaattctggcaggaggcggaagggtccttttaagaccataaagttcggaaccaatatcgacctatcagataacaaaaaatggaagcttcagctgcacgagctgacgaaactaccagcgttcgctagagttgtgtccgccggaaacttactgacgcatgtcggtcacacaatcctcgggatgaacactgtgcagctgtatatgaaagtcccagggtctcgaactcccggacaccaagagaataacaatttttgttcagtcaatatcaacattgggccaggcgactgtgagtggttcgtcgtacctgaagattattggggggttttgaacgatttctgtgaaaagaataacctgaacttcctgatgtctagttggtggccgaatctagaggacctgtatgaagccaatgtccctgtctatcgttttattcagcgcccaggagacctcgtatggattaacgcaggtacagtgcattgggtccaagctgtggggtggtgcaacaacatcgcctggaatgttgggcctctcactgcctgtcagtacaaactagcggtagagcgctacgagtggaataagctcaaatccgtgaaaagccccgtcccaatggttcacctaagttggaacatggccaggaacattaaagtgagcgacccgaaattgttcgagatgattaaatag

SEQ ID NO: 246104 - DNA, 624 bp, Artificial Sequence
  Description of Artificial Sequence: Synthetic coding sequence
atgaaatcatgtgccgtgagcttgactacagccgcagtggcatttggagatgaggccaagaagatggctgaagggaaagcgtcacgggagtcagaagaagaatccgtgtccctaaccgtggaggagagagaagctctcggcggtatggactcccggttatttggctttgtacgattgcatgaggacggggctaggaccaaaactctcctcggcaaggcagtcagatgctatgagagtctcatactgaaagccgaggggaaagttgaaagtgactttttctgccagcttggccactttaacctgcttctggaggattattcaaaagccctctcagcatatcaacgatactatagtctgcaggctgattactggaaaaacgctgcctttctgtacggactgggattagtctacttttactacaacgcatttcattgggccataaaagcatttcaggatgtgctgtacgtggatcccagtttttgcagagcgaaggaaattcatctgcggctcggtctgatgtttaaggtgaataccgactacaagtcaagccttaaacacttccaactggcactcattgactgcaacccatgcacactttcaaacgccgagagcaagtacttctag

SEQ ID NO: 246105 - DNA, 4179 bp, Artificial Sequence
  Description of Artificial Sequence: Synthetic coding sequence
atgaagagctgcgcggtctcactgaccacagccgcagtagcttttggcgatgaggcaaagaagatggccgagggaaaagccagtagggagagtgaggaagagtcagtctctctaaccgtcgaagaacgagaggccctgggcggaatggactctagactctttggcttcgtgagactccatgaagacggcgcacgaactaaaaccctgctcgggaaggcggtcagatgctatgagagcctgattttaaaggccgagggtaaagtggagagtgatttcttttgccaattaggtcactttaatctgttactggaggactacagtaaggccctttccgcttatcagcgctattactctttacaagccgactattggaagaatgcagcattcttgtatggacttggccttgtgtacttttactacaacgctttccattgggccattaaagcctttcaagatgttctgtatgtggacccctccttttgtcgcgcaaaagagatccacctcagactcggcctgatgtttaaggtcaataccgattacaagtccagcttgaaacactttcaactagccctgatcgactgtaacccttgcaccctgtccaacgcggagatccagttccatatcgcccacctctatgagacccaacggaagtaccactctgcaaaggaagcgtacgagcagctgcttcagaccgagaacctaccagctcaggtgaaagcgacagtactccagcagctgggttggatgcaccacaatatggatctggtaggcgacaaggcaactaaagagagttatgcgatccagtatcttcagaaatcactggaggctgatcctaactccggtcagagctggtactttctgggaagatgctatagcagtatcgggaaggtgcaggatgcattcataagttatcgtcagtctatagacaagtccgaggctagcgcggacacctggtgcagcatcggggtgctctaccagcaacaaaatcagcccatggatgcattacaggcctacatctgcgccgttcagctagaccacgggcacgcagccgcatggatggatttgggcaccctgtacgagtcttgcaaccaaccccaggacgccattaagtgttatctgaacgcagccaggtccaagcgctgctcgaatacttctactcttgctgcacgcatcaaatttttacaggcacagctgtgtaaccttccacaatcctccctgcaaaacaaaacgaaacttttaccaagtatagaagaggcatggtccctgcccataccggctgagctcacatccagacagggtgctatgaatacagcacagcagaatgggtcagataactggaatggcggacagtccctttctcaccatcctgtccagcaggtatatagtctctgtcttactccacagaagttacagcacttggagcagctccgggctaatcgcgataatctgaacccagcccagaagcatcagttagaacagctcgagagccagtttgtgctaatgcagcagatgagacacaaagaagtggcccaagtgcggacaactggtatccacaatggtgctatcaccgactcctcactccccactaatagtgttagtaaccgccagccccacggtgcactcaccagggtatccagtgtgagtcagcccggagtaagacccgcatgcgtggaaaagctgctgtcatccggcgcattctccgcaggatgtatcccatgcgggacaagtaaaatactgggatccaccgacaccatacttttgggctcaaattgtattgccggatcagagtctaatggcaatgtgccctacctacagcaaaatacacacaccttgccacataatcacacagatcttaatagctccacagaggagccatggaggaaacagttgtcaaactcggcgcagggactacacaagagccagtcatcatgcctgtccggacctaacgaggaacagccattattttccaccgggagtgcccagtatcaccaggctacgtctaccggaattaagaaagccaacgaacatctgaccctgcctagcaacagcgtgccccaaggggacgcagacagccacctctcttgtcacactgccacttcaggcggtcagcagggaattatgttcacaaaggaaagcaaaccttccaaaaataggtcattagtgcccgaaacaagtcggcacacaggggacactagcaatggatgcgcagatgtgaagggcctcagcaatcacgtgcaccagttgatcgccgacgcagtgtcatccccaaatcacggagattctcccaatctcctgatagctgacaacccccagctgagcgctctgctgatcggcaaggccaatggaaacgtggggacagggacctgtgataaggtaaacaatatccatcccgctgtccacaccaaaaccgaccattctgtagcttcatccccatctagcgccatttctacagcgaccccttcccctaaatccaccgagcagaggtccattaactccgtgacctctctcaatagcccccacagtgggttacataccgtcaatggcgagggactgggaaagagccagtcgagcaccaaagtagacctgcccttagcctcacacaggtctacaagtcaaatccttccctctatgtccgttagcatctgcccttcttccactgaagttctcaaagcgtgtcgtaatccgggtaagaatggcctgagtaactcatgtattctattggacaaatgcccaccacctcgaccaccgactagcccatacccgccacttccaaaagacaagctcaatccccctacaccatcaatatacctggaaaataaacgcgacgcgtttttcccacctctgcaccagttctgcacaaacccaaagaacccagtgactgtgattcgcggattagcaggagctctgaagctggatttaggattgttcagtactaaaactcttgtcgaagctaacaatgagcacatggtggaggtgcggacgcagctgcttcagccggctgatgaaaattgggatcccactggcaccaagaaaatctggcgctgtgagagtaatagatcccatacgactatcgcaaagtacgcccaatatcaggcttcaagtttccaagagtcacttcgggaagaaaacgaaaaaagaacacagcataaagaccactcggataacgaaagtaccagcagcgagaacagtgggcgtaggagaaagggcccttttaaaaccattaagtttggcaccaacatcgacctgtccgacaataagaagtggaaactgcagctgcacgagctgacaaagctgcccgcttttgccagggtagtgtccgctggcaatctgttgacccacgttgggcataccattctgggcatgaacacggttcaactgtacatgaaagttcctggtagccgcacccccggacatcaggagaataacaacttttgcagcgtaaacatcaatattgggcctggcgactgcgaatggttcgtggtacctgaggactattggggggtcctgaatgatttttgtgaaaagaacaatttgaatttcttaatgtctagttggtggcccaacttggaagatctctacgaagccaatgtcccggtgtatcgatttatccaacgtccgggtgacctggtttggataaacgccggtactgttcactgggtgcaggcggttgggtggtgtaataatatcgcctggaatgtgggccctctgactgcctgtcagtacaaacttgctgtggagaggtacgagtggaataagctgaaaagcgtgaaaagtccagtcccaatggtgcacctgtcgtggaatatggcccgtaacatcaaggtctccgatcctaaacttttcgaaatgataaagtattgtctgcttaaaattctgaaacaataccagactctgagagaagcactcgtcgccgcaggcaaggaagtaatctggcatggtcgaactaacgacgaacctgcccactattgttccatttgcgaggtcgaagtcttcaacctcttgtttgttactaacgagagcaacacccagaaaacctacatcgtacattgccatgattgtgctcgcaagacaagcaagtcactagagaactttgtggtgctggagcagtacaaaatggaggaccttatccaggtatatgatcaattcactctggctctctccctgtccagttccagctag

SEQ ID NO: 246106 - DNA, 3636 bp, Artificial Sequence
  Description of Artificial Sequence: Synthetic coding sequence
atgaagtcttgtgctgtgagcctgaccaccgctgctgtagccttcggagatgaagcgaaaaagatggccgaaggcaaggcgagcagggagtctgaggaagaaagcgtcagccttaccgttgaggaacgggaagctttggggggaatggatagcaggttgttcgggtttgttcgccttcacgaggacggagcgagaactaaaacgctgttggggaaggctgtgcgttgctacgaatccctgatcctcaaagcggaggggaaggtggaatcagacttcttttgtcaacttggacactttaatttgcttctcgaggattactccaaggctctgagtgcctaccagagatactacagcctgcaggccgattactggaaaaacgccgcattcctatacggtcttggactcgtgtacttttattacaatgcatttcactgggccataaaggctttccaagacgttttgtacgtagatccatctttctgccgcgctaaggagattcatctaaggctgggtctgatgtttaaggttaacacagattataaatcatctcttaagcactttcagcttgcgctgatcgattgcaacccctgcactctgagcaacgccgagatccagtttcacattgctcacttgtatgagacacagagaaagtaccatagcgccaaggaagcctatgaacagctgttgcagacagagaatctgccggcacaggtgaaggcaacagttctgcagcaactgggctggatgcatcacaatatggatctggtgggcgataaggccactaaggaatcgtacgcaatccaataccttcaaaaatctcttgaggccgatcctaacagcgggcagtcctggtatttcttgggacgatgctattcctccatcggcaaagtccaggacgcatttataagttatagacagtccatagacaaaagcgaggctagcgcagacacctggtgtagtatcggggttttataccagcaacaaaaccagcccatggacgctctccaggcctatatttgtgcagtgcagctggaccacggacacgccgctgcctggatggacttaggaaccctttacgagtcatgcaatcaacctcaggacgcaatcaagtgttacctcaacgcggcacgctctaagcgctgtagtaacactagcacgctggctgctagaatcaaatttctgcaggcgcaactatgtaacctgccacagagtagtttgcagaataaaaccaagctgctgccaagtatcgaggaagcgtggtcgttgccaatccccgctgagctcacctctagacagggtgcaatgaacaccgcccagcagaacgggtccgacaattggaatggtggccaaagcctatcccaccatcccgtgcagcaggtgtatagcctgtgcctgacaccgcaaaaactgcaacacctggaacagctccgggcaaatagggataatcttaatcctgcccagaagcaccaacttgaacagctcgaaagccagtttgtattgatgcagcaaatgcgtcacaaggaggtggctcagggactgcataaatctcagagttcatgcctctctggtcccaacgaggaacagccactgtttagcactggcagtgcacagtaccatcaggctacctccaccggaattaagaaagccaacgagcacctgacattgcccagtaacagcgtaccccagggcgacgccgactcccatctgtcatgtcatactgccacctcaggaggacagcaaggaattatgtttactaaggaaagcaaaccatccaagaatcgaagtctggtacctgaaacatctcgtcatactggcgatacttccaatggctgcgcggatgtgaagggtctttccaatcacgtgcaccaactgattgctgacgctgtttcctcacctaaccatggagactccccaaatcttctcatcgccgacaacccacaactgtccgctctcctgataggaaaggccaacgggaatgtcggcacgggcacatgcgacaaggtcaataatattcaccctgctgtacatacaaaaactgatcactcagttgcaagcagccctagctcagcaatctcaactgccaccccttctccaaagtctaccgagcagcggtctatcaactccgtgacatccttgaattccccccattccggtctgcacactgtgaacggcgagggtctgggtaagagccagagcagtaccaaggtcgacctgccactggccagtcacagatctaccagccagattctcccttcaatgagcgtgtcgatttgtcccagttcaacagaggttttgaaagcttgccggaaccccggaaagaatggtctaagcaatagttgtatcttgctcgataagtgtcctcccccacggccacccacttccccttatccacccctaccaaaagacaaactcaacccccctactccatctatttatctcgaaaataagagagacgcattcttcccacctctgcatcagttttgtaccaatcccaaaaaccctgttaccgtaattaggggcctggccggagcgctgaagttagacttgggactatttagcactaagaccctggtcgaggcgaataacgaacatatggtcgaggtgcgtacccagctgttacagcctgcagacgagaattgggaccccacagggacaaagaagatttggagatgtgaatccaaccgatcccacaccaccattgctaagtacgcccagtaccaagccagttcattccaagaatctctgagagaggagaacgaaaagcgaactcaacataaagatcactctgacaatgaatctactagctcagagaactctggcagacgacgcaaaggccctttcaaaaccattaagttcggcactaacatcgaccttagcgacaataaaaaatggaaactccagttgcatgagcttacgaagttgcctgctttcgcgagggtggtgtccgccggtaacctgctaactcatgtggggcatacgatcctgggcatgaataccgtccagctatacatgaaggtgcccggatcgaggactcctggccaccaggaaaataacaacttttgtagcgtcaacataaatattggccctggagattgtgaatggttcgtggttcccgaagattactggggcgtactgaatgatttttgtgaaaaaaataacctcaatttcctgatgtcatcgtggtggcctaacctagaggacctgtacgaggccaacgtaccagtctataggtttatccagaggcctggcgatctagtgtggatcaatgctggcacagtccactgggtccaggccgtggggtggtgcaacaacatcgcttggaatgtgggtccactcactgcatgccagtacaaactggccgtggagaggtacgagtggaacaaactgaaatccgtgaagtcaccagtgccaatggtgcatctctcctggaatatggctagaaatatcaaggtgtctgatcccaagctattcgaaatgatcaagtactgcctccttaagattctgaagcagtatcaaacactgagggaggcattggtagctgccggaaaggaggtcatctggcacggcaggacaaacgatgagcccgctcactattgtagcatttgtgaagctttgagtctgtcttcgtcttcctag

SEQ ID NO: 246107 - DNA, 3141 bp, Artificial Sequence
  Description of Artificial Sequence: Synthetic coding sequence
atgaaaagctgtgccgtgtccctcacaactgccgctgtggcattcggcgacgaggccaagaagatggccgaggggaaggcaagtagggagtcagaggaagagagcgtcagtctcacggtggaggaacgggaagcactcggaggtatggacagtaggctgttcggctttgtgagactgcacgaggacggggcacggaccaaaaccctcttaggaaaggccgtgaggtgttacgaatctctcatcctcaaagcagagggaaaagtcgaatcggacttcttttgtcagttgggccattttaacttgctgctggaggactacagtaaggcactctccgcgtatcaacgatattacagccttcaggctgattattggaagaatgccgcattcctctatggactcgggctggtatatttttactacaatgcatttcactgggcaatcaaggctttccaggacgtgctctacgtggaccctagtttctgcagggccaaggagatccacctccggctgggtctgatgtttaaagtgaataccgactacaaaagtagcctcaagcacttccagctggccttgatagactgcaatccttgcaccctctccaacgccgagatccaattccacatcgcccacttatatgaaacacagcgtaaatatcactccgcgaaggaagcttacgagcagctgttgcaaacggagaacctccccgcacaagtgaaggccacagtactccagcaacttgggtggatgcaccataacatggacctggtgggcgataaagccacaaaggagtcgtacgcgatccagtatctccagaaaagcctggaagccgatcccaattctggacagtcttggtactttttaggctccgtgctgtatcagcaacagaatcagcccatggacgctttacaagcttatatttgtgccgtccaacttgaccatggtcacgcagcagcctggatggatctgggtactctgtatgagagttgtaatcagccccaggacgccattaagtgttatctgaatgcggctcgatccaagcggtgcagtaacacatccaccctggcagcaagaatcaagttcttgcaaaacggaagcgacaattggaatgggggtcagagcctgagccaccatcccgtgcagcaggtgtactcgctctgcctgaccccacagaaactccaacatctggagcagttacgagctaatagagacaaccttaaccccgctcagaagcaccagctagaacaattagagtcccaattcgtactcatgcagcagatgcggcacaaggaggtggcacaggttcgcactaccggaatccacaatggggctatcaccgattcttcattgccaacaaattctgtctctaaccggcagccacacggagccttaactcgcgtttcctcagtgagccagccaggtgtcagacccgcatgcgttgagaagctcctctcgtctggagcattttcagctggctgtatcccttgcggtacctcaaaaattctcggttcgaccgacaccatcctgctggggagcaattgtatcgctggatccgaaagcaatggaaatgtaccctatctgcagcagaacacacacaccctgccccacaatcacacagacttgaactcctcaaccgaggagccttggcgcaaacaattgagtaatagcgcccaggggctccataaatcccagagcagttgtctgagcggtcccaacgaggaacagccattgttctcaacgggctcagcccagtaccaccaggctacttcgacaggaatcaagaaggctaacgagcacttgacactaccttcaaacagcgtgccccagggagacgccgactcacacctgagttgccatactgccacctcaggcggacagcagggaatcatgtttacaaaagagtctaagcctagtaaaaatcgcagccttgttcctgaaacaagcaggcatacgggagacacaagtaatggatgcgctgatgtaaaggggctgtccaaccatgtccatcagctcattgcagacgctgtatcgtcacccaatcacggcgatagtccaaatctgcttattgctgataatccacagttatcagcccttctgatagggaaggctaatggaaacgtaggtacagggacctgtgataaggtcaataatattcaccctgccgttcacacaaaaacggaccacagtgtggcctctagcccatccagtgcaatttcaactgccacccccagccctaagtctaccgaacagcggagcatcaattctgtaacgtccctgaattctcctcacagtggcctccacacggtgaatggtgagggcctgggtaagtctcagagctctaccaaggttgatctaccactggccagccacagaagcactagccagattctaccatccatgagcgtatctatctgcccttcttcgacagaggtacttaaggcctgtcggaatcccggtaagaatggactgtccaactcctgtattcttctggataaatgcccccctcctagaccacccacttcaccttatcccccactgccaaaagacaaactgaacccacccaccccatcgatatacctcgaaaataaacgggatgctttctttcctccactccaccagttttgtacaaacccaaaaaaccccgtgacagtgatacggggacttgctggggctctcaagctcgatttaggcctgttctccaccaagacactggtggaggccaataacgaacacatggtggaggtgcgtacacaactgctgcaacctgctgacgaaaactgggaccccacaggaaccaaaaaaatttggcggtgcgagagtaataggagccataccaccattgccaaatatgcccaataccaggcatccagtttccaggagagtctgagggcaggcatgcagtggtgcgatttgtcatctttacaaccccctccacctgggttcaaacggttctcccatctaagccttcccaatagctggaattaccgccacctcccatcttgtccaactaatttctgtatctttgtagaaacaggattccaccacgttggccaagcgtgtctagaactgctgacgtccggaggactgctggcttcagcatcgcagtctgctggcatcactggagtctctcaccacgcacgctag

SEQ ID NO: 246108 - DNA, 3018 bp, Artificial Sequence
  Description of Artificial Sequence: Synthetic coding sequence
atgaagtcctgcgctgtatctctcaccacagcagccgtggccttcggcgatgaggccaagaaaatggccgagggcaaggcaagtagggagagtgaagaggagtcagtctctctgactgtagaggaacgggaggcactaggtggcatggactccagattgttcggcttcgtccgcctgcacgaagacggggctcggaccaagaccttgctgggaaaagccgtacgctgctatgagagcttaatactgaaagcggaggggaaagttgaatcagactttttctgccagctaggtcacttcaacctgctgttagaggactactccaaagctttgtccgcataccagagatattactcccttcaagccgactactggaagaatgctgcttttctctatggcctgggcctggtatatttttattataacgccttccactgggcaatcaaggcattccaggatgtgctgtacgtagatccatcgttctgccgcgcaaaagagatacacctgcgtctgggactaatgtttaaagtgaatactgactacaaaagctctctcaagcacttccagctggccctaatcgactgcaatccttgcacactgtccaacgccgagatccaattccacatagctcacctctacgagacgcagcgcaagtaccattccgccaaagaggcttacgaacagctgctacagactgaaaacctgccagcccaggtcaaagctaccgtcctgcaacagctgggctggatgcaccataatatggatctggtgggcgacaaggccaccaaggagtcttatgctatacagtacttgcagaaaagcctcgaagctgatcccaactcaggtcagtcatggtacttcttgggctccgtgctgtaccaacagcaaaaccaacctatggatgcactgcaggcttacatttgcgccgtccagcttgatcacggacacgccgcagcgtggatggatctcgggacactgtacgagagctgtaaccagccccaagatgctattaaatgctacttgaacgcagctcgatcaaagcgttgttctaatacaagcactctggcggcaagaataaaattcctccagcaatccctgagtctgcacatgatcacaagctcgcaggtggagggcctctcatccccagcaaagaagaagcgtacttcgagccctacaaaaaacggaagtgataactggaatggcggacagagcctgagtcatcatccagtgcagcaggtttatagtctctgcctgactccacagaagttgcaacatctggaacagctccgggcaaatagagacaacctcaacccagctcagaagcaccaacttgaacagcttgagtctcaatttgttcttatgcaacaaatgaggcacaaggaagttgcccaggtgcggactacaggcatccataacggagcaatcactgattcctcattacccactaacagtgtgtctaatcggcagccccacggggcactgacccgcgtttcatccgtgagccagcccggagtgagacccgcttgcgtggagaaactgctgagctccggcgctttcagcgctggctgcattccctgcgggaccagcaagatcctgggatcaaccgacaccatcctattaggctctaactgtatcgctggtagcgaaagtaacggcaatgtcccctacctgcagcagaacacccataccctccctcataaccacaccgacttaaatagttcaacagaggagccttggcggaaacagctgagcaactctgctcagggattgcacaaatcacaaagtagttgcctgtccgggccaaacgaggagcagccgctgttctctactggcagcgctcagtatcatcaggcaacatcaaccgggattaagaaggccaatgagcacctgaccttgccgtccaatagtgtccctcagggggacgcggactcacatctgtcttgtcacactgcaacgagtgggggtcagcaaggcatcatgtttaccaaagaaagtaaaccctccaagaaccgatcattagtgccggagacctctcggcatactggcgataccagcaacgggtgtgccgatgttaaaggcctgtcaaaccacgtgcaccagctgattgcagacgccgtatcttcccctaaccatggagactcacctaacttgttaattgctgataatcctcagctctctgccctacttattggaaaagccaatggcaacgtcggcacgggcacctgcgataaagtaaacaatatacaccccgcagtccacactaaaaccgaccactccgtggcttcgagccccagcagtgctatatccacggcaacaccttcaccaaagtccacagagcagagatctattaactcagtgactagccttaacagcccgcacagtggccttcacacagttaacggtgagggtctaggtaaaagccagagctccacaaaggtggacctaccgctggctagtcaccggagtaccagccaaatactcccctcgatgtctgtatctatctgtccatctagcactgaagttttgaaagcctgtcgtaaccccggaaagaatggactatcaaactcttgtatcctgctcgataaatgcccgccacctagaccgcctactagtccttaccccccacttcccaaagataagctcaatccccctaccccaagcatctacctggagaacaagcgggacgcatttttcccccctctgcatcagttctgcacgaaccctaagaatcccgtgacagtcatccgagggctggctggcgctctcaagctggacctgggcttattctccacaaaaactttggtcgaagcgaacaatgagcacatggtagaagtgcgtacacagctgttgcaaccggcagatgaaaattgggaccccaccggcactaaaaagatctggagatgtgagagtaatcgttctcacaccactattgctaagtacgcccagtaccaggcatcaagcttccaggaatcgctccgatccctgattctgagtcatccaggatggaatgccatggtgtag

SEQ ID NO: 246109 - DNA, 3213 bp, Artificial Sequence
  Description of Artificial Sequence: Synthetic coding sequence
atgaaatcctgcgccgttagccttacaacggccgctgtcgcttttggggatgaagccaaaaagatggcggaaggcaaagcatctagggaatccgaggaagaatctgtgtccttaacagtggaagaaagggaggctctggggggaatggactctcggctcttcggctttgtgcgcctgcatgaagacggggctcgaaccaagactcttctgggaaaggccgtgcgttgttacgagagcctcatactgaaggctgaggggaaggtagagtctgacttcttctgtcagctgggacacttcaatctgcttctcgaggattattcgaaggctctctccgcttatcagcgctactacagtcttcaagctgactattggaagaacgccgctttcttgtatggactcgggttggtgtacttctattacaacgcttttcattgggcaattaaggcctttcaggacgtcctgtacgtagaccctagtttttgtagggccaaggaaatccacctgcggcttggcttaatgttcaaggtgaatacagattataaaagttctttgaagcattttcagcttgccttaatcgactgtaatccttgcactctgtcaaatgctgaaattcaatttcatatagcacatctttatgaaacgcagcgaaaataccattctgcaaaggaggcctacgagcaactattgcaaactgagaatctgcccgctcaggtgaaggcaacagtgctccaacaactgggctggatgcaccacaacatggacttagttggagataaagccacaaaggaaagttatgctatccaatatctgcagaaatctcttgaggctgaccctaatagcgggcaatcttggtactttctgggcaggtgttattcaagcatagggaaggtgcaggatgccttcatttcatatcgccagagcattgacaaatctgaggcttctgcagacacttggtgctcaatcggagtcctatatcaacagcaaaaccaaccaatggacgccttacaggcttacatctgcgcggtccagctggatcatggacacgctgccgcatggatggacctaggtaccctgtacgaatcatgtaatcaacctcaagacgctatcaagtgttacctcaacgccgcacggtcaaagcgttgcagtaacacctccaccctggcggcaaggattaagttcctgcaggcacagttgtgcaacctgccgcagagttctctgcagaacaaaaccaagttactgccatctattgaggaagcttggagcctgcccatccccgcagagttgactagtaggcaaggggcaatgaacacagctcaacagcaaagcctatcactgcatatgatcacctcatctcaggtggagggattatcttccccggcaaaaaaaaagcggacctccagtccaactaagaacgggagtgacaattggaacggtgggcagagcctcagtcatcaccccgttcaacaagtgtattcactgtgcctgacccctcagaaacttcagcacctggagcagttgcgcgcaaaccgtgataacctaaaccccgctcagaaacaccagctggagcagctggaaagtcaattcgtcctaatgcagcagatgcgtcataaagaggtagctcaggtccggaccacgggtattcacaatggtgcaattacggatagttccttgcctaccaacagtgtgtcaaacaggcagcctcacggcgctctgacccgggtcagttccgtatcccagccaggtgtgcgacctgcatgcgtggaaaaacttctttcaagtggggcattctctgcaggatgcatcccatgcgggacgagcaagatcctggggtctaccgatactatcctactggggtctaactgcatagctgggagcgagagcaatgggaatgttccctacttgcagcagaacacccacaccctgccacacaatcataccgaccttaatagtagtacagaagagccgtggaggaagcagctctctaattccgcccagggattgcacaaatcacagagcagctgtctgagtgggcctaacgaggagcagccactgttctcaacggggtcagcacagtaccaccaggccaccagcactggcattaaaaaagccaatgagcaccttacactcccatctaactctgtcccccagggagatgcagacagccacctcagctgtcatacagcgacttctggtggacagcaggggatcatgttcactaaagagagcaagcctagcaagaatcgctcattagttcctgagacttcaagacataccggcgacacctccaacggatgcgctgacgtcaaggggctgtccaaccatgtccaccagttgattgctgacgcggtttcaagcccaaatcacggagattcacctaacctgctaattgcagacaacccccagttatctgctcttctcatcggaaaagccaacggcaacgtgggaacaggtacctgcgataaggtgaataacatacatccagctgtccataccaagactgaccacagtgtggcttcaagcccaagctccgcaattagtactgccaccccctctccgaagagtacagagcaacgatccatcaactcagtgacaagtctgaacagcccccattctgggcttcatacagtcaacggagaaggcctgggtaagagccagagcagtactaaggtggacttacccctggcatcacaccgaagcacttcgcaaatactgccatccatgagtgtgtccatttgtccctccagtaccgaagtactgaaggcttgccggaacccaggtaaaaacggcttaagtaattcctgcatactcctcgacaagtgtccgccacccaggccacctacgtccccctacccacctctgccaaaggacaaactcaatccgccaacccctagtatttacctggaaaacaagcgcgacgccttcttccctccccttcaccagttttgcacaaatcccaagaatccagttactgtgatcagagggctggccggagccttaaaactggacctgggactcttttccaccaaaaccctggtggaggctaacaacgaacatatggtggaagtgagaacccagttgctgcaacccgctgatgagaactgggatcccacggggaccaagaaaatctggcggtgtgagagcaatcggtcccataccaccattgccaaatatgcccagtatcaggcatcttcattccaggagtctctgcgatag

SEQ ID NO: 246110 - DNA, 798 bp, Artificial Sequence
  Description of Artificial Sequence: Synthetic coding sequence
atgcccaatatggtattcatcgggggtataaactgtaaaaagcgtaaggatctctcccaggaattcgaggcatacattaacgcttctggcgaacatggtatcgtggttttctccctaggaagtatggttagtgaaatccctgagaaaaaggctatggccatagctgatgctctgggcaagatcccccagactgtgctgtggcgatatacaggcacccggccaagcaatctggcaaacaacaccatactcgttaagtggctgccacagaatgacctcctgggacacccaatgacaagagccttcatcacacacgcgggaagccatggggtctatgagagtatctgcaatggcgtgccgatggtgatgatgccgcttttcggcgaccaaatggacaacgctaagaggatggaaactaagggcgcaggtgtgacactcaacgtgttggagatgacaagtgaagacctcgaaaacgctctcaaagccgtaattaatgacaagtcatataaggagaacattatgcgactcagcagcctgcacaaggatcggccagtcgagcctctggatttggccgtattttgggtggagtttgtcatgagacacaagggcgcacctcacctgaggcccgctgcccacgatctgacttggtaccagtaccactctcttgatgttatcgggtttttgttggccgtcgttctgacggtggcttttatcacgttcaaatgttgtgcttacggatatagaaaatgtctgggaaagaaaggccgtgtcaagaaagcacataagtccaaaacgcactag

SEQ ID NO: 246111 - DNA, 1605 bp, Artificial Sequence
  Description of Artificial Sequence: Synthetic coding sequence
atggccaccgggctacaggtccccctaccccagctggcaaccggtctcctgcttctgctgtctgttcagccctgggcagagtcaggaaaggtgttagtggtacccacagacggatcacactggttaagcatgcgggaagccctgcgcgacttgcacgcacgagggcatcaggtagtggtactcaccctggaagtcaacatgtacatcaaagaggagaatttcttcactcttaccacatacgccatctcctggacccaggatgaatttgaccgactgttgcttgggcatacacaaagtttctttgagaccgaacatttactcatgaaattttctcgcaggatggccattatgaacaatatgtctttgataatacatcgttcatgcgtggagctgctgcataatgaagccctcattaggcatctacacgcaacctcgtttgacgtcgttctcacggaccccttccatctctgcgccgcagtcctggcaaagtatctcagcataccagcggttttttttcttaggaacattccatgcgacctggacttcaaaggcactcaatgtccaaacccttcatcctacatcccacggctgctgaccaccaattctgatcatatgaccttcctgcaacgcgtcaagaatatgctgtatcccctagccctatcctacctctgtcatgcagttagcgccccttacgcctccctcgccagcgaactgtttcagcgggaggtttctgtcgtggatttagtcagccatgcttccgtgtggctcttccgcggtgacttcgtgatggactatccaaggcccatcatgccaaacatggtgtttataggcggtataaactgcgccaacgggaaaccactatctcaggaattcgaggcatatataaatgcctccggggagcatggtatagttgttttcagtctaggatctatggtgtcagagattccggagaagaaagcaatggccatcgccgacgccctaggtaagattccccagaccgttttgtggagatacacaggcaccaggccttctaatctggctaataatactatcctggtgaaatggctcccacagaatgaccttcttggtcaccccatgactagggcctttataactcacgcaggatcacacggtgtttacgagagcatctgcaacggggtaccaatggtgatgatgcctctgttcggggaccagatggacaatgcaaagcggatggaaaccaagggggcaggagtgacactgaatgtgttagagatgacatcagaagatttggagaacgctctgaaagccgttataaacgacaaatcatataaggagaacattatgaggttatctagtctccataaggaccgtcccgtcgagccactggacctggcggtattctgggtcgagtttgtgatgcgccataaaggggctccacacctgcgacctgctgcccacgatctcacttggtatcagtatcactctttggacgtgattggctttctgcttgccgttgtactcactgttgcctttattaccttcaagtgttgtgcctatggctaccgcaagtgtctgggaaagaaagggagggtgaaaaaggcacacaaatccaagacccattag

SEQ ID NO: 246112 - DNA, 1599 bp, Artificial Sequence
  Description of Artificial Sequence: Synthetic coding sequence
atggcttgtctgcttcgtagcttccagcggatttctgccggagtgttcttcctggcactctggggcatggttgtcggcgataaacttctcgtggttccccaggatggttcccattggctgagcatgaaggatatagtagaggttctgagcgataggggacatgagattgtggtggtggttcctgaagtgaatctacttctaaaagagtccaagtactatactcgcaaaatttaccctgtgccttatgatcaggaagaactgaagaaccgctaccagagttttggaaacaatcattttgctgaaaggagctttctcacagctcctcagacggaataccgcaacaacatgatagtgatcggtctgtacttcatcaattgtcagtcattactgcaggatcgggacacactgaacttcttcaaagagagcaaatttgacgctctcttcacggatcccgctttgccatgcggggtgattctggcagaatatcttgggctcccatcagtatacttattccgaggttttccttgctcgctcgagcacacattctcccggagcccagaccccgtgagttatatacctcgatgctataccaagtttagcgaccacatgactttcagccagagggtggctaactttcttgtcaatctgctcgagccgtacctgttctactgcctgtttagtaagtacgaggagctagcttccgcagtccttaaacgggatgtcgatataatcaccctctaccagaaggtcagcgtgtggctgttgcggtacgacttcgttttggaataccctcgccctgttatgccgaatatggtgtttattggcggaataaattgcaaaaagcggaaggatctctcacaggaattcgaggcgtacatcaacgcctcaggggaacatggaatcgtcgtcttctctctaggctctatggtctcagagatcccggagaaaaaggcaatggcgatagctgatgccctcggcaagattcctcagactgtgttgtggcgttacaccggtacacgcccttctaatcttgcgaacaacaccatcctcgtaaagtggctgccccagaatgatttgcttggccatccgatgacccgcgctttcatcacacatgccggatcccacggcgtgtatgagtccatatgtaacggcgtcccgatggttatgatgcctcttttcggcgaccagatggacaatgccaaacgcatggagacgaaaggcgcaggggtcacgcttaacgtgctggaaatgacgagcgaggaccttgaaaatgcccttaaggcagttattaatgataaatcctacaaggagaatatcatgagactatcaagcttgcacaaagaccgcccagtggagccactggatctggccgtattttgggtcgaattcgtgatgcggcataagggcgcaccccacttacgacctgcagcgcacgatctgacttggtaccagtaccactctttagacgttatcgggttcctgctggccgtggtcttgactgtggcgtttataaccttcaaatgttgtgcctacggctatcgaaaatgcctggggaagaagggcagagtgaagaaagctcacaaaagtaagacccattag

SEQ ID NO: 246113 - DNA, 570 bp, Artificial Sequence
  Description of Artificial Sequence: Synthetic coding sequence
atggcttgcttgcttcgctcattccagcggatctccgctggcgtattttttctagccttgtggggcatggtagtaggggataaattactggttgtcccacaggatggatctcactggctgtccatgaaggacatcgtggaggtgctatccgataggggacacgaaattgttgtcgtggtgccggaagttaatttgctgctcaaggagagtaaatactacaccagaaagatctaccccgtaccgtacgaccaagaagaattgaaaaatcgttatcagtccttcgggaacaaccactttgcggagcgctcattcctgacagctcctcagaccgagtatcgcaacaatatgattgtcatcggcctgtatttcattaactgtcagagcctgttgcaagatcgcgacactcttaatttttttaaagaatctaaattcgacgccctgtttaccgacccggcactgccctgcggagtgatcttagccgagtacctagggcttccgtcggtgtacctcttcagaggattcccatgtagcctcgaacataccttcagcaggagccccgatcccgtgtag

SEQ ID NO: 246114 - DNA, 1593 bp, Artificial Sequence
  Description of Artificial Sequence: Synthetic coding sequence
atggcccgagccggttggaccgggttgcttcccctgtacgtttgtctgctgttaacttgtgggttcgcaaaagccggtaaactgctggtagtgccgatggacggttcacactggttcactatgcaaagcgtggtcgagaagctcatcctccggggtcacgaggtcgttgtcgtgatgccagaggtctcttggcagcttggaaggtctttgaactgtacggtgaaaacctactctacaagctacaccttggaggatcaggatcgtgaatttatggtattcgctgacgcgcgttggactgctccgctccggagtgccttttcgctcctcaccagctcttcaaatggcatttttgatctgttctttagcaattgtcggtctttatttaacgacaggaaactggtcgaatacttgaaagagtcctgctttgacgcagtgttcctggatccctttgacgcttgcggtctaatcgttgccaaatacttcagtctcccttctgtggtgtttgctcggggaatcttttgtcactatctggaagagggagcccagtgtccagcccctctgagctatgtgccccgacttctactaggattttctgatgccatgacctttaaggaaagggtttggaaccatattatgcatctggaggaacacctgttctgtccctatttctttaaaaacgtcctggaaatcgccagcgaaatcctgcagacccctgtgactgcctatgatctctactcccacacctccatttggttgctgaggaccgactttgtactcgagtaccctaaacccgtcatgcctaatatgatattcattggcggtattaactgccaccagggaaagcccgtgcccatggaatttgaagcgtacataaacgcctcaggcgagcatggcatagttgtgttctccctcgggtccatggtttccgaaatacctgaaaagaaagcaatggcaatcgccgatgccctggggaagattccccagacggtgttatggcgatataccggaactagaccctccaacctcgccaacaataccatacttgtcaagtggctgccccagaatgacctcttaggccacccgatgacacgagccttcatcactcacgccggttctcatggggtgtacgaatctatatgcaatggagtgccgatggttatgatgccgctgtttggggatcaaatggacaatgcgaagcggatggagactaagggagcaggcgtgacgctgaatgtattagagatgacttccgaagatctcgagaacgccctgaaggcagtgatcaatgataaatcatacaaggaaaatattatgagattgtccagcctgcacaaagatcgtcctgtagaacctctcgacctcgccgttttttgggtggagtttgtgatgcgccataagggcgctcctcacctgagaccagcggcacacgatctaacctggtaccaatatcattcactggatgtcataggtttcctgctggccgtggtgctcactgtagccttcattacctttaagtgctgtgcttatgggtacagaaagtgtcttggtaaaaagggaagagtgaaaaaggctcacaagtccaaaacccattag

SEQ ID NO: 246115 - DNA, 1593 bp, Artificial Sequence
  Description of Artificial Sequence: Synthetic coding sequence
atggcccgaactggctggacttcccccattcctctttgtgtgagcctgttgctaacatgtgggtttgctgaagcagggaagctcctggtggttcctatggatggtagtcactggttcactatgcagtctgtagttgagaaactcattctgcggggacacgaggttgtggtggttatgccggaagtgtcgtggcaactggggaagtcacttaactgcactgtgaaaacatattctacctcctataccctggaagacctggaccgcgagtttatggatttcgccgatgcccagtggaaggcccaggtaagaagcttattttctctcttccttagttcatcaaacgggttcttcaatctttttttctctcactgccgaagcctgttcaatgatagaaagttggtagagtacctaaaggaatcaagctttgacgctgtgtttctggacccattcgatgcttgcggtctcatcgtggcaaagtacttcagcctcccatcagtggttttcgccagagggatcgcctgccactatcttgaggagggcgcacagtgccccgcaccactgagctatgtaccgaggatcctgcttggattttccgacgctatgacgttcaaagaaagggtgaggaaccacattatgcatctggaggagcatctattttgccagtacttttccaaaaacgctttggaaattgccagcgaaattttgcagactccggtgacggcctatgatctgtacagtcatacgtccatttggctgttaaggactgacttcgtcttggactaccctaagcccgtcatgccaaacatgatttttataggcggaattaattgccaccaaggcaagccgctgcccatggagtttgaagcctatatcaacgcgtccggcgagcatggcatagttgtcttcagccttgggtccatggtcagtgagatcccagagaaaaaagccatggccatcgcggatgctctaggtaaaattccgcagacagtattgtggcggtatactgggactaggccgtctaatctggctaacaataccatactggtgaaatggcttccgcagaatgaccttttgggccacccaatgacaagagcctttattacacacgcaggaagtcacggggtctacgagtcaatttgtaatggggtccctatggtgatgatgccactgttcggggatcaaatggataacgccaaaagaatggaaacaaaaggcgcaggcgttacattgaacgtcttggagatgacctcggaagacttggagaacgccttaaaggccgtgataaacgacaaatcctataaagaaaacattatgagactgagcagcctccacaaagaccgccctgttgagcccctggacctggcagtgttctgggtggaattcgtcatgagacacaaaggagctccgcacctgcgcccagcggcacatgatctgacgtggtaccagtatcattcactagacgtaatcggatttctgcttgccgtggtcttgacagtcgcatttatcacattcaaatgttgcgcttatggctaccggaaatgcctgggtaaaaaggggagggtgaaaaaagcgcacaagtccaaaacccactag

SEQ ID NO: 246116 - DNA, 1593 bp, Artificial Sequence
  Description of Artificial Sequence: Synthetic coding sequence
atggcgtgcacaggctggactagccccttaccactttgtgtctgcttgcttcttacatgcggttttgcagaggccggtaagttacttgttgtgccaatggatggctctcattggtttacaatgcgtagtgtagtggagaagcttatcctgagagggcatgaggtcgtggtggttatgcctgaggtatcttggcaattagggagaagcttgaactgcaccgtaaagacctactccactagctacacgctggaagatctggatagggaatttaaagccttcgctcacgcccagtggaaagcacaggttaggagtatctacagccttttgatgggcagttacaatgatatcttcgacctcttcttttccaactgccgatccctctttaaggataaaaaactggttgagtacctcaaggaatcctcatttgatgcagtcttcttagacccatttgataactgcggtctgattgtggccaaatacttcagcctgcctagtgtggtctttgcacgcggaatcctgtgccactacctcgaggaaggcgctcagtgccctgctcccctctcgtacgtgcctcggatcttgctgggatttagcgacgccatgaccttcaaggagagagtgcgcaaccatatcatgcatctggaggaacacctcctgtgccacagatttttcaagaatgctttagaaattgcgtccgaaatcttacagacccccgttacagagtatgatctgtacagccatacctctatctggctgttgaggacggactttgttcttgattaccccaaaccagtgatgcccaacatgatctttatagggggaatcaattgtcaccagggaaaacccttgcctatggagttcgaagcctacataaatgctagcggcgagcacggcattgttgtcttctcccttggatctatggtaagtgaaatacctgaaaagaaggccatggctatagcggacgcattgggcaagatccctcagactgtgctgtggagatacactgggacccgcccatcaaatttggccaacaataccatcctagtgaagtggcttccccagaatgacttacttgggcatcctatgacacgcgcatttatcacgcatgcgggatcccacggcgtgtatgaatccatctgtaatggggtgcctatggtaatgatgccattattcggggaccagatggacaacgcaaaaaggatggaaacaaagggcgcaggtgtgacacttaatgtgctggagatgactagcgaggatctggagaacgccctgaaagcagtgatcaatgataagtcctataaagaaaatatcatgcggctaagttccctgcataaggatcgcccagtggagcctcttgatctcgcggtgttctgggtcgaatttgttatgcgtcacaagggggcaccgcacctgcgcccagccgctcacgaccttacatggtaccagtaccatagcctggatgtaataggattcctgctggctgttgttttgacagtcgcctttatcacatttaagtgctgcgcttacggatacagaaaatgtctcggtaaaaaaggaagggtgaagaaagcacacaaatctaaaacacactag

SEQ ID NO: 246117 - DNA, 1584 bp, Artificial Sequence
  Description of Artificial Sequence: Synthetic coding sequence
atgctcaataatctgctcctattctctcttcagattagcttgataggaactacgctgggtggtaatgtgctgatttggccaatggaagggagccactggttgaacgttaagattattattgatgagctcattaagaaggagcataacgtcacggtgctggtggcaagcggggctttgttcataacccctacaagcaacccaagccttacgttcgaaatttaccgggttccattcggaaaggagcggatagagggcgtgataaaagatttcgtgctcacgtggctcgaaaataggcccagtccttcgaccatatggagattctatcaagaaatggccaaggttatcaaagactttcacatggtgagtcaagagatctgcgacggcgtcctgaagaatcagcagctcatggcaaaacttaagaaatccaaattcgaagtgctggtaagcgatcctgttttcccttgtggggatattgtggccctgaaactcggcattccgttcatgtactctctccgcttcagccccgcttctacagtggaaaagcactgtggtaaagtgccatacccaccctcatacgtgccagccgtgctcagcgaattaacagaccagatgtctttcactgaccggattaggaacttcataagctatcacttgcaggattatatgtttgaaaccttgtggaaatcctgggacagctattacagtaaggctctgggcggtctactgctgtgttgcccaggatggagcgccgttgccgatctgggatcactccagcctctgttgcccggattcaagcggttctctagactgtctttacactgcagttgggattatagactcccggctgggagacctactactctttgtgagaccatgggcaaggctgagatctggctcataaggacgtattgggatttcgagttcccacgcccatatctgccgaacttcgaatttgtggggggactgcattgtaaacctgcaaaacccctgcccaaagtgttatggcgatataaaggaaaaaagccagctacattgggcaacaatacacagttatttgactggataccccaaaatgacctgctggggcacccgaaaactaaagcttttatcacccatggaggcactaatggaatttatgaagcaatatatcatggggtgccgatggttggcgttccgatgtttgcggaccagcctgacaacatcgctcacatgaaggctaaaggcgcagctgtcgaggttaacctgaatacaatgacatctgtcgatttactcagcgccctaagaaccgtgattaacgaaccatcatataaagaaaacgcaatgcgactgtcacgcatccatcatgatcagcctgtaaagcccctggaccgggcagtcttctggatagagtttgtgatgagacacaaaggagcaaaacacctgcgcgttgccgctcacgatcttacgtggtttcagtaccactccctggacgtgattggtttcctgttggtgtgtgtgacaacggcaatttttctggtgatccaatgttgcctattcagttgtcaaaagttcggcaaaatcggaaaaaaaaaaaaaagagaatag

SEQ ID NO: 246118 - DNA, 2082 bp, Artificial Sequence
  Description of Artificial Sequence: Synthetic coding sequence
atgcttaataatttactactgtttagccttcaaatcagtcttatagggactacactggggggtaatgtcttgatatggccaatggagggctcacactggttgaacgtgaaaattattattgatgaattgattaaaaaggaacacaacgttaccgtgttggttgctagcggcgcattgttcattacgcctacctctaacccctctctcaccttcgaaatttaccgtgtcccattcggaaaggaacgcattgagggtgttataaaggatttcgtactcacctggttggagaaccggccatcccctagtaccatttggcggttttatcaggagatggccaaagtaattaaggactttcacatggtgagtcaggagatctgcgacggagtattgaagaatcaacagctgatggcgaagctcaaaaaatccaaatttgaagttctcgttagcgatcccgtgtttccctgcggcgatattgtcgcccttaagctgggaatcccctttatgtactcacttagatttagtccagctagtaccgtagagaagcactgtggcaaggtgccgtacccaccaagctacgtaccagcagtcctaagtgagctcaccgatcagatgtcattcactgatcggattcgcaattttatctcctaccaccttcaggactacatgttcgagaccctgtggaaatcatgggacagttactactccaaggcacttgatggctcccactggctgaacataaaaatcattctggaagaactgattcaacgcaaccataacgttacagtgttagcttcaagtgccactcttttcatcaacagcaaccctgacagtcccgtaaacttcgaggtgatcccagtgtcttacaagaagagcaacattgactcccttatcgaacacatgattatgctttggatagatcatcgccctacaccactgaccatctgggcgttttacaaggagctggggaaactgctggacacattctttcagattaatatccagctctgtgacggcgttctcaagaaccccaaacttatggctagactccagaagggaggttttgatgtcctggtggctgacccagttactatttgtggcgacctggttgctctcaaactcgggattccgtttatgtacactcttaggttctcacccgcatctacagtggaaaggcattgcggaaagatccccgctcctgtgtcctatgtccccgcagccctgtcagagctcacagatcagatgacttttggtgagcggattaaaaacaccatatcctactccctgcaggattatattttccagtcctattggggcgagtggaattcttattattccaaaatccttggaagaccgaccaccctctgtgaaaccatgggcaaggctgaaatttggctgatcagaacatattgggattttgaattcccacgaccttatctgccaaattttgaattcgtgggtggcctccactgtaaacctgcaaagccccttcccaaagtcctctggcggtacaaggggaaaaaacctgcaacgctggggaacaatactcagctcttcgactggatcccacaaaacgacctgttgggacatcccaaaacaaaagcctttatcacacatggtgggaccaacggcatttatgaagccatctaccacggagttccaatggtgggtgtgcccatgtttgccgaccagcctgataatatcgcgcatatgaaagctaagggtgcagccgttgaggtcaacctaaataccatgacctcagtggacctgctctctgctctcagaactgtgattaacgagccatcctacaaggagaacgcaatgagactcagccggattcaccatgatcagcccgtgaaaccactggatagggctgtcttctggatcgagtttgttatgcggcataaaggcgcaaaacatctgcgagtcgccgcacacgacctgacgtggttccagtatcacagtctcgacgtgattggattcctcctggtgtgtgtgactaccgctatcttcctcgtgattcagtgctgcctgttctcgtgccagaaattcggcaagattggaaagaagaagaagagagagtag

SEQ ID NO: 246119 - DNA, 1611 bp, Artificial Sequence
  Description of Artificial Sequence: Synthetic coding sequence
atggtgtctattcgagattttactatgcctaagaagttcgtgcagatgctggtattcaatctcacccttaccgaagtggttttaagtgggaacgtgctgatttggcctacagatggctctcactggttgaacatcaagatcatccttgaggaactgatccaacgaaaccacaacgtcacagtcctggctagttctgctacactgttcattaactctaatccagattccccagtcaacttcgaggttatccccgtgtcctataagaagtctaatatcgacagcctgattgaacacatgatcatgctctggatcgaccatagacccactccacttacaatatgggccttctacaaggagctgggcaagttgctggatactttcttccagattaacattcaactatgtgacggcgtgctgaagaatccaaaattgatggctcggttacagaagggagggttcgacgtattagtggcggaccccgtgacaatatgtggggatctcgtggccctcaaactgggaatacccttcatgtatacactgcggttcagtccggcatctactgttgagaggcactgtggcaaaatccctgctccagtgagctacgtgcctgctgccttgtctgagttaaccgaccaaatgaccttcggcgaaagaatcaaaaatacgatctcatattccctgcaggactacatcttccagtcctactggggggagtggaacagctattactccaaaatcctcggcagacccactacgctttgcgagaccatgggcaaggcggagatctggcttatcaggacatactgggacttcgaatttcctcgaccgtatctgccaaatttcgagtttgtcggcggactgcactgcaagccggcaaagcccttaccaaaggagatggaggagtttatccagagctcggggaagaatggcgtggtggtgttctctctgggctctatggtaaagaatctgaccgaagagaaggccaacttgatcgcgagcgccttagcacagattccccaaaaagtgttgtggagatataaaggcaaaaaaccagcaactctgggcaataatactcagctctttgactggatcccacagaacgatctgctgggccaccccaaaactaaggctttcattacccatggcggaacaaacgggatatacgaggccatctaccacggcgtacctatggtaggggtgcctatgtttgcagaccagcctgataatattgcgcacatgaaggctaaaggggctgctgtagaggtgaacctgaacacgatgacttcggtcgacctgttgagcgccctgcgtaccgttataaacgagccctcgtacaaggagaacgcgatgcgcttgtctaggatccatcatgatcagcccgtgaaaccgcttgacagagctgtgttctggattgaatttgtcatgcggcacaaaggggcaaaacatctgcgcgtggcagctcacgacctgacatggttccagtaccattccctggacgtaataggctttcttctggtgtgtgtgacaaccgccatctttttagtcatccagtgctgtctgttcagctgtcaaaagttcggaaaaattggtaaaaagaagaagcgcgaatag

SEQ ID NO: 246120 - DNA, 1584 bp, Artificial Sequence
  Description of Artificial Sequence: Synthetic coding sequence
atgctcaacaaccttctgttgtttagcctccagatctctctcattggaaccaccctggggggaaacgtcttgatttggcccatggagggctcacattggctgaacgtaaagatcattattgatgaattgattaagaaagaacacaacgtcaccgtgctggttgccagtggcgcactgttcattacacctacgagtaacccttctcttacatttgagatttaccgggttccgtttggaaaggaaaggatcgaaggcgtcattaaggatttcgtcttgacctggctggagaaccgaccatccccttccaccatttggagattctaccaagagatggccaaagtgattaaggacttccacatggtctctcaagagatttgtgatggtgtgttaaagaaccaacagctaatggctaaactgaaaaagtcaaaattcgaagtcttggtttcagaccccgtgtttccatgcggagatatcgtagcgctgaagctggggatcccctttatgtactcactgcgctttagtcctgctagtaccgtggagaagcactgtggaaaggttccgtaccccccatcttacgtgcctgccgtactctctgagctcactgaccagatgtctttcaccgaccggattcgtaattttatatcataccacctgcaggactacatgttcgaaactttgtggaaatcctgggatagctattacagcaaggccctgggccgaccgacaactctgtgcgagaccatgggcaaagcagagatctggctcatcagaacgtattgggacttcgagttccctaggccctatctccccaacttcgagttcgtcggcggactgcactgtaagcccgctaagccactgccaaaggagatggaggagttcatccaatccagtggaaaaaacggagtcgtggttttttctctcggatcgatggtgaagaacctcacggaagagaaggcaaatttgatcgcgagcgctctagcccaaatcccccagaaagtactgtggagatataaggggaagaaacctgccacgttggggaacaacacgcagctcttcgactggatccctcagaacgacctcctcggacaccctaaaacgaaggcatttattacccatggtggcaccaacggaatttatgaggccatttatcacggggtgcctatggtcggagtgcccatgttcgctgatcagcctgataatatcgctcacatgaaagccaaaggtgcagcagtggaggtgaatctgaacacaatgacaagcgtggacctcctgtctgcactccgcaccgtgatcaacgaaccatcctataaagaaaatgctatgaggctgtctagaattcatcacgatcagccagtgaagccactggaccgtgccgtgttctggatcgaattcgtcatgcggcacaagggggcaaaacatctgcgggtggccgcacacgacctgacatggtttcagtatcatagcctggatgtaattgggttcttgctggtgtgcgttactacagctatctttttagtcatacagtgctgtctcttcagctgtcagaagtttggaaaaattgggaaaaaaaaaaaaagagagtag

SEQ ID NO: 246121 - DNA, 477 bp, Artificial Sequence
  Description of Artificial Sequence: Synthetic coding sequence
atgctgaataatctccttctattctcgctgcagataagtctgataggaactacactgggcggtaacgtattaatttggcccatggaggggagccactggctcaatgttaaaatcattatcgacgaactcatcaagaaagagcataatgtgactgttctggtcgcttccggtgccttgtttataaccccaactagcaacccatctctgacattcgagatctatcgcgtcccatttgggaaggaaagaatcgagggcgtgattaaggatttcgttttgacctggctcgagaataggccgagcccaagcaccatttggaggttttaccaagagatggcaaaggtaattaaagactttcacatggtttcgcaagaaatatgcgacggggtgctgaaaaaccaacagcttatggcgaagctcaagaagtccaaattcgaggtcctggtgagtgaccccgtttttccttgtggcgatatttag

SEQ ID NO: 246122 - DNA, 1590 bp, Artificial Sequence
  Description of Artificial Sequence: Synthetic coding sequence
atgacactgaagtggactagtgtgcttttgttgatccatctatcatgttatttcagctccggatcatgcggaaaagttttagtctgggccgctgaatatagccattggatgaatatgaagacaatattgaaagaactcgtgcagagaggtcacgaggtgactgtgctggcatcctcggcgtcaattctattcgatccaaatgatgcctctaccctcaagtttgaagtctatcccactagcctaaccaaaaccgaatttgaaaacattatcatgcaacaagtcaaaaggtggtccgacattcgtaaggattccttttggctgtacttctctcaagagcaggaaatattatgggagctctatgacatctttcgcaatttttgtaaggacgttgtcagcaataagaaggtcatgaaaaaactccaggagtctcgatttgacattgtgttcgctgacgctgtctttccatgcggcgaacttctggctgcccttcttaacatccggtttgtgtacagtctgaggttcacccctggttacacaatcgagagacatagcggcggactgattttcccgccatcttatatcccaatcgtgatgagcaagctgtctgatcaaatgaccttcatggagcgtgtcaaaaatatgatatatgttctctacttcgacttttggtttcagatgtccgacatgaaaaaatgggatcagttttactcagaagtgttgggccgaccaactacgctcttcgagactatggggaaagctgacatctggctgatgcgcaattcttggtccttccagtttccccaccccttcctgcctaacgtggattttgtcggcggttttcattgcaaaccagccaaaccgctccccaaggagatggaagaattcgtgcagagtagtggcgagaatggcgtggtggtcttctcattgggatccgttattagtaacatgacagcagaaagagcaaacgtcatcgccaccgcccttgccaaaatcccccaaaaagtcctttggcgcttcgacggaaacaaacctgatgcgttgggcctgaataccaggctctataaatggatccctcagaatgacctactaggacaccccaaaacccgggctttcatcacccatggtggtgcaaacggaatttacgaggcaatttaccatggcatacctatggttgggataccattgttttttgaccagccagataacattgcccacatgaaggccaaaggcgctgccgtgagactggactttaacacaatgtcctcaacagacttgctgaatgccctcaagacagtgattaatgaccccctctacaaagaaaacatcatgaagttaagccgcattcagcatgaccagcccgtcaagcctctggacagggcagttttctggattgaattcgttatgccacataaaggtgcaaagcacctgagggtcgccgcacatgacctgacctggtttcagtaccatagtctcgatgtgataggatttctgctggcctgtgtcgccacggtgatcttcataataaccaaattttgcctgttctgcttttggaaattcgctcggaaaggaaagaaaggcaaaagagactag

SEQ ID NO: 246123 - DNA, 1593 bp, Artificial Sequence
  Description of Artificial Sequence: Synthetic coding sequence
atgtccctaaaatggacatcagtatttttactgattcagctatcttgctacttcagctcgggttcctgcggcaaggtgttggtttggccaaccgagtactcccattggattaatatgaaaactatactcgaagagctcgtgcagagaggtcacgaagtgaccgtattgacttcatccgcttcgacgctggtcaacgcttctaagagttctgcaatcaaattggaggtgtatcccacctctctcactaagaactacttggaagactcgctcctcaaaatattggacagatggatttacggagtgagcaagaacacattctggagctacttctcacagttgcaggagctgtgttgggaatactacgattactccaacaagctgtgtaaagacgccgtgctgaacaaaaaactaatgatgaaactgcaggagtctaagttcgacgtaatcttggcggatgcactcaatccatgtggggagttacttgcggagctgttcaatatcccttttctgtacagcctgcggttttcagtaggttacacgttcgaaaaaaatggcggaggcttcctattccctcccagttatgtgcccgtcgtcatgtctgagctatcggaccagatgattttcatggaaaggatcaaaaatatgattcatatgctgtatttcgatttctggtttcagatctacgaccttaagaagtgggaccagttctactcagaggtgctggggaggcccacaactctgttcgagactatgggcaaggcagagatgtggttaatccggacttactgggattttgagtttcctcggcctttcctgccgaatgtagactttgtagggggattacattgtaagcctgccaagcccctcccaaaagaaatggaggaatttgtccagtcatcaggcgagaatgggatcgtggtttttagccttggctctatgatcagcaacatgtccgaggagagcgcaaatatgatagcctctgccctggctcaaattcctcagaaagtgctgtggaggtttgatgggaaaaaacccaacactctggggagcaacacgcgactctacaaatggctccctcagaatgatttactcgggcatcctaaaactaaagcatttatcacacacggtggtacaaatggtatctacgaagcaatctaccacggcatccctatggtgggcattcctttgtttgcggatcagcacgacaacatcgcccacatgaaggccaagggagccgcactgtcagtggacatcagaaccatgtcaagccgggatcttttaaacgccctgaagtcagtgatcaacgaccccgtatacaaggagaacgtcatgaaattgtcgcgcatccaccacgatcagcccatgaagccactcgaccgagcagtgttctggatcgaattcgtgatgcgacataagggtgctaaacatctgagggttgccgcacataatctaacatggatccagtaccattccttggacgtgatcgcgttcctcctggcttgtgtagcaaccgtgatattcataattacaaagttctgcctgttttgcttccggaagctggcgaaaaagggtaaaaaaaaaaagcgagactag

SEQ ID NO: 246124 - DNA, 1593 bp, Artificial Sequence
  Description of Artificial Sequence: Synthetic coding sequence
atgtcactcaagtggatgagcgtctttctcctcatgcagctgtcttgttattttagctcaggatcctgtggaaaagtgctggtctggcccacagaatactctcactggataaatatgaaaaccatcctggaagagctggtccaacggggtcacgaagtcatcgtgctgacctcttctgcgtcaattctagttaacgcctccaagagctccgccattaaactggaagtgtacccgacatctctgacaaagaacgatcttgaggactttttcatgaaaatgttcgacaggtggacgtattccatctctaaaaataccttttggtcctatttctctcagctccaggagctgtgttgggaatactcagactacaacattaagctttgtgaagacgccgtcctgaacaagaagttgatgcgtaagctccaggagtcaaaattcgatgtgttgttagcggacgcagtcaatccgtgtggggaactactagccgagctactgaacatccccttcttgtacagtctgcggtttagcgtcggctataccgtggaaaaaaacggaggcggtttcctattcccaccgagctatgtcccggtggtgatgtcggaactgagcgaccaaatgatcttcatggaaaggattaagaacatgatctacatgctgtacttcgatttctggttccaggcctatgatctgaagaagtgggaccaattttactccgaagttctgggcaggcccaccacgctctttgaaacaatgggtaaagcagagatgtggctgatccgtacctactgggactttgagttccctcggcctttcctgcccaatgtagatttcgttggtggactgcactgcaagcctgctaaaccactacccaaagagatggaggagttcgtgcagtccagcggagaaaatggaatcgtggtgttctccttggggtcaatgatctctaatatgagtgaagaatccgcaaatatgatcgcttcggctctggcccagatcccccagaaggttctttggcgcttcgacggaaagaaacccaatactctcggatccaacacccgtttgtataagtggctgccccagaacgacctcctgggacatccgaaaacaaaggcgtttataactcatggtggtactaatgggatatatgaagcaatctaccatggtatcccgatggtcggtatccctctgttcgcggatcagcacgataacatagcgcatatgaaagcaaaaggggctgctttatctgtagacatcaggaccatgagttccagggacctactaaatgcactgaaaagtgtgattaatgatccaatatataaggaaaacatcatgaagctttccagaatccaccatgatcagccagtgaagcccttggaccgtgcagtattttggatcgaatttgtcatgaggcacaaaggtgctaaacaccttcgagtggccgctcataatctcacatggatccaatatcattcgctcgacgtgatcgccttcttgctcgcctgcgtggccaccatgatatttatgataactaagtgctgtctgttttgttttcgtaaactagccaaaacaggaaaaaaaaagaaacgcgactag

SEQ ID NO: 246125 - DNA, 1590 bp, Artificial Sequence
  Description of Artificial Sequence: Synthetic coding sequence
atggctttaaagtggacgagcgtgctgctgctgattcacttggggtgctatttctcctctgggagttgtggcaaggtactcgtgtggaccggcgagtattcacattggatgaacatgaagacgatccttaaggaactggtgcagcgaggccatgaggtgactgtgcttgcatcatctgcatcaattttgtttgatccgaacgacgcttttacactcaaattagaggtgtatcctacaagcctgacaaaaaccgaattcgagaatataattatgcagcaggtgaagagatggtcggatatccagaaagactcattttggctctatttttcccaggaacaagagatactgtgggagttccatgatatttttagaaatttttgcaaagacgtggtcagtaacaagaaggttatgaaaaaactgcaagagagcagattcgatatcatctttgcggacgctttcttcccatgtggggagctgcttgccgcactgcttaacatcccattcgtgtactcgctctgtttcacacccggttacaccatcgaacgccattccgggggactgattttcccacctagctacattcctgtggtgatgtcaaaactcagtgaccagatgacttttatggaaagagtaaaaaacatgatttacgtgctttacttcgatttttggttccaaatgtgcgacatgaagaagtgggaccagttctactcagaggtactgggtaggccaactactctgttcgagactatgggcaaggcagatatttggttgatgcgtaatagttggtctttccagttcccccacccgtttctgcccaatatcgatttcgtgggaggcttacattgcaagccagccaagcctcttcctaaggaaatggaggagttcgtacagagcagcggagaaaacggcgttgtcgtctttagcctgggctctgtgatttctaacatgactgctgagcgggctaatgtgatcgcgactgcactggctaaaattccccaaaaggtactgtggaggtttgatggtaacaagcccgacgccctagggttgaacactagattgtacaaatggatcccccagaacgaccttctgggactgcccaagacgcgcgcttttattacacatggaggggcaaacggaatttacgaagccatctatcatggcatcccaatggtcggcattcctctcttctgggaccagccagataatatcgctcatatgaaagccaaaggtgctgcggttcgcctcgactttcacaccatgtctagcacggatcttcttaatgccctgaaaacagtgatcaacgatcctagctataaggaaaatgtcatgaagctgagtataattcagcacgatcagccggtgaagcccctgcacagggcagtgttctggatcgagttcgttatgtgccataagggcgctaaacacctacgagtggccgctcgagatttgacctggtttcagtatcatagcctggatgtgattggatttttgttagcatgtgtcgccaccgtcatttttgtcgtgacaaagttctgccttttctgtttctggaagtttgcacgcaagggaaaaaagggtaaacgcgactag

SEQ ID NO: 246126 - DNA, 1008 bp, Artificial Sequence
  Description of Artificial Sequence: Synthetic coding sequence
atggccttgaagtggacctcggtgcttcttctgatacacttgggctgttatttcagttctggctcgtgtgggaaagtcctagtgtggaccggtgagtacagccattggatgaatatgaaaaccatcctgaaggagttggtccaaagaggacacgaggtcactgttctcgcatccagcgcctcgatcttattcgatcccaacgacgcatttacactgaagctggaagtgtatccaacctcactgaccaagaccgagttcgagaatatcattatgcagcaggtaaagagatggtctgacattcagaaagacagtttttggctgtacttctcccaggagcaggaaatcctatgggaattccacgatatttttcgcaacttttgtaaggacgtggtgtctaataagaaggttatgaagaagctccaggaaagccggttcgacatcatcttcgctgatgccttcttcccttgcggtgagctgctcgccgcactgctcaatattccatttgtctactccctatgtttcactccagggtatacgatcgagcggcacagtggaggtctgatttttccccctagctatattccagtggtgatgtcgaaactatcggatcagatgacattcatggagcgggtcaagaacatgatctacgtcctgtacttcgatttctggtttcagatgtgcgatatgaaaaagtgggatcagttctacagtgaggtcttagggaggcctactaccctctttgagaccatgggtaaggctgacatttggctgatgagaaacagctggtcttttcagttcccccaccctttccttccgaatattgattttgttgggggtctgcactgcaagccggctaagcccctgcctaaagaaatggaagaattcgttcagagtagtggcgagaatggcgtggtagtcttcagcttggggtcagtgatatcaaacatgacagcagagagagctaacgtgatcgccaccgcgcttgcaaagatcccgcagaaaatatag

SEQ ID NO: 246127 - DNA, 1587 bp, Artificial Sequence
  Description of Artificial Sequence: Synthetic coding sequence
atgtctatgaagtggacatctgccttgttgctgattcagctatcatgttatttctcctcaggatcttgcggaaaggtgctcgtttggccaaccgagttcagccattggatgaatataaaaacaatcctcgatgagctcgtccagcggggacatgaggtgacggtcttggccagcagcgctagtatctctttcgatcccaacagcccctctaccctcaaatttgaggtgtatccagtgtctctgactaagactgaattcgaagacattattaagcagttggtgaagcgctgggctgaactgcccaaggacactttctggtcctatttttcacaggtacaagagattatgtggactttcaacgacattctgaggaagttttgcaaggacatagtgtccaataagaaactcatgaagaagctccaggaatcgagattcgacgtcgttttggctgatgccgtttttccattcggagaactcctggccgaactgttgaagatcccctttgtgtacagtctacgattctcccctggctatgctatcgagaaacactctgggggactgctatttccgccttcctatgtacccgtggtgatgtcagaactgagcgaccagatgacgttcatcgagcgcgttaaaaacatgatctacgtcctgtactttgaattttggtttcaaatctttgatatgaagaagtgggatcagttttactctgaagtgctgggcaggccaacaaccctgtcagaaaccatggcgaaagccgatatttggcttatcagaaattactgggattttcagtttccacatccattactcccgaacgtggaatttgtcggagggctccactgtaagcccgctaaacctttgccgaaggaaatggaggagttcgtgcagtcctccggcgagaacggcgtagtggttttcagcctcggatctatggtctcaaacacctccgaggaaagagcaaacgtaatcgcctcggccctggctaaaattccacagaaggtgctctggcgattcgatggcaataaaccagacactctgggcctgaatacccggctgtataaatggatccctcagaatgatctgctggggcatcccaagacacgagctttcatcacccatggaggcgctaatgggatttatgaggctatttaccacgggattccaatggtgggagtccccctgtttgccgaccagccggacaacattgcccatatgaaggccaagggagctgccgtcagtctcgacttccacactatgtcatctaccgatctgcttaacgcgctaaagactgtgattaacgatccgctttacaaggagaatgctatgaaactgtccagaatccaccacgatcagcctgtgaagcccctggatcgggctgtgttttggatagagttcgtcatgcgccacaaaggtgctaagcatctgcgggttgccgctcatgatcttacttggttccagtatcacagtctggacgtcaccggattcctcctggcctgtgtagcaacggttatttttataattaccaagtgcttgttctgcgtgtggaagttcgtaaggacaggaaaaaagggaaagagagactag

SEQ ID NO: 246128 - DNA, 1179 bp, Artificial Sequence
  Description of Artificial Sequence: Synthetic coding sequence
atgttcttcgcactgctacacgtttcaagcacaaacggactggatgctgtcttccctttcggggaactcctcgcggagctcttaaaaatccctttcgtgtacagcctccggttctcaccagggtatgccattgaaaaacatagcggtggcctcttgttcccgccaagttatgtgccagtcgttatgagtgaattatccgaccagatgacattcattgaaagagtcaagaacatgatttatgtgctctactttgagttttggttccagatcttcgatatgaaaaagtgggatcaattttattctgaagtacttggacggcctactacactcagtgagacaatggccaaggctgacatctggctcatccgaaattattgggattttcagttcccacaccccctattacccaatgtagagtttgtgggtggactccattgtaagcccgctaagccattgcccaaggagatggaggagttcgtccagtcctccggcgagaacggcgtggtggtgtttagtctcggatctatggtttcgaacacaagcgaagagcgagcaaatgtgattgcctctgccttggcaaagattcctcagaaggtcctgtggagattcgacggtaataaacccgatactctcggcctgaacactagactctacaagtggattccgcagaatgacctccttggccatcccaagacccgagctttcatcacccatggcggagcaaacggcatttacgaagctatttatcacggcattccaatggtaggcgtgcctctattcgctgaccagcccgataatatcgcacatatgaaggccaaaggtgcagctgtgtccctcgactttcataccatgtcctcaacagacctgctcaatgccctcaagactgtcatcaacgatccgttatataaagagaacgccatgaaacttagccgaattcaccatgatcagccagttaagccattggaccgcgctgtcttctggatcgagtttgttatgcggcacaaaggtgcaaagcaccttagagtggcggctcatgaccttacctggtttcagtaccattcattagatgtgaccggttttctgctggcttgtgtggccacagttatcttcatcataactaaatgcctgttttgcgtctggaaattcgtgagaacagggaagaagggcaagagggattag

SEQ ID NO: 246129 - DNA, 165 bp, Artificial Sequence
  Description of Artificial Sequence: Synthetic coding sequence
atgagcatgaagtggacgtccgcactcttgctgatacagttgtcctgttactttagttctggatcttgtgggaaagtcttggtgtggcccactgagttctcacactggatgaatattaaaactattctcgacgaactcgtgcagcgaggacacgaagtgacatag

SEQ ID NO: 246130 - DNA, 1590 bp, Artificial Sequence
  Description of Artificial Sequence: Synthetic coding sequence
atgtccgttaagtggacatctgtcattttgctcatccaactgtctttctgtttcagctccggcaactgcggcaaggttcttgtatgggctgccgagtactctcactggatgaacataaaaacaatcttggacgagcttattcaaagggggcatgaggtgaccgtgctggcttctagcgccagtatcttatttgatccaaataattccagtgcactcaagatcgagatctatcccactagtctgactaagaccgaattagagaattttatcatgcagcagatcaagagatggagtgacctgcccaaagacacattttggctgtattttagccaggtgcaggagatcatgtctatttttggcgacatcacaaggaagttttgtaaggacgtagtaagcaataagaaattcatgaagaaagttcaggagagccggtttgatgtcatttttgcagatgccatttttccctgcagcgagctcctggccgagctttttaacatccctttcgtgtatagcctttcctttagtccagggtatacgtttgagaagcattcgggagggtttatttttcctccaagctacgtgcctgtggtcatgtcagagttaactgatcagatgactttcatggaaagagtgaaaaatatgatctacgttttatactttgatttctggttcgaaatcttcgatatgaaaaaatgggatcagttctactccgaagtcctagggcgtcccactactctttcggaaacaatgggtaaagccgacgtttggcttattagaaattcttggaactttcagtttccctaccccttgctccccaacgtggacttcgttgggggtctccactgcaagcctgcgaagccactgccaaaggaaatggaagactttgtgcagtctagtggggagaatggcgtggttgtcttttccttaggcagtatggtgagcaatatgactgaggaaagagctaacgtgattgcctctgctctggctcagatcccacagaaagtactgtggcgctttgacggtaacaagccagacaccctgggcctaaatacacggctctacaagtggatcccccagaacgatctattggggcatccaaagaccagagctttcatcactcacggcggtgcaaacggtatctatgaagcaatatatcatgggatccctatggtcggaatccctctctttgcagatcagcctgataatatcgcacacatgaaggctaggggcgctgctgtgagagttgatttcaacactatgtcatccaccgatctgctaaacgcactcaagagagtcattaatgacccctcctataaagaaaacgtcatgaaactttcacgtatccaacatgaccagccagtgaaacccctcgacagggctgtcttttggatcgagttcgtgatgcgccacaagggcgcaaaacatctgagagtcgccgcacatgatttaacgtggttccagtatcacagtcttgatgtcatcgggtttttgctcgtttgtgtcgcaacggtgatcttcatcgtgacaaaatgttgcctgttttgtttttggaagtttgccaggaaggcaaagaagggaaaaaacgattag

SEQ ID NO: 246131 - DNA, 1269 bp, Artificial Sequence
  Description of Artificial Sequence: Synthetic coding sequence
atgctccagtggaggagacgccattgttgtttcgccaagatgacttggaacgccaaaaggtctctgttccggacacacctgataggcgttctttctttggtgttcctcttcgccatgtttctattctttaatcatcatgattggttgcctgggagggcgggatttaaggagaaccccgtcacctacacattcagaggcttccgctcgacaaaatcggagactaaccacagtagcctgcggaatatttggaaggagaccgtgccccaaaccctgagaccacaaacggcaacaaattccaacaataccgatctttctccgcagggcgtgacaggactcgaaaacactttgagtgcaaatggaagcatttataacgagaaggggacaggacatcctaactcgtatcactttaagtacatcattaatgagccagagaagtgccaggaaaagtccccgtttctgatcttgttgattgccgctgagccgggtcagattgaagctcggagggcgattagacagacttggggcaatgaatctctggccccaggcatccagatcacaagaatttttcttctgggactgtcaattaagctgaacggttacttgcaacgggctatcctcgaagagtctcggcagtaccacgacattatacagcaggaatatctggacacatattataatctgaccatcaagaccctgatggggatgaactgggtggctacgtattgccctcatatcccgtatgtgatgaaaaccgacagcgatatgtttgtcaatacagaatacctcattaacaagctgctcaaacccgacctgccacctagacacaactacttcacaggatacttgatgcgcggatacgcccctaatcgtaataaggactctaagtggtatatgcccccagacttgtacccaagcgaacgctatccggtattctgctccggaacagggtacgtcttctcgggggacctcgctgaaaagatctttaaagtgtctcttggaatcagaaggctgcacctcgaggatgtctatgtcggaatctgtctcgctaaacttaggatagacccagtaccccctcccaatgagtttgtgttcaatcattggagggtttcgtactcctcctgtaaatactcgcatcttattaccagccaccagttccagccaagcgagctgataaagtattggaaccacctgcagcaaaacaaacacaacgcttgcgcaaatgcagccaaagagaaagccggaagatataggcacagaaagctccattag

SEQ ID NO: 246132 - DNA, 1137 bp, Artificial Sequence
  Description of Artificial Sequence: Synthetic coding sequence
atgcagctgaggctttttagaaggctgttacttgcggctctgctgctggtcatcgtatggacactttttggcccttccggccttggagaggaattgctgagcctttcattagccagccttctgccggctcctgcttctcccggtccacctcttgccctccccaggttgttgatcccgaatcaagaggcctgcagtggcccaggagcccctccgttcctgctgatactagtctgtaccgcacccgaaaatttgaatcagcggaatgcaattcgtgcatcatggggcggtctccgcgaagctaggggattgagggtgcagacactgtttctgctgggcgagcccaacgcccagcaccccgtgtggggctcccagggctcagatctcgcaagcgagagcgcagcgcagggggacatcttgcaagcagcctttcaagatagttataggaatctgactctgaagacattgtcaggcctgaactgggccgagaaacattgcccgatggccagatatgtcttaaaaaccgatgacgatgtttatgtgaacgtaccagaacttgtatccgagttggtcctgcgcggtgggagatgggggcagtgggagcgctctacagagccccagcgagaagccgaacaggagggcggacaggtcctgcattcagaagaagttccactcctatatctggggcgagtccattggcgcgtgaacccctcacgaacgcccggaggacgccaccgcgtgtccgaggagcagtggcctcacacctgggggccttttcctccctatgctagtggaactggatatgtgctgtctgcatccgccgtccagctaatcctaaaggtggctagcagagctcccttgttacctctggaggatgtttttgtaggtgtttcagctcgcaggggcggactcgcccctacacaatgtgttaagctggcgggagcaacccactacccactcgaccggtgttgctacggcaagtttttactcacgagccacagactagatccatggaaaatgcaggaggcctggaagttggttggcggtagcgacggcgagcgcacagccccattctgcagctggttccagggcgtgctggggattctgagatgtcgcgctatcgcatggctccagagttag

SEQ ID NO: 246133 - DNA, 1137 bp, Artificial Sequence
  Description of Artificial Sequence: Synthetic coding sequence
atgcagctgcggctcttcaggcgtttactgctcgccgctctgcttctggtgatcgtctggactttgttcggaccatccggactgggggaggagttgctgtccctgagccttgcctcgctgctccccgctcctgcttctcccggaccaccgctggctttgcccagactcttaattcccaatcaggaggcctgctctggccctggggcacccccattcctgctcattctggtctgtacagcaccagagaatctcaatcaacggaatgctatacgggcatcatggggaggtctccgcgaagctcggggtctccgggtccaaaccctgttcttgctgggcgagccaaacgcacagcaccctgtatggggcagccagggctcggacctcgcaagtgagtctgccgcacaaggcgatattctgcaggctgctttccaagattcatatcggaatctaacgctgaagaccctttccgggctaaattgggctgagaagcattgtccaatggctcgctacgtccttaaaaccgacgatgacgtgtacgtcaacgtccccgagctggtcagtgaactcgtgctccgcggtggcagatggggccaatgggaaaggtctacagagccccagcgcgaagctgagcaggagggcggacaggtgttgcactctgaagaagtgccactgttgtacttggggagagtgcattggagagtaaacccgtcgcgcacgccaggaggccgacacagggtgagcgaggaacagtggccccacacgtggggtccctttcccccatacgcgtcaggaactggctacgtcctaagcgcttccgccgtccaactgatcctgaaggtagcttccagggccccactgctgccacttgaagacgtgtttgtgggtgtgagtgcccgacgtggcggtctggcaccaactcagtgcgtcaagctggcaggtgccactcattacccactagataggtgttgctacggcaagtttctgttgacttcgcatcgtctggatccttggaagatgcaagaagcgtggaaactcgtgggcggaagcgatggcgagagaaccgccccattctgctcatggtttcagggcgtgctcggaatcttgcgctgccgtgcgatagcctggcttcaatcgtag

SEQ ID NO: 246134 - DNA, 1137 bp, Artificial Sequence
  Description of Artificial Sequence: Synthetic coding sequence
atgcaactgcgcttatttcgcaggcttctgctggccgcactgcttttagtgatcgtttggaccctcttcggacctagcggcctgggcgaggaactcctgtctctctccttggctagtcttctgccagcccctgcaagtcccggacctcctttggctcttcccaggctgttgattcccaatcaggaggcatgttcaggtccaggagctcccccattcctcttaatcctggtgtgcacagctcccgagaatcttaaccagcgcaacgccattagggccagctggggaggtttgcgggaagctcggggtctgcgcgtgcagaccctgttcttgctcggggaaccgaatgcccaacaccccgtttggggatcccaaggcagcgacctggcctcagagtctgcagcccagggcgacatcctgcaggccgctttccaggactcatatcgcaatctgaccctgaaaactttgtccggcctcaattgggccgagaaacattgtcccatggccagatatgtgctgaagaccgacgacgacgtgtatgtgaatgtgcctgagttggtttctgaactggtgctgcgcggaggacgctggggccagtgggagaggtccaccgaaccccagagagaagctgagcaggaagggggtcaggttctgcattctgaagaagtgcctctcctgtatctgggcagagtgcactggagagtgaacccaagccgcactccgggagggagacaccgtgtgtctgaggaacagtggccgcacacctggggaccttttcctccctacgcttctgggactggatacgtcctcagtgccagcgccgtgcagcttatcttaaaggtcgcctctagagccccactcctgccactcgaggacgtgtttgtaggcgtgtctgctcggaggggcggtctggctccaacacagtgcgtgaaacttgccggagcgacccactaccctctcgatcgctgttgttatggtaaatttctattgacttcccacaggctcgatccctggaaaatgcaggaggcctggaaattggtgggcggatccgatggcgaaaggacagcccctttctgctcgtggttccagggcgtcctcggcatccttaggtgccgggctatcgcatggctgcaatcatag

SEQ ID NO: 246135 - DNA, 1137 bp, Artificial Sequence
  Description of Artificial Sequence: Synthetic coding sequence
atgcagttgcgcctgtttagacggttgctgctcgccgcattgcttcttgtgattgtgtggacattgttcgggccttccggcctcggagaggagctgctcagcctaagtctcgctagcctgctgccagccccagcgagtccgggacctcccttggccttaccgaggctgttaatccccaaccaagaggcctgttctggcccaggagcccctccctttctgttgatcttggtgtgcacggcccctgaaaatctgaatcagcgcaacgccatacgcgcaagttggggaggtctaagagaagctagaggattaagggtgcagactctcttcctgctgggggaaccgaatgctcaacacccggtttggggaagccagggaagtgacctggcatccgaaagcgctgctcaaggagacatcctccaagctgctttccaggactcatacagaaacctgaccctcaagacactttccgggctcaactgggctgagaagcactgtcccatggcgcgttatgtgctgaaaacagatgatgacgtgtacgtcaacgtccccgagctcgtgtccgagctggtgctgagagggggaagatggggacaatgggagaggtcaaccgaacctcagcgcgaggctgagcaagagggcggacaagtcttgcatagtgaggaggtgccattgctgtacctgggacgcgtgcactggcgcgttaacccgtcacggacgcctggaggacgccaccgtgtttccgaagagcaatggccccacacatggggcccttttccaccttacgcaagtgggaccggatatgtgctctctgccagcgctgtccaattgatcctgaaggttgcgtctagggccccactcttacccctcgaagacgtctttgttggtgtctctgcgaggcgcggaggcctggccccaacccaatgcgtcaagctcgctggtgccacacattaccctctagaccggtgctgttacggaaaatttctcctgaccagccatcgcttggatccctggaagatgcaagaggcctggaaactcgtgggaggaagcgacggggaacgtacagcaccgttctgctcttggtttcagggcgtactgggcatactgagatgtagagccattgcttggcttcagagctag

SEQ ID NO: 246136 - DNA, 1137 bp, Artificial Sequence
  Description of Artificial Sequence: Synthetic coding sequence
atgcagctgcgactgttccggcgtctattactggccgctctgctactggtgattgtttggactctctttggaccaagtggcctgggggaggagttgctttccctcagcctggcttccttactgcccgcacccgctagccccggacctccattagcccttccgcgactcctaattccaaatcaagaagcatgcagcgggcctggagcgccacccttcctgctgatcctcgtatgtacagccccagaaaatttaaatcaaaggaacgctattcgcgcatcttggggaggcctccgcgaggctaggggactgcgggtgcagactctgttcctccttggggagccaaatgcccaacaccctgtttggggctctcaggggtccgatttagcttctgagagtgctgcccagggagacattctgcaggccgcatttcaagactcttacagaaacttgactctgaaaaccttgtccggcctcaactgggctgagaagcactgtcccatggccagatatgtgctgaagaccgacgatgacgtgtacgtcaatgtgcctgagctggtgagcgagctcgttctgagagggggacggtggggccagtgggagaggagcaccgagccccagagagaggcagagcaggaaggaggacaggtgctgcactccgaggaagtgccactgctgtatctcggccgagttcactggagagtcaacccatcaaggacccccggtggccgtcacagggtgagtgaagagcagtggcctcacacatggggaccgtttcccccttacgctagcggtacagggtacgttctgagtgcgagcgctgtgcagttgatactgaaagtcgcatccagggcccctctcctgcccttggaggatgtctttgtgggcgtctccgccaggagggggggtctggctcccacacagtgcgttaaactggccggagccactcattatcccctagacagatgctgctatggaaagtttctcttaacgtcccataggctcgatccttggaagatgcaggaggcctggaagctggtgggcggaagtgatggcgaaaggaccgcccctttctgcagttggtttcagggggtgcttgggatcctgcggtgtcgcgctattgcttggctgcagtcatag

SEQ ID NO: 246137 - DNA, 933 bp, Artificial Sequence
  Description of Artificial Sequence: Synthetic coding sequence
atggcctttcccaaaatgcgcctcatgtatatctgtctactcgtcctgggagccctgtgcctctatttctcaatgtattcgctaaatccattcaaagagcagtcatttgtatacaaaaaggacggtaacttcctgaagctgcccgatacagactgcagacagacccctccattcttggtgcttctcgtcacaagcagccacaagcagctggccgaacgcatggccatacgtcagacctggggaaaagaacggatggtgaagggaaaacagcttaaaaccttcttccttttgggtaccacttcttccgccgctgagaccaaggaagtcgatcaggaaagccaacggcatggcgatataattcaaaaggattttttggatgtatattacaaccttaccctcaaaacaatgatgggcattgaatgggtacaccgcttctgcccccaggccgcatttgtcatgaaaaccgactccgatatgttcatcaacgtcgactatctgacggagcttctactcaagaaaaaccggactacacgtttcttcacgggcttcctgaaacttaatgaattcccgatacggcaaccattcagcaagtggttcgtcagcaaaagcgaatatccctgggacaggtaccccccattttgcagcggtaccggatatgtcttctctggcgacgtcgcaagccaagtgtataatgtaagtaaatccgtgccgtatatcaaacttgaggatgtattcgtgggactttgcctggaacggctgaacattagacttgaagagttacactcccaacccaccttcttcccgggtggactgcgattctcagtgtgtttatttcgcaggatagtggcgtgtcactttatcaaaccacggacactcttggattattggcaggctctggagaactcccggggagaagactgcccgcctgtgtag

SEQ ID NO: 246138 - DNA, 933 bp, Artificial Sequence
  Description of Artificial Sequence: Synthetic coding sequence
atggccttcccaaagatgcggctcatgtacatatgtttactggtactcggcgcactgtgtctctatttctccatgtactcactgaaccccttcaaagagcaaagtttcgtgtacaagaaagacggcaactttctcaaactgcccgacacagattgcagacaaacaccccctttccttgttctgcttgtgacttcctcccacaaacagctggctgagcggatggcaatccggcaaacgtggggcaaggaaagaatggtgaaaggcaagcaactgaagacctttttccttttgggaaccacttctagcgcagcggaaaccaaagaggtcgatcaggaatctcagaggcacggggatatcatccagaaggactttctcgacgtgtactataaccttaccctgaaaacaatgatgggcatcgagtgggtgcatcgcttctgccctcaggcagcattcgtgatgaagactgatagtgatatgtttattaatgttgattacttgaccgagctactcctgaaaaagaatagaactacgcggtttttcactgggtttttgaagctgaacgagtttccaatccggcagccgtttagcaaatggtttgtcagcaagtctgagtacccgtgggaccgctatcctcctttctgttccgggacagggtacgtgttctccggggatgtggccagtcaagtgtacaatgtgtctaagtccgtcccttacataaaactggaggatgtttttgtaggtctgtgcctggaacggctgaatattcgtttagaggagctccacagccagccaactttcttccctgggggtcttcgattctctgtatgcctgttccgcaggattgtagcttgtcactttataaaaccgaggactttacttgactactggcaggccctggaaaattcgcgcggagaggactgtccccctgtgtag

SEQ ID NO: 246139 - DNA, 933 bp, Artificial Sequence
  Description of Artificial Sequence: Synthetic coding sequence
atggcattccccaaaatgagactgatgtatatttgcctgctcgtgctgggagctctttgtctgtatttcagcatgtactcactgaacccattcaaagagcaatcattcgtgtacaagaaagatgggaactttctgaaactgcctgatacggattgccggcagaccccgccattcctggtgttactggtgactagctcccataaacagctggctgagaggatggctatccgtcagacttggggaaaagaacgaatggtcaaaggcaaacagttaaaaactttctttctactaggcactacatcaagcgctgcggagactaaggaagtggaccaggagtcccagcggcatggcgatatcatccagaaagacttccttgatgtgtattacaacttaactttgaagaccatgatgggaatcgaatgggtccataggttctgtccccaggctgcctttgtcatgaagacagattctgacatgttcatcaacgtggattacctgaccgaactgctcctcaaaaaaaatagaactacccgatttttcacaggctttctgaagctgaacgagttcccgattcgccagcctttttccaaatggtttgtgtccaaatcagaatatccctgggaccgatacccccctttctgcagtggaaccggctatgtgttctcaggagacgtcgcctctcaggtgtacaatgttagcaaatctgttccctacataaagttggaggacgttttcgtgggtctgtgcctcgaacggcttaacatccgcctggaagagctgcactcacagcccactttctttcccggaggacttcggttcagcgtgtgtctgttcaggagaatcgtcgcatgccattttatcaaaccacgaactctgctggactactggcaggccttagaaaactctcgaggtgaggattgccctcccgtttag

SEQ ID NO: 246140 - DNA, 933 bp, Artificial Sequence
  Description of Artificial Sequence: Synthetic coding sequence
atggcatttccaaaaatgcgacttatgtacatctgtctgcttgtgttgggcgctctgtgtctatactttagcatgtacagtctaaacccgttcaaggagcaaagcttcgtgtacaagaaagatggaaactttttgaagctgccggacaccgactgtaggcagacccccccatttcttgtcctcctggtgacgtccagccataagcagttagccgaaagaatggctatcaggcagacctggggaaaggagagaatggtgaaagggaagcaattaaagactttcttcttgctgggcaccacatcctctgccgcagagactaaagaagtagatcaggaaagccagcgccacggggatatcattcagaaggatttcctagatgtctactataatctcactttgaagacgatgatggggattgagtgggtacaccggttttgcccgcaggcggcttttgtgatgaaaaccgattcagacatgttcattaatgtggattatctgaccgagttactgctgaaaaagaataggacaacaagattcttcactggtttcctgaaactaaacgaattcccaatccgccaacccttcagcaaatggtttgtgtccaaaagcgaatacccttgggacagatatccaccattctgctctgggacgggatacgtcttctccggcgatgttgcttctcaggtctacaatgtcagtaagagtgtgccgtatatcaaactggaggatgtcttcgtcgggctgtgcctggaaagactaaatattcgcctcgaggagctgcatagccagcctaccttcttccccggtggacttcgcttctccgtctgcctcttcagacgaattgtggcctgccatttcattaagccgagaaccttgctggattactggcaggcgctcgaaaactcacgtggcgaggactgtcccccagtgtag

SEQ ID NO: 246141 - DNA, 1197 bp, Artificial Sequence
  Description of Artificial Sequence: Synthetic coding sequence
atgcgactgcgagaacccctgctgtccggctctgctgccatgccaggcgcttctctccaacgggcatgcaggctgctggtggccgtctgcgcgctccacctgggagtgacacttgtgtattacctcgccggtcgcgatctttcgagattgcctcaactggtaggcgttagcacacccctgcaagggggaagcaacagcgccgcagccattggacagtccagtggggaattgcgcacaggaggagcccgtccgcctccccctttgggcgcttcctcacagccacgccctggcggagactccagccctgtggtcgattcagggcctggaccagcctccaatctaacaagcgtgccagtccctcacactaccgcactttctcttcccgcatgtcctgaggagagtcctctcctcgtgggcccaatgcttatcgagtttaatatgccagtggacctggaactggtggcaaagcagaaccctaatgtgaagatgggtggacggtacgcgcctagagattgcgtatccccacacaaggtggctattatcattccctttcggaaccggcaggagcacctgaagtactggttgtattatctgcatccggttttgcagagacagcaactggattatggaatctatgtcatcaatcaagcaggcgataccatattcaatcgcgcaaagctcctcaatgttggattccaggaagcgcttaaggactacgattacacgtgctttgttttttctgatgtggatctgatcccaatgaacgaccataacgcctacaggtgttttagccagcctagacacatctcggtcgccatggataaattcgggttttccctcccatacgtccagtactttgggggagtatccgcccttagtaagcagcagtttctgaccatcaacggcttccctaacaattattggggctggggcggtgaagatgacgatatctttaatcggctggtcttcagaggtatgtccatatcccgccctaatgctgtcgtaggacgatgcagaatgataaggcacagtcgagataaaaagaatgagcccaacccgcaacggttcgaccgaattgctcacacgaaggagacgatgctcagcgacgggctgaacagcctgacatatcaggtattagatgtccagcggtatccgctctacacacagatcaccgttgacattggtacgccatcgtag

SEQ ID NO: 246142 - DNA, 678 bp, Artificial Sequence
  Description of Artificial Sequence: Synthetic coding sequence
atgagactgcgcgaacccctgctttcaggatcagccgcaatgcctggagcctcactgcagcgtgcttgcagactgttggtagccgtttgtgcgcttcacctgggagtcacgctggtgtactatcttgccggacgggatttatccagactcccgcaacttgtgggagtctccacaccgcttcaggggggttcaaacagtgctgcggctattggacaatcatccggtgaattaagaaccgggggagctaggcctccgcctcctctaggtgctagctctcagccccgaccgggaggtgactcatccccagtcgttgactccggccctgggccagcctccaatttaacctcagtccctgtgcctcacactaccgctctaagcctgcccgcttgccccgaggaatcaccactgctcgttggtcctatgctgattgagtttaacatgcctgtcgatctagagttggtcgcaaagcagaatcctaatgtcaagatggggggacggtatgcgcctagggactgtgtctccccccacaaagtggctatcataataccgttccgaaacaggcaggaacacctcaagtactggctgtactatttgcaccctgtgcttcagcgccagcagctggactatgggatctatgtgatcaatcagtatgaaaagatccgccgattactttggtag

SEQ ID NO: 246143 - DNA, 1068 bp, Artificial Sequence
  Description of Artificial Sequence: Synthetic coding sequence
atgcgcctccgcgagccattactgagtggctcagcggcaatgcccggagcaagtttacagcgcgcttgtcgtcttcttgtcgccgtttgtgcgctccatcttggggtgactttggtctactacctggcaggcagggacttaagtaggcttccacagctggtgggcgtatcaacacctgtcgtggatagtggtccaggcccagcaagcaacttgacaagcgtccctgttccgcatacaacggccttgtcactgcccgcttgtcctgaggagtctcccctactcgtgggacccatgcttatcgagtttaacatgccggttgacttggaacttgtggctaaacagaatccaaatgtgaaaatggggggaagatatgctccacgtgactgtgtgagcccacataaagtcgccattatcataccgtttaggaaccgccaagagcatttaaaatactggctctactatctacaccccgtgctccagcggcagcaacttgactacgggatttacgtgatcaaccaagccggagatacaattttcaacagagccaagctgttgaacgtaggcttccaagaggctttaaaggactacgattatacatgttttgttttctcggacgtcgacctaattccaatgaatgatcacaacgcttataggtgcttctcgcagcctagacacattagcgtggccatggacaaattcggctttagcctcccatacgtccagtattttggcggtgtgtctgcgttaagcaagcaacagttcctcacaataaacggtttcccaaataactactggggatggggaggggaggatgacgacattttcaatcggcttgtcttccgaggcatgagtatttcacgccctaacgcggtagtggggcgatgccggatgatcagacactcccgtgacaaaaaaaacgaacccaacccccagcgattcgaccgcattgcccatacgaaggaaactatgttgagcgacggcctgaactccctcacctatcaagtcctggacgtgcagcgctatcccctgtacactcagatcacagtggatatcggcaccccgtcgtag

SEQ ID NO: 246144 - DNA, 438 bp, Artificial Sequence
  Description of Artificial Sequence: Synthetic coding sequence
atgaacgatcacaacgcttacaggtgtttcagccagccgaggcacatttccgtggccatggataaatttgggttttcactaccatacgtgcagtacttcggtggtgtgtctgccctttccaagcagcagttcctgaccatcaacgggttcccaaataactactggggttggggcggagaggatgatgacatttttaatcgcttggtgtttagggggatgtccatctccaggcccaatgccgtcgtcggcaggtgtcgaatgattagacacagccgggacaagaagaatgagccaaaccctcagcgattcgatcgaattgcccacacaaaagagactatgttaagtgacggtctgaactccctcacctaccaagttctcgacgtgcaacggtatcccctatacacgcaaatcaccgttgatattggaactccatcatag

SEQ ID NO: 246145 - DNA, 1206 bp, Artificial Sequence
  Description of Artificial Sequence: Synthetic coding sequence
atggctgtggaagtgcaggagcagtggccctgccttcctgccgcaggttgtccgggacccctgggcggtccggtggcagcttgtgggatgtccaggctgttgggcggtaccctggaacgcgtgtgcaaggctgtactacttctctgcttgttgcatttcctcgtggccgttatcctttactttgatgtctatgcccaacacctggcttttttttcgcggttctccgctcggggaccagcgcacgccttacaccccgctgcctcatcctcatcctcaagcagcaactgttcacgtccaaatgccactgctagttcatctggcctgcctgaagtgcctagcgccttacccggacctaccgcccctacattgccaccttgtcctgatagtcctcccggactggtcggtcggctgttgatcgagtttacgtccccaatgcccctggagcgggttcagcgcgagaaccccggagtcctcatgggtgggaggtacacacccccagactgcacccctgcccagactgtcgccgtgataattccattcaggcacagagaacatcatcttagatattggctacactacttacatcccatactgcggagacagcgtctgagatacggcgtttatgttatcaatcaacatggcgaagacaccttcaatcgggcaaaactgttaaatgtcggcttcctggaagcgcttaaggaagatgccgcttacgactgctttatctttagcgacgttgacctcgtgcctatggacgaccgcaatctgtacaggtgcggcgatcagcccagacattttgccatagccatggacaagttcggattcaggctcccgtatgcaggctacttcggtggcgtatcagggttgagcaaagcccagttcctccggatcaacggtttccccaacgagtactggggatggggcggtgaagacgacgatatttttaaccgaatctctctaactggcatgaaaatctcacgcccagatatccggattggccgatatcgcatgattaaacatgaccgagacaagcacaacgagccaaacccacagcgtttcactaaaatccagaacacgaagctcacaatgaagcgcgacggtattgggagtgtgagatatcaggtactcgaggtctctagacaaccactcttcacaaacattaccgttgatattgggcgtcctcctagctggccacccaggggttag

SEQ ID NO: 246146 - DNA, 1119 bp, Artificial Sequence
  Description of Artificial Sequence: Synthetic coding sequence
atgagtagactcctgggaggcactctggaaagggtgtgcaaggctgtcttgttactgtgcttgctgcattttctagtggctgtgattctgtacttcgatgtctatgctcagcaccttgcattctttagtcggttttcagcaagaggaccagctcatgccttgcaccctgccgcatcttcctcaagcagctcatcgaactgttcccgcccaaacgctacagctagctccagcggcttgcctgaagttccttcagctttaccaggcccaaccgccccaaccctgcctccgtgccccgactctccgcctgggttagtgggccgactgctgattgagttcacctcccccatgcctctcgagcgtgtgcagcgtgagaatccaggggtcctgatgggtgggagatacacaccccctgactgtacccctgcccaaacggtggcagtcattatcccatttcgccacagagaacatcatttacggtactggctgcactatctacaccctattctgcgcagacaacgtctgcgctatggggtctatgttattaatcagcacggggaagatacattcaacagggcaaaactgctcaatgtgggatttctcgaagctctgaaagaagatgctgcttacgactgcttcatcttctctgatgtggacctggtgccaatggacgaccgtaatctgtaccggtgcggagaccagcctagacacttcgcaatcgcaatggataagtttggcttcagactgccttacgcgggatacttcggaggcgtcagcgggttgagtaaggctcagtttcttcgcatcaatgggttccccaacgaatattggggctggggtggcgaggacgacgacatattcaacaggattagcctaaccggaatgaagatctctcgacctgatatcaggatcgggaggtatagaatgatcaagcacgatcgagataagcataacgagcctaaccctcagagattcactaaaattcagaacaccaagttgacaatgaagcgagatggcattggtagcgtaagatatcaagtgcttgaagtgagccgccaaccactcttcactaacattaccgtcgacattgggaggccaccaagctggcctccccgtgggtag

SEQ ID NO: 246147 - DNA, 1119 bp, Artificial Sequence
  Description of Artificial Sequence: Synthetic coding sequence
atgtccaggcttctgggtggaacgttagaacgagtatgcaaggcggtcttgctactgtgcctgttgcacttcctggttgcagtgattttgtatttcgacgtttatgcccagcacctggcgtttttctctcgattctccgccaggggccctgcccacgcactgcatcccgctgcgagttcatccagcagctcctcaaattgttccagacctaatgccactgcttcttcctcagggctgcctgaagtcccaagtgctctgccgggacccacagcccctacactaccaccctgcccagactctcctcccggtctcgtaggcagactgctgatcgaattcacaagtcctatgccactggaacgtgttcagcgtgagaaccctggcgtgctcatgggcggtcgctacactccacccgattgcactccggctcagaccgtggcggtgattattccttttagacaccgcgaacaccaccttaggtattggctccactacctccacccgattttacgtaggcaacgtctgcgttacggcgtgtatgtcatcaatcagcatggagaggacaccttcaatagagcaaaacttctgaatgtgggatttctagaggccctgaaggaagacgcagcctacgattgttttatattttccgacgtcgacctcgtccccatggacgaccgcaacctctatcggtgcggtgaccagccgcgacattttgctatcgccatggataaattcgggttcaggcttccgtatgctggatactttgggggagtctctgggctgagcaaagctcagttcctccgcatcaatggattccctaacgaatattggggctggggcggtgaggatgatgatatcttcaatcggattagtctgaccgggatgaagatcagtcggccagacattagaattgggcgatacaggatgattaagcacgacagggataagcataacgaacccaacccccaacgcttcactaagattcagaacacaaagctcacaatgaaaagagatggcattgggtccgtcaggtaccaggttctcgaggtgtctcgacagcctttgtttacgaatatcactgtggatatcgggcgaccaccttcatggcctccgagagggtag

SEQ ID NO: 246148 - DNA, 921 bp, Artificial Sequence
  Description of Artificial Sequence: Synthetic coding sequence
atgcccagcactcagcttcttgccgctgcagccgctgccgctactgccccaggtccaacgccccctccgctggcccctgggagtctacgaagtccggttccgtgccccgtgccgagactgccacggtgccatcccgtactgacaagacatcttgtgctgcgtgtgcaaagagagaaccccggtgtgctcatgggcggacgatacacacctcctgactgtacacctgcccaaacagtcgcggtgataattcctttccgccacagagaacaccacctgcggtattggctgcattacctgcatccaatattacgaagacagaggctgcggtatggggtctatgttattaaccagcacggcgaagatacatttaatagagccaaactcctcaatgtgggtttcctggaagcgttaaaagaggacgccgcttacgactgttttatattctcagatgtcgacttggtaccgatggatgacagaaatctgtaccgatgcggggatcagcccagacatttcgccatcgccatggataagtttggatttcgcctcccatacgccggttatttcggtggtgtgtcaggcctcagcaaggctcagttccttcgaatcaatggctttcctaacgagtattggggctggggcggagaagacgatgacatcttcaatcgaatctcactgacagggatgaagattagccgcccagatatcagaatcggaagataccgcatgatcaagcatgatagagataaacacaatgaaccaaacccccaaaggtttaccaagatccagaatactaaacttactatgaaaagagacggcataggcagcgtgagataccaagtactcgaggtatcaagacagcccttattcactaacatcactgtcgacattggccgacccccttcttggccgccaagaggatag

SEQ ID NO: 246149 - DNA, 441 bp, Artificial Sequence
  Description of Artificial Sequence: Synthetic coding sequence
atgttgaggaggctcctggagcggccatgcactctcgcgttactagtgggctcacagctggcagttatgatgtatctgagcctcggtgggtttaggtccctgagcgcactgttcggacgcgaccagggcccaacctttgattactcacatcccagagacgtgtactctaacctgtctcaccttcccggtgccccaggcggtccccctgcccctcagggactgccctattgccccgaacgctcccctctgctcgttggacccgtgtcagtctccttctctcccgtgccttctttggccgagatcgtggagagaaatccaagagtggaaccaggcggtagataccgcccacctgctgctctgcccccagcacctttattggccgctcctgctgcatgcctctggcatctgtgtcaccctcccggttggaaatggaacatttag

SEQ ID NO: 246150 - DNA, 1182 bp, Artificial Sequence
  Description of Artificial Sequence: Synthetic coding sequence
atgttaaggcgtttactggagcgcccttgtactttggctctccttgtcggctcccagttggcagttatgatgtatctctccctaggtggctttcggtccctcagcgcactgtttggacgcgaccagggcccaaccttcgactatagccaccccagagacgtttactccaatctgtcccacctgcccggagcacccggaggccctcccgctccacagggcctcccgtactgtcccgagaggtcacccctgctggttggtcccgtttctgtgagcttctcccctgttccttccctggctgagatcgtagagcgaaaccccagggttgaacctggagggcgttatcggcctgccggatgtgaaccccgtagcaggactgcaataatcgttcctcaccgggctagagaacaccacctgcgattgctactataccatttgcatccattcctgcagcggcagcagctggcctacggaatctacgtgattcaccaagcgggtaacggcacatttaatcgagcaaagctgttaaacgtcggcgtgcgtgaggcccttagagatgaagagtgggattgcctctttcttcatgatgtcgacctcctgccagaaaacgaccataacctctatgtctgcgatcccaggggccctcggcacgtcgctgtagccatgaacaaattcggatactctctcccgtacccacagtacttcgggggtgtgtcggctttgaccccagaccagtacctgaaaatgaacggattccctaacgagtattggggctggggaggtgaagacgatgatatagccaccagggtgaggctcgctggtatgaaaattagcaggccccctacctcagtgggtcattacaagatggttaagcacaggggggataagggcaatgaggagaaccctcatagatttgacctgctcgtgcggacccagaattcctggacccaggacgggatgaacagcctgacttaccagcttttggccagggaactgggtccactttacactaacatcaccgcagatatcggcactgacccgaggggcccacgggctcctagcggccctaggtatcctcccggaagcagtcaggctttccgacaggagatgctgcagagacgcccaccagccagacccggacccttgagtactgctaatcataccgcgctccgtggatcacactag

SEQ ID NO: 246151 - DNA, 1182 bp, Artificial Sequence
  Description of Artificial Sequence: Synthetic coding sequence
atgctacggaggctgctcgaacggccatgtacactggctctgctcgtcgggtcacaactggctgttatgatgtacttgtcccttggcggattccgctctctctccgcattattcggtcgggaccaaggacctactttcgactactcccacccacgcgatgtatacagcaatctgtcccacctcccaggcgctccgggaggccctccagctcctcagggactgccttattgcccggaaaggtcgcctctgctggttggaccagttagtgtgtccttcagccctgttccttcactagcagagattgtcgagcgcaacccaagggtggaacctgggggtcgatataggccagcgggttgcgagcctcgcagtcgaactgcgatcatagtcccccaccgggctagagagcaccacttacgcctgctgctgtatcatctgcatccattcttgcaaaggcaacagttggcgtacggtatctacgtcatccaccaggccggaaacgggaccttcaatagggccaagctgttgaacgtgggtgtacgggaggctcttcgtgatgaagagtgggactgcttgtttctccacgacgtcgatttgcttcctgaaaacgatcacaatctctatgtctgcgaccccagaggacctagacacgttgcagtagcaatgaataaattcgggtattcactgccctaccctcagtattttggtggggtcagtgcactcaccccagatcagtacctgaagatgaatggctttcccaacgaatactggggctggggcggagaggatgacgacatcgccacacgagtgagactggcgggtatgaagatatccaggccgcctacctcagtgggtcattacaaaatggtcaagcacagaggtgacaaagggaacgaagagaatccccatcgattcgatctgttagtacgaacccagaattcatggacacaggacggcatgaacagcctgacttaccagctgctagcaagggagctgggtcctttatatactaacattaccgccgacattggtaccgaccccagaggcccaagggctccttccggcccaaggtaccccccagggagctcacaggcctttcgccaggagatgctgcagaggaggccaccagcacgacccggaccactgagtacagccaaccacacaccgagcgaagttcacacctag

SEQ ID NO: 246152 - DNA, 1182 bp, Artificial Sequence
  Description of Artificial Sequence: Synthetic coding sequence
atgctgagaagactcctcgagcgaccttgcacactcgccctgctggtgggttcacaattagccgtaatgatgtacctgtccttggggggattccggtctttgagtgcactttttgggagggatcaggggccaacattcgattacagccatccccgtgacgtgtattccaatctgagccaccttcctggtgctccagggggtccccctgcccctcagggactgccttattgtccagagcggtctcctttgctagtgggccctgtttccgtctcattcagtcccgtgccaagtttggcagagatcgtggagagaaacccccgtgtggagcccggaggcaggtatcgaccagcaggatgcgagcctaggagccggacggctatcatcgtgcctcaccgtgcacgagagcaccatctaagattgctcttatatcacttgcatccttttcttcagcgacaacagttggcttatggcatctacgttatccatcaggccggtaacgggaccttcaacagggctaagctgctgaacgtgggcgtgagggaagcgctgagggacgaggagtgggactgcctgttcctccacgacgttgaccttctgccagaaaatgaccacaatctttacgtttgtgatcctcgaggcccacggcatgttgccgtggccatgaacaaattcggttacagcttgccttacccacagtatttcggaggagtctccgctctcacgccagaccagtacctgaaaatgaacgggttccccaacgagtattggggttggggtggtgaggacgacgatatcgcgacacgggtgcgtttagctggcatgaagataagtcgacctccaacgtctgtcggccactacaaaatggtgaaacacaggggtgataaggggaacgaagagaacccccaccgctttgatctgctggtgagaacacagaatagttggactcaggacggtatgaactcgttaacttaccaactgctcgcgagggaattggggcctctgtacacaaacataacagccgacatcgggacggaccctcgaggtcctagggcaccctcagggcctcgctatccgcctggctcctcccaagcgtttaggcaggagatgctccagagaaggccaccggcacgcccaggaccccttagtacagctaatcacacagcgctgcgcggatctcattag

SEQ ID NO: 246153 - DNA, 1113 bp, Artificial Sequence
  Description of Artificial Sequence: Synthetic coding sequence
atgctccgaagattgctcgagcgcccatgcacactcgcattgttcggcagggaccagggacccacattcgactactcccacccgagggacgtctatagcaacctgtcacatctaccgggtgccccaggagggcctcccgcaccacaggggctcccctattgccccgaaagaagccctctactggttggaccagttagcgtgtccttttccccagtcccatcactggctgagatagtagagaggaatcctcgagtcgaacccggtggacggtacagacccgctggatgcgagccaagaagccgtaccgccattatcgtgccccacagagccagggaacatcacctcagattactactctatcatctccatcccttcctccagagacagcagttggcttacggaatttacgtgattcaccaggctggaaacggcactttcaatcgggcaaagctgttaaatgtgggggttcgggaggcactgagagacgaggagtgggactgccttttcttgcatgacgtcgacctattgccagagaatgatcataatctgtacgtgtgcgatccccgaggccctaggcatgtggccgttgccatgaacaaattcggctacagcctgccttacccccagtatttcggtggggtgtcggccctgactcccgatcagtaccttaagatgaatgggtttcccaacgagtattggggttggggcggagaggatgatgatatagcaactagagtgcgtctcgctgggatgaaaatttctcggccacccacctcggtcggtcattataaaatggttaagcatcggggtgataagggcaacgaagagaaccctcaccgcttcgatctgttggtgcggactcagaattcctggactcaggatgggatgaactctttaacataccaactgctcgctcgcgagcttggacccctgtataccaatatcacggctgatattggcactgatccgcgaggtccacgggcaccctccggccctcggtatcctccaggctccagccaagctttcagacaagaaatgcttcagcgacggccacctgccaggcccggacccctttcgacagctaatcacaccgccctgcggggttctcactag

SEQ ID NO: 246154 - DNA, 684 bp, Artificial Sequence
  Description of Artificial Sequence: Synthetic coding sequence
atgttacgtcgattgctggagagaccctgcacgctggctctgctggtaggctcacaactggccgtcatgatgtacctgtccttaggtggatttaggagtctgtcagctttgttcggtagggatcagggcccaacattcgactatagccacccaagagatgtgtacagcaatctctctcatctccctggcgctccgggaggtcccccagctcctcagggcctgccttactgcccagagcgaagccccctgctagtgggcccagtgagcgtgtccttctctcctgtgccttctctggctgagatagtggaacgaaatcccagagtagagcccggtggcaggtatagacccgctggctgcgaacctcggtcccggactgccatcattgtcccgcacagggcaagagaacatcatctgaggctgctgttgtatcacctccacccattcctgcagagacagcagttggcttatggtatctacgtgattcatcaggccggaaatgggacgttcaaccgtgcaaaactgctgaatgtcggagtaagagaagccctgcgcgacgaggaatgggattgtctgttcttacacgatgtagatctgctccccgagaatgatcacaacttgtacgtttgcgaccctagggggccaaggcacgtggcggtcgcaatgaacaagtttggatataggtag

SEQ ID NO: 246155 - DNA, 1035 bp, Artificial Sequence
  Description of Artificial Sequence: Synthetic coding sequence
atgggcttcaatcttaccttccacctcagttataagtttaggctactgttgttgttaactctttgcctgaccgtggttgggtgggcaacttctaactactttgtgggagccatccaagagatcccaaaggccaaggagtttatggccaactttcataagactctcatactcggtaaaggaaagacgctgaccaatgaggccagcaccaagaaggtggagctcgacaattgcccaagtgtgagtccatacttgcggggtcagagcaaattgatcttcaaaccggacctcaccttggaggaagttcaggccgaaaatcccaaagtctctcgcggtcggtataggccccaggagtgtaaggctctccagagggttgcaattctcgttccccaccgaaatagggaaaaacacttaatgtacctgctcgagcacttacacccttttctccagcgacagcagctggattacggaatttatgtcatccaccaggcagaagggaaaaagtttaatagagcaaaactcctgaatgttggctacctggaagcgctcaaagaagaaaactgggattgctttatttttcacgatgttgatctggtccccgagaacgattttaacctctacaaatgcgaagagcatcctaaacatttggtcgtcggtcggaacagcacggggtaccggcttcggtatagcggatatttcggcggtgttaccgctttgtctcgcgagcagttctttaaggttaatggcttcagcaataattattggggatgggggggtgaggacgatgatctgcgcctgagggtggagctgcagagaatgaaaattagcaggccgctccccgaggtgggaaagtacacgatggtattccacacccgcgataagggaaacgaagtgaatgccgagcgaatgaagcttctacaccaagtgtctcgagtctggcgcaccgacggactttcttcatgcagttacaaactcgtatcagtagaacacaatcctttgtacattaacattacagtggatttctggtttggcgcttag

SEQ ID NO: 246156 - DNA, 1035 bp, Artificial Sequence
  Description of Artificial Sequence: Synthetic coding sequence
atgggatttaacttgacatttcacctgtcttataagttcaggcttctgctactactgaccctgtgcctgacagtggtcggctgggcaacctccaactactttgtgggggcaatccaggaaatacctaaagccaaggagtttatggccaactttcacaagacgctcatactgggtaagggcaaaacactaacgaatgaggcctccaccaagaaagtggaactggacaactgcccctccgtttccccctaccttcgcggacagtcaaaacttatatttaaaccggatctgaccctggaggaggtgcaggcagagaaccctaaagtaagtagggggagatatcggccacaggaatgtaaagcactgcaaagggtcgcaatccttgtccctcatcggaatagagaaaagcacctgatgtacctccttgagcatctgcacccctttctgcagagacagcagttggattacggaatctatgtgattcaccaggcagagggcaagaagttcaatagagccaaactcctcaacgtcggatacctagaagcactgaaagaggagaactgggattgctttatttttcacgatgtggacctcgtccccgagaatgattttaatctctataaatgtgaagagcatcccaagcacctggtcgtgggaagaaactccactgggtacagactcaggtatagcggttacttcggcggtgtcacagctctgtccagggaacaatttttcaaggtcaacggatttagcaacaactattggggctgggggggtgaagacgacgatctccggctgcgtgtggagctgcagcggatgaagataagccgcccactaccagaggtaggcaaatatacgatggtctttcataccagagacaagggcaatgaagtgaacgccgagaggatgaaactcttacaccaagtgtcacgggtgtggcggaccgatgggctttcttcttgcagttacaagctcgttagcgttgagcataaccctctgtacataaatatcacggtcgatttttggttcggggcttag

SEQ ID NO: 246157 - DNA, 21 bp, Artificial Sequence
  Description of Artificial Sequence: Synthetic coding sequence
atggggtttaatttgacctag

SEQ ID NO: 246158 - DNA, 9 bp, Artificial Sequence
  Description of Artificial Sequence: Synthetic coding sequence
atggggtag

SEQ ID NO: 246159 - DNA, 168 bp, Artificial Sequence
  Description of Artificial Sequence: Synthetic coding sequence
atgggattcaacctgacttttcatctgtcatacaaattccggcttctcttgttattgaccctgtgtctgaccgtcgtcggttgggcgacctcaaactatttcgtgggcgctattcaagaaatcccaaaggccaaggaattcatggccaacttccacaagacgttgtag

SEQ ID NO: 246160 - DNA, 66 bp, Artificial Sequence
  Description of Artificial Sequence: Synthetic coding sequence
atgggatttaacttgacctttcacctatcgtacaaatttagactgttactgctgctgacactatag

SEQ ID NO: 246161 - DNA, 411 bp, Artificial Sequence
  Description of Artificial Sequence: Synthetic coding sequence
atggggtttaaccttacctttcatctgagttacaagttccgattacttctgctccttactctctgcctaacagtggtgggctgggccacgagcaactattttgtgggcgctatacaggagatccctaaagcgaaggagttcatggctaatttccataagactcttattctcggaaaggggaagaccctcaccaacgaagccagcacaaaaaaggtagagctagacaattgccctagtgttagcccatatctcagaggccagtccaagctgatttttaaaccagatctgacgctcgaggaagtgcaagctgaaaatccgaaggtctcacgtggtcgatacaggcctcaggagtgcaaggccctccaaagggtcgcaattctcgtgcctcaccggaatcgagagaagcactag

SEQ ID NO: 246162 - DNA, 357 bp, Artificial Sequence
  Description of Artificial Sequence: Synthetic coding sequence
atggggttcaacttaaccttccacttaagttataaattcaggctgctgttgttgttaactctttgtttgactgtagtagggtgggcgacgtctaattatttcgttggagctatccaggagatccctaaagcaaaagaattcatggctaactttcacaaaaccctcatcttgggaaaagggaagactctcacaaatgaagctagcaccaaaaaggtggagctcgacaattgcccgtcagttagtccttacctgcggggacagtctaagctgatcttcaagcctgacctcactctggaggaggtgcaggccgagaacccgaaagtgtcgagaggcaggtataggccccaggaatgctag

SEQ ID NO: 246163 - DNA, 1035 bp, Artificial Sequence
  Description of Artificial Sequence: Synthetic coding sequence
atgggttttaatctcacatttcacttgagctataagttccggctgcttctcctcctcaccttatgcttgacagttgtggggtgggcgacaagcaactattttgttggagccattcaggagatccccaaagccaaggagtttatggcaaacttccacaaaaccttaatactgggaaagggtaagacccttacgaatgaggcctccactaagaaggttgaactggacaactgcccgtcagtgagtccgtatctacgcggtcagtccaaactgatttttaagcccgacctgaccctcgaggaagtgcaggccgaaaatccaaaggtttctagaggcaggtatcgacctcaggagtgcaaggctctgcagagggttgccatactggtcccacacaggaatagggaaaagcatctgatgtacttgctggagcacctgcatccgttcctacagaggcaacagttagactacggcatctatgtaatccaccaggccgaaggaaagaagtttaatcgtgctaaacttttaaacgtgggttacctggaagctctcaaggaagagaactgggactgttttatctttcatgacgttgatctagtacctgagaacgacttcaatctgtacaaatgcgaagaacacccaaagcatctggtggttggccgaaactccaccggctaccggctgcgctatagcggatactttggcggagttaccgctttatcaagggagcagttctttaaagtaaatggattctccaataattactggggctggggaggcgaagacgacgacttaagactgcgcgtggaactgcagcgcatgaaaataagtcgccctcttcctgaagtgggtaaatacacaatggtctttcacacaagggataaaggaaatgaggtgaacgcagaacgaatgaagctattgcaccaggttagcagagtttggcgaaccgacggcctgtcttcctgctcttacaagctggtgtccgtggagcacaaccccctgtatatcaacataactgtcgatttttggttcggcgcttag

SEQ ID NO: 246164 - DNA, 129 bp, Artificial Sequence
  Description of Artificial Sequence: Synthetic coding sequence
atgggcttcaacttgacttttcatttgtcatataaattccggctcctgctcttgctgacactctgtcttactgtcgtaggctgggccactagcaactatttcgtaggcgcaatccaggaaattccttag

SEQ ID NO: 246165 - DNA, 1167 bp, Artificial Sequence
  Description of Artificial Sequence: Synthetic coding sequence
atgagggccagacggggactgctgcgcctgccacgtagaagccttctcgccgcactctttttctttagcttgtcaagtagcttgctgtactttgtgtatgtagcgcctggcatagtcaatacatatttgtttatgatgcaggcgcaagggatcttaattagagacaatgtgcgcacaatcggcgctcaagtctacgaacaggtgctcagatctgcctacgctaagaggaacagcagcgtcaatgattctgactatcccctggatttaaatcacagcgaaacattcctgcaaactacgacgttcctcccagaagacttcacctattttgctaatcacacttgtcctgagaggcttcctagtatgaaggggcctattgacatcaacatgtctgagattggcatggactacatacacgagcttttttctaaagatccgaccataaagctcgggggtcactggaagccgagcgattgcatgccgagatggaaagtagccattcttattccctttaggaaccgccacgagcacttgccagtactgttccggcatcttctcccaatgctccagcgccagcgactgcagttcgcattttacgtcgtggaacaggtcggtacgcagcctttcaaccgggcaatgctgttcaatgttgggttccaggaggctatgaaggatctggactgggactgtctgattttccacgatgtggatcacatacctgagagcgaccgcaactattatggctgcggacaaatgcctaggcatttcgcaacgaagctagataaatacatgtatctgcttccctacacggagttctttggcggagtcagtggattgaccgtcgagcagttcagaaaaatcaacggatttcccaacgctttttgggggtggggcggtgaagatgacgacctgtggaaccgagtccaaaatgccggatactccgtgagtcgcccagagggagatactgggaaatacaaatctattccacatcaccacagaggagaggttcagttcctgggcagatacgcactcctgaggaagtcaaaggagcgccagggcctggatggccttaacaatctgaactatttcgccaacatcacatatgatgccctgtacaagaacatcaccgtgaatctgacaccggagctggctcaggtcaacgagtattag

SEQ ID NO: 246166 - DNA, 1032 bp, Artificial Sequence
  Description of Artificial Sequence: Synthetic coding sequence
atgtcggtactgaggagaatgatgagagtttccaataggtctcttctagctttcattttctttttcagtctgtcatcttcttgtctgtatttcatctatgtcgccccaggcatagattatccagagggcaacaattccagcgactatctggtgcagacaaccacgtatctgcctgaaaatttcacctattccccctacctgccatgccccgagaagcttccttacatgaggggattcctgaacgtgaatgtgagcgaagtgtcgttcgatgagatccaccagcttttctctaaggacttagacatagaaccaggaggacactggcgcccaaaggattgtaaacctagatggaaagtggcggtgctgatccccttcagaaacagacatgaacatctccctattttctttctccatctgattcccatgctacagaaacagcgtcttgaatttgcgttctacgtgatcgagcagacgggtacccagccctttaaccgcgctatgctgttcaatgttgggtttaaggaggccatgaaggattcagtctgggactgcgtgattttccacgacgtggatcacctgcccgagaatgaccgtaactactatggctgtggcgagatgccaaggcacttcgctgccaaattggacaagtatatgtacatccttccatataaggaattcttcggaggtgtctctggtctgacagtcgaacagttccgcaaaatcaatggttttccaaacgccttttgggggtggggcggagaggacgacgatctgtggaacagagtccactatgccggatacaacgtgacacgacctgaaggtgatctcggcaaatataagagcatacctcatcaccaccgcggagaggtgcagttcttggggaggtataagctgttgaggtattccaaggaaagacagtacatcgacggcttaaataatttgatctatcgacccaagattttggtggacagactatacacaaatatttcagtgaatcttatgccagagttagcaccaattgaggattattag

SEQ ID NO: 246167 - DNA, 1149 bp, Artificial Sequence
  Description of Artificial Sequence: Synthetic coding sequence
atgagtgtcttgcggaggatgatgagggtgagcaacaggtctctcctggcatttatcttcttcttctcgctgagctcatcctgcctctattttatctacgttgccccagggattgccaatacttatctttttatggttcaggccaggggaattatgctgagagagaatgtgaagacgattggccacatgattcgcctctacacaaacaagaattctacacttaacggtaccgattatcccgagggaaacaactcctctgattatctggtgcagactactacctatctgccagagaatttcacctattccccctacctaccatgcccagagaagctaccctacatgagaggattcctgaatgttaacgtaagcgaagtatcctttgatgaaatccatcaactgttttcaaaggacttggatattgagcctggaggccattggcgccctaaagattgcaaaccacggtggaaggtggccgtccttatcccttttcggaaccgccatgagcatctgccgatctttttcctgcaccttatcccgatgctccagaaacagcgtctcgaattcgccttttatgtgatcgagcagacaggaacacaaccctttaaccgcgctatgctcttcaacgttggctttaaagaagctatgaaagacagcgtttgggactgcgtgattttccatgacgttgatcacttacccgagaatgaccgaaactactatggatgcggggagatgcctaggcacttcgctgccaaactggataagtatatgtatatcctcccctataaagagttcttcggcggagtcagcgggctgactgttgagcaattccggaaaatcaatggattccctaatgccttttggggatggggtggagaagacgacgacctgtggaaccgcgtgcattacgccggatataatgtgactaggcccgaaggcgacctcggcaaatataagtccatacctcaccaccatagaggtgaagtccagttcctcggtcggtataaacttctgcgctactccaaggagcgtcagtatatcgacggactaaacaacctgatttaccgcccaaaaatcttagtggaccgcctgtacacaaacattagcgttaacctgatgccggagctcgcccctatagaagactactag

SEQ ID NO: 246168 - DNA, 1032 bp, Artificial Sequence
  Description of Artificial Sequence: Synthetic coding sequence
atgagtgttctgcggagaatgatgcgggtctcaaatcgatctctgttagcctttattttttttttcagcttaagcagcagctgcctgtatttcatttatgtggccccaggaatcgctaatacatatctgtttatggtccaggctagggggattatgctgcgggagaacgttaagaccattgggcacatgatcagactgtatactaataaaaattcgaccctcaacggcaccgactacccagagggcaacaactctagcgactacctggtacagacgacaacttacctgccggagaacttcacatacagcccttatctaccctgtccggaaaagctgccttatatgaggggcttcctgaatgtgaacgtgtctgaagtctcattcgacgaaattcatcaactgttctctaaggaccttgatatcgagccaggcggacattggaggcccaaggactgcaaacctagatggaaaaccggcacccagcccttcaatcgagctatgctgttcaatgtgggattcaaggaggcaatgaaagacagcgtttgggactgcgtgatattccatgacgtcgatcatttacctgaaaatgatcgcaactactatgggtgcggcgagatgcctcgccatttcgcagctaagttagataagtacatgtacatactcccgtataaagaattctttggcggtgtgagtggtctcactgtcgaacaatttcgtaagattaacggatttccaaatgcgttctgggggtggggaggagaagacgacgatctgtggaatagggtgcactacgccggatataatgttactcgacctgagggagacctgggaaagtataagtctattccacatcaccaccgcggtgaggtgcagttcctcggtaggtataaactcctgcggtatagcaaggaaagacagtatatcgatggcctgaataacctgatctaccgtccaaaaattctagtcgatcggctctacacgaatatttctgttaatttaatgccagaacttgcccctatagaagattattag

SEQ ID NO: 246169 - DNA, 1047 bp, Artificial Sequence
  Description of Artificial Sequence: Synthetic coding sequence
atggcagaaaaagtgctagtgactggcggagcgggttatatcggcagtcacacagtgctagagttgctcgaggccggttacctgcccgtggtgattgacaactttcacaatgcttttcgaggaggagggtcgcttcctgagtcattaaggagagtccaagagctgaccgggagatccgtggagttcgaggaaatggacatcttggaccagggcgctttacaaagactcttcaaaaagtactccttcatggccgtaattcatttcgccggtctcaaggcagtcggcgagtccgtacagaaacctctggattactatcgcgtcaatctgactgggacaatccagctactggaaatcatgaaggcgcacggcgtgaagaacctggtgttcagctcatctgccactgtgtatggcaaccctcagtatctgccactggatgaggctcatcccacagggggttgcaccaacccttacggcaaatcgaagttctttatcgaggaaatgataagagacctgtgtcaggccgataaaacatggaacgccgttctgcttcgttacttcaatccaaccggtgcgcacgcttccggctgcattggcgaggatccacaagggatcccaaacaatctcatgccttatgttagtcaagttgctatagggaggagagaagctctcaacgtctttggcaacgactatgacacagaggacggcacaggcgtgagggactacatacacgtggtcgacctggcaaaaggacatattgcagctcttcggaagctcaaagaacagtgcggttgtcggatctataacttaggcactggcacaggctacagcgtccttcaaatggttcaagccatggagaaggcctcaggaaaaaaaattccatataaggtggtcgccaggagagaaggagacgtcgctgcatgctatgcaaaccctagcctggcccaggaggagctgggctggacagccgcacttgggctcgataggatgtgtgaagatctgtggcgctggcagaagcaaaatccgtccggctttggcacccaagcctag

SEQ ID NO: 246170 - DNA, 777 bp, Artificial Sequence
  Description of Artificial Sequence: Synthetic coding sequence
atggatattctggatcagggagctctgcaacgcctttttaagaagtatagtttcatggctgtgattcattttgcaggtctcaaagctgtcggcgagtctgtgcaaaaacccctagactattacagagtcaacctgaccggcactattcaactgctggagattatgaaagcccatggcgtgaagaatttggtgttttcatcctccgcaacagtgtacgggaatccacagtacttgcctctcgacgaagcacacccaactggcggatgcacaaacccttatggcaaatctaagttttttatcgaggagatgatcagggacctgtgccaggcggacaaaacttggaacgctgtgttgttgcgatacttcaatcccactggagcacatgcatccggatgcataggggaggatccacagggtatcccaaataacctgatgccctacgttagccaagtagcaatcgggcgaagagaagccctcaatgtttttggcaacgattatgatacagaggacgggactggcgtacgcgattacattcatgtggtcgacctcgcgaagggccatattgcagcactccgcaagctgaaagaacagtgcggatgccgtattccatacaaagtcgtcgcccgacgtgagggagatgtggctgcttgttatgcaaatccttccctggctcaggaggagcttggatggactgccgcattgggattagacaggatgtgcgaggacttatggaggtggcaaaagcaaaaccctagcggattcggcacccaggcgtag

SEQ ID NO: 246171 - DNA, 684 bp, Artificial Sequence
  Description of Artificial Sequence: Synthetic coding sequence
atggatatcctcgaccagggcgctctgcagagactgtttaagaagtacagcttcatggcggtgattcacttcgccggtctgaaggcagtgggcgaatctgtgcaaaagcccctggactattatcgcgtgaacctgacgggtaccatccagttgctcgaaataatgaaggctcacggcgtcaagaatcttgtcttctcatcgtctgccacggtctacggtaacccccagtatctgccactggatgaggcccatcccacagggggttgtactaacccttacggaaagagcaaattcttcatcgaggagatgatacgcgacttgtgtcaagccgacaagacctggaacgctgtcctgttgagatatttcaatcccaccggtgcccacgcatccgggtgcataggcgaggacccccagggtatacccaataacctgatgccctatgtttcacaggtagcgatcgggagaagggaggctctaaatgtgtttggcaacgactacgatacagaggatggcaccggcgtacgtgactacatacatgtcgtcgatcttgccaaaggtcacattgcggcattacggaagctcaaggaacagtgcggctgtcgaatttacaatctcggcaccgggaccggatactcggtattacagatggtgcaggccatggagaaagcctcgggaaaaaagtag

SEQ ID NO: 246172 - DNA, 588 bp, Artificial Sequence
  Description of Artificial Sequence: Synthetic coding sequence
atggcagaaaaagtgctggtgactggaggtgctgggtacatcggtagccatacagtcctggagctcctggaggctggataccttcccgttgtaattgacaactttcataacgccttcagaggcggtggaagcttgccggaatctttaaggcgggtgcaagagctcactggcaggtctgttgaattcgaggaaatggacatcttggaccagggggctctgcagcgcctgtttaagaagtacagtttcatggccgttatacacttcgccggtctgaaagcagtgggcgaaagcgtgcagaagcctcttgactactatcgagtgaatctcaccggcacaatccagctgctggaaatcatgaaggcacatggagtcaaaaatctcgtgttctccagtagcgccacggtgtatggaaatccacagtatctgccccttgacgaagctcatcccacaggtgggtgtaccaatccatatgggaaaagtaagttctttatcgaggaaatgatccgggacctttgccaggctgacaaaacatggaacgccgtgctcctaagatattttaatcctaccggagcccacgcttcaggttag

SEQ ID NO: 246173 - DNA, 720 bp, Artificial Sequence
  Description of Artificial Sequence: Synthetic coding sequence
atggacatcttggaccagggcgcactccagcggctgttcaaaaagtactcttttatggccgttatacattttgctggtctgaaggcagttggagagtcagtgcaaaaacccctggactactatcgtgtgaaccttacaggtacaatccagttgcttgaaatcatgaaagcacacggagtgaaaaatctcgtcttcagttctagtgctactgtgtacggcaacccacagtacctgccccttgatgaggcacatccaaccggcggttgtaccaatccctatggcaagagtaaattctttatagaggagatgatcagagacctgtgtcaggccgacaaaacctggaatgccgttttgctccgctatttcaaccccaccggagctcatgccagcgggtgtattggcgaggacccccaggggataccaaataatcttatgccctacgtgtctcaggttgctattggacgcagagaggctctcaatgtctttgggaatgactacgataccgaagatggcaccggggtgcgggactatatccacgtggtggaccttgccaagggtcacatcgcagcccttcggaaactcaaagaacaatgcggctgccgtattccctataaggtggttgcacggagagagggggacgtggccgcatgttacgccaatcccagcctggcgcaagaagagctgggctggactgccgcattgggcttagaccgtatgtag

SEQ ID NO: 246174 - DNA, 585 bp, Artificial Sequence
  Description of Artificial Sequence: Synthetic coding sequence
atggccgagaaggttctggtcactgggggagcgggttacattggaagccatacagtgctggaattgttggaggccggttaccttccagtcgttatagataactttcataacgctttcaggggaggcggttcgttaccagagagcctgaggagagtgcaggaattgactggtaggagcgtcgagttcgaagaaatggacatcctcgaccagggagcactccaaagactcttcaagaaatactcatttatggcagtgattcacttcgctggactgaaagcggtgggcgagagcgtgcagaaaccgctagactattatagggttaacctcaccggcacaattcaactacttgagatcatgaaagcacatggtgtcaagaatctcgtgtttagttcctctgccacagtttacggcaatccccagtatctgccgttagatgaagcgcacccaactgggggatgtacaaacccgtatggcaaatccaaattctttattgaagagatgatcagagatctatgtcaggcagacaagacctggaatgccgtccttcttaggtattttaatccaaccggcgctcatgcatcctag

SEQ ID NO: 246175 - DNA, 327 bp, Artificial Sequence
  Description of Artificial Sequence: Synthetic coding sequence
gttgctattggcaggagggaggctctgaatgtgttcggcaatgattacgacacagaagacgggaccggtgtccgcgattacattcatgtcgtggacctggcaaaagggcatatcgcggcactcagaaaactgaaggagcaatgcggctgccgcataccctacaaagtggtcgcaagacgggagggcgacgtagctgcctgctacgccaatccttccctggcccaagaggagctggggtggaccgctgcactgggcctggacaggatgtgtgaagatctgtggaggtggcagaagcagaatccaagcggattcggcacccaggcttag

SEQ ID NO: 246176 - DNA, 1119 bp, Artificial Sequence
  Description of Artificial Sequence: Synthetic coding sequence
atgaagtatttgcgtcataggagaccaaacgccactctgatcctcgccatcggggcttttactctgctattgttctcccttttggtgagcccacccacttgtaaggtgcaggagcagccccctgccatccccgaggccctggcctggcccacccctccaacaaggcctgccccagccccatgccatgctaacacctcaatggtcacgcatccggatttcgccacccagccacaacacgtacagaattttctcctctatagacactgcaggcacttccctctcctacaggacgtgcccccatcaaaatgtgctcagccggttttcttgctgttagttatcaagtcgtcaccctccaattacgtcagaagggagctgctgcggcgtacttggggcagagagcgtaaggtgagagggctccagctccggctgttgttcctcgttggcacggcctcaaatcctcacgaagcgcgaaaggtgaaccgtttgttagagcttgaggcccagacccacggggatatactacagtgggattttcacgatagctttttcaatctgacactcaagcaggtgctctttctgcaatggcaggaaacaagatgtgctaatgcctcctttgtgctgaacggagacgacgacgtcttcgctcataccgacaatatggtgttttacctccaggaccacgatcccggaagacacttgttcgtgggccagctgattcagaacgtgggcccaattagggctttttggtctaaatactacgttccggaagtggtgactcagaatgaacgctatcctccttattgtggaggcggaggctttctactgagcagatttactgctgccgcactgcggagagccgcacatgtgttagatattttccccatcgatgatgtgttcctgggtatgtgtctagagctggaggggctcaaaccagcatcacattccggaatccgcacctccggagttcgcgcaccaagccagcggttatcctcatttgatccgtgcttttatcgcgatctgctgctcgtccacaggtttctcccctacgagatgctgctcatgtgggacgctctgaatcagcccaacctcacctgtggcaaccaaacgcagatatattag

SEQ ID NO: 246177 - DNA, 1137 bp, Artificial Sequence
  Description of Artificial Sequence: Synthetic coding sequence
atgttgcctccacaaccgtcggctgcccaccagggacggggtggccgttctggtttacttcccaagggcccagcaatgctgtgccgtctgtgctggttggtgagttatagcctcgccgtcctgttattgggctgcctgttgttcctacgcaaggccgcaaagcctgccggagacccgactgctcaccagcccttctgggcgccaccgacacccaggcattcacgctgcccgccaaaccacaccgtatcatcagcttccttgtctctcccaagtagacacaggctgttcctgacatatcgacattgtaggaatttcagtatcttgctggaaccaagcggctgcagtaaggataccttcctcctgctcgctatcaagtcacagcctgggcacgtggagcggagagcagctatccggagcacctgggggagagtcgggggatgggcacgaggacgtcagctgaaactggtatttttgctcggcgtagctggcagtgccccacctgcgcaactcttagcatacgagtctcgcgaatttgacgatatcttgcagtgggacttcactgaagacttttttaatctgactctgaaggagctgcacctccagcgctgggtggtggcagcctgcccacaggcgcatttcatgctcaaaggggatgacgacgtgttcgtgcacgtgccgaacgtgttggagttcctggacggatgggatccggctcaggacctgctggtgggcgatgtgatccgtcaagccctgcccaacaggaataccaaagtaaaatactttatcccccctagcatgtatcgtgccactcattaccccccttacgctggtggcggtgggtatgtcatgtcacgagcaaccgtccgaagacttcaggccatcatggaagatgcagaactcttcccgatagacgatgtcttcgtgggcatgtgcctgcggagactggggctcagtccaatgcatcacgcgggatttaagacatttggaatccggagacctctcgacccactggatccctgtctgtaccgaggattgctactggtgcacaggctgtccccactggaaatgtggacaatgtgggcactagtcactgatgaaggtttaaagtgcgcggctggacccataccccagagatag

SEQ ID NO: 246178 - DNA, 1062 bp, Artificial Sequence
  Description of Artificial Sequence: Synthetic coding sequence
atgttatgccggttgtgctggctcgtgagttacagcctcgcggtactgttgttgggatgcctcctgttcttacgcaaggctgctaaacccgcaggagacccaaccgcgcaccaaccattctgggctccaccgacccctagacactctagatgtcctcctaaccacacggtttcaagtgctagtttatcattgccctcccgccatagactgttcctcacataccgtcattgtaggaattttagcatactcttggaaccaagcggctgcagcaaagatacattcctgctcttggccatcaaatcacagcctggccacgtcgagcgcagagccgctattcgctcgacctggggccgagtagggggatgggccagaggacggcagctgaagttggtgttcctcttgggggtggccggatctgctcctcctgctcagctgctcgcctatgagagccgcgagtttgacgacatcctgcagtgggactttacagaggatttcttcaatctgaccttaaaagagctgcatctgcagcggtgggtggtcgccgcatgcccacaggctcactttatgctcaaaggggatgatgacgttttcgtgcatgtgcccaatgtactagaatttttggacggttgggatcctgcccaggatcttttagtcggggacgtgataaggcaagctctgccgaaccggaacacaaaggtgaagtacttcattccaccctctatgtaccgtgccactcactacccaccctacgcaggcggaggaggctacgtgatgtcgagagctacagtgagaagacttcaggccattatggaggacgcagagcttttccctatagatgacgtttttgtgggcatgtgcctaagacgcctcggactgtcccccatgcaccacgcgggatttaagacattcggtattagaagacccctggacccactggacccctgtctttatcgtgggcttttgctggttcataggctttcgcctctggaaatgtggaccatgtgggccctggtgacggacgagggcttgaaatgcgctgccggacctatacctcagcggtag

SEQ ID NO: 246179 - DNA, 1062 bp, Artificial Sequence
  Description of Artificial Sequence: Synthetic coding sequence
atgctgtgtagattgtgctggttggtatcctattcactcgcagttctcctgcttggttgtttgctgtttctcagaaaagctgccaaacccgctggggaccccacagcccaccagcccttctgggcacctccgaccccgcgacatagtcggtgtcctccaaaccacaccgtgtcaagcgcttcactgtcactcccatctcggcaccgccttttcttaacctacagacactgtagaaatttcagcattctgctggaaccctcaggttgcagcaaggacaccttcctgctccttgcaatcaagtcgcagccgggtcacgtcgagaggagggcggcaattcgaagtacttggggtagggtgggagggtgggccaggggtagacagctcaagctcgtgttcctgctcggtgtagccggtagtgcgcctccggcacagctactggcatacgagtctcgcgagtttgacgacattctgcagtgggatttcacagaagatttcttcaatctcacactgaaggagctccatctgcagaggtgggtggttgccgcatgtccgcaggcccatttcatgctgaagggggatgatgacgtctttgtacacgttcctaatgtgctcgagtttctggatgggtgggatccggcacaggatttgctcgtcggcgacgtaatacggcaggccctccctaatcgtaacaccaaagtcaagtatttcatcccaccgtccatgtaccgagccacccattatcctccgtacgcagggggaggtggctacgtgatgtctcgcgcaacggtccggaggctgcaagccattatggaagatgccgaactctttcccatagatgacgtttttgtaggcatgtgtttgcgacgattaggactgtctccaatgcaccatgcgggattcaagactttcggcatccgcagacctctggatccattagacccgtgtctgtatcggggtctcttgctggtgcaccgactctctcctctggaaatgtggacaatgtgggctttagtaactgatgaaggcttgaagtgcgctgcagggcctataccccagcgttag

SEQ ID NO: 246180 - DNA, 1485 bp, Artificial Sequence
  Description of Artificial Sequence: Synthetic coding sequence
atgttcgagattaaaaagatctgctgcataggcgctggatacgttggtggaccgacctgctcggtgatcgcccatatgtgccccgagattcgtgtgacagttgtggatgttaacgaatcaaggattaacgcctggaattcacctacactgccaatatacgaaccaggactgaaagaagtggtggagtcatgcagaggcaagaacttgttcttctctacaaacattgacgacgcaattaaagaagctgatttggtcttcataagtgtgaacacacccacgaagacttatggcatgggaaagggaagagctgccgatctcaagtatatcgaggcctgcgcccgacggatcgtacagaactcaaacggatataagatcgtgaccgaaaagtctacagtcccagtgcgagcggcagaatctattcgcagaatttttgacgcaaataccaaacccaatctcaatctccaagttcttagcaatcccgaattcttggccgaggggacagctattaaggacctgaagaaccctgatagggtgctcattggtggtgatgaaactcctgagggccagagggctgtccaagccctgtgtgccgtatacgaacattgggtgccccgtgagaaaatcttgaccactaatacatggagctccgaactgagcaagcttgctgctaacgctttcctcgcccagcggatctcttctattaatagtatttcagcactgtgtgaggccactggggctgacgtggaagaggtggctaccgcaattggtatggaccagcgaatcggtaacaagttcctgaaggcttctgtggggttcggtgggtcttgctttcagaaggacgtgctcaacttggtgtatttatgtgaagcgcttaaccttcctgaagtagctaggtactggcagcaggttatcgatatgaatgattatcaaagacgtcgcttcgcttctcggatcattgactctctcttcaacactgtgaccgacaagaagatcgctatcttgggattcgcgttcaaaaaggacacaggtgatacacgggagagctcctcaatctatattagcaaatatttaatggacgagggcgctcatctccatatctacgacccgaaggtgccaagggaacaaattgttgtcgacttgagccatcccggagtcagcgaagatgaccaggtgagccgcctggtcacaattagcaaggatccctacgaagcttgtgatggcgctcacgcagttgtgatatgcaccgagtgggacatgtttaaggagctggattatgaacgaatacacaaaaagatgctcaaacccgcttttatctttgacggcagaagggtcctagatggtctacacaacgaactccagactattgggtttcagatcgaaacaattggtaagaaagtttcttctaagaggatcccatatgctcccagtggggagatcccaaagttcagtctgcaggacccaccgaacaaaaagcccaaggtctag

SEQ ID NO: 246181 - DNA, 1284 bp, Artificial Sequence
  Description of Artificial Sequence: Synthetic coding sequence
atgttcgagattaagaagatttgttgtatcggcgctgggtatgtgggcggacctacttgttcggtgattgcacacatgtgtcccgagatacgagtaactgtggtcgacgttaatgagagtcgcatcaatgcttggaactctcctaccctccctatctacgagccaggcctgaaagaggtagttgaaagctgtagaggaaaaaacctattcttcagtacaaacatcgatgacgctatcaaggaagctgacttagtgtttatctctgtcctgtcaaacccagaattcctcgcagagggtactgcgatcaaggatctcaagaatcccgatcgggtcctcattggcggtgatgagacgcctgaaggccaacgggctgttcaggccctgtgtgctgtatatgagcactgggtgccgagagaaaaaatcctgactactaatacatggtcaagtgagctctccaaactcgccgctaacgcatttcttgctcaaaggatcagcagtattaacagcatttcagctttatgcgaggccactggcgcagacgtcgaggaagtcgcaactgctatcggaatggaccaacgaatcggcaataagtttctcaaagcttccgtggggtttggcggaagctgctttcagaaagatgtgctcaacctagtctacttatgtgaggccctcaacctgccagaagttgcgcgttactggcagcaggtgatcgacatgaatgattatcaacggcgacggtttgcctcacgcatcattgactccctctttaataccgtgaccgataaaaaaatcgccatactcgggtttgctttcaagaaagacaccggggacaccagagaaagctctagcatctacatctccaaatacctaatggacgagggtgctcatctgcatatctacgatccaaaagttccccgagagcagatcgtggtggatcttagccatcctggtgtgtccgaggatgatcaagtatcaagactcgtgacaatatcaaaggatccatatgaggcctgcgacggcgctcacgccgtagtgatttgcactgagtgggatatgttcaaagagttggattacgaaaggatccacaaaaagatgttgaaaccagcctttattttcgacggcaggagggtgctggatggtctccacaacgagctgcagacaataggttttcaaatcgagacaatcgggaaaaaagtcagttctaagcggatcccatacgcaccgtctggcgagatccccaaattttcactgcaggatcccccaaataagaaacctaaggtatag

SEQ ID NO: 246182 - DNA, 168 bp, Artificial Sequence
  Description of Artificial Sequence: Synthetic coding sequence
atgttcgaaatcaagaaaatctgctgcataggagcaggctacgtaggtggacctacctgttcagtgattgcacacatgtgccccgagattagggtcacagtggtggatgttaatgaatctagaataaatgcttggaactcccctactctgcctatttacgaggactag

SEQ ID NO: 246183 - DNA, 258 bp, Artificial Sequence
  Description of Artificial Sequence: Synthetic coding sequence
atgttcgaaattaaaaaaatctgttgtatcggtgctggatacgtgggcggacctacgtgttccgtcattgcccacatgtgcccagagatcagagttaccgtcgtagatgtgaatgagagccgcataaatgcctggaacagccctacattgccaatatatgagcctggtctgaaggaggtggtcgaatcctgcagaggaaagaacttattcttcagcacgaatatcgacgatgcaatcaaagaggccgaccttgtttag

SEQ ID NO: 246184 - DNA, 1485 bp, Artificial Sequence
  Description of Artificial Sequence: Synthetic coding sequence
atgtttgagattaagaagatttgctgcatcggggcaggatatgtgggtgggcctacgtgtagcgtgatcgctcatatgtgccccgagattagagtgaccgttgtggatgtgaatgaatccagaataaacgcctggaattccccgaccctgcctatctacgagcccggtcttaaagaagtagttgagtcgtgtcgtggaaaaaacttatttttcagcacgaacatcgacgacgcaatcaaggaagctgatttggtctttatatcggttaatacgccaacaaagacgtatggaatgggaaaaggacgggcagctgatctgaagtacattgaggcgtgcgctagaagaatcgtacagaattccaacggctataaaattgttactgagaagtccaccgtcccagtgcgcgctgccgagtccattcgccgtattttcgatgcgaatactaaacctaacttgaatctgcaagtattgagcaaccccgagttcctggctgaagggacagctatcaaggatctgaagaacccagacagggtgttaatcggtggcgacgagaccccggagggccagagggccgtccaggctctttgcgccgtctatgagcactgggtgccccgagagaaaatactgaccaccaatacctggagttcagagctatccaagctggctgctaacgcattcttggcccaaagaatctcatctattaatagtatttctgccctctgcgaagcaacgggcgctgatgtggaggaggttgcaaccgccatcggcatggatcagcgcattggcaacaaattccttaaggccagtgtgggctttggcggatcttgttttcaaaaggacgttctcaatctagtctatctatgcgaggcgctcaacctgcctgaggttgctaggtattggcagcaggtgatagatatgaacgactaccagagacggaggttcgcatccagaattatcgacagtctgttcaacaccgtaaccgataaaaagattgcgatactcggctttgccttcaaaaaagatacaggagacactcgcgagagctcaagtatctacataagcaaatacctaatggacgagggggctcatctgcacatttacgaccctaaggtgcccagagaacagatcgtggtggacctgagtcatcctggagtgagtgaagacgaccaggtctctaggcttgttactatcagcaaggatccatacgaggcgtgtgacggcgctcacgctgtggtgatctgcaccgagtgggacatgtttaaggagctggattatgaacgtatccacaagaaaatgctcaagccggcattcatttttgatggcaggagagttcttgatgggctgcacaacgagctacagactataggcttccagattgagactatcggtaagaaagtgtcgtccaagagaatcccctacgctccgtctggcgaaatccctaagttctcattacaggacccccctaacaagaagccaaaagtgtag

SEQ ID NO: 246185 - DNA, 1194 bp, Artificial Sequence
  Description of Artificial Sequence: Synthetic coding sequence
atggggaaaggcagagccgcagacctgaagtacattgaggcatgcgccaggagaattgtgcagaattcaaatgggtacaagatcgttacagagaagagtactgtgcccgtccgggctgcagagtcaattcgcagaattttcgatgcaaacacaaaaccgaatctgaacttacaggtgctttctaatccggagtttttggcagaagggaccgctatcaaagatctcaagaatcctgatagagtgcttatagggggtgatgaaacacccgaaggtcagcgggcagttcaggctctttgcgccgtatacgagcactgggtgcctcgggagaagatccttaccactaacacttggtcatccgaactttctaaactcgccgcaaatgcctttctggctcagcgtatttcatccataaactctatatcagccctgtgcgaggcgacgggcgctgacgtggaggaggttgccaccgccatcggaatggatcagagaataggtaacaagttccttaaggcgtctgtcggcttcgggggatcctgttttcaaaaggacgtactcaatctggtgtatctgtgcgaggctttaaatttacccgaggttgcaagatattggcagcaagtgatcgatatgaacgattatcagagaagacgcttcgcctcccgtattattgatagtctttttaacaccgtcactgataagaagattgccatattgggcttcgcttttaagaaagacacaggggatacgagggagtcaagtagtatctatatatcaaagtatttgatggacgagggagcccacctgcacatttacgatcccaaggtcccgagggagcagatagtagtggacctttcgcatcccggagtcagcgaggacgaccaggtcagccggctggtcaccatcagtaaggacccatacgaagcctgtgacggcgcacacgccgtggtgatttgtacagagtgggatatgttcaaggagttagactatgagcggattcataaaaagatgctcaaacccgctttcatcttcgatgggcgaagggttttagacgggttgcataacgagctgcagaccatcggattccagatcgaaaccataggcaagaaagtgagcagcaaaagaattccctatgccccatccggggaaattccaaaattttccctgcaggacccccctaataagaagccaaaagtctag

SEQ ID NO: 246186 - DNA, 393 bp, Artificial Sequence
  Description of Artificial Sequence: Synthetic coding sequence
atgttcgagatcaaaaagatatgctgcattggggctggatacgttggcggacccacctgctccgtcattgcacacatgtgtcccgagattcgggtgacagtggtggacgtcaacgagagcagaatcaatgcttggaacagtcccaccctgccaatctatgaacccggtttgaaggaggtggtggaatcgtgcagaggtaagaatctctttttcagcacaaatattgacgatgccatcaaagaagccgatctcgtgtttatctcagtgaatacaccgacgaagacatatgggatgggaaagggaagggctgccgacctcaagtacatagaggcctgtgcacggagaattgtccaaaatagtaatggctacaagatcgtgaccgagaaatcatag

SEQ ID NO: 246187 - DNA, 162 bp, Artificial Sequence
  Description of Artificial Sequence: Synthetic coding sequence
atgtttgaaatcaagaagatctgttgcatcggcgcaggatatgtggggggtcccacttgctcggttatagcccacatgtgccctgagatcagggtaactgtggtcgatgtcaacgaatcccgtataaatgcttggaacagtccaacgctgccaatatactag

SEQ ID NO: 246188 - DNA, 168 bp, Artificial Sequence
  Description of Artificial Sequence: Synthetic coding sequence
atgtttgagattaaaaaaatctgttgtattggggcaggatacgtcggcggtccgacctgtagcgtcatcgcccatatgtgccctgagatccgagttactgtcgtggatgtgaatgagagtcgaatcaatgcctggaacagtcccaccttaccaatatacgaggactag

SEQ ID NO: 246189 - DNA, 462 bp, Artificial Sequence
  Description of Artificial Sequence: Synthetic coding sequence
atgtttgagatcaaaaaaatttgttgtattggggctgggtacgttgggggtccgacctgttctgttattgcccacatgtgtcctgagatcagagttaccgtagtagacgttaacgagagccgcatcaacgcgtggaattctcccactcttcctatttacgaacctgggcttaaggaagtggtggagtcctgcagagggaagaacctatttttcagcacgaatatcgacgatgccataaaggaggctgacctcgtattcatctcagtgaatacccccaccaaaacgtacggcatgggcaaaggacgtgccgctgatttgaagtacatcgaagcctgtgctcggaggattgttcagaactccaatgggtacaagattgtgaccgagaaatcaaccgtccccgtccgcgctgccgagagcatcaggcgtatcttcgacgccaacactaagcccaacctgaattag

SEQ ID NO: 246190 - DNA, 546 bp, Artificial Sequence
  Description of Artificial Sequence: Synthetic coding sequence
atgtggtcttcaggacttcttattcaggacagcactattatgttcgaaataaagaagatctgttgtatcggtgctggatacgtggggggacctacttgctcggtgatagcgcacatgtgccctgaaattagagtcactgtcgtggatgtgaacgaatcacgaatcaatgcctggaattcccccaccctgccaatatatgagcccggactgaaagaggtggtagaatcctgccggggtaaaaacctgttcttctcgactaacatagacgatgccatcaaagaagcggacctggtattcatcagtgttaacacgccgaccaagacttatggcatggggaagggcagagccgcagaccttaaatatatcgaggcctgtgcccgaaggatcgtacaaaatagcaacgggtataaaatcgtcacggaaaaatcaactgtgcctgttagagctgccgaatctatccgcagaatcttcgatgctaacacaaaacctaatctgaacctacaagtcttgtctaatccagagttcctcgccgaggggactgcctag

SEQ ID NO: 246191 - DNA, 1185 bp, Artificial Sequence
  Description of Artificial Sequence: Synthetic coding sequence
atggccctcctggacttggctctggagggaatggccgtttttgggttcgtgcttttccttgtcctgtggttgatgcatttcatggctatcatctacacccgactgcacctgaataaaaaagccacagataaacaaccctattctaagctgcctggcgttagcctccttaaacccttgaagggggtggatccaaacctgattaataacctggagacattctttgaactagattatcccaaatacgaggtattgctatgtgtgcaggatcatgacgaccccgctatcgacgtgtgcaagaaactcctcggcaaataccccaatgtggacgctcggctttttattggagggaagaaggtcggcatcaaccctaagataaacaatttgatgccaggctacgaagtcgcaaagtacgacctcatctggatctgtgacagcggcatccgggtgataccagacacattaacggacatggttaaccaaatgactgagaaggtcgggctcgtccacggcttaccatatgtggccgacaggcagggctttgccgcaactctggaacaggtctacttcggaacctcccatccaaggtactatatttccgccaatgtcactggattcaaatgcgttacaggaatgagctgcctgatgagaaaggatgtcctagaccaggccggaggtctgattgcttttgcacaatatatcgcggaagattatttcatggcaaaagccatagcagatcgaggctggcgcttcgcaatgtccacacaggtggccatgcagaacagcggcagttatagtatcagtcagtttcagtctagaatgatcaggtggaccaaactgcgcatcaacatgctgccagctactattatctgtgaaccaatatcggagtgctttgtagcttcacttattattgggtgggcagcgcaccacgttttccggtgggatattatggttttttttatgtgccactgcctcgcctggttcattttcgactacatccagctccgcggagtccagggcggaactctttgtttttctaagctggattacgccgtcgcctggtttataagagagagtatgaccatctacattttcctgtcagcactgtgggatccaaccatttcgtggcgtactggtcgctaccgcctgaggtgcgggggtacagcagaagagatcttagacgtctag

SEQ ID NO: 246192 - DNA, 4667 bp, Artificial Sequence
  Description of Artificial Sequence: Synthetic coding sequence
atggggtgcaaaggagatgccagtggtgcttgtgcagcgggtgctcttccagtaaccggggtatgctacaaaatgggggtcctcgttgtgctcacagtattgtggctgttcagcagtgtaaaggcagatagcaaggccataaccacctccctgacaaccaaatggttttccacaccactcctgctcgaggccagtgaatttctggccgaagattcccaggaaaaattttggaacttcgtggaagcttcccaaaatattggcagctctgaccacgatggcaccgactactcctattaccacgcaatcctcgaagcggcttttcaattcctcagcccgcttcagcagaatctattcaagttctgtttgtcgctaagatcatatagcgccacgatacaagccttccaacagatcgccgctgatgaaccaccgcctgaaggctgtaatagtttcttcagcgtacatgggaaaaaaacatgtgagagcgataccctggaagcactcttactgaccgccagcgagcgcccaaagcctttgttattcaagggcgaccacagatatccctcttctaacccagaatctcccgtggtaattttttactccgagatcggatccgaagagttttctaactttcatcgccagttaatctccaaaagtaacgccggaaagattaactatgtgttcagacactatatctttaacccaagaaaggaacctgtatacctttccggatatggcgtcgagctggccattaaatccaccgaatacaaagcaaaagatgatacgcaggtgaagggcacggaggtcaatacaacagtgatcggagagaatgatcccatagacgaggttcagggatttttgttcggaaaactgcgggatctgcaccctgatctcgaaggccaattaaaagagttgcgtaaacatctcgtggagagtactaacgaaatggccccactaaaggtctggcagctccaggatcttagcttccagacagctgcacgaattttagcgtcccccgttgagctagcgttagtggtgatgaaggacctatcccagaacttccccactaaggccagggccatcaccaaaacagccgtgtctagtgagttaagaaccgaagtagaggaaaaccagaagtatttcaaagggacactcggtttacagcctggtgactctgccctattcatcaacggtctacacatggacctggacacccaggatattttttccctgtttgacgtgctcagaaacgaggctcgtgtgatggaaggattgcatcggctcggaattgaggggttatccttacacaacgtactgaagctcaacatacaaccgagcgaagcagactacgccgtggacattcggtcacccgcaattagctgggtgaataacctagaagtggatagccgatacaacagctggccttcttccctccaagagcttctgcggcctacctttcccggtgtgatacggcagattagaaagaatctgcacaatatggtcttcattgtcgaccctgctcatgagaccactgccgaactaatgaataccgccgagatgttcctatccaatcatatccccttgcgcatcggattcatcttcgtggttaatgactctgaggacgttgacggaatgcaggatgctggcgttgctgtgctgcgcgcttataactacgtcgctcaggaggtggacgattaccacgcgttccaaacactgacccacatttataacaaggtgcgtaccggtgagaaggtgaaagtcgaacacgtggtgtccgtgctcgagaaaaaatacccctacgttgaagtgaattcaatcctagggatcgattccgcctacgacaggaatcggaaggaagctaggggctactacgagcagactggcgtgggccctctgcccgttgtgctgtttaatggcatgcccttcgaaagagaacagcttgaccccgacgagcttgagaccatcacgatgcacaagatcttagagactacaacatttttccaacgtgccgtctatctgggagagcttccacatgaccaggacgtggtcgagtatattatgaaccagcccaacgtggtgccccgtatcaactcccggatactcacagcagaacgagattacctggatctcaccgccagcaataacttctttgttgatgattatgccagatttaccattttggacagccagggaaagactgccgcagtcgcaaacagtatgaactatctcacaaagaagggcatgtcctctaaagaaatttacgatgattcctttattcgaccggtcaccttttggatcgttggagattttgacagcccttcaggcaggcagttgctatacgacgcaattaagcatcagaaatcctcaaataatgtgcgcatctccatgatcaataatcccgctaaggagatctcctacgagaacactcaaatttcacgagccatttgggccgcactacagactcaaacgtccaatgcagccaagaacttcataactaaaatggcaaaagagggcgctgccgaggccctggccgcaggcgcagatatcgccgaattttcggtcggcggtatggatttttctcttttcaaggaagtgttcgaatcctccaaaatggactttatcctaagtcacgcggtgtattgcagggatgtgctcaaattgaaaaaggggcaaagggctgtgataagcaatggtcggatcatcgggcctctggaggacagcgagctgtttaatcaggacgactttcatcttctggagaatattatcttgaagacaagtggccagaagatcaagagccatattcaacaactgcgggttgaggaggatgtcgccagtgatctggtaatgaaggtggatgctctcctcagcgctcaacctaaaggggacccaaggatcgaatatcagtttttcgaagataggcattcagcaattaaactccgtcctaaggaaggcgaaacctacttcgatgtcgttgccgtagttgacccggttactcgcgaggcacaaaggcttgcaccactcctgctcgtgctcgcgcaattgattaatatgaaccttcgggtcttcatgaattgtcaatccaagctttcagacatgcccctgaaaagcttctaccgctatgtgctggaacccgagatatctttcacgagcgacaatagtttcgcaaagggcccaatcgcgaaatttctcgatatgccacagtctcccctcttcacgttgaacctcaatacgccagaaagttggatggtggagtctgtgcggacaccatatgacctcgacaacatttacctcgaagaggttgattcagtggtagccgcagaatacgagcttgagtatctcttgttggagggacactgttatgatattaccactgggcagcctcctagaggactgcaatttactttggggacatctgcaaaccccgttatagttgatactatcgtcatggccaacctggggtactttcaactgaaggccaatccaggggcttggatcctgagacttagaaagggacgctccgaggatatttataggatttacagccatgacggcacggatagcccgccagatgcagatgaagtggttattgtactaaataatttcaaaagcaaaatcatcaaagtgaaagtgcaaaagaaggccgacatggtcaatgaggacctcttaagcgacggaacatcagagaatgagtccggcttttgggattcattcaaatggggttttactggacagaagaccgaggaggtaaaacaggataaggacgatatcatcaatatcttttcagtcgcctcaggccatctctacgaacgattcctacgaattatgatgctgtcagtgctcaaaaatactaagacccccgtgaaattctggtttttaaagaattatttgtctcctacctttaaggaatttatcccttatatggctaatgaatataatttccagtacgagctagtgcagtacaaatggcctagatggctccaccaacagactgaaaaacagcgaattatttggggatataagattctatttcttgatgtgctcttccccctggtggtcgacaaatttctgttcgtcgacgccgatcagatcgtcagaacggacctaaaggagctgcgggacttcaacctcgacggagccccatatggatacacaccgttctgcgactcacggagagagatggatggctacagattttggaagagtggctattgggcctctcacctcgccggaaggaagtaccacatcagtgcactgtacgtcgttgatctcaaaaagttccgaaagattgcggctggcgatcgtctacgaggccaatatcagggcctgtcgcaggatccaaattcgctgagtaatctggaccaggacctaccgaacaatatgattcatcaggttcccattaaatccctccctcaggaatggttatggtgtgaaacatggtgcgacgatgcgagcaaaaagagagccaaaacaattgacctgtgcaacaacccaatgaccaaagagccaaagctggaagccgctgtgaggatcgtccccgaatggcaagattatgaccaggaaattaagcaattacagatcagattccaaaaggaaaaggagaccggcgcactatataaggaaaagaccaaggagccttcgcgggaaggcccacagaagcgggaggagcttta

SEQ ID NO: 246193 - DNA, 4595 bp, Artificial Sequence
  Description of Artificial Sequence: Synthetic coding sequence
atgggggtgctggttgtccttaccgttctctggctgtttagtagtgttaaagcagatagcaaggctatcacaaccagccttaccacaaaatggttttccacacctcttcttctcgaagcttccgagtttctcgctgaagatagccaggaaaaattttggaatttcgtagaggcttcgcaaaatattggttcaagtgaccatgacggtactgattactcctattaccatgccatcctggaagctgcttttcagtttctgtcacctttgcagcagaatctgtttaagttttgcttgagtctgagaagctatagcgcaactatacaggcctttcagcaaattgctgccgatgaaccaccccctgaaggatgcaatagctttttcagcgtgcacggtaaaaaaacctgcgagtctgacaccctggaggcgctgttgctgacagctagtgagcggccaaagccgctgcttttcaagggtgatcatcgatacccaagcagcaaccctgaatcacccgtcgtaatcttttactccgagatcgggagcgaagagttttctaactttcaccgccagctgatctcaaagtccaacgccggaaaaattaattacgtcttccgtcattacatctttaaccctagaaaagaaccagtttatctctctggttacggcgtagagctggcaatcaagagtaccgaatacaaggcgaaagacgatacacaggtgaagggaaccgaagtgaatacaacggtcattggagagaacgaccccattgacgaggtccaggggttcctctttgggaagctgagagacttacaccctgacctggaagggcagcttaaggagctgaggaaacacctggtggaaagcacgaacgaaatggctccgttgaaggtgtggcaactgcaagatctgagcttccagacagcggctcgtatccttgcgagtcccgtggaactggcgttggtggtgatgaaagacctatcccagaattttcctacaaaggctcgcgcaatcacaaagactgccgtctcaagtgagctgcggactgaggtagaggagaaccagaaatatttcaagggcactctggggctgcagcctggggacagtgccctgttcataaacggactccatatggatctcgacacgcaggacatcttttcattattcgacgtgttgcgcaacgaggcacgggtcatggaggggctgcacagactgggaatcgaggggcttagcctgcataatgtcctcaagctcaatattcaaccatcagaggccgattatgcagttgatattagatcaccggcaatatcatgggtgaataatctggaagtggacagcaggtacaatagttggcccagttctctccaggagcttctccggccaacctttccaggggtcattaggcagatacggaagaatttacacaacatggtgtttatcgtggatcccgctcacgagactaccgccgaactgatgaacaccgcggaaatgttcctgtccaaccatatccccctccgcatcggtttcatattcgtcgtgaacgacagcgaagacgttgatgggatgcaagatgctggagttgctgtcctgagggcttacaactacgtggcgcaggaggttgatgactaccacgccttccagacgttaacccatatctacaacaaggtcaggactggggaaaaagtgaaggttgagcacgtcgtgtccgtgctggagaaaaaatacccatacgtggaggtgaactccattctgggcatcgattccgcctacgaccggaatcgcaaggaggcgagaggatactatgagcagacgggagttggtcccctgcccgtagttctgttcaatgggatgccctttgaaagggaacagttagaccctgatgagctcgaaacaatcactatgcacaaaatactggagacaaccactttttttcagcgagctgtttacctgggggagctaccacacgatcaggatgtggttgagtacattatgaatcaacctaacgtggtgcccaggataaactcaaggatcctgacagccgaacgggattatctggatctgactgcttcaaacaacttttttgtggacgattatgcgagattcactattcttgattctcagggcaagacagccgcagtcgctaactccatgaactatcttaccaaaaaaggcatgtcttcaaaggaaatttacgacgacagcttcattcgtcctgtaacattttggatcgtaggcgattttgacagtccaagcggccgtcagcttttatatgatgctatcaaacatcaaaagagcagcaacaatgtccggatctctatgataaataatcctgcaaaagagatttcttacgaaaatactcagatcagccgtgccatttgggccgctctgcagacccagacgagcaacgctgcgaaaaatttcattaccaagatggctaaggagggcgctgcagaggccttagctgctggagccgatatcgccgagtttagtgtgggaggcatggacttcagcttgttcaaagaggtcttcgaaagttccaagatggactttatactgtcacacgccgtgtactgccgagacgtgctgaaactaaaaaaggggcagcgagccgtgattagcaacggcaggattatcggtcctctcgaggactctgagctgttcaatcaagatgactttcatcttctagagaacatcatattaaaaacttccggacagaagattaagtctcatattcagcagctgcgcgtcgaggaagacgtcgctagtgacctggtgatgaaagtggacgccttgttaagcgctcagcctaaaggagacccgagaatcgagtaccagttttttgaagacagacattcagccataaagctccggcctaaagaaggtgaaacatacttcgatgtcgttgccgtagttgaccctgtgactcgcgaagcccagcgcttagcacccttgctcctcgtgctggcacaactaattaatatgaatctcagggtgttcatgaattgccagagtaagcttagcgacatgccattaaagtctttttacagatacgtattagaacctgagatcagttttacttcagataattcctttgccaagggtcctatagccaagtttcttgatatgccccagtcgccccttttcacactgaacctgaatacgccagagtcctggatggtcgagtctgtacggaccccctatgacctggataacatttatcttgaggaggtggatagtgtggtcgcagctgaatacgagttggaatatcttctactggaagggcactgctacgatattacaacaggacagcccccaagaggcttgcagttcaccctgggcacgtcggccaatccggttattgtggataccatcgtgatggccaatctgggctactttcagctgaaggctaaccctggagcctggatactgaggcttcgcaagggaaggagcgaggatatctacagaatatacagccacgacggtacggactccccacccgatgccgatgaagtggtgatcgtgctcaataactttaagtcgaaaatcatcaaagtaaaagttcaaaaaaaagctgatatggtcaatgaagacctcctctccgatggcacaagcgaaaacgaatccggcttctgggatagttttaagtggggctttaccgggcagaaaactgaagaagtgaagcaagacaaggacgatattattaatatcttttcagtggctagcgggcatttgtacgagcgatttttgcgcatcatgatgctcagtgtacttaagaacacgaaaacgccagtcaaattttggttcttaaaaaattatcttagccctacttttaaagagttcatcccttacatggccaatgagtacaattttcagtatgagcttgttcagtacaaatggcctagatggctgcatcaacaaacagagaagcagagaatcatttgggggtataaaatcctgtttcttgacgtcctgttccctcttgtggtcgacaagttcctctttgtggacgccgaccagatagtacgaaccgatttgaaggaactgcgcgacttcaatctggatggagcaccttacggctatacccctttctgtgattcaaggcgcgagatggatgggtacaggttttggaaatctgggtactgggcgtcacatttggcaggtcggaagtaccacatctccgccctgtacgtggtggatttaaagaaattccggaagattgccgctggagaccggcttcgcggtcagtaccagggacttagccaggatcctaacagcctgagcaacctggaccaagatctcccaaacaacatgatccaccaagtcccaattaagtcactgccacaggaatggctctggtgcgagacgtggtgcgatgacgcatccaaaaagcgcgcaaagacaatagacctctgtaacaaccctatgactaaggagcccaaactggaggccgctgtgcggatcgtgcctgagtggcaggactatgaccaggaaattaaacagctccagatccggtttcaaaaggaaaaggaaacaggagcactgtacaaggaaaagactaaagaacccagtcgcgaggggcctcagaaaagagaggagttgta

SEQ ID NO: 246194 - DNA, 843 bp, Artificial Sequence
  Description of Artificial Sequence: Synthetic coding sequence
atggctcccgcaaaggccacaaatgtggttcggttgctgcttggatccaccgccctttggttatcacagctcgggtcaggaactgtggcagctagcaagtccgtgaccgcccacctggcggcaaagtggcctgaaacaccactgttgctggaggcatcagagttcatggcagaagaatcgaacgagaagttttggcagttcttggagaccgtccaagagctggcaatctacaagcagactgagtcagattactcttattataatctgattctgaaaaaggctggacagttcttagataaccttcatattaacctgcttaagttcgccttttcaataagggcctactctccggctattcagatgtttcagcagatcgccgctgatgagccacccccagatggttgtaatgctttcgtagtcattcataagaagcatacctgtaaaatcaatgagatcaagaagttgctcaagaaggcagcatccaggacacgtccatatctttttaagggggaccataagtttcctactaacaaggagaacctgccagtggtgattctttacgccgaaatgggcacacggactttcagcgcattccataaagtgttaagcgaaaaggctcagaacgaagagattctctacgtgcttagacactacatccaaaagccaagcagccgtaagatgtacttgtccggatatggggtcgaattagccattaaatctaccgagtacaaggccttagatgatacccaagtgaaaacagtaacaaacacaactgtagaggatgaaaccgagactaacgaagtgcaaggctttttgttcggtaaacttaaactcgtctactag

SEQ ID NO: 246195 - DNA, 837 bp, Artificial Sequence
  Description of Artificial Sequence: Synthetic coding sequence
atggccccagctaaggcgacgaatgtagtgcggctcctgcttggatcgactgccctctggctcagtcagttaggatcgggaaccgttgccgcatcaaagtctgtgaccgcccatctggccgctaagtggccagagacccccttgttgctggaggcgtccgaatttatggccgaagagtccaacgaaaagttctggcaatttctggaaacagtacaggaactagccatctataagcagactgaatctgattactcctactacaatctcatcctgaagaaggccggacagtttcttgataatttacatattaacctcttgaagtttgccttctccatacgggcatattctccagccatccagatgtttcagcagatcgctgccgatgaacctccgccagacggatgcaacgcatttgtggtcattcacaagaaacacacatgcaaaattaatgagatcaagaagttgcttaaaaaggcggcatccagaacaaggccctacctcttcaagggcgaccacaaatttccaaccaacaaagagaatctgcccgtcgtgatcctgtacgctgaaatggggaccagaacctttagcgcatttcacaaggtactgtctgaaaaggcccagaacgaagaaatactgtatgtgctgaggcattacattcagaaaccctcatcccgtaagatgtacctctccggctatggcgttgagctggcaattaaatcaaccgaatacaaggccttagatgacacccaggtgaaaactgtcactaatacgaccgttgaagacgaaacggaaacaaacgaagtgcagggcttcctctttgggaagctcaaatcctag

SEQ ID NO: 246196 - DNA, 786 bp, Artificial Sequence
  Description of Artificial Sequence: Synthetic coding sequence
atggccccagccaaagcaaccaatgtagtgagactgttgctcgggtctaccgctctgtggctgtcacagcttggcagcgggactgtagcggcttctaaaagcgtcacagcccacctggctgccaagtggccagagacccctctcctgctggaggcttctgagttcatggctgaggaatccaacgagaagttctggcaattccttgaaaccgtacaagagcttgcaatatataagcaaaccgagagcgactactcatattacaatctaatcttgaagaaagctggacagtttctggacaatctgcatattaacctgctgaagttcgcattttccattcgggcatatagcccagcaatacagatgtttcaacagattgcagccgatgaacctccgcctgatgggtgtaacgcctttgttgtgatccataagaaacacacttgtaagatcaatgaaatcaaaaagctgctcaagaaggctgctagcagaaccaggccatacctcttcaagggagaccataagtttccaaccaataaggaaaacctgccagtcgtaatcttgtatgccgaaatgggcactcgcacattcagtgccttccataaggttttgtcagagaaagcccagaacgaggaaattttatacgtgctcagacattatatccaaaagccatccagtaggaaaatgtatctgtcaggctatggcgtggaattggccatcaaatccacagaatacaaggcgttagacgacacacaagttaaggtctttcaggatcccgaggcattcttttag

SEQ ID NO: 246197 - DNA, 4551 bp, Artificial Sequence
  Description of Artificial Sequence: Synthetic coding sequence
atggcacctgcgaaggctactaacgtcgtacggcttttactgggatctactgctttgtggctcagccagctggggtccgggaccgttgctgcgagcaaaagcgttaccgcccatttagctgcgaaatggcctgaaaccccgctccttcttgaggcaagcgaatttatggcggaggagagcaatgagaaattttggcagtttctggagacagtccaggaattggccatctataaacagaccgaaagtgattattcatactacaatctgatactcaagaaagctggtcagttcttggacaacctccacattaacttgctgaaatttgccttcagtatccgggcatactctcctgccatccagatgttccaacagatagctgctgatgaaccaccacctgacgggtgcaatgcttttgtggtaattcacaagaagcatacctgtaagatcaatgaaattaaaaaactcctgaaaaaggcagcatcccgaacgcgcccatatctttttaagggggaccacaagttcccaacgaacaaagagaacctgcccgtggtcatcctctacgcagaaatgggaacacgtacattctctgccttccacaaggttctctccgagaaggcccagaacgaggaaatcttatatgttctgaggcactatatacagaagccatcaagtcgcaaaatgtacctgagcggatacggggttgagctggcaattaagtcgacagagtataaggccctggatgacacccaggtgaaaaccgtgaccaacaccacagtggaggatgaaactgaaacaaacgaagttcaggggttcctcttcgggaagctcaaagagatttacagcgatctgcgggataacctgacggcattccaaaaatacttgattgagagtaacaagcagatgatgcccctgaaagtttgggagctgcaagacctgtcgttccaggccgcaagccagatcatgagcgcgcctgtgtatgactcgatcaagctcatgaaagacatatcccagaacttccctattaaggctaggagcttgactcgcatagctgttaatcaacatatgcgggaagaaattaaggaaaatcaaaaagacctgcaggtgcgcttcaagatacaaccaggggacgctaggctttttattaacggacttcgtgtcgatatggacgtatacgacgcgttctcaattctggacatgctgaagctcgaggggaagatgatgaacggtctgagaaacttgggcattaatggggaagatatgagtaagtttctcaaactgaactctcacatttgggaatatacctatgtgctcgacattcgtcactcctccattatgtggataaacgacctggaaaacgatgatctttacatcacctggcccacttcgtgtcaaaaactcctcaaacccgtgttcccagggagtgtgccgagtatacggcgaaatttccataatctggtgttatttattgacccggctcaggagtatacccttgatttcatcaaactggccgatgtgttttattcccatgaagtgccattgcgaattggctttgtgttcatcctgaatacggacgacgaggtggacggggctaatgatgccggagtcgccctctggcgggcatttaattacatagctgaggaattcgacatctcagaagccttcatctctattgtgcatatgtaccaaaaagtgaaaaaggatcagaatatactgactgtcgacaatgttaagtctgtgcttcaaaatacatttccccacgctaacatttgggatattctgggaatccattccaaatatgatgaggaacggaaggctggggctagcttctacaaaatgactgggctcgggcctttgcctcaagctctctacaatggggagccattcaagcatgaggaaatgaatataaaggagctcaaaatggcagtgctccagcgtatgatggacgccagtgtttatttgcagcgcgaagtgtttctgggcaccctgaatgatagaactaacgccattgacttcctgatggacaggaataatgttgtcccgcgaataaacacactgattctgcggacgaaccagcagtatctaaacctcatatcaacaagcgttactgccgacgtcgaggattttagcacattctttttcctcgacagtcaggacaagagtgcggtcatcgctaaaaatatgtactacttgacccaagacgatgagagcatcatctcagccgtcacactgtggatcatcgcagacttcgacaaaccatcggggcgaaaactgctgtttaatgcacttaaacacatgaagacgagcgtgcattcacggctcggaattatatacaatccaactagcaagattaacgaggaaaacacagccatatcacgcggaatcttagccgcattcctgacccagaaaaacatgtttctgcgcagctttttgggccagcttgcaaaggaggagatagctactgcaatttacagcggggacaagatcaagacctttctcatagaaggtatggacaaaaacgcctttgagaagaagtataatacggtgggcgtgaacatcttccgcactcatcagctgttctgccaagacgttctcaagctgcgaccaggcgagatggggattgtgtcaaacggaagatttctgggccctctcgacgaagacttctacgcagaggacttttacctgcttgaaaaaattactttctcaaatctcggcgagaaaataaagggaatcgttgaaaatatgggcatcaacgctaataacatgtcagactttatcatgaaggtggacgctctgatgtcctccgtcccaaagcgggcttctcgttatgatgtgacattcctgagggagaatcacagcgtaattaagacaaacccacaggagaatgatatgttcttcaacgtgattgccattgtggacccattgacccgggaagcccaaaagatggcacagctgctagtggtgcttggcaagataatcaatatgaaaattaaacttttcatgaactgccggggtcgcctgtccgaggctccattagaaagcttttatcggtttgtccttgagccagaattaatgtcaggcgcaaatgatgtgagctctttaggtcctgttgcaaaatttctggatatccctgagtcccccttactgattttaaatatgatcacgccggaaggttggcttgtggagacagtgcactctaactgcgatctggacaatattcatctcaaagacactgagaagacagttactgccgagtatgagctggaatacctgctgctagagggccagtgtttcgacaaagtgacagaacagccacctcgaggcctgcagtttaccctgggaaccaaaaataagccggcagtagtggacactatcgtgatggcccaccacggatattttcaacttaaggctaaccctggtgcctggattctccgcctgcatcaaggcaagtcagaagacatctatcagattgtgggacacgaggggactgactctcaagccgatttggaggatattatcgtggttttgaattcgttcaaaagtaaaatcctgaaagtcaaagtgaagaaggaaactgataagataaaggaggacatactgactgacgaggacgagaagactaagggcttgtgggatagcatcaaatcatttacagtctctctgcacaaagagaacaagaaggagaaagacgtgctcaatatcttttctgttgctagcggacacttgtacgagagatttctgagaatcatgatgctgtctgtacttaggaataccaaaacacctgtcaagttttggctgctgaaaaactatctctcccccacgttcaaagaggtgatccctcacatggctaaggaatacgggtttcggtatgaactggtacagtacaggtggcccaggtggctcaggcagcaaactgagaggcagaggatcatttggggctataagatcctgtttctcgacgtgctgttcccactggctgttgataagatcatattcgtggatgccgaccagattgttcggcacgatctcaaggagctcagagactttgacctcgacggggcaccctatgggtataccccgttttgtgacagcagacgagaaatggacggatacaggttctggaaaacgggatattgggcatcccacctcctcagacgcaagtaccatatttcagcactctacgttgtcgatttaaagaaatttagacgtattggggctggggaccgcctgcggtcacagtaccaggccctctcccaggatcccaattccctatctaacttagaccaggaccttcctaataacatgatctaccaagtggcgattaagtctctgccacaggattggctgtggtgtgagacttggtgtgacgatgagtcaaagcagagggccaaaaccatagatctctgcaacaaccccaaaactaaggagtctaaactcaaagcagccgctagaattgttcccgaatgggttgaatatgacgccgaaatccgacaacttcttgatcatctcgagaacaagaaacaggacaccattctaacccatgacgagctctag

SEQ ID NO: 246198 - DNA, 1119 bp, Artificial Sequence
  Description of Artificial Sequence: Synthetic coding sequence
atggccccagctaaagccactaatgtggtgagactgcttctggggtcaaccgctttatggttgagtcaattgggaagtggaactgtggccgctagcaaatcagttacagcgcatttagcggcaaagtggcctgagaccccactccttcttgaagcctcagagtttatggcagaagagagtaatgaaaaattctggcagtttctagagaccgtgcaggagctggccatctacaaacagactgagtctgattatagctactacaatctgatcctgaaaaaggcaggccagttcctggacaacttacacattaatcttctaaagttcgccttctccattcgggcatacagccccgctattcagatgtttcagcagatcgctgcggacgaaccaccacccgacggctgtaacgcttttgtcgtgatccataagaaacacacctgtaagattaatgagatcaaaaaactactgaagaaagctgccagccggactagaccgtatttatttaaaggcgatcataagtttcccactaacaaggaaaacctgcctgttgtcattctgtacgcagagatgggcactcggacattttcggcctttcataaggttctcagtgagaaggcccagaacgaagaaattctatatgtgttgaggcactatattcagaaaccaagtagtaggaaaatgtatctgtcgggatacggagtagaactagccatcaagtccactgagtataaggcgcttgacgatacgcaggtcaaaaccgtcactaacaccacagtcgaagacgagactgagacgaatgaggtccagggtttcctgttcgggaagttaaaagaaatttattccgacttgagggataacctgaccgctttccagaaatacctgatcgagtctaacaagcaaatgatgccattgaaggtgtgggagctgcaggacttgagctttcaggccgctagccagatcatgtccgccccagtgtatgactccatcaaattaatgaaagatattagccagaactttcctattaaggcaaggttacgcatgaatattctgatttgcttattccagagcaccttgaatgtcaagaatctgcgctcaaggcatctctataacaagacttag

SEQ ID NO: 246199 - DNA, 1527 bp, Artificial Sequence
  Description of Artificial Sequence: Synthetic coding sequence
atgtcacgatttgtccaggatctcagtaaagctatgtcacaggacggggcttcccagttccaagaagtcattcgacaagagcttgagctctctgtgaagaaggagcttgagaagatcctaacgactgcctcctctcacgagtttgagcacacgaagaaggatctggacggcttcaggaaattattccatcgcttcctgcaggagaaaggaccatcggtggactgggggaagatacagagaccccctgaggattctattcagccctacgagaagatcaaggccagaggcctgcccgacaacatcagctccgtgttaaataagctggtggtcgtgaagctcaacggtggactgggtacatcaatgggatgtaaaggtcccaaaagcttgattggagtaaggaatgaaaacacttttttggacctaactgtacagcaaattgaacacctgaacaaaacctataataccgatgttcctttagtcctcatgaactctttcaacacggacgaggatacaaagaaaatcttacaaaagtataaccattgcagagttaagatctacacatttaatcagagtagataccctcggatcaataaggagtctctgttgcccgttgctaaagatgtgtcctactcaggggagaatacagaggcctggtacccccctggccatggggatatttatgcctcattctataatagcggcctgttggataccttcataggagaaggaaaggagtacatcttcgtctctaatatcgacaacttgggcgcaaccgtggatctctatattttgaaccacctgatgaatcccccaaatggcaagaggtgtgaattcgtaatggaagtgacgaacaagacccgtgccgatgtgaagggcggaacactgacacagtatgaggggaagctgaggctggtagaaattgcccaggtgcctaaagcgcacgtcgacgagttcaaatcggtgtctaagttcaaaatttttaatactaacaacctgtggatcagcctagctgccgtaaagaggcttcaggagcagaatgctatcgacatggaaataatcgtgaatgctaagaccctggacgggggacttaatgttatccagcttgagacagctgtgggtgctgccattaagtcctttgagaattctttgggcataaacgtgcctagaagcaggttcctccccgtcaaaacaactagcgacttgctcctggtgatgtctaatctttactccctgaacgctgggtcacttacaatgtccgaaaagcgggagttccccaccgtccctcttgtcaagcttggatctagctttaccaaggtgcaagactacctgcggagatttgagtccatccccgacatgcttgagctagaccatctgaccgtgtctggcgacgtgactttcggtaaaaatgtgtctctcaaagggactgtaattatcatcgccaatcacggcgatcggattgacatcccaccgggagccgtgctggagaacaagattgtgagcgggaacctgcggatccttgaccactag

SEQ ID NO: 246200 - DNA, 1494 bp, Artificial Sequence
  Description of Artificial Sequence: Synthetic coding sequence
atgagtcaggacggcgcatcccagtttcaagaggttattaggcaggagctggagctgtcagtgaaaaaggaactggagaaaatcctgaccaccgcatcctctcacgagtttgaacataccaaaaaggatctggacggcttcaggaagctttttcataggttcttacaggaaaagggaccctctgtcgactggggaaagatccaaaggccacccgaagattcaatccagccctatgaaaaaatcaaggcacgaggtttgcctgacaatatcagcagcgttctgaataagttggtcgtggttaagctaaacgggggtctagggacttctatggggtgcaagggaccaaagagtctgattggcgtgcggaacgagaacaccttcttggatctcaccgtacagcaaatcgaacatctgaataagacctataatacggatgtcccactggtgctgatgaactccttcaataccgatgaggacactaagaaaatcctgcagaaatataatcactgccgcgtgaagatctataccttcaaccagtctcgctaccccaggatcaacaaggagagcttattgccagtggcaaaagatgtctcttattcgggggaaaatacagaggcatggtatcctcccggacatggtgacatctatgcaagcttctataattccggactgctcgacacgttcattggcgaaggtaaggaatacatatttgtgtcgaacatcgataacctcggagcaacagtggacctctacatactaaaccacctcatgaacccccctaacggcaagagatgcgagtttgtgatggaggtaaccaacaaaacgagggccgacgtcaaagggggaactctcacccagtacgaaggtaagctgagacttgtggaaatcgctcaagtgccaaaggcccacgtggacgagtttaagtccgtttcaaaatttaaaattttcaataccaacaatctgtggatttccctggcggctgtcaagagactgcaggagcaaaacgcaatcgacatggagatcattgttaatgcgaaaacactggatggtgggctgaacgtgatccagctcgaaacagctgtaggtgctgccataaagagcttcgagaactctttggggataaatgtgccacgcagcagattcctcccggtcaagaccacttcagacctattgctggtgatgtcaaacttgtacagtctcaatgccggttctctgacgatgtcggaaaagcgcgaatttccgactgttcctctagtgaagctaggatcatctttcacaaaagtgcaggattatctccgacgcttcgagtcaatcccagatatgctggagcttgaccatctgacagtgtcaggggatgtaaccttcggtaagaatgtatctctgaagggcaccgtcatcatcattgctaaccacggcgaccggattgacattccccctggcgctgtgctggaaaataaaatagtgagcggtaatttgcggatactggaccattag

SEQ ID NO: 246201 - DNA, 1554 bp, Artificial Sequence
  Description of Artificial Sequence: Synthetic coding sequence
atgctcctttacccagctggtttctccttcgcctcactgaagagcgatctgtcaaaagcgatgagtcaagatggggcatcacagtttcaagaagtcattcgtcaggaattggagctgtctgttaagaaggaactagagaaaatactgacaactgcaagctctcatgaatttgagcataccaagaaggaccttgacgggttccgaaagctgtttcataggtttctgcaagagaaagggccaagtgtggactgggggaagattcagcgccctcccgaggactccatacagccctatgaaaagattaaagcaagaggcctgccagataacatttcctcagtgctgaacaaactggttgttgtgaagctgaacggcggactcgggacatcaatgggatgtaaggggccaaagtccctgatcggcgtgcgaaatgaaaatacgtttctagatctaacagtgcagcagattgaacatcttaacaaaacctacaataccgacgtgcccctcgtgctcatgaatagtttcaatactgacgaagataccaagaagattctgcaaaaatacaatcactgtcgggttaaaatttacaccttcaaccaaagccgataccctagaattaataaggagtctctactgccagttgcaaaggacgtcagctacagtggggagaataccgaggcctggtacccacccggacatggcgacatctacgcaagcttctacaacagcgggcttctcgatacttttatcggagagggtaaagaatatattttcgtgtcgaatattgacaatctgggcgcaacggtcgacctgtacatattgaatcacctgatgaaccctcccaacggcaagcgctgcgaattcgtaatggaagtcaccaataaaacacgggctgatgtaaagggagggaccctgacacagtacgagggtaaattaaggttagtggagatagcacaggtgccaaaagctcacgtcgatgagtttaagagcgtgtcaaaatttaaaatatttaatactaacaacttatggatttcactggccgcagtgaagcggctgcaggagcagaacgcaattgacatggagattattgttaacgcgaagacactggatggcggattgaacgtgattcagctggagaccgcggtgggggcagcgattaagagttttgaaaatagtctgggaattaacgtgccgagaagcaggttccttcccgtcaagaccactagcgacctgctcctcgtgatgagcaatctgtatagtctcaacgccggatcactgaccatgtccgagaaacgcgagtttccgactgtgccactcgtgaaactggggagtagttttacaaaagtacaggattacttgcggaggtttgaatcaatcccagacatgctggaactggaccacctgacggtgagtggggatgtcaccttcgggaaaaatgtatctctgaaggggacagttatcatcatcgctaaccacggtgaccggattgacataccaccaggggcagtgttagagaataagatcgtttctggaaatctcagaattcttgatcactag

SEQ ID NO: 246202 - DNA, 1494 bp, Artificial Sequence
  Description of Artificial Sequence: Synthetic coding sequence
atgtcccaggacggagcgtcccagtttcaagaggttatacggcaggaacttgagctatcggtcaagaaggagctcgagaaaattcttactaccgcctcctcacacgagtttgagcatacaaaaaaggatttagatgggttccgtaagctgttccataggttccttcaggaaaaaggccctagcgtagactggggcaaaatccagagacctcccgaagatagcatccagccgtatgagaaaatcaaggcgcgtggactgcctgacaacataagctccgtgctcaacaagctcgtggtggtgaagctgaatggcggactgggtacctccatggggtgtaaaggccctaagtctctgatcggcgtgcgaaacgaaaacactttcctggacttgacagtccagcaaatcgaacacctcaataaaacatacaataccgatgtgcctctggtgttgatgaactcttttaacacagatgaagatactaagaagatcctccagaagtacaatcattgcagggtcaagatctatactttcaatcagagtcgctaccccaggatcaataaggagtccctgctgcctgttgccaaggacgtttcctactccggggaaaatacagaagcttggtatcctcccggacatggagacatttacgcctccttttataattccggcctgctggacacctttatcggagagggcaaggagtatatcttcgtttctaacatcgacaacttaggcgctacagtggatctgtatatcctaaatcatcttatgaacccccctaacgggaaaagatgtgagtttgtaatggaagtcactaataaaacccgggcagacgtgaaggggggaacactgacccaatacgagggcaagctgaggctggtcgaaatcgcacaggtgcctaaggcacatgtggacgagttcaagtccgtgtccaagttcaaaatcttcaatacgaacaacctctggatcagcctggcggcagtgaaaagattgcaggaacagaatgccatcgacatggagattatcgttaatgccaaaacactggatggcggacttaacgtcattcaactggaaactgcagtgggtgccgcaattaagagtttcgaaaattctcttggcatcaacgtccccagatctcgatttctgcccgtaaaaaccacaagcgacctccttctggttatgtctaacctatactctctcaatgcgggaagcctgacaatgtccgaaaaaagagagttccccacagtgcctctggtgaagctgggctctagcttcacaaaagttcaggactatcttagacggttcgagagcatcccagatatgctggaactggaccacctgacagtgtcaggtgacgtgaccttcggaaagaacgtgtccctgaaagggacagtgatcatcatcgctaatcatggtgatcgcatcgatatccccccaggggctgtgttagagaacaaaatcgtgtcagggaatctccggatactggaccactag

SEQ ID NO: 246203 - DNA, 453 bp, Artificial Sequence
  Description of Artificial Sequence: Synthetic coding sequence
atgagtcaagatggcgctagtcagttccaggaggttatcaggcaggaactggaattatccgtgaagaaagaattagaaaaaattctgacaaccgcctctagtcacgagttcgaacacacaaagaaagaccttgacgggttcagaaaattattccaccgattccttcaagagaagggcccaagcgtcgattggggaaagatccagcgaccgcctgaagatagcatccagccatacgagaagattaaggctagaggactaccagataacatttccagcgtgctgaacaagctggtggtcgtaaaactcaatggagggctgggcacgagtatggggtgcaaaggacccaaatcactcattggcgtccgaaacgagaatacatttctagatctgaccgtacaacaaattgaacacttgaacaagacgtacaacactgatgtgcccctggtcctgtag

SEQ ID NO: 246204 - DNA, 516 bp, Artificial Sequence
  Description of Artificial Sequence: Synthetic coding sequence
atgtcccaggacggagcttcgcagtttcaagaagttattcgacaagaattagagctgtccgtgaaaaaggaactcgaaaagattctgaccaccgcatcaagtcacgaatttgaacacacaaaaaaggatctggatgggttcagaaagctgtttcaccgatttttacaggagaaaggtcctagtgtcgactggggcaagatccagaggcctcccgaagattccatccagccatacgaaaaaattaaggcaagaggcctgcccgacaatatatcgtccgtgctgaacaagctcgtagtcgttaagttgaatggcggactgggcactagtatgggatgtaagggccctaagtcccttattggggtccgtaacgaaaatacattcctcgatctgaccgtgcagcagattgagcacttgaacaaaacgtataataccgacgtgcctctcgtgctgatgaacagcttcaacaccgacgaggacaccaagaaaatcctgcaaaagtataaccattgtaggtag

SEQ ID NO: 246205 - DNA, 117 bp, Artificial Sequence
  Description of Artificial Sequence: Synthetic coding sequence
atgtcccaggatggtgcttcacaatttcaggaggttatacgacaggaattagagttgagcgttaaaaaagagctcgagaaaatacttacgactgcaagtagtcacgaattcgaatag

SEQ ID NO: 246206 - DNA, 318 bp, Artificial Sequence
  Description of Artificial Sequence: Synthetic coding sequence
atgagccaagacggagcttcccaattccaggaagttatccggcaggaattagagctgtcggtgaagaaggaactggagaagatcctgaccacagcttcatctcatgaattcgaacacacaaagaaagatctagacggcttcaggaaactgtttcaccgattcttacaggagaaaggaccctctgtggattggggaaagatacagcgacccccagaagacagcatccaaccctacgagaagataaaggccaggggactgccagataacattagctcagtgttaaacaagctggtggtggtgaagctgaacgggggatag

SEQ ID NO: 246207 - DNA, 150 bp, Artificial Sequence
  Description of Artificial Sequence: Synthetic coding sequence
atgtctcggtttgtgcaggatctgtccaaggctatgtcccaagatggggcatctcagtttcaggaggtgatcagacaggaactggagctgtcggtcaagaaagagctagagaaaattctgacaactgcgagttctcatgaatttgaatag

SEQ ID NO: 246208 - DNA, 408 bp, Artificial Sequence
  Description of Artificial Sequence: Synthetic coding sequence
atgagtcaagatggtgcgtctcaattccaggaggtgattcgacaggagctggagttgtccgtcaaaaaagaactggagaaaattctcacaaccgcctcatcgcacgagtttgaacatacaaaaaaggacctggacggttttcgaaagctgtttcacagattcctgcaggaaaaaggcccttccgtcgattggggcaagatacagaggccacctgaggatagcattcagccctacgaaaaaatcaaggccaggggattacccgacaatatcagtagtgtgctgaacaagttagtagtggtgaagctcaatggcggactgggcacgtccatggggtgtaaagggccaaagtccttgatcggtgtgcgcaacgagaatacattccttgatctgacagtgcagcagatctag

SEQ ID NO: 246209 - DNA, 642 bp, Artificial Sequence
  Description of Artificial Sequence: Synthetic coding sequence
atgtctcaagacggtgctagccagtttcaggaggtgattaggcaagagctagagctaagcgtaaaaaaggaactcgaaaagatactaacaacggccagctcacacgagttcgagcatacaaagaaggatctggatgggttccgcaaactttttcataggtttttgcaggagaaaggaccttccgtggattgggggaagatccagagaccacccgaggattccattcagccatatgaaaaaataaaggccagaggtctgccggacaatatcagctctgtgttgaacaaactggtagtggtgaaactgaatggagggttggggacaagtatgggttgcaaaggtccgaaaagcctgattggggtcagaaacgaaaatacctttctcgatctaacagtccagcaaattgaacacctgaacaagacatacaacacggacgtgcctctggttctgatgaattcattcaacactgacgaagataccaaaaagatcctgcagaaatacaaccactgccgggtgaaaatttacactttcaaccagagtagatacccccgtatcaacaaggagagcctgctcccagtcgcaaaagacgtgtcctatagcggcgaaaatacggaggcatggtatccacctggacacggctag

SEQ ID NO: 246210 - DNA, 1278 bp, Artificial Sequence
  Description of Artificial Sequence: Synthetic coding sequence
atggtcagcaaggctctgctgcggctagtgagcgcagtcaataggcgacggatgaaactcctcttaggtatagcacttttggcgtatgttgcgagcgtgtggggcaacttcgtgaatatgagcttcttgttgaatcgctccatacaggagaatggtgagctgaaaatcgagagcaagatcgaagaaatggttgagcccctgagagaaaaaattagagatctggaaaagtccttcactcagaagtacccgccagtcaagttcctctcagagaaggaccgcaaacggatcttaatcacaggaggcgctggattcgtcggatctcacttaaccgacaagctgatgatggacggacatgaggttacggtcgtagataacttttttaccggcagaaaaaggaacgtggaacactggattggacacgagaattttgaactgatcaatcatgacgtcgtggaacccctatacatcgaggtcgaccagatttaccacctagcttcccctgcctcacccccaaactacatgtacaaccccatcaaaacgctcaagaccaacacaatcgggacattgaatatgctgggcctggccaaacgggtgggggcacgcctgctcctcgcgtctaccagcgaggtgtacggtgatcccgaagtccatccccagtctgaagattactggggacacgtaaacccaataggcccaagagcttgttacgatgagggcaaacgagtggcagagactatgtgctatgcctatatgaaacaggaaggggtggaggttagggtggcccgaatctttaataccttcgggccacgcatgcatatgaacgatggcagagtcgtgagcaactttattctgcaggccttgcagggagaacctctaacggtctacggttcgggatcccagaccagagcatttcagtacgtctctgatctagtgaatgggctggtggccttgatgaatagcaatgtgagcagccccgtcaatctgggaaacccagaagagcataccatcctcgaattcgcccaactcattaaaaatctggtgggctcgggctctgagattcagttcctgagtgaggcccaggacgacccacagaaacgcaagcccgatataaagaaagccaaactgatgctcggatgggagcctgtggtacccctggaagaaggactcaataaggccatccattacttccggaaggagcttgagtatcaggcgaataaccagtacattccgaagcccaaaccagccaggattaagaagggacgtaccaggcattcctag

SEQ ID NO: 246211 - DNA, 759 bp, Artificial Sequence
  Description of Artificial Sequence: Synthetic coding sequence
atgtataaccctatcaaaacactgaagacaaatactattggaacactaaatatgctcgggctggccaagcgggtgggtgctcggctgcttctcgcatccactagcgaagtgtatggagaccctgaggtacacccacagtctgaggattactggggacacgttaaccctatcgggccacgagcatgttacgacgaggggaagagagtggccgaaacaatgtgctatgcctatatgaaacaggagggtgttgaagttcgcgtggccagaatcttcaataccttcggacccaggatgcatatgaacgacggacgtgtggtgagcaatttcatactccaggctctacaaggcgaaccgttgactgtttatggatcagggagtcagacgagggctttccagtatgttagtgacctggtcaacggccttgtcgctctcatgaattcaaatgtttccagcccagtcaacctaggcaaccccgaggagcacactatcttggaatttgctcaacttatcaagaatctggtgggttcaggctcagagatacagttcctcagtgaggctcaggacgacccccagaagcggaaacccgatattaaaaaggccaagctgatgctgggttgggagcccgtcgtccctctggaggaaggtctgaataaagctattcactacttcaggaaggagctcgagtaccaggccaataatcaatatatccctaaaccaaagcctgcaagaattaagaagggaagaactaggcatagctag

SEQ ID NO: 246212 - DNA, 1263 bp, Artificial Sequence
  Description of Artificial Sequence: Synthetic coding sequence
atggtgagcaaggccctcctgcgactggtaagcgcagtcaacagaagacggatgaagttgcttctcggcatagccctgttggcctacgttgctagtgtctggggcaatttcgtaaatatgagatcaattcaggaaaatggagaattgaagattgagtcaaaaatcgaagagatggtcgaaccactgcgtgaaaaaatccgcgatctggagaagtccttcactcagaagtatcccccagtgaagtttctgtcagaaaaagacagaaaaagaattctcatcacagggggtgctgggttcgtgggttcgcacctgactgacaagctgatgatggatggtcatgaggtgaccgtcgtggacaacttcttcacaggcaggaagcgcaatgtggagcactggatcggacacgagaacttcgaattaataaaccatgacgtcgtggaacccctctatatcgaggtggaccagatctaccacctagcatcaccagcaagccctcctaactatatgtataatccaatcaagacactcaagactaacactattggcacactgaacatgctgggattggctaagagggtgggcgcaaggctcctgttagccagcacttccgaagtatatggggacccagaggtccacccccagtcggaagattattggggacacgtcaatccaatcggtccgagggcctgctacgatgaaggcaaacgcgtggctgaaacaatgtgttatgcctatatgaaacaagagggggtggaggtgcgcgtggcccgtatctttaacacatttgggccacgtatgcacatgaatgatggcagggtggtgtccaactttatcctgcaggctctgcagggcgagccattgacggtgtatggatctggaagccagacgcgcgcttttcagtacgtctccgatctcgtgaacgggctggttgcccttatgaatagtaatgtgtcatcaccggtgaacctgggcaacccggaagaacacaccattctggagttcgcccagctaataaagaatctcgtgggatccggcagtgagattcaatttctgagtgaggcacaggatgacccccagaaaaggaaacctgatataaaaaaggccaagcttatgctagggtgggagccggtggtaccactagaggagggtctgaacaaggccattcactattttcggaaagaactcgagtaccaggccaacaaccagtatattcccaagcctaagcccgcaaggattaagaagggccgaactcgccattcgtag

SEQ ID NO: 246213 - DNA, 405 bp, Artificial Sequence
  Description of Artificial Sequence: Synthetic coding sequence
atgtacaaccctatcaagacactgaaaactaacaccattgggacgctcaacatgttgggcttggcaaagagagtgggagccagactcctgttagccagtacatccgaagtgtatggtgaccccgaagttcacccacagagcgaagattactggggacatgtcaaccctattggaccacgtgcctgttatgacgaggggaagcgcgtggccgagaccatgtgctatgcctatatgaagcaggaaggcgttgaagtccgagtcgcccgtattttcaacaccttcggccctaggatgcatatgaacgacggacgggtggttagtaactttatcctgcaggctctgcagggagagcccctgaccgtgtatggctctggtagtcagacacgagcattccaatacgtttag

SEQ ID NO: 246214 - DNA, 558 bp, Artificial Sequence
  Description of Artificial Sequence: Synthetic coding sequence
atggtgtccaaggcactgctcagactggtgtctgctgtaaatcggaggcggatgaagctgctcctcggaatcgctctgctcgcttacgtggcatggctggcaaagcgcgtcggcgcacgactgctgctcgcgagcacaagcgaagtttacggcgaccccgaggtacatccccagtctgaggactactggggccatgtaaatcccattggccctagggcctgctacgacgagggtaaaagagtcgcggaaaccatgtgctacgcctacatgaaacaggagggcgtggaggtcagggtggccagaatctttaacacatttggaccacgcatgcacatgaatgacggacgagtcgttagtaatttcatcctccaggccctacaaggagaacccttaaccgtgtatggcagcggctcccaaacacgtgccttccaatacgtgtcagatctggtcaacgggctagtggcattgatgaactctaacgtgtcgtcaccagtgaacttggtcagtgcacccctgccacctttgtgccggacggcccagaccttcgttcatctttag

SEQ ID NO: 246215 - DNA, 159 bp, Artificial Sequence
  Description of Artificial Sequence: Synthetic coding sequence
atgtacaatccaatcaagacgttgaagaccaatactataggaaccttgaacatgctgggcttggccaagagggtgggcgctcggctcctgctcgcatcaacatccgaggtgtacggagatccggaggtgcacccccagtcagaggattattggggttag

SEQ ID NO: 246216 - DNA, 366 bp, Artificial Sequence
  Description of Artificial Sequence: Synthetic coding sequence
atgtataaccctatcaagactctgaagactaacaccatcggcaccctcaatatgttgggcctcgcgaagagagtgggtgcacgacttcttctcgcatcgactagcgaggtatacggggatcctgaggtacaccctcagtcagaggattactggggccatgtcaaccccatcggaccaagggcctgttacgatgaaggtaagagagtcgccgaaacaatgtgctacgcgtatatgaaacaggagggcgtggaggtacgggttgccaggatttttaatacattcggcccacggatgcacatgaatgatgggcgagtagtaagtaattttatactccaggccttgcagggagagccactgactgtgtag

SEQ ID NO: 246217 - DNA, 1092 bp, Artificial Sequence
  Description of Artificial Sequence: Synthetic coding sequence
atggttgagccactgcgggaaaaaattcgtgatctagagaaatcgttcactcagaaataccctcccgtgaagttcttatccgagaaagacaggaaacggatcctgatcaccgggggagcaggcttcgtgggcagccatctcaccgacaagctaatgatggacgggcatgaagtgactgtggtggacaattttttcacgggtcgcaagcgcaacgtggagcattggatcggccacgaaaattttgagttaatcaatcatgacgtggtggagcctctgtacatagaagtggatcaaatatatcacttggcttcacctgcatccccgccaaactacatgtataacccaattaaaacattgaagactaacactataggaacactgaatatgttagggctggcaaaaagagtcggggcacggctccttcttgcatcaacctccgaggtgtacggggatcctgaagtacaccctcagtcagaggactactggggtcacgtgaatccgatcggacctcgggcttgttatgatgaaggcaaaagagttgctgagacaatgtgctacgcttatatgaagcaagagggcgtggaagttcgagtcgcccgaatttttaataccttcgggcctagaatgcatatgaatgacggtcgcgtagtgtcaaatttcatcttacaggctctgcagggggaacctctgaccgtgtacgggagcgggtctcaaacacgggctttccagtacgtgtcggaccttgtaaacggcctggtcgctctcatgaactccaatgtgtcttctcccgtgaacttgggaaaccccgaagaacacactatactagagtttgcccagctcataaaaaatctcgtcggttcaggcagcgaaatacagtttctaagcgaagcccaagacgatccccagaaacgcaagcccgatattaaaaaagccaagctgatgctcggctgggagcccgtggtgccactcgaagagggactaaacaaggctatccattatttcagaaaggaacttgaatatcaggcgaataaccagtatattcccaaaccaaagcccgcacggatcaagaagggacgaactcgtcattcgtag

SEQ ID NO: 246218 - DNA, 1680 bp, Artificial Sequence
  Description of Artificial Sequence: Synthetic coding sequence
atgcgtaaatttgcgtactgcaaggtggttctcgccacctctctgatttgggtgctactcgacatgtttctgcttctctacttttctgagtgcaataagtgcgacgagaaaaaggagaggggactgccagccggagatgtgctggagcccgtccagaagcctcatgagggccctggggaaatgggaaagcccgtcgtgataccgaaggaggaccaggaaaagatgaaagagatgtttaaaatcaaccagttcaatcttatggcctccgagatgatagcgttgaatcgcagcctgcccgatgtccggttagaaggctgcaaaaccaaggtgtatccggacaatctccccactacctccgtggtgatcgtgttccataatgaagcctggagtactctgctccgtacagttcactctgtcataaaccggtctcctcgccatatgattgaggaaattgtgctggtggacgatgcatcagaacgggactttctcaaacgcccattggagagctatgttaagaaattgaaggtgcctgtgcacgtgattaggatggaacaacgttctgggttaatccgcgctagattgaaaggggctgccgtgagtaaaggccaggtaataaccttcctggacgctcactgcgagtgtaccgtaggctggctagaaccactcctcgcccgaatcaagcatgaccgacgcacagtcgtgtgccctattatcgacgtgatcagcgatgatacattcgaatacatggccggttccgacatgacatacggaggctttaactggaaattaaatttcagatggtacccggtgccgcagcgtgagatggaccggaggaaaggtgatcgtacgctgccagtacgaactccaacaatggctggcggacttttttccattgatagggactatttccaggagatagggacgtatgatgccggaatggatatttgggggggagaaaacttagaaatctctttccggatctggcaatgcgggggaaccttagaaattgtgacgtgtagccatgttggtcatgtgttcaggaaagctactccatatacttttcctgggggaactggccaaatcattaacaagaataacagaagacttgctgaagtgtggatggacgagttcaagaactttttctacatcatctcacccggtgtgacaaaggttgactacggagatatttccagtagagtgggcttgaggcacaaactccaatgcaagcctttcagctggtatctggagaatatatacccagattcccagataccacgtcattatttttcactgggtgagataagaaacgttgagaccaaccagtgtctggataacatggctagaaaggagaatgagaaagtggggatcttcaattgtcacggcatggggggaaaccaagtatttagctatactgccaacaaagagatacggacagacgacttgtgcctggacgtctctaagctaaatgggccagtgaccatgcttaagtgccaccatttaaagggaaaccaattgtgggaatatgacccagttaaacttacccttcaacacgtgaacagcaatcagtgcttggacaaggcaactgaggaggactcccaggtccccagcattcgcgattgtaacggaagtcgttcccaacagtggctgctgcgcaatgttacactccctgaaatcttttag

SEQ ID NO: 246219 - DNA, 1500 bp, Artificial Sequence
  Description of Artificial Sequence: Synthetic coding sequence
atgggcaagcctgtggtaatccccaaagaagaccaggagaagatgaaggaaatgttcaagatcaatcaattcaatctgatggcttctgaaatgatagccctaaataggagcttacctgacgtgagactggagggatgtaagaccaaagtgtatcctgacaatttgcctacaacgtctgtagtgatagtgttccacaatgaggcctggagcacgctactgcgcacagtccactctgtcatcaatcgctcaccacggcatatgattgaagagatcgtcctggtcgacgatgcgtcggagcgggatttcttgaagagaccactggagtcatacgtcaagaaattgaaagttcctgtacacgtcatacgtatggagcagagaagcggattaattcgagccaggctaaagggagcggctgtgtccaagggtcaagtaatcacctttcttgatgctcattgtgagtgcacagtgggatggttagagcctctgctagcacggatcaagcacgataggaggacggtcgtgtgccctatcatagatgtgatttccgacgacactttcgagtacatggctggcagcgatatgacatacgggggattcaattggaaactgaatttcagatggtatcctgtgcctcagcgagagatggacaggcggaagggagataggactcttccggtaagaacccctacaatggccggaggcctgttttctatcgatagggactatttccaggagattgggacatatgacgcaggcatggacatttgggggggtgagaatttggagatctcctttcggatatggcagtgtggaggtacgctagagatagtcacatgttcgcacgttggccatgtgttccggaaagccacgccatatacttttcccggtgggactgggcaaattatcaacaagaacaacaggaggctggcagaggtctggatggatgaatttaaaaacttcttttacatcatctcacccggtgtaacaaaagtagactatggcgacatctcctcacgcgtgggactccgacacaagctccagtgtaaaccattcagctggtatctggaaaatatctatcccgattcacagattccaagacattacttcagcctgggtgagattcgcaatgtggaaacgaatcagtgcctcgacaatatggcccgaaaagagaacgagaaggtcgggatctttaattgtcatggtatgggcggaaaccaagtcttttcctacaccgctaataaggagatccgtaccgatgatctctgcctcgatgtatccaaattgaatggtcccgtcactatgctgaaatgccatcacctgaaagggaaccagctctgggagtacgatcctgtcaagctgactctgcagcacgttaattccaatcaatgcctggataaagcaactgaggaggattcccaggtcccatcaatcagagattgtaacggctcccgatcccaacaatggctgctgcggaatgtcacactgcccgagatattctag

SEQ ID NO: 246220 - DNA, 1680 bp, Artificial Sequence
  Description of Artificial Sequence: Synthetic coding sequence
atgcggaagtttgcttattgcaaagtcgttctcgctacctccttaatttgggttttactggacatgttcctcttgctgtattttagtgaatgtaacaagtgcgatgagaaaaaggagagaggtctgccagcaggagatgttttggaaccagtccagaaaccgcacgaagggcctggggagatgggaaagcccgtcgttatcccaaaggaagatcaagaaaagatgaaagaaatgtttaaaattaatcaattcaacctcatggcatctgagatgattgccctgaatcggtccttgccggacgtgagactcgaaggttgtaagacaaaagtgtacccagacaatctaccgactacctctgtggttatcgttttccacaatgaagcttggtccaccctcctgcggactgtgcacagtgtgataaatcgctcaccacgtcacatgatcgaagagatcgttctcgtcgatgacgcctccgagcgagacttcctgaaaaggccactcgagagctacgtgaaaaagttgaaagttcctgtccatgttattaggatggaacagaggagtggcttgatccgtgcgagactaaagggggcagccgtgtctaaaggacaggtcatcaccttccttgatgcccattgcgaatgcaccgttggctggctggagcctctcctggctcgaattaaacacgaccgcagaaccgtggtttgccccattatcgacgtcatcagtgacgataccttcgagtacatggccggttctgacatgacctacggcggattcaactggaagctgaacttcagatggtaccctgttccccagcgtgagatggacagacgtaaaggcgaccgcaccctgcccgttagaacgcctacaatggcaggcggtctgttctccatcgatcgtgactactttcaggaaatcggcacttatgacgcgggtatggacatctgggggggtgagaatctggaaatttcctttaggatctggcagtgcggcggtactctcgagatcgtgacgtgcagtcacgtcggtcacgtcttccggaaggctaccccctacacgttccccggaggcaccggacaaatcattaataaaaataatagacgattggccgaggtatggatggatgagtttaagaattttttttatattatatctcccggtgtcactaaagtggattatggcgatattagtagcagagtagggctccggcacaagctacagtgcaaacccttttcttggtaccttgagaacatctatccagactcccagattcctcgacactattttagcctcggtgagatacgaaatgtcgaaacaaaccagtgtttagacaacatggccagaaaagagaacgaaaaggtgggaatctttaactgccacggaatgggtggcaatcaagttttttcctacaccgctaataaagaaatccgcactgatgacctctgcctcgacgtcagtaagctgaacggccctgtcactatgctcaaatgccatcacctcaagggtaaccagctctgggaatatgaccccgtgaagttaacgctccagcatgtcaatagcaatcagtgtctggacaaggctacagaggaagacagtcaggttccatcaatccgcgactgtaacggaagccgatcccagcagtggctcctgcgtaacgtcacactccccgagatcttctag

SEQ ID NO: 246221 - DNA, 1812 bp, Artificial Sequence
  Description of Artificial Sequence: Synthetic coding sequence
atgcggagaaaagaaaagcggcttttgcaggccgtggctttagtgctcgctgccttggtcctcttacccaatgtcggtttatgggcgctataccgtgagcggcagcctgatggaacccctggcggatcaggggcagctgtagccccagctgccggtcagggctcacattccagacagaaaaagacgttctttcttggagatggacagaagctgaaagattggcacgacaaagaagcgatccggcgagatgcacagagggtgggaaatggtgagcagggccgaccctatcccatgaccgacgctgagagagtggatcaggcctaccgggaaaatgggttcaacatctacgtaagcgacaagatttcactgaaccgctccctccctgacatacgacatcccaactgcaacagcaaacgatacctggagacactcccgaacacaagcattatcattccctttcacaacgagggttggagctccttactccgtactgtgcactccgtcttgaatcggtctcctcctgagctggtggccgagatcgtgctagtggacgacttctctgacagagagcatctcaagaaacctttagaggattatatggcgttgttcccttcagtgaggatcctacggacgaaaaaaagagaggggctgatccgcaccaggatgctaggagctagcgttgccaccggcgacgtgatcacgttcctggactcccattgcgaggcaaacgtaaattggctcccacctcttttggaccggatcgccaggaacagaaaaacaatcgtctgccctatgatcgacgtgattgaccacgacgactttcgctatgaaacgcaagctggggacgctatgaggggcgctttcgattgggagatgtactataaacgcattccgatccctcccgaactccagaaagcagaccccagcgaccctttcgaaagtcccgttatggcaggaggactctttgccgtggaccggaaatggttctgggagctgggaggctacgaccccggactggaaatttggggcggtgagcaatacgagatctccttcaaagtctggatgtgcggaggcaggatggaggatattccttgctcccgtgtcgggcatatttacagaaaatatgtgccttataaggtacccgctggggtgagcctggccagaaatctgaagcgggtggcagaggtgtggatggacgagtacgcagagtacatctatcaaaggcgaccagagtatagacacctgagcgccggtgatgttgctgtgcagaaaaagctcaggtcgagcctcaattgcaagagcttcaaatggtttatgactaagatcgcgtgggacctgcccaagttctaccctccggttgaacctccggctgccgcttggggagagataaggaatgtaggcactgggctgtgcgccgacacaaaacatggtgctctggggagccctctccgtctggaagggtgtgtgcgtggccgaggcgaggcggcttggaacaacatgcaagtctttacatttacctggcgagaagatattcggccaggagatccccagcacaccaaaaagttttgctttgacgctattagtcacacgtccccagttactctttatgattgccattccatgaaagggaaccaactttggaaatacaggaaagataagactctctaccacccagtgagcgggtcatgtatggattgctcagaaagtgaccaccgtatctttatgaatacctgcaatccctcatcgctcacgcagcagtggctcttcgagcacaccaattcaacagttcttgagaaattcaaccggaattag

SEQ ID NO: 246222 - DNA, 831 bp, Artificial Sequence
  Description of Artificial Sequence: Synthetic coding sequence
atgctcgcctggcgtgacggcgaattagaagccgagaccagcagttctctcttccttttagcaatgcaggtatggatgtgcggtggcaggatggaggacatcccgtgtagcagggtcggtcacatataccgtaaatacgtgccttacaaggtgccagccggtgtgtccctggccagggtgagaaacctgaagcgcgttgccgaagtttggatggatgaatacgccgaatacatctatcagcgcaggcctgaatatcgacatctcagtgcaggggatgtagctgtgcagaaaaaattaaggtcctccctcaattgcaagagcttcaagtggtttatgacgaagatcgcctgggacttacccaaattttatcccccagttgaaccccctgctgcagcttggggcgagattaggaacgttggaacgggcctttgtgctgataccaagcatggcgctttggggtctccgttgcgactggaaggctgcgtcagaggcaggggcgaggccgcatggaacaatatgcaggtttttacttttacttggagagaggacatccgccctggcgatccccagcacacaaagaaattctgtttcgatgctatcagtcatacttcacctgttacgctgtatgattgccattccatgaaggggaaccagctgtggaagtataggaaagacaaaactctgtatcacccagtgtccggcagctgcatggattgttcagagtccgatcataggatctttatgaatacctgcaacccatcctcgctgactcagcaatggctattcgaacacacaaattccacagtgttagaaaagttcaatagaaattag

SEQ ID NO: 246223 - DNA, 1626 bp, Artificial Sequence
  Description of Artificial Sequence: Synthetic coding sequence
atgagaaggaaagagaagagacttctgcaggcggttgcactggtgctcgcagcactggtgctccttcctaatgtggggctatgggcactgtaccgcgagaggcagccagatggcactccgggaggttctggcgcagcagtcgcccctgcagccggacaggggtctcactcccgccagaaaaaaaccttttttctgggcgacggtcaaaaacttaaagactggcatgacaaggaggcgatacggagggacgcccagcgagtagggaatggcgaacagggacggccataccctatgaccgatgccgaaagggtagaccaggcctatagagaaaacgggttcaacatttacgtgtccgacaaaatctccctcaatcgctctctcccagatatccggcacccaaattgtaacagcaaaaggtacctagagaccctccccaatacaagcattataatcccctttcataatgagggatggtcaagcctgttgcgcacagttcatagcgttctgaatcgctcacctcctgagctggtggcggagattgtgttagttgatgacttctccgaccgcgaccgcatagcacgaaaccggaaaaccattgtgtgtcccatgatagacgttatcgaccacgacgactttagatacgagacacaggcaggggacgctatgcgtggagcttttgattgggagatgtattataaaaggattcctatcccgcctgagctccagaaagccgatcctagcgacccttttgagtcacccgtcatggccggtggtctgttcgccgtggaccgcaagtggttctgggaactgggagggtatgacccagggctcgagatttggggcggtgaacagtatgaaatttccttcaaggtgtggatgtgtgggggtcgcatggaagacattccatgtagccgcgtgggccatatttacaggaagtatgtgccatacaaggtccctgcgggagtcagtttggcacggaacttaaagcgcgtagcagaagtatggatggacgagtatgccgaatatatctaccaaagacgtcccgagtatcgccatctgtccgctggcgatgtagcagtgcaaaagaagctgcgttccagcctgaactgcaaatccttcaaatggttcatgaccaagattgcctgggacctaccgaaattctacccgccagtcgaacctcctgcagctgcttggggcgaaatcagaaatgtaggcaccggtctctgcgcggatacgaagcacggagcattaggaagccccctgcgattagaggggtgtgtgagagggagaggcgaggccgcttggaacaatatgcaggtcttcactttcacctggagggaagacatcagacccggtgacccacagcatacaaagaaattctgctttgatgcaatcagccataccagcccagtgactttgtacgattgccactcaatgaagggcaaccagctgtggaaatacaggaaagataagaccctctaccatccagtctctgggagttgcatggactgctcagagtcagaccaccggatcttcatgaatacttgcaacccgtcctcactgacacagcaatggctttttgagcatacaaattctaccgtgttggagaagttcaatcgcaactag

SEQ ID NO: 246224 - DNA, 1101 bp, Artificial Sequence
  Description of Artificial Sequence: Synthetic coding sequence
atgcgtcggaaggagaagcgactgttacaggccgttgcacttgtactagctgccttggtcctgctccccaacgtcgggctttgggcactctatcgcgaaaggcaacctgatgggactcctggcggatccggcgcagctgttgctcctgctgccggacagggcagccactccaggcagaagaagacttttttcttgggagacggtcagaagctaaaggattggcacgataaggaagccatccgtagagacgcccagagggtcggcaacggcgaacagggccgaccctacccgatgactgacgccgaacgggtagaccaagcctatagggagaatgggtttaacatctacgtgtctgacaaaattagcctgaatcgcagcctccctgacattcgacatcccaactgcaattccaaacgctacctggaaacgctcccaaatacatcaatcataatcccttttcacaacgagggctggtcgtcccttttacggactgtccacagcgtgctgaaccgaagccccccagaactagtggcagagatcgtgctggttgatgacttctctgatcgagagcacctgaaaaagccattagaggactacatggccttgttccctagcgtgagaatcctcaggacgaaaaaaagggaggggctcatacgcaccaggatgttgggagcgagtgttgctacaggagatgtgattacattcctggactctcactgcgaggcaaacgtcaactggttgccccctctgcttgacaggatagccagaaataggaagaccatcgtgtgcccaatgattgatgtaattgaccatgacgacttccgctacgaaacccaagcgggtgacgcgatgagaggagcctttgattgggagatgtactataagcggatccccatcccacccgaactccagaaagcggacccaagcgatcccttcgagtctcccgtgatggccggtgggctttttgccgttgatcggaaatggttttgggagctgggaggctacgacccaggcctcgagatttggggtggggaacagtatgagatctctttcaaggtcagtcaattgtctagacggccagtactaggaacagcctcatag

SEQ ID NO: 246225 - DNA, 1746 bp, Artificial Sequence
  Description of Artificial Sequence: Synthetic coding sequence
atgtggggaaggaccgccagacggaggtgcccacgcgagcttagacggggacgggaggccctcctggtcctcctggccctgcttgccctcgcaggtctcggttccgtgcttcgagcgcagcgtggcgcaggagccggtgcagccgaacccggtccgcctaggactccacgccctggtagacgagaaccggtcatgcctcgtccacctgtccccgctaacgcactcggggctcggggagaagctgtccggctgcagctgcaaggagaggaactccgtctccaggaggagagcgtcaggctgcatcagataaatatttatctctctgaccgcatatcactgcacaggcgcctgcctgaaagatggaatccgctgtgcaaggaaaagaagtatgactacgataatttgcccagaacttcagttatcatcgctttctataacgaggcctggtccacactgttaaggaccgtgtatagcgtgttagaaacctcgcccgatatcctgctggaggaagttatattggtagatgattactcagatcgggaacatttaaaagaacgtctcgccaatgaactgtctggtctccccaaggtacgactgattcgggctaataaacgggaaggcctggtccgtgcacggctgctgggcgcttctgctgcccgaggagacgttctaacatttcttgactgccactgcgaatgccacgaaggctggctcgaacccttgctgcagaggatccacgaggaggaaagtgctgtcgtgtgtcctgtgattgatgtgatcgactggaacacattcgagtatctgggcaattccggcgagccacagattgggggattcgattggaggttggtcttcacctggcataccgtgcccgagagagagcggatacgaatgcagagtccagtcgatgtgattagaagtcccacaatggcgggaggacttttcgcagtgtcaaagaagtatttcgaatatctcggctcctatgatacgggaatggaagtgtggggaggcgagaacttggagttcagtttcagaatctggcagtgtgggggtgtgctggagacacacccgtgttcccacgtgggccacgttttccctaaacaggcgccatatagtcggaataaggcgctggccaactcagtaagagccgctgaggtatggatggacgagttcaaggagctgtattaccatcgcaacccacgtgctaggctcgagccattcggtgatgttaccgagaggaaacagctgcgtgacaagctgcagtgtaaggatttcaagtggttcctggagaccgtgtacccagaactacacgtcccagaggacaggccgggatttttcggcatgttgcagaataaaggcctgaccgattactgttttgactataatccaccagatgagaaccaaatcgtgggacaccaggtaatcttgtatctatgtcacggtatgggtcagaaccagttcttcgaatataccagtcagaaggagattaggtacaacacccatcagcccgaaggttgcatcgccgtggaagcgggaatggacaccctgattatgcatttatgcgaggagactgctcctgaaaaccagaagttcatactgcaggaggatgggtctctcttccatgaacaaagtaagaaatgtgtacaagccgctaggaaagagagctcagacagtttcgtccccctcttgcgggattgcaccaatagcgatcaccagaagtggttctttaaggagaggatgttgtag

SEQ ID NO: 246226 - DNA, 1671 bp, Artificial Sequence
  Description of Artificial Sequence: Synthetic coding sequence
atgaggcggtttgtttattgtaaggttgtgctcgcaacctctctgatgtgggtcctggtggacgtgttcctgctgctttacttttctgaatgtaacaaatgtgacgacaaaaaagagagaagcctgttacctgcacttcgcgcagttatctcccggaaccaggagggacccggagaaatggggaaggctgttttgatccccaaagacgatcaggagaaaatgaaagagttgtttaaaattaaccaattcaacctgatggcaagtgatctcatagctctgaataggagccttccagatgttcgcctcgaggggtgtaaaaccaaagtgtatcctgacgaactccccaacacctctgttgtaatagtgttccacaatgaggcctggagcacactcctgcgaacagtctactctgtcataaatagatctcctcactatttgctgagcgaggtgatccttgtcgatgatgcaagtgagcgagactttctgaagctgaccctagagaattatgtcaagaatctagaggttcctgtgaagataatccgtatggaagaaagatcaggcctgatccgagcaagacttagaggcgctgctgcttccaagggacaagttattacttttctcgacgcccattgtgagtgtactctggggtggctggaaccattactagctcgtattaaggaggataggaaaaccgtcgtgtgccccatcatagatgtgatttcggacgatacatttgagtacatggccggatccgatatgacatacggagggtttaactggaaactgaattttcggtggtaccccgtcccacagagggagatggacagaaggaaaggagatcggacattgccggtgagaaccccaactatggccggagggctgttcagtattgatagaaactactttgaggagattggcacatatgacgctggcatggatatctggggaggcgaaaacctagaaatgagcttccgcatttggcagtgtggaggctccctggaaattgttacatgtagccacgtcgggcacgtcttccgcaaagcaactccatatacatttccgggaggaactggccatgttattaacaagaataacagacgactggccgaggtgtggatggatgagtttaaggactttttttatattatcagccccggtgttgttaaagttgactatggcgacgtcagcgttcgaaagacattgagggaaaatcttaagtgtaaacccttctcttggtacttggaaaacatataccccgacagccagattcctaggaggtattatagtctgggggagataaggaatgtggagactaatcagtgcctggacaatatggggagaaaggagaatgagaaagtgggaatatttaattgccacgggatgggtggaaatcaggtcttctcctatacggccgataaagagattcggacagatgacttgtgtctggacgtgtcaagactcaacggacccgtgataatgctgaagtgccaccacatgcgaggcaatcagctgtgggagtacgacgctgagcgccttacattaagacatgtgaatagcaaccagtgtctggatgaaccaagcgaagaggataagatggttcccaccatgcaggattgtagcggaagccgctcccagcagtggcttctgcggaacatgacccttggtacatag

SEQ ID NO: 246227 - DNA, 1686 bp, Artificial Sequence
  Description of Artificial Sequence: Synthetic coding sequence
atgagacggtttgtgtactgcaaggtcgtgcttgccacaagtctgatgtgggtgctcgtggacgtttttctgttgttgtacttcagtgagtgcaacaaatgcgatgacaagaaagagcgctctctgctgccagccttaagagcagtcatcagccgcaatcaagagggcccaggagagatgggaaaggcagtgctcatcccaaaagatgatcaagagaagatgaaggagttgtttaaaattaatcaattcaatttaatggcctctgacttaatcgccctgaatcgatcccttcctgacgtgcgcttggaaggctgcaaaacgaaggtctatcctgacgaactgcccaacaccagcgtcgttattgtgtttcacaacgaagcctggtccaccctgcttcggaccgtctattctgtgattaatagatcacctcactatctcctcagcgaggtgatccttgtggacgatgccagcgagcgcgacttcctgaagctgactctagagaactacgtcaagaatctagaagtccctgtcaaaatcatccgcatggaggagagaagtggactcattcgggcacgcctccgaggcgcagcagctagcaaagggcaggtgattacctttctggatgcacattgcgaatgtaccctcggatggttagagcccctgttggccaggattaaagaagaccggaagaccgtggtctgtcctattatcgacgttatttccgatgacacatttgagtacatggctgggagcgacatgacatatggaggcttcaattggaagttgaatttccgctggtatccggtcccacagagagagatggatcgccgtaaaggcgacaggacattgcccgttcggactccaacaatggctggaggcttatttagcatcgacagaaattactttgaggagatcgggacttacgatgccggaatggatatatggggaggggaaaatttggagatgagttttcgaatctggcagtgcggcggatctctggaaatcgtgacctgcagccatgtgggccatgtgttccgaaaagccacaccttacacgttccccggaggtacggggcacgtgatcaacaagaataaccgaagattggccgaggtgtggatggacgaattcaaggatttcttttatattatctcccctggggttgtcaaagtggattacggcgatgtgagtgttcgcaagactctgcgggaaaacctgaagtgtaagcccttctcttggtatcttgaaaacatttacccagactctcagatccctagacgctattactccctcggtgagattagaaatgtagagaccaaccagtgtctcgataacatgggaagaaaagagaatgaaaaggtcggaattttcaactgccacggcatgggcggtaatcaggtgttctcctataccgctgataaagagatcaggaccgacgacctgtgcctcgacgtgagccggctgaacggccctgtgatcatgcttaagtgtcaccatatgcggggaaaccaactctgggaatatgatgctgaaagctgcctgtctgtgaataaggtcgccgacggttctcagcaccccaccgtggagacatgcaacgatagcaccttgcagaaatggctgctgaggaactacacccggatggagatttttcggaatatttttggtaactccacagactacatattatag

SEQ ID NO: 246228 - DNA, 60 bp, Artificial Sequence
  Description of Artificial Sequence: Synthetic coding sequence
atgcgacggtttgtttattgtaaggtcgttttggctacaagcctgatgtgggtcttgtag

SEQ ID NO: 246229 - DNA, 1659 bp, Artificial Sequence
  Description of Artificial Sequence: Synthetic coding sequence
atgaggaggctgaccagaagactggttcttcctgtgttcggagtactgtggatcacagtgctgctgttcttctgggtaactaaacgaaaattagaggtcccgacaggtccagaagttcagacccccaagccaagcgatgcagactgggacgacctttgggatcaattcgatgagagacggtatctgaacgccaaaaaatggcgtgtcggagacgatccctataagctttatgccttcaaccagcgcgaaagtgaacgcatatcctctaaccgggctatccccgacacccgccatctcagatgtacgttgttagtctattgtaccgatctccctccgactagtatcatcatcactttccacaacgaagctagatcaactctcctcagaactataaggagtgtgttgaatcggactccaacacacctcatcagagaaatcattctggttgacgatttttctaacgacccggacgattgcaagcagcttatcaaactgcctaaggtgaagtgtttacgaaacaacgagcgccagggcttggtgcgctcgcgcatccgcggtgccgatattgcccagggcacaaccctcacattcctcgacagccattgcgaggtgaatagggattggcttcaaccgctgctgcaccgggtgaaagaggactacactcgcgtcgtttgtccagtgattgatatcataaacctcgatacttttacatacatcgagtcggcctccgagttgagagggggatttgactggtctctacacttccagtgggagcagctgtctccagagcagaaagcccgtaggctcgaccctactgaaccaatcaggacacctatcatcgccggaggtttatttgtcatagacaaggcgtggtttgactacctcgggaaatacgatatggacatggacatctggggaggtgagaactttgaaatttcgttccgcgtgtggatgtgtggcggatctctggaaattgtcccctgtagcagggtgggacacgtcttccgcaagaaacatccatacgtgttccctgatgggaacgcaaatacttatatcaagaatacaaagcgaaccgctgaagtttggatggatgagtacaaacagtactactatgcagccagacccttcgcactggagaggcctttcggcaacgtggaatcgcgacttgacttaagaaagaatctcaggtgtcagagttttaagtggtatctggagaatatatatccggaactcagcataccaaaagagagcagcattcagaagggtaacattcgccaaagacagaagtgtctggaatcccagcggcagaataaccaagagactccaaatctgaagctgtccccatgcgctaaggtgaaaggtgaagacgccaagagtcaggtatgggctttcacctatactcagcaaatactgcaggaagagttatgcctgagtgtgatcactctctttcccggtgcccctgtggtactagttttgtgcaagaatggcgacgacaggcagcagtggaccaagacaggatcccacatcgagcacattgcctctcatttgtgtctcgacacagacatgtttggggacgggacagaaaatggaaaggagattgtggttaatccctgcgagtcttccctcatgagccagcattgggacatggtgtcttcttag

SEQ ID NO: 246230 - DNA, 1560 bp, Artificial Sequence
  Description of Artificial Sequence: Synthetic coding sequence
atgagaaggctgacacgtcggctcgtgctccctgtttttggcgtcttgtggataacagttctgcttttcttctgggtcaccaagcgaaagctcgaggtacctacgggcccagaagtacaaacgccaaaaccaagtgacgctgattgggacgacctttgggatcagtttgacgagcggagatatctgaacgctaagaagtggagggtgggggacgacccgtacaagctttacgcctttaaccaacgggagtcagagcgcatttcctcaaaccgggcaattcccgacacccggcacctgtcagtgctgaaccgaactccaacccatctcattcgtgagattatccttgtggacgattttagcaatgaccccgacgattgcaagcagctgatcaagctcccaaaagtgaaatgtctaaggaataatgagagacagggactggttcgttcgagaatcagaggggcagatattgcacagggcaccacactgacgttcctggattcccactgcgaagtgaatcgtgactggttgcaacccctgctccaccgagtaaaggaggactacaccagggtggtttgtcccgtcatagacattattaatctcgacacctttacgtatatcgagtctgcctccgagcttcgcggaggatttgactggtctctgcacttccagtgggagcagctttcgcccgaacagaaggcgaggcgtctcgatccaaccgagcctatacggaccccgatcatcgccggaggattgttcgtgattgacaaagcatggttcgactatttaggcaagtatgacatggatatggacatctgggggggtgagaactttgaaatcagttttagggtctggatgtgcggcggaagcctggaaattgtaccctgctccagggtggggcacgtgtttagaaagaagcatccctacgtcttcccagatggcaatgctaacacatacattaagaatactaagcgtaccgcagaagtgtggatggacgagtataaacagtattattacgccgctcggccatttgcgcttgagcggccatttggaaacgttgaatctcgattggatttgcgcaaaaacctccgatgccagtccttcaagtggtatctcgagaatatctaccctgagcttagtattcccaaagagagttcaatccagaagggtaacattaggcaaagacagaaatgtctggagtcccagcggcagaataatcaagaaacacctaacttaaagctgtccccctgtgctaaagttaaaggagaggacgcaaaatcccaggtatgggctttcacctacacccagcaaatactccaagaggaactgtgtctgtctgtcattactttgtttccgggagcacccgtagtcctggtgttatgcaagaacggggatgatcgtcagcagtggaccaaaacagggagccacatcgaacacattgcctctcacttgtgtctggacaccgacatgttcggagacggcaccgagaatggaaaagagatcgtagtgaatccatgcgagtcttccctgatgtcccagcattgggacatggtgtcttcctag

SEQ ID NO: 246231 - DNA, 1599 bp, Artificial Sequence
  Description of Artificial Sequence: Synthetic coding sequence
atgagcttcccaatgagtctggcgagatcgagtgtcccgttcgccgactcaggcctgtcctctagccagccctccgacgcggactgggacgacctgtgggaccaattcgacgaaaggaggtatctgaacgctaaaaagtggagggttggtgacgacccctataagctatatgccttcaaccagagggagtcagaacgaattagttcgaatcgggctattcccgatactagacacctgcgctgtaccctgctcgtgtactgtactgacctaccacccaccagtatcattatcacattccacaacgaggctaggtctactctcctgcggaccatcagatccgtgctgaatcgtaccccgacgcacctgatcagagaaattatcctcgtagacgactttagtaatgatccggatgattgcaagcagcttatcaagcttcccaaggtgaaatgtctgaggaataacgagagacagggacttgttcggagcagaattcgaggggcagatattgcacagggcaccacactgaccttcctcgactcacattgtgaggtgaatcgcgactggctgcagccgctgctccatcgcgtgaaggaagactacaccagggtagtgtgtccggttattgatatcatcaacctggacacgttcacgtatatcgaaagtgcctccgagctgaggggtggctttgactggagcctgcacttccagtgggagcagctgagtcccgaacagaaagctagaagattagaccctacggagcccatcaggactcctattattgctggaggtctctttgtgatcgacaaggcatggtttgactacttgggcaagtacgatatggacatggatatttggggaggggagaatttcgaaatcagcttcagggtttggatgtgcgggggatctctggaaatagtgccctgctctcgcgttggccacgtttttagaaaaaagcatccgtacgtgtttccagacggcaatgcgaacacctatattaaaaatacaaaacgtactgccgaagtctggatggatgagtataagcagtattattatgccgctcgccctttcgccctcgaaagaccttttggtaatgtggaaagtcgcctcgatctgaggaagaatttgagatgccagagcttcaaatggtacctagagaatatctatccggaactcagcatacccaaggagagttctatccagaaaggtaacatccggcagaggcagaagtgcctggagagccaacgccagaacaaccaagaaacccccaatctgaaactatcaccttgtgcaaaagtgaaaggtgaggacgccaagtcacaagtttgggccttcacatacacgcagcagatccttcaggaagagttgtgcctgtctgtgattacactgttccccggagccccagtcgtgttggtgctctgtaagaatggggatgatcggcagcagtggaccaaaaccgggtcccatatagagcatatagccagtcacctgtgcctcgatacagacatgtttggggacggcaccgagaatggcaaggagattgtggtcaatccctgtgaatcctccctgatgtcccagcactgggatatggtgtccagctag

SEQ ID NO: 246232 - DNA, 1554 bp, Artificial Sequence
  Description of Artificial Sequence: Synthetic coding sequence
atggcccaggatgaaagttgcccgcctagtgatgctgactgggacgatctgtgggatcaattcgacgagcgcagatacctcaatgccaagaaatggcgagtcggtgacgacccctacaagctttatgcttttaatcagcgcgagtccgagcgtatctcatcaaatcgcgcaataccagacacccgacatctgaggtgcactctcctggtgtactgtactgatctcccgccaacaagtatcattattaccttccataacgaggcaaggtccactttgctgaggacaattcgctctgttctgaatcgaacccctactcatcttattcgtgagatcatcctggtggatgacttcagcaacgaccccgatgactgtaaacagctcatcaagctccctaaggtcaagtgtcttcgcaataatgaacgacagggactggtcagatcccgtatccggggagcagatattgcgcagggcacgacccttacatttttagacagtcactgtgaagtgaaccgcgactggttacagcccctactgcatagagtgaaagaagactacactagggttgtgtgtccggtgatagacataattaatctggacacattcacatacatagagagtgcctccgagctcagaggtggtttcgactggagtttacacttccagtgggagcagctctcccctgagcaaaaagctcgaaggctggatcccacagaaccaatccgcacacccattatcgccggagggctgttcgtgattgacaaggcctggtttgattatctaggcaagtacgatatggacatggacatctgggggggagaaaacttcgaaatatctttccgagtttggatgtgtgggggatccctcgagatcgtgccttgttcaagggtgggacacgtttttcgcaaaaaacacccatatgtgtttccggatggaaatgcaaatacatacatcaaaaacaccaaacgtactgccgaagtttggatggatgaatacaagcaatattattacgctgctagaccattcgccctggaacggcctttcgggaacgtggagtcgaggctagacctgcggaaaaacttacgctgtcagtctttcaagtggtatctggagaacatatatccagagctttccattcctaaggaaagtagcattcaaaagggtaacattcgtcagaggcagaaatgtctggaaagccaaagacagaataaccaggaaacacccaatcttaagctatccccttgtgccaaggtgaaaggggaagatgcaaaaagccaggtgtgggcattcacctacactcagcagatcctgcaggaggagctgtgtctatctgtcattacactctttcccggtgcccctgttgtcctggttttatgtaagaacggagacgacaggcagcagtggacaaaaacagggagccacatcgagcatatcgcctctcatctatgtctcgatacggatatgtttggagatggcactgagaacgggaaagaaatcgtcgtcaacccctgtgagagcagccttatgtcccaacactgggatatggtttcatcttag

SEQ ID NO: 246233 - DNA, 1674 bp, Artificial Sequence
  Description of Artificial Sequence: Synthetic coding sequence
atgcggaggctgacgcgcaggcttgtgctgccggtcttcggcgttctttggatcaccgtgctgttgtttttttgggtgactaaacgcaaattagaagtgccgactgggcctgaagtgcagacaccgaaggtctggagcctgttctttaaggtggcgggtatgtcgccatgggctcctcaagttcccgtatcccccacgccaccctaccaacgcggacacctgcctactggtggccatctggcagtgtgccactttccttgcctgctgcaggaggcacagttccacctccaaacacaggtgtttctgcaggtaaggtgcacactgttagtgtactgcacggacttgcccccaacaagcattatcatcactttccataacgaggcgagatctacccttctgaggaccatccgaagtgtgctcaataggaccccgactcacttaatcagagagatcatcttagttgatgacttctccaatgacccggatgattgcaagcagttaattaagctgcctaaggtgaaatgcttgcgcaacaatgaacgccagggcctggtgcggagtaggatccgcggagcggacattgcccagggcaccaccctcacttttttggatagccattgtgaagtcaatagggactggctgcagcctttactccaccgggttaaagaggattacactcgggttgtgtgccctgtaatcgatattataaacttggacacttttacatacattgagtcggcttccgagctgcgaggcggattcgactggtccctgcattttcagtgggaacaactctctcccgaacaaaaagcccgacggttagaccctacggaaccaattcgcacacctataatcgccggtggactgttcgttatcgacaaagcgtggttcgactaccttgggaaatacgacatggatatggatatctggggtggagaaaacttcgaaatttcctttcgagtttggatgtgcggcggttccctggagatcgtgccctgcagtcgtgtcggccatgtgtttcgaaagaaacatccctacgtgtttccggacgggaatgctaatacttatatcaagaacacgaagaggactgccgaggtttggatggatgaatacaagcaatattattacgccgctaggccattcgcactcgaacgcccttttggcaacgtagaatccagactggacttgcggaagaacctgagatgccaaagcttcaaatggtatttggaaaacatctatcctgaattatccatccctaaagaatcgtcaatccagaagggtaacatcaggcagaggcagaaatgcttagaatctcagcgccaaaacaaccaagagactccaaacctcaaactgagcccttgcgcaaaagtgaagggtgaggatgcgaagtcccaagtctgggctttcacatatacacagcagattctgcaggaagaactatgcctgagcgtcataaccttgtttcctggagctcctgtggtgcttgtcctgtgtaaaaatggagacgaccggcagcaatggaccaaaactgggagccatattgagcatatcgcatctcacctgtgcctggacactgacatgttcggagatgggactgagaatggcaaagaaattgtggtgaacccatgcgagtcctccctgatgagccagcactgggatatggtctcttcttag

SEQ ID NO: 246234 - DNA, 1716 bp, Artificial Sequence
  Description of Artificial Sequence: Synthetic coding sequence
atgcggaggaggtccaggatgctgctgtgtttcgcatttctttgggtcctgggtatcgcctactatatgtattccggcggagggtcagcactggccggaggagctggcggaggtgctgggagaaaggaggactggaacgagatcgatcccattaagaagaaggatctgcaccactcaaacggtgaggagaaggctcaatcaatggagacactccccccagggaaagtgaggtggccagactttaaccaagaggcctatgtgggcggaaccatggtcagatccgggcaggacccatatgccaggaacaaattcaatcaagttgagagcgataagctcaggatggaccgcgcaattcctgatactaggcatgaccaatgccagcgcaagcaatggagggtcgaccttcccgctacctccgtggtgattacattccataacgaagccaggtctgctctgttaaggactgttgtgtccgtcctgaagaagtctcctccccatcttatcaaagagatcattttggtcgacgactattcaaacgatccagaagacggagcgctactaggaaagattgagaaagtgcgggtactgcgcaacgacaggcgggaagggttgatgcggagcagagtgcgtggcgctgacgccgcacaggccaaggtgcttaccttccttgactcccactgtgagtgcaatgagcattggttagaaccacttctggagagggtggcagaggatcggacccgcgtcgtttcaccgatcatcgacgtaatcaacatggacaattttcagtacgtgggcgcttccgcagacctgaagggaggatttgactggaatctcgtctttaaatgggactacatgacacccgaacagcggaggtccagacagggtaatcctgtagccccaattaaaacgcctatgatcgccggtggcctttttgtaatggacaaattttacttcgaggaactagggaagtacgacatgatgatggacgtttggggcggagagaatctggagatctcgtttagggtctggcagtgcggtggcagcctggagattataccatgttctagagtcggtcatgtgtttcgaaaacagcacccttatacatttcccggtgggtccggaactgtgtttgcccgtaatacccggagggccgctgaggtgtggatggatgagtataagaacttctactacgccgcagttccttccgccagaaatgtgccctacgggaacatccagtcacgtctggaactcagaaaaaaactgtcctgcaagccctttaagtggtacttagagaatgtctacccagaattaagagttcctgaccaccaggacattgcatttggagcacttcagcagggaacgaattgcctagatactctgggccatttcgccgacggcgtggttggcgtgtacgagtgtcataatgccggaggtaaccaggaatgggctctcacaaaggagaaatccgttaagcatatggatctttgcttgaccgtagtcgatcgggctccagggtccttgattaagttacaggggtgcagagagaatgattcccgccaaaagtgggagcagatagaaggaaattcaaagttaaggcatgtgggttccaatctgtgcttagattctcgtactgcaaaatccgggggtttatcagtggaagtttgcgggccagccctcagccagcagtggaagtttacgctgaatctgcagcagtag

SEQ ID NO: 246235 - DNA, 798 bp, Artificial Sequence
  Description of Artificial Sequence: Synthetic coding sequence
atggtgcgcagcgggcaggacccatatgcacggaacaagttcaatcaggtggagtctgacaaactccgtatggacagagccattccggacactagacacgaccaatgccaacgcaagcagtggagggtcgaccttccggctacctctgtcgtaattactttccacaacgaggccagatctgccctgcttcgcaccgtggtttctgtgctgaagaaatcgccccctcacctaattaaagaaatcatcctggtagacgattactccaatgatccagaagacggagcgttgcttggcaaaatcgagaaagtacgggttctgaggaacgatcgtcgtgaaggactgatgcgatcccgcgttagaggagccgatgccgctcaggccaaggtgctgaccttcctcgattcacattgcgaatgtaacgagcactggttagagccactgctggaacgcgtcgcggaagacagaacacgcgtagtctcacccattatcgacgtgatcaacatggacaacttccaatacgtaggggcttccgccgatctgaagggaggctttgattggaatctcgtctttaagtgggattatatgactcctgagcagcggcgtagtagacagggaaatcccgtggcacccatcaaggacttggtcccaagagtagcagtgtggtggcagcctggtgatcatccggttcaaccctgtggtacaagagtacccgaggcggctccgctgcacgtacccggttggcagtggcattgcctgtgtcctaaacacccgcctgggagcaggggcttggacggttag

SEQ ID NO: 246236 - DNA, 1086 bp, Artificial Sequence
  Description of Artificial Sequence: Synthetic coding sequence
atgaggcggaggagtcgcatgctcctgtgtttcgcctttctctgggtcctgggtatcgcttactacatgtacagtggaggcggttctgcactagccggtggggcaggcggaggagcaggccgtaaggaggattggaatgaaattgatccaatcaagaaaaaggatctccaccacagcaatggggctgaggacggggctttacttggaaaaatcgagaaggtccgagtcctgaggaacgaccgccgagagggactcatgcggtctcgggtgcgcggagcggacgcagcacaggctaaggtactgacttttctggactctcactgcgaatgcaacgagcactggttagagccattgttggagcgtgtggcggaagatcgcactagggtcgtttctcccattatagacgtgatcaatatggataacttccaatacgtcggcgcaagtgcagacctcaaaggagggttcgattggaacctggtgtttaagtgggactacatgacccccgagcagaggcgttcgcgccagggaaaccccgtggctcctattaaaacaccaatgatcgcagggggtttgttcgtgatggataaattctactttgaggagctgggtaagtacgatatgatgatggacgtttggggcggagaaaatctggaaatatcctttagagtttggcagtgtggagggtctctggaaattataccctgttcaagggttggacacgtgtttagaaagcagcacccttatacgtttcccggagggtctgggacggtgtttgctaggaatacgaggagagctgcagaggtgtggatggacgagtacaaaaacttttactacgcagccgtgccctccgctagaaatgtgccctacggaaatattcaaagtcgtctggagctgcggaagaaactcagctgtaagccgtttaaatggtatctcgaaaacgtctacccagagcttcgggtacctgatcaccaggatatagcctttggagcccttcaacagggtacaaactgcttggatactctcggacacttcgctgatggcgtggtgggggtgtatgaatgccacgtggctggactccggcagtag

SEQ ID NO: 246237 - DNA, 1602 bp, Artificial Sequence
  Description of Artificial Sequence: Synthetic coding sequence
atggcggatcgcgaggactggaacgagattgatcctattaagaagaaagacctacatcacagcaacggagaagagaaagcccagtccatggaaacattgcctcctggaaaggttagatggcctgattttaaccaggaggcatacgtgggtgggaccatggtgagatctggacaagacccttacgcccgaaacaagtttaaccaggtcgaaagtgacaagctgaggatggatcgggctatcccggataccagacacgaccagtgccagcggaagcaatggagggttgacctaccagctacatctgtggtcattacattccacaatgaggctcggtccgccctgttgaggacagtggtgtccgtcctgaagaagagcccccctcatcttataaaggagatcattctggtagacgactacagcaacgaccctgaagatggcgctctgctcggaaagatcgagaaggtgcgagtgctgagaaatgacaggcgggaagggttgatgcgatctagagtgagaggagctgacgctgctcaagccaaggtcctgacctttctggattcccattgcgaatgcaatgagcattggcttgaacctctgttagaacgtgtggccgaagatcgcacacgggttgtaagtccaataatcgatgtgattaatatggacaacttccagtatgtcggcgcatctgccgaccttaagggtggctttgattggaatttggttttcaagtgggactacatgacccccgaacagcgcaggagccgccagggcaatccagtggccccaattaagactccgatgattgctggcggactgtttgtcatggacaaattctacttcgaggagcttggtaaatatgacatgatgatggacgtgtggggcggagaaaatctggaaatatcttttagagtctggcaatgcggcggatcgttggagattatcccgtgttctcgcgttggccacgttttccgtaagcagcacccatatacatttccaggtggcagcggcacagttttcgctaggaataccagacgcgctgccgaggtatggatggacgagtataagaatttctactacgccgctgtgccatccgccagaaatgtcccatacggcaatatccagagcaggctcgagttacgcaagaagttatcatgtaaaccgttcaaatggtacctggagaacgtatacccagagttgagggttcccgaccatcaggacatcgctttcggcgcacttcagcagggcaccaactgcctggacactctaggccactttgccgacggcgtggtcggggtttatgagtgccataacgccggaggcaaccaggagtgggcactgacaaaagagaagtcagtgaaacatatggacctctgtttaacagttgttgaccgggcacctggatctctgatcaagctgcaagggtgtagggaaaacgattcacggcagaaatgggagcagatcgaaggcaactctaaattaagacacgtgggttccaatttgtgcctcgatagtcggacggcaaagtccggcggactgtcagtcgaagtctgtggacccgctctttcacagcagtggaagtttactctgaatctgcaacagtag

SEQ ID NO: 246238 - DNA, 1902 bp, Artificial Sequence
  Description of Artificial Sequence: Synthetic coding sequence
atggcccacttgaagagactggtgaaactccatatcaagcggcactaccataaaaagttctggaagctgggcgctgtgatcttttttttcataattgtgctggtgttgatgcagcgggaggtatctgtacaatactccaaggaagagagtcgtatggagagaaacatgaagaacaagaacaagatgctcgatttgatgcttgaagccgtcaacaatataaaagacgccatgccaaagatgcagattggtgcccctgtcagacagaatatcgatgcaggtgagcggccatgcctgcaagggtactacacagccgcagaactcaaaccagttttagatcggcctccacaagatagcaatgcccctggagcctcaggaaaggcttttaaaactaccaatctgtcagtggaggagcagaaggagaaggaaagaggggaggcgaaacactgtttcaacgctttcgcatccgaccgcatctccctccatcgggacctaggtccggacaccagacctccagagtgcatagaacagaagttcaagcgctgcccccctctgccaaccacaagtgttatcatcgtttttcataacgaagcttggtcgactctcttgaggaccgttcactccgtgttatactcgtcgcctgctattctgctaaaagagattatcctggttgacgacgccagtgtggacgaatacttacacgacaagcttgacgaatatgttaaacagtttagtatcgtaaagatcgtgaggcagcgtgaacggaagggacttatcacggctcgtctgctgggggctacagttgcaaccgctgaaacgctgacattcctagacgctcattgcgaatgtttctacgggtggctagagcccttgcttgcacggatagctgaaaattatacagctgtcgtcagtcctgacattgcctctatagacttaaacacttttgagttcaataaaccctctccatatggctctaaccacaatcgcggaaacttcgactggagtttgtcattcggatgggaaagcctgcctgaccatgagaagcaaaggagaaaggatgagacataccctattaaaaccccgacatttgcaggtgggctcttctctattagcaaggagtactttgaatacatcgggagctacgacgaggaaatggagatctggggaggcgagaacattgaaatgagctttcgggtgtggcagtgcggagggcagttggaaattatgccttgcagcgtggtgggacatgtcttcagatccaagtctccccactccttcccgaagggcacccaggtcattgccagaaatcaagttcgtctggcagaagtttggatggacgagtataaggaaatcttctacaggagaaatacagatgcagctaaaattgtcaagcagaaggctttcggggatctctcaaagcggtttgaaatcaaacataggcttcaatgcaagaactttacatggtatctcaacaatatctaccctgaggtatacgtgcctgatctgaaccccgtgatcagcggctatattaagtctgtagggcagcctctatgtttagatgtgggggaaaacaatcagggtgggaagcctctcatcatgtatacatgtcacggactgggcggtaatcagtatttcgaatacagtgctcaacacgagattcgacacaacatccagaaagagctgtgcctgcacgctgcccaaggactcgttcagcttaaagcctgtacctataagggccacaagactgtcgttaccggcgaacagatctgggagatccagaaggaccaactcctgtacaatcccttccttaagatgtgcttgtcagcgaacggagaacatccatcgctggtgtcctgcaacccctctgatcctttgcagaaatggatcctgtctcagaacgactag

SEQ ID NO: 246239 - DNA, 1395 bp, Artificial Sequence
  Description of Artificial Sequence: Synthetic coding sequence
atggcacacttaaagaggctggtgaagttacacattaagcggcactaccacaaaaagttctggaaactgggagccgttatcttctttttcattatcgtgcttgttttgatgcagcgcgaagtgtccgtgcagtacagtaaggaagagtccaggatggaacgcaatatgaagaataagaataagatgttggacttaatgttagaggccgtgaacaacatcaaggatgccatgcctaagatgcaaattggcgcaccagtgagacagaacatcgatgccggtgagcggccttgcctgcagggatattacaccgctgccgagcttaagcccgtcctcgatcggcctccgcaggactcaaacgcccctggggcaagcggtaaggcatttaagacgacaaacctcagcgtggaagagcagaaagaaaaggagcgaggagaggctaaacattgttttaatgctttcgcatccgatcgcatatctctccatcgggatttgggccctgacacccgcccaccagaatgtatcgagcagaaatttaagagatgcccgcctctgcctaccacaagcgtgatcatcgtttttcacaacgaggcgtggtcaacccttctcagaacagtgcacagcgtgctctactcatcaccagctatcctgctgaaagagataattctggtagatgacgcctcagtggacgagtatctgcatgataagctggacgagtacgtgaaacagtttagcattgtgaaaattgttagacagagggaaagaaagggcttgatcactgcacgattgttaggggcaactgtggccacagcagagacactgactttcctggacgctcactgtgaatgtttctacggttggctggagcccctcctggctcggatcgcggagaactataccgcggttgtctctccagatattgcatccatagacctgaacacctttgagtttaataaaccatctccgtacggatctaatcacaatcggggtaacttcgactggtctctgtctttcggctgggagagcctacccgatcatgagaaacagagacgcaaagatgagacctaccctattaaaacccctacttttgcaggcggtcttttctccatatccaaagaatacttcgagtacatcggttcttatgatgaagagatggagatttggggcggagagaatatagaaatgtctttccgcgtttggcagtgtggtggacagctagaaatcatgccctgttctgtcgtcggacatgtgtttcggtctaaatccccacattcgttccccaaggggacccaggtgattgctcgcaaccaggtgcggttagctgaggtgtggatggacgagtataaggaaatcttttatcggcgaaacactgacgccgctaaaattgtcaagcagtag

SEQ ID NO: 246240 - DNA, 174 bp, Artificial Sequence
  Description of Artificial Sequence: Synthetic coding sequence
atggcccacctgaagagactggtgaaactgcacataaaaagacactatcataagaaattttggaagctgggggctgttatatttttctttatcattgtcctagtgctgatgcagagagaggtgtccgtgcagtatagtaaagaggaatcgaggatggagaggaacatgaaatag

SEQ ID NO: 246241 - DNA, 78 bp, Artificial Sequence
  Description of Artificial Sequence: Synthetic coding sequence
atggcccacctcaagaggctggtcaagctgcatattaagaggcattaccataagaaattctggaagctgggggcatag

SEQ ID NO: 246242 - DNA, 273 bp, Artificial Sequence
  Description of Artificial Sequence: Synthetic coding sequence
atggctcaccttaagcgcctggttaaattacacattaagcgtcattatcataagaagttctggaaactgggcgctgttatttttttctttattatcgtgctcgtgctgatgcagcgcgaggtatcagtgcaatactccaaggaagaatcccgtatggagcgcaatatgaagaacaagaataaaatgctcgatcttatgttagaggctgtgaataatatcaaagacgctatgcctaaaatgcaaatcggtgcccctgtaaggcagaacatttag

SEQ ID NO: 246243 - DNA, 36 bp, Artificial Sequence
  Description of Artificial Sequence: Synthetic coding sequence
atggcacatctgaagaggctcgtgaaacttcattag

SEQ ID NO: 246244 - DNA, 1737 bp, Artificial Sequence
  Description of Artificial Sequence: Synthetic coding sequence
atggccgtgagatggacctgggcaggcaagagttgcctgcttctggccttccttacagtcgcctatatttttgtggagctgctggtgtcaacattccatgcttccgccggagccggacgcgctcgcgaactgggcagtaggcggctgtcagatctgcagaaaaacacagaagacctttcccggcctctctataaaaagcctcccgctgattcccgggcactgggggagtggggcaaggcatccaaactgcagcttaatgaagacgagctgaaacagcaggaggagctgattgagcggtatgccattaacatatacctatcagatcgcatctctctgcacaggcacatcgaggataaaagaatgtatgaatgcaagtcccagaagttcaattaccggacacttcccactaccagcgtgatcatcgctttttacaacgaagcatggagcaccctcctgcggactatccattcagtgctggagacctcacctgcagtcctgcttaaagagataatcctggtggatgatctctcagatagggtttacctcaagactcagttggaaacgtatatatccaatctggaccgggtgcgactgatcaggacaaacaagcgggagggacttgtgcgcgctcggttgatcggtgcaaccttcgcaaccggtgatgtgttgaccttccttgattgtcattgtgaatgcaattccgggtggctggaaccattgctggaacggattggccgagatgagacagcggttgtatgcccagtcatcgataccattgactggaacacatttgaattttatatgcagattggcgaaccaatgatcggcggttttgattggcggctgaccttccaatggcattcagtccccaaacaggagcgagatagaagaatcagcaggatagaccccattcgttctcccaccatggccggaggcttgttcgccgttagtaagaagtacttccagtacctggggacctatgacactggaatggaggtgtggggaggggaaaacctggaactttcctttagggtttggcagtgcggcggtaaactagaaatccatccctgttctcacgtcggtcacgtgttccccaagagagccccttatgccaggcctaattttctgcagaacactgcacgagccgctgaagtttggatggacgaatataaggaacacttttacaaccgtaatccacccgcacggaaagaagcctatggcgacatctccgagcgcaagctgctgagggaaagacttcggtgtaaatctttcgactggtatttgaagaacgtgtttcctaacctgcatgtacctgaggaccggcctggctggcatggagcaatccgatcacggggaatttcaagtgagtgtctggactacaactcaccagacaacaacccaactggggctaatctgtctctttttggttgtcatggccagggcggtaaccaattctttgagtatacctctaacaaggaaatccgttttaatagcgtgacagagctgtgtgcagaagtaccagaacagaagaattacgtgggaatgcaaaactgccccaaagacgggttcccggttccggctaatatcatatggcatttcaaggaggatgggacaattttccaccctcattcgggactttgcctgtccgcttataggactcccgaaggaaggcctgacgtgcaaatgaggacctgtgacgcactggataaaaaccagatatggtcatttgagaaatag

SEQ ID NO: 246245 - DNA, 1869 bp, Artificial Sequence
  Description of Artificial Sequence: Synthetic coding sequence
atgcgccttctaaggcggaggcacatgccgctgaggctcgccatggtggggtgcgctttcgtgttatttcttttcttacttcatcgggatgtgtccagccgggaggaggccaccgagaaaccctggctcaagagccttgtgtcccgcaaggaccatgtgctggacctcatgctcgaggctatgaataacctgcgcgatagcatgccaaagctccaaatcagagcacccgaggcccagcaaacgctgttttcgattaatcaatcctgtctccctggcttctacactcccgctgaactcaaacctttttgggaacgacctccccaggatcctaatgcacccggtgctgacgggaaagcctttcagaagtcaaaatggactccactggaaacacaggagaaggaggagggatacaagaaacactgtttcaatgcttttgcttctgatcgcatctcgttgcagagatctcttggaccggacacgagaccacctgagtgtgtggatcaaaagtttagacgctgtccgccactcgccaccacatccgttattatcgtgtttcacaatgaggcctggtccaccctgctgcggaccgtgtactcagttttgcatacgactcccgcaatcctgcttaaagaaatcatactggtcgacgatgccagcactgaagaacatctcaaggaaaagctcgagcagtacgtgaaacagttgcaggtggttcgggtggtgcgacaggaagaacgcaaaggcctgatcacggctcgccttctgggggcatccgtcgcccaggccgaggtcctgacctttctggatgctcactgcgagtgtttccatggttggctggagccgctgctggccagaattgccgaggacaaaactgttgtggtgtcgccagatatcgtgacaatcgatctgaacaccttcgagtttgcgaagcccgtgcagcgaggtagggtgcacagtcggggaaattttgactggagtctgacctttggctgggagaccctcccacctcatgagaaacaaagacggaaagacgagacctatccaataaaatctcccacctttgccggtggtctcttttccatctcgaagtcatactttgaacatattggcacatacgacaaccaaatggagatctggggcggagagaacgtggaaatgagtttccgtgtgtggcagtgtgggggtcagctagaaattatcccatgttcagtggtggggcacgtgtttcgcaccaagagccctcataccttcccaaagggcacatcagtcatcgctcggaaccaagtgcgcctagcagaggtatggatggattcatataagaaaatcttctatagacgcaaccttcaggcagctaagatggctcaggaaaagtctttcggagatataagcgagcgcctgcagctccgagagcaactccactgtcataatttctcgtggtacttacataatgtgtatcccgagatgtttgtcccagacctcactcctaccttctacggagctatcaagaatttgggcacaaatcagtgtctcgacgtgggtgagaacaatcgcggtgggaaaccccttattatgtattcttgccatggcctggggggtaatcagtacttcgaatacactactcagcgagacctgcggcacaatatagctaagcagctgtgcctacacgtaagtaaaggcgctctcggccttggatcttgtcatttcaccggcaaaaactcccaagtccccaaggatgaggaatgggagttggctcaagaccagctgatcagaaatagtggatctggcacatgtctcacatcacaggacaagaagccagcaatggcaccatgcaatccatcagatcctcaccagctttggttatttgtctag

SEQ ID NO: 246246 - DNA, 1869 bp, Artificial Sequence
  Description of Artificial Sequence: Synthetic coding sequence
atgcgcctgctgaggagaaggcacatgcctctgaggctggctatggtcgggtgtgcgttcgtgcttttcctatttctgctgcaccgggacgtgagctcacgggaggaagctacggagaagccatggctcaaatcactggtgtcccgaaaagaccatgttctggacctgatgttagaggccatgaataatttgagagattctatgccaaaattgcaaatcagagctcccgaagcacagcagacgcttttcagcatcaatcaatcttgtctacccggtttttacacccccgcagagttaaagccgttttgggaacgcccacctcaggaccccaacgcacccggtgccgacggtaaggcatttcaaaaatctaaatggacaccattggagactcaggagaaagaagaaggctacaagaagcactgctttaacgcctttgccagcgatagaatttcgttacagcggagccttggaccggacaccaggcctcctgaatgcgtcgatcagaagtttcgtagatgccctccccttgccaccacgagtgtgattatcgtgttccacaacgaggcctggtcaacacttctgaggactgtgtatagcgtcctgcatacaacccccgctatattacttaaagaaataatcctggtcgacgatgcttcaacagaggagcacctgaaagagaaactcgaacagtatgtgaaacagttacaggtcgtgagagtcgtacgtcaggaagaacgcaagggacttattaccgctagactcctgggcgcttcggtggcccaagctgaggtgctgaccttccttgatgcacattgcgagtgcttccatggctggctggagccattactggctcggatcgcagaagacaaaaccgttgtggtgagcccagacatcgtgacgattgatctgaatacattcgaatttgccaaaccagtgcagcgagggagagtgcactccagagggaactttgactggagccttactttcggctgggagaccttacctcctcatgaaaaacaacggagaaaagacgagacttatccaataaagagtcctacctttgccggtggcctattttccatcagcaagtcctatttcgagcatattggtacttacgataatcagatggagatttggggaggagagaatgtggaaatgtcgttccgggtgtggcagtgtgggggtcaacttgaaatcatcccttgctcggttgtggggcacgttttcagaaccaagagccctcatactttccccaaaggaacaagcgtcattgcacggaatcaggtacggcttgccgaagtatggatggatagctacaagaagatcttctacagacggaacctccaggccgcaaaaatggcgcaggaaaagtctttcggagacattagcgaacgcctgcagttaagagagcagttgcattgccataatttcagctggtatttgcataacgtctatcctgagatgttcgtccctgatctaaccccaacgttctatggggctatcaagaacttgggaacaaaccagtgtttggacgtgggggagaacaatagagggggaaaaccgttgatcatgtattcctgtcatggacttggtggcaatcagtacttcgaatacacaacccaaagagatttgcgtcacaacatcgctaaacagctctgcctccacgtgagcaaaggcgctctgggcttgggttcatgtcactttactgggaaaaacagccaggtgccaaaagacgaggagtgggaattagcccaggatcagctgatccggaattcaggatcagggacgtgtcttacctcccaggataaaaaaccggctatggccccatgcaacccttccgatcctcaccagctctggctcttcgtctag

SEQ ID NO: 246247 - DNA, 1812 bp, Artificial Sequence
  Description of Artificial Sequence: Synthetic coding sequence
atgagactattacggaggcgccacatgcccctcaggctggcaatggtgggctgtgcgttcgtccttttcctcttcttactcgtgagcagaaaagaccacgtgctcgacctgatgctggaggccatgaacaacctgagagacagtatgccaaagcttcagattagggccccagaagcccaacaaaccctcttctccattaatcagtcctgcctaccgggattctataccccagctgaactgaagcccttctgggaaaggcctccacaagatccaaacgcacccggagcagatggtaaagcatttcagaaatctaagtggacacctctggagacacaggagaaggaggagggctacaaaaagcattgtttcaatgctttcgcctctgatagaatttccctgcagcgtagcctcggacccgatacgagaccacccgagtgcgtggaccaaaagttccggaggtgtccccctttagccactacctccgtgattatcgtttttcacaatgaagcgtggtccacattactgcggacagtttatagcgtgctgcataccactcccgcaattctactcaaagagatcattctcgtcgatgatgcatctactgaagaacatctcaaagagaaactcgagcaatatgtcaaacagctgcaggtggtgagagtcgtgaggcaggaggagcgcaaagggctgatcaccgcacggttgctgggcgcaagcgtggcccaggccgaggtgctgacttttctggatgcccactgcgaatgcttccacggatggctcgagccactgctggcgaggatagctgaggacaaaacagtcgtggtgtcaccagatatcgtaaccatcgatttgaacactttcgaattcgcgaagccagtgcagcggggtagagtgcatagccggggtaatttcgattggagtctgacgtttgggtgggagaccctgccacctcatgagaagcagagaagaaaggacgagacatatcctatcaagagtcccacatttgccggtggactgtttagcatttcgaaaagttacttcgagcacattggaacgtacgacaatcagatggaaatttggggaggtgaaaacgtcgagatgtcttttagggtgtggcaatgcggtgggcaactggaaatcatcccatgcagcgtggtggggcacgtgttccgcactaaaagccctcataccttccccaaaggcacttctgtcattgccaggaatcaagtccgactcgctgaggtttggatggattcatacaaaaagatattttataggcgtaacctccaggctgctaaaatggcacaggagaaatccttcggtgacatcagtgagagacttcagctccgggaacagttgcattgccataattttagttggtatttacacaacgtctaccccgaaatgtttgtacctgatcttacccccacgttttatggcgctatcaagaacttggggacaaaccaatgtttggacgtgggagaaaacaaccgagggggtaagccattgattatgtattcctgccatgggctgggtggtaaccaatatttcgaatacaccacccaaagagatctcaggcacaacatcgccaaacagctatgcctccacgtctcaaaaggcgcacttggtctaggctcctgccatttcacaggaaagaattcacaggtgccaaaggatgaggagtgggagcttgctcaagatcagctgattcgcaacagcggctcaggcacctgcctcacaagtcaagataagaagcccgctatggccccatgtaatccctccgatcctcaccaactctggctgtttgtatag

SEQ ID NO: 246248 - DNA, 1974 bp, Artificial Sequence
  Description of Artificial Sequence: Synthetic coding sequence
atgagacttaaaatcggattcatactccggagtttactcgtggtgggcagtttcttaggcttggtcgtactgtggtcctctctcactccaaggcccgatgacccctccccgctgagtaggatgcgtgaggatcgggacgtgaatgatcccatgcccaaccgcggtgggaatggccttgcacccggagaagataggttcaaacccgtggtgccttggccacacgtcgagggggtcgaggtggaccttgaatcaattcggagaataaacaaggcaaagaatgagcaggagcatcatgcaggtggcgactcgcagaaggatattatgcagagacagtacttaaccttcaagccgcagacctttacatatcatgatcctgttcttcgtccagggattcttgggaattttgaacctaaggagcctgaacctcccggagttgtggggggacccggagaaaaggctaaacctctggttctgggtcctgagtttaagcaggccattcaggcttctatcaaagagttcggatttaatatggtagcgtccgacatgattagtctggaccgatctgtgaacgacctgcgtcaggaggaatgcaagtattggcactatgatgagaatctactgacttcctccgtcgtgattgtgttccacaacgaggggtggtcaacgctgatgagaactgtgcattcagtgatcaagagaacacctcgtaagtacttggctgaaattgtgcttatagatgatttttccaataaagaacatcttaaggagaagctcgatgagtatataaagctgtggaacggcttagtcaaggtttttcggaatgaaaggcgggaaggtttgatccaggcaaggagcataggcgctcaaaaagctaagctgggacaggtgctgatttatttagatgcccattgcgaagtggccgtcaactggtatgcccctctggtggccccaatcagcaaggacagaacaatctgcacagtgccgttaattgatgtgatcaacggcaacacttacgagatcatcccccaaggaggcggagacgaggatggttatgccagaggagcctgggattggtctatgctttggaaacgggttcccctcacaccacaagaaaagcgcctgagaaaaaccaaaacggagccttatcggagtccggcaatggcgggaggcttgtttgctattgaacgcgagttcttttttgaactgggcctttatgatccaggcttacagatttgggggggtgaaaatttcgaaatctcctataagatctggcaatgcgggggtaagctcctattcgttccatgttctagagtaggtcatatctacagactcgagggttggcagggcaatccacccccaatatacgtcggaagttccccaacactgaaaaactatgtgcgggtcgtggaggtgtggtgggacgaatataaagattacttctacgcgagtaggcctgaaagtcaggctctgccctacggtgatatttcggaactgaagaagttcagggaggaccacaattgtaagtcttttaagtggtttatggaggagatagcctacgacataacttcacactatccactgccaccaaagaacgttgattggggcgagattcgaggttttgagacggcctattgcatcgatagcatgggcaaaaccaatggcggtttcgtggaactgggcccatgtcacaggatggggggaaatcaattgtttcgtattaacgaggctaatcaactgatgcaatatgatcagtgcttgacaaagggcgcagacggtagcaaggtgatgattacacattgtaacctcaacgagtttaaggaatggcagtattttaaaaacctgcatcggtttacacacattccctccggcaagtgtctggatagatcagaggtccttcaccaagtgttcatttctaactgcgattcatcaaaaactacacagaagtgggaaatgaacaacattcattctgtttag

SEQ ID NO: 246249 - DNA, 717 bp, Artificial Sequence
  Description of Artificial Sequence: Synthetic coding sequence
atgagaacagtgcattccgtgattaaaaggactccccgtaagtatctggctgagattgtacttatcgatgacttcagtaataaagaacaccttaaggagaaattggacgagtatatcaagttgtggaatggcctggtcaaggtgttcaggaacgagcggagggaggggctgatccaagccagatctatcggtgcgcagaaagccaaactggggcaggtcctgatatatctggacgcccactgcgaggtggctgttaattggtatgcccctctcgttgcacccatctcaaaggatcgcaccacgtgcaccgtgcccctcattgattacattgacggcaatgactactctattgaacctcaacagggaggcgatgaggacgggtttgccagaggggcttgggattggagtctcctctggaaaaggatcccattgtcccacaaagagaaagccaagaggaagcataagactgaaccgtaccggtcacctgctatggcaggcggactgttcgctattgagcgggagttcttttttgagctgggcctttacgatcctgggctgcagatctggggcggaaaaaccttgcgatcccatactagatatggcagcgtcgtggcgaattattaccttttcctcgtgctcgtgctggatatatcgaccgtgctcagagctggtaaagaaattcttcggccatttatgctgggattgttgcaactctag

SEQ ID NO: 246250 - DNA, 1914 bp, Artificial Sequence
  Description of Artificial Sequence: Synthetic coding sequence
atgatgttctggcggaagttgccaaaggcactgtttattgggctgaccttagcgattgcggtgaatctgctgttggtcttcagttccaaaggcaccctgcagaatctgttcactggcggtctgcaccgggagctacccctgcatcttaacaaaaggtacggcgcagttattaagcgcctaagccaccttgaggtcgaactgcaggatctaaaggagagtatgaaacttgctttaaggcagcaggaaaatgtgaactccacactgaagagagcaaaggatgaggtgcgccctttgttgaaagccatggagaccaaagtgaacgagacaaagaaacacaagacacagatgaagctgtttccgcattcccagctgttcagacagtggggagaggacctgtctgaagcccagcagaaggcagcccaggatttattccggaaatttggctataacgcctacctgtctaaccagttacccttgaaccgtaccattcccgatacccgagattaccggtgtctgcgaaagacatatccgtcacagctgccctccttatctgtcatactcatcttcgttaatgaggcactgtccatcatacaaagggcaattacctcaatcattaaccgcacacccagccggctgttgaaggaaatcatcctcgtggacgacttttccagtaatggggagctgaaagtgcatctggacgaaaaaattaagctctacaatcagaaatatcctgggctgctgaaaatcatccggcaccctgagagaaagggacttgcacaggccaggaataccggctgggaagccgctacagcagacgtggtagctattctagatgctcacattgaggtgaatgtgggctgggcagagcctatcctcgcccgaattcaggaagaccggactgtgattgttagtcccgtgtttgataacatcagattcgatactttcaagctcgacaagtacgagctcgccgtggatggcttcaactgggagctgtggtgtcgctatgatgctcttcctcaagcttggattgatctgcatgacgttacagcaccagtgaagtcaccctctatcatggggattctggccgctaacagacactttctaggggaaattggctccctggacggaggcatgctcatttacggaggggagaacgtggagttgtccctgcgggtgtggcagtgtgggggaaaggttgagatcctcccttgctcccgtatcgcccatctcgagcgccatcataaaccctatgcattagacctgacggccgctttgaagaggaatgctctgagggtcgctgaaatctggatggacgagcataagcacatggtttacttggcctggaatatccccctccagaactctggcatagatttcggcgatgttagtagccggatggctctgcgggagaaacttaaatgcaaaacctttgattggtatctgaaaaacgtctatcccctcctgaagcccttgcacacgatcgtgggctatgggaggatgaagaacctgttggatgagaatgtgtgcctggaccagggcccagtgccagggaacacccccattatgtactactgccatgaattcagtagtcagaacgtgtactaccacctgacgggtgagctgtatgttggccagcttatagcagaggcctctgcgagtgatcgctgcctgacagacccgggaaaggctgagaaacccaccttagaaccatgttccaaggccgctaaaaacaggctgcacatatactgggatttcaagcctgggggagctgtgatcaatcgagatactaagcggtgtctcgagatgaagaaagacctactgggctctcacgttctcgtactccagacttgcagtactcaggtgtgggagattcagcacactgtccgggattggggacagacaaattcccagtag

SEQ ID NO: 246251 - DNA, 648 bp, Artificial Sequence
  Description of Artificial Sequence: Synthetic coding sequence
atggaattcgactgcgaaggtctgcgccgtctcctgggtaagtataagtttcgggacttaactgtggaggaactcaggaacgtgaacgttttctttcctcatttcaagtacagcatggacacctatgtctttaaggactcatcccagaaagacctgttaaactttactggcaccatacctgtgatgtatcaaggaaatacctataacattcctatccggttttggattctcgattcccacccctttgcaccacccatttgtttcctgaagccgacagctaatatgggaatactcgtaggcaagcatgtcgatgcccaagggcgtatttacctgccctacctacagaactggtcccatcctaagtctgttatcgtggggttgatcaaagaaatgatcgccaagtttcaagaggagctgcctatgtactctctgtcctctagtgatgaggcccgtcaagtagacttgttagcatacattgctaagataaccgaaggcgtatccgatactaatagtaagtcatgggccaaccacgagaataagacagtgaataaaattactgtcgtcggagggggtgagctgggtatcgcctgtacactcgccatctccgccaaggttgagagccggtccgtgacccaggcaggtgtgtag

SEQ ID NO: 246252 - DNA, 1416 bp, Artificial Sequence
  Description of Artificial Sequence: Synthetic coding sequence
atggaattcgattgcgaaggccttcggcgactgctcggaaaatacaagtttagagatctgaccgtggaggagctgagaaacgtgaatgtgttttttccacactttaagtatagtatggatacctatgtatttaaggattcttcacagaaggatttgctgaacttcactgggactattccggtcatgtaccaaggcaatacgtacaatatccctatccgtttttggatcctggacagccatccttttgcaccacctatctgttttttgaagccaacagccaatatggggatcctggtgggtaagcatgtggacgcacaagggcgtatctacctgccctacttacaaaattggtcccacccgaaatcagttatcgtgggtcttatcaaggagatgatcgccaaatttcaggaagagctccctatgtacagtctgagctcaagtgacgaagcacgccaggtcgatctgctggcttacattgcgaagatcacggaaggggtgtcggataccaattcaaaaagctgggccaaccacgagaataaaacagtcaacaaaattacggtagtgggcggaggggagctcgggatcgcttgcactctggccattagtgccaaggggatcgcagatcgtcttgtgctactagacctcagcgaggggaccaagggagctaccatggacctggaaatcttcaacttaccaaatgtcgaaatttccaaagatctgtctgcttccgcacactccaaggttgtcatctttacagtcaattctctgggatccagtcagtcttacctggacgtcgttcagtcaaacgtcgatatgttccgggcactagtgcccgcattgggacactactcacaacacagcgttctgttagtggcttcccagccggttgagattatgacatatgtgacctggaaactgagtacattcccagcaaatcgagtgatcggaattgggtgtaatttggattcccagcgattgcagtatatcatcactaacgtccttaaagcccagacttccggcaaggaagtgtgggttattggggagcagggggaggacaaggtactgacatggagcggccaagaagaggttgtgtcacatactagtcaggtccagctctccaatcgcgcaatggaactactacgcgtgaaaggacagagatcatggtctgtgggtctgtccgtggccgatatggtagacagtatcgtaaacaataaaaagaaggtgcactcagtcagtgcgctcgccaagggatattacgacattaattctgaggtcttcttgtctttgccctgtatcctcggcacaaatggagtgtccgaggtgatcaagaccacccttaaagaggataccgttaccgagaagctgcagagctccgcctccagtattcacagtctgcagcaacagctcaaactctag

SEQ ID NO: 246253 - DNA, 747 bp, Artificial Sequence
  Description of Artificial Sequence: Synthetic coding sequence
atggacttggagatatttaatcttcctaacgttgagatcagcaaagatctgtcagcatccgcccactctaaggttgttatcttcacagtcaactcgctgggttctagccagagttacctggatgttgtacaaagcaacgtggatatgttcagggcgttggtacctgcattgggacactacagtcagcacagcgtcctgttggtggccagccagcctgtggagatcatgacctatgtgacttggaaattgtcaacattcccagccaatcgagtcatcggcatcgggtgcaatcttgattcacagcgtctgcagtacataattacaaacgtcctgaaggcacagaccagtgggaaagaagtgtgggtcattggcgaacagggtgaggacaaggtcttaacctggagcggtcaggaggaagtagtgtcccataccagtcaagtgcagctctctaaccgagcgatggaattactccgggtaaaaggccagagaagctggtccgtcggacttagcgtagcagacatggttgactctatcgtgaacaacaagaagaaggttcacagcgtgtcagccctcgccaagggctattacgacatcaattctgaggtgttcctaagcctgccttgcattctaggcacgaacggcgtttccgaggttatcaagactactttgaaggaggacactgttacagaaaaattacagagctctgcgagcagtattcactcactccagcagcagttgaaactgtag

SEQ ID NO: 246254 - DNA, 1140 bp, Artificial Sequence
  Description of Artificial Sequence: Synthetic coding sequence
atggagtttgattgtgaaggcctgcggagactcctaggcaaatacaaattccgagacctgactgtggaggagctccgcaatgtcaacgttttctttccccacttcaagtactctatggatacctatgttttcaaagacagttcccagaaggacctgttaaattttacaggtactatacctgtcatgtatcaggggaatacatacaacatccctattagattttggatcctggacagccacccctttgcaccacctatttgtttcctgaaacctacagcaaatatgggcattttggtgggaaaacacgtggatgcccagggcaggatctatctcccctatctgcagaattggagccaccccaaatctgtaatcgtagggttaatcaaagaaatgatagccaaatttcaggaggagctgcccatgtactctttatcaagctcagacgaagctcgccaggttgaccttctcgcttacattgccaaaattacagagggtgtcagcgacacaaacagcaagtcatgggcaaatcatgaaaataagacagtcaacaagatcacggtcgtcgggggaggtgaactcggcattgcttgtacattagctatctccgcaaaagggattgctgataggctggtgctgctggacctgtccgaaggaaccaagggggcaacaatggaccttgaaatatttaacttgcccaacgtggaaatttccaaagacctcagcgctagcgcgcacagtaaggtggtgatatttactgtgaactctttgggctctagccaatcttaccttgatgtcgtccaatcgaacgtggatatgtttcgcgctcttgtccctgccttggggcattactcccaacattcagtcctgctagtggcatcacagccagtggagatcatgacatatgttacctggaaactatccacattccctgccaatcgggtgatcggcatcggttgtaatctggacagccagcggctgcagtacatcattaccaatgtgctgaaagcccaaacctctggaaaagaggtctgggttataggagagcagggcgaagataaggtactgacttggagcgggcaagaagaggtggtcagtcacaccagccaggtgcaactgtcaaacagggacattatgatctag

SEQ ID NO: 246255 - DNA, 1350 bp, Artificial Sequence
  Description of Artificial Sequence: Synthetic coding sequence
atggaatttgattgtgagggacttaggcggctgttagggaagtacaaatttagggatctcaccgtcgaggagttacgaaatgttaacgtgttttttcctcacttcaaatacagtatggatacctacgggaatacctacaacatccctatccgattttggattctagactcacaccctttcgcacctcccatctgctttcttaagcccaccgccaatatgggaatcctagttgggaagcacgtcgatgcgcagggacggatctacttgccgtatctgcaaaactggagccatcccaagtccgtgattgtgggactgattaaggagatgatcgccaagtttcaggaagaattgcctatgtactcactcagctcgagtgatgaggccaggcaggttgacctcttggcatatatcgccaagattaccgagggggtgtccgacacgaattcgaagagctgggctaaccacgagaacaaaactgtcaacaagattaccgtcgtggggggtggggagttgggtatcgcatgcacactggctatctcagctaagggtatcgcagatcgactcgtgttgctcgacctcagcgagggcaccaagggggcaacgatggacctggaaatctttaatctgcctaatgtggagatttctaaggatctctctgcatcagcccactcaaaggtagtaatctttacagtaaattctttggggtcctcccagagctacctcgatgtggtccagagtaatgtggacatgttccgggctctggtgcctgccttggggcattactcgcaacatagcgtgctgctggtcgcctcacagccagtggaaataatgacttatgtgacctggaagctgtcaacgttccccgctaaccgggtgatcgggattggctgtaacctggatagtcaacgactgcagtacatcataaccaatgtgctgaaggcccagacatcaggaaaggaggtctgggtgatcggggaacagggggaagacaaggtgctgacctggagcggtcaggaagaggtcgtgtctcacacgagtcaggtccagctgtccaatcgtgcgatggaactgcttcgagttaaagggcaacgcagctggtctgttggcctgtccgtagcggacatggtcgactctatagttaacaacaagaagaaggtacattccgtcagcgcactagccaaaggttattatgacattaactccgaagtcttcctgagtctgccttgtattttgggaactaatggggtgagcgaggtgatcaagaccaccctgaaggaagacacggttacagagaaactccaatcctctgcctctagtatacatagtctccagcagcagctcaaattgtag

SEQ ID NO: 246256 - DNA, 429 bp, Artificial Sequence
  Description of Artificial Sequence: Synthetic coding sequence
atgggggacaaacctccaggttttagggggtcaagggactggataggctgcgtggaagcttcactgtgcctcgcccactttgggggaccccaggggcgtctctgtcacgttccacgcggtgtcggcctacacggcgagctggaacgtctttactcccactttgccggtggcggtggccctgtcatggtgggaggtgatgcagacgcgcgtagtaaagcattgctgggagtttgtgtaggctcggggaccgaggcgtacgtattggtgctggacccccactactgggggacgccaaagtccccaagcgagctccaagcggctgggtgggtgggttggcaggaagtgagcgccgctttcgaccctaactctttctataatctctgtcttaccagtctatcgtcccaacagcagcagaggacactggattag

SEQ ID NO: 246257 - DNA, 1410 bp, Artificial Sequence
  Description of Artificial Sequence: Synthetic coding sequence
atggtcattagcgagagcatggacatcctgttcaggatccgcggaggactggacctggcctttcagctggccactcccaacgagatattcctcaaaaaggcactcaagcacgtcctgtcagacctgagcaccaagctctcttcaaatgccctggtgttccgtatctgccacagcagtgtttacatttggccttcatccgacatcaacactatcccaggcgagctcaccgatgctagtgcttgcaagaacatactaaggttcattcagttcgagccagaggaggacatcaagaggaaattcatgaggaagaaagacaagaagctgtcggacatgcaccagatcgtgaacatcgatctcatgctcgaaatgagcacctcacttgccgctgtgacgcccatcatagagcgagaatccggaggtcaccactacgtaaacatgacactgccagtggatgctgtgatctcggtcgcgccagaagagacctgggggaaagtacgaaagcttctggtggacgctatccataaccagctgactgatatggaaaaatgcatcctcaagtacatgaaaggcacatccattgtggtacctgagcctttacacttcctccttcctggcaaaaagaacctggtcaccataagttatccaagcgggatacctgacgggcagctccaagcctatcggaaagaattacacgatctgttcaatttgcctcatgatcggccatacttcaaacgcagcaacgcataccattttcctgacgaaccttataaagatgggtatattcgcaatccccatacatacttgaacccaccgaatatggagacgggcatgatctatgtggtccagggtatatatggctaccaccactacatgcaggatcgaatcgatgataacgggtggggctgcgcttacagatcacttcaaactatatgtagctggtttaaacaccaggggtacactgaacgcagcattcctacacaccgagagatccagcaagccctggtggatgccggagacaagcctgctacttttgtggggagtagacagtggatcggtagcatagaggtgcagctcgtgttgaatcagttaataggcatcactagcaaaatcctgtttgtgtcccaaggaagcgagatcgcgtctcagggacgcgagttagctaaccacttccagagtgaggggacccccgtgatgattggaggcggagtgctggcccacacgatactgggagtggcctggaacgaaattacgggacagattaagtttctgattcttgatcctcactatacaggagcggaagatctccaggtcatcttggagaagggctggtgcgggtggaaaggcccagacttctggaataaggatgcctactacaatctgtgtctgccccagcgacctaatatgatctag

SEQ ID NO: 246258 - DNA, 2484 bp, Artificial Sequence
  Description of Artificial Sequence: Synthetic coding sequence
atggtcgtccagaagccgcatgggaccatggagtatactgctggcaaccaagatacactcaacagcatagcattgaagtttaacattactcctaataaattggtggagctcaataagttattcacgcacacaattgtacccggtcaggtgctttttgtgcctgacgctaacagtccaagctcgacacttcggctgagttcatccagccctggtgcaaccgtttctccatcttctagcgacgcagaatatgataagctcccagacgcagacctagccaggaaggcccttaagccaatcgagagagtcctgtccagtacctctgaagaggacgagcccggagtggtaaagtttctcaagatgaattgtcgctatttcacagatggcaaaggcgtggttgggggagtaatgatagttacaccgaataatataatgttcgacccacacaagtcagaccccttagtaattgaaaacgggtgcgaagagtacggcctgatatgtcctatggaggaggtggtctctatcgcgctctataatgatatcagccatatgaagatcaaggatgcactcccaagccccggagagtgggaagaccttgcgtctgagaaagatattaacccattcagtaagttcaagagcatcaataaggaaaaacgtcagcagaatggagaaaaaattatgacatctgacagtagaccgatcgtgccgctcgagaaatcgacgggacacacacctaccaagccttccgggtcatccgtatccgagaagctgaaaaagctcgacagttctagagagactagccatggctctcccaccgtcacaaaactctcaaaagagccgagcgatacttcatccgcctttgagtcgactgcgaaagagaacttcctgggggaggatgatgatttcgtcgatttggaagagttgagcagccagaccggtgggggaatgcacaaaaaggatacactgaaggaatgcttgtcactcgatccagaagagcgcaagaaggcagagtcccagatcaacaactctgctgtggaaatgcaggtccaaagcgcccttgcattccttggcacagaaaatgatgttgagctgaagggcgcactggatttggaaacttgtgaaaagcaagacattatgccagaggtggacaaacagagcggatcaccagaaagcagagttgaaaacaccctgaacattcatgaggacttagacaaggttaaactcatcgagtactacctcaccaagaacaaggaaggccctcaggtgtccgaaaatctgcagaaaacagagttaagcgatgggaagtccattgagcctggaggcattgatatcacattgtcctcttcactgtcacaggctggcgatccaatcacagagggcaacaaagagccggacaagacctgggtgaagaaaggtgagcccctgcctgtcaagctcaatagctctaccgaggcaaacgttattaaagaagccctggattctagcttggagagtacgctggataactcatgccagggggctcagatggacaataagtccgaggtccagctgtggcttctgaagcggatccaggtgcccatcgaggatatcctccctagcaaagaagagaaatccaagacacccccaatgtttttatgtataaaagtcggtaagcctatgagaaagtcatttgccacccacaccgccgcaatggtgcagcagtacgggaagaggcgaaaacaaccagaatactggtttgcagtgccacgcgagagggtggatcacctttatacatttttcgtccagtggagcccagatgtctacggaaaggatgccaaagagcagggcttcgtcgtggtggagaaagaagaactaaatatgattgacaactttttctccgagcctacgaccaagtcctgggagataatcaccgtagaagaggccaagcgtagaaaaagtacatgtagctattatgaggatgaagatgaagaggtgttacccgtcctgcggcctcatagtgctctcctggagaacatgcacatagagcagctcgccaggcgactccctgctagggtacagggatacccctggcgcctggcatacagcacgctggaacatggcacgagtctaaaaaccctctacagaaaatccgcatcactggatagtccggtcctccttgtgattaaggatatggataaccagatcttcggtgcctatgcaacgcaccctttcaagttctcagaccactactacggtacaggtgagactttcctctacacatttagccctcattttaaggtgttcaagtggtctggagagaactcttactttatcaacggcgatatctcctctttggaactgggcggaggcggaggccgatttggcctctggctcgatgccgacctgtatcatgggagatcaaacagctgctctacatttaacaatgatatcttgagcaaaaaggaggacttcattgttcaggatctggaggtctgggcatttgactag

SEQ ID NO: 246259 - DNA, 735 bp, Artificial Sequence
  Description of Artificial Sequence: Synthetic coding sequence
atggccgctgcagcatcacctgctttccttctgtgtttgccactgctgcatcttttgtcagggtggtccagggctggctgggtcgatacgcattgtttatgttatgactttatcatcactccaaagtccaggcccgaaccccagtggtgcgaggtgcagggactggtggatgagagacccttcctccattacgattgcgtcaaccataaagccaaggcattcgcctcactcgggaagaaagtaaacgtgactaaaacttgggaggagcaaactgagacattgcgagacgtagtggatttcctgaaaggacagctgctagacattcaggtggaaaatctgattcctatagaacctctaaccctgcaggctcggatgagttgcgagcacgaggctcatggccatggacgaggcagctggcagttcttgtttaacggccagaagttcctcctttttgacagcaataatcgcaagtggacagccctccatcccggtgctaaaaagatgacagaaaagtgggagaagaatagggacgtcacaatgtttttccaaaaaatcagccttggcgattgcaagatgtggctggaagagtttttgatgtactgggaacagatgctggatcccacaaaacctccgagcttggcacctgggaccacacaaccaaaagctatggctaccactttgtctccctggagtctcctgattatcttcctctgttttattctggcgggtaggtag

SEQ ID NO: 246260 - DNA, 741 bp, Artificial Sequence
  Description of Artificial Sequence: Synthetic coding sequence
atggcagccgctgccgcaacaaagatactactatgtttgccactcctgctcctgttgagtggatggtcacgtgcaggccgtgctgatccccactccctatgctacgacattaccgtgattcccaaatttcgccctggcccacggtggtgcgctgttcagggtcaagtggacgaaaaaacattcctgcactatgattgcggtaacaagaccgtcacccctgtgtcccccctcgggaaaaagctgaacgtgacaaccgcgtggaaggcgcagaaccctgtactacgtgaggttgtggacatccttaccgaacagctccgcgacattcagctggagaattataccccgaaagaaccgttaacactccaagcccgtatgagttgcgaacagaaggccgagggccactcgtctgggtcatggcagtttagctttgacggccaaatctttctcctgttcgacagcgagaagaggatgtggactacagtgcatccaggagcaagaaaaatgaaagaaaagtgggagaacgacaaggtcgtggcaatgagcttccattatttcagcatgggagattgtatcggatggttagaagatttccttatgggaatggactctactctcgagccaagcgcgggtgcccctctggccatgtccagcggaacaacccagttgcgagcaaccgcgacaactttaatactgtgttgtctcttaattatcctgccctgctttatcctgcccggtatctag

SEQ ID NO: 246261 - DNA, 510 bp, Artificial Sequence
  Description of Artificial Sequence: Synthetic coding sequence
atggcagctgcagcttcccctgcgattctgccccgtctcgctatactgccgtacctcctgtttgactggtctggaactggcagggctgatgcacactctctttggtataactttaccatcatccacctgcccagacacggtcaacagtggtgtgaggttcagtcacaggttgaccaaaaaaattttctctcttacgactgtggttcagataaggtactgtcaatgggacatctagaagagcagctttacgcgaccgacgcatgggggaaacaactggagatgctgcgggaagtgggtcagagactcagactggagctagcggataccgagctggaagattttactccaagcggccctttaaccctgcaagttcgtatgtcttgcgagtgcgaggcagatggatacatccggggatcttggcagttcagcttcgatgggaggaaatttctgctcttcgacagcaataatcggaaatggaccgtggtccacgccggtctggggactagctag

SEQ ID NO: 246262 - DNA, 735 bp, Artificial Sequence
  Description of Artificial Sequence: Synthetic coding sequence
atggccgctgcagcttctcccgctatcctaccaagattagctatcttgccctacctgctgtttgactggtcagggacaggacgagccgacgcccactccttatggtataatttcaccattattcacctgccaaggcacggccagcagtggtgtgaagtgcagtcacaggtggatcaaaaaaacttcctgtcgtacgactgtgggagtgacaaagtcctgtccatgggacacctcgaggaacaattgtacgctactgatgcttgggggaaacagctggaaatgctgcgcgaggtgggtcaaagactcagactggaactcgcagacacggaactggaagacttcacacccagcggtcctctgaccctgcaagtacgtatgtcgtgtgagtgtgaagctgacgggtacattagaggctcttggcagttttccttcgacgggcgtaaatttctgctgttcgactctaacaatcggaaatggacagtggtgcacgctggggctcgacgtatgaaggagaagtgggaaaaagatagtggtctgaccacttttttcaaaatggtttcaatgagggattgtaaaagttggctccgcgacttcctcatgcacaggaaaaagcggttggaacctaccgcaccacctactatggcccctggtctcgcacagcccaaggccatcgccactaccctttcaccctggtcctttctgattatactgtgcttcatcctgcctggcatatag

SEQ ID NO: 246263 - DNA, 393 bp, Artificial Sequence
  Description of Artificial Sequence: Synthetic coding sequence
atggccgctgccgcaagcccagcgatcctgcctagacttgccatcctgccctaccttctgttcgattggtctgggacaggccgtgcagaggagcagctgtacgcaacagacgcatgggggaaacaattggagatgctgagagaagtgggacagcgtctccgtttggaactggcagacaccgaattagaggacttcaccccaagtgggcctctgaccctccaggttcgcatgagctgcgaatgcgaggcagacggatatatccggggttcatggcaattttccttcgacggaaggaagttcctcctcttcgactcaaataatcgtaagtggacagtcgtgcatgcaggtgcacgccgaatgaaggagaagtgggaaaaatctcatctggagtag

SEQ ID NO: 246264 - DNA, 735 bp, Artificial Sequence
  Description of Artificial Sequence: Synthetic coding sequence
atggctgctgctgcctctcctgccatcctgccccgactcgcgatactgccctacctgctgttcgactggtctggaaccggccgtgccgacgcccattcgctctggtacaatttcacaatcattcatttgcctcggcacggccagcaatggtgcgaggtacagtctcaggtggatcagaaaaactttctctcctacgattgtggctccgacaaggtgctgtccatgggacatctagaagagcaactctacgcaacagatgcatggggcaaacaactggaaatgttgcgagaggttggtcagcggctgcgcttagaactagccgacactgaactagaggactttactccaagcggtcccctgactttgcaggtacgaatgtcctgcgagtgcgaggccgacggttacatccgcggaagttggcaattttcttttgacggtcgtaaattcctgctgttcgactccaacaacagaaaatggaccgttgtgcacgccggagccagacggatgaaagaaaagtgggagaaggactctggactgacaacctttttcaagatggtgtcaatgcgagactgtaagagctggctccgtgactttttgatgcatcgaaagaagagactggagcctaccgctccacccacaatggccccaggattagcccagcctaaggcaattgccacaaccctctccccgtggagttttctgataattctgtgcttcattcttccgggaatatag

SEQ ID NO: 246265 - DNA, 663 bp, Artificial Sequence
  Description of Artificial Sequence: Synthetic coding sequence
atgaaggtaaagaaagggggtgggggagctggcaccgcaacagagtcagcaccaggcccatcggggcaatctgtggcgccaattccgcagccacctgcagagtcagagtccggcagcgaaagtgaacctgatgctggacccggtcccaggcccggtccccttcagcgcaaacagcctatcggtcctgaagatgtactgggactgcaacgaatcacaggcgattatctgtgctcgccagaagaaaatatttataagatcgattttgttcggttcaaaatccgtgacatggacagcggtacggtgctgtttgagattaaaaagcctcctgtatccgagcgattacccattaaccggagggatctagatcctaacgctggtcgttttgtcagataccaattcactccagccttccttaggctgaggcaggtaggggctacagttgaatttacggtgggagataaaccagtgaacaacttccgcatgatagagcgccattattttcggaaccagctgctcaagtcatttgactttcattttggtttctgcattccatccagtaagaatacctgcgaacatatctacgatttccctccactttcagaggagctatcagccagggccggttcgtccggatctggcgaggtcggtgcttctcgggactag

SEQ ID NO: 246266 - DNA, 723 bp, Artificial Sequence
  Description of Artificial Sequence: Synthetic coding sequence
atgaaggtgaaaaagggcggagggggagctggcaccgctacagagtccgcccctgggccttccggacagagcgtggccccaattccccagcctcctgcggaaagcgaatctggaagcgagagcgagccagacgctggacccggtccacggccaggccctctgcagcgcaagcagccaatcgggcctgaagatgtgttgggattacaaagaatcaccggtgattatctctgcagccctgaggagaacatctataagatcgattttgttcggtttaagattcgcgatatggacagcggaaccgttctttttgagattaagaagccacccgtatctgaaagacttcccatcaatagacgagacctggatccaaacgccggtcggtttgtcaggtatcagtttacgcctgcctttctgcggctcaggcaagtgggcgctacagtggagtttacggtaggcgacaagcctgtgaataacttccggatgatagaacggcattatttccggaatcagcttcttaagagcttcgacttccatttcgggttttgtatacctagttccaaaaatacatgcgaacatatctacgactttccccctttgtccgaagagctaatctccgaaatgattcgacacccctacgagacccagagtgattctttttactttgtcgacgaccgcctggtgatgcacaataaggctgactattcttattccggcacaccatag

SEQ ID NO: 246267 - DNA, 627 bp, Artificial Sequence
  Description of Artificial Sequence: Synthetic coding sequence
atgaaggtgaagaaggggggtggcggagctggaacggctaccgaatcagcacccggaccatccggacagagcgtggcccctatccctcaacctccggctgagtccgaaagcggctccgaatctgaacctgacgccggaccaggacccaggcctggcccactgcagagaaagcagcccattgggcctgaagatgtgttggggctccagcggatcactgggggtgccaggcctctgttccctgcctggcgttttaagattcgtgacatggacagtggaacagtgcttttcgaaatcaagaagccaccagtatctgagagactgcctataaacaggcgagaccttgacccgaacgctggcagattcgtgcggtatcagttcacccccgcttttctcagactgcggcaggttggtgccacagttgagtttacagttggagataaaccggtgaacaattttaggatgatagagcgtcattacttcaggaaccagctgctgaaatcttttgacttccattttggattctgtatcccctccagcaagaatacgtgcgagcacatatacgatttcccccctctgagtgaagaactcagtgctagggccggatcaagcgggtccggcgaagtgtag

SEQ ID NO: 246268 - DNA, 5112 bp, Artificial Sequence
  Description of Artificial Sequence: Synthetic coding sequence
cttagtctgttgtgtgtgtcattaaaaaaagctaaattcgacggcgcacaggagaaatttaatacctacgttactctgaaggttcagaacgtaaaatccacaaccatagccgtgcgcggttcccagccaagctgggagcaagattttatgtttgagatcaatcggctcgacctggggttaacagttgaagtatggaacaagggcctgatttgggatacgatggtgggaaccgtgtggatccctttacgcaccatcagacagtccaacgaggagggcccaggcgaatggctgacactagattcccaggttataatggccgacagcgagatctgcggaactaaggatccgaccttccaccgcatcctactggacacaaggtttgaactcccgctggatatcccagaagaagaggccaggtactgggctaagaaactcgagcagctcaatgctatgcgcgaccaggatgagtactcttttcaggatgagcaggacaaaccactcccagtgccgtctaatcaatgctgcaactggaattactttggctggggcgagcaacataacgacgatccggacagcgcagtggacgaccgggacagcgactacagaagcgagacatcgaactcaattccgccaccttattatacaaccagtcagccaaacgcatccgtccatcagtatagtgtccgcccacctcccctgggctcaagggagtcctactcagatagcatgcacagttatgaggaattctccgagcctcaagctctgtcacccacaggctctagccggtacgccagctctggggagctgtcccaagggtcttcccagctcagtgaggattttgatccagatgagcatagtttacaggggtctgatatggaggatgaacgagatcgggactcttatcatagctgccactcgtccgtgagttatcataaggattctcccaggtgggatcaggacgaagaggagcttgaagaagacctcgaggactttctggaagaggaagagctgcctgaagacgaggaggagcttgaggaggaagaagaggaagtgcctgacgacttaggatcctatgcacagcgagaggacgtcgccgtggccgagcccaaggacttcaagcgcatttccctaccaccggcagccccaggcaaagaggacaaggccccagttgctcctaccgaggcgccagacatggccaaagtcgctcccaagcccgcaaccccagataaggtgcccgctgcagaacagatccctgaagcagagcctcccaaagatgaggaaagcttccggcctcgggaggacgaggaggggcaggagggtcaggacagcatgagtagggctaaggcaaattggttgagggcattcaacaaggtccggatgcagctccaggaggcacgaggagagggggagatgagcaaatctctctggtttaaaggcggacccggtgggggactgatcataattgatagcatgcctgatatccggaagaggaagccgatccctctcgtcagcgacctcgctatgtctttggtgcaatcacggaaagcagggattacgtctgctctcgcctcctctactctgaacaatgaggagctaaagaatcacgtatacaagaaaactcttcaagcacttatttaccctatctcttgcaccacaccacataattttgaggtgtggacggcaacgacccccacctactgttacgagtgtgagggactgttatggggaatcgccagacagggcatgagatgcaccgagtgtggagtgaaatgccatgagaagtgccaggatctcttgaatgccgactgcctacagagggctgccgagaagtccagcaagcacggggctgaagaccgaacccagaatattatcatggtgctgaaggacaggatgaagattagggaacgaaataaacccgagatctttgagttaattcaagaaattttcgcagtcaccaagacagcccatactcaacagatgaaggctgtcaaacagagcgtcctcgatggcacgtcaaagtggagcgccaaaatatctattaccgtggtttgtgctcagggccttcaggcaaaagataagacaggctcatcggacccatacgttactgtgcaggtgggaaaaacaaaaaagcggacgaaaaccatctatggcaacctgaatcccgtctgggaggagaattttcacttcgagtgccacaattcatcggacaggatcaaggtgcgcgtgtgggatgaagacgatgacatcaaatctcgagtgaaacagcgcttcaaacgcgagagcgacgattttctcggtcagacaatcatcgaggtaaggacccttagcggcgagatggatgtgtggtataacttagataagcgcacagataaaagtgcagtgtctggcgcaatccgtttacacatctctgtggaaattaagggagaggaaaaggtggcgccataccacgtgcaatacacctgcctgcatgagaatctgttccatttcgtgaccgatgtgcagaacaacggcgtcgtgaaaattcctgacgccaagggggatgacgcttggaaagtgtactacgacgaaacagcccaggagattgtcgacgagttcgcaatgcgctacggtgttgaatccatataccaggccatgacacactttgcttgtctcagcagcaagtatatgtgcccaggggtgccagccgtgatgtctaccctgctggccaacataaacgcctactacgcccatacgactgcgtcaaccaacgtgtccgcttccgacagattcgcagctagcaattttgggaaggagagatttgtgaaactgctggatcaactgcacaactcgttacgcattgacttgtcgatgtatagaaataatttcccggctagctcccccgaaagactacaggatctgaaaagcacagtcgacctgctgacaagcatcaccttttttcggatgaaggtgcaagagcttcagagcccgccacgggcatctcaagtggtaaaagactgtgtcaaggcctgcctgaactctacatacgagtatatattcaacaactgtcatgagctgtactcccgcgaataccagaccgatcccgctaagaagggcgaagtactgcccgaggagcaggggccaagtatcaagaaccttgatttctggtcaaaactgatcacactgatagtatcgataattgaggaggacaaaaactcctatacgccctgcctgaaccaatttccgcaggaactcaacgtaggcaaaataagcgccgaagtgatgtggaacctgtttgcccaagacatgaagtacgcgatggaagagcacgacaagcacaggttatgtaaatccgccgactacatgaaccttcactttaaggttaaatggttgtataatgagtacgtcacagaactcccagctttcaaagatcgcgtccctgagtatcccgcttggttcgagcccttcgtgattcaatggctcgacgaaaatgaggaggtgagccgggatttcctacacggagccttagagcgtgacaaaaaggatgggtttcaacaaactagcgaacacgccctattcagctgttccgtggtggacgtcttttcccaactgaatcagagctttgaaataataaaaaagctggagtgccccgacccacagattgttggacattatatgcgccgtttcgctaagaccatatccaacgtgctacttcagtacgctgacattatatccaaggacttcgcatcttactgctcaaaggagaaggagaaggtcccctgcatccttatgaataacacgcagcagctgagagtgcagctggagaagatgttcgaggccatgggcggaaaggagcttgatgctgaagccagcgacatcctgaaggagctccaggtgaagcttaacaacgttcttgacgagcttagtagagtgtttgctacgtcctttcagccacacattgaagaatgcgttaaacagatgggagacattctttcgcaggtcaagggcactggcaacgtcccagcatcagcgtgttcctcagttgcccaggacgccgataatgtcctccagccaataatggatttattggattccaatctgacgctgttcgctaagatttgtgagaagactgtactgaaaagagtcctgaaggagctgtggaagctggtgatgaacactatggaaaagactattgttttgcctccactgacggaccagacattgcagggtaaccttctccggaagcacggtaaaggactcgaaaagggtagggtcaaacttccctcacattccgatggaacgcagatgatattcaatgccgctaaagaattggggcagttatccaagcttaaggatcatatggttagagaggaggctaagtcattgacccccaagcagtgtgctgtagtggaactcgctttagacacaattaagcagtatttccacgcgggaggcgtcggcctgaaaaagacctttctggagaaatcacccgacctgcagagcctgcggtatgccctgtctctttatactcaagcaaccgacctgttgattaaaacttttgtccagacacagtcggctcagggactgggggtggaggatcccgtcggggaagtgagtgtgcacgtcgaactgttcacccatcctggcaccggcgagcataaggtcacagtgaaagtggtcgcggcaaatgacctcaagtggcaaacgtcgggaattttccggccttttatagaggtgaatataatcgggccacagctgtcagacaaaaaaaggaagttcgcaaccaagtccaaaaataatagttgggccccaaaatataatgagtcatttcagttcacactcagtgcagatgctgggcctgaatgctacgagctgcaggtgtgcgtgaaagactattgtttcgccagggaggaccgcacagtcggtctggccgtgcttcagctgagagaattggcccaacgaggatccgctgcatgctggttgcctctaggacgtcggatacatatggatgacacaggcctgacagtgttgaggattcttagccagcgatccaatgatgaggtggccaaggaatttgtcaagcttaagagcgatactcgatctgcagaagaagggggtgctgcccctgcgccttar

SEQ ID NO: 246269 - DNA, 5375 bp, Artificial Sequence
  Description of Artificial Sequence: Synthetic coding sequence
atgggtggcggtgggacgtgcactatctctgtgcaggtgagagtctgcacgggcggaaacctccttggaggcagacgaagacccctatcaccctgcaatgaggaagtgtggggcgaagcccctctgccaggcgctcgtccattcaacgctcctcccgctaggagcgctcccgcaccctccggcgtccctggccttcgccttccggcaccccaccaaagacactcccgacccggtcgcttaagaccgacttgtgagctgggagacatgtctctcctttgcgtgggcgttaaaaaagcgaaatttgatggggcacaggagaagtttaacacctacgtcacccttaaagtccagaatgtgaagtctaccaccattgccgtcaggggttcacagcccagctgggagcaggactttatgttcgagattaaccgtctggatttagggttgactgtcgaggtatggaacaaaggcctcatctgggatactatggtaggtacggtctggatccctttaagaacaataaggcaatccaatgaagaggggcctggggagtggctgacgttggacagtcaggtgatcatggctgattcagaaatttgtggtaccaaggatcctacatttcatcggattctgctcgatacacggttcgaacttcccctcgacatccctgaggaggaggcccgatactgggccaaaaaactggaacaattgaacgccatgagggaccaagatgagtacagcttccaagacgaacaggataagcctctgccagtgccaagtaatcagtgttgtaattggaactatttcggctggggcgaacaacacaatgatgatcctgactcagctgtcgacgacagagactcagattaccggtctgagacaagcaactcgattccacccccttactacactacaagccaacccaatgcaagcgtccatcaatactccgtcaggccaccgcctttgggctctcgcgaatcgtatagcgactctatgcacagctacgaagagttctctgagcctcaggctctcagtcccaccggtagctccaggtacgcctctagtggcgagctgagccagggctcctcgcagctctccgaggacttcgatcccgacgagcattcgctgcaaggctctgatatggaggacgaacgggatcgtgacagttaccactcttgccactcaagcgtctcctaccataaggattctcctcgatgggaccaagacgaagaggaactggaggaagacctggaagactttctggaagaagaagagctcccagaagatgaagaagaacttgaggaggaggaggaggaagtcccagacgatctggggagctacgctcaaagagaagatgtcgcggtagcggagcctaaggatttcaaaaggatcagcctcccccctgcggcaccgggaaaggaggacaaggcgcctgtggcacccaccgaagctcccgacatggctaaggtcgcccctaagcctgccactcccgataaagtgcccgcagcagagcagattcctgaggccgagcctcccaaggatgaggagtcattccggcctagagaagatgaagaagggcaggaaggacaggattcaatgtcccgggctaaagcgaactggctccgtgctttcaacaaggtccgcatgcagttgcaggaggctcggggagaaggagaaatgtcaaagtctctctggtttaagggcggtcccggtgggggactgataataatcgactccatgccggatatcaggaagaggaagcccattccccttgtgagtgacttggccatgagcctggtgcagagtaggaaagccggtatcacctcagcactagcgtctagcaccttaaataatgaggagcttaagaatcacgtatacaaaaagaccctacaggcattaatctatcctataagttgcacaaccccgcacaattttgaggtatggactgctaccacccccacctactgctacgaatgtgaagggctcttatggggcattgccagacagggtatgcgctgcacagagtgtggcgtgaagtgccacgaaaaatgccaggatttgctgaacgccgactgtctgcagcgggctgccgaaaaaagttcaaagcacggcgcagaggatcgaacccagaatatcattatggtgctgaaggatcggatgaaaatcagggagcggaacaagccagaaatcttcgagttgattcaagagatttttgcggtcacaaagactgcccacactcagcaaatgaaagctgttaagcagtcagtgctggatggcaccagcaaatggtctgcaaaaatctctattaccgtggtctgtgcgcagggactccaggcaaaggacaagaccggaagttccgatccatatgtaacagtgcaggtcggcaagaccaaaaagagaactaaaacaatttacggaaacctgaaccccgtttgggaggagaactttcactttgagtgtcacaatagctccgatcgtattaaagtgcgcgtgtgggacgaagacgacgacatcaagagccgcgttaaacagaggttcaagcgcgagtctgatgattttctgggtcagaccatcattgaagtacgcactctgagcggcgaaatggatgtgtggtacaatttagacaagcgcacagacaagtcagccgtgagcggagcaatccggctgcacatatcggtggaaattaagggggaagaaaaggtcgctccttatcacgtgcagtacacatgtcttcatgagaatctgttccattttgtaacagatgtacagaacaacggtgtggtcaaaattccggacgctaagggcgacgacgcctggaaagtctactacgacgaaacggcgcaggagatcgtggacgagtttgctatgagatatggcgttgaaagtatctatcaggccatgactcacttcgcctgcctgtcatccaagtacatgtgccctggggtaccggcagttatgagcacgctcctggctaatattaacgcgtattacgctcataccaccgctagcacgaatgtcagcgcctcggataggttcgctgcgtctaacttcggcaaggaaagattcgtgaaactacttgaccagcttcataattctctccgcatcgacttatccatgtatcgcaataacttccctgcctcctctcctgagcgactacaggacctgaagagtaccgtggatctgcttacatccattacattcttccggatgaaggtgcaggaactacagagtcctcccagggcttctcaggttgtgaaagactgcgttaaagcctgtctgaattctacttatgagtacatttttaacaactgccacgaactctacagtagggaataccaaactgatcccgctaagaaaggcgaagtgctccccgaagagcaaggcccatccatcaaaaacttggatttttggagtaaattgatcactttgatcgtgtccatcatcgaagaggacaagaattcctacacaccctgcctgaaccagttccctcaggaacttaatgtggggaaaatctccgcagaggtgatgtggaacctttttgcacaagatatgaagtatgccatggaggagcatgataagcacagattgtgcaaatctgcagactatatgaatcttcacttcaaggttaaatggttatacaacgagtacgttaccgagctaccagccttcaaagacagagtcccagaatacccagcttggttcgagccttttgtcattcagtggttagatgaaaacgaagaggtgtcacgcgactttttgcacggagccctggaacgggataagaaagacggcttccagcagacatctgagcacgcactcttctcctgttcagtcgtcgatgtttttagtcagctaaaccagtcttttgaaataatcaagaagttggagtgcccagatccacaaattgtcggacactacatgaggaggtttgctaagaccatttctaacgtgctgcttcagtatgccgatatcatctccaaggactttgcttcctattgctccaaagagaaggagaaggttccatgtatccttatgaacaacacgcagcaactgagggtccagctcgagaagatgttcgaggccatggggggaaaggagctagatgccgaggcgtctgacatcctaaaagagctgcaggtcaaattaaataatgttctggacgaattatctcgtgtgtttgccacctcatttcaaccccacattgaagagtgcgtcaagcaaatgggtgacatcctctcacaggtcaaaggaacgggaaacgtacccgctagcgcgtgctctagtgtggcccaagatgctgacaacgtgttgcagcctatcatggatcttctggattccaacttaacacttttcgccaaaatttgtgaaaaaaccgttctaaagcgagtccttaaagagttatggaaactcgtgatgaacacgatggaaaagactatcgttctgcctcccctgaccgatcagaccatgattgggaatttgctgcggaagcacgggaaaggattagagaaagggagggtgaaacttccttctcatagcgacggaacccaaatgatattcaatgctgcgaaggagctgggccagctctctaaactcaaggatcatatggttagggaagaggctaaatctttaacgccaaaacagtgcgcagtggtcgagcttgccctcgacacaataaaacaatatttccatgccggtggcgtcggtctgaagaagacttttctggaaaagtctccagatcttcagtcactgcgctacgctctcagcctatacacccaggcaactgacttgttaatcaagacattcgtgcagacccagagtgcccagggtttgggcgtcgaggacccagttggggaagtctctgtgcacgtggagctgttcacacatccagggaccggagaacataaggtcaccgtcaaggttgtcgcagcaaatgatctgaagtggcagaccagcggcatctttcgcccttttattgaggttaatattataggcccacaactttccgacaaaaaaagaaagtttgctactaagtcaaaaaacaattcctgggcgccaaagtataacgagtccttccaattcacactttccgccgacgcgggtccggagtgttacgagctccaggtctgtgtcaaagactactgttttgcacgagaggaccggactgtaggcctggccgtgctgcaactgcgcgagttagcacagagggggtctgccgcttgctggctgccgctcgggagacgaattcacatggatgacacaggtctcacagtcctgcgcatccttagtcagaggagtaatgatgaagtcgccaaagagtttgtcaagcttaaaagtgacacccgaagcgccgaggaaggcggtgctgcccctgccccata

SEQ ID NO: 246270 - DNA, 5111 bp, Artificial Sequence
  Description of Artificial Sequence: Synthetic coding sequence
atgtctcttctgtgcgtgggagtgaagaaagctaagttcgacggcgctcaagaaaaattcaatacctacgtgaccttgaaagtgcagaacgtaaaatccaccacaatcgccgtgcgaggttcgcaacccagctgggagcaggacttcatgtttgagatcaatcggttggacctgggactcactgttgaggtctggaataaggggctgatctgggacactatggtggggaccgtgtggattccgctgcgcaccatccgccagtccaatgaggagggaccgggtgagtggctaaccttggatagtcaggtgatcatggctgattcagagatttgcggtactaaggatccaaccttccatcgcatcctgctggataccagattcgagctccccctggatattcccgaagaggaagcacgctactgggcgaagaagctggagcagcttaatgcgatgagagatcaggatgagtactccttccaagacgaacaggataagcctctgccagtgccatccaaccagtgctgcaactggaactatttcggttggggagagcagcataacgacgaccccgattctgccgtggacgacagagattccgactatcgcagtgaaacttccaatagtatcccaccaccatattacacaacctcccagcctaacgcgagcgttcaccagtattccgtgagaccccctcccttaggctcacgggaatcctactctgactcaatgcacagttacgaagaattctctgagcctcaggcccttagtccaactggatctagcaggtatgcaagcagtggtgaattgtcccaggggagcagtcagctgtccgaggactttgacccggatgaacatagcctgcaagggagcgatatggaggacgagagagatcgagattcctatcattcttgtcactcaagcgtatcttaccacaaggactctcccagatgggatcaggacgaagaagagcttgaggaggatttggaagattttttagaggaagaagagctccctgaggatgaggaggagttggaggaggaggaagaagaggtgcctgatgatcttggcagctatgcccagcgcgaggacgtcgcggtcgccgaacccaaagacttcaaacgtatcagcctgccccctgctgcgcctggaaaagaggataaagccccagtcgcccctaccgaagctcctgacatggcaaaagtggctccgaagcctgccactcccgacaaagtgcccgctgcagaacagattcctgaggcagagccacctaaggacgaggagtcgtttaggcctagggaagatgaggagggccaagaaggtcaggatagtatgagccgggctaaagccaactggctaagggctttcaataaagtacggatgcaactgcaggaagccagaggagaaggggagatgtccaagtctctctggttcaagggtggcccaggcggtgggctcataataattgactccatgccagacatacgcaaacggaagccaatccctcttgtaagcgatctagctatgtctctggtgcaatcccggaaggcaggtatcaccagcgccttagctagttcgacattgaataacgaggaactgaagaaccacgtttacaagaagactttgcaggccctcatctaccctattagctgcacaactccccataacttcgaagtttggactgccaccactcccacttactgctacgaatgcgaggggttactgtggggcattgcccgtcagggcatgaggtgtacggagtgtggtgtaaaatgtcacgagaaatgccaggatctcctgaacgccgattgtctgcagagagcggctgagaagtccagtaagcatggggctgaagacaggactcagaatattatcatggtgttgaaggatcgtatgaaaattcgggagaggaataagcctgaaatctttgagcttatccaggagattttcgccgtcacaaagaccgctcatacccaacagatgaaggcagtaaagcagtccgtgcttgacggcacgtccaaatggagcgctaaaatatcaatcacagtggtttgtgctcaaggcctccaggctaaggataagacaggctcctctgatccgtacgtgaccgtgcaggttgggaagaccaaaaaacgaactaaaaccatttacggcaatctcaaccccgtgtgggaagaaaattttcattttgagtgtcataatagcagtgaccggattaaagttcgggtgtgggacgaagacgacgacattaaatctcgcgtcaaacaacggttcaaacgcgaaagcgatgactttctgggccagaccatcatcgaagtccgaacactctcgggagagatggatgtttggtacaatctagataaacgaacagacaagtccgcggtgtcaggcgctattcgcctgcatatttccgtggagattaaaggggaggagaaggtagctccttatcacgtgcagtacacctgcctgcatgagaatcttttccatttcgtaacggatgttcagaataacggtgtagtgaagatcccagacgccaaaggtgatgacgcttggaaggtctactatgacgagaccgctcaagaaattgtggacgagtttgcgatgcgatacggggtggagagcatctaccaggctatgacccatttcgcttgtctatcttccaaatatatgtgccctggtgtgcctgccgtcatgtcgacactgctcgccaatatcaacgcttattacgcacacaccacagcctcaactaatgttagcgcctctgacagattcgccgcatcaaatttcggaaaggaacggttcgttaagctcttggaccagttgcataatagcttacgcatcgacttatcaatgtatcgtaacaattttcccgcttcctcgcccgagcggcttcaggacctgaagtcgacagtcgatctgctgacatctattaccttttttagaatgaaagtgcaggaactccagtccccaccacgggcttcccaagtggttaaagactgtgtaaaggcttgtttaaactctacgtacgagtatatcttcaataactgccatgagctgtatagtcgggagtaccaaactgatccagccaagaaaggcgaagtactgccggaggagcagggaccgtctataaaaaatcttgacttttggagcaagctgataaccctgatagtttccattattgaagaggataaaaactcatacacaccatgcctgaatcaatttccccaagagttgaacgtaggcaaaatcagtgccgaggtcatgtggaatctattcgcacaggacatgaaatatgctatggaggagcatgataagcacaggctatgtaagagcgccgattacatgaatcttcatttcaaagtgaagtggctgtataacgagtatgtgacagagctacctgctttcaaggacagagtgcccgaatacccagcctggttcgaaccgtttgtcatccagtggctagatgagaacgaagaagtgtctcgggattttttacatggcgctcttgaaagagacaagaaagacggattccagcagacttccgagcacgctcttttcagttgtagtgtcgttgatgttttcagccagctaaatcagagctttgagataattaagaagcttgagtgcccagacccgcaaatcgtcgggcattacatgagaagattcgccaaaactatttctaacgtcctccttcagtatgcggatattatctcaaaagatttcgcaagctattgtagcaaagaaaaagagaaggtgccttgtatcctgatgaacaatacccagcagctcagagttcaactggaaaaaatgttcgaggcaatgggtggaaaggagctggacgcagaggcctcagacattctcaaagaactgcaggtaaaactcaataacgtcctggacgagctgtctcgagtttttgccacttcttttcagccacacattgaggagtgcgttaagcagatgggggacatcctgtcacaagttaaggggacgggcaatgtccccgcttccgcttgttcatccgtcgcccaggacgcagacaacgtacttcagcccatcatggacttgctcgatagcaacctgaccctattcgccaaaatctgtgaaaagactgtcctaaagagggttctgaaagagctgtggaaactggtgatgaataccatggagaaaactatcgtcctcccacctttaaccgatcaaaccatgattggaaacctgttgaggaagcacggaaaaggactggagaaaggacgtgtgaagctgccgagtcattcagatggtacgcagatgattttcaacgccgctaaggaactaggtcagttgtcgaagttgaaagatcatatggttagggaagaggccaagtctttgacccccaagcagtgtgccgttgtggagctggctctggacactatcaaacaatacttccatgctgggggagtcgggctgaagaagacattcctagagaagagccccgatttgcagagcctgaggtatgctctctccctgtatacccaggcaactgacctgctgatcaagaccttcgtgcagacgcagtccgcccaggggctgggagtggaggatcccgtcggagaggtgtcagtccatgtggagctctttactcaccctggcaccggagagcataaggttaccgtgaaagtggtcgccgctaacgatcttaagtggcagacaagtggtatctttcggccattcatcgaggtgaacataattggcccacagctgtccgacaagaaaagaaagttcgcaacaaaatcaaagaataactcctgggcgccaaagtataacgaatcattccagttcaccctttctgccgacgcgggaccagagtgctatgaactgcaggtgtgcgttaaggactactgcttcgccagagaagatcggactgtcggattggcagtgctgcaactgcgggagttagcccagaggggctccgcggcttgttggctacccctgggtaggcgcatccatatggacgacaccggacttacggtgctgaggatcctgtcccagcgctctaacgatgaggtagctaaggagtttgtaaaattgaaatcagacacaaggtctgccgaagaaggcggagccgctcccgctccgta

SEQ ID NO: 246271 - DNA, 1293 bp, Artificial Sequence
  Description of Artificial Sequence: Synthetic coding sequence
atggcaaccctcagtgtaaaaccatccagacgattccagctgccagattggcataccaatagctatttattgagtaccaacgctcagcttcagcgagatgcctcccaccagataaggcaggaggcaagggtgctgaggaacgagacaaacaatcaaactatctgggatgagcatgacaaccggaccagattggtggagcggatcgacaccgtgaataggtggaaagagatgttagacaagtgcttgaccgacctcgacgccgagatagatgccttaactcagatgaaggaatccgcagagcaaaacttacaggctaaaaatctaccccttgatgtagctattgagtgtctaacgttgcgggagtcccggagagacatcgacgtcgtcaaagaccccgtagaggacgagctgcacaaggaggtggaggtgatagaagccacaaagaaggctttgcagcagaaagtgtcacaagcattcgaacaactgtgtctcctgcaggaagtgcaacagcagcttaactccgaccatagggggaaaatggaaactcttgagatcgaccgcggatgtctctctcttaaccttcgctctcctaacatatctttaaaagtcgaccccactcgagttccagatggtagcacaacgttacagcaatgggacgacttctcccgattcaataaggatagggccgaagccgaaatgaaagccgcaacagaactgcgggaggccaccgcccttactattgcggaaaccaataatgagttggaggcacaaagggtggccactgagtttgcttttcgtaagagattacgtgagatggaaaaggtgtactccgagctcaagtggcaggagaaaaatactttggaagaaatcgctgagctgcaagaagatatccgacatctggaagaggatctgaggaccaagctgctgagtttaaaactctcacacacaagattagaggccaggacttatcgacctaacgtcgagctctgtagggaccaggcccagtatgggctgacggacgaagtccatcagctggaggccactatcgcggcattaaagcagaaactggcgcaggctcaggatgcactggatgccctgtgcaagcatctggccaggctgcaggctgatattgcatgtaaggcaaatagcatgctcctggatacaaagtgcatggacacacgcaggaaactgacagtgccagccgagcgatttgtccctgaggtcgatactttcacccggacgacaaattctaccctgtcacctcttaagtcctgccagctcgagctcgcgtag

SEQ ID NO: 246272 - DNA, 3429 bp, Artificial Sequence
  Description of Artificial Sequence: Synthetic coding sequence
atggccacactcctttctcatcctcagcagcgacctccgtttctgaggcaggcgataaagattcgacggaggcgagtgagagatctgcaggatccacccccacaaatggctcctgaaattcagcccccatcacaccactttagccctgagcagcgagccctcctttacgaggacgccctgtataccgtcttacacaggctgggccaccctgaacctaaccatgtcactgaagcaagcgagctcctgcggtaccttcaagaagccttccacgttgagcccgaggaacaccagcaaaccttgcagagggtacgggaactagaaaaacccattttctgcctgaaggccactgttaaacaggcaaaagggatcctgggcaaggatgtgtcaggcttttctgatccgtattgcctccttgggattgaacagggggtgggtgttcccggaggcagccccggtagcagacacagacagaaggctgtggtgagacatactatcccagaggaggagacccatagaacccaggtgatcacccaaacattaaatccagtgtgggacgagacctttatcctcgaatttgaagacataaccaacgctagtttccacctggacatgtgggacttggataccgttgagagcgtgcgccagaaactcggggagttaacagatctgcatggattgcgacgtatctttaaggaggccagaaaggataagggccaagatgatttcctaggcaacgttgtattaagactgcaggacctgcgatgtagggaagaccagtggtatccgctggaaccacggactgagacgtacccggatcgtggccaatgccatcttcagttccaactgattcataagagaagggccaccagcgcctcacgctcgcagccgagctacactgtccacctccacctgttgcagcaattagtatctcatgaggtgacccagcatgaggctggaagcacaagctgggacggaagcctgtctcctcaggcagccaccgttctgtttctgcacgctacccagaaggatctgtcagatttccaccagagcatggcacaatggttggcctacagcagactttatcaatccctggaattcccttctagttgtctgcttcacccaatcacatccatcgagtatcagtggatccagggacgtctgaaagcagaacaacaggaagagttggccgcttctttttcatctctcttaacctacggcctctctctgatcaggcggttcaggagtgtttttcccctttctgtaagtgactctccagccagactgcaatcactgctcagagtgttggtacagatgtgtaagatgaaggcgttcggcgaactgtgccccaatactgctccactgccgcaactagttaccgaggccttacaaactggaactacagaatggttccacctgaaacaacaacatcaccaaccgatggtgcagggtatacccgaggcagggaaggcgttgcttgggctcgtgcaggacgtcattggcgacctccatcaatgtcagcgtacatgggacaaaatctttcataatactctgaagatacatctgttctctatggcgttcagggaactccagtggctggtagccaagcgcgtccaggaccatactacagttgtaggcgatgtggtctccccggagatgggggaaagcctgttccagctttacatatctctcaaagaattatgtcaactgagaatgagctcaagcgaacgcgacggcgtgttagcactcgacaatttccacaggtggttccaacccgcaatacccagttggttacaaaagacttacaatgaggctctggctagggttcagcgggcagtccagatggacgagctcgtcccactgggagagttgacgaagcatagcacaagcgctgttgatttgtccacatgcttcgcacagattagccataccgctcggcaactcgattggcctgatcctgaggaggcattcatgataactgtgaaatttgtggaggacacgtgtagactggccctagtgtattgttcactgattaaggctagagctcgggaattatcctccggccaaaaagatcagggtcaggcagctaacatgctttgtgtggtggttaacgacatggaacagttacgcctcgttataggcaagcttccagcccaactcgcctgggaggcactcgaacagagagttggcgcagtgctcgagcaaggccagctccagaatacactccacgcccagctgcagagcgccctggccggtctgggccatgaaattaggactggggtccggactctggccgaacagttagaggtcggaatcgccaagcacattcaaaaactcgtgggagtacgcgaatcagtgctcccagaggacgccatcctacccctcatgaagtttcttgaagtagagctgtgttacatgaacactaatcttgttcaagagaatttctcctctctcttgaccctgctgtggactcacactctcaccgttcttgtcgaagctgccgcttcacaaaggtcttctagcttggccagcaaccggttgaaaattgccctgcaaaatctcgaaatttgtttccatgccgagggatgcggacttccccctaaagcgctgcatacagccacttttcaggccctgcagcgcgatctggagctacaggctgcttcaagccgggagctgatccggaagtacttctgctccagaatccagcagcaagccgagactactagcgaagagctgggcgcagtgactgtgaaggctagctaccgggcaagcgagcagaagctgagagtcgagttactgtctgcctcttccctgttgccactggactcaaatggcagtagcgatccttttgtccagctcacacttgagcccaggcacgagtttccggagctcgccgctcgagaaacacaaaaacataagaaggacctgcaccctcttttcgacgagactttcgaatttctcgtccccgctgaaccttgtcgcaaggccggtgcctgcctgttgttgaccgtactggactatgatacgttgggtgcagatgatctggagggagaagcattcctgcccctgcgagaagtgccagggctgtctggaagcgaggagcccggagaagtcccacaaacgagactgcccttaacttatcctgcccctaacggcgaccctatcctgcagctgttggaaggcagaaagggcgatagggaggcgcaggtgttcgtccgacttagacgccaccgcgcaaaacagggcatcggcccttcagtgagttggccatggccaatttgcctgctcgcctttctgttccagccactgggctggggtcctgggtccctgggacccggactgcaggcccagtctctgctcgaaaaaggggaggggacattacctaagatgcggctgcagttgccctggggtgagggtggcggacattattag

SEQ ID NO: 246273 - DNA, 2835 bp, Artificial Sequence
  Description of Artificial Sequence: Synthetic coding sequence
atggccaccctgctgagtcacccacagcagcggccacccttcctgcgacaggccattaagatacggcgtaggcgagtgagagatctacaggatccaccaccgcagatggcccctgaaattcagcccccatctcaccacttttccccagagcagcgggcactgttgtacgaggacgcattgtacacggtgttacaccggttgggtcaccccgagcccaatcatgtcacagaggccagcgaactgctgcggtacctgcaagaagccttccacgtggaacccgaggagcatcagcaaactctccagcgtgttcgagaactggagaaacccatcttttgccttaaggcaaccgtcaagcaggccaagggaatccttggaaaggacgtctctggtttttctgacccttattgtctgctaggtatcgaacagggcgtaggagtaccgggtggttctccagggtcccgtcaccgccagaaagctgtagtcagacataccatccccgaggaggaaacccaccggacccaggtgatcactcaaactttgaatccagtctgggacgaaacctttatactggagtttgaagacatcacaaatgctagctttcacctggacatgtgggatctggatactgttgagtcagtccgccaaaaacttggtgagcttaccgacctgcacggcctgcgacggatcttcaaggaagctcggaaagataagggtcaggacgattttctggggaacgtcgtgctccggctgcaagacttgcgatgccgggaagaccagtggtatccgctggagccacgcactgaaacgtatcccgacagaggtcagtgtcatctgcagttccagctcatacacaaacgaagagctacctcggctagccgctcccaaccctcttataccgtgcaccttcatctgctgcagcagttggtgtcacatgaggtgacacagcatgaagccggaagtacatcctgggacgggtcactcagcccgcaagccgctacggttctgtttctgcacgcaacacaaaaggacctgagcgattttcaccagtccatggcacagtggctggcttacagtcgactgtaccaatcactggaattcccgagtagttgtctgctccaccccataacaagtattgaatatcaatggatccagggtcggctcaaagccgagcagcaggaggagctggctgcttctttttcctcactgctcacttatggcctctctctcatccggaggtttaggtcagtttttcccctgtctgtctctgacagtccagcacgtctccaatcactcctgagggtcctggttcagatgtgcaagatgaaggctttcggagagttgtgcccaaatactgccccactgcctcagctggtgaccgaagcgttgcagacaggcaccacagaatggttccatcttaagcagcagcaccatcagcctatggtccagggaattcctgaggctggaaaggcactgctgggtctcgtgcaagacgttattggcgacctgcatcaatgtcagcgaacctgggataaaatctttcacaacacccttaagatccacttattctccatggccttcagggaactgcagtggcttgtggctaaacgtgttcaggatcacactaccgtggtgggagacgtggtgtccccggaaatgggggagagtcttttccagctttacatttcactcaaggaattgtgtcagctgcgtatgtcgtctagcgaaagagacggggtgcttgctctggacaactttcaccgttggttccagccagcgataccgtcttggctccaaaagacttacaacgaagcgctcgcacgggtgcagcgcgcagtgcaaatggatgaactggtgcccctgggtgagttgacaaaacattccacgagcgccgttgacctgagtacctgttttgctcagatttcccacactgcccgtcaacttgattggccagatcccgaggaagcgtttatgatcaccgtgaaatttgtcgaagacacctgtcggttggctctggtatactgttcattaatcaaggcacgggctcgcgagctgagcagcgggcaaaaggatcagggccaggccgctaatatgctgtgtgtggtggtcaatgacatggagcagctaaggctggtgatcggaaagttgcctgcacagctcgcctgggaggctttggaacagagggtgggcgcagtgctcgagcagggacagttacagaatactctgcatgctcagcttcagtccgctcttgcgggactgggtcatgagatccgcaccggcgtacgcacactcgctgagcagctagaagtgggcatagcaaaacatatccagaaactcgtgggtgtgagggagagtgtattgcccgaagatgccatcctgcctctcatgaagttcctggaagtcgagttatgttatatgaatacaaatctggtgcaagaaaacttttccagtcttctgactcttctctggactcatacccttacagtcctggttgaggcagccgcatcccagcgctcctctagcctggcgtctaataggttgaagattgcactgcagaacctggagatttgctttcacgccgagggctgcggccttccccctaaaactctgcctcttccggcttcacaaaagagctgctgtgggggtcagggcatcggaccatctgtgagctggccatggcctatctgtctgctcgcttttctttttcaaccactgggctggggcccaggaagcctcggtcctgggcttcaagcgcagagccttctagaaaaaggggaaggcaccctgccaaaaatgcgcttacagttaccctggggggagggtggcggtcattattag

SEQ ID NO: 246274 - DNA, 2790 bp, Artificial Sequence
  Description of Artificial Sequence: Synthetic coding sequence
atgacagcgagctctgtcgagcaactgagaaaagaaggaaacgagctattcaagtgtggcgattatggaggtgcccttgctgcttacactcaggctcttgggctggacgccacccctcaagaccaagccgtacttcacaggaatcgtgcagcatgtcatcttaaactggaagattacgacaaagcagagaccgaagcctcaaaggcgatcgagaaggacggtggagatgtgaaagcactgtaccggagaagccaggcccttgaaaagctaggaaggttggatcaggctgtgctcgatctacaaaggtgcgttagtctggagcccaaaaacaaggtcttccaagaggctttacgtaatattgggggtcagattcaggagaaagtcaggtacatgtctagcacagacgccaaggttgagcaaatgttccagatactgttggacccagaggagaaagggacggagaaaaagcagaaagcttcacagaacctagtcgtgttggccagggaagacgctggagcagagaaaatcttccgctcaaatggtgtgcagttgcttcaaaggctgcttgatatgggcgagaccgaccttatgctggccgcactgcggacactggttggcatatgctccgaacaccagagccgtactgtagctacactgagcatccttggcacccgaagggtcgtctctatcttgggggttgagagccaggccgtctccctggccgcatgtcacttgctccaggtgatgttcgatgccctgaaagagggcgtgaagaaaggatttcgcggaaaggagggggcaattatcgtggatcctgccagagagctgaaggtcctgatctcaaatcttctagacttacttactgaagtcggagtgagcggccaaggcagggataacgctctgacactattaatcaaggccgttcccaggaagtcattaaaggaccctaacaacagcctcacactttgggttattgaccaagggcttaaaaaaatcctggaggttgggggttcccttcaggaccctccaggagagctggccgttaccgcaaattcccgcatgtccgcttcaatcttactgtccaagctctttgatgacttgaaatgtgacgcggagagagaaaactttcataggctgtgcgagaactatatcaagtcttggtttgaagggcagggcttggccggtaagttgcgcgcaatacagaccgtgtcttgtctgttgcaggggccatgcgacgcaggaaaccgggctttagagttaagtggtgtaatggagtctgtcatagccctttgcgcatccgagcaagaagaggaacaactcgtggcggtcgaagcgcttattcacgcagctggtaaggcgaagagggcctccttcatcacagctaacggggtttccctactgaaggacctctacaaatgtagtgagaaagacagtatcagaattcgcgcactcgtcgggctgtgtaagctggggtccgccggtggaaccgacttttccatgaaacaatttgcggagggtagcacactgaaattggccaagcaatgccgtaagtggctgtgcaatgatcagatcgatgcaggcacgcgtagatgggccgtggagggactcgcctacctgactttcgacgcagacgttaaagaagagttcgtcgaggacgcagccgctctgaaggctctgtttcagctttcacgactcgaagaacggagcgtcctgtttgcggttgcttcagcacttgtgaattgtacaaattcatatgactatgaggagccagatcctaagatggtggagttagctaaatatgctaagcagcatgtccccgagcagcatcctaaagacaaaccgtccttcgttcgcgcacgcgtgaagaaacttcttgctgcaggcgtggtatccgccatggtgtgcatggtgaagacggagtccccggtgctgacaagtagttgcagggaactgttatcccgggtttttctggcccttgtagaggaggtagaggatcgcggtaccgtcgtggcccagggcggtggcagagccctcattcctctggccctagaaggtaccgacgtcggacaaaccaaagctgcccaggccctggcgaagttgaccataacaagtaaccctgagatgacattccccggagaacgcatttatgaggtcgtgagaccccttgtctccctcctgcatctgaactgctcaggactccagaatttcgaggcccttatggcgcttacaaatctagccggtatcagcgagcgcctgaggcagaaaattctcaaggagaaggccgttcccatgatcgagggatacatgtttgaggaacatgaaatgattcggagggccgctaccgagtgtatgtgcaatctcgctatgtcaaaggaggtgcaggacttatttgaggctcagggcaatgatcgcctcaagttgctggtcctatatagcggtgaagacgacgagctacttcagcgagccgctgcagggggtcttgccatgctcacctctatgcgccctacactctgtagccggattcctcaggtaaccactcattggctggagatcctacaagcacttctcttaagctccaaccaggaattacagcacaggggagccgtcgttgtgctaaatatggtggaagcaagcagggagattgcatcaaccttaatggagagcgaaatgatggaaatccttagtgtgttagctaaaggggaccatagtcctgttacgcgagccgcagccgcttgccttgataaggcagtggaatatggactgatccagccaaatcaggacggagaatag

SEQ ID NO: 246275 - DNA, 2835 bp, Artificial Sequence
  Description of Artificial Sequence: Synthetic coding sequence
atgacagtcagcgggcctggaaccccagaaccgcgacccgctacacctggagcgagctcagtcgaacagctgagaaaggagggtaacgaactcttcaagtgcggagactatggcggagccctagcagcatatacccaagcactgggcctggatgccaccccccaagatcaggctgtgcttcaccgtaatcgtgcagcttgtcatctgaagctggaggattacgacaaggccgagacagaagcttcaaaggccatcgagaaggacggaggtgatgtgaaagccctgtaccggaggtctcaggccctcgagaagttgggcaggctggatcaagcggtattagacctgcagcggtgcgtgtcactggagccaaagaacaaagtgttccaagaagctctgcggaatattggcggacagatccaggagaaggtgaggtacatgtcctccacagatgccaaggtggagcaaatgttccagatcttactggatccagaagaaaaaggcactgagaagaagcagaaagcatcacagaacctcgtggtgcttgcacgcgaggatgccggagcagagaaaatctttcgctctaatggagtgcagttattgcagcggttgctggacatgggggaaactgatctgatgctggccgcactgagaaccctggtcggtatatgttctgagcatcagagccgcacggtggctacactgtctattctggggacaaggcgggtggtaagcatactcggggtggagtcccaggctgtcagcctggccgcttgccatctgctgcaagtgatgttcgacgccctgaaagagggtgtgaaaaagggtttcagaggcaaggagggcgctattattgtggaccctgcacgggaattgaaagtgctgatttccaatctcctcgatttgctcaccgaagtgggagtctccggtcagggacgggataatgctctcacactcttgattaaagccgtgcccaggaagtccctgaaggacccgaacaattctctaacgctgtgggttatcgaccaggggctcaaaaagattctcgaggttggagggagccttcaagatcccccaggcgagttggcggtgactgctaactcccgcatgtccgccagcatcttgctctcaaaattattcgacgacctgaagtgcgacgctgaacgggagaacttccacaggctatgtgagaattacattaaatcgtggtttgaagggcagggactggccggaaaattgagagctattcagactgtgtcctgtcttctccagggaccctgtgatgccggaaacagggccctggaactctctggagttatggagagtgtgatcgctctgtgcgctagcgaacaagaagaagagcaactcgtcgcagtagaggctttgatccatgcggcaggaaaggctaagcgagccagcttcattaccgcaaacggagttagcttactaaaggacctgtacaagtgtagcgagaaagattctattcgcattagagctctggtcgggctgtgtaagctgggatccgccggaggtaccgatttttcaatgaagcaattcgctgagggttcgaccctgaaattagccaagcaatgcagaaagtggctgtgtaacgatcaaatcgacgccggaacacgaaggtgggccgtggagggtcttgcttatctaacgtttgacgccgatgtgaaggaggaattcgtagaagacgccgcagcgctgaaagctctattccagctttcacgactggaggagagatccgtgctgttcgccgtggcctctgctcttgtgaattgtaccaacagctacgattacgaggagcccgaccccaagatggtggagctggcgaagtacgccaaacagcacgtgcctgaacagcatccaaaagataagccaagttttgtccgagcaagggttaagaagctgctcgcggcaggagtcgtttctgccatggtgtgtatggtgaagacagagagccctgtgctgacatccagttgtagggagctactaagcagagtgttccttgccctcgtggaagaagtggaagatcgcggaacagtggtggcccagggtggcggtcgagctttaattcctctggccctggagggcacagacgtgggccagaccaaagccgcacaggcgcttgccaagctgacgattacttctaaccctgaaatgactttccccggagagcgaatttatgaggttgttcgtcccttagtctccctactgcatctgaactgctccgggctccagaattttgaggccctaatggcactgacaaacctcgcaggtatatccgagagattgcgtcagaaaatcctaaaagaaaaagccgtgccaatgattgagggctacatgttcgaggaacatgaaatgattagacgggctgctacggagtgcatgtgtaacttggcaatgtctaaagaggttcaagatctgttcgaggcccaggggaacgaccgccttaagcttctggtgctttattccggagaggacgatgagttgctccagagagctgcagctgggggtctggccatgttgacaagcatgcgacccacactctgtagcaggattccacaggtcacgactcactggctcgaaatactgcaggcactattgctcagtagcaatcaggagctgcagcaccgcggagctgtggtagttcttaatatggtagaggcttctcgcgaaatcgccagcactttaatggagtcagagatgatggaaattctgagtgtactggcgaaaggtgaccactcccctgtcacccgtgccgcagctgcttgcttggacaaggccgttgaatacggtctcatccagcctaaccaagacggcgagtag

SEQ ID NO: 246276 - DNA, 2409 bp, Artificial Sequence
  Description of Artificial Sequence: Synthetic coding sequence
atggccggaacctctgagcggtctctgataagctccatttcacagccaaaggcaattgagtgctttgaggtgaagaaaaaagcatttcttacccacggacggtaccacggatcaggagccaccccccctaaaactaaggatccgaagcctgagacattttgtggccaaacaggattacctactatggaagtccgcattaacgtgagtagacaacaggtcgagaaggtattcggccttgaggaatactggtgtcagtgcgtggcttggtctagttctgggactacaaaatcacagaaagcatacatacggattgcttacctgaggaagaattttgagcaggagcccctggcaaaggaggtctctctcgaacagggtatcgtgctcccctgtcgacctccggaggggattccccctgccgaggtggagtggttaaggaacgaagacctagtggatccctccctggaccctaacgtttacattacgcgagagcactctctcgtcgtcagacaggctcggctggcagacacggctaactatacctgtgtcgctaagaatatcgtggccagaaggagaagcgcatctgctgcagtgattgtgtatgtcgacggctcctggtcaccttggtccaaatggtccgcttgcggcctcgattgtacacactggagatctagggagtgcagtgacccagcacctcggaacggaggggaggagtgccagggaacagaccttgacactagaaactgtacatccgacctgtgtgtacacacagctagcgggccagaggacgttgccctctacgtcggcctaatcgctgtggctgtatgcctggtgctcctcttactggtgctgatactggtgtactgccgaaaaaaggaaggactcgactccgacgtcgctgacagctcgattctgacttctggctttcagccggtttcaataaaaccatccaaggccgataaccctcatctgctaacaatccagccggacctgtcaactaccacgactacatatcagggatctctgtgccctaggcaggacggaccttcccccaagttccagctgacgaatgggcatctgttatcacccctgggaggaggcaggcacaccttacaccactcttcccccacttccgaggctgaagagtttgtgagccggctatccacccagaactatttcagatctttgcccaggggcactagtaatatgacctatggcacgtttaactttttaggcggtcgcctgatgattcctaatacaggtatttcactgcttattccacccgacgccatcccaaggggcaagatatatgaaatctatctgaccctgcacaaaccggaggatgttcggctgccactggccggatgtcagactctactttctccaattgtgagttgtggacccccaggggtgttactaactaggcccgttatcctggccatggaccattgcggcgagccatcccccgactcctggagcctccggctgaagaagcaatcatgtgaaggatcctgggaggatgtccttcacctgggggaggaagccccatctcatttgtattactgccagctggaggcatcagcctgctacgtgttcaccgagcagctcggtagattcgctctggtcggcgaagccctaagcgtggccgctgcaaagcgcctcaaactgctgctatttgccccagttgcatgtacctcactcgagtacaacatacgcgtttattgccttcatgacacacatgacgcgctaaaagaggtggtgcaactggaaaagcagcttggaggtcagctgatccaagagcctagggtccttcatttcaaggacagctaccataaccttcgactgtccatccatgatgtcccgtctagcctgtggaagagcaagttgttagtatcatatcaggagatcccgttttatcacatctggaatggcactcagaggtatctacactgcaccttcacattggaacgggtgtcacccagcacctctgacctggcctgcaagctgtgggtgtggcaggtagaaggtgatgggcaaagcttctcaatcaactttaatattaccaaggacacaaggtttgctgaactgttagcgctggagagcgaggctggagtcccagccctcgtgggtccgtctgcatttaaaataccctttttaattaggcagaaaattatctcctctttagaccccccatgcagacgtggtgccgactggcgcacactcgcccaaaaacttcacctagactcccacttgtcattttttgccagcaagccctctcccacagccatgattttaaatctgtgggaagccagacactttccgaacggaaatctttcccagctggctgcagctgtggctgggcttggtcaacctgatgccggtctgttcaccgttagcgaagcagaatgctag

SEQ ID NO: 246277 - DNA, 2529 bp, Artificial Sequence
  Description of Artificial Sequence: Synthetic coding sequence
atggcagttaggcccggactgtggccagcattgctgggcatcgttcttgccgcttggttgcgaggctctggcgcacagcaaagcgccaccgttgccaatccagtccccggtgctaatcctgacctactgccgcactttcttgtggagccggaggacgtgtatattgtcaagaacaaacccgtgctgctggtgtgcaaggctgtccccgcaacccagatcttctttaaatgtaacggcgagtgggtgagacaggttgatcatgtcatcgaaaggtctacagacggttcctcaggcttacccactatggaggtccgaattaatgtatcgcggcaacaggtggagaaggtgtttggtcttgaagagtactggtgccagtgtgtcgcttggagttcttctgggaccactaaaagtcaaaaggcttatatccgaattgcttatcttcgtaagaatttcgagcaagagccactggccaaggaagtatctctggagcaagggatagtgttgccctgtaggcccccagaggggatcccacctgctgaagtcgaatggctgcggaatgaggatctggtggatccaagcctggatccgaacgtgtatattacccgagagcacagcttggtggtgcgacaggctcgccttgccgacacggcaaattacacatgcgtggccaagaacattgtggcacggaggaggtcagcttctgctgccgtcatcgtgtacgtcgacggtagctggtccccttggtcaaagtggtctgcttgcggcctggactgtacacattggcggagtagagagtgtagcgatccagccccaaggaacggtggagaagaatgccaagggaccgacctggataccagaaactgcacaagtgatctgtgcgttcatacagcatccgggcctgaggatgtggccctttacgtcgggctgatcgctgtggccgtgtgtctggtcttgttactgttggtgttaatactagtgtattgtcgaaaaaaagagggattagactccgatgtagccgacagctctattctgacctctggattccagcccgtctctattaaaccatccaaagctgacaatcctcatctcctgactattcagcccgatctgtcaactacaaccacaacttaccagggctccttgtgccctagacaggatggaccttcaccaaagtttcagctgacgaatggtcacctgctttccccacttggcggaggtaggcacacattgcaccattccagtccaacttctgaagccgaggagttcgtatcaagactaagtacacagaattacttcagatcactgcccagaggaacatctaacatgacctacggcactttcaacttcctaggtggcaggctgatgatacctaacaccgggatttcactcctcattcctcccgacgccattccgaggggcaagatttatgaaatttacctgaccctccacaaaccagaggacgttcgtttgccgttagcgggttgtcagacactgctgagtccaatcgtaagctgcggcccacccggagtgctgctcacacgcccagtaatactggccatggaccattgcggtgaaccctcacctgactcatggtccctgcgactgaaaaaacagtcatgtgaaggctcctgggaggacgtgcttcacctgggcgaagaggcaccctcccatctttactattgccagcttgaagcttccgcatgctacgtttttacagagcagcttgggagatttgcccttgtgggagaggcactgtccgtggccgctgccaagcgactaaaactgctgctatttgccccagtggcttgcacttcccttgagtataacattcgcgtgtattgcttgcacgacactcatgacgccttgaaagaagtcgtgcagttagagaaacagctgggcggacaactgattcaggaacccagagtcctgcatttcaaagattcatatcacaacctgaggctgagcattcacgatgtcccatcttcactctggaaaagcaagctgcttgtttcataccaggaaatcccgttttaccacatatggaatgggactcagcgataccttcattgtacgttcactctggagcgggtctccccgagcacctcagatctggcctgcaaactgtgggtgtggcaggtggaaggcgatgggcaatctttttctatcaattttaacattaccaaggatacacgctttgcggaactcctcgccctggagagcgaggctggggtgccagccttagtggggccatcagcctttaagataccattcttgatccgccagaagatcatcagtagcttagatcctccatgtagaagaggcgctgattggagaacactggcccagaaactgcaccttgactctcatctctccttttttgccagtaaaccatcaccgacagctatgatcctcaatctctgggaagcacggcatttccctaatggcaacctatcccagcttgccgcagcagtcgccggactggggcagcctgacgcgggtttgtttaccgtgtcagaagctgagtgctag

SEQ ID NO: 246278 - DNA, 2838 bp, Artificial Sequence
  Description of Artificial Sequence: Synthetic coding sequence
atgggtgcaagatctggggcaagaggcgcactgctgttagcactactcttgtgttgggaccccaggcttagtcaagcaggcactgattccgggagcgaagtcttacctgacagtttcccttctgccccagccgagccgctgccatattttctacaggagccacaagacgcgtatatagtgaaaaataagccagtcgaattacggtgtcgtgctttccctgccactcagatctacttcaaatgcaacggtgaatgggtcagccaaaatgaccatgttactcaggaggggttggacgaggccaccggtctgcgggtgcgagaggtgcaaattgaggtgtcaagacagcaggttgaggaactgtttgggctggaggattattggtgccagtgcgttgcgtggtcttccgcgggaacgactaaatctagacgcgcttacgtgcgcatcgcgtacctccgcaagaacttcgaccaggagccactggggaaagaggtcccacttgatcatgaggtgctcctccaatgcaggcctccagaaggcgtcccggtggccgaggtggaatggctgaagaatgaagacgttatcgatccaacacaagacactaactttctactgaccatcgaccacaaccttataatccgacaggctcgcctgagcgacaccgccaattatacttgcgtggcaaaaaacatcgtggctaagagaaggtcaactacagcaacggtcatcgtgtacgtgaacggcggatggagttcatgggccgagtggagcccttgcagtaatcggtgtggcaggggctggcagaagaggacccgaacctgcactaatcctgcccctctcaatggtggggctttctgtgagggtcaggctttccaaaagaccgcttgcactactatctgtccggtcgatggcgcttggactgagtggagcaagtggtctgcgtgctctaccgaatgcgctcactggaggtctcgtgaatgtatggcacctccgcctcagaatggcggtcgggactgctcgggaaccctcctggactccaagaattgcacggatggcctgtgcatgcaaaataaaaagaccctctccgacccaaactctcaccttctagaggcaagcggggacgctgcactgtacgccggacttgtcgtggcaattttcgtcgtggtggcaattctcatggccgtgggtgttgtggtgtatagaagaaattgcagagactttgatactgacatcactgatagcagcgcagcacttacagggggattccatcccgtcaatttcaagacagctcgccctagtaacccacagttgctgcatccctccgtgccacctgacctaacggcctctgctgggatctaccggggaccagtctatgccctccaggactctacggacaagatcccaatgaccaatagtccactcctggacccactgccgagcctcaaggtaaaggtttattcctctagcactaccgggtcaggacctggactagccgatggcgcagatctgcttggtgtcttaccccctggcacatacccaagtgacttcgcgagggacacacatttcctgcacctcaggagcgcatcattaggatcacaacagcttctgggcctgccgcgtgaccctggtagctccgtatccggtacctttggatgcctgggtgggagattgtctatccctggaacaggagttagcctattggtccctaatggggctatacctcagggtaagttctacgagatgtatctgctcatcaacaaggccgagtcgacgctccccctgagcgagggcacccagaccgtcctctctccctctgtcacctgtggtcctactggacttctgctttgccggcctgtgatcctcacaatgccacactgcgcagaggtgtccgccagggactggatcttccagctgaagacgcaagcccatcaggggcattgggaagaagtggtcacactcgacgaagagaccctcaatacaccgtgttattgccagcttgaacctcgagcatgtcacattctcctagatcagctgggtacatacgtgttcaccggcgagtcctatagccgcagcgcagttaagcgactgcagctcgctgtcttcgctcctgcactctgtaccagcctggagtacagtctccgcgtgtattgtcttgaggatacccccgtcgccctaaaggaagtcctggaactggaaaggactctggggggatacctggtcgaagaacctaaaccgcttatgtttaaggactcctatcataacctgcggcttagcctgcacgacttgccccatgcacactggaggtcaaaactcctcgccaagtaccaagaaattccgttttatcacatttggagtgggtctcagaaagccctgcactgcacattcactctggagcgccactctctggcctcaaccgagttgacatgcaaaatatgcgtccggcaagttgaaggggaggggcagattttccagctgcacacgactctagccgagacaccagccggtagcctagatacgttgtgttctgcaccaggctctacagtaacgactcagctgggcccttacgcgttcaaaatcccactcagtatcaggcagaagatttgcaacagtcttgatgcacctaactccaggggaaatgactggcggatgctggcccaaaaactctccatggacagataccttaattactttgccactaaagcctccccaaccggtgtgattctggacctctgggaggcccttcaacaagatgacggtgatctgaactctctggctagtgcgctcgaagagatgggaaaatcagagatgcttgtggcagtggccaccgacggcgactgctag

SEQ ID NO: 246279 - DNA, 2805 bp, Artificial Sequence
  Description of Artificial Sequence: Synthetic coding sequence
atgggagccaggagcggcgcacggggtgccctcttgttggccttgttattatgctgggatccgagattgagccaggccggaacagacagtggctcagaagtcctgcccgactcttttccatcagcaccagcagaaccactgccttactttttacaagagcctcaggacgcttacatcgtgaagaataagccggtggaactccggtgtcgtgccttccccgctacacagatctattttaagtgtaatggggaatgggtttcccagaatgaccacgtgacccaggaaggattggatgaggcaaccggtctgcgtgtgcgggaagtccagattgaggtgagtcggcagcaggttgaagaactattcgggttagaagattactggtgtcaatgcgtggcatggtcttctgccggaactacaaagtctcgtcgggcatacgtacggatcgcatacttgcggaagaatttcgatcaagagcccctgggcaaggaagttcccctggaccatgaggtcctgctccagtgtagacctcccgaaggggtgccagtggccgaggttgaatggttgaaaaatgaagacgtaatagaccctacccaggatactaattttctcctcactattgaccacaacctcatcatccgccaggctagactgagtgataccgctaattatacatgcgtcgcaaagaatattgtcgccaagagaagatcaacaaccgctacagtcattgtttacgtgaacggcggttggtctagttgggccgaatggtctccctgtagcaacagatgcggcagggggtggcagaagaggaccaggacctgcacaaatccagcccctttaaacggaggcgcattctgtgaggggcaggccttccagaaaacagcatgcacgacaatatgtcctgtggacggagcatggaccgagtggtccaaatggtccgcttgttcaacggaatgcgctcactggcggtctcgagagtgtatggcacctccgccacagaacggtggcagggattgcagcggtactcttctggatagcaagaattgtacagacggcctgtgtatgcagatgctggaagcaagcggcgacgccgcactatacgcagggctcgtggtcgcgatctttgtcgtggtggcaatccttatggccgttggtgtcgtcgtctaccggcgtaattgccgcgatttcgataccgatattacagattccagcgccgctttaactggtgggtttcatcccgtgaattttaagactgcgagaccttcaaatccacagctgctccacccatctgtcccaccagacctgacggccagcgccggaatttatagaggacccgtgtatgcattgcaggacagtaccgacaaaattccaatgaccaattcccccctcctggatccccttccctctctgaaggttaaagtttatagtagctctaccacgggaagcggaccagggctggcagacggagctgatctcttgggcgtgctgccgcctggaacctatccttcagacttcgcgagagacacacacttcttgcacctccggtctgcttctttgggcagccaacaactgctgggtctgccgagagatccaggctcatcagtgtccggtacattcggttgcctgggcggaagactctcgatccccggaacgggtgtgagcctgttggtgcccaatggggctatcccccaggggaaattttatgaaatgtacctcctcatcaataaagccgagagcaccctcccgctttcggagggcacacagacagtgctgtcaccctccgtcacgtgcggacccacgggactccttctttgccgacccgttattctaacaatgccccattgcgccgaggtcagcgctagggactggattttccaacttaagactcaagcccaccaggggcattgggaagaagtggttacactcgatgaagaaaccctgaatacaccgtgctattgtcagttagaaccaagggcctgccacattcttctggatcaactggggacctacgtgtttactggtgagagttactcccgcagtgccgttaaaaggctccagctggccgttttcgctccagccctgtgtacgtctctggaatactcactgcgggtatattgtctggaagacacccccgtggccctgaaagaggtcctggaactggaacgcacattagggggatatcttgtggaagaacccaaacccctgatgttcaaggattcctaccataatctccgcctgtctctccatgatcttccgcatgcccactggaggtctaaactgctggcaaagtaccaggaaatcccgttctaccatatatggtcggggtcccagaaagctcttcattgtacattcacattagagcgccactcattggcttctactgagctgacctgcaaaatctgcgtcagacaggtcgagggcgaaggtcaaatcttccagctgcacaccactctcgcggagactccagcaggatccctcgataccctttgcagcgcacccggaagcactgtaacgactcagttgggaccatatgcctttaaaattcctctgagcataaggcaaaaaatctgtaactccctagacgcccctaattcccgcggaaatgattggcgcatgctggctcagaagctcagcatggacaggtatctgaattatttcgccaccaaagcttcgccaactggggtcatactggacctctgggaagctctgcagcaggacgatggagacctgaatagcttagcaagtgctctcgaggagatgggcaagagtgaaatgcttgtcgccgtagctacagacggagattgctag

SEQ ID NO: 246280 - DNA, 2673 bp, Artificial Sequence
  Description of Artificial Sequence: Synthetic coding sequence
gacgacgactttttccacgaactgcctgaaacttttccaagcgatcctccagaacccttgccgcactttctgattgaaccagaggaggcatatattgtgaaaaacaaaccagtgaatctttattgtaaagcgagtcctgcaacccagatttactttaagtgtaactccgaatgggtgcaccaaaaagaccatatcgttgacgaacgggtcgacgagacgtcgggtctcatcgtacgtgaggtgtcaattgaaatctcacgccagcaggtggaagaattgtttggccctgaagattattggtgccagtgtgttgcatggtcatcggccggaaccactaaatcccggaaggcatatgtgaggatcgcttatctgcggaaaacttttgagcaagagcctttaggcaaggaggtgagcctggagcaggaagtgttacttcagtgtaggcctccggaggggattccagtggcggaagtggagtggttgaagaacgaggacatcatcgatcccgtggaagaccggaatttctatatcaccatcgaccataacctcataattaagcaggcacggctgtctgatacagccaattacacgtgcgtcgcgaaaaacatcgtagcaaaaagaaaatcaactactgcgaccgtgatagtttacgtgaacggagggtggagtacatggactgaatggtctgtttgtaactcgaggtgcggaagaggataccagaagcgaacacggacttgtacgaatccagccccacttaatgggggtgccttctgcgaaggccagtctgttcagaagatagcatgcactacattatgccccgtagacggaaggtggactccttggtcaaaatggtccacctgtgggacagaatgcactcactggaggcggagagagtgtaccgccccagccccaaaaaatggtggaaaggactgcgatgggctggtcctgcagagcaaaaactgcactgatggattgtgcatgcagaccgctcctgacagtgatgacgtcgcactgtacgtagggatcgtcatcgctgtcatcgtgtgtctggccatctcagtagtggtcgctttgtttgtgtatcgaaaaaaccacagggactttgagtctgacatcatcgatagctcggccctgaacggaggcttccagcccgttaatattaaggctgccagacaagatctgctagctgtacccccagatttgacatccgctgccgctatgtatcgcggaccagtctacgccctgcacgacgtctccgataagattcctatgacaaactcgccgatccttgatcccctaccaaacttaaagattaaggtctacaatacttcgggcgcagttactccacaggacgatctgtctgaattcacttccaagctctccccccagatgactcaaagcctgttggagaacgaggcactgtctttgaaaaaccagtccctcgcaaggcagacggacccctcttgtacagcatttggaagcttcaacagtctgggcggtcacctaattgtgccgaattccggggtcagtcttctcattccagccggagctatcccgcaagggagagtttacgagatgtatgtgaccgtgcacagaaaggaaactatgaggccgccaatggatgattcccagacactgttaaccccagtggtttcatgcggtcctcccggtgccctgctcactaggccagtcgtcttaacaatgcaccactgtgccgatcctaatactgaagactggaaaatcctgttaaagaatcaggcggctcaagggcagtgggaggatgtggtcgtggtaggcgaagagaactttaccactccatgctatatacaacttgacgccgaagcttgtcatattctgaccgagaatctgtctacatacgccctggtcggccattccacgaccaaggcagcagctaagcgactgaagctcgccatcttcggtccactctgctgctcctctttggagtacagtatcagagtatattgcctggacgatacccaagacgccctgaaggagatactgcacctggagcgccagatgggcggtcagctgctggaagaaccaaaggcacttcattttaaaggcagtacccataacctcaggctgtctatccatgatatcgctcattctctctggaaaagcaagctgcttgctaaataccaagagatccccttttaccatgtgtggtcaggctcccagcgtaacttgcattgtacatttactctagagcgcttttcgcttaataccgtcgagttagtatgcaagctctgtgttcggcaagtggaaggagagggccagatcttccagctgaactgtacagtatctgaagagcccaccgggatcgatctcccacttctggacccagcaaacacaattacgacagtgacagggccatcagccttcagcatccccctcccgattcgccagaaattgtgttctagcctggacgctccacaaacaaggggacacgactggagaatgctcgctcacaaactaaatctggatcgctacctcaactattttgcaactaaatcatctccaacgggcgtgatcctagatctttgggaggcccagaacttccccgatggaaacttgtctatgttggccgctgtgctggaagaaatgggcagacatgagacggtggtgtccctcgccgcagaggggcagtactag

SEQ ID NO: 246281 - DNA, 2796 bp, Artificial Sequence
  Description of Artificial Sequence: Synthetic coding sequence
atgcgtaagggtcttcgcgcaacagcggcacgatgcggcctgggattggggtatctactgcagatgctggttctccccgcactcgcgctgctctctgcaagcggaaccggttcggcagcccaggacgacgatttttttcatgagctgccagaaacattcccgagtgaccctcccgagccattgccccacttcctcattgagcctgaggaggcttacattgtcaagaacaagcctgtcaatctgtactgtaaggcttcacctgcgacacagatctattttaagtgtaacagtgagtgggtgcaccagaaagaccacattgtcgacgaacgagtggacgagacatcaggtctgatcgtaagagaggtaagtatcgaaatcagcagacaacaagtggaggaactgtttggcccagaagattactggtgccagtgcgtggcatggtcaagcgccggtactaccaaaagccggaaggcctacgttaggattgcttacttgagaaaaacatttgagcaggagccgttaggcaaggaagtctccttagagcaggaagttctgctgcaatgccgaccgcctgagggtattcctgtcgccgaagtggaatggctcaagaacgaggatatcatcgatcctgtcgaagacagaaacttctacataacgatcgaccataacctgatcataaaacaagcacgactcagcgatactgccaattacacttgtgtggcaaagaatatcgtggctaagagaaaaagcaccaccgccaccgtgatagtctacgttaatggcggttggtccacgtggaccgaatggtctgtgtgcaacagccggtgtgggaggggatatcagaaacggaccagaacgtgcactaatccagccccacttaatggcggtgccttctgcgaagggcagtctgtgcagaagatagcctgcacaaccctgtgtccagtcgacggccgatggactccatggtccaagtggtccacctgtggcactgagtgtactcactggagaagaagagaatgtaccgccccagccccaaaaaacggaggcaaggattgtgacggacttgttctgcaaagcaagaattgtactgatggtctgtgcatgcagaccgcccctgattcagatgacgttgccttgtacgttggaatagtgatcgcagtgatagtgtgtttggccatctccgtggtcgtggctctgttcgtctaccgcaaaaaccaccgtgatttcgaatccgatatcattgacagcagtgctcttaacggagggtttcagcctgttaatatcaaagctgcaagacaggacctacttgccgtcccacctgatctgactagcgccgcagcgatgtaccgcggacccgtgtacgccctccacgacgtttccgataagattccaatgactaatagccctatcctcgaccctctccctaaccttaaaataaaagtttacaacacttccggggcagtgacacctcaggatgatctgtctgagttcacctctaagctttccccacagatgacacagagcctccttgagaacgaagctctttcgttgaagaatcagtcactcgctcgtcagaccgatccctcatgcactgcatttggatccttcaactctctcggaggccatctgatagttcctaacagtggagtgtcccttctcatccctgcaggagccatcccacaaggaagggtttacgagatgtacgtgactgttcaccgaaaagaaactatgcggcctcctatggatgactcacagactctgctgacaccagtggtgagctgtgggccacctggggcactgctaacaagacccgtggtgctgaccatgcatcactgtgctgatccaaacaccgaggactggaaaattttgcttaaaaaccaggccgcacagggccagtgggaagatgtggtcgtcgttggcgaggaaaattttaccactccctgctacattcagctggatgcagaagcatgtcatattttgaccgaaaatttgagcacctatgcattggtaggccattcaaccacaaaagccgcagccaaaaggctcaagcttgctatcttcggacccttatgctgtagttcattggagtacagcattcgggtctactgccttgatgacacccaggatgcattgaaggaaatcttgcatttggagcgacaaatgggaggccaactcttagaggaacctaaggccttacacttcaaagggagcacgcacaacctgcggctgtcgatacatgacattgctcatagcctctggaaatctaaactgcttgccaaataccaagaaatccctttctatcacgtttggtctggttctcagcgtaatctgcattgtactttcacgctcgagcgattcagtctgaacactgtcgaacttgtgtgtaagctctgcgtgcgccaagttgaaggtgagggccaaatcttccaacttaattgtaccgtgagtgaagaacccactgggattgaccttcccttattggatcccgctaataccataactacagtgaccggccctagcgccttctctatccctctgcccatccgacaaaagctgtgttcttctttggatgctccccagacacggggacacgactggagaatgttggcccataagctaaatctggatagatacctcaattacttcgcaacaaaatccagtccaacgggagtgatcctggacctttgggaggcccagaactttccggacggtaacctctccatgctggccgctgtgctggaagagatgggacgacacgagacagtggtcagtcttgctgcggaaggacagtattag

SEQ ID NO: 246282 - DNA, 3153 bp, Artificial Sequence
  Description of Artificial Sequence: Synthetic coding sequence
atggagcccggaagaggaggcactgaaacagtgggcaagttcgaattctctagaaaagatctgatcgggcacggagcgttcgcggtcgtgttcaaaggcagacaccgggagaagcatgacttggaagtcgccgtgaaatgcataaacaagaagaacctggccaagagccaaaccttgttaggcaaagaaataaaaatcctgaaggagctgaagcacgagaacatcgtcgctctatatgactttcaagaaatggctaattccgtgtacctagtgatggaatattgtaacggcggtgatctcgccgactatctccatgcgatgagaactctatccgaggacacaatccgactattcctgcaacagattgccggagcaatgcggctccttcatagcaaaggcattattcaccgagacctgaaacctcagaacatccttctgtccaatccagccggtagacgagctaaccccaacagcatacgggtgaagattgctgatttcgggttcgctcggtacttgcagtccaatatgatggccgctacgctgtgcggcagtcccatgtacatggcacctgaagtaattatgtctcagcattacgacggtaaagcggacctgtggagtattggcacgatcgtttaccaatgcctgactggaaaggcacctttccaggccagcagcccacaggatcttcgcttgttttacgagaagaacaagactttggttccgactattccacgggagacctctgcccctctgcgccaacttctcctggcactgttgcagcgtaatcacaaggaccgaatggattttgacgagttcttccaccacccctttctggatgcctcacccagcgtgagaaaatctccgcctgtccccgtcccttcatacccaagttctggctcaggttcttcgtcttcgagctcctcaacatcccatctcgccagccctcccagtctgggcgagatgcagcaactgcagaagactctggcatctcccgctgacaccgccggatttttgcacagctcacgcgattcaggaggatcaaaagactcatcttgtgatactgatgacttcgtgatggtccctgcgcagtttcccggtgatctggtggccgaagctccttcagcgaaaccccctccagactctctcatgtgtagcggctctagcctggtcgcaagcgcaggacttgaatcacacggcagaactccatctccgagtcccccttgttcttcctcacccagcccttcaggccgtgctggacctttttcctccagcagatgtggcgcttccgtgcctatccccgtgcctactcaagtgcaaaactatcaacgaatagagaggaatctccagagccctactcagtttcagacccctcgttcctccgctattcggaggagcggatctaccagccctctcgggttcgctcgggcatccccttcaccgcctgctcacgctgagcatggtggcgtgctcgcaagaaaaatgagcttgggtggtgggagaccttatactccgtcaccccaagtggggaccatcccagagcgcccagggtggtccggcacacctagcccgcaaggtgcggaaatgcgcggtggccgaagccctaggcccggttccagcgcgccagaacattctccgagaacctctgggttggggtgtaggctccatagtgctcctaacctgtccgacctgcacgtggtgcgacctaagctgccaaagccacccacggacccactcggagcagtctttagccctcctcaggcttctccaccacagccctcgcatggcctgcagtcctgccgcaacttgagagggtcccccaaacttcctgatttcctccaaagaaatcctcttccccctattctggggagcccaactaaagcagtgccttcgtttgatttccctaaaactccttccagccagaatctactggcccttttagcacggcaaggggtcgtgatgacgcccccaaggaacaggacccttcccgacctgagcgaagtaggcccatttcacggacaaccccttggcccaggcctgcgccctggcgaggaccccaagggcccattcggacggtctttcagtaccagtaggctgaccgacctgttgttgaaagccgctttcggaacacaagcccctgatccaggcagtacggagagtctgcaggagaaacccatggagatcgcacctagtgctggcttcgggggatctttacatccaggggcaagggccggtggaacctccagccccagtcccgtggtctttaccgttggcagccccccatccggatcgacaccaccacagggaccgagaacgcggatgttttctgcaggacctactggctcagcttcatcctctgcaagacatctcgtccctggcccttgctccgaggccccagctccagagctacccgcacctggacacggatgcagctttgccgaccccataaccgctaacctggagggggcagtcactttcgaagcaccagatctccctgaggagaccctcatggaacaagaacacacagagattctgcgtggcctgcgatttacgctgctcttcgtgcagcacgtgctagagatcgctgctcttaaaggaagcgcgtctgaggctgcaggcggacctgagtatcaactccaagaaagtgtggttgcagatcagatttctctgttgtctagggagtgggggttcgcagaacagctcgtgctgtatctgaaagtggctgaacttctgagttcaggcctccagtccgccattgatcagatccgcgcaggaaagctgtgtcttagtagcacggtgaagcaggttgtgcgcagacttaatgagctgtacaaagcctccgtggtatcatgtcaggggctgtccctgcggctacagcgcttttttttagacaagcagcgcctcctggacaggatacattccatcacagccgagagactgatttttagtcatgccgtgcaaatggtgcaatccgcggcactagatgagatgtttcagcaccgggagggatgtgtgccacgctaccacaaagccctgctgctgttggaggggcttcagcacatgctcagcgatcaggccgatatcgagaacgtgacaaagtgtaaactttgtattgagcgtcgactctcggcgctcttaactgggatttgtgcctag

SEQ ID NO: 246283 - DNA, 1452 bp, Artificial Sequence
  Description of Artificial Sequence: Synthetic coding sequence
atgcagagaaatggcagcgccagccgtggactggagaagacacggcttcggctttgtcgggaagcccgtatccccgagagtgcttttctgactggcctgacccgggaaagctgggaggctcgttgttggtgtgcaaaagatactagggaggttgtagctatcaaatgcgtggccaagaaatcattgaataaggcatctgtggagaatctcctgaccgagatagaaatcttgaaggggattcgacacccacacatcgtgcagctcaaggattttcagtgggattcagacaacatatatcttatcatggagttctgcgcaggtggcgacctgagcaggttcatccacactcggcgaatccttcccgaaaaagtcgccagggtgtttatgcaacagctcgcatcagcccttcagtttttgcatgaacgcaatatcagccatctggacctgaagccccaaaacattctgctgtctagtctggaaaaaccacacctgaagctggcggattttggctttgcacagcatatgtccccctgggatgagaaacatgtgttacggggaagtcccttatacatggctcccgaaatggtgtgccagcgccaatacgatgctagagttgacctgtggtccatgggtgtgattctgtatgaagcgctgttcggtcaaccaccattcgccagtcgatcctttagtgagctcgaagagaaaatcaggagcaaccgggtcatagagctcccccttagaccactcctttctagggactgcagagaccttcttcagcgattgctggagcgggatcccagcagaagaatctcattccaagatttctttgctcatccatgggtggacctggagcatatgccgtcgggagagagcctggggagggccactgcccttgtggtccaggcggtaaagaaggatcaggaaggcgacagcgctgcagctttaagcctctattgtaaagccctggatttttttgtgcccgcactccactacgaggtcgacgcccagcggaaggaggcgattaaggctaaagtggggcagtatgttagcagggcagaggagttgaaggccattgtgtcaagctcgaatcaagcgctgttaaggcaggggacaagtgcacgggacctcctgagagagatggcaagagataaaccacgcctgttggctgccctggaggtagccagcgctgctatggccaaggaggaagcagcaggtggcgaacaagacgcattggatttgtatcagcattccctgggggagctcctcctcctgctagccgctgagccaccaggcaggcgcagagaactcctccacaccgaagttcagaacctgatggcacgtgccgaatatttgaaggaacaggtcaagatgcgcgagtccaggtgggaggcggacaccctcgacaaagagggtctctctgaatctgtccgctcttcttgcactttgcagtag

SEQ ID NO: 246284 - DNA, 1419 bp, Artificial Sequence
  Description of Artificial Sequence: Synthetic coding sequence
atggccggtcccggatggggaccgccaagactggacggctttattctgaccgagcggctgggttccggaacctacgcgacagtttacaaagcctatgcaaagaaagatactagggaggtggtagctatcaaatgcgtggcaaaaaagtctttgaacaaagcctcggtcgagaatttgcttactgagattgagatactgaaagggattcgacacccgcacattgtccaacttaaggatttccagtgggatagtgacaatatctacttaatcatggagttctgtgctgggggtgacctctctcgcttcatacacacacgacgaatattaccagagaaggtggcacgggtatttatgcagcagctggcctcagcactacagtttctgcacgagagaaatatctctcacctcgaccttaagccacaaaacatcctcctgtcaagcttagagaagcctcatctcaagctggccgactttggcttcgctcagcatatgtctccctgggatgagaaacacgtgctccggggatcgccgttgtatatggctcccgagatggtgtgccagcggcagtacgatgcgagagtcgacctctggagcatgggagttattctctacgaggcactatttggccagcccccatttgccagccgcagctttagcgagctcgaagagaagattaggagcaatcgagtcatcgaactgccccttcggcctctgttgtcaagagattgtagagacttgttgcagcgtctgctagagagagatccatctcgacgaataagtttccaggatttcttcgctcacccatgggtcgatctggaacacatgccttccggggagagcctggggcgagctacagcactggtggttcaggctgtgaagaaggaccaggagggagattctgccgcagccctgagtctttattgcaaagccttagattttttcgtgccagctctgcattacgaagtggacgcacagcgcaaggaagccattaaagctaaggttgggcaatatgtgagccgcgcagaggaactgaaggctattgtgtcaagcagtaaccaggcactccttagacaaggtacatccgccagagatcttttgcgggaaatggcgagagataagcctcggcttctggcagcactggaggtcgcatcagccgctatggcaaaagaggaggctgcgggaggagagcaagacgcacttgacctgtaccagcatagcctcggggaactgctcctgctgttggctgctgaaccacctggcagacgccgagagctcctccatacggaagtgcagaatctcatggctagggctgaatatctcaaagaacaagtcaaaatgagggagtcaagatgggaggccgatacccttgacaaggaaggtcttagcgaatccgtgagatcttcatgtacattgcagtag

SEQ ID NO: 246285 - DNA, 9705 bp, Artificial Sequence
  Description of Artificial Sequence: Synthetic coding sequence
atggtgaagcggaagagctccgagggacaggaacaagacgggggaaggggcatccccttgcctattcagacattcctgtggcgtcagacttctgccttcctgaggccaaaattgggaaaacagtatgaggccagctgtgtttccttcgaaagggtccttgttgaaaacaagttgcatggccttagccctgccctcagtgaggccattcagtccatatcaaggtgggagctggtccaggctgctctgccacacgtgttacactgcaccgctacactcctaagtaaccggaacaagctcggccaccaggataagcttggagtggcagagaccaaactgcttcatacgctgcattggatgctgctcgaagctccccaagactgtaacaacgagaggttcggtgggactgacagaggatcatcttgggggggtagttcatccgccttcatacaccaggttgagaaccagggcagtccagggcaaccctgtcaatccagcagcaatgacgaggaagaaaataacagaagaaaaattttccagaatagcatggcaaccgtggagttgttcgtgtttttgttcgccccacttgtgcacaggatcaaagagagcgacctgaccttcagactggcctctggcctcgtgatctggcagcctatgtgggagcaccgacaacccggtgtaagtggctttaccgcactggttaagcctatcaggaatattatcactgcaaaaaggtcatcacctatcaattcccaatcaaggacatgtgagagccctaatcaggacgctcggcaccttgaaggacttcaagttgtgtgtgagacttttcagtccgattcaattagccccaaagcaacaatcagcggctgccacagggggaactccttcgatggctccctgtccagccaaacttctcaggaacggggacctagtcatagccgcgctagtctggttattccaccctgccagcggagtcgatacgccacatactttgatgtagcggttctgcggtgtctgctgcagcctcattggagcgaagaagggacacagtggtctctcatgtactacctgcagaggctcaggcatatgctggaggagaaacccgagaagccccctgagccagacataccattgcttcctcggcctcgcagcagtagcatggtggctgcagcacccagcctggttaatacacacaagacacaggacctcacgatgaaatgcaatgaggaggaaaagtcgctttcttccgaggcattcagcaaagtcagcctgactaatctgaggcgctcggccgtcccggatttaagctcagacttgggaatgaatattttcaagaagttcaaaagccggaaagaggatcgcgagaggaaaggctccattccgtttcaccacacaggcaagcgacggcctcgaaggatgggagtacccttcttactgcatgaggaccacctggacgtgtcccccacccgctctaccttctctttcggaagtttttccgggttgggagaggaccggaggggtatcgaaaaaggtggatggcaaaccactatcttgggcaagctgacaagacgaggtagtagcgacgccgcaacagagatggagagcctcagcgccaggcactctcacagccaccacacactcgtgtcagacctgcctgatcccagcaattcccacggcgaaaataccgtaaaggaggtgagaagtcagatttcaacaatcacagtggccacattcaatacaactctcgcaagcttcaacgtgggatacgcagacttcttcaatgaacatatgaggaaattgtgtaaccaggtgcctatcccagaaatgccgcacgaaccccttgcctgtgccaatctgcctcggtcattgaccgactcttgcataaactattcttatttagaggacacagaacatatcgatggaactaataattttgtacacaagaatggaatgttagatctgagtgtggttctaaaggcagtgtatcttgtgctgaaccacgacatctccagcagaatttgcgatgtcgctctcaacattgttgaatgtcttctccagcttggcgttgtgccttgcgtagaaaagaatcgaaagaaatccgagaacaaagagaacgaaacgttagaaaaacggccttcggagggcgcattccagtttaaaggcgtttccgggagctccacttgtggcttcgggggaccagcagtaagtggtgcaggggacggaggtggggaagaagggggaggtggggacggcggaggcggagggggtgacggcggaggcggtggcggtggaggcggtggtccctatgaaaagaacgacaaaaaccaggagaaagacgagagcacacccgttagtaaccatcgcctggccttgactatgctgatcaaaattgtaaaatctttaggctgtgcatacgggtgtggagaaggccatagagggttgagcggggataggttgcggcatcaggcacaaaactgcttaaccaagctgtataagttagacaagatgcaatttaggcaaacaatgcgtgattatgtgaataaggactctctaaataacgtggttgactttctgcatgcactactgggcttttgtatggagcctgtcaccgacaacaaggccggttttggaaataactttaccactgtcgacaataaaagcactgcccagaacgtggaaggcatcattgtgagcgcaatgtttaagagtctaatcactcgttgcgccagcaccacccacgagcttcattccccggagaacctcggattatactgtgatatccgccaactagtacagtttattaaggaagctcacgggaacgtgtttagacgggtcgcactttcagctctgctggacagtgcggagaaactggctccagggaagaaggtagaagagaatgagcaggaaagtaaacctgctggaagcaaacggtccgaagcaggttccatcgtcgacaaaggtcaagtttctagcgccccagaagagtgccgctcctttatgagtggaaggccttcacaaacccccgaacacgatgagcagatgcagggagccaatcttggcaggaaagatttctggcgcaaaatgttcaagtcccagtccgctgccagtgatacctcctctcagtctgagcaggacacgtctgaatgtacgaccgcccattccggtacgacatcagaccgacgggcacggagcagatctcggcgaatatctctgcggaagaaactgaaactgcccattgggaagcgtaactggctgaaacggagcagtctgagtggactagccgacggcgtagaggatttgttggatattagctcggtggatcgactatcttttattcgccagagttctaaggtaaaatttacgtcggctgtcaaactgtctgagggcggacctggaagtggcatggaaaacggcagagacgaggaagagaacttcttcaaaagattgggctgtcactcctttgacgaccacctgtctcctaaccaggatgggggtaagagtaaaaatgtggtgaatctgggcgcaatcaggcagggcatgaagcggtttcagttcttgcttaattgttgcgagcctgggacaattcccgatgcttccatcctcgccgctgcccttgatttagaagcccctgttgttgctcgggcagctttgtttctcgagtgcgccagatttgtacacaggtgcaaccggggaaactggccagagtggatgaaggggcaccatgtcaacataacgaagaagggcctcagcaggggtcgcagtcccatagtgggaaacaagagaaaccagaagctgcagtggaatgccgctaaactgttctatcagtggggagacgcgattggggttaggctgaacgaactgtgccacggcgaaagtgagtctcccgctaatctgctcggcttgatatacgacgaggaaacaaagagacgactccgcaaggaggacgaagaagaggactttttggacgacagtacagtgaatccttcgaaatgcgggtgccccttcgcgctcaagatggccgcttgtcagctcctgctggagattacaaccttcttgagagaaaccttctcatgcctcccaaggccccgaacggagcctctcgtggatctggaaagctgccgccttcggctcgatcctgaactcgatcggcaccggtatgagagaaaaatttcgtttgctggtgttctggatgagaacgaggatagtaaggactctttacacagctcttcacacacattgaagagtgacgccggtgttgaagagaaaaaggagggttctccatggtcagctagtgaaccatctattgaacctgagggcatgagcaacgccggtgctgaagagaattaccacagaaatatgtcctggctccacgtgatgatactgctgtgcaaccaacagtcattcatatgtacccatgtggattattgtcatccccactgttatctccatcactctcgctcctgtgcgaggttagtgcgcgcaatcaaactcctatatggggactctgtggactcccttagagagtcctcgaacatttcctccgtggccctgcggggaaagaaacaaaaggagtgttctgacaagtcatgtctaagaacccccagcttgaagaaacgcgtgtccgatgcaaatttagagggcaaaaaagattcgggaatgctgaagtacatccggctgcaggttatgagcctttctcccgcacctctgtccctgctgatcaaagcagcccctattctgacggaggaaatgtatggggacattcagcccgcagcttgggaactgctgttgtctatggacgagcacatggccggagccgcagctgctatgtttctgctgtgtgccgtcaaggtgcctgaagccgtgtctgatatgttgatgtccgaattccatcaccccgaaactgttcagcggctgaacgcagttctgaaatttcacacattgtggcgctttcgatatcaggtctggcccaggatggaggaaggtgcacaacagattttcaagattccaccgcctagcattaatttcaccttaccatcccctgtgcttggaatgccgtcagtacctatgtttgatccaccttgggtcccccagtgcagcgggtccgtgcaggatccaatcaacgaagatcagtccaagtcatttagcgctagggccgtgagccggagccaccagcgtgctgaacatattcttaaaaacttgcagcaagaagaggagaagaagagactcgggagggaggccagcctgattaccgccatccccatcacacaggaagcatgctatgaaccaacatgcacaccaaactctgaacccgaagaagaggttgaagaggttacgaacctcgcttcgcgacgcttgtctgtgtccccaagttgtacatccagtacatctcatcgaaattactcgttccggcgagggagtgtatggtctgtcaggtcagccgtgagtgctgaggacgaggaacacacgacggaacacacccctaatcaccacgtcccacagccgcctcaagctgtgtttcctgcgtgcatttgcgcggctgtgttgcccatagtgcatttgatggaggacggagaggtccgagaggacggcgtggcagtgagcgccgtcgcccaacaggtgctgtggaactgcctgatcgaagatccctcaactgtgctgcggcatttcctcgagaagctgaccatttccaaccgccaggacgagctgatgtacatgttgcgcaaacttctcttgaatataggcgacttccctgcccagacatctcacatattgttcaactacttggttggcctgattatgtatttcgtgagaacaccctgcgaatggggcatggacgccataagcgccacattgacatttctgtgggaggtggtgggctacgtagaaggattgtttttcaaagatctcaaacaaacaatgaagaaggagcagtgtgaggtcaagctgctggtcaccgcatccatgccaggtactaaaaccctggtggtacacggccagaatgagtgcgatatcccgacgcagctgcccgtgcacgaagacactcaattcgaagccctcctcaaagaatgtttagagttctttaatataccagagtcccaatccacccactattttcttatggacaagcggtggaacctgatccattacaacaaaacatatgtcagagacatttacccatttaggaggtcagtcagtcctcagcttaacctggtccatatgcaccctgaaaaagggcaagagcttattcagaaacaggtcttcaccagaaaactggaggaggttgggagggtgctgttcctcatatccctgactcagaagattccgactgctcataagcaatctcatgtcagtatgctacaggaagacctgctccggctgccttcctttcctcgctcagcgatcgatgccgaattctctctcttcagcgacccacaagcaggcaaagaactgtttggccttgataccctgcagaaaagcctctggatacaactcctggaggaaatgttcctagggatgccgtccgagtttccctggggcgatgagatcatgctgtttctgaatgtgtttaacggggctttaatactgcatcctgaagacagtgccttgctcagacagtacgcagccaccgtgatcaatacagcagtgcactttaaccaccttttctcactgagtgggtaccaatggattttacccacaatgctgcaagtgtattccgattacgaatctaaccctcagttaagacaggcgatagagtttgcttgccatcaattttacattctgcaccggaaacccttcgtactgcagctttttgcttcagtggcaccattgttagagttccctgatgcagctaacaacggcccaagtaagggtgtaagcgctcagtgcctcttcgatctgctgcaaagccttgaaggagaaaccaccgatatcctggatatattggagctggtcaaggcggaaaagccactcaaaagcctagatttttgttacgggaatgaagacctgaccttcagcattagcgaagcaatcaaactctgtgtcactgtagtggcgtacgcgccagaaagcttccgctccctgcagatgctcatggtcctagaagctctggtgccatgctacctgcagaagttaaagcggcagacaagtcaggtggagacagtccccgctgctcgggaagaaattgctgccactgcggcactcgccacatctctgcaggcattgctgtactcagtggaagtgctcactcgcccaatgacagccccacagatgagtcgttgcgaccaggggcacaagggcacaacaactgcgaatcacaccatgtctagcggagtgaatacccgatatcaggagcaaggggcaaagctacattttataagagaaaatctgcaccttctggaagaggggcaaggcatacccagggaagagcttgatgagcgaattgcccgtgaagaattcagacgaccgagggagtcactccttaatatctgtaccgagttctacaagcactgtgggcctcgcctcaagatcctccagaacctagccggtgagccacgagtcatagccctggagctgctggatgttaagtctcacatgcgtctcgcagagattgcacactctcttttaaagcttgcaccctacgatacacagacaatggagagcagggggttgcggaggtacataatggaaatgctcccgattactgattggaccgcggaggcggtccgccctgcattgatcttaattcttaaacggttagaccggatgtttaataagattcacaagatgcccacgctgaggaggcaggtggagtgggaaccagcatcgaacctgatcgagggtgtctgtctgaccctgcagcggcagcctatcatatctttcctcccacacctccgatctctgatcaatgtgtgcgtcaatttggttatgggcgtcgtaggtccttcgagcgtcgctgacgggcttcccctcctgcatctgtctccctacttaagtccaccccttccgttcagcactgcagtagtacgtctggttgctctccagatccaggcactgaaggaggatttcccattgagtcatgtaatatcaccctttaccaatcaggaacggcgagagggaatgctactgaatttgctcatcccatttgtgttaacagtgggctccggatcaaaagattcaccttggctggagcaaccagaggtccagctccttctccagaccgttatcaatgtcctgttgccgcctcgcatcatatccaccagcaggtccaagaatttcatgcttgaatccagccctgcccactgtagtacccctggagacgcaggtaaagatctgcgtagggaaggtttagctgaatcaacctcacaagccgcttatttggccctcaaagtaattctggtgtgcttcgagaggcagttgggtagccagtggtactggctgtcccttcaggtgaaagaaatggcattaaggaaagttggtggcctcgccctgtgggatttcctcgatttcatcgtccgcacccgaatcccaatcttcgtattgctgaggcccttcattcagtgtaagttgctggcccagcctgctgaaaatcatgaagaactcagcgctaggcagcacattgctgaccagctcgagcgcagattcattccgaggcccttgtgtaagagttccctcattgccgaatttaatagcgaacttaaaattctgaaggaagcggtgcactccggttctgcatatcaggggaaaacctccatttcaaccgtgggcacctcaacatccgcctatcgtctgagtctcgctacgatgagccgcagcaacaccggcactggaaccgtttgggaacaggactcagagccttcacagcaggcctctcaagacaccctctctagaacagacgaggaggatgaagaaaatgactcaatatccatgccctctgttgtgtccgagcaggaagcctatttgctgagtgctattggcaggagacgcttcagctcacatgtgagctccatgagcgtgccccaggccgaggtcgggatgttaccatctcagagggttgcctccattcaatctgagccaggacaacaaaacctgctcgtgcagcagccgttagggagaaagcgcggactgagacaactcagaaggcccctcctcagcaggcaaaaaacacaaaccgagcccagaaaccgacagggtgcacgcttaagcacaaccaggcgaagtatccagcctaaaaccaaaccttcggctgatcagaaaagatctgtgacattcatcgaggctcagcctgagccggcagctgcgccaactgacgccctgcccgctactggtcagcttcaaggatgttccccagccccatcccgtaaaccagaggcaatggacgaacctgttctgacctctagccccgctattgtggtggctgatctacacagcgtgtccccaaaacagtcagagaatttccccacggaagaaggagaaaaggaagaggacacagaggcgcagggcgcaaccgcgcattccccacttagtgctcagcttagtgatcctgacgatttcactggacttgaaacctctagcctcctgcaacatggtgacacggtcttgcacatatctgaagaaaacggaatggagaaccctttactgagtagccagttcacctttactcccactgaactgggcaaaacagacgcagtccttgacgagtctcacgtgtac

SEQ ID NO: 246286 - DNA, 9777 bp, Artificial Sequence
  Description of Artificial Sequence: Synthetic coding sequence
atggtgaaacgcaagtctagcgaaggacaggaacaagatggcggaagaggcatccctcttcctattcagacgttcctatggcgacaaacaagtgcctttctgcggcctaaattgggcaaacaatacgaggcttcctgtgtcagcttcgaacgggtgctggtagaaaataagctgcatggtttaagtcctgctctgtccgaggccattcagagtattagtcgttgggagctcgttcaggctgcattaccacatgtgctgcactgtaccgcgacactcctgagcaacagaaacaaactcggtcaccaggacaaactcggagtggccgaaacgaagctactccacacactccattggatgctgctcgaggcgccacaggattgtaacaatgaaagattcgggggaacagatagggggtcttcatggggcggaagctcttctgcattcatacaccaggtggagaaccagggaagccccggacagccttgtcagtcctccagcaacgatgaggaagaaaataaccgccgtaagatcttccagaacagtatggcgacagtggagctgtttgtctttctgttcgcacctctggtgcataggatcaaagaatctgatctgaccttccggctggccagcggactggttatatggcagccaatgtgggagcataggcagccaggggtatccggcttcaccgccctcgtcaaaccgatccggaacattattaccgctaaacgaagtagccccataaacagtcagagtcgcacttgcgagtcaccaaatcaggacgcccgtcatctcgaaggactccaggtggtttgcgaaacttttcagagcgactcgatcagtccaaaagccaccatcagtgggtgtcataggggcaacagctttgacgggtcgctgagcagtcagacttcccaggagcgaggtccttcccacagtcgggcttccctggtaattcccccttgccagcggagcaggtatgctacttattttgatgtggcagtactgcggtgtttgctccagcctcactggagtgaggaaggaactcaatggagcttaatgtattatctgcagaggctgcgtcatatgctagaagagaagcccgaaaaacccccagagcctgacattccactgctgcccaggcccaggtccagctcaatggtggccgctgctcctagcctggtgaacacccataaaacccaggacctcactatgaaatgcaatgaagaagagaagtcacttagcagtgaagccttctcaaaggtttcattgactaatctaagaaggagtgccgtgcctgatttatccagtgatttggggatgaacatcttcaagaagttcaaaagccgcaaagaagatagagagagaaagggatctattcctttccatcatacaggtaagcgacggccaagacggatgggggtaccgttcctcctgcacgaagatcacttggacgtttctccaacacgctccaccttttcctttggttcgttcagtggcctgggagaggaccggcgaggcattgagaagggcggatggcaaaccaccatcttaggcaaactgacccggaggggcagctctgatgcagcgaccgagatggagagtctgtccgcgcgacactcccactcccatcataccctcgtgtctgacctccctgatccatcaaactctcatggagagaatacagtcaaggaagtccgctcccagatctccaccatcacggtggccacatttaatacgaccttggcgagttttaatgttggttacgccgacttttttaatgagcatatgcggaagttgtgtaaccaagtaccaatcccggaaatgcctcacgaaccattagcatgcgccaacttgcccagatctctgacggattcttgtattaactactcttacctggaagatacggaacacatcgatgggaccaataatttcgttcataaaaacggaatgctagacctcagcgtcgtgctgaaggccgtctatctggtgctgaatcatgacattagctcccgaatttgtgatgtcgctctcaacatcgtggaatgcttattgcagctgggcgtagtgccttgcgtggagaaaaacagaaaaaaatcggaaaacaaggagaatgagacgctggaaaaaagaccaagcgaaggagcgtttcagttcaagggggtcagcggcagttccacctgtggcttcggaggtcccgcagtgtctggcgcaggcgacggcggaggcgaggagggaggtgggggtgacggtggtggcggagggggtgacggcggtggcggagggggtgggggtggtggcccatatgagaaaaacgacaaaaatcaggaaaaagatgagtccacccccgtttcaaatcaccgcctcgccctgacaatgctaattaagatcgtgaagtccctgggatgcgcatacggatgcggcgagggccacagaggactgagtggcgaccggctaagacatcaggtttttcgtgagaacgcacagaattgcctgactaagttatataaactcgacaaaatgcagtttaggcagaccatgcgagattatgtcaataaggattctcttaacaatgtggtggattttttgcacgccttgctcggtttttgtatggaacctgttactgataacaaggccggattcgggaacaacttcaccaccgtcgataataagtccactgcccagaacgtggagggcattatcgtgagcgctatgttcaagagccttataactcgctgtgcctcaaccacgcacgagctccacagccccgagaatcttggcctctactgtgatatacgacagctcgtccagttcatcaaagaggctcatgggaatgttttccgcagagtggctttgtctgctctgctcgactccgccgaaaaactggccccaggcaaaaaagtggaagaaaacgagcaggagtctaaacccgcaggaagtaaacgatctgaggccggttcgattgtggataagggtcaggtgagttccgcaccagaagagtgccgttctttcatgagtgggagacccagtcagactccggaacatgacgaacaaatgcagggagctaacctggggagaaaggatttctggcggaaaatgttcaaaagccagtccgcggcttccgacacatcctcccagagcgaacaagatacctcagagtgcacaactgcccactctggcactacaagcgatcggagagccagatcgaggtccaggcgcatcagtcttagaaagaaactgaaattgcctatcgggaagcgcaactggctgaaaagatcttccctgtctggcctcgcagatggtgtcgaggacctgctggacatctccagcgttgatagacttagttttatccggcagtcctcaaaggttaagttcacctccgccgtgaagctctcagaaggcggacccggtagtggaatggaaaacgggagagacgaagaggagaacttctttaagaggttgggttgccactctttcgacgaccacttgtccccgaatcaagatgggggtaagtctaaaaatgtcgtgaatctcggtgcgattcgccaaggcatgaaacgtttccagtttctgctaaactgttgtgaaccaggcaccatcccagacgcttctatcctcgcggcagccctggatttagaggcccctgtagtggcgcgtgccgcattatttctggaatgtgcacgctttgttcatcgatgtaacagagggaattggccagagtggatgaagggccaccatgttaacattacaaagaaaggcttaagcagagggcgatcgccaattgtgggcaataaaaggaatcaaaagttacagtggaatgctgccaagctcttctatcagtggggagatgccatcggcgttaggctgaacgaattatgccacggagagtccgaatccccggcaaacctgctgggcctgatatacgatgaggagacaaagaggcggctgagaaaggaggacgaggaggaagacttccttgatgattccactgtcaacccaagcaaatgcgggtgcccctttgcattaaagatggcagcctgccagctgttactggagattaccacattcctccgagaaaccttttcttgtctgccccgaccacgcacagagcctttggtcgatctggaatcttgcagacttcgtttagatccagagcttgatcggcatagatacgaaaggaagattagttttgccggagtcttagacgaaaatgaagactctaaagatagtcttcacagctcgagtcatactctgaaatcagacgctggcgtggaggaaaagaaggaaggctcaccttggagtgcatccgagccctccatcgagcctgagggtatgtctaacgcgggagccgaggagaactaccacaggaatatgtcttggctacatgtgatgatcctgctctgcaaccaacagtctttcatttgtacccacgtggactactgtcatccccactgctacctccaccattctaggtcctgtgcacggcttgtgcgcgcaatcaaactgttatacggtgattcagtagatagcttaagagagtcttcgaatatctcttccgtcgctctccggggtaagaaacaaaaggaatgctcagacaaaagttgtctgaggaccccaagtctgaaaaagagggtatctgacgccaatctagagggcaagaaggactcaggtatgctcaagtatatacgccttcaggtgatgagccttagccccgctcctctaagcctactcattaaagcggcacctatactgacagaggagatgtatggcgacatacagcccgcagcctgggaattactcctgagtatggacgagcatatggccggtgctgcagccgcaatgtttctgctgtgtgctgtcaaagtgccggaagccgtgtctgatatgttgatgagtgaattccaccatcctgagacagtacagcgtctgaatgccgtcctgaaattccacacactctggcgcttccgctatcaggtttggcctagaatggaagaaggtgcccagcaaattttcaagatccccccaccgagcataaactttactctcccatcccccgttctgggaatgccttccgtgccaatgttcgatccaccatgggtgccccaatgcagtggctctgtgcaggatccaataaacgaagaccaaagcaagagcttttctgcacgcgcagtatcgaggagccaccagagagccgaacatatcctcaaaaatctgcagcaggaagaggagaagaagcgcctcggacgcgaggcaagtctcatcacagccatccctatcacgcaggaagcttgttatgaacctacatgcacccccaattctgagccggaggaggaggtcgaagaggtgaccaacctggccagccgacggctgagtgtttctcctagttgtacctcatctacgtcgcaccggaactacagcttcagaagaggaagcgtctggagcgttcggtcagcagtgtctgctgaagacgaagagcacacgactgagcatactccgaaccaccacgtcccccagcccccacaggcggtctttcccgcttgcatttgtgctgcagtgttaccaatcgtgcatctgatggaagacggtgaggtacgggaggatggcgtggctgtgtcagccgtcgcacagcaggtcctctggaactgcctgattgaagatccttccacagtcctccgccactttctggaaaaactgaccatctccaaccggcaggacgaactgatgtatatgttaagaaagttgttgctcaatataggcgacttcccagctcagacaagccatattctctttaactatcttgtgggcctgataatgtattttgtaagaactccttgtgaatggggcatggatgcaatttctgctaccctaacctttctgtgggaggtggtcggttatgtcgaagggttatttttcaaagacttgaagcagaccatgaagaaggaacaatgtgaagtcaaactgctcgtcactgcctcaatgccgggaactaagacactggtcgtgcacgggcaaaacgagtgtgatatacctacgcagctccccgtacatgaagatactcaatttgaagccttgcttaaagagtgcctcgaattcttcaacatccccgaatcacagagtacgcattactttctgatggacaagaggtggaaccttatccattacaacaaaacctatgtgagagatatctatcccttcagaaggagcgtttcccctcagcttaacctcgtgcacatgcatcccgagaaaggacaagagctcatccagaagcaggtgtttaccagaaagcttgaggaagtcggcagagttctctttctgattagtctgactcagaaaattcccactgcacacaaacagtcccacgtcagcatgctgcaagaagatctgctccggctcccttcgtttccacggtccgcaattgatgccgaattctctctgttctccgacccgcaggccggaaaagagctctttggcctcgataccttgcagaaaagcctctggattcagctgctggaggaaatgtttctcggaatgccgagtgagttcccatggggggacgagatcatgctcttcctgaacgtgtttaatggcgcacttattttgcacccagaggactccgctctcttacgtcagtatgctgcaactgtcatcaataccgcagtgcactttaaccatctgtttagtcttagcgggtaccagtggattctgcccaccatgctgcaggtttactcggactacgaatctaacccccagctgaggcaggcaatagaattcgcttgtcaccaattctacattctgcaccggaagccatttgtgttgcagctttttgcctccgtggccccactcctggagtttccagatgctgccaacaatggtccatcaaagggtgtctccgcccagtgtttgtttgacctcctgcagagcctcgagggggagacgactgacatcctggatattctggaactggtcaaggccgagaagccactcaaaagcctagacttttgctacggaaacgaagacctgacattcagtataagcgaagctattaagctctgtgtcaccgttgtcgcctatgctccagagtctttccgatcacttcagatgttgatggtactcgaggccctggtcccttgctaccttcagaagctaaagcgtcagacttctcaagtagaaactgtgcccgcagcccgagaggaaatcgccgctaccgccgcactggccacaagtctccaagcgctcctttactctgtagaggtcttgactagacctatgaccgctccccagatgtctaggtgtgaccaaggccataaagggaccactaccgctaatcatacaatgagctctggggtgaacacacgataccaggaacagggcgctaaacttcattttattcgcgaaaaccttcacctcttagaagaaggacaaggcatcccaagagaagagctggacgagcggatcgctcgcgaggagttccggcgtccccgagagtccctgctaaatatttgtactgagttctataagcactgtggtccaagattaaaaattctgcagaaccttgctggagagccgagggtcatcgctctcgagctcctggatgtgaaaagtcacatgagattggctgaaattgctcattctttgctgaaactggcgccttacgacactcagaccatggaaagtaggggcctgcggagatacattatggagatgctgcctattaccgattggaccgctgaggccgttagaccagctcttatattgatactgaaacgcttggatagaatgttcaataagatccacaaaatgccaaccctccgcagacaagtggaatgggaacccgcaagtaacttgatagaaggtgtgtgcctgaccctgcagaggcaacctattatttctttcctcccacacttgagaagtctcattaacgtttgcgtgaatttggtcatgggcgtcgtcggaccatctagcgtggccgacggtttgcccctgctccacctgtcaccttacctgagcccaccactacccttcagcaccgccgtggttcgattggtggcattgcagatacaagcactgaaggaggattttcctctatctcatgtgatatctcccttcaccaaccaggaacgtcgcgaaggaatgctccttaacctgctgatccctttcgtgctcaccgttggcagtggtagcaaggacagtccctggctggagcaacctgaggtccagctgttgctccaaaccgtcattaacgtcttactcccgccacgtatcatcagtacctcacggagcaagaattttatgctcgaatcatcacctgctcactgttcgacacccggagatgccggtaaggacctccgtcgagaaggactggccgagagtacctcccaagccgcttatctggcccttaaagtaatactggtctgtttcgaaagacagctcggcagccaatggtactggctgtctctgcaggtgaaggagatggcactgcgcaaggtgggcggtctggccctgtgggattttctcgacttcatcgttaggacacgcatccctatctttgtgctcctgaggccattcattcagtgtaagttgttagcccagcctgctgaaaaccacgaggaactgtcagccaggcagcacattgcggaccaactggagaggaggtttattcccaggccgctgtgcaagtctagtctcattgccgagttcaatagcgaactgaagatactaaaagaggcagtgcatagtggtagcgcgtatcaaggaaaaacttcaatctcaactgttggcacttcgaccagcgcttataggctttccctagctaccatgagccggagcaatacaggaacagggacggtatgggagcaggattccgaacccagccagcaagccagccaagatactctttccaggaccgatgaagaggatgaggaaaacgattcaatatccatgccctctgtggtatcggaacaggaggcctacctgctcagtgccattgggagacgcaggttttcctctcacgtttcctcaatgtctgtacctcaggctgaagttggaatgctgccaagccaatcagaacccaatgtgctggacgattcacaaggcctcgccgctgaggggagtctgagccgtgttgcttctatacagagcgagcctggacagcagaatctccttgtgcagcaacctctcggtaggaaaaggggactgcgacagttgagacggccattgctgtctcgtcagaaaactcagacagagccacgcaaccggcaaggagccaggcttagcactacacggcgaagcatccaacccaagactaagccctcggccgaccagaaacgatctgtgaccttcatcgaggcacagcctgagccagcggctgcgccaacagatgcccttccagcaaccggtcaactgcagggatgctcccctgctcccagccgaaagcctgaggccatggacgagccggtgctcacctcctctcccgcaatcgttgttgccgatcttcatagtgtgtcacctaagcagtcagagaacttccccactgaggagggcgaaaaagaggaagacacagaggcccaaggagcaaccgcgcactcacccctgagcgcccaacttagcgatccagatgactttaccggtttggagacaagctctcttcttcagcacggagacaccgtgctgcacattagcgaggagaatggaatggaaaacccgctgctctcctcacaatttacgtttactcctacggagctcggcaagactgacgcggtattagacgaaagtcatgtctac

SEQ ID NO: 246287 - DNA, 1401 bp, Artificial Sequence
  Description of Artificial Sequence: Synthetic coding sequence
atggagtctaggggcctgcgcagatacataatggaaatgctacccattactgactggactgcagaggcagtgagaccagctttaattctgattcttaaacgattagaccggatgtttaataagattcataagatgcctactctccgtaggcaggtggagtgggagccagccagtaatttaattgaaggtgtgtgcttaacgctccagaggcagcctatcataagctttctgccgcaccttagatcgctcatcaatgtctgtgtcaacctggtcatgggagttgttggcccttcttccgtcgcagacgggctgcctcttcttcacttgtcaccttaccttagccctcctctgcctttttccaccgccgtcgtgcgcctagtcgcccttcagatacaagctctgaaggaagacttcccactcagccacgtgatctccccttttactaatcaggaacgccgagagggtatgcttttgaatttgctcataccgttcgttcttacggtgggatccggatctaaggacagtccctggctggaacagcctgaggtgcaactgctactgcagaccgtaataaatgtcttgttaccgcctcggattatttcaacgtctcggagcaagaacttcatgctcgaatcgagccccgcacattgctcaaccccaggggatgccggaaaggacctgagaagagagggacttgccgagtccacctctcaagcagcgtacttggcactgaaggtgattctagtgtgttttgagaggcagctaggcagtcagtggtattggctctctcttcaggtgaaagaaatggcacttagaaaagtgggaggattggccctgtgggactttctggatttcatcgtgcgaactaggatccctatttttgtgctcctgcggccttttatccagtgtaaactgctggctcagcctgccgagaaccatgaagaattgagtgccaggcagcacattgcagatcagctagaacgccgattcatcccgagaccactctgcaagagttcgctgatcgccgagtttaactccgagttgaagatcctcaaggaagcagttcacagcgggtcagcctatcagggcaagacttcgattagcactgtgggaaccagcacttccgcttacaggctttcgttggctacgatgtcgagaagcaacacaggcactggcaccgtgtgggagcaggattccgagccatcccagcaggcgtcccaggacaccctgtcccgcacagacgaggaggacgaagaaaatgacagcataagcatgcccagcgtagtgagcgaacaggaagcttatcttctctcagcgatagggaggaggaggttctcatcacatgtctcatccatgagtgtgccccaggccgaagtggggatgctgccttctcagcggtag

SEQ ID NO: 246288 - DNA, 786 bp, Artificial Sequence
  Description of Artificial Sequence: Synthetic coding sequence
atggcttcccaattgcaaaaccgcctgcgttctgcactggcactggtgaccggagccggaagtggcatcggacgtgctgtcagtgtgcgtctcgccggagaaggcgcaacagtcgcagcatgtgaccttgatagggccgctgctcaggagaccgtgagactgctcggcggacccggatccaaagaaggcccacccagagggaaccacgcagctttccaagccgatgtctccgaagcacgagccgctcggtgtctgctggagcaagtacaggcttgcttctcacgcccaccctcagtggtggtgtcatgtgccggaattacacaggatgagtttttgttgcacatgtcagaagacgactgggataaagtcattgctgtgaatcttaaaggaacgttcctcgtgacacaggcggctgcacaggcgctggtgtcaaatggatgccggggttctattatcaatatttcctctatcgtgggcaaggtggggaatgtgggacagacgaattacgctgcttcaaaagccggagtgatcggcctgacccagaccgccgctagagaattgggcagacatgggatcaggtgcaatagtgtgttgcctggctttattgccacccctatgacccaaaaggtgccacagaaggtggtcgataagattacggaaatgatccccatgggacacctgggcgaccccgaagatgtagctgacgttgtggcattcctggccagtgaggactccgggtacatcaccggaacgtctgtagaagtgactggcggtctctttatgtag

SEQ ID NO: 246289 - DNA, 1248 bp, Artificial Sequence
  Description of Artificial Sequence: Synthetic coding sequence
atggatcgatccctccggaatgtgctggtcgtgtcattcggtttccttttactgtttactgcgtatgggggactgcagagcctccagtcgtccttatattcagaggaagggcttggcgtgactgcactgagcacactctatggaggcatgctcctgtcatccatgtttctgccccctctcttgatcgagaggctcggctgcaaaggtacgattatattgagcatgtgtggctatgtagcatttagcgtgggcaattttttcgcaagctggtacaccctcatccccacaagcatacttctggggctcggagctgctcccttatggagcgcccagtgcacgtacttgacgatcacaggtaatactcacgctgagaaagccggaaagcggggtaaagacatggtaaaccagtattttgggatcttcttcctcatcttccaatcatcgggcgtgtggggtaacctcataagcagcctggtatttggacaaaccccctcccagggcagtggcgtcctggcagtcctcatgatcgccgcttttctccagcctataagggacgtgcagcgggagtccgaaggcgagaaaaaatcggtgccattctggagcacactgctcagtacctttaagctgtatagagataagcgcttatgccttctcattcttttgcccctgtattctggcctgcagcagggtttcctctcctccgagtatactcgtagctatgtgacctgcacgctgggcattcaattcgttggctacgtcatgatctgcttttcagcgacggacgctctttgctctgtactctatggtaaggtgagccagtacacagggagagccgttctgtacgtgctgggagccgttactcatgtcagctgcatgatcgctcttctgttgtggaggccaagggccgaccacctggctgtattcttcgtcttttctgggctgtggggagtggctgacgctgtttggcagactcagaacaatgctctttatggagtattgttcgaaaaatccaaggaagctgctttcgctaactatcgtctgtgggaagccctgggtttcgtgattgcattcggttactccatgtttctgtgtgtgcacgtgaaattgtacatactgctcggtgtgctttccttgaccatggtagcctatggcctggttgagtgtgtggagagtaagaatcccatccggcctcacgctccaggacaggttaatcaagctgaagatgaggaaattcaaaccaagatgtag

SEQ ID NO: 246290 - DNA, 435 bp, Artificial Sequence
  Description of Artificial Sequence: Synthetic coding sequence
atggaccgcagtctgcggaatgtattggtggttagcttcggatttctcctgctgttcacggcttatgggggactgcagtccctgcagtcctccctgtacagcgaggagggcctgggcgtgacagctctgagtactctgtacggcggaatgctcctctcctccatgttcttaccgccactgctcatcgagagactggggtgtaaggggaccatcatattgagtatgtgcggatacgtggctttctcagtggggaattttttcgcctcctggtacacactgatccccacgtccatactcttgggtctcggcgcagcgccactttggtccgcacagtgtacttatcttaccataactggcaacacacacgctgaaaaggcaggcaaaaggggaaaagacatggttaatcagtattttggaattttcttcctgatatag

SEQ ID NO: 246291 - DNA, 1545 bp, Artificial Sequence
  Description of Artificial Sequence: Synthetic coding sequence
atgagtcgctggctttggccttggagtaattgcgtcaaagagagggtctgtcggtacttactgcaccactacctcggccatttctttcaggagcatctgtcattggatcagctatccctagatttatacaaaggttctgtggctttgagggacattcaccttgagatttggagtgtaaacgaagtgctggaatccatggaatcacctctggagcttgtggagggctttgtggggagcatcgaggtggccgtcccatgggcagcactcctgacagaccattgcaccgtgagggtgtccggcctacaactcactctccagcctagacggggacctgctcccggagcggcagatagccagtcatgggcttcatgcatgactacgtctctgcagcttgcgcaggaatgcctgcgggatggccttcccgagccctctgaacctcctcaacctctggagggtctggagatgtttgcccaaactatcgaaaccgtacttcgtagaatcaaggtaactttcctcgacaccgtggtccgggtggagcacagccctggtgacggagagagaggggtggccgtcgaagtccgcgtccagcgactggaatattgtgacgaagccgttagggatccgagtcaggcccctcccgtagatgttcatcagccccctgcatttctacataagctgttacagttggccggtgtgcgcttgcattatgaggagttacctgcacaggaagagcctccagaaccacctttgcagattggttcttgctctggttatatggagctcatggttaaactcaagcaaaatgaggcctttcccggtcctaagctcgaagtagccggacagctaggctcactgcacctgctgctgacccctaggcagctccagcaattacaggaacttctgtccgccgtttctttaacggaccatgaagggcttgcggataagctgaacaaaagccggccactcggcgcagaggacctgtggcttatagagcaggacctgaaccagcagctgcaggccggagccgtcgccgagcctctgagccccgaccccctcaccaacccgctgctgaacttagataacactgatttgtttttctcgatggctggtctgacttccagcgtggctagtgcgttgtccgaattgtcactgtcggatgtggaccttgcttctagtgtgcggagtgatatggccagccgtaggctatctgcccaggcaaggcccggtctcgccttgcagggcatggccaccgtgaaagatgcatttcccgcatgccctcttccaatatgttgcgagagaggggcatccttgccttgggggctgagtcccggatccgctttgttcctgcgtggcgagcgcaccttgccactgccacgccctgggccaaccctgttacctagcccacgaacagaggcttttggcccttccgatccaatacctctgagccaggtgagcttttgtgtgtggggggaggaaggcatgatctctgtgtggttcgacgtccttttcttatcctctgtctcggcttgggtgtcagtttgttag

SEQ ID NO: 246292 - DNA, 924 bp, Artificial Sequence
  Description of Artificial Sequence: Synthetic coding sequence
atgggcggtctgacagcaagtgacgtccatcccactctcggcgttcagctgttctcagctggtattgctgcctgcttggccgacgtaatcacctttccactcgataccgccaaggtccgcctccaagtccagggggagtgccctacttctagcgtgatcaggtacaaaggcgttttgggtactattaccgcagtggttaaaacagagggtcgaatgaagctctattctgggcttccggctggcctccagagacagatttccagtgcatcgttacgtatcgggttatacgataccgtgcaggaatttctgaccgccggaaaagagacagcccctagtctggggagcaagatcttagcaggcctaactaccggtggcgtggcggttttcatcggacagcccaccgaggtggtgaaggtaaggctccaggcccagagccacttacatggcatcaaacctcgttacacgggtacctataacgcatatcgaatcattgcaacaactgagggactcactgggctgtggaaaggcaccaccccgaatctgatgagaagcgtgattatcaactgcaccgagttggtcacatatgacctgatgaaggaggccttcgtgaaaaacaacatcctagcagacgacgttccatgtcacttggtgagcgccctgatagccggattctgtgccactgcaatgagttcccctgtggacgtggtcaaaacacgatttatcaattctcctccaggccagtacaagtccgttccgaactgcgcaatgaaagtttttaccaacgaaggtcccacagccttcttcaaaggattagtgcctagttttttacgactcgggagctggaacgtgatcatgtttgtatgtttcgagcagcttaagcgggagcttagtaaaagccgacaaactatggactgcgcaacctag

SEQ ID NO: 246293 - DNA, 930 bp, Artificial Sequence
  Description of Artificial Sequence: Synthetic coding sequence
atggtcggttttaaagctacggacgtgccccctactgccacagtgaagttcttgggcgctggaactgccgcatgcattgctgacctcatcaccttccctttagacactgccaaagtaaggctgcagattcaaggagaaagccagggacccgtgcgggctacggcttccgcccagtatcgaggagtaatggggactatcttaaccatggttagaactgaggggccacgctccttgtataacggcctggtggcagggctccaaaggcaaatgtcgtttgcatctgtgcgaattggtctctacgatagtgtgaagcagttttacacaaaaggctctgagcacgcgagcatagggtcacgtctgctggccggttccaccacaggcgcactggccgtggctgtcgcccagccgaccgacgttgttaaagtgcgttttcaggcccaggcacgcgcaggcggtggacggagatatcagagcacagtgaacgcttacaagacaattgccagggaggaggggtttcggggtctgtggaaaggaacatctccaaacgtagctagaaatgcgattgttaattgtgctgaactagtaacctatgacttaattaaagatgccttgctcaaggccaaccttatgaccgatgatctaccctgtcactttacgtctgcttttggggcaggattttgtacgacggtgatcgcaagcccggtggatgtggtgaaaacaaggtacatgaactcagcactgggccaatactcaagcgcgggacactgcgctctgaccatgttgcagaaggagggacccagggccttttataagggcttcatgccatcttttctgcggttggggtcctggaatgtggtcatgttcgtgacttatgagcagctgaagcgggctcttatggcagcctgtacttctcgggaggctcccttctag

SEQ ID NO: 246294 - DNA, 102 bp, Artificial Sequence
  Description of Artificial Sequence: Synthetic coding sequence
atggtgggatttaaagctactgacgttcctccgacagcaactgtgaaatttttgggggctggcaccgcagcgtgtatagcagacttgattactttcccctag

SEQ ID NO: 246295 - DNA, 939 bp, Artificial Sequence
  Description of Artificial Sequence: Synthetic coding sequence
atggttggactgaaaccctccgacgtgcctcctactatggccgtaaaattcctcggagccggaaccgccgcttgtttcgccgatctggtgactttccccctcgacactgctaaagtacgcctccagatccagggggaaaatcaagcagtgcaaacagctcgcctggtccagtacagaggcgtacttggtaccatcctgacaatggttcgcacggagggaccttgttctccatataacggactggttgctggactacagaggcaaatgtcattcgcctcaatcagaattggattgtatgatagtgtcaagcaggtgtatacgcctaagggggctgacaattcttcactgactactcggatcttggccggatgtactacaggcgctatggcggtcacatgcgcccagcctaccgacgtcgtgaaggtccggttccaggccagcattcacctgggtcctagccgtagcgaccgcaagtactctgggaccatggacgcgtacagaaccattgcccgagaggaaggggtccggggattgtggaagggaacacttcccaatataatgcgcaatgcaattgtcaactgcgctgaagttgtcacctacgatatccttaaggagaaactgctggactaccacctgcttaccgacaattttccctgtcatttcgtgagcgcttttggtgcaggtttctgcgctacggtagttgcgtcccccgtggatgttgtcaaaacaagatatatgaattcaccacctggccaatatttcagccccctcgactgcatgatcaagatggtggcccaagagggccctactgccttctacaagggatttactccctcatttctgcggttaggttcctggaacgtggtgatgtttgtcacatatgagcagttgaaaagagctctgatgaaggtgcaaatgcttagagagtcgcctttctag

SEQ ID NO: 246296 - DNA, 633 bp, Artificial Sequence
  Description of Artificial Sequence: Synthetic coding sequence
atggtgggcctcaaaccaagcgacgtcccacctacgatggccgtgaagttcttaggcgcaggaaccgctgcatgctttgctgatctagttacctttcctctcgataccgctaaggtgcgactccagattcagggcgaaaatcaagctgtgcaaaccgcaagactcgtgcaataccggggagtgctgggcacaattctcaccatggtacgaacagagggcccatgctccccttataacgggctggtggccggtctccagcgacagatgtctttcgcgtctatccgaattggactgtatgattccgtaaaacaggtctacacccccaaaggagccgacaataactttccctgccactttgtaagcgctttcggggctggattttgcgctaccgtggttgcctctcccgtggatgtggtgaaaacccgttacatgaacagtcctcccggtcaatacttttccccccttgactgcatgatcaagatggttgcccaggagggacctacagcattttataagggcttcacccccagtttccttaggcttggatcctggaacgtggtcatgtttgtcacctacgaacagctgaagcgcgcactaatgaaggttcaaatgctccgggagagccccttctag

SEQ ID NO: 246297 - DNA, 828 bp, Artificial Sequence
  Description of Artificial Sequence: Synthetic coding sequence
atggtcggtctaaagccgtctgatgtcccgcctacaatggctgtgaaatttctgggggctggcacagctgcctgctttgctgacctcgtaacgtttccgttagacacggctaaagtcagactgcaaattcagggggagaatcaggccgtgcaaacggctcgccttgtgcagtatcgcggtgtacttgggaccatccttaccatggttagaaccgagggtccttgttccccgtataatggcctagttgcgggtttgcagaggcagatgagcttcgcgagtatcagaatcgggctgtacgattctgttaagcaggtgtataccccaaagggggcagataattccagcctaacaaccaggatcctggcgggatgcaccaccggcgctatggccgtcacatgtgcacagcctaccgatgtagtgaaggtgcgctttcaagcctccatccatttgggacctagccggtcagaccggaagtattctgggactatggacgcctatcggacaatagctagggaggagggagttcggggtttgtggaaaggcacattgcccaacatcatgcgaaatgccattgtcaattgcgccgaggtggttacctacgacatactgaaggagaagctactggactatcatttgctgactgacaacttcccctgccatttcgtgtcagcgtttggggctgggttttgcgccaccgttgtggcaagtcccgtggacgtcgtcaagacgcgatatatgaactcccccccaggccagtatttctcacccctggattgcatgataaagatggtggcccaggaaggcccaaccgctttctataaggggtag

SEQ ID NO: 246298 - DNA, 291 bp, Artificial Sequence
  Description of Artificial Sequence: Synthetic coding sequence
atggtaggattaaaaccttcagatgtgcctccaacaatggccgttaagttccttggggctggaaccgccgcatgcttcgctgacctcgtgacattccctctcgatactgccaaggtccgcctgcagatccagggagagaaccaggccgtccagaccgccaggctcgttcagtaccgcggagtcctaggcaccatcctgacaatggtacgcactgaggggccatgctctccctataacggcctggtcgccggactccagaggcagatgagcttcgcatccattcggatttag

SEQ ID NO: 246299 - DNA, 1026 bp, Artificial Sequence
  Description of Artificial Sequence: Synthetic coding sequence
atgcttttaaggcctagacgaccaccccctttggctccacccgcacctcctagtccggcatcgcccgacccagaaccacgcacacccggagacgcccctggaaccccacctagacgccctgcgtctccatcagcgctcggggagctcggactgcccgtgtcccctggaagcgcccaacgcaccccctggagtgcaagagagaccgagctcctcttggggaccctccttcagcctgccgtgtggcgcgctctgctgttggaccgtcggcaagccttaccaacttatagaagagttagcgctgccctagcccagcagcaggtgcgacggactcctgcccagtgtcgcagacgatacaaattcctcaaagataaatttagagaggcccatggtcagcctcccggaccatttgatgagcagatcaggaaactcatgggactgctgggtgataacggaagaaagcgtcctcgaagacgcagtcctgggtctgggaggccacaacgggcaagacgcccagtgccaaatgctcatgcacccgctccctcggagcctgacgcgacaccgctccctacagctagagacagagacgccgacccaacttggacactgcggtttagcccctcacctccaaaatctgcagatgcatctcccgctcccggatccccccctgcccctgccccaaccgctctggccacttgtatccccgaggatagagctcccgttaggggcccaggtagccctccaccgccaccagccagggaagatcccgattctccacccggacgcccagaggactgtgctccaccccctgccgcacccccatccctcaacaccgcattgcttcagacccttggccatctgggggacatcgcgaatatcctgggtccactccgggatcagctcttgacactgaaccaacatgtcgagcaactgcggggtgctttcgaccaaaccgtgagcctcgcagtcggatttattcttggctctgcggcagctgagagaggagttcttagggacccgtgccagtag

SEQ ID NO: 246300 - DNA, 3357 bp, Artificial Sequence
  Description of Artificial Sequence: Synthetic coding sequence
atgtctgtggaagcgtatggaccatcatcacagacattaactttcctggataccgaagaggctgaattgctgggcgcagatactcagggatccgagttcgaatttacagattttaccctccctagtcagacccagaccccacctggtggacctggaggacctggcggagggggagccggtggccctgggggagccggtgcaggcgctgccgctggtcagctcgatgcgcaggttggccctgaaggcattctgcagaacggtgcagtggatgatagcgtggccaaaaccagccagctgttagctgaattgaacttcgaagaggatgaagaggatacatattatactaaggatttgcctattcacgcctgttcctactgcggtatccacgacccagcgtgcgttgtttactgtaatacatccaagaaatggttttgtaatggaaggggcaacacatctggatctcacattgtaaatcatttggtgcgggctaagtgcaaggaggtcacattgcacaaggacggtcctttaggagagactgtgctggaatgctacaactgtggctgcaggaatgtgttcctactggggtttatccctgcgaaggccgattccgtggtggtgctgctttgtaggcagccctgcgcaagtcaatccagtcttaaggacatcaattgggacagcagtcagtggcagcctcttatccaggacaggtgtttcttaagttggctggtaaagatcccatccgagcaggagcagctacgggctcgccagattaccgcgcagcagataaacaagttggaggagctgtggaaagagaacccctcagccacactggaggatctggagaaacctggggtcgacgaggaaccgcagcacgtcctgctgagatacgaagatgcctaccagtaccaaaacattttcggaccccttgtgaagctggaggccgactatgacaaaaagctaaaggaatcacagacccaagataatattacggtgaggtgggacctaggattgaacaaaaaacggattgcctacttcactctgccaaaaacagatagcgatatgagactgatgcagggcgacgagatctgtttgcggtataaaggcgacctcgccccattgtggaagggcataggacacgtgatcaaagtgcccgataactacggcgacgagatcgccatcgaactaaggagttccgtaggggcaccagtggaagtgacccacaacttccaggtagatttcgtgtggaaatcgaccagcttcgatagaatgcaatcagctctgaagaccttcgccgtggacgaaacttcggtttcagggtatatttaccacaaactgctgggccatgaggtggaggatgtgattattaagtgtcagttgccgaagcggttcacggcgcagggtctaccagacctgaatcacagccaggtctacgccgtgaagaccgtacttcagaggcctctgtctctcattcagggcccacctggtaccggaaagacagtgacgtccgcgaccatcgtgtatcacctggcaagacaaggaaatggacccgtgctggtatgtgcgccatccaacatcgcggtggaccagctgacagaaaagatacatcagacaggactgaaggtcgtgcggctgtgtgccaaaagccgtgaagctattgattctcccgtttcatttctggccctccacaatcagatccgcaatatggattcgatgccagaactgcaaaaactccagcagttgaaagacgaaacaggggagctgtcatccgccgatgaaaaaagataccgggcactgaagcgcacagcagagcgggaactgctcatgaacgccgatgtcatctgctgcacatgcgtgggggctggcgatcctcgcctcgctaaaatgcagtttcggtccattctgatcgatgagtctactcaggctaccgagcccgaatgcatggtgcctgtggttcttggagccaagcagctgatactggtcggcgaccactgccagctgggacctgttgttatgtgtaaaaaggccgcaaaggccggactttcgcagagtctgtttgagagactggtcgtgctgggtatccgccctattcggcttcaggtgcagtatcgcatgcatcctgccctttccgccttcccaagtaacatcttctacgagggatcgctccagaatggcgtaactgccgctgacagagttaaaaaaggtttcgacttccagtggccacagcctgacaaacccatgttcttctacgttacacaggggcaagaagagatcgcttcctccggtaccagctacctcaaccggacagaggctgccaacgttgaaaagattaccacaaagctactgaaggccggtgccaagcctgaccagatcggcattattacaccttatgaaggacagcgcagttatctggtccagtatatgcagtttagcggatccctccacacaaaactctatcaagaggtcgaaatcgcctccgtggacgcctttcaagggcgagagaaggatttcataatactgtcctgtgtccgggctaatgagcaccaggggatcggcttcctcaacgacccgagaagactgaatgtcgcactcacgcgcgcacggtatggagttataatcgtgggaaacccgaaggcgctgagcaagcagccactttggaaccatcttcttaactactataaagagcagaaggtcttagtggagggtcctctcaacaatctgcgagaatccctcatgcaatttagcaagccacgcaaacttgtaaataccatcaatccaggcgctagatttatgaccacagctatgtatgatgctcgcgaggcaattatccccggttcagtgtacgatagatcttcccagggaaggccatcaagcatgtatttccagactcacgatcagatcggcatgatcagcgcgggtcctagccatgtcgcagcaatgaacatcccaattcccttcaacttggtcatgcccccaatgccgcctcccggatactttggacaggcaaacggccctgccgctggtagaggcacacctaagggcaaaactggcaggggcggaagacagaagaatcgattcggactccccggaccatctcagactaacctgcctaacagccaggccagtcaggatgttgctagccaacccttctctcaaggcgcattgacccaggggtacattagcatgtctcagcccagtcagatgagtcagccaggcctgtctcagcctgagctgtctcaggactcatacttgggagacgagtttaagtcccagatagacgttgccctgtctcaggatagcacgtaccagggagaacgggcatatcagcacgggggagtgactggactgtcacagtactag

SEQ ID NO: 246301 - DNA, 1740 bp, Artificial Sequence
  Description of Artificial Sequence: Synthetic coding sequence
atgcccgctgagcgcaagaagcctgcaagtatggaggaaaaagattcgttgccaaataacaaggagaaagattgcagcgagaggcgcaccgtatcctctaaggaacgacctaaggatgatattaagctcaccgcaaagaaagaggtttccaaggcccctgaggagtccaagaaaaaggaagaagaggagaaaaagaaacaccaggaggaagagcgcaaaaaacaagaggagcaggctaaaagacagcaagaggaagaggctgcagcccagatgaaagaaaaagaggaaagtattcagttgcatcaggaagcgtgggaacgacaccatctccggaaagaactaaggtcgaaaaatcaaaacgcccctgacagccgccctgaagaaaatttcttcagccgcctcgactctagtcttaagaagaacacggcgtttgtaaagaaactcaaaaccatcaccgagcagcaacgggactccctgagccatgacttcaatgggctcaacctctccaaatacattgcggaggcagttgcctcaatcgtggaggccaaactgaaaatcagtgatgtgaactgtgcggtgcacctgtgctctctgtttcatcagaggtatgccgatttcgccccttcccttctccaggtgtggaagaaacactttgaggccagaaaggaggagaaaactcctaacataacaaagctgaggaccgacctcaggtttattgctgagcttaccatagttggtatttttaccgataaagaaggactgagcctgatctatgaacagctgaaaaacatcattaatgctgatcgcgagtctcacactcacgtgtcggtagtgatcagcttttgcagacactgtggggatgatatcgccggtctcgtgcctaggaaagtgaaatccgccgctgagaagttcaacctttctttccctccatcagagattatctctccggagaaacaacaaccttttcagaatcttctgaaggagtactttacatcccttaccaagcatctgaaaagagaccaccgagagctccagaatacggagaggcagaaccgcagaatcttgcattctaaaggtgagctgtcggaggatagacacaaacagtatgaggaattcgcgatgtcataccaaaagctcctcgccaatagccagtctttggccgacttgctcgatgaaaatatgcccgacttgccccaggacaagccaactccagaggaacacggacctggaatcgatattttcaccccaggcaagcctggagagtatgatctggaagggggaatctgggaggatgaggacgcccgaaacttttatgaaaacctcattgacctaaaggcattcgtgccagcaattctttttaaggataatgaaaagtcttgtcagaataaagagtctaacaaggacgacaccaaggaagctaaagagtctaaagagaataaggaggtctcctctccagatgacttggaattagagctcgaaaacctggaaatcaatgacgacaccctggagctcgagggtggcgatgaggctgaggacctgactaagaaactgctggatgagcaggaacaggaggatgaagaggcttcaacggggtctcatcttaaactgatcgtggacgcctttttgcagcagctgcctaattgtgtgaacagggatctgattgacaaggccgagaaagccttttgcaatgggaacctagccagggtcaatctgctcctacgtatggcggtgaagaagtag

SEQ ID NO: 246302 - DNA, 3819 bp, Artificial Sequence
  Description of Artificial Sequence: Synthetic coding sequence
atgcctgcagagagaaaaaaaccggcatctatggaggagaaggatagcctaccaaacaataaagaaaaagattgctccgaacgcagaaccgtctcatccaaagaacgtcctaaagatgacattaaacttacagcaaaaaaagaggtatccaaagccccagaggacaaaaaaaagagattagaagacgataaaagaaagaaggaagacaaagaaagaaagaagaaggacgaagagaaggtgaaggctgaggaggagtccaagaaaaaagaagaggaagagaaaaagaaacaccaggaggaggagcgcaagaaacaagaggagcaggcaaaaagacaacaggaagaagaagctgccgctcagatgaaggaaaaggaagaatccatccagttacatcaggaagcctgggagaggcaccatttacgaaaagagctgaggtccaagaatcagaacgcccctgactcacgccctgaggaaaactttttttcacgcctggattcttccctaaagaagaacacagcttttgttaagaagctcaagactattacggaacagcagagagactccttaagccatgattttaacgggcttaacttatccaaatacatagcagaagccgtcgcttctatagtggaggcgaagttgaagatctccgacgtgaactgtgcagttcacctttgttctctcttccatcagagatatgccgattttgccccttcgttgttgcaggtgtggaagaagcacttcgaggcaaggaaagaggaaaaaaccccaaacatcacaaagttgaggaccgacctgcgatttattgcagaactgacaatcgtgggaattttcaccgataaggaaggtctgtcactgatttacgagcagctgaaaaacatcattaacgccgatcgcgaatcccatacacacgtaagtgtggttatctctttttgtaggcactgtggggacgacatagccggtttggtcccaaggaaggtgaaaagcgccgctgaaaagtttaatctcagtttccctccctctgagatcattagtcccgagaaacagcaaccttttcagaatcttctcaaagaatactttaccagcctgactaaacatctcaaacgagaccatcgggagttacagaacactgaacgccagaatcgtcgcattctgcacagtaaaggagagttgtccgaggacaggcataaacagtacgaggagttcgcgatgtcctatcagaaactgctggcaaactcccagagtctggcggacctcctcgacgaaaatatgcccgatctccctcaggataaaccgacgccagaagagcacggtccaggtatcgatatctttactccgggaaagccaggtgaatatgatctggaggggggtatttgggaggatgaggatgccaggaacttttacgagaacttgatagacttgaaagcctttgttcccgctattctgttcaaggacaatgagaagtcttgccaaaacaaagagagcaacaaagatgacactaaagaagccaaagaaagtaaggagaataaggaggtgtccagcccagacgatctcgagcttgaactggaaaaccttgagatcaatgacgataccctggagttggaaggcggagacgaagccgaggacctgacaaaaaaactgctggacgagcaagaacaagaagacgaggaggcgtcaactggttcacacctaaaactcattgtggacgcttttctccagcagctccccaactgcgttaaccgggatctgattgataaagccgctatggatttctgcatgaacatgaatacaaaggccaatcggaaaaagttggtgcgggctttgtttattgtccccaggcagcgcctggaccttttgcctttttacgcccgactcgtggccacactgcacccgtgcatgagcgatgtggcagaggacctgtgtagcatgctgcggggagacttccgcttccatgtgcgtaagaaagaccagattaatattgagactaaaaataagaccgtgaggtttattggcgaattgactaaatttaagatgttcacaaagaacgacaccctgcactgtctgaaaatgctgttgagcgacttctcacatcaccacatcgaaatggcctgcaccctgctcgagacctgcggacgctttttgtttcgaagtccagagtctcacctccgaacgagtgttctgctcgagcagatgatgcgtaaaaagcaggctatgcacttggatgcaagatacgtaaccatggtggaaaacgcatactactactgtaatcccccacctgccgagaaaacagtcaaaaagaaacgtcccccattgcaggaatacgtacgcaagcttctgtataaagatttaagcaaggtgactactgaaaaagtgttgcgccaaatgcgtaaactgccctggcaagatcaggaagtgaaagactacgttatttgctgtatgataaacatctggaacgtgaagtataattccattcattgtgtcgccaaccttcttgctggattagtgttgtaccaggaggacgtaggcattcacgtggtggatggggtgcttgaggatatcagacttggcatggaggttaatcagccaaagtttaatcaacgaaggatatcctccgctaaattcctgggggagttgtataattatagaatggtagagagcgccgtcatctttcgcacactgtattcattcacctcctttggcgtcaatcccgacggctctccgtcatctcttgaccctcctgagcacctgttccgtattcggctggtgtgtacaatcttggatacatgcggccagtattttgacagaggtagtagcaaacgcaagctggattgtttcctggtttatttccagcggtatgtgtggtggaagaaatcccttgaggtgtggaccaaagaccacccctttccaatcgatatcgactatatgatctctgacaccctcgagctgttaagaccaaagataaagctgtgtaattcattggaagaatcaatcaggcaggtgcaggacttagaacgagagtttttaatcaagcttggcctcgtgaacgataaggactctaaagattctatgacggaaggcgaaaatctggaggaagacgaggaagaggaggaggggggtgcggagacagaagagcaatctggtaacgagagcgaagtaaatgagccggaggaggaggaaggcagcgacaacgatgatgacgagggtgaggaggaggaagaggagaatactgactatctgacagattcaaataaggagaatgagaccgatgaagagaacactgaggtgatgattaaaggcggtggactaaaacacgtcccctgcgttgaggacgaggattttatacaggctttggacaaaatgatgctggagaatttacagcagcgctcaggcgaaagcgtaaaggtgcatcagctggatgtggccatccccttgcacctcaagtcacagttacgaaaaggacctccactgggtggcggtgaaggagaagccgaatcagccgacaccatgccattcgtcatgctcacgagaaagggaaacaagcaacagtttaaaattctcaacgtgccaatgagcagccagctcgctgcaaaccattggaaccagcagcaggcagagcaggaagaacgcatgaggatgaagaaattgaccctggacattaacgagcgccaggagcaggaagactaccaggaaatgcttcaatccttggcacagcgacccgcaccagcaaatacaaatagggaacgccgacccagatatcagcaccccaagggtgcgcctaacgctgacctcatcttcaagactggcggtagaagacggtag

SEQ ID NO: 246303 - DNA, 3819 bp, Artificial Sequence
  Description of Artificial Sequence: Synthetic coding sequence
atgcctgcagaaaggaagaaacccgcatccatggaagaaaaagacagtctccccaacaataaagaaaaggactgctccgaacggagaacagtaagcagcaaggaacgaccaaaggatgatatcaagctgactgccaagaaagaggtgtcgaaggccccagaagataagaagaagagactcgaggacgacaagaggaaaaaggaggataaagaacggaaaaaaaaggacgaggaaaaagtgaaggccgaagaggagtctaagaagaaagaggaggaggaaaagaaaaagcatcaagaggaggaaagaaagaagcaggaggagcaggccaagcgacaacaagaggaggaggccgctgctcaaatgaaggagaaagaggagtctatccagttgcaccaggaagcttgggagagacaccaccttcgcaaggagctgcgaagtaaaaaccagaacgccccagactcccgccctgaggagaatttcttctctcgcctggacagtagtctgaagaagaacacggcctttgtgaagaaactgaagactatcactgagcagcaacgagactccctttcacatgatttcaatggccttaatctcagtaagtacattgccgaggccgtggcctccattgtggaagcaaagttgaagatcagcgacgtgaactgtgctgtgcatttgtgctccctcttccaccagaggtacgcggatttcgccccttccctgctccaagtgtggaaaaaacacttcgaggctcggaaggaggagaagactcccaacataacaaaactgaggactgacctgaggttcatcgcggagctgactattgtgggtattttcaccgacaaggaaggactgtccctcatctacgaacagctcaaaaacattatcaacgcagatcgcgaatctcacacccatgtttctgtggtcatctctttttgcaggcactgcggcgacgacatcgctgggcttgttcccaggaaggttaaaagcgctgcggaaaagtttaacttaagcttccctccatctgagatcatctccccggagaaacagcagccatttcagaacttgctcaaagagtatttcacctcactgacaaagcaccttaaaagagatcacagagagctccaaaacaccgaacggcaaaacagacgtatcctccactcgaagggtgaactgtctgaggacaggcataagcaatacgaggaattcgccatgagctaccaaaagctcctggcgaacagtcagagtctggccgatctactggatgaaaatatgcccgatctacctcaagacaaacccacacctgaagagcatggccctggcatcgatatttttacccctggaaagcctggcgagtacgatctggaaggcggaatatgggaagacgaggatgctcgcaacttctacgagaacttgatagacctaaaagccttcgtgcccgcaatcctgtttaaggacaatgagaaatcctgtcaaaacaaggaatcaaataaggacgataccaaggaggccaaagaaagcaaagagaacaaggaagtctccagccctgacgaccttgaattagaacttgaaaacctggaaatcaatgatgacacattggaactcgaggggggagacgaggctgaagacctgaccaaaaagctgctagacgagcaagaacaggaggacgaagaggcctccaccggcagtcatctgaagctgatcgtggacgccttcttgcaacagctgccgaactgtgtgaacagggacctaattgacaaggcagcaatggatttttgcatgaacatgaacacaaaagccaaccgcaagaagctggttcgtgctctttttattgtcccgaggcaacgtctggacctgctgcctttttacgcaagactggtggcaacgcttcacccctgcatgagcgacgttgcagaagatctctgtagtatgctgcgtggcgactttcgctttcacgttcgaaagaaggaccagatcaatatcgaaacaaaaaataagacagtgcgctttataggggagctgaccaagttcaagatgttcaccaaaaacgacacgctccactgcctgaagatgctgctcagcgatttctctcatcaccatatcgaaatggcctgcactctcttagaaacctgtggtagatttctctttcgctcaccagagagccacctgcgcacatccgtgctgctggagcagatgatgagaaaaaaacaggctatgcatctggacgcccgatatgtcaccatggtggaaaatgcctattactactgcaacccaccaccggcagaaaagaccgtaaaaaaaaagagaccgccacttcaggagtacgtgcgtaagctgctttacaaagacctctcaaaggtgaccacagagaaagtcctcagacagatgagaaaactgccttggcaagaccaggaggtgaaggattacgtgatatgttgtatgataaatatttggaacgtgaaatacaacagtatccactgtgtagctaatttacttgcaggcctggtgctgtatcaggaggacgtgggcatacacgtcgtggacggagtgttggaggatatccgcctgggaatggaggtgaatcagccgaagtttaaccaacggaggatctcgagtgccaaatttctgggggaactctacaactacagaatggtggagtccgcggtcatctttcggactttgtattcttttacttcattcggagtcaatcccgatggctcgccttccagtcttgatcccccagagcacttgtttcgcataaggctagtttgtacaattttggatacttgcggccagtacttcgatcggggtagcagcaaaaggaagttggactgtttcctggtctattttcagcggtacgtgtggtggaagaagagccttgaagtctggaccaaggaccaccccttccctatagacattgattacatgatctctgacacactggaactgctgagaccaaagatcaaactgtgtaacagcctcgaggagtcaatacgacaggtgcaggatcttgagcgcgaattcctgatcaaactaggcctggtgaatgataaagacagtaaagacagcatgacagaaggggaaaatcttgaagaggacgaggaagaagaggaaggtggggctgaaactgaagagcaatccgggaacgagtcagaagtgaatgagcccgaggaggaggaagggtctgacaacgacgacgatgaaggagaggaggaggaggaggagaatacggattacctgaccgactctaataaggagaatgagactgacgaagaaaacactgaagtcatgattaagggcggaggactgaagcacgttccctgtgtggaagacgaagatttcattcaggccctagacaaaatgatgctcgagaacctccaacagcggagtggcgagtctgttaaagtccaccaacttgacgtagcaattccattgcatttaaagagtcaattgaggaaggggcctcccctaggcggtggtgagggggaagccgaatccgctgataccatgcccttcgttatgctgacccggaaaggaaacaagcagcagtttaaaatactgaacgtccccatgtctagccagctggccgcaaaccactggaaccaacaacaggcagagcaggaggaacgaatgcggatgaagaaacttactttggacatcaacgaacgacaggaacaggaggactatcaggagatgctgcagtccctggcacagaggccagcacccgctaacacaaatagagaacgccgaccaaggtatcagcatcctaagggtgctcccaacgcagatttaatcttcaagaccggcggaagacggaggtag

SEQ ID NO: 246304 - DNA, 375 bp, Artificial Sequence
  Description of Artificial Sequence: Synthetic coding sequence
atgatcaaaggaggcggtctgaaacacgtgccttgcgtcgaggatgaggacttcattcaagcactagacaaaatgatgttggaaaatctccagcagcgctccggagagagtgttaaggtccatcagctggacgtggctattcccctccacctgaaatcccaactgaggaaggggccaccccttggcggaggggagggggaggccgaatctgccgacaccatgcccttcgttatgcttacaagaaagggtaataagcagcagtttaaaatactgaatgtgccaatgagctcccagcttgccgctaaccactggaatcagcagcaagccgaacggcgtgaggacgagaacgaaaaggctcacacccggtaccagtag

SEQ ID NO: 246305 - DNA, 1740 bp, Artificial Sequence
  Description of Artificial Sequence: Synthetic coding sequence
atgcccgcagagagaaaaaagcccgcaagcatggaggagaaggactcactgcctaacaacaaagaaaaggactgcagtgaaaggcgtacagtctcctccaaggaacgcccaaaggacgacattaaactgacagccaagaaggaggtatccaaggctcccgaagaatctaaaaagaaggaagaagaagagaagaagaaacaccaggaggaggaaagaaagaaacaagaggaacaggccaagaggcagcaggaagaggaagcggctgcccaaatgaaagaaaaagaagaatcgatacagttgcaccaggaggcttgggagaggcaccatctgaggaaagagctgcggagcaagaaccaaaatgcacccgacagcagacctgaggagaacttctttagcagacttgactccagtctcaagaagaacaccgcttttgtcaagaaactgaaaacaatcaccgagcagcagcgcgattcactgagccacgatttcaatggtctgaacctgtcgaaatatatagcagaggctgtcgcttctattgtagaagctaagcttaagatctcagacgtgaattgtgccgttcacctgtgcagtctattccaccagaggtatgccgacttcgccccatcattgctccaggtatggaaaaagcactttgaggcgagaaaagaggagaagactcccaatattaccaagttaagaacggacctgcgttttatcgctgagctcacgattgtgggaatctttactgacaaagaggggctgtcccttatatatgaacagttgaagaacattattaatgccgaccgagagtctcacacacatgtgtctgtggttatcagcttttgtaggcattgtggcgacgacatagctggccttgtccctaggaaggtcaagtcggcagcagaaaaattcaaccttagtttccccccttcagaaatcatcagccctgaaaaacagcagccttttcagaatctgctgaaagaatatttcaccagccttaccaagcatctgaagagagaccatagagagctgcagaacaccgagagacaaaataggcgtattctgcacagcaagggggaactcagtgaggacagacacaaacagtacgaagagttcgccatgtcctaccagaagctgctggccaattctcagtcccttgctgatctcctagacgagaacatgcctgacctgccacaagataagccaactcccgaagagcacggcccaggcatagacatttttacccccggaaagcctggcgagtacgacctggaagggggaatatgggaagacgaggatgccagaaacttctacgagaatctgatcgacttgaaggcattcgttccagctatcctcttcaaagacaacgagaagtcctgtcagaacaaagagagtaacaaagacgataccaaagaggctaaagagtccaaggagaataaagaggtgtccagtcctgacgatctggaacttgaattagaaaacttagagatcaatgacgacaccctcgagctggagggaggcgatgaggccgaagatctcaccaagaagctgctcgatgagcaggaacaggaagatgaggaagcctccactgggtcacatctgaagctgatcgtcgatgcctttctccaacagctgccaaattgcgtcaacagagatctaatagacaaggctgaaaaagctttctgtaacggcaacctagccagagtgaacctgcttctaaggatggccgtgaaaaaatag

SEQ ID NO: 246306 - DNA, 3819 bp, Artificial Sequence
  Description of Artificial Sequence: Synthetic coding sequence
atgccagccgagcggaagaagccagcaagcatggaagagaaggattcgctgcctaataataaagagaaggactgctctgagcggcgtacggtttcaagtaaagaaagacctaaggacgatattaagctgacagcgaagaaggaagtgtctaaagccccagaagataagaaaaagcgacttgaagatgataagcggaaaaaggaagacaaagaaagaaagaaaaaggatgaggaaaaggtaaaagctgaggaggaatctaaaaagaaagaggaagaggaaaagaagaaacatcaagaagaagagcgaaaaaagcaggaggagcaagctaaacgccaacaagaagaggaggctgcagcccaaatgaaggaaaaagaggagagcattcagcttcatcaggaggcctgggagagacaccatctgagaaaagagctgcggtcaaagaaccagaacgcaccagatagcaggcctgaagagaactttttctcaaggcttgactcctcactgaaaaagaacacagccttcgtgaagaagctgaaaacaataactgaacaacagcgcgattctttatcacacgacttcaatggcctcaacctgtccaagtatatcgccgaagccgtggcttcgattgtggaggccaagctcaagatcagcgacgtcaattgtgccgtgcacttgtgcagtcttttccatcagcgttacgcagactttgcacctagtctgttgcaggtgtggaaaaagcactttgaggctcgtaaagaagagaagacacctaacatcacaaaactcaggacagatttacgcttcatagctgaattgacaatcgtcggtatttttactgacaaggagggattgagtttgatttacgaacagctcaaaaacattatcaatgcggatcgcgagtctcacacccatgtgtccgtcgttattagcttctgcaggcactgtggggacgatatcgccggactagtgccccgtaaggtgaagtcagcagccgaaaaatttaatctgtcatttcctcctagcgaaataatttcgccagagaagcagcagcccttccaaaatttgcttaaagaatatttcacgagcctgaccaagcacctgaagagggatcatcgcgagttgcagaataccgaacggcagaaccgacgaatcctccatagcaagggagagctctcagaggacaggcataagcagtatgaagagtttgcgatgagttatcagaaattgctcgcgaatagccagagtctcgctgacctgttggacgagaacatgccagacctacctcaggacaagcccacccctgaagagcatggcccagggattgacatcttcactcctgggaagcctggggaatacgatctggagggcggaatctgggaagatgaagatgcaagaaacttttacgagaatctaatcgatctcaaggcgttcgtgcccgctatactgtttaaagataacgagaagtcatgccagaacaaagaatcaaataaagacgacacaaaggaagcgaaagagtccaaagaaaataaggaagtctcaagcccagacgatctcgagcttgaactggagaatctggaaataaatgacgacactctggagctggagggaggagatgaagcagaggatctgacaaagaaactgctggacgagcaggaacaggaagatgaggaagcctctactgggtcccacttgaagctgatagtggatgcattcttacaacaattgcctaactgcgttaatagggatttgatcgataaagccgctatggacttctgtatgaatatgaataccaaagcaaaccgaaaaaaactcgtacgcgctctttttattgtgccacgccagagactggatctgctgccattctacgcaagattagtcgccacgctccacccgtgtatgtcagatgtcgcagaggatctatgctccatgctgaggggagatttcaggttccatgttaggaagaaggaccaaatcaatattgagacaaaaaataaaaccgtgcgctttatcggcgagctgacgaaatttaagatgttcaccaagaacgacactctacactgtttgaagatgctgctttccgatttctcacatcaccacatcgaaatggcctgcactctgctcgaaacctgcggtcggtttcttttcaggagccctgagtctcacctccgcacatctgttctgctggagcaaatgatgagaaaaaagcaagctatgcatttagatgcgagatacgttacaatggtcgagaatgcctactactattgcaatccgccaccagcggagaagaccgtgaaaaagaagcgtccacccttgcaagaatacgtgcggaaattgctgtacaaagatctctctaaggtgaccaccgagaaagtgctgaggcagatgaggaaactgccatggcaagaccaggaggtgaaagattacgttatctgctgtatgatcaacatatggaacgtgaagtacaacagtattcactgtgtggctaatctgctggccggtctggttttgtatcaggaagacgtaggtatccatgtcgtagacggcgtgttggaagatattcggctggggatggaagtgaaccaaccgaagttcaaccagcggagaatttcttctgccaagttcctcggagaactgtataattaccggatggtcgaatctgctgtaatttttagaacactatacagcttcacttcatttggagtgaatccagatggcagtccttcttccttagatccaccagagcacttgtttaggattcggctggtatgcaccatactggatacgtgcgggcagtactttgatcgaggcagctctaaacgtaagcttgactgctttcttgtgtactttcaaagatacgtctggtggaaaaaatcactggaggtctggactaaggaccaccccttcccgatcgatattgattacatgatttccgacactttggaattactgcggccaaaaatcaaactgtgtaactcgttggaagaaagcatccgccaggtacaggatcttgagcgcgaattcctcattaaattgggactggtgaacgacaaggactctaaggattccatgacagaaggcgaaaacctggaggaagacgaagaggaagaggagggtggggctgaaaccgaggagcaaagcggcaatgagtccgaggtgaatgagcccgaggaggaggagggctctgacaacgacgacgacgagggggaggaagaggaagaggagaatacagattatctgaccgactcaaataaagagaatgagactgacgaagagaatacagaggttatgataaagggcggtggtttgaagcatgtgccatgtgtggaagacgaggacttcatccaggccctagataagatgatgcttgaaaacctgcaacagaggtcaggggaaagcgtgaaggtgcatcaactggacgtggccatccccctgcacctcaagagccagctgcgaaagggcccacctttggggggaggagaaggagaagccgaatctgctgacacaatgccatttgtgatgctgacaaggaagggtaataagcagcagtttaagattctcaacgtgccaatgtcatcgcaactcgccgctaaccattggaatcaacagcaggccgaacaggaagaacgcatgcgcatgaagaagctcacccttgacatcaatgagcgacaggaacaggaggattaccaggaaatgctccagtctctggctcagagaccagcaccagcaaacacgaatagggaacgacggcctcgctatcagcatccaaagggagccccaaatgctgacctgatctttaagaccggcggaagacgccgttag

SEQ ID NO: 246307 - DNA, 1332 bp, Artificial Sequence
  Description of Artificial Sequence: Synthetic coding sequence
atgcgcagcgagaaggagggagctggaggactcagggcggctgtggccgctaggggtccttccggacgagaaaaactcagtgctctcgaggtccagttccatagggactcccagcagcaggaagctgaaactccgccaacatcgagtagtggatgcggtggaggggctggcaaacccagagaggaaaaaagaaccgctctctctaaggttgttattagacgactccctcccggtcttaccaaggagcagctcgaagaacagctgaggcctctccctgcacatgattattttgaattcttcgcagcagatctgtcactctacccccatttgtatagcagagcgtatataaattttcgtaacccagacgacatcctcctgtttcgcgataggttcgacgggtacatctttctggattccaaagaccccgagtataagaagtttctggagacctactgtgtggaggaggagaagacctctgctaacccggaaacgctgctaggtgagatggaggcaaagactagagagctaatagcacgacgtaccactcccttgctggaatacatcaagaatcgtaagctggagaagcagaggatacgagaggaaaagcgggaagagcggaggaggcgcgagttggagaagaagaggctccgcgaggaagaaaagcgtagacgcagggaggaggagcggtgcaaaaagaaagaaaccgacaagcagaagaagatagccgagaaggaggtgagaatcaaacttctgaaaaaaccagaaaagggcgaggaaccgacgaccgaaaaaccgaaggagcgtggtgaagagattgataccggaggcggaaaacaggagtcctgtgcccctggcgcagtagtgaaggccaggcccatggagggttctctggaagagccgcaggagacctcacacagcggatctgacaaggagcatcgggatgtcgagcgctcccaagagcaagagagcgaagcacaacgttaccatgtggacgacggaagaaggcatcgggcacaccacgaaccagaaagactgtcccgcaggagtgaggatgaacagagatggggaaagggccctggacaggataggggaaagaagggttctcaggacagtggagcccctggagaggcgatggagcgactgggtcgcgctcaacgatgtgatgactctccggctccacggaaggaacggctcgcgaacaaggaccgacccgctttacagctgtacgacccgggagctagatttagagcccgtgagtgtggcggaaacaggagaatatgtaaggcagaaggctccggcactgggccagagaaacgtgaagaggctgagtag

SEQ ID NO: 246308 - DNA, 1431 bp, Artificial Sequence
  Description of Artificial Sequence: Synthetic coding sequence
atgcggtcagagaaagagggggcaggtgggttgagagccgcagttgccgctcgaggacctagcggcagggaaaagctgtccgccctcgaggtccagtttcaccgggactctcaacagcaggaggccgagacaccacccacttcgtcttcagggtgtggcggaggcgcaggtaagcctcgcgaagaaaaaaggaccgccctttcaaaagtcgttatcagaaggttgccacctgggttgactaaggaacaacttgaagaacagctgagaccgctcccagcgcacgactattttgaattttttgccgctgacctgtccttatacccccacttatactcccgcgcatacatcaattttcggaatccagatgatattctactgtttagggataggtttgatgggtacattttcctggatagtaagggcttggaatacccggcagtagttgaattcgccccttttcaaaagattgcaaagaaaaagctgaggaagaaagatgcaaaaacgggaagtatcgaggacgaccccgaatataagaagtttctggaaacctactgtgttgaagaagagaagacttcggccaatccggagactctgctgggtgaaatggaggcgaaaacccgtgaactgatcgcacgaaggacaactccactcctggagtatattaagaacaggaaactagagaagcagagaataagggaggaaaagagagaagaacggagacgacgagagttagagaagaagaggctccgcgaggaagagaaaagacgcaggcgagaggaggaacggtgcaaaaaaaaagagaccgacaagcaaaaaaagattgcggagaaggaagtccgcatcaaattgttaaagaagcccgagaaaggagaggagcccaccaccgagaaacctaaagaacggggtgaagaaatcgacactggtgggggaaagcaagagagctgtgcgccaggtgctgtggtgaaggctcgacccatggaaggaagtctggaggaaccgcaagagacttcccactccggaagtgacaaggagcaccgtgatgtcgaacggagtcaggaacaagagtcagaggctcaacgttaccacgtcgacgacgggaggagacaccgagcgcaccacgagccagagaggctttctcgcaggtccgaggatgagcagcgctggggcaaaggtcccggacaggacaggggcaaaaagggcagtcaggatagcggtgccccaggcgaggcgatggagagactcggacgagctcagcgctgtgacgatagtcccgcaccacggaaagaaaggctggcaaacaaggaccgaccagccctacagctgtacgatcctggcgctcgtttcagagccagagagtgcgggggtaacagacgcatttgtaaagcggaaggctccggcacgggtcccgagaagcgcgaggaggcagagtag

SEQ ID NO: 246309 - DNA, 627 bp, Artificial Sequence
  Description of Artificial Sequence: Synthetic coding sequence
atggaggcgaagactcgagaactgattgcgaggagaaccactccactcctggaatacattaagaaccggaaactcgaaaaacagcgtattcgagaagagaagcgagaagaaaggaggcggagggaactcgagaagaagcggctccgggaagaggagaagagacgaaggagggaagaggagagatgcaaaaaaaaagagacagataaacagaagaaaattgccgaaaaggaggttcgcattaagctcttaaagaaaccggaaaagggagaggagccgaccaccgaaaaaccaaaagaacgtggtgaggagatcgacaccggtggcggtaagcaggagagctgcgcaccaggggcagtggtgaaagcgcgtcccatggaggggtcactcgaagaaccccaggagacatcacactcaggcagcgacaaggagcaccgcgacgtagagagatctcaggaacaggaatccgaggctccaaggaaggaacgccttgccaacaaggaccgaccagcactacaactgtacgatccaggcgctaggtttcgagcacgggagtgcggcggaaatagaagaatatgcaaggctgaagggtcaggaaccggcccagaaaagagagaagaggccgagtag

SEQ ID NO: 246310 - DNA, 1452 bp, Artificial Sequence
  Description of Artificial Sequence: Synthetic coding sequence
atgaaggaagaaaaagagcatcgccctaaggaaaagagagttactctcctgacgccagctggggctaccggatcaggtggcggaacatcaggggattcatccaaaggcgaggacaagcaagatcgaaacaaagagaaaaaagaggcgctgtccaaagtagtcattcggagattaccgccaacgcttaccaaagaacagttgcaagaacacttgcagccaatgccagagcacgactattttgagttcttcagcaacgacacatcactctaccctcacatgtatgcgcgtgcatacataaatttcaaaaatcaggaggacattatcctcttcagagaccggtttgacggatatgtattccttgataataaaggccaagaatacccagcaatcgttgaattcgctcccttccagaaagctgccaagaaaaaaaccaagaaacgagacactaaagtcggtaccatagatgatgacccagaatacaggaaattcctagagtcttacgctaccgataatgaaaaaatgacttcaactccagaaaccctgctggaagaaattgaagcgaagaaccgagaattaatcgcaaagaagacaactcctctgcttagcttcctgaaaaacaaacaacgcatgcgcgaggaaaaacgtgaggaacgtagaagacgggaaatcgaacgcaagcggcaacgggaggaggaaaggcgaaagtggaaagaggaggaaaagcgaaaacgaaaagatattgagaagctcaaaaaaatcgaccggatcccagagcgggacaagctgaaagatgagcctaagattaaggtacaccgcttcttgttacaagcagtgaatcagaagaacttactgaaaaagccggagaaaggcgatgagaaagagctcgacaagcgggagaaagcgaagaaattggacaaagaaaacttgagcgatgaaagggcctctggtcagtcctgtacactgcccaagagatctgattcagaactcaaagatgaaaaacctaagcgcccagaggacgagtccggcagagactacagagagagggagcgtgagtatgagcgtgatcaagagcgcatcctgcgggagcgagagcgactgaagcgtcaagaggaggaacggaggcgtcaaaaggaacgttacgagaaagagaagacctttaagcggaaagaggaagaaatgaaaaaggagaaggacaccctgcgagacaaaggaaagaaagcagagtccaccgagagtatcggcagttccgagaagacagagaaaaaagaggaggtggttaagagagataggatcaggaataaagaccgccctgcaatgcagctctatcagcctggcgcaaggagccgcaatcgcctgtgcccccctgacgattccacaaaatcaggcgacagcgccgctgagcgtaagcaagaaagtggaatatcccacagaaaagagggcggagaggagtag

SEQ ID NO: 246311 - DNA, 1413 bp, Artificial Sequence
  Description of Artificial Sequence: Synthetic coding sequence
atgaaggaggaaaaagaacaccggccaaaagaaaaacgagtgacactcttgacaccggcaggagcaaccggatcaggcggaggtacatcaggcgacagctcaaagggagaggataagcaggaccgcaacaaggagaagaaagaggcactgtctaaggtcgtgatcaggagactcccccctaccctgacaaaggaacagttgcaggagcacctgcagcctatgcctgagcatgactattttgagttcttcagcaacgatacatccctgtatccccatatgtatgcccgtgcatacatcaactttaagaaccaggaggacattattttattccgggaccgctttgatggctatgtgtttcttgacaataaaggacaggagtacccggcaatcgttgaattcgccccatttcagaaggccgctaagaaaaaaacaaagaagagggacactaaggtgggaacaatcgatgacgatccagagtaccggaagttcctggagtcctacgccacagacaacgagaaaatgacaagcacacccgaaacgctgctggaagaaatcgaggccaaaaatagggaactgatcgcgaaaaaaaccacgcccttgctctcttttctgaaaaacaaacagcggatgagagaggaaaagcgagaggagcgcaggcgacgggagatcgagcgtaagaggcagcgggaggaagagcgccgaaagtggaaggaggaagagaaaaggaagcgcaaagacatcgagaagttaaaaaagattgatcgcatccccgagcgggacaagctgaaagacgaacccaaaatcaaattgctgaaaaagcctgagaagggtgatgaaaaagagcttgataagcgtgagaaagccaagaagctggacaaagagaatctgagtgatgagagagcctcaggacagagttgcactttgccaaaacgttctgattctgagctgaaagacgagaagcccaagaggcctgaggacgagagcggtcgagactatcgcgaaagggagcgtgagtatgagcgcgaccaggaaagaatcctcagagaaagagagcgcctgaagagacaagaggaggagcggaggagacagaaagaacgttatgaaaaagagaagacatttaaaagaaaggaggaggaaatgaaaaaggaaaaggataccctccgagacaaaggtaaaaaggccgagtctacagagtcaattggaagctccgaaaagacagagaaaaaggaagaagtggttaaaagagatcgcataaggaataaagatcggccagccatgcagctctaccagcctggggcaaggagcaggaatcgactctgccctcccgacgactcaactaagtccggcgactctgccgcagaacggaagcaagagtccggaataagccacaggaaggaaggaggagaggagtag

SEQ ID NO: 246312 - DNA, 657 bp, Artificial Sequence
  Description of Artificial Sequence: Synthetic coding sequence
atgaaagaggaaaaggaacaccggccaaaggaaaaaagagtcacactcctgacccccgcaggcgcaactgggagcgggggaggcacatccggcgactcatccaagggcgaagacaaacaggaccggaataaagaaaagaaggaggctctgtctaaagtggtcattaggcgcctcccacccaccctgactaaagagcaactgcaagagcatctgcagcccatgccagaacacgactattttgaattcttcagcaatgataccagtctgtatccccacatgtacgccagggcgtatattaattttaagaaccaggaggacataatactgttccgtgaccgttttgacggatatgtctttttagataacaagggacaggagtatcccgctatcgtagagttcgccccttttcaaaaggccgctaaaaaaaagaccaagaaaagagatactaaggtgggcaccattgatgatgatcccgagtatcgcaaattcctcgagagctacgccacagacaacgaaaagatgacaagtacaccggagacgctgctcgaagaaatagaggcaaagaatcgagaactaatagccaaaaagacaacacccctcttaagtttcctcaaaaataaacagcgcatgagagaggaaaaacgcgaggatttctag

SEQ ID NO: 246313 - DNA, 441 bp, Artificial Sequence
  Description of Artificial Sequence: Synthetic coding sequence
atgatgtggcagaaatacgccggatctaggcgttctatgccgctcggcgcaagaatcctgtttcatggggtcttctacgccggaggatttgctatcgtatactatttgattcagaagtttcactcaagagcactgtactacaagcttgcagtcgagcagctgcagtcacacccagaggcccaggaggcactgggaccaccattaaacattcattacctgaagctgattgatcgggagaatttcgttgatattgtggatgcaaagttaaaaattcccgtcagtggctcaaagtctgaggggttgctgtacgttcatagcagcagaggcggaccgtttcagcgatggcacctggacgaagtttttttggagttaaaagatggacaacagatccctgtgttcaagttgagcggggagaacggcgatgaagtgaagaaagaatag

SEQ ID NO: 246314 - DNA, 2667 bp, Artificial Sequence
  Description of Artificial Sequence: Synthetic coding sequence
atggagggcgatgactgtgaattcaggtacggcgacgggactaatgaagcccaggacaatgatttccctactgtcgaaagaagccgactgcaggaaatgctgagccttcttgggcttgagacctaccaggtgcagaagcttagcctgcaagactctctgcagataagctttgactctatgaagaattgggcccctcaggtccctaaagatttaccatggaactttctgcgaaagctgcaggcactcaatgcggatgctaggaataccacaatggtgcttgatgttttgcccgacgccaggccagtcgaaaaagagagtcaaatggaagaggagatcatttattgggaccccgctgatgaccttgccgcagatatatatagtttctccgagctccccacacctgacacaccagtgaatccactcgatctgctgtgcgctttgctgctttccagcgactccttcctgcaacaggagattgctctgaagatggcactttgccagttcgctcttccattagtgttgcccgactccgaaaaccactaccacaccttcctgctgtgggcgatgcggggaattgtcagaacttggtggagccagcctccacggggaatgggctcatttagggaggacagcgtggtgctatcccgcgcacctgcctttgcttttgttcgaatggatgtttctagcaattccaagtcacaacttttgaacgcagtactctcccccggtcatagacagtgggactgtttctggcaccgcgacctcaatctcggaacgaacgcgagggagattagtgacggcttagttgagatttcatggttttttcccagcggacgcgaggatctggatattttcccagagcccgtggcattcctgaacttacggggagatatcgggtcacactggcttcagttcaaactcctgactgaaatctctagcgcggtcttcatactcaccgataatatttctaagaaggaatataagctactgtattctatgaaagagagcaccactaagtattactttattctaagtccttaccgaggaaagcggaatacaaatctcagatttttgaacaaactcatccctgttctgaagatcgaccacagccatgtgttagttaaggtttcctcgaccgactctgatagtttcgtgaagcgcattagagccattgtgggaaatgtgctcagagccccatgcaggcgggtgtcagttgaggatatggcccacgcagccaggaagctaggtcttaaagtggatgaagattgcgaagagtgtcaaaaggcaaaggatcgaatggagcggataactcgtaaaatcaaagactctgacgcgtacagaagggatgaattaaggttacagggagacccctggaggaaggctgcacaggtggagaaagaattctgccagcttcagtgggctgtggacccccctgagaagcatagagccgagctgaggcggaggctactggagcttaggatgcagcagaacggacatgatcccagtagcggagtgcaagaattcatcagcggtattagctcaccttctttgtccgaaaaacagtactttctgaggtggatggaatggggattggccagagttgctcaaccccgactcagacagcctcctgagacgctgctaactctccgtcctaagcatggagggacaactgatgtgggggaacctctgtggccagagcccctcggcgtggagcacttcctgagagaaatgggtcagttctacgaagctgaaagctgtctcgttgaagctgggaggttgccagcaggtcagaggagatttgcccattttcctggtctcgcctccgaactgctactgaccggactcccactggagctgatcgatggctctacattgtccatgcctgttcgctgggtgacaggtctcctcaaagaattgcatgtgaggctggagcggagatctcggctggtggtgctatccacagtgggggtgccaggtactgggaagtcaactctactgaataccatgtttggcctcagatttgccaccgggaagtcctgtggacctagaggcgctttcatgcagctgatcaccgtggcagaggggtttagtcaagacctcggttgcgatcacatcctggtgatagactctggcggtctgatcgggggagccctcacctctgcgggagaccgatttgagctcgaagcgtcgctggctaccttgttgatggggttgtcaaacgtgacagtcatcagcctggcggaaaccaaggatatccccgctgcgattttgcacgccttcctgcggctggaaaagactggccatatgcctaattaccagttcgtgtaccagaacctgcacgacgtgtccgtccccggacccagaccaagggacaagaggcagctgctggacccccctggtgatttgagccgcgcagcggcacaaatggagaaacaaggtgatggttttcgggctctggcaggtcttgccttctgcgaccctgagaagcagcatatctggcacatccctggcctatggcacggcgctccccctatggcagccgtcagcttggcgtattcagaagccatcttcgagttgaaaaggtgcctcctggagaacatcaggaacggactgtccaatcagaataaaaacatccagcagctaatcgagctggtgagacgtttatag

SEQ ID NO: 246315 - DNA, 2769 bp, Artificial Sequence
  Description of Artificial Sequence: Synthetic coding sequence
atggcgtcaccaggacactccgatctcggtgaagtagcacctgaaattaaagcctccgagaggcgcaccgcagttgccatcgctgatctggagtggagagagatggaaggcgatgattgcgagtttaggtacggggatggcacgaacgaagcccaggacaacgatttcccgacagtcgagcgttcccgtcttcaggaaatgctgtccctgctcggactggagacctaccaagtgcagaaactctccctccaggacagtctccagatctcctttgattctatgaagaactgggccccacaggtgcccaaagacctgccttggaactttctgcggaagctgcaggccctgaatgccgacgcccgaaacactacaatggttctggacgtccttcctgatgccaggcctgtggaaaaggagtcccaaatggaagaggagatcatttattgggatcccgcagacgatctggcagctgacatctactctttctccgagcttcccacccccgatacccctgtgaaccccctagacctcctctgcgcactcctcctgtcctcagacagcttcctccagcaggaaatagcccttaaaatggcactttgtcagttcgccttgccactcgtgcttccagattccgagaatcactatcacacatttctgttatgggccatgcgcggtatagtaagaacttggtggagtcagccaccacggggtatgggaagcttccgtgaagattctgtggtgctcagcagagcaccagcattcgcgttcgtccgcatggatgtcagctccaattccaaaagtcagctcttaaatgctgttctaagtcccggacacaggcaatgggattgtttctggcatcgagacttaaatctggggaccaacgcccgtgaaatcagtgacggcctggttgagatttcgtggtttttcccatcgggcagagaagatcttgacattttccccgaacccgtagccttccttaatctgcgaggggacatcggttctcattggctccagtttaagctgctcaccgaaatctcctccgccgtttttatactgacagacaatatcagtaagaaggaatataagcttttatacagtatgaaggaaagtacgaccaagtattatttcatcttgagtccgtaccgcggaaaaagaaatactaacttgaggtttctgaataagcttattcccgtgctaaagattgatcactcccacgtccttgtgaaggtgtcctctaccgactccgatagctttgtgaagcgcatccgtgccattgtggggaacgtgctgcgcgctccatgccgtagggtctcagttgaagacatggctcatgccgctcgaaagttaggacttaaggtggacgaggactgtgaagagtgtcagaaggccaaagacaggatggaacgcattacccgaaaaattaaggatagcgacgcctatcggagggatgagttacgcctgcagggggacccgtggaggaaggccgcacaagtggagaaagagttctgtcagctccagtgggccgtcgatccccctgaaaagcatcgcgctgaattgaggcgacgacttctggagctcaggatgcagcagaacggccatgatccctcaagtggtgtacaggagttcattagcggtatcagctctccctccctttcggagaagcagtactttctgaggtggatggagtggggcctggctagggtggctcaacctagactgcggcagcctcccgagaccctcctgactctcaggcctaagcacggtggcacaacggatgtcggagaaccgctctggccggagcccctaggagtggaacactttctacgcgaaatggggcagttttacgaagcggagtcctgcctagttgaggccggacgactcccagccggacaaagacggttcgctcactttccaggtctggcttctgagctgctgctgaccggcctgcccctcgagttaatcgatgggagcactcttagtatgccagttcggtgggtcacggggctcttaaaggaactccacgtacgactggagagaagatcacgtctcgtggtgcttagtaccgtgggggtgccaggtacggggaagtctaccctgctgaacacgatgtttggattaaggttcgccactggtaagtcttgcggtcctcggggtgcctttatgcagctgattaccgtcgctgaagggttttcacaagacctagggtgtgaccacatccttgtcatcgattcaggtggactgatcggcggtgcattgaccagcgccggtgaccgttttgagctggaggccagtcttgcaacccttctgatgggcctttccaacgtgaccgtcattagtctggctgagacaaaagatatccccgctgcgatcttgcacgctttccttcggctcgagaaaacaggacatatgccgaattaccagtttgtttaccagaatcttcacgacgtgtccgttccaggtcccagaccaagagataagcggcagttgctcgacccaccaggcgacctgtcacgggcagctgcacagatggaaaagcaaggtgatgggtttcgagcactggccggtcttgcgttctgcgatcctgagaagcagcacatttggcacattccgggactgtggcatggtgcaccaccaatggccgcagtgtcactggcatactctgaggctatttttgaactcaagcgttgtttacttgagaacatccgaaacggcctgtcgaaccagaacaagaatatccagcagcttatcgaactcgtgaggagactgtag

SEQ ID NO: 246316 - DNA, 492 bp, Artificial Sequence
  Description of Artificial Sequence: Synthetic coding sequence
atggagggggacgattgtgagttcaggtatggagacgggactaatgaggcccaggacaacgatttccctacggtcgagcgtagcaggctgcaggagatgcttagtctgttgggattagagacctaccaggttcagaagctgagtctccaggacagtttgcagatctcttttgactccatgaagaattgggctccccaggttcctaaagatttgccctggaacttcttgcgtaagttgcaggccctgaatgcggacgcccgaaacacaactatggtgctggacgtcctcccggatgcccgacccgtggagaaagaaagtcaaatggaggaggaaatcatttattgggatcccgctgacgacctggccgcagacatttactcatttagcgaacttcccacccccgatactcccgttaacccattggacctgctatgtgcattgctcctctcctctgattctttccttcagcaggagattgctctgaagatgtag

SEQ ID NO: 246317 - DNA, 2667 bp, Artificial Sequence
  Description of Artificial Sequence: Synthetic coding sequence
atggagggcgatgattgcgaattccgctatggcgacggaaccaatgaagctcaagacaacgattttccaaccgtggaaagaagccgcctccaggaaatgctctccctactaggcctggagacataccaggtacagaagttgagcttacaggattccttacaaatttctttcgacagtatgaaaaactgggctccacaggtgcctaaagacctgccctggaactttttgcgcaagctgcaggccctgaacgccgacgctagaaacacaaccatggtcttggacgtgctgcctgacgccagacctgtcgaaaaagagagtcagatggaagaggagatcatctactgggaccctgctgacgacctggctgctgacatttattcttttagcgaattgcctacccctgacacccccgttaatcccctggatctcctgtgtgcactcttgctgtcgtctgattcattcctccagcaggagatcgccctaaagatggccctgtgccagttcgcactgccacttgtattgcctgattccgagaaccactaccatacttttctgctgtgggctatgaggggcatcgtgcggacgtggtggtcccagccccctagaggcatggggtccttccgagaggattctgtcgtcctgtccagagcccctgcgttcgcctttgtgcgtatggacgtctccagcaactcaaaatctcagcttctgaatgccgttctgtctccagggcaccgccagtgggattgtttctggcaccgcgatctcaatctgggtactaacgctagagagatcagcgatggactggtcgagatctcctggttttttccaagtggcagggaggatctggatatctttccagaaccggtggcctttcttaatctaagaggggatattggaagccactggttacagttcaagctactcactgagatatcttctgccgtcttcatccttacagataacatctcaaaaaaagaatacaagctcttgtacagcatgaaagagagcactaccaaatactattttatcctctccccataccgtgggaaacgaaacacaaatcttagattccttaataagctaattccagttctgaagatcgaccatagccatgtactcgtgaaagtgagctctacggacagcgattcatttgtgaaacggatcagggcaatagtcggaaatgttttgcgggctccatgccggcgagtaagtgtagaagatatggcccacgccgctcgcaagctgggcctaaaagtggacgaagattgtgaggaatgtcagaaggctaaagaccggatggagcggattaccaggaagatcaaggacagtgatgcttacaggagagatgaacttcggctgcagggtgacccttggcgcaaagcagcccaggtcgagaaggagttttgccaactccaatgggccgtggaccccccagaaaagcacagggcagagctgagaaggcgactcctggagttgcgcatgcagcagaatggacatgatcctagctccggcgtgcaggaatttattagcgggatctctagtccttctttgtctgaaaagcaatattttctccgctggatggaatggggtctggccagggttgcacagccacgcctgagacagcctccagaaacactgttaacgctccgacctaaacacggcggaacaaccgatgttggtgaaccgctttggcccgagccattgggcgtcgagcatttcctacgagagatgggccaattctacgaggccgagtcttgcctggtggaggcaggcagattgcccgcagggcagcgcaggttcgctcacttcccaggactggccagtgagctgttactgacggggctgcccctggagctgatagacgggtccacattaagcatgccagtgaggtgggtgaccggactcctcaaagagttgcacgtgaggctggagaggcggtcacgcctggtggtcctctccactgtgggagtgccaggaactggtaaatccacactgctgaacacaatgttcgggttacgctttgcaaccggaaaatcctgtggtcctcgcggagcctttatgcagctgatcacagtggctgagggcttcagccaggacctgggctgtgatcatattttagtcattgactctggcggacttattggcggagccctgacttccgctggagatcgtttcgagctggaggcatctctggctaccctgctgatgggactttccaacgttactgtgattagccttgcagaaacaaaggacattcccgctgctatactgcatgctttcctccggctggagaaaaccggtcacatgcccaattatcagttcgtgtaccaaaacctccatgacgtctctgtgccagggcctaggccgagagacaagcgccagttactggatcctccaggtgacctgagccgagccgcagcccaaatggagaagcagggcgacggcttcagagccctggccggactggctttctgcgatccagagaaacagcacatatggcacattccagggctgtggcatggagctccgccaatggccgctgtttccctcgcttactccgaggctattttcgagctcaaaaggtgtctcctggagaacatcaggaatgggctgagtaaccaaaataagaacatccagcagttgatcgaactggtgaggcgcctctag

SEQ ID NO: 246318 - DNA, 2667 bp, Artificial Sequence
  Description of Artificial Sequence: Synthetic coding sequence
atggaaggcgatgactgcgagtttcgatatggcgatggtacgaatgaggcacaggataacgactttcccactgttgaacgaagcaggctacaggagatgcttagccttcttgggctggagacttaccaggtgcagaagctgagtttgcaggattctcttcagatctccttcgacagtatgaaaaattgggcaccacaggtacccaaggatctgccctggaattttcttcgcaagctgcaggcactgaatgcagacgctcggaacaccacaatggtgctcgatgtactgcctgacgccagaccagtcgaaaaagaatcacagatggaggaggaaatcatttactgggatcccgcagatgatctggctgctgatatctatagtttcagcgaactgcctactccagatacgcctgtgaacccacttgacctcctgtgcgccctgctcctgagctctgatagctttcttcagcaggagattgcgttgaaaatggccttgtgccaatttgcgctcccactcgttttgcctgattccgagaaccactatcacacctttctcctatgggcgatgcgagggattgtcaggacctggtggtctcaacctccaagggggatgggatctttccgcgaggatagtgtggtactctctcgggctcccgcatttgcctttgtgcgaatggacgtaagttcaaacagcaaaagccagctactcaatgcggtcctgtccccaggtcatcggcagtgggattgcttctggcatcgcgacttgaacctggggaccaacgcgcgagagattagtgatgggctagtcgaaatttcctggttctttccatccgggagggaagacctggacatcttccccgagccagtggcctttctaaatctcagaggcgatattggatcccattggctgcagtttaaactgctaactgaaatttcctcagccgtctttatcctcaccgacaatatctctaagaaggaatacaagctgttatactcaatgaaggaaagtaccaccaagtactactttattctcagcccttaccgcggtaaaaggaacaccaacttgagatttcttaataagcttatccccgtactgaagatcgatcattcccacgtcctcgtcaaggtctcatccaccgattcagattcattcgttaaacgcatcagagccattgttgggaatgtgctgagggccccttgcagacgggtttccgtggaggacatggcccatgctgctcggaagctgggtctgaaggttgatgaggattgtgaggaatgccagaaggctaaggatagaatggagcgtatcactaggaagattaaggactctgatgcataccgaagggacgagttgcgcctccagggcgatccatggcggaaagctgcccaagtggagaaggaattttgccaactgcagtgggctgttgacccgcctgaaaaacacagagctgaattgcgtcggcgtctcctggaactcaggatgcagcagaacggacatgacccttcatctggcgtgcaagagttcatatccggaatcagctccccttctctgtcagagaaacagtatttcctccggtggatggaatggggcttagccagagtcgctcaacctaggttacgtcagcccccagagacattactgactttgcgcccaaagcatggaggtaccaccgatgtcggcgaacctttatggcctgaaccattgggcgttgaacactttctgcgggaaatgggccagttctacgaggcggagtcctgcctggtagaagccggacgtttacctgcgggtcagaggagattcgcacactttccagggctggcctccgaattgctcctcacgggtctccccctggaactgatagacggctcaacgttaagcatgccggttagatgggtgacaggcttactcaaggagctgcatgtacgtctcgagagacgcagcaggctggtggttctgtcaaccgtgggcgtccccggtactgggaaaagtactttgctcaacaccatgttcggactgcgattcgccacaggcaaatcttgcggcccacgaggtgccttcatgcagctgattaccgtcgcagagggcttctctcaagacctgggatgcgaccatattttggtcattgattccggtggtctgattgggggagcactgacctcagctggcgatcgatttgagttggaggcttctcttgctaccctactgatgggcttatccaacgttaccgtcatctctttggctgagactaaggacattccggcagccatcctccatgccttcctgcggctcgaaaaaaccggtcatatgcctaactatcagtttgtgtaccagaatcttcacgatgtgtccgtgcccggtcccagaccaagagacaaacggcagctcctggaccctccaggggatctcagccgggctgccgcacagatggagaaacagggcgatggctttcgcgctctcgctgggctggccttttgtgaccccgagaagcagcacatttggcatatacccggactgtggcacggggctcctcccatggctgccgtgtctctcgcttactctgaagcaatcttcgaactgaagcggtgcttgctagagaatataaggaacggtctctctaaccaaaataaaaacatacaacagctcatagaactcgtcagaaggctttag

SEQ ID NO: 246319 - DNA, 2796 bp, Artificial Sequence
  Description of Artificial Sequence: Synthetic coding sequence
atggcgagccccggaattgaggtggaacttttggggaagggacactccgacctgggggaggttgccccagagatcaaggctagcgaaagaagaaccgccgttgcaatcgcagatctggaatggcgagagatggagggagatgattgcgagttcagatacggcgacggaacaaatgaagctcaggacaacgacttcccaactgtggaacggtcccgcctgcaggaaatgctgtcgttgctgggcctggagacatatcaggtgcagaagctcagtctgcaggactcactccaaatatctttcgacagcatgaaaaattgggcccctcaagtccctaaggatctgccttggaatttcctccggaagctccaggccctgaacgccgatgccaggaacacaactatggttctggacgttctccctgatgctaggccagttgagaaggaaagccaaatggaggaggaaattatctactgggatcccgcagatgatttagcagctgatatatattccttttcagagctgcctacccccgacacccctgtgaaccccctagatctcttatgcgccttgttgctgagttccgattcttttttgcagcaggagattgcactcaaaatggcactttgtcagttcgcgctgcctttggtcttgccagacagtgagaaccattaccacacgttcctcctctgggcgatgcgaggcatagtcaggacctggtggtctcagccccctagggggatgggcagttttcgggaggatagtgtcgtccttagcagggcccctgccttcgcctttgtccggatggacgtatcaagcaattccaagtctcagctgctgaatgctgtcctgagcccgggtcatcgccagtgggattgtttctggcatcgcgatttgaacctcggcaccaatgcccgagagattagcgatggattagtcgagataagttggtttttccctagtgggcgagaggatctggatatttttccagaaccagtggcctttctcaatctacgcggtgatatcggttcgcactggttacaattcaaacttctcaccgaaattagcagtgccgtgtttatcttaacagataacataagcaaaaaagagtacaagctgctctactccatgaaagagtctactactaaatactatttcattctttccccatatcggggtaagcggaacaccaaccttaggtttctgaataagctcatccctgtactgaagatagaccacagtcacgtactggtgaaagtttcctcaacggatagcgactctttcgttaaaaggattagggcaattgtggggaacgtacttcgtgcaccctgcagacgggttagcgtcgaggatatggctcacgccgcacgaaagttgggactcaaggtcgacgaggattgtgaggaatgccagaaggccaaggaccgcatggagcgcattacgcgaaagattaaagattctgatgcatatagacgggatgaactgcgcctacaaggagacccctggcgaaaggctgcccaggtggaaaaagaattctgccagcttcagtgggcggtggaccccccagagaagcacagagcagagcttcgccgacggttactggaactgcggatgcagcagaatggtcatgatccgtcctctggagtgcaggagttcatttctggcatctctagtcctagcctgagcgaaaagcagtactttttaaggtggatggagtggggtctagcacgcgtcgcccagcccagactgaggcagccacctgagaccttgttaaccctgcggccaaaacacggcggtacaactgacgtgggggagccactctggccagagccactgggtgtggagcactttctaagggagatgggccagttttacgaagctgagagttgcttagttgaggccggaagactacccgctgggcagcgccgttttgcccactttcctggcctcgccagcgagctgcttctgacgggattaccccttgagttaatcgacgggtcaacgttgtccatgccagtcaggtgggtcaccggcctgctgaaagaactgcatgttcggcttgagcggcgaagtcgcttagtcgtgctgagtacagtgggcgtgcccggaacagggaaaagtaccctgctgaacacaatgtttggcctgcgattcgccaccgggaaatcctgtgggccaaggggtgcgttcatgcagctgattactgtcgccgagggtttttctcaagatctcggctgcgatcacatactggtgattgattctggaggactgatcggcggagccctgactagcgctggtgaccggtttgagctggaggcctccctggcaactctgctgatgggcctttccaatgtcacagtgatttcacttgccgaaaccaaagacattcccgcagccatcctgcacgcctttttgcgacttgaaaagactggccacatgcccaactaccagtttgtatatcagaacctgcatgatgtgagcgtccccggtcctcgccctcgcgataagcggcagcttctggatcctcccggagatctaagccgcgcagctgcacaaatggaaaagcagggagacggattcagggcattggcaggactcgcattctgcgaccctgagaaacagcacatctggcacattcccggactctggcatggcgcacccccaatggcagccgtgtcactcgcttatagtgaggctatctttgagctgaaacggtgtctcttagaaaacattagaaatggcctcagcaaccaaaataagaacatccagcagctgattgagctggttaggaggctgtag

SEQ ID NO: 246320 - DNA, 369 bp, Artificial Sequence
  Description of Artificial Sequence: Synthetic coding sequence
atggaaggcgatgattgcgagttccgttatggtgacggaaccaacgaggcccaggataatgacttcccaactgtcgaacggtcacggctgcaggaaatgctcagcctgttgggcctggagacctatcaggtccaaaagctcagcctgcaggatagtctccagatctccttcgattccatgaagaactgggcaccccaggtgcctaaggacctcccatggaattttcttcgtaaactccaggcccttaacgcagatgctcgaaatactacaatggtgctggacgtcctgccagacgcaagaccagtggagaaggagagccaaatggaagaagagatcatttactgggatccagctgatgacctcgcttag

SEQ ID NO: 246321 - DNA, 1623 bp, Artificial Sequence
  Description of Artificial Sequence: Synthetic coding sequence
atggcgtgggtgctgaagatggatgaagttatcgaaagcggacttgtccacgacttcgatgcctctttgagcggaattggtcaagaactcggcgcaggggcttactcaatgtctgatgtgctggccctgcctatctttaagcaagaggattcctctctgccactggacggagaaacagagcacccaccatttcagtatgttatgtgtgccgctacctcccctgcagtgaaactccatgatgagactctgacatatctgaaccagggccagagttatgaaattaggatgctcgacaatcggaaaatgggggatatgcctgaaattaacggtaaacttgtcaagtctatcatccgcgtggtgtttcacgatcggagactccagtacaccgagcatcagcagctcgaaggctggaagtggaaccgtcccggtgatagactgctggacctggatatacctatgtctgtgggtatcatcgacacgcggacaaacccatctcaactcaatgcggtcgagtttctttgggaccctgctaagagaacctccgcattcatacaagtgcactgcatctcaacagagttcactcccagaaaacatggaggtgagaagggcgtcccattcagaattcaagtggatacctttaagcagaatgagaacggtgaatacacagaccatttacactctgcgagctgccaaattaaagtgttcaagcccaaaggtgcagatcgcaagcagaagacagaccgtgagaagatggaaaaacggacagcccatgagaaagagaaataccaaccaagctacgacaccactatcttgacagagatgagactggagccaatcattgaagatgccgttgaacacgaacagaagaaaagttcaaagcggaccctgcctgctgactacggggacagcctggcgaaaaggggctcttgctccccgtggcctgacgctccaaccgcctatgtaaacaactcaccaagccccgctcccacatttacaagccctcagcagtccacttgttcggtgccagatagcaatagctcaagtcctaaccaccagggggatggtgcatctcagaccagtggcgagcagattcagccatctgcaactatccaagagacacagcagtggctgttgaaaaacagattctctagttacacacggttattttctaacttctctggcgctgatctgctgaagctaactaaggaggacctggtccagatctgtggcgcagccgatggcattcgtttgtataactctctcaaaagcaggtccgtgcgcccaaggcttacaatttacgtttgcagggaacagcccagttcaaccgtgctccagggccagcagcaggccgcaagcagtgcttcagagaacggcagcggagcaccttacgtgtaccacgctatttaccttgaagagatgattgccagtgaggtagctcggaagcttgccctcgtcttcaacataccactgcatcaaatcaatcaggtctatagacagggcccaacagggatccacatccttgtttcggaccagatggttcaaaattttcaagacgagagttgcttcctgttttcgaccgtgaaagctgagtcctccgatggtatccacattatcttgaaatag

SEQ ID NO: 246322 - DNA, 1623 bp, Artificial Sequence
  Description of Artificial Sequence: Synthetic coding sequence
atggcatgggtgctcaagatggatgaggttatcgaatctggtctcgtgcatgatttcgacgcaagcctgtccgggataggtcaggagttgggagccggtgcctatagtatgagtgatgtgcttgcactccccatattcaagcaggaggatagttctctaccattggacggagagacagaacaccctccattccagtatgtgatgtgcgcagccaccagtccagcagtgaagttgcacgatgagaccctcacttatttaaatcagggccaatcctatgaaattcggatgctcgacaaccgtaagatgggcgatatgcccgaaatcaatggtaagctggtgaagagcattatacgggttgtcttccatgaccgccgattacaatataccgagcaccagcagctggaaggatggaagtggaacaggcccggtgaccgcttgctcgatctggatattcctatgtcagtggggatcatagacactaggacaaatcctagccagcttaacgctgttgaatttctgtgggaccccgctaaaagaacatccgctttcatacaggtccattgtattagcactgaatttacaccgagaaaacacggcggagaaaaaggagtcccgttcaggatacaggtcgacactttcaaacagaatgagaatggcgagtatacggatcacttgcatagtgcttcctgtcagatcaaggtgtttaagccgaagggagccgatcgcaagcaaaaaacggacagggaaaagatggagaaacgaaccgcccacgaaaaagagaaataccagcctagctacgacacgacaattcttaccgagatgagactcgaacctatcatcgaagatgcagtagagcacgagcagaaaaaaagtagcaagcgaaccctacccgctgactatggggacagccttgcaaaacgagggagttgcagcccatggcctgatgcccctaccgcatacgtgaataatagtccttcacccgctcccacctttaccagcccccagcaatctacttgcagtgtccctgacagtaatagtagctcgcctaaccaccagggggacggtgcctcccagacgtctggggagcaaattcagccatcagctacgatccaagagacacagcagtggctgctcaagaaccggttttccagctacaccagactcttctccaactttagcggagccgacctcctaaaactgacgaaagaggacctagtccagatttgcggagcggcagacggtattcgactgtacaactcccttaagtctcggagtgttcgaccgaggcttaccatatacgtgtgccgggaacagcccagcagcactgtgctccaggggcagcagcaggcagccagtagtgcaagcgagaatgggagcggcgctccctacgtctaccacgcaatatacctcgaggagatgatcgcttctgaggtcgccagaaaactcgctctagtatttaatattcccctccatcaaattaatcaggtgtaccggcagggacccaccggaatccacatcctagtctccgatcagatggtccagaatttccaggacgaatcatgctttttgttcagtaccgtgaaggctgaatctagcgatggcatccatatcattctgaaatag

SEQ ID NO: 246323 - DNA, 1515 bp, Artificial Sequence
  Description of Artificial Sequence: Synthetic coding sequence
atggcatgggtgctgaagatggatgaggtgattgagtctggtcttgtgcatgattttgacgctagtctcagcggaattggccaggagctcggggcaggtgcatattctatgtctgacgtcttagcactgcccattttcaaacaggaagattccagtctgcctctggacggggagaccgaacacccaccttttcagtatgtaatgtgtgcagccactagtcctgcggtaaagttacatgacgagaccttgacctacctcaaccagggccagagttacgagattagaatgctcgataaccggaaaatgggcgacatgcccgagatcaatgggaagctcgtcaagtcaatcatccgtgtggtcttccacgatcgcagactgcagtacacggaacaccagcagctggaaggctggaaatggaacagaccaggagataggctcttggatctggacataccaatgtccgtgggaatcatcgatactagaactaacccatctcagcttaacgccgtcgaatttctctgggatcctgcgaaacggacttccgccttcatccaggtgcattgcatatccactgagttcactccgagaaaacacggcggagagaagggggtgccctttcggatccaagtcgatacattcaagcagaatgagaacggcgagtataccgatcacctccatagcgccagctgtcaaataaaggtcttcaagcctaagggagcagatcgaaagcagaaaaccgatcgtgaaaagatggaaaagaggactgcacatgaaaaggagaagtaccaaccctcctatgatactaccattttgaccgaatgttctccatggccggatgctcccacagcgtacgtgaacaacagcccatctcccgctccaacctttacctcaccccaacagagcacatgcagtgttcctgattcaaattctagctctccaaaccaccagggagacggtgcaagccagacctccggggaacaaatccagccatcagcaactatacaagagacgcagcaatggctgctcaagaaccgtttcagttcgtatactagactgtttagcaacttttctggggctgacctgcttaagctcaccaaggaggatcttgtccagatatgcggtgctgccgatggcatacggctctacaatagtctgaagtctcggtctgtaagacctcgcctgactatatacgtatgcagagaacaaccaagcagcacagtgctgcagggccaacagcaagccgctagcagtgctagtgaaaatggctctggtgctccttacgtgtaccacgcaatctatctcgaggaaatgattgcaagcgaggtggcacggaagttagcgctggtgtttaatatccctttgcatcaaatcaatcaggtgtatcggcagggacccaccggtattcacattttggtgtccgatcagatggtccagaacttccaggacgagtcctgctttcttttcagcactgttaaggccgaatcatccgacggcattcatattatcctgaaatag

SEQ ID NO: 246324 - DNA, 447 bp, Artificial Sequence
  Description of Artificial Sequence: Synthetic coding sequence
atggcctgggtactgaagatggacgaagtgatcgagagcggtctggtgcacgactttgatgctagcctgtccgggattgggcaggaactgggtgctggggcatattcaatgagcgatgttctagctctccctatattcaagcaagaagacagctctctacctcttgacggtgaaacggaacacccaccgtttcagtacgttatgtgtgcagccacctcccccgcagtcaaactgcacgacgaaacactgacctacctgaaccagggacagagctatgaaatccgtatgctggataaccgcaagatgggggacatgccagaaattaatggcaaactcgtgaaatctatcataagggtggtcttccacgaccggagacttcagtataccgagcaccagcagcttgagggttggaagtggaatcgccctggcgatcggctattggattag

SEQ ID NO: 246325 - DNA, 2295 bp, Artificial Sequence
  Description of Artificial Sequence: Synthetic coding sequence
atgaatggggaggccgactgtcctacggacctcgaaatggcagctcccaaaggccaggacaggtggtctcaagaggacatgctgacccttctggaatgcatgaaaaacaatcttccaagcaatgacagctcaaagttcaagaccacagagtctcacatggattgggagaaggttgcgttcaaggacttcagtggggacatgtgtaaactgaaatgggtggagatcagcaacgaagtgagaaaattccggacattgacagagctaatcctagacgcacaggaacatgtgaagaacccttacaagggaaagaaactcaaaaagcacccggatttcccgaagaagccactgactccgtatttcaggttctttatggagaagagagctaagtacgcaaaactccacccggagatgtccaacctcgacctgaccaagatcttgtccaagaaatacaaagaactgccggaaaagaagaagatgaagtacatacaggattttcagagggagaagcaagagttcgaaagaaatctcgctcgctttcgggaggatcacccggacctgatccagaacgccaagaaatcagacatacccgagaagccaaagacgccccagcaactgtggtatactcatgaaaaaaaagtgtatctcaaggtgcgccctgatgccaccacaaaggaagtgaaagatagcttgggcaaacagtggagtcaacttagtgacaaaaagagacttaagtggattcacaaggcattggaacaaagaaaggaatatgaggagattatgcgggactacatccagaaacaccccgaactgaacatctctgaagagggtattacaaagtcaacgctgacaaaagcagagcggcagctgaaagacaagttcgacggtcgcccaaccaagcctcctcctaactcctacagcctgtactgtgctgaattgatggcaaatatgaaagatgttccatccactgagcgcatggttctgtgtagtcagcaatggaaattgctgtcacagaaagagaaggacgcgtatcataaaaaatgcgatcagaagaagaaagactacgaggtggagctcttaagatttctggagtcactccctgaggaggagcaacagcgtgtgctcggcgaagagaagatgttaaacattaacaaaaagcaggcgactagtccggcatcaaagaaacctgcccaggaagggggtaaagggggaagcgagaagccaaaaagaccagttagtgccatgtttatcttcagcgaagagaagcggagacagctccaggaggagcggccagaattgtctgagtcagaacttacccgcctcctcgcacgcatgtggaacgacctgtccgaaaaaaagaaggccaaatataaggccagggaggccgcactcaaagcccagtctgaacggaagcccggtggagaaagggaggagcggggtaaactgcctgagagtcccaagagagctgaggagatctggcagcaatcagtaataggagactacctggctcgcttcaagaatgacagagtcaaagccctgaaggccatggaaatgacctggaacaatatggaaaaaaaggagaaactaatgtggatcaaaaaagccgctgaagaccagaagaggtacgaaagagaactctcagagatgcgagcaccacctgcagccaccaactcaagcaagaagatgaaatttcagggcgaacctaagaaaccccctatgaacggttatcaaaagttctctcaggaactgctttcaaacggcgagctgaatcacctgcccctgaaggagcggatggtcgagattggttctcgatggcagagaatatctcaaagtcagaaggagcattataagaagctagctgaggagcagcagaagcagtacaaggtccacctggacctgtgggtcaagtccctgagtccccaggatcgcgcagcttacaaggaatatatctcaaacaagcgtaaatctatgaccaaactgcggggtcctaacccgaagtcgtcaaggaccactcttcagtccaaaagcgaatctgaggaagacgatgaagaagacgaagatgacgaagacgaagacgaagaagaagaggacgacgaaaacggagactcttctgaggacggcggagattcctcggaatcatcgagtgaagacgagtcggaggatggggatgagaatgaagaagatgatgaggacgaggatgacgacgaggatgatgacgaggacgaggataacgagtctgaggggagctctagttcgtcctccagcagcggggattcctccgactcagacagcaattag

SEQ ID NO: 246326 - DNA, 2184 bp, Artificial Sequence
  Description of Artificial Sequence: Synthetic coding sequence
atgaatggcgaagccgattgcccaaccgatctcgaaatggccgctcctaagggtcaggatcgatggtcacaggaggacatgctgaccctactagagtgcatgaaaaataatctaccgtctaatgatagcagcaagtttaaaaccaccgagtcacatatggactgggaaaaagtagcctttaaggatttttcgggcgatatgtgtaaactcaaatgggtggagatttctaacgaggtgcgcaaattccgaacactgactgaactcatactcgacgcacaagagcatgtcaagaacccgtacaaaggtaaaaagctgaagaagcaccctgacttccccaagaaaccgctcacaccgtattttcgattctttatggagaaaagggcaaaatatgcaaaactgcaccccgaaatgtctaacctggacctgaccaaaatattatctaagaagtataaagaactgcctgagaagaagaagatgaaatatatccaggattttcagagagagaagcaagaatttgaacgaaatctggcaaggtttcgcgaggaccatccagacctcatacagaatgccaagaaatccgacattcctgagaagccaaagacaccccagcaactgtggtacacacacgagaagaaagtgtatctgaaagtgcggccagatgaaataatgcgagactacattcagaaacatcctgaactgaatatctccgaagaggggatcacaaaatcaaccctgacaaaggcagagagacaactgaaagacaaattcgacggcagaccaaccaaacccccacccaactcttactcactctactgcgcagaacttatggctaacatgaaagacgttccctccaccgagcgaatggttctatgcagccagcagtggaagcttctaagtcaaaaagagaaggacgcgtaccataaaaaatgcgaccagaagaaaaaagattatgaggtggagttgcttcgctttctggagagcctccctgaggaggagcaacagcgggtcctgggagaggagaagatgcttaacatcaataagaagcaggcaacatcgcccgcatctaaaaaaccggctcaggaaggcggaaagggcggtagtgagaagcccaagaggcccgtgagcgctatgtttatattctctgaagagaagcgtagacaactccaggaggaacgtccagagctgtctgagtcggagctgaccagactactggcacgcatgtggaacgacttgagcgaaaaaaaaaaggcgaaatataaagcgagggaggcagccctgaaagcacagtcagaaaggaaacctggcggagaacgtgaagaaagaggcaagctgccagagagtcccaagcgcgctgaggaaatctggcagcagagcgttatcggagactaccttgcacggttcaagaacgatagagtgaaggcgctcaaggcaatggaaatgacctggaacaatatggaaaagaaagaaaagttgatgtggatcaaaaaggccgcagaagaccaaaagcgctatgaacgggaactcagcgagatgagagcccctcctgctgccactaattcttccaagaaaatgaagttccagggcgagcctaaaaagccacctatgaacggttaccagaagtttagtcaggaactgctgtccaatggcgagctgaatcacctgcccctgaaggagagaatggtggaaattgggtctcgctggcagagaatatctcaaagccagaaagagcattacaagaaactggctgaggaacagcagaagcagtataaggtgcacctggacctgtgggtgaaaagcttaagcccccaggaccgagctgcttacaaagagtatatctcgaataaacggaagtcaatgaccaaattgcggggacccaacccaaagtcctccagaaccactctccagtctaagagcgagtccgaggaagatgacgaggaagatgaggacgacgaagatgaggacgaggaggaagaagacgatgagaatggtgatagtagcgaagatggcggagactcgtccgagtcaagctccgaagatgagagtgaggacggtgacgaaaacgaagaagacgacgaagatgaggacgatgatgaggacgacgacgaggatgaagacaacgaatctgagggttcttccagttcatccagcagtagcggagattcttcggattctgacagcaactag

SEQ ID NO: 246327 - DNA, 2184 bp, Artificial Sequence
  Description of Artificial Sequence: Synthetic coding sequence
atgaacggcgaggctgactgtccaacagatctcgaaatggcagcgcctaaaggccaagatcgctggagccaggaggacatgctgaccctgctcgagtgcatgaaaaacaatcttccctccaacgattcaagtaaattcaagacgacagaatctcacatggactgggaaaaggtggcctttaaagatttttcgggggacatgtgcaagctcaagtgggtggagatcagcaatgaggtccgaaagtttcggactttaacagagttgatcctagatgctcaagaacacgtgaaaaacccctataaaggcaagaagctcaagaaacacccggactttcccaagaagccactgaccccttattttcgattcttcatggagaaaagagctaagtacgctaaacttcatcccgaaatgtccaacctagatcttactaaaattttgtcaaagaagtacaaagaactgcctgaaaagaaaaaaatgaaatacattcaggacttccagagagagaaacaggaattcgagaggaatctggctagattcagggaggatcatcccgatctgatacagaatgccaaaaagtctgatattccagaaaagcccaagacccctcagcaactgtggtacacacacgagaaaaaggtgtatctcaaagtcaggcctgacgagataatgagggactacatccagaagcatcctgaactgaacatttctgaagaagggattactaaatctactctgaccaaggccgagcgccaattaaaagacaagttcgatgggaggcctacaaaaccgcctcctaactcttacagcctgtattgtgcggaactcatggccaatatgaaagacgttcctagcacagagagaatggtgttatgttcccagcaatggaagctgctgtcgcagaaagaaaaagatgcttatcacaaaaagtgtgatcaaaagaaaaaggactatgaggtggaactgctgcggtttctagagagcctaccggaggaggaacagcaaagagtactcggggaagagaagatgctgaatattaacaaaaaacaggccacatctccagcctccaaaaagcccgctcaggagggtggtaagggaggttctgaaaagcccaagcgccctgtttccgccatgtttattttctctgaggagaagcggaggcagctgcaggaagagcggcctgagcttagcgagtctgagctaacaaggttacttgcacggatgtggaacgacttaagtgagaagaagaaggctaaatacaaggccagggaggcagcacttaaggcccagtcggagagaaaaccaggtggtgagcgcgaagagagggggaagctccctgagagtcccaagcgggctgaggagatttggcagcaatctgtgatcggagactatctcgcacggtttaaaaatgatagggtcaaggccctgaaggcaatggaaatgacctggaataacatggaaaagaaggagaagctgatgtggattaaaaaggccgcagaggatcagaaaaggtacgaaagggaactctctgagatgcgagccccaccggcagcaacaaattcttctaagaagatgaagttccagggcgagcccaaaaagcccccaatgaatggctaccagaaattctcacaagagctcttgagtaacggagagttgaatcatctgcctcttaaagagcggatggttgagatcgggagcagatggcagcgcatttcacagtcacagaaagagcattacaagaagttagcggaagagcaacagaagcagtacaaagtccacttggacctgtgggtcaaatcactgtccccacaggaccgtgctgcttataaagagtacatctccaataaacggaaaagcatgacgaaattgcgcggacccaaccccaaatcgagtcggacaacactgcaaagcaagtctgaaagcgaggaagatgacgaagaggacgaggatgatgaggatgaggatgaagaggaagaagatgacgaaaatggcgactctagcgaggatggtggtgacagcagcgagagctcaagtgaagacgagtctgaagatggcgatgagaacgaggaagacgacgaagacgaagacgatgacgaggatgatgatgaggacgaggataatgagtcagaaggcagtagcagctcatcaagtagtagtggggattcttccgactctgatagcaactag

SEQ ID NO: 246328 - DNA, 2295 bp, Artificial Sequence
  Description of Artificial Sequence: Synthetic coding sequence
atgaatggggaggccgattgcccgacagacctggagatggccgcaccaaaagggcaagaccgctggagccaggaggacatgctgacactgctggagtgtatgaaaaacaacctgccatctaacgattcaagcaagttcaaaacgaccgagtctcacatggattgggagaaggtggcttttaaagactttagtggcgacatgtgcaagctgaagtgggtggagattagcaacgaggttcggaaattccggacgctgactgagctgatactagacgcgcaggagcatgtgaagaatccctataaggggaagaaactcaagaagcatcccgacttcccgaagaaaccacttactccgtattttcgctttttcatggagaagcgggctaaatatgccaaactacatcctgaaatgagcaacctagatttgacaaagattctttccaagaagtacaaggagttgccggagaaaaaaaagatgaaatacatacaggatttccagcgggagaaacaggaatttgagcggaacctcgccagattcagggaggaccatcccgatctgatccaaaacgcgaagaagagtgatatacccgaaaagcccaaaaccccccagcagctctggtacacacatgaaaaaaaagtttatctaaaggtgagacccgacgccactaccaaagaggtgaaagattcactgggaaaacagtggagccagctctctgacaaaaagcggctcaagtggatccacaaagctttggagcagagaaaggaatatgaggagattatgcgcgactatatccaaaaacatccagaactcaatatatccgaggaggggattaccaagtcaaccctgactaaagcagagagacaactaaaggacaagtttgacggtagacctacaaaacccccaccaaatagttatagtctgtattgcgctgaactcatggcaaatatgaaggatgttcctagcaccgaacgcatggtgctgtgctcacaacaatggaagctcctgtcgcaaaaggaaaaggacgcctaccataaaaagtgcgatcagaaaaagaaggattacgaagtcgagttgcttcgtttccttgagtctctgccagaggaagagcaacagcgggtgctcggtgaggaaaagatgttaaacatcaataaaaagcaggctaccagtcccgcatccaaaaaaccagcacaagaaggtggcaaggggggttctgagaagcccaaacggccagtgtccgccatgttcatctttagcgaagaaaagcgaaggcagctgcaggaagagcgtcctgagctgagcgagagtgagcttacaagactcctggctagaatgtggaacgacctctcagaaaagaaaaaggcaaaatacaaggcgagagaagccgcactcaaagcccagtctgagcgcaaacctggtggggagcgcgaggaacgaggcaagctgcccgagtcaccaaaacgggctgaggaaatctggcaacaaagcgtgatcggggattatctcgcgagatttaagaatgatcgggtcaaagctctgaaagctatggagatgacctggaataatatggagaaaaaagagaagcttatgtggatcaaaaaagctgctgaggaccagaaaaggtacgaacgtgagctttctgaaatgcgcgcacctcccgctgccaccaacagttccaaaaagatgaaatttcagggcgaacctaagaagccccctatgaatggctatcagaagttttcccaggaacttctgagtaacggcgagctgaatcatctgccccttaaagagcggatggttgagatcggatctcgctggcagcgcatttcccagagccagaaggagcattataagaagttagctgaggagcagcagaagcagtacaaagtgcatctggatctctgggtgaaaagtctttcgcctcaggacagagctgcttacaaggagtacatttcaaacaaaaggaaaagcatgactaaacttagggggcctaaccctaagagcagtcggacaacactccaatcaaagtccgagagcgaggaggatgacgaggaagacgaggatgacgaggacgaagatgaagaagaagaggatgacgaaaacggcgactctagtgaggatggtggtgattccagcgagtcgtccagtgaggatgaatcggaggacggtgacgagaacgaggaggacgacgaggacgaggacgacgacgaagacgatgatgaagacgaagataacgagtctgagggttcttcctcctcaagctctagtagcggtgactcgtctgacagtgacagcaactag

SEQ ID NO: 246329 - DNA, 2184 bp, Artificial Sequence
  Description of Artificial Sequence: Synthetic coding sequence
atgaatggcgaagccgattgcccgacagatttggagatggctgcacccaaaggacaggatcgatggtcccaagaagatatgctcactttactggaatgtatgaaaaacaatttaccttcgaatgattcctcaaaatttaaaaccacggagtctcacatggattgggagaaggtagcattcaaggatttttcaggggatatgtgtaagctgaaatgggtggaaattagtaatgaagtgaggaagttccgaacgctgactgagttaatactggatgcccaggagcacgtcaagaacccttataaaggcaagaaactgaaaaagcacccggacttccccaaaaaacccctgactccctatttccgattctttatggagaagagggcgaagtatgccaagctacatcccgagatgtccaatctcgacttgaccaagatcctgagcaagaaatataaggaacttccagaaaagaagaagatgaaatacatccaggattttcaacgcgagaaacaggaatttgaaagaaacctggctcgttttagggaagaccatcccgatctgatccagaatgctaaaaagtctgacatcccagagaaacctaaaaccccccaacaattatggtacactcatgagaagaaggtgtacctgaaagtgcgcccagatgaaattatgcgcgactacattcaaaagcatcctgagttgaatatctccgaagaaggcatcaccaagagcactctgacgaaggctgaaagacagttgaaggacaaatttgatggccgacccacaaagccccctccgaatagctactccttgtactgtgcagaactgatggccaatatgaaggatgtgcctagcaccgaacggatggttctttgcagccagcagtggaagctgctttcccagaaggagaaggacgcataccataaaaagtgcgatcagaagaagaaggactatgaagtggaactgttacggtttctcgaatcgctgcctgaagaggagcagcaacgggtgctgggagaggaaaaaatgcttaatattaataaaaagcaggccacatcgcccgcttccaagaagccagcccaggagggaggcaaaggcggttcagagaagccaaagcggcctgttagcgctatgtttattttcagtgaagaaaaacggcgacagctgcaggaagaaaggccagaattaagcgagagcgaacttactcggctgctggccaggatgtggaacgatctgtccgaaaagaagaaggctaagtacaaggctagggaagccgcattaaaggctcagtctgaacgcaagcccggtggtgaacgcgaggaaagaggtaaacttcctgagagcccaaaaagggcagaggagatctggcagcaaagcgtcataggtgactatctggctagattcaaaaatgatcgagtgaaggctcttaaggccatggaaatgacgtggaacaacatggaaaaaaaagagaagctgatgtggatcaagaaggctgctgaggatcaaaagcggtatgagcgtgagctgtccgagatgagagccccacccgcagccaccaattcgagtaaaaagatgaaattccagggagaacccaagaagcccccaatgaatggatatcagaagttttcccaggagctactgtcaaatggggaactcaatcacctacccctcaaagaacgcatggtcgagatcggaagtcggtggcagcgtattagtcagagtcagaaagagcattataagaagctcgccgaggaacagcagaagcagtataaagtgcacctggacctctgggttaaaagtctctctcctcaggaccgtgccgcatataaagaatacatctctaacaagcgtaaatctatgacaaagctgaggggaccgaatccaaaatccagccgcacaactctgcagtccaagtcggagagcgaggaggacgacgaagaggacgaagacgacgaggacgaagacgaagaagaagaagatgacgagaacggagattcctcagaggatggtggagattcttccgaaagcagttctgaagacgaatcagaggatggtgacgagaatgaggaggacgacgaggatgaggacgatgacgaagacgacgacgaagacgaagacaacgagagtgaggggagttctagcagtagtagttcatcaggtgacagtagcgattctgatagcaactag

SEQ ID NO: 246330 - DNA, 2295 bp, Artificial Sequence
  Description of Artificial Sequence: Synthetic coding sequence
atgaacggggaggcggattgtcctaccgacctggaaatggccgctcctaagggccaggacagatggtctcaggaggacatgcttacccttcttgaatgtatgaagaacaatctacctagcaatgatagttctaagtttaagacaaccgaatcacacatggattgggagaaggtggcctttaaggatttcagtggagatatgtgcaagttaaaatgggtggagattagtaatgaagtcaggaaatttagaactttgactgaactcatcctcgatgcccaagagcatgttaaaaatccgtacaagggcaaaaagcttaagaaacacccagatttccctaagaagcccttgactccttattttcgtttcttcatggagaagcgcgcaaagtacgcgaagctccaccccgagatgagtaatttggatttgacaaaaatcctctccaagaagtataaggaactgccggagaagaagaagatgaaatacattcaggacttccagcgggagaaacaggagttcgaaagaaatctggccaggttcagagaggaccatccagacctcatccaaaatgctaaaaaatccgatatccctgagaagcctaagactccacagcaactgtggtacacccacgagaagaaggtgtaccttaaagtgcggcctgatgcaactactaaagaggtgaaagatagcctcggcaaacagtggtctcagctgtctgacaagaagcgccttaagtggatccataaggctttagagcaacgcaaagagtatgaggaaataatgcgcgactatatccagaagcacccagagctaaacatcagcgaagagggcattacgaagagcacgctcaccaaggccgagcgtcagctcaaggataaatttgatgggcgtcccacaaagcccccacctaactcttattcactgtactgtgccgagctgatggccaatatgaaagatgtgcccagcaccgagagaatggtgctgtgttctcagcaatggaagctgctctcacagaaagaaaaggacgcctaccacaaaaagtgtgatcagaagaagaaagactatgaggtcgagttgctgcgctttttggaaagcctccccgaggaagagcaacagagagtgttaggagaggaaaagatgcttaacattaacaagaagcaagccacctcccctgcatctaaaaagccagctcaggagggcggaaagggaggttctgaaaaaccaaaacgaccagtgtctgccatgttcatttttagcgaagaaaagcgccgtcagctccaggaagaacgtccagaactcagcgaatccgaattgaccaggctacttgccaggatgtggaacgacttgagtgaaaagaagaaggctaaatacaaagcaagggaggctgctctgaaggcccagagtgagagaaagcccggaggtgaacgtgaagagcggggaaagctgcccgagagtcccaaacgcgctgaggaaatttggcagcagagcgtgatcggcgattatcttgcaagatttaagaacgatcgggtgaaagccttgaaggctatggaaatgacttggaacaacatggagaaaaaagaaaagctgatgtggataaaaaaggccgcagaagatcaaaaaaggtatgaaagagaactgtccgaaatgcgagctcctccagcagctacaaacagttcaaagaaaatgaagttccagggagaacccaagaagcctcccatgaacgggtaccagaaattctcccaagaacttctgtctaatggagagctgaaccacctgccactgaaggagagaatggtggagatcggttccaggtggcaacgcattagtcagagtcagaaggagcactacaagaaactcgccgaagaacagcagaagcagtataaggtgcacctggacctttgggtgaagagcctgtcgcctcaagatagagccgcatataaggaatacatttccaacaagcgtaagagcatgactaaactccgaggacctaaccctaaatcttctcggactactctccagagcaagtctgaatcggaggaggacgatgaagaggatgaggatgatgaggatgaggatgaagaagaagaagatgacgagaacggggactctagtgaggacggaggcgacagctctgagtccagctccgaggacgaatcagaggacggggacgagaacgaggaggacgacgaggacgaagacgacgacgaagatgacgatgaggacgaagataatgaatcagaaggctccagtagctcttccagtagttccggagactccagcgactccgatagtaactag

SEQ ID NO: 246331 - DNA, 2184 bp, Artificial Sequence
  Description of Artificial Sequence: Synthetic coding sequence
atgaacggtgaagccgattgccccaccgaccttgagatggctgcgccaaaaggccaggaccgatggtctcaggaggacatgctgacactcctggagtgcatgaagaacaacctgccctccaatgactcatctaaattcaagacgaccgagtcccacatggattgggagaaggttgcatttaaagacttcagcggagatatgtgcaagctcaagtgggtagagatctccaacgaggtcagaaaattccggacactcactgaacttattctggatgcacaggagcatgtcaaaaacccatataaaggtaagaagctcaaaaaacacccagatttccctaagaagccgttaaccccatacttcaggttcttcatggagaagcgagcgaaatatgccaagctgcaccccgagatgagcaatctggacctcacaaaaatactgagcaagaagtataaagagcttccagaaaagaaaaagatgaaatatattcaggattttcaacgggagaagcaagagttcgagaggaatctggccaggtttcgtgaggatcatccagacctcatccagaatgccaagaaaagtgacatccctgagaaacctaagacacctcagcagctatggtacactcacgaaaagaaggtttacctgaaagttaggccggacgagataatgagggactatatccagaagcaccctgagctcaatatttcagaggagggtattacaaagtccaccctgactaaagctgagaggcaacttaaggacaagttcgatgggcgacctacaaagcctcctcccaattcatatagcctttactgcgcagagctcatggccaatatgaaagatgtcccttccactgaaaggatggtgttgtgcagtcagcaatggaagctgctgtctcagaaggaaaaagatgcttatcacaagaaatgtgatcagaagaaaaaggattacgaagtcgaactcctcaggttcctagagagcctgccagaggaagaacagcaacgggtgctgggggaggagaagatgctaaacatcaataaaaaacaggcaacaagccccgcttccaagaaacccgctcaggagggtgggaaaggcggatcagagaagccaaagagaccagtgtctgccatgttcatctttagcgaagaaaaacgacgtcagctccaagaggaaaggcccgaacttagtgaatctgaactgactagactcctggctagaatgtggaacgacctgtctgagaagaaaaaagctaagtacaaagccagagaggccgcactaaaggcccaaagcgaaagaaagcccggtggagaaagagaggaaagaggaaagctgcccgagtcaccaaaacgggctgaggagatctggcagcagagtgtcattggagactatctagcacgatttaaaaatgaccgggtgaaagctctaaaagctatggaaatgacctggaataacatggaaaagaaggaaaaactgatgtggatcaaaaaagcggcagaagaccaaaaaagatacgagcgggagctgtcagaaatgcgggctccaccagctgccaccaactcatctaagaagatgaagtttcaaggagagcccaagaagcctcccatgaatggttatcagaagttttctcaggagctgctgagcaatggcgaactaaaccacttgccacttaaggagagaatggtcgagatcggctccagatggcagcgaataagccagtctcagaaggaacactataaaaagttagcagaagagcagcagaagcagtacaaagtccatttggatctctgggtgaaatccctgtcgccacaggatcgagcggcttacaaagagtacatctccaacaagcgaaagagcatgacgaaactgcgaggaccaaaccccaagagctctagaaccactcttcagtccaagtcggagtcagaggaggacgatgaagaggatgaagatgacgaggacgaggacgaagaagaggaagatgatgagaacggcgattcttctgaggatggcggagatagtagcgaatcaagctctgaggacgagtcagaagacggcgatgaaaatgaggaggatgacgaagacgaggatgacgacgaggacgacgacgaagatgaagataatgagtctgaggggagctcatcttcctcatctagctcaggggattcctctgattctgactcaaattag

SEQ ID NO: 246332 - DNA, 849 bp, Artificial Sequence
  Description of Artificial Sequence: Synthetic coding sequence
atgaagggacagcagaagaccgctgaaacggaggagggcacggtccaaattcaggagggtgcggttgctaccggggaggatcccacatcagtagccattgcaagcatacagtctgcagctacttttcccgatcccaacgtgaaatacgtttttagaactgagaacggtggacaagtgatgtacagggtgattcaggtgagcgagggccaattggacggccagaccgagggcactggggctatctcaggatatcctgccactcagtcgatgacccaagccgttattcagggagcatttacatccgatgatgccgtggacactgaagggaccgcagccgagacacactacacctacttcccgtcgactgctgtcggggacggcgcagggggtcagttttttgtgatgatgtccccccaagaagtccttcagggagggagtcagaggagtatcgctccccgtactcacccctactctcctaagtccgaggcccctcgtaccaccagagatgagaagcgcagagctcaacacaacgaggttgaacggaggagacgagacaagataaacaactggattgtgcagctttctaaaatcattccagattgctccatggagtccaccaaatccggccagtcgaaaggcggtattctgagtaaggcgtgtgattacattcaggagctgaggcagtccaaccataggctctcagaggagttacaggggctagaccagctccaattggacaacgacgtgttacggcaacaggtcgaggaccttaaaaacaagaaccttctgctgcgcgctcagcttcggcaccatgggttggaagtggtcatcaagaacgattccaactag

SEQ ID NO: 246333 - DNA, 933 bp, Artificial Sequence
  Description of Artificial Sequence: Synthetic coding sequence
atgaaagggcagcaaaagacagcagagaccgaagaagggactgtccagatacaggaaggggctgtggccacaggcgaggacccaaccagtgtagctattgcaagcatccagtctgccgcaaccttccccgatccaaacgtgaagtacgtcttccgcacagagaatggtggacaagtcatgtaccgggtgattcaggtcagtgagggccagctcgacggacaaacggaaggtactggagccatctcaggttatcccgcaacccagagcatgactcaggccgtgatccagggtgcatttaccagcgatgatgccgtggacactgaaggcacagctgcggagactcactatacttatttcccttccactgctgtcggtgacggcgctggaggaacaacctccgggtctacagcggcagtcgtgacaactcagggcagcgaggccttattaggccaggctaccccacccggaacaggacagttttttgtgatgatgtcacctcaggaggtgttacaagggggaagccagcgcagcattgctccacgtacccatccttatagccctaaatcggaagccccacgtacaactcgggacgaaaagaggcgcgctcagcacaacgaggtggaaaggagacgcagggataaaatcaataactggatcgtgcagctttccaagatcattcccgactgctcaatggagtcaaccaagagcggacagtcaaagggaggcattctgtccaaggcatgcgactacattcaggagctccggcaaagcaatcacagattgagtgaagaacttcaagggctggaccagcttcagctggacaatgacgtgcttcgtcagcaggtcgaggatctgaaaaataagaatcttctgttgcgcgctcagttgcggcatcatgggctggaggttgtgatcaaaaacgactcaaattag

SEQ ID NO: 246334 - DNA, 933 bp, Artificial Sequence
  Description of Artificial Sequence: Synthetic coding sequence
atgaaaggccagcagaagaccgccgagaccgaggaaggaaccgttcagatccaggagggcgcagtggcaactggggaggatccaacaagtgttgcaatcgcttccattcagtccgccgctacctttccagacccaaatgttaagtacgtcttcaggaccgaaaacggcggacaggttatgtatcgcgtcatccaggtgtctgaaggtcagctcgacgggcagactgaggggacaggcgcaattagcggctaccctgccacccagagcatgacacaggctgtcattcaaggggcattcacatctgacgacgcagtcgatacagaaggtacagccgctgaaacccactacacttatttccccagtacagccgtgggagacggcgcaggcggaacaactagtggatcgacggccgcagttgtgacaacccagggcagcgaggccttgctgggtcaggctacccctcccggaaccggccagttcttcgtcatgatgagcccccaggaggtgcttcaagggggttctcagaggtccatcgcacctcggactcatccttactctccaaagagtgaagcccctaggacaacccgggacgagaaacggagagctcagcataatgaggttgagcgtagaagacgcgacaaaattaataattggatcgtgcagctgagcaaaatcatccctgactgtagtatggagagtactaaaagcggtcagtctaaagggggaatcctgtcaaaggcttgtgattacatccaagaactcagacagtccaaccaccggctgtccgaagaactacagggcctcgatcagcttcagctagataatgatgttctgcggcagcaagtggaggatctcaagaacaaaaatctcctcctgcgcgctcagctgaggcaccacggactggaggtggtgataaaaaacgacagtaactag

SEQ ID NO: 246335 - DNA, 756 bp, Artificial Sequence
  Description of Artificial Sequence: Synthetic coding sequence
atgtatagagtgatccaggtgtcggagggtcagctcgatggtcaaacagaggggacaggagccatctccggctaccccgcaacacagagcatgacccaggcagtcatccagggcgcttttacttcagacgatgccgttgataccgaagggactgcggcagagacacattatacatattttccctctaccgcagttggggacggtgcaggtggcactacttctggctcaactgccgctgtggttaccactcagggctcagaggcactcctcggacaggcaactccccctggcactggacaattctttgtaatgatgtcacctcaggaagttctgcaaggaggtagccaacgatcaatagcccctcggacacatccctattctcctaagtctgaagcccctagaaccacaagagatgaaaagcggagagcccagcataacgaggtggagagaaggagaagagacaagatcaacaactggatcgtgcagctgtcaaagatcattccagactgttctatggaatcgacaaaaagcgggcagtcaaaggggggtatactgtcgaaggcgtgcgactacatccaggagctgcgtcagtccaaccaccggttatccgaagagctgcaaggcctggatcaactccagctggataacgacgtcctgagacagcaagtcgaagatctcaagaacaagaaccttctgctgagagctcaactgcgccaccacggactggaagtggtcattaagaatgactccaattag

SEQ ID NO: 246336 - DNA, 1155 bp, Artificial Sequence
  Description of Artificial Sequence: Synthetic coding sequence
atggctggcgctgaatggaagagcttagaggagtgtctcgagaagcacctgcctctgccggatctacaggaggtgaaaagagtgttgtatgggaaagaattgagaaaattggaccttccccgagaggcatttgaggccgcaagtagagaagactttgagctgcaggggtacgcatttgaagctgctgaagaacagcttcgacgacctcgaatcgttcacgtgggcctggtgcagaaccgcataccactgcctgcaaatgcccctgtggccgaacaggtctccgccttgcatagaagaattaaagccatcgtcgaagtagccgcaatgtgcggggtcaatatcatttgtttccaggaggcatggaccatgccatttgctttttgcacgcgggagaaactgccctggaccgagttcgccgagtccgcggaggatgggcctacaacacgcttctgtcagaagcttgccaaaaatcatgacatggttgtcgtatccccgattctcgagcgcgattcggaacacggagacgttctgtggaacactgctgtggtgatctccaattcaggagccgtgctggggaagacacgcaagaaccacattccacgggtaggagattttaatgagtcaacttactacatggaggggaacctcgggcatcccgtgttccagacacagttcggccgtattgcagtcaacatatgttatggccgacaccatcctcttaattggctcatgtatagcataaacggcgctgagattattttcaatccctcagcgactataggcgcattgtctgaatccttgtggccgattgaggccaggaatgcagccatagctaatcattgcttcacctgtgccataaaccgcgttggtaccgaacatttcccgaatgaattcactagcggcgatggcaagaaagcacatcaagactttggttatttctatggatcctcttacgtggccgcaccagacagttcacggactccaggcctgagccggtcaagagacggtctccttgtggccaaactggacttgaatctgtgtcagcaagttaacgacgtctggaatttcaagatgaccgggcgatacgagatgtatgcccgtgaactggccgaagccgtgaagtccaattattccccaactattgttaaggaatag

SEQ ID NO: 246337 - DNA, 951 bp, Artificial Sequence
  Description of Artificial Sequence: Synthetic coding sequence
atgcttggagaggctccagctgcacctcgcttagcaggcagtgaggccaggtcgctgtggcaaggcacacaggtatccgcgcttcaccgccgtattaaagctatcgtcgaggtagcagctatgtgcggtgtgaatataatttgttttcaggaggcctggacaatgccctttgccttctgtacccgcgagaaactgccatggaccgagtttgctgagagtgccgaggacggcccaactaccagattctgccagaagttagccaaaaatcacgacatggttgttgtgagcccaattctggaacgggacagcgaacatggagatgtgctgtggaacacggctgttgttatttccaactcaggggcagtgctcggtaaaacccgaaaaaatcacatacctagagtcggggatttcaacgagagcacctattacatggagggaaatctaggacatccggtgttccaaacccagtttggccgaatcgcagttaacatttgttatggccgacaccatccacttaactggttaatgtatagtattaatggcgctgagatcatctttaacccatccgctaccatcggagctttgtcagaaagcttgtggccaatcgaagcccgaaacgctgcaatcgctaaccactgttttacatgcgctataaatcgcgtgggcacagaacacttccctaacgaatttactagcggtgatggaaagaaagctcaccaggactttggttatttctatggctcgagctacgtcgccgcacctgactcatcgcgcactccagggctgtcccggtcacgcgacggccttttggtcgcaaagctggatctgaatctgtgtcagcaagttaatgacgtctggaatttcaagatgacaggcagatatgagatgtatgctagggagctggccgaggccgtgaagtccaattatagccctacaatcgtaaaagaatag

SEQ ID NO: 246338 - DNA, 561 bp, Artificial Sequence
  Description of Artificial Sequence: Synthetic coding sequence
atggctggtgcggagtggaagtccttggaagaatgcctggagaagcatctgccactccccgatctgcaggaggtcaaaagggtgctctatggaaaggaattaaggaagctggatctaccccgagaagcttttgaggcggctagtcgtgaagatttcgaactgcagggctacgcgttcgaagcagccgaagagcagcttcgacgaccccgtatagtacatgtgggccttgtccagaataggattcctttgcccgcaaatgccccagtggcggagcaggtcagtgccttgcatcgtcgcataaaggccattgtcgaggttgccgcaatgtgtggagtcaacatcatttgcttccaggaggcctggattctgcggcctcatcatcaggagccgcgacccccttgttgctacgcccctagttgctgcttgattcccagcgtctttccccatcggagtgagagcatccgcagctctccttcactgtaccatcatttggtccaggcacccggatctagtcctctggcctttgtaatccctagttcatggtcccctgtgccaagttag

SEQ ID NO: 246339 - DNA, 2955 bp, Artificial Sequence
  Description of Artificial Sequence: Synthetic coding sequence
atggatgacagatatcctgccctgcagagggctcagctgcgtctcgacttcattcatgcaaatagcaccacgcacagcttcctgttcggagcattggccgaactgctggacaatgcgagagacgccggtgccgaacgtctagatgtgttctccgtagacaacgaaaaactgcagggtggattcatgctgtgtttccttgatgatggctgcgggatgtcacccgaagaggcatctgacataatttattttgggaggtccaaaaagaggttaagcaccctaaaattcattggacagtatggtaacgggctgaaatccggaagcatgcgaatcggaaaagacttcatactcttcactaagaaagaggaaacaatgacttgcgtgttttttagtcagactttttgcgaagaagaatccttgagtgaggtggtggtgcccatgcctagctggctgatccgcacccgagaaagcgtgaccgatgatccgcagaaattcgcaatggaactgagcatcatttacaaatattccccttttaagacggaagcagaactgatgcagcagtttgacgtcatttacgggaagtgtggcacactgctcgtaatctataacctgaagcttcttttaaacggagagccagaattggacgtgaagaccgataaagaggacatcttgatggcaggggctttagaggatttcccagcacggtggagcttccgggcttatacttctgttctgtatttcaatccttggatgcgaatctttattcaagctaaacgagtgaagacgaagcatctgtgttattgcctgtacagacccagaaaatacctgtatgtgacatcatcctttaagggcgctttcaaagacgaggtgaagaaggcggaggaggccgtaaaaatagcggaatctattctcaaagaggctcagatcaaagtaaatcaatgtgaccggacaagcttgagctccgccaaggacgtgctgcagcgagccctagaggacgtagaggcgaaacagaagaacctcaaggagaaacagagggagctgaagactgctaggactctgtctctgttctacggcgtgaatgtggaaaaccggagccaggctgggatgttcatttactccaataacaggctcatcaaaatgcacgaaaaagtgggaagtcaattgaagttaaaaagccttctgggagccggagtggtgggaattgttaatattccacttgaggtgatggaacctagtcataataagcaggagtttcttaacgtccaggaatacaaccacctattgaaagtcatgggtcagtatttggtgcagtattgcaaagatactggcattaataacaggaatctcacgctgttctgtaacgaatttggatatcagaatgatatagatgtggagaagccgcttaattctttccagtatcagagacgccaggcgatgggcataccatttatcatccagtgtgacctttgtctcaagtggagagttctcccatcatctaccaactatcaagagaaagagttttttgacatctggatttgtgccaataaccctaaccggctggagaactcttgtcatcaagttgaatgtcttccaagtattcccctggggacaatgtccacaatttctccaagtaagaatgagaaggagaagcaactgcgggaatcagtgatcaagtaccagaatcgcctcgcagaacaacaaccccagccccagtttatccccgtggatgagatcaccgtgacatccacatgtcttactagtgcacacaaggagaatactaagacccagaaaatcagactcctaggtgacgacctaaaacacgagtcattgagttctttcgaactcagcgcatccagacgcggtcagaaacgcaacatcgaagagactgattcagatgtggagtacatctccgagaccaagatcatgaagaaaagcatggaggagaagatgaactcacaacaacaaaggataccggtcgctctccccgagaacgtaaaacttgcggaaaggtcccaacggagccagattgccaatatcactactgtctggagggcacaacccacagagggatgtctgaaaaatgcgcaggcggcttcatgggaaatgaagaggaagcagagtttgaatttcgttgaggaatgtaaggtcctcactgaggatgaaaatacgagcgactcagatatcatccttgtgagcgacaaatcgaatacagacgtgagcctcaaacaggagaaaaaagagatcccattgctgaaccaagagaaacaggaattatgcaatgatgtgctggccatgaagagaagtagctccctccctagctggaaatctctcctcaacgtgccaatggaagatgtcaacttgtccagcgggcacatcgctcgggtgtcggtctccggctcatgtaaagtagcatcttcacctgcctcttcacagtctactccagtgaaagagactgtacgcaagttgaagtcgaagctcagggagattctactctacttttttccagagcatcagctcccatctgagttggaggaacccgctctctcgtgcgaactcgaacagtgcccagagcagatgaataagaagctcaagatgtgcttcaaccaaattcaaaacacctatatggtccaatacgagaagaagatcaaaagaaaacttcaatccattatttacgacagtaacactcgcggtatccacaacgaaatttctctcggccagtgtgagaacaagaggaagatatctgaggataaactgaaaaacctgagaatcaaactggccctcctgctccaaaaactccagcttgggggaccggagggtgaccttgagcagaccgatacgtacctagaagccctgctcaaagaggataacctgttattccagaacaatctcaataaagttactatagacgcacggcaccggctgcccctggagaagaacgagaagacttccgaaaattag

SEQ ID NO: 246340 - DNA, 618 bp, Artificial Sequence
  Description of Artificial Sequence: Synthetic coding sequence
atgctcgagatactggaacagcaaaagaaggtggacgctgaaactgtgggtagggtgaaaagattcatccaggaaaacgttttcgtggctgctaatcacaacgggtcaccactgtccatcaaagaggcccctaaagaattaagcttcggagcaagggctgagttgccgcgtatccaccctgtggcctcaaaattgctgagattgatgcaaaagaaagaaaccaatctgtgcctctcagccgatgtaagcctggctcgggagcttctccagctagccgacgccttgggtcctagcatctgtatgcttaagactcatgtagacatactgaacgatttcacactggacgtgatgaaagaacttataaccctggcaaaatgtcatgagtttttgatatttgaagaccgtaaattcgccgacattggcaataccgtcaaaaagcagtacgagggcgacaatctgggacagcaatataactcgccccaggaggtcataggcaagcgcggtagtgacatcattatcgtgggcagggggattatctcagctgcagatcgtctggaagctgctgaaatgtatcgaaaggccgcttgggaggcttacctttctaggctcggtgtttag

SEQ ID NO: 246341 - DNA, 1167 bp, Artificial Sequence
  Description of Artificial Sequence: Synthetic coding sequence
atgctgattcgaagaaaggagacgaaggactatgggacaaaaagacttgtagagggcacgataaatcccggtgagacatgcctgattattgaagacgtcgtgacctcaggctcttcggttctggagacagtggaggtgctgcagaaagagggcctaaaagtgaccgacgcgattgtgctgttggacagggagcagggaggcaaggacaagttacaggcacatggaattcgattacactcagtctgtactctcagcaagatgctggaaatacttgaacagcaaaagaaagtggatgctgagaccgtggggagagtgaagagattcatccaggagaatgtctttgtagcggcaaaccacaacggcagccctttatctatcaaagaggcacctaaggaactgagtttcggcgctcgggctgagctgccacgtattcaccccgttgcaagtaagctgctccgcttgatgcagaagaaagaaactaacctatgcctgtcagcagacgtaagcctggccagggaattgttgcaactagccgatgctctggggccttcgatttgcatgctcaaaacacacgtggacattctgaacgatttcacactggacgtgatgaaagaacttataaccctcgctaagtgtcatgagttcctgatatttgaggatcggaagttcgctgatatagggaatactgtcaaaaaacagtacgaaggtggcatcttcaagatagcctcatgggccgacctggtaaacgctcatgtggtccccggaagcggcgtggtcaaagggctgcaggaagtcgggctccctctgcatagaggctgccttctcatcgcggagatgtcctcgactggctcacttgcaaccggagattacacccgcgcagccgtaagaatggccgaggaacattcggagttcgtggtgggttttattagcggttctagagtctctatgaaacccgagtttttgcacctgacaccgggtgtgcagctggaggctggcggtgacaacctgggccagcagtacaattcgccacaggaagtcataggaaaacgcggaagcgacatcatcatcgtgggcagaggaataatttccgcagcggaccgcttagaggctgccgagatgtaccgcaaggccgcttgggaggcctacctgtctcgactgggagtctag

SEQ ID NO: 246342 - DNA, 909 bp, Artificial Sequence
  Description of Artificial Sequence: Synthetic coding sequence
atgctcgaaattctcgagcagcagaaaaaggtggacgcagaaactgttggaagagtgaaacgctttatccaggagaatgtgtttgtggccgctaaccataatggcagccctctatccattaaggaagcccctaaggagctgagctttggagcacgggctgagctgcctcgaattcatcccgtggcttcaaagctgctgcgactgatgcaaaagaaggagacaaatctctgcctcagcgctgatgtttcacttgcacgggaactactgcagctcgccgatgccttagggccaagcatctgtatgctgaagacgcatgtcgatatcctgaatgatttcacccttgacgtgatgaaagaactgataacactagctaagtgccacgagttcctcatctttgaggacaggaaattcgccgatattggaaatacagttaaaaagcagtatgagggtggaattttcaaaattgcctcctgggctgatctggtgaacgcccacgttgtaccagggtccggcgtcgtgaaaggactgcaagaggttggattacccctgcataggggctgcctgttgatcgcagagatgtcttcaaccggcagcctggcaacaggcgattatactcgagcagccgtaagaatggccgaggaacacagcgagttcgtcgtcggattcatctcaggttcacgtgtgagcatgaagcccgagttccttcacctcactcctggagtgcagctggaagccggaggcgacaacctcgggcagcaatataactctccccaggaggtaatcggcaaacgaggttcggacattatcatagtgggccgagggatcatcagcgcagccgatagactcgaggcggcagagatgtaccggaaggcagcttgggaagcctacctgtcgcgcctgggagtgtag

SEQ ID NO: 246343 - DNA, 933 bp, Artificial Sequence
  Description of Artificial Sequence: Synthetic coding sequence
atggctgccaccggcgcaaacgctgagaaagccgagtctcataacgactgcccagtccgtctgcttaacccgaatatcgcaaaaatgaaggaagatattctttatcacttcaacctgacaactagtagacataacttccccgctctgttcggtgacgtgaagtttgtctgtgtcggcggttcccccagccggatgaaagcttttatcagatgcgtgggcgctgaacttgggctggactgtcccggacgggactacccgaatatatgcgccggtacggataggtacgcgatgtataaggtgggcccagtgctgagcgtgtctcatggcatgggcatcccctctattagcataatgctgcatgagttgattaaactgctgtattacgctcgatgttcaaatgttaccataattcgcatcggaacttccggtggcattggcctcgaacctggcacggttgtcattaccgaacaggccgtagatacttgcttcaaagccgaattcgaacagatcgtgctggggaaacgcgtgatacgcaagaccgatctgaacaaaaaacttgtacaagagctactgctatgcagtgccgagttatctgaatttaccacagtggttggtaacacaatgtgcactttagacttttacgagggccaggggcgtttagacggcgcactctgtagttacacagagaaggacaagcaagcatacttggaggccgcatatgctgctggtgtccgtaacattgagatggagtctagcgtgtttgccgcaatgtgttctgcttgtggtctgcaggctgctgtggtctgcgtgaccctacttaatcgcctagagggggatcaaatttcttcacctcgcaacgtcttgagcgagtatcagcagagaccacagagactggtgtcctactttatcaagaaaaagttgtcaaaggcatag

SEQ ID NO: 246344 - DNA, 933 bp, Artificial Sequence
  Description of Artificial Sequence: Synthetic coding sequence
atggccgcaacaggggctaatgccgaaaaagctgagtctcacaacgactgccctgttcgcctcctgaacccaaatatagcaaagatgaaagaggacattctataccacttcaatctgaccacctccagacataactttcctgcgttgtttggagatgtcaagtttgtgtgcgttgggggaagcccaagccggatgaaggctttcatccgatgtgtcggggctgaactgggcctggattgtccaggacgcgactatcccaacatttgtgctggcaccgaccggtatgccatgtacaaggtcggcccagtccttagcgtctcacacggcatgggtattccatctatcagtattatgctgcacgaactcatcaagctcctgtattacgcaaggtgctccaacgtgacaatcatcaggattggcaccagtgggggaattggcctggagcccggaacggtcgtgattacagagcaggccgtggatacctgttttaaggcggagtttgagcagattgtgctcgggaagagagtcattagaaaaacagacctgaacaaaaagttggtccaggaactgttactctgtagtgccgagctgtccgagttcacaaccgtcgtgggcaacacaatgtgtacgttggacttctatgaaggccagggacgcctggacggcgcactgtgttcgtataccgagaaagataagcaggcctacttagaagccgcttacgccgcaggagttcgcaacattgagatggagtctagcgtattcgctgcaatgtgttcagcatgtgggttgcaagcagcggttgtgtgtgttacactgctgaacaggttagagggcgaccagattagttcacccagaaacgtcctgtctgagtaccagcagcgtccacagaggctggtttcgtatttcattaagaagaagctgtccaaggcgtag

SEQ ID NO: 246345 - DNA, 933 bp, Artificial Sequence
  Description of Artificial Sequence: Synthetic coding sequence
atggctgctactggggctaacgctgaaaaggcagaatctcacaacgactgccccgtccgcctgctgaatccaaacatcgccaagatgaaagaggatattttataccacttcaaccttaccacctcaagacacaatttcccagcacttttcggtgacgtcaagtttgtatgcgttggcggatcaccaagcaggatgaaggccttcattagatgtgttggcgcagagctcggactggattgtcccggacgtgattatcccaacatttgtgctgggacagaccgatatgcaatgtataaggtcggcccagtcttaagcgtttctcatggaatggggattccctctatttcgatcatgctgcatgagcttatcaagctactgtactatgccagatgttcaaatgttacaataataagaattggtacgtctggagggatcggattggagcctgggactgtcgtgatcaccgagcaggccgtggatacctgtttcaaagctgaattcgagcagatcgtcctgggaaagagagtaatacggaagactgacctcaataagaaacttgttcaggaactgttactctgcagcgcggagctttccgagttcacaactgtcgtcggcaacacaatgtgcactctggatttctacgaagggcaaggcagactggacggggctttatgttcatacaccgaaaaggacaagcaggcatatctggaggccgcatatgccgctggggtcagaaacattgaaatggagtcttctgtattcgctgctatgtgctcagcatgcggtcttcaagcagctgtggtatgtgttaccctgctgaatcggctggagggcgatcagatttcatcgcccaggaacgtgctgtccgagtaccagcaacgccctcagcgccttgtgtcctatttcattaaaaagaagctgagcaaggcctag

SEQ ID NO: 246346 - DNA, 435 bp, Artificial Sequence
  Description of Artificial Sequence: Synthetic coding sequence
atggcagcaacgggcgcaaacgcagaaaaggctgaatcccacaatgattgtcccgttaggctcctgaaccctaacatagccaagatgaaggaagatattctatatcactttaacctaaccaccagccggcacaactttccggctttatttggagatgtgaaatttgtatgtgtagggggttccccatcaagaatgaaagccttcatccgctgcgtcggtgcagaattgggtctggattgcccgggtagggactatccaaatatttgcgctgggaccgatcgctacgctatgtataaggtgggaccagtgctttctgtgtctcatgggatgggtatcccgtcaatttcgattatgttgcacgaattgatcaagctgctctactatgccagatgttccaacgtgaccatcatccgcattgggacatccggaggatag

SEQ ID NO: 246347 - DNA, 516 bp, Artificial Sequence
  Description of Artificial Sequence: Synthetic coding sequence
atggccgcaaccggggctaacgcggagaaagcggagtctcacaacgactgcccagtaaggcttcttaatccaaacatcgctaagatgaaggaggatatactgtaccatttcaatttaaccaccagcaggcacaatttccccgctctgttcggtgatgtgaaattcgtctgcgttggagggtccccttctagaatgaaggccttcatccggtgtgtgggagccgaactaggactagactgtcccggacgcgactacccaaatatttgcgccggtacggatagatatgccatgtataaggtagggccagtgctgagcgtgagccatggaatgggaatcccctccatctctatcatgttgcacgaactcatcaaactgctgtactatgcacggtgttcaaatgtcaccattataaggatcggcactagcggcggtattggcatcctcaagcacttgcggaggaaggacacaggtaaaagcaagggaggaagagagagacggtcgacaaaactgcgttag

SEQ ID NO: 246348 - DNA, 522 bp, Artificial Sequence
  Description of Artificial Sequence: Synthetic coding sequence
atgcagcgcaagctgaaggtgacctctcttgagcctgggactgttgtcattactgaacaagccgtagatacctgcttcaaagcagaattcgagcagatagtgctgggcaaaagggtgattcgcaagaccgacctgaacaagaagctggtccaagaattactgttgtgcagcgctgaactgtcggagtttacaaccgtagtcggcaatacaatgtgcactctcgatttttatgagggccagggacggctcgatggtgcgttgtgtagttacaccgaaaaagacaagcaggcctacctggaggctgcctatgcggcaggggtgcgaaacattgaaatggaatcatcagtgttcgcggctatgtgttcagcatgtggacttcaggccgctgtggtttgcgtcacccttcttaaccgcttggaaggggatcagatctcatctccaaggaatgtccttagcgagtaccagcagaggccgcagaggttggtgagctatttcattaagaagaaactgtccaaagcctag

SEQ ID NO: 246349 - DNA, 90 bp, Artificial Sequence
  Description of Artificial Sequence: Synthetic coding sequence
atggcggctacaggagctaacgcggagaaagctgagtcccacaatgactgtcccgtgagactcctcaatccgaacattgccaagatgtag

SEQ ID NO: 246350 - DNA, 441 bp, Artificial Sequence
  Description of Artificial Sequence: Synthetic coding sequence
atggccgctaccggggctaacgcggagaaggcggaatcacataatgactgccccgttaggcttctaaaccctaacatcgccaaaatgaaggaggatatactgtaccacttcaacctaaccacttcccgccacaacttcccagccctcttcggagatgtaaaattcgtttgcgttggaggcagtcccagcaggatgaaggccttcattaggtgtgtcggcgctgaactcgggctcgattgtccaggtcgcgattacccaaacatatgtgcagggaccgaccggtacgctatgtacaaggtggggcctgttttatctgtctcacatgggatgggcatcccctccattagcatcatgttacatgaacttattaaactcttgtattatgccaggtgtagtaacgtaacaatcatacgtatcgggacaagtggcggtatcgggtag

SEQ ID NO: 246351 - DNA, 606 bp, Artificial Sequence
  Description of Artificial Sequence: Synthetic coding sequence
atggcttctgccggaggcgaggactgtgaatctcccgctcccgaggcggaccgccctcaccagcgtccattccttatcggcgtgtcaggaggcaccgcgtctggcaagtctacggtgtgtgaaaaaattatggaactcctgggccagaatgaggttgaacagcgccagcgcaaggtggtaatactaagccaggaccggttctataaggtactgacagccgagcaaaaagctaaagcccttaaagggcagtacaacttcgatcaccctgatgcgtttgataatgatttgatgcacaggacactcaaaaatatcgtcgaagggaagaccgtcgaagtgcctacatatgacttcgtaacccattccaggcttcctgaaactacagtcgtgtacccagctgacgtggtgctcttcgaaggaattctagtgttctatagccaggagatcagagacatgtttcacctacggctctttgttgacactgactcggacgtacgcctttcacgacgcgacaaggaagtttgccgttgcgaccatccagccagatccggccagtatgggtgccatcagcctgatcgtgctgcccacccaggtcacagcgagtggtag

SEQ ID NO: 246352 - DNA, 807 bp, Artificial Sequence
  Description of Artificial Sequence: Synthetic coding sequence
atggcatccgcgggaggggaggactgcgagagccccgctccagaagcagaccggccacaccagcggccatttctcattggctccaccgtctgtgagaagatcatggagttgctgggtcagaatgaagtcgaacaacggcagaggaaggtggtcattctgtcgcaggatcgcttctataaagtcctaaccgcggagcagaaagctaaggccctgaagggacagtacaattttgaccacccagacgcatttgataatgatcttatgcacaggacactcaaaaatattgttgaaggtaagaccgtggaggtgcctacatacgactttgtgacccactctagactgcctgagacaacggtggtctaccccgcagacgtagtgctctttgaaggtatcctggtgttctactctcaggagattcgggatatgtttcatctgagactgttcgtggacacagattcagatgttcgcttaagcaggcgtgtgcttcgggacgtcaggcggggtagagacctcgaacagattcttactcagtacacaacatttgtgaagcccgcttttgaagaattctgtctcccgacaaagaagtacgcagacgtaattattccaaggggcgttgacaatatggtggccattaaccttattgttcagcacattcaggacatcctgaatggtgacatttgcaagtggcatagaggtggaagcaacggcagatcctacaaaaggacctttagcgagcctggcgatcatcccggaatgctcaccagtggaaagaggagtcacttggagtccagcagtcggcctcactag

SEQ ID NO: 246353 - DNA, 849 bp, Artificial Sequence
  Description of Artificial Sequence: Synthetic coding sequence
atggctagcgcgggtggtgaagattgcgagagccccgcacccgaggccgatcgcccacaccagcgcccatttctgatcggtgacgagcggttccaagccggtatacctctgttgtgccttcagtcgactgtatgtgagaaaattatggaattgcttggccagaacgaggtggaacagcgccagcgcaaggttgtcatactgagtcaggacaggttctacaaggtgctcacggccgaacagaaggctaaagctctcaaaggccaatataacttcgatcatcccgatgcatttgataatgatctgatgcacaggacactcaagaacatcgtcgaaggcaagacggtggaggttcctacatacgattttgtcacccactctaggctgcccgaaaccacagtggtgtacccagcggatgttgtgctgttcgaaggaattctggttttctatagtcaggagatcagagacatgttccatctcagactgttcgtggacactgatagcgatgttcggctgagcaggcgcgtgctccgggacgtgcggaggggaagagacctggaacaaattctgactcaatataccacattcgttaaacctgcgtttgaggagttttgcttgcccacaaaaaagtacgctgacgtgatcattccacgtggcgttgataatatggtcgcgattaacctgatcgttcagcatattcaggacatccttaatggagacatctgtaagtggcacagggggggtagcaatggccgttcttacaaacgcaccttcagcgagcccggtgaccatccgggtatgcttaccagcgggaagaggtcacacctggaatcatctagtcgaccacactag

SEQ ID NO: 246354 - DNA, 834 bp, Artificial Sequence
  Description of Artificial Sequence: Synthetic coding sequence
atggcaagcgccggaggggaggactgcgagtctccagcacctgaagccgatcgccctcatcagcggccattcttgataggcgtgtctgggggaactgcctctgggaaaagcacagtgtgtgagaagattatggagttgctgggccagaacgaagttgaacagcggcagaggaaagtcgttattctctctcaggacagattttacaaagttctgacagctgaacagaaagccaaagctctgaagggccagtacaacttcgaccaccccgacgcctttgataatgatcttatgcataggacactcaagaacattgtcgagggcaagaccgtggaagtccccacttatgatttcgtgacgcattctagactccccgagacaacggtcgtgtatccagctgatgtggtcctgtttgagggcattctggtattctatagtcaggagatccgtgacatgtttcaccttcggctttttgtggatacagacagtgacgtaagactgtcaaggcgggtccttagggatgtccgacgcggacgggatcttgagcagattttgacccaatacacaacatttgtgaaacctgccttcgaagagttctgcctccccacaaagaagtacgccgacgttataattccacgaggagtggataacatggtggccattaacctgattgtgcagcatattcaagatatcttgaatggggatatctgtaaatggcacagggggggatccaacggaagaagctacaaacgcacgttttcggagccgggtgatcaccccggtatgctgaccagcggtaagcgatcgcacctggagtccagttcacgtcctcactag

SEQ ID NO: 246355 - DNA, 1647 bp, Artificial Sequence
  Description of Artificial Sequence: Synthetic coding sequence
atggccgctccgcctgcgagggcagatgcggacccgtcgcccacctccccccctacagctcgggataccccaggacgtcaggcagagaaaagcgaaaccgcatgtgaagaccgcagtaatgcagagagtttggacagactgttgcccccagtgggaactggacggagccccagaaagcgaactacgtcccagtgtaagtccgaacctcccctcctgcggacaagcaagaggacaatctacacagccggtcgccctccatggtataatgagcacggcactcaatctaaggaggcatttgctatcggactggggggaggttccgcaagcggtaagactacagtcgctagaatgatcattgaggctctggacgtgccttgggtggttttactgtctatggactctttttataaggtactgactgaacagcagcaggaacaggccgctcacaacaatttcaatttcgaccaccccgatgcttttgacttcgatttgattatctccacattgaaaaagttaaagcagggtaagagtgtgaaagtgcccatttatgatttcacaacgcatagtaggaagaaggactggaagacactttacggcgctaatgtgattatcttcgaaggcattatggcgtttgcagataaaacactgttagaactgctagacatgaagatctttgttgataccgattccgacatacgcttagtgagacgcctgcgaagagatattagtgaacgcggtcgggacatcgagggggtcatcaagcaatataacaagttcgtcaagccttcatttgatcagtacattcagccaacaatgcgtctggccgacatagtagtgccaagggggagcggcaacacggtcgccattgacctgatcgtgcagcatgtccattctcaactagaggagcgagaactgtctgttcgagccgcacttgcctctgcccatcagtgtcatccactgcctagaacattgagtgtactgaagtctacccctcaagttagggggatgcatactatcatccgtgacaaggaaacatctcgtgacgagtttatcttctactctaagcgcttgatgcgtcttctgatcgagcacgctctgtcgtttcttccatttcaagactgtgtagtgcagactccgcaggggcaagactacgctgggaagtgttatgctggaaagcagatcaccggggtttctatactcagggccggtgaaaccatggaacctgccctccgggctgtctgcaaggacgttcgtataggcactattctcatccagaccaaccagctgaccggcgagccggagcttcattacctcagactgcccaaggacatcagtgatgaccacgttatactgatggattgcacagtgagtacgggggcagcagctatgatggctgtgcgcgttctattagaccacgatgtgccagaggacaaaattttcctcctatctctgctcatggctgaaatgggtgtccactccgtagcctacgctttccccagagttcgaatcataaccaccgcagtggataagagggtgaatgatctgttccgcatcatacccggtataggcaatttcggcgaccggtactttggaacagacgccgtgcccgatgggtccgatgaagaggaggtggcatacaccgggtag

SEQ ID NO: 246356 - DNA, 1260 bp, Artificial Sequence
  Description of Artificial Sequence: Synthetic coding sequence
atggccgcacctcctgcccgagctgacgccgatccctcccctaccagccctcccacggctcgcgatacccccggacgtcaggctgaaaaatccgagacagcttgcgaggataggtccaacgcagagtcccttgatcggctgctgccccctgttggaaccgggagatcccctcgcaagcggacgacttcccagtgcaaatcggaacctccacttctgcggacctccaagagaacaatctataccgctggcagacccccttggtacaacgaacatgggacgcagagtaaggaggcatttgctattgggctgggaggtggatcagcatccggcaaaaccaccgtggcacgtatgattatcgaggctctggatgtgccttgggtggtgctgctttcaatggattcgttttacaaagtgctcactgaacaacagcaggagcaggcggctcacaacaatttcaattttgatcaccctgatgcttttgatttcgatctcattatctctaccctaaagaagctcaaacagggaaagtccgtgaaagtccccatttatgatttcacaacacattcaaggaaaaaggattggaagacactctacggcgcaaatgtaatcatttttgaaggcataatggcctttgccgacaaaacactcctcgaattgttggacatgaagatcttcgtcgacactgactccgatatccgattggtgaggcgtctcagacgagatattagcgaacgcggacgtgacatcgagggggtaatcaagcagtataacaagtttgttaagccgtcctttgaccagtacatccagcctacgatgagacttgcagacattgtggttccccgaggtagcggcaacactgtagctatcgacctcattgtgcagcatgtgcactcgcaactagaagaagggtgtgccggactgggaactccagttcctcctgctgctcctgatgccgagaggccagaggaacacgctgccggaacaggccatgcacatcaccatcaggttagggcccatctgggcacgggacgccctcgggctcgggctcccgcacagctgctcgcacctcagggccagggagaccagagccgcagagtacacctcctgcttcaggaaaccgatgcagccgctcatcgggctcgggctttgttgcccgctctgtccggcctaaggagaactgatccagccggagccggattatgcggacaggtgttatgtggggaggctgatcatcgatgcgtgcactcagctaggaggtag

SEQ ID NO: 246357 - DNA, 1647 bp, Artificial Sequence
  Description of Artificial Sequence: Synthetic coding sequence
atggctgccccacctgccagggcagatgccgaccccagtcctacatctcctcctaccgccagagatactcccggtcggcaggccgagaagtcagagactgcctgtgaagataggagtaacgcagaaagcctggacaggctattgcctccggtgggcacaggacggagtcccaggaagcgtacgacaagccagtgcaagagcgagcctccactacttcgcacatcaaaacggaccatctatactgccggtcgtcccccatggtataacgaacatgggacccaatctaaagaggcattcgccataggactgggaggaggctctgcatccgggaaaacaactgtggcccgtatgataatcgaggccctagacgtcccttgggtggtgttactctctatggattcattctacaaagttttaacagaacagcaacaagaacaagccgctcacaacaatttcaatttcgaccatcccgatgcctttgacttcgatctaatcatctcaaccctgaaaaagctgaagcaaggtaagagtgtgaaggttcccatctacgactttactacacactcccgtaagaaagattggaagacactgtatggcgcaaacgtgattatattcgagggcattatggcctttgcagacaagactctgcttgagctcctcgacatgaagattttcgtcgataccgactccgatattagattagtccggcgtctccgacgcgacatctccgagaggggtagggacatagagggagtgattaaacagtataacaagtttgtcaagccaagctttgaccagtacatacagcccaccatgcggctggccgatattgtggtacccagaggatcaggaaatactgtcgctattgacctcatcgtacaacacgtgcactctcagcttgaggagctgcggttcgttccccgagcagccctggcctcagcccaccagtgtcaccctctcccaagaacactctccgttctgaagtcaacgccacaggtgcgaggcatgcacactatcatccgagataaggaaacctccagggatgagtttatcttttacagcaagaggctgatgcggctgcttatcgagcatgccctgagcttcttaccattccaggactgtgtggtacagaccccccaggggcaagattatgcaggaaagtgctatgctggcaagcagatcaccggggtgagtattctccgcgcaggtgagactatggagccagcactgagggctgtttgcaaagatgtcagaataggcactatccttatacaaaccaaccagttaaccggcgaacccgagctccattaccttagattacctaaggacattagcgacgaccacgtgatactgatggactgtactgtgagcaccggagcagctgctatgatggctgtgagagtcctgctcgatcacgatgtgccggaggataagatcttcctgctcagtctcctgatggccgaaatgggcgtccatagtgtggcttacgcgtttcctcgggtgcgaattataactactgcagtggacaaaagagtgaatgatctttttagaatcatccccggaatcggaaattttggagaccggtatttcggaacggacgcagtgccagatggttctgacgaggaggaggtggcatataccggatag

SEQ ID NO: 246358 - DNA, 1602 bp, Artificial Sequence
  Description of Artificial Sequence: Synthetic coding sequence
atgtcctcccccccagcatatcctggtatcaggatctccggctgcagggcactcggcgctgagggaagctctaatgccgaatctctggacaggctgctcccaccagttggtacgggtcgtagccccaggaagaggactacttcacagtgcaagtctgaaccccctctcctgagaacttctaagcgcacaatttatactgctggccgacctccttggtataacgagcacgggactcagtccaaggaagctttcgccatcggactgggagggggatctgcttcaggaaagaccaccgtggccagaatgatcattgaggctctggacgttccgtgggtggtactcctgagcatggactccttttataaagtgctgacggagcagcagcaggaacaagcagcgcacaataacttcaactttgaccacccagacgcatttgattttgatctgattatcagtacattaaagaagttgaagcagggaaaatccgtcaaagtgcccatctacgatttcacaactcatagtcggaagaaagactggaaaactttatatggggcaaacgtgatcatcttcgagggcattatggcctttgcggacaagactctgctggagctgctggatatgaaaattttcgttgacaccgacagtgacattagactggtgaggcgcctcagaagggatatttcggagagaggacgggacatcgaaggggtgatcaaacagtataataagttcgtcaagccatctttcgatcagtacatccagcctaccatgagactcgcagatattgtggttcccagggggtctgggaatacagttgccatcgacctgatcgtgcagcatgtgcacagtcaactggaggagagagaactgagcgtgagagctgcattggccagcgcgcaccaatgccaccccctgcctagaacgcttagcgtgcttaaaagtacgccccaggtgcggggtatgcacacaattatccgagacaaagagacatctcgtgacgagttcatattctattccaaacgattgatgaggctgctgattgaacacgctctcagcttcctgccatttcaagattgtgttgtgcagacccctcaagggcaggattatgcagggaagtgctatgctggcaaacagatcacaggtgtgtccatcctgcgagccggagagactatggaacccgcattacgggctgtgtgcaaggatgtgcgcatcggtacaatcttaatacagactaatcaattgactggagagcctgagcttcattacctaaggctgcccaaagatatttcggacgaccacgtcatccttatggattgtacagtctcaacaggagccgctgcaatgatggcagtgagagtgctgctcgatcacgacgtgcctgaggacaaaatatttctgcttagcctcctgatggccgaaatgggcgtccactctgttgcctacgcctttcccagagtacgcatcataaccactgcagttgataagcgcgtcaacgacctattccgtatcattcctggaattggaaattttggtgacagatactttggtaccgacgccgtccccgatggaagcgatgaggaggaggtcgcttacactggttag

SEQ ID NO: 246359 - DNA, 261 bp, Artificial Sequence
  Description of Artificial Sequence: Synthetic coding sequence
atgtcatccccacccgcatatcccggtattagaatctccggctgtagggcccttggcgctgaaggatcttccaacgctgagagtctggatagactgttgcccccagtgggaacaggacgctcccccagaaagaggacaacctcgcaatgtaagagtgagcctcccctacttaggacaagcaaaagaacaatctacaccgccggtagacccccatggtataacgaacacggaacgcagagcaaagaggcatttgctatttag

SEQ ID NO: 246360 - DNA, 408 bp, Artificial Sequence
  Description of Artificial Sequence: Synthetic coding sequence
atgcataccattatccgggacaaagagaccagtcgagacgagtttattttttattctaaacgactaatgaggttgctcattgagcacgctttgagtttcctgcccttccaggactgtgtggtccagaccccacagggacaagactatgcgggtaaatgttatgccggaaaacagattacgggggtcagtattctgcgcgctggcgagactatggagcctgcgctcagggccgtttgtaaggatgttcggatcgggaccatattgatccagaccaaccaactgaccggggagccagagcttcattatctgcggttgccaaaggatatctccgacgaccatgtgatattaatggactgtactgtgtctacaggtgccgcagctatgatggcagtgcgggtgctcttgtag

SEQ ID NO: 246361 - DNA, 786 bp, Artificial Sequence
  Description of Artificial Sequence: Synthetic coding sequence
atggcgggtgatagcgagcagactttacagaaccaccaacaacctaatggcggagagccctttctgatcggggtttccggtggaaccgctagtggcaaaagctcagtctgcgcaaaaatagtacagcttctgggccagaacgaggttgactataggcagaagcaagtcgtcatactgtcccaagactcattttatcgagtgctgacaagcgaacagaaggccaaagccctgaagggccagttcaattttgaccatcccgatgcatttgataacgagctgatcctgaaaaccttgaaagaaattacagaagggaagacagtacagatccctgtgtacgattttgttagccattcaagaaaggaggaaacagtgactgtctatccagccgatgtggtcctgttcgaggggatcttggctttctatagccaggaggtccgggacctgttccagatgaagcttttcgttgacacagacgccgacaccaggctcagtcggcgtgtcctgagagatatctccgaacggggaagagatctggagcagatactcagtcagtacattacctttgtgaagccggctttcgaagaattttgtctgccaacaaaaaagtatgccgacgtgataatccccaggggggctgataaccttgttgctattaatcttatcgttcaacacatccaggacatcttgaatgggggacctagtaagaggcagacaaatggctgcttgaacggctacacgccatccagaaagcgacaagcctccgagtccagttccaggcctcattag

SEQ ID NO: 246362 - DNA, 393 bp, Artificial Sequence
  Description of Artificial Sequence: Synthetic coding sequence
atggctggcgatagtgaacaaactttgcagaaccatcagcagccaaacgggggtgagcccttcctgatcggcgtttccggagggacggccagcggcaagtcatctgtgtgtgctaagattgttcagctgcttggacagaatgaggtggattaccgccagaaacaggtcgtcattttgagtcaggactcgttctaccgcgtcctgacatccgaacaaaaagccaaggcgctgaaaggccagttcaactttgatcaccccgatgcctttgacaacgagctgatcctcaaaaccctgaaggagattaccgaaggtaagacagtgcagattcctgtctacgatttcgtgagccacagcaggattaagggccaccagcgcgagcgtcaaggaagttag

SEQ ID NO: 246363 - DNA, 2031 bp, Artificial Sequence
  Description of Artificial Sequence: Synthetic coding sequence
atgtccagtctccaggctctatgttcgggtctgccacttcgccctcttcccgagaatagagggaggcaggctggggtaccccacgctccagtgcggacgccttctctctcccccgttgagaaacagctagccctccgcaatgcactgaggtactttcccccagacgtgcaagaattactggctcctgaattcgctcaagagctgcagttgtacggtcacatatacatgtataggttttgtccggacatagagatgcgagcatatccaatcgagcagtacccgtgccaaactaaagtcgccgcagcaatcatgcacatgattatgaataatttagaccccgcagttgcccagtttccgcaggaactcgtcacctacggcggtaacggacaggtgttttcaaattgggctcagttctggttgaccatgttttacctgagtaagatgacagaggagcaaaccctggttatgtatagcggacaccccttgggcctctttccttccagtaggagcgcacctaggcttgtgataaccaatgggatggttatccctaactactcgtcccgcacagagtacgagaagctgttcgctctgggcgtgacaatgtacggtcagatgacagcgggttcctattgctatattggacctcagggcattgtccatggcaccgttctgaccgtactgaatgcagcaaggcgctacctgggtattgaagatctggccggtaaggtgttcgtgacctccggactcggagggatgtcaggggcacaggctaaagcagcagtcattgtcgggtgcattggagttattgcagaggttgacaaagctgcactggaaaaacgacaccgacagggatggttaatggaggttaccgattctcttgatcgctgtattcagcgtcttcgggaagcacgcaaaaagaaggaggtgctgtctttaggttatcacggcaacgtggtggcattgtgggagcggctggtacacgagttagataccaccggcgaatgcctggttgacttagggagcgatcagaccagctgccacaacccttttaatggcggatattaccccgtgcagttgagctttacagaagcacagtctctgatggcctccaaccctgctgtctttaaggacctggtgcaggaaagtctgagaagacaggtgtcagcaatcaatcgccttgccgaggaaaagttctttttctgggactacggtaatgctttccttttagaggcacagcgggcaggcgcagatgtagaaaagaagggcgcagggagaactgagttccgatatccttcctacgtccagcatatcatgggtgatattttttcccaaggcttcggtccctttaggtgggtttgcacatccggagaccctcaggatctcgccgttacggatgaacttgctaccagcgtgttggaggaagctatcgccgacggagtcaaagtttccgtcaaactccagtacatggacaacatcaggtggattcgagaagccgctcgtcatagattggtggtcggttcacaagccaggatcctctattcagatcagaaggggagagtggccatcgctgttgccatcaaccaagctattgcttgtagaaggattaaggctccggtggtccttagtagggatcaccatgacgtctctggaactgatagcccttttcgggaaacctccaatatctacgatggctccgcattttgtgccgatatggccgttcagaactttgtgggtgatgcgtgtcgcggagcgacctgggtggctctgcataacggtggaggagtgggctggggcgaggttattaatggaggtttcggactggtgctcgatgggactccagaggcagagggaagagcccgtctcatgctgagctgggacgtatcaaacggtgtggcaagaaggtgttggagcggcaatcagaaggcttatgaaatcatatgtcagaccatgcaagagaatagcactctcgtggtgaccctgccccacaaagtggaggatgaacgagttctgcaacaggctttgcagctgtag

SEQ ID NO: 246364 - DNA, 2211 bp, Artificial Sequence
  Description of Artificial Sequence: Synthetic coding sequence
atgtcctctctgcaggcactttgtagcggcctccccctgagacccctgcccgaaaataggggtcgccaggccggagtgccccatgcaccagtacgaactccaagtctctcccctgtcgagaagcagctggctttacgcaacgctctgcgatacttccccccagatgtccaggaactcctggccccagagttcgcacaagaactgcagctgtatgggcatatttatatgtacagattctgtccggacattgagatgagagcctacccaattgagcaatacccttgccaaacaaaggtggctgcggctatcatgcatatgataatgaacaatctggatcctgccgtggcccagttcccacaggagctggttacgtatggcggtaacggccaggtcttttctaactgggctcaattctggttgactatgttctacctttctaagatgacagaagagcagacattggtgatgtattctggccatccccttgggctgttcccctcatctaggtcagccccacggctggtgatcactaatgggatggtgatacccaactatagttcccgcaccgaatacgaaaaactctttgcccttggtgtcaccatgtacggccaaatgacagccggaagttactgttacataggacctcaaggaattgtgcacggcaccgtgctcacggttttaaacgcagcgagacgctatcttggcatcgaagacctggccggaaaggtttttgttacatctggtctggggggaatgagcggcgcacaggctaaagcagctgtgatcgtgggctgcattggcgtgatcgctgaggtcgacaaagcagccctcgagaagcgtcaccgacagggatggttaatggaagttacggatagtcttgatcggtgcatacagcgattaagagttttgcagctcgggctgcaacaggcgcttgggtgggcgggacttcccgctgccttaggcctttgtgtcctttcctgcttcgttaatttggcccctttgggtgaggggaggtgcctcgcgccatctggattttcccgtcctttattgggtgcacctgtgttgctcctctgtccctcaagggaggcccgtaaaaaaaaagaggtgctgtccctggggtatcatgggaacgtagttgctttgtgggaaaggctggtccacgaattggacaccacaggagagtgtctcgtcgacctcggctccgaccagacttcatgccacaaccctttcaatgggggatattaccccgttcaactttctttcacggaggcacagagtctgatggcctcaaaccctgccgtgtttaaagatttggttcaggagtccttgcgccgacaggtgtcagcaatcaatcggctggcagaagagaaatttttcttttgggattatggtaatgctttcttactggaagcacaaagagctggggctgacgtggaaaagaagggagccggacggactgagttccgctacccatcgtatgtccaacatataatgggcgatatcttcagtcaggggtttggccctttcaggtgggtatgcaccagtggcgacccacaggacctcgcagtaacagacgagctggctacttctgttctggaggaggccatcgccgatggagtcaaagttagtgtaaagttgcaatacatggacaacattagatggatacgcgaggctgccagacatcgattagtggttggcagccaagcgaggatcttgtattcagatcagaagggcagagttgctatagcagtggcaattaaccaggccattgcctgccgccgaatcaaggctcccgtggtgcttagcagagatcaccatgatgtgtcaggcactgactcacctttcagagagacttcaaacatatatgacggatcggccttttgcgccgatatggctgtgcaaaactttgtcggagatgcttgcaggggcgcaacctgggttgccctgcataacggcggaggcgtgggctggggggaggttataaatggaggtttcggactggtcctggatggaactcctgaggccgaaggcagagcgaggctcatgctctcttgggacgtgagtaacggtgtggcccgaaggtgttggtccgggaaccaaaaggcatacgagattatttgtcagacaatgcaagagaatagtaccttggttgtcaccctcccacataaggtggaggacgaacgcgttctgcaacaggccctccagttgtag

SEQ ID NO: 246365 - DNA, 375 bp, Artificial Sequence
  Description of Artificial Sequence: Synthetic coding sequence
atgcggcaggccggaagagcagcactcttggcggctcttctgctgctcgtccaactgtgcccagggtcttcccagcgctcccccgaggcagccggagttcaggaccctagcctgcgctggtctccgggagctaggaatcagggaggcggtgctagggccttacttctgctgctggccgaacgctttcctaggcgagcaggtcccggacgcctcggcctggggaccgcaggtgaacgcccacgaagggataacccatctctgagtattgacttgacattccaccttctacgaaccctcttggagctcgcacgaactcagtcccagagggagcgcgctgagcagaaccggattatcttcgattctgtggggaagtag

SEQ ID NO: 246366 - DNA, 339 bp, Artificial Sequence
  Description of Artificial Sequence: Synthetic coding sequence
atgactcgctgcgccctgcttctactgatggtgttaatgttgggaagggtgctggtagtgccagtaacccccattcctacatttcagttgcgacctcagaacagtccccaaacaacacccaggccggctgccagtgagtctccttctgcggctccaacgtggccctgggcagctcagagccattgctcccccacaagacatccagggagtcgcatcgtgctgagtctcgatgtaccaatagggctcctgcaaatacttttagagcaggcacgcgctcgggcagcccgtgagcaggctacaactaatgctcgcatcctagcccgagtgggccactgttag

SEQ ID NO: 246367 - DNA, 1923 bp, Artificial Sequence
  Description of Artificial Sequence: Synthetic coding sequence
atgggccagccctctctcacttggatgctaatggttgttgttgcatcctggtttatcaccacagcagccacagatacttccgaagcccgatggtgtagtgaatgtcactcaaacgccacctgcacagaggacgaggccgtaaccacttgtacatgtcaggaagggtttacaggggatggcctcacgtgcgtcgacctcgatgagtgtgccattccaggagcccacaactgcagtgcaaactccagctgtgtgaacacccccggaagtttctcctgtgtgtgccccgagggattcaggctgtcccctggtctcggatgtactgacgttgacgaatgtgccgaacctggactctcccattgtcatgcactggccacctgtgtaaacgttgtgggaagctacttgtgtgtctgcccagcaggatacaggggcgacggatggcactgcgagtgctcccccggttcttgtggaccgggactggattgtgtgcccgagggcgacgcactggtttgcgccgacccatgccaggcacataggactctggacgagtactggcgatccacagagtatggcgaggggtacgcctgtgatacagacctcagaggctggtaccggttcgtggggcagggcggagccagaatggctgagacctgtgtgccggtcctgaggtgtaataccgctgccccaatgtggctcaatggcacccaccctagtagtgatgagggtatcgtctcccgcaaagcatgtgctcactggagcggtcactgttgcctgtgggatgcatccgtgcaggtgaaggcgtgcgcgggaggatactatgtctataacctcaccgcccctccagagtgccatctggcctactgtaccgaccccagcagtgtcgagggcacatgcgaagaatgtagcatcgacgaggactgtaagtctaacaacggcagatggcattgtcagtgcaaacaggactttaacatcactgacatctcactcctggaacaccgtctagagtgcggggcaaatgatatgaaggtcagtttaggcaagtgccagctaaaaagtctgggattcgataaagtgttcatgtacctgagcgactcaaggtgttcaggattcaatgaccgggacaatcgtgactgggtctcagttgtgaccccagcacgcgacggaccatgtggcaccgtcctgacccggaatgagactcacgctacttactctaatactctctatctggctgacgagattattatccgggatcttaatatcaaaatcaactttgcatgctcttacccattagacatgaaggtgtccctcaagacggcccttcaacccatggtgagtgctctgaacattcgcgtcggcggaaccggtatgttcaccgtacgaatggcattgtttcagaccccctcctacactcagccatatcaggggagctctgtgaccttgagcaccgaagccttcctctatgtggggaccatgttggatggcggagacctctcccggtttgccctgttaatgacaaactgctacgccacaccttcttccaatgcaactgatccacttaagtactttattatccaggaccgatgcccccacactcgggattcaacgatccaagtggtggaaaatggtgaaagctcccagggacgcttcagcgtgcagatgttccgattcgccggaaactatgacttggtctacttgcattgcgaagtgtacctgtgtgacacgatgaatgagaagtgtaagcctacctgtagcggaactaggtttcggtcaggaagcgtgatcgaccagagcagagtactgaatctcggaccgataactcgcaagggggtccaggctacagttagtagagccttctcttctttgggcctgttaaaggtctggttacctctgcttctgtctgcgacactgacgctgactttccagtag

SEQ ID NO: 246368 - DNA, 2022 bp, Artificial Sequence
  Description of Artificial Sequence: Synthetic coding sequence
atggggcagccctcactcacttggatgctgatggtagtggtggcctcctggtttattacaacagccgcaactgatactagtgaagcaagaaccaagtacaattgtcctgctaggtggtcctggcgtacaccacagcgaggaggggacaccgaacagggcccagatgaagactttacgtcccagggcagatggtgtagcgaatgtcactcaaacgcgacatgcacagaagacgaagcagtcaccacctgcacttgccaggagggattcaccggcgacggccttacttgcgtggacctggacgagtgcgctattccaggtgcacacaattgttcggccaattcttcatgtgtgaatacccccggatccttcagttgtgtttgccccgagggcttccgcctgagccctggattgggttgcacagacgtagacgaatgtgctgaacccggactgtcgcactgccatgcactggccacctgcgttaacgtcgttggatcttacctgtgtgtatgccccgctggctatagaggcgacgggtggcattgtgaatgctcaccaggaagctgcggccctggtcttgactgcgtgcccgagggagatgctctggtgtgcgctgacccatgccaagctcacagaacactcgatgaatattggcggtctactgagtatggagaaggctacgcatgtgataccgatttgcggggatggtaccggtttgtcggtcagggcggagcgaggatggctgaaacctgcgttccagttctgagatgcaacacagcagcaccaatgtggttgaacggtactcaccctagctctgatgagggcattgtgagcagaaaagcttgcgcacactggagtggacactgctgtctgtgggatgcaagcgtgcaggtcaaagcatgtgcaggtgggtactacgtgtacaatctgactgctccaccagaatgtcatctggcatactgtactgaccctagttcggttgaagggacttgtgaggagtgcagtattgacgaggattgcaaaagcaacaacggtcgctggcattgccagtgcaaacaagacttcaatatcacagacatctccttactggagcatcgactggaatgtggagccaatgacatgaaggtttctttgggaaagtgccaactaaagtctctcggatttgataaagtcttcatgtatctctcggatagcagatgttcaggcttcaatgaccgagacaatagggactgggtcagcgtcgtcacccctgcgagggatgggccttgcgggacagtactcacgaggaatgagacgcacgcgacctattctaacacactgtacctggcagacgagattattatccgtgacctgaatatcaagattaactttgcatgcagctaccccctcgatatgaaggttagtctcaagactgccctgcagccaatggtaagtgccctcaacatccgcgtcggaggcactgggatgttcaccgtccgaatggcattattccagacaccaagctacacgcagccttaccagggcagctccgtaactctgagtacagaggcatttctgtacgtgggcacaatgttggatggcggagacctgagtaggtttgctctgctgatgacaaattgttacgcgaccccatcctctaacgcaacggacccactaaagtacttcatcattcaggataggtgtcctcatactcgcgatagcacgatccaggtggtagagaatggcgagtcctctcagggacgtttctctgtccaaatgttcaggttcgccggaaattatgatcttgtttacctccactgtgaggtctacctttgtgacacaatgaacgagaaatgtaaacccacctgcagcgggacacggtttagaagcgggagcgtaatcgaccaatctagagtgttaaacctaggccctataacgaggaaaggggttcaggcaaccgtgtcccgtgccttctctagtctcgggcttcttaaggtctggcttcctctgctattgagtgccacgttgacgctgactttccaatag

SEQ ID NO: 246369 - DNA, 1923 bp, Artificial Sequence
  Description of Artificial Sequence: Synthetic coding sequence
atgggacagccgagtttgacatggatgcttatggtcgtggtcgcctcttggttcatcacaaccgcggcaactgatactagtgaagctaggtggtgcagcgagtgccacagcaacgccacctgcactgaagacgaagccgtcaccacctgtacttgccaagagggatttacgggcgacggactgacttgcgtggatctcgacgaatgcgctatccccggtgcgcacaactgctcggcaaattcgtcctgcgttaacacaccagggtcattttcatgcgtttgccccgagggattcagactaagcccagggctcggttgtactgacgtagatgagtgcgcagagccaggtctctctcactgccacgccctggcaacttgcgtgaacgttgttggttcgtacctgtgcgtgtgccccgctggctaccgcggagacggttggcattgtgaatgtagccctggcagttgtggccctggactggattgcgttcctgaaggtgatgctcttgtgtgcgccgacccatgtcaggcgcaccgaacactggacgagtattggagatcaaccgaatacggcgaggggtatgcttgcgacaccgacctaagaggatggtaccgctttgtagggcagggcggtgccaggatggctgaaacgtgcgtaccagtactgaggtgcaatactgcggctccaatgtggctgaatgggacacatccaagctccgacgagggtatcgtctctcggaaggcatgtgcccactggtccggacactgctgcctgtgggacgcctctgtacaggtgaaggcttgtgctggcggatattacgtctataatttaaccgctcctcctgagtgccacttggcatactgtaccgatccctcctcagtagagggaacatgcgaagagtgtagcattgacgaggactgcaaatcaaataatggcagatggcactgccagtgtaaacaggatttcaatataactgacatcagtctccttgagcaccggctagaatgcggggctaacgacatgaaagtgagcctggggaaatgtcagcttaagtcacttggctttgataaggtgtttatgtatttatccgatagccgatgttctggatttaatgacagagacaaccgggactgggtctctgtagtgaccccggcacgcgacgggccttgtggtacagtccttacacgtaacgagacacacgcaacttattcaaatacgctatacctcgctgacgagatcataatccgcgatctgaacattaaaattaactttgcctgttcctatcccctggacatgaaggtgagtctcaagaccgctcttcagccaatggtcagtgccctaaacattagggtgggcggtaccggtatgttcacagtgcgcatggcgttatttcaaactccctcttacacgcagccttaccagggttcttcagtgacacttagcacagaagcctttctctacgttggcacaatgctggatggcggagatctgagccgctttgctcttctgatgacaaactgctacgccactccttctagtaacgccactgacccactcaaatattttataattcaagacagatgtccccacacaagggatagtaccatccaggtggtggagaatggggagagcagccaaggcagatttagcgtgcagatgttccgctttgctggaaactatgacttagtgtatcttcactgtgaggtctatctgtgtgacacaatgaacgaaaaatgcaagccgacatgtagtgggaccaggtttagatctggttctgtgatcgaccaatctagggtattgaacctggggcctatcaccaggaaaggggtacaggctaccgtgagtagagcgttttccagtctaggtctccttaaggtctggcttcctctcttgctgtctgccactctgaccctgaccttccagtag

SEQ ID NO: 246370 - DNA, 1923 bp, Artificial Sequence
  Description of Artificial Sequence: Synthetic coding sequence
atggggcagccaagtctgacttggatgctaatggtggtggtcgcttcttggtttattactacggcagccacagacacatcggaagctcgctggtgcagcgagtgccatagcaatgccacatgtactgaagacgaagcagtcaccacatgtacatgtcaagagggatttacgggcgacggactgacctgtgtcgaccttgacgaatgtgccattcccggagcgcacaactgttctgccaattcctcatgcgtgaataccccagggtctttttcttgtgtctgcccagagggtttcagactgagccccggtctcggttgcacagacgtggatgaatgtgccgagcccggactttctcattgccatgcattggctacatgtgtcaacgtggtaggttcgtacctgtgcgtgtgcccagctggttatcggggagacgggtggcactgtgaatgttcaccaggatcatgtggccctggactggattgcgtgcccgaaggggacgccttagtgtgcgctgatccctgtcaggcacaccgaaccttagatgagtattggagatcaaccgaatacggggagggatacgcctgtgatactgatttacggggatggtataggtttgtcgggcaaggcggtgcacgcatggccgaaacttgtgtgccagttctgagatgtaataccgcagcacccatgtggctcaatggcacacacccttcgtctgacgagggcattgtttctcgtaaggcctgcgcccattggtctggccattgttgcctgtgggacgcctctgtccaggttaaggcctgtgccggagggtattatgtatacaatctcacggcaccccctgagtgccacctggcatactgcacggatccatcctcggtggagggcacttgtgaagaatgttcaattgatgaggactgcaaatccaacaatggaaggtggcactgtcagtgcaagcaagatttcaacatcacagacatttctctgctggagcaccgcttggaatgtggggcaaatgacatgaaggtttccctagggaagtgccagttaaaatccttaggtttcgataaagtttttatgtacttatcggactcacgctgctccggattcaatgatcgtgacaatagggattgggtttcggtggtgacaccagctcgagacgggccatgcggaaccgtgttgaccagaaatgaaacgcacgccacctacagcaacaccctttatcttgctgacgaaataatcatcagagatctgaatatcaaaattaacttcgcctgcagctatccactggacatgaaggtctccctaaaaactgctcttcagcccatggttagtgccctgaatatccgagtggggggaacggggatgtttaccgtacgaatggcgttgttccaaaccccgtcctacacacagccgtatcagggttcttctgtcacactctccaccgaggccttcctatacgtgggtaccatgctcgacggcggagatctgtctaggtttgccttgcttatgacgaattgttacgcaacacccagtagtaacgctacagatcctctgaagtatttcattattcaggatcgctgccctcacactagagatagtaccatccaggtggtagagaacggcgagagcagccagggtagattttcggtccagatgttcagatttgccggaaattacgatctagtctaccttcattgtgaagtgtatctttgtgatacaatgaacgagaaatgtaaaccaacctgctctggcacccgctttcgatccgggtctgtgatagaccagagtcgcgtgctgaatctgggacctattactcgcaagggtgtgcaggccactgtctctagggctttctcttctctgggcctgcttaaggtgtggttaccgttgcttttgtccgctactctcactctgaccttccagtag

SEQ ID NO: 246371 - DNA, 2022 bp, Artificial Sequence
  Description of Artificial Sequence: Synthetic coding sequence
atggggcagccaagtctaacatggatgctcatggttgtggtcgcatcctggttcatcaccacggctgccacggataccagtgaggcacggacaaaatacaattgtcctgctagatggagttggcggaccccacagagggggggagacacagagcagggcccagatgaagatttcacctcccaaggtagatggtgctctgagtgtcattctaatgccacttgcaccgaggacgaggcagtcacaacttgcacttgtcaagaggggttcaccggggatgggcttacctgcgtcgatcttgatgagtgcgctatccctggagctcataactgctcagcaaactcaagctgtgtgaatacacccggaagtttttcgtgcgtgtgccccgagggcttcaggctatctccaggcttgggctgtactgatgtcgatgagtgcgctgagcccggactgtcccactgtcatgccttggctacctgcgtgaatgttgttggatcctacctttgcgtgtgtcccgcaggctacagaggcgacggctggcattgcgagtgctctcccggttcttgtggacctggactcgattgtgtgcctgagggagatgccctggtctgcgccgatccttgtcaggctcaccgcaccctggacgagtattggcggtccaccgagtatggcgaaggctatgcctgcgataccgatctgagaggatggtataggtttgtggggcagggcggagcgagaatggcagagacgtgtgtgcctgtcttgaggtgcaacacggctgcccctatgtggctgaacgggactcacccctctagcgatgagggtatcgtttcgcgaaaagcctgtgcccactggtctggccattgctgcctgtgggatgcttccgtgcaagttaaagcgtgcgccggaggctattacgtctacaatttaaccgcccctccggagtgccaccttgcctattgtacggatccctcctctgtcgagggcacgtgtgaggagtgcagcatcgacgaagactgtaagtccaataacgggcgatggcattgccagtgcaaacaggactttaatatcacggacatttcactcttagaacaccggttagaatgcggagccaacgatatgaaggtgtctttgggaaaatgccaactcaagtctcttggattcgacaaggtctttatgtacctaagcgattcccggtgtagtggatttaacgatcgtgataatcgcgattgggttagtgttgtgacaccagctcgagatgggccatgcggaacagtgcttaccaggaatgagactcatgccacttactccaatactctgtacctggcagatgaaatcattatccgggatctgaacattaagattaacttcgcctgttcttacccgctcgacatgaaggtctccctcaagaccgcattacagcccatggtttcagcgctgaatatccgcgtgggtggaactggcatgtttactgtgaggatggcgttgtttcaaacgccgagttacactcagccgtatcagggaagctcagtcaccttgtccaccgaggctttcttgtacgtcggaactatgttagacggcggtgacctgagtcgatttgcactgctgatgactaactgctacgctactccatcttcaaatgcaaccgatcccctgaagtactttattatccaggaccggtgtcctcacactagagacagcacaatccaggtggtggaaaacggtgagtcttcgcaagggagattctccgttcagatgtttcggtttgccggaaattatgatcttgtgtacctgcactgcgaggtctacctgtgtgacaccatgaacgagaagtgtaaacctacctgctctggaactagattccggtccgggagtgttatcgaccagagtagggtgttaaacctcgggcctatcacccggaagggcgtgcaagccaccgtgagcagggccttcagctctttggggcttctgaaggtctggttgcccctcctgttaagcgccacactgactctaacttttcaatag

SEQ ID NO: 246372 - DNA, 1857 bp, Artificial Sequence
  Description of Artificial Sequence: Synthetic coding sequence
atggggcagccctctctcacatggatgcttatggtcgtggtggccagttggtttattactaccgccgcaaccgacacttcggaagcccgttggtgttccgaatgtcactcaaacgcaacatgcactgaagacgaagccgtcaccacgtgcacatgccaggagggctttactggtgacggtctcacctgtgtggatctggacgaatgtgccatacctggcgcacataattgtagcgcaaatagctcttgtgttaatacacctgggtccttcagctgtgtctgtcccgaggggtttcgactgtctcccggactcggatgtactgacgtggacgagtgtgccgagcccggtctgtcgcattgccacgctctggccacttgcgtgaacgtggtgggatcctgcgggccaggccttgactgcgtccctgagggcgacgcgcttgtatgcgcagatccatgtcaggcgcatcgaacccttgacgaatactggagatcaaccgaatatggagaagggtatgcttgcgacacagacctgcgcggatggtaccggtttgtgggtcagggcggtgcgaggatggcagagacctgcgtgccagtgctccgatgtaatacagctgccccaatgtggctgaatggcacacaccccagttccgacgaggggatcgtgagcagaaaagcctgcgcgcattggtccggtcactgttgcctctgggacgcctccgtgcaggtaaaagcctgcgcgggagggtactatgtctataatctcaccgctcctcccgagtgccaccttgcatactgtaccgacccgtcatccgtggaaggcacttgtgaagaatgctctattgatgaggattgtaaatcaaacaacgggaggtggcattgtcagtgtaagcaggacttcaatattactgatatctccttgctggagcatcggctcgagtgcggcgctaatgatatgaaggtatctctcggaaaatgccagctgaagtccctggggttcgataaagtcttcatgtacctttcagatagcagatgctcaggatttaatgaccgggacaacagggactgggtaagtgttgtgacgcctgcacgggacgggccatgtgggaccgtcttgacaaggaatgagacccacgcaacttactccaacacactctacctggctgatgagattatcatccgggacctgaatattaaaatcaacttcgcttgttcttatccactggacatgaaagtgtccctgaagactgcgctgcagccaatggtcagcgcactgaacatcagggtcggtgggaccggcatgttcacagtgaggatggccctatttcaaacccctagctatacccagccttaccaagggtccagcgtgaccctgtccacagaggcctttctgtacgtgggtaccatgctggatggcggagacttatctagatttgccctccttatgacaaactgttacgcaacccccagctcaaacgccaccgaccccctgaaatatttcataattcaggaccgctgcccgcacacaagggattccacaatccaggttgttgaaaacggagagtcctctcaaggcagattctctgtgcagatgtttaggttcgccggtaattacgatctcgtgtatttgcattgtgaagtttatctttgtgacactatgaatgagaagtgcaaacccacctgctcaggaacgagattcagatctggttcagttatagatcagagcagagtcttgaacctcggtccaatcacgcgaaagggcgtacaggccaccgtgagcagggcatttagtagcctcggattgctgaaggtgtggctgcctctgttattaagcgccaccctcaccttgaccttccagtag

SEQ ID NO: 246373 - DNA, 759 bp, Artificial Sequence
  Description of Artificial Sequence: Synthetic coding sequence
atggcccctgctcctcaggcgcctgaacgggatcctgtcggcagttggtacaatgtgacgattttggtgaaaatggacttcaaggaactgcagcaggtcgatcctcgtctgttaaatcacatgagactcttgcacagtttagtgaccagcgccctccagccaatggccagcacagtgcaccacctgcacagtgcccctggcaatgcctcaaccactgtgtctcgtctgctgcttggcctgcccaggccactacctgtagccgatgttagcaccttgcttggcgacatagccaagcgagtatacgaggttatatctgtccaggttcaggacgtgaacgaatgtttctatgaggaactcaatgcctgcagcgggcgagagctctgcgccaatctagaagggtcttactggtgtgtttgtcaccaggaggctccagctactagtccacggaaacttaacctcgagtgggaggattgccctccggtgagtgactacgtcgtgctgaatgtcacctctgactccttccaggtctcctggcgcttgaactccacgcagaatcacacatttcatgtgcgagtgtaccggggtatggaactgctccggagcgcacgcacccagtcacaggccctagctgtggctgggctggaggcaggcgtgctctatagagtcaagaccagttatcagggatgtggtgctgacgtgagcaccacactgacgattaagactaaatacgtgctggagaagttggactttcagtcatag

SEQ ID NO: 246374 - DNA, 555 bp, Artificial Sequence
  Description of Artificial Sequence: Synthetic coding sequence
atggcccctgcccctcaggctcctgagagagatcccgtgggctcctggtataatgttacaattttggtaaagatggacttcaaggagctccaacaagtggacccgaggctgcttaatcacatgagactgctgcactcgctagtaacatcagcgctccaaccgatggcttccaccgtccatcaccttcactccgcgccaggaaacgccagtaccactgttagccgactgctcctggggttacctaggcccctgcctgttgccgatgtttccacgctgctgggtgacatagcaaaacgagtgtacgaagtcatcagcgtgcaggtacaggatgtaaatgaatgtttctatgaggaactcaacgcctgtagcgggagagaactgtgcgctaacttggagggctcctattggtgcgtgtgccaccaagaggctccggcaacctcacctcgtaaattaaacctagagtgggaggccaggggactggaaattcatcttgaactgcgtgcaacttccactagccatggtacccccctgtcctctgcagagaactgtctatag

SEQ ID NO: 246375 - DNA, 3741 bp, Artificial Sequence
  Description of Artificial Sequence: Synthetic coding sequence
atggtatatcgaacccagtatcttgtcgtggaagtcccagaatcacgcaatgttaccgattgttgcgagggctacgaacagctaggcctgtattgtgtgctaccactgaatcagagcggccagtttacaagccgccctggggcatgtcccgctgaggggccagaacctagtacttctccctgtagcctggatattgactgtccaggattggagaaatgttgcccatggtctggtggtcgatactgcatggcacccgcaccgcaggccccagaaagggacccggtaggtagttggtacaacgttactatcctggtaaagatggattttaaggagcttcagcaggtcgacccacgactgctgaaccatatgagactcctgcactccctcgtgacgtctgctctccagcccatggcttctaccgttcaccacctgcacagcgcacccggtaacgctagcactacagttagtcgactgcttctcggcctcccacgccctctgccggtggccgacgtatcaactctcctgggagacatagcaaagagggtctatgaagtcatcagcgtgcaggttcaggatgttaacgagtgtttctacgaagagctgaatgcctgctctgggagggaactttgcgccaaccttgagggctcatactggtgtgtctgtcaccaggaggcccctgcaacatctcccaggaagctgaatttggaatgggaggactgcccgcctgtgagtgactacgtagtgcttaacgtgacatctgacagtttccaggtcagttggcgcttaaactccactcagaatcacacctttcatgtcagggtatatagaggaatggagctactgagatccgctaggacccagtcccaagcattggctgtggcaggcctagaagcaggcgtgctgtaccgcgtgaaaacgagctaccagggttgcggagccgatgtgtccactacactgaccattaagacaaacgctcaggtctttgaggtgactattaagatcgttaaccataaccttaccgaaaagctgctcaatcggagctctgtcgagtatcaggacttttcacggcaattgctgcacgaggtagaaagctctttccctcctgtagtatctgacttgtaccggtccggtaagctgcgcatgcagatcgtgtccctgcaggctggctctgttgtggttcggctgaaacttacagtccaggatcctgggtttccgatgggtatcagcacccttgctccgattctacagccacttttggcctcaaccgtgttccaaatcgatcgtcaggggacgcgcgttcaagattgggatgagtgcgtggactcagccgaacatgactgttctcctgcagcctggtgtattaacctggaaggaagttacacttgtcagtgtcgtacaaccagagacgctacacccagtcgtgcagggagggcctgcgaaggtgatctggtctctccgatgggcggagggctctctgctgcaacaggcgtgaccgtgcccggtctcggcaccggaacggccgcactgggcttggagaatttcaccctctctccttcccctggatacccccaaggcacacctgccgcaggtcaggcctggaccccagagcccagtcctagacgcggtgggtccaatgtcgtgggatatgaccgtaataacactgggaaaggagtggagcaggaattacaggggaactctatcatggagcccccttcttggcctagccctacagaagatccaacgggccatttcctgtggcacgcaacacggagcaccagagagacactcttgaaccctacctggctgcggaatgaggacagcggaccgtctggcagcgtggaccttccacttacaagcactctgactgccttaaagacaccggcatgtgtccctgtttccattggcaggattatggtcagcaatgtgacatctaccggtttccaccttgcatgggaagcagatctagccatggattccacattccaactgactttgactagtatgtggagccccgctgtggttctggaaacttggaacacaagcgtgaccctgagcggcctggaacccggagtgttacaccttgtcgagatcatggccaaggcctgcggcaaagagggggctagagctcatctcaaagtgcgtacagccgctcggaaactgattggaaaagttagaatcaagaatgtgcggtattctgagagcttccgtaacgcctctagccaggagtatcgagactttctggagctcttcttcaggatggtaaggggttctctgcccgctacaatgtgccagcacatggatgctgggggagttcgtatggaggtggtgtccgtaactaatggatctattgtggtcgagtttcatttgctgatcatcgcagatgtggatgttcaggaggtgagtgcagcgttcctcacagcctttcagaccgtgccacttttagaggtaatcaggggagacacctttatccaggactatgacgagtgcgagaggaaggaggacgattgtgtaccaggtacgtcttgcaggaataccttggggtcctttacatgcagctgcgaaggcggagcccctgactttcctgtcgagtactcagaacggccatgtgagggtgattctccaggtaacgaaacctgggctactagcccagaaagaccacttacaaccgccggaactaaggcagcatttgtccagggcacatctcccaccccccagggactgccccagagactgaacctgactggggctgtccgagtgctatgtgaaattgaaaaggtggttgtcgctattcagaaaagattcctccagcaagagtccatccctgagagctctctgtacctttctcaccctagttgtaacgtatcccatagtaatggcacacatgtgttgttagaagccggatggtccgagtgtgggacactgatgcagtctaatatgaccaatacagtggtgcggacgactctgcggaacgatctcagccaggaaggcatcatacaccacctgaaaatattgtctccaatctactgtgcttttcagaacgacctcttaacatctagcggatttaccctggagtggggcgtatatacaatcatcgaagaccttcacggcgcaggtaacttcgtaaccgagatgcagttattcatcggtgattcccctatcccacagaattattccgtcagtgcctccgacgacgtccgcattgaggttggcctgtaccggcagaagagtaatcttaaggtagtgctcacagagtgctgggccacaccttcctccaatgcacgggaccccataaccttttcatttatcaacaactcctgcccggttcctaacacatacacaaacgtgattgaaaatggcaattccaacaaggcacagtttaaactcagaatcttcagtttcatcaacgacagcattgtctacctgcactgtaagctgcgggtatgtatggagtcacctggcgcaacctgtaaaataaattgtaataatttcagattgttgcaaaattctgagacatccgcaacccatcaaatgagttggggcccactgatccggtctgagggggaaccccctcatgctgaggcaggcctcggcgctgggtacgtggtgctgattgtcgtagccatattcgttctggtcgcagggacggctaccctgttgatcgttagataccagaggatgaacggtcgctacaacttcaaaatccaatccaataacttctcttaccaggtattctatgaatag

SEQ ID NO: 246376 - DNA, 4125 bp, Artificial Sequence
  Description of Artificial Sequence: Synthetic coding sequence
atggtgtataggacccagtatctggtggtggaggtacctgagtctagaaacgtgacagactgttgtgagggatacgagcaactaggactgtattgcgtgctgcccttgaaccagtcaggtcagtttacgtcgcggcctggggcatgccccgcagagggacctgaaccttcgacctctccctgttccctggatatcgactgtcctggtttggagaaatgttgcccctggtctggaggccgatattgcatggctccagcaccgcaggcacccgagcgggaccctgttggatcctggtataacgtgaccattctggtgaaaatggactttaaggagctgcagcaggtggacccaagactgctgaatcatatgaggttgcttcacagtctcgtgacctcagccctacaaccaatggcaagcacagtgcaccatctgcactcagctcccggaaatgcctctactacggtgtcccgcttactgttggggctgccacgcccactaccggtggccgacgtctccactttactgggcgacattgccaaaagggtgtacgaggtaatatctgtccaggtgcaggacgttaacgagtgcttctacgaggaactgaatgcgtgctcagggcgagagctctgtgccaatctcgaggggtcttattggtgtgtttgccatcaggaagcgccagctactagcccccgtaagctgaatctcgagtgggaagactgtccacctgtgtccgattacgttgtcctgaacgtcaccagcgacagcttccaggtgtcatggaggctgaactctacccaaaatcacacctttcacgtgcgtgtctacagggggatggagctactgagaagtgcaagaacacagtcacaggcacttgctgttgcaggactggaggccggtgtcctgtacagagtgaagacctcttaccagggatgcggtgctgatgtttccacaaccctgactattaaaacaaatgctcaggtgttcgaagtaacaatcaaaatcgttaaccacaacctcactgaaaagctcctcaaccggtcttcagtggagtatcaggacttttctcggcagctgctgcatgaagtggagagttcatttccaccagtcgtgtcagatctctacagatccggaaagctgaggatgcagattgtgtctttgcaagctggctcggtcgtcgtcagactcaagttgacagtgcaggaccccggtttcccaatgggtatcagtacactggcacccatcctgcaaccactgctggctagcactgtgtttcagattgatagacaggggacacgggttcaagactgggatgagtgcgtggactcagcagagcacgattgctcacctgccgcatggtgtatcaacctggagggaagctatacctgccagtgtagaactactcgcgacgctactcccagcagagccggacgcgcatgcgaaggagatttagtcagccctatgggagggggtctgagcgccgcaaccggagtgaccgtgccagggcttggtacggggaccgcagccctgggattggaaaacttcactctcagtccatcaccaggatacccccagggtacaccggcagcaggacaggcatggaccccggagccaagccccaggcgtggcggatctaatgtggttggatacgatcggaataacaccggaaaaggcgtcgagcaagaggtgccctccaccgcacctggccttgggatggatcagggaagtccaagccaggttaacccttcccagggctcgccaagtcaggggagtctgaggcaggagagcaccagtcaggcctcaccgagccagcgctctacgtcacaagggtctcccagccaggtgaatccaagccaacggtccactagccatgccaatagcagccagggatcacctagccaggggtcgccaagccaagaatctccaagccagggatctacatcccaggcatcacctagccaccgaaatactattggagtgattggcaccaccagtagtcctaaagccaccggttccacccatagctttccgccaggcgctactgatggtcctttggctctgcccggacagctgcaaggcaattctataatggagcccccaagttggcctagccccactgaagatccgacgggccacttcctgtggcacgcaacacgtagcacgagagaaaccctcctcaatccaacatggctgagaaacgaggactctggtccatctggcagtgttgatttacctctgacctctactctgacagctctcaaaacacctgcctgcgtcccagtcagtattgggaggattatggtgtccaatgtcacctctaccggctttcacctggcgtgggaggctgacctcgccatggacagtacttttcagctaaccctcacttctatgtggagccccgctgtggtcctggaaacatggaacacgtcagtgaccctcagtggactggagcccggtgtgctccatctggtcgaaataatggccaaagcttgtgggaaagagggggcaagagcccacttaaaggtaagaactgcagctagaaagttaataggcaaggtgaggatcaagaatgtgagatacagcgaatctttcaggaacgcaagcagccaggagtatcgtgattttttggaactttttttcaggatggtgcgagggtcgcttcctgctaccatgtgccaacatatggacgccggaggggtgaggatggaggtggtctctgtgaccaacggctctatagtggtggaatttcacctgctcatcatcgccgacgttgatgtacaagaggtctctgccgcatttctgaccgccttccagaccgtccctctgctcgaggttatacgcggtgacacattcatacaggattacgacgaatgcgagcggaaggaagatgattgtgtaccaggaaccagttgcagaaatacattaggtagcttcacctgtagctgcgagggaggtgcgccagatttccctgtagagtactccgagcgaccttgtgaaggggattctcccggaaacgagacgtgggctacgtctccagagagaccacttacaacggctggtactaaagcggcttttgtgcagggcacatctcccaccccgcaggggctgccccagcggcttaatttaactggtgccgtccgcgtgttatgcgagattgagaaggtggtcgttgcgatccagaaaagattcctgcaacaggaatccatccctgaatcatccctttatctcagccaccctagctgtaatgtgtctcattcaaacggcactcacgtactcctggaggctgggtggagcgagtgtggaaccctgatgcagagtaatatgacaaacactgtggtcagaacaaccctacgaaatgacctctcccaagaaggcatcattcatcatctaaagattttgtcacccatatattgcgctttccagaatgacctcctgacttcgagcggattcaccctcgagtggggcgtgtatacaatcatcgaggatctccatggcgctggcaactttgttactgagatgcagctctttatcggcgactcacccatccctcagaattatagcgttagcgcctctgatgacgtaagaatcgaggttggtctctaccggcagaaatctaacctcaaagtggtacttacagaatgctgggcgacacccagcagcaatgcacgggaccctatcaccttttcgttcatcaacaattcctgtccggttccgaacacatacaccaatgttatcgagaacggcaatagcaacaaggctcaattcaagctccgtattttcagttttatcaacgattcaatagtatatctacattgcaagctgcgggtatgcatggagtcacccggagcaacctgtaagattaattgtaacaacttccggttactccagaactctgagacgtcggctacgcatcaaatgagctgggggccactgatccgttccgaaggagaacccccacacgccgaggcaggactgggcgctggctatgtcgttctgatagttgtggctatttttgtgttagtagccggaacagctacattactgattgtcaggtaccagaggatgaatggaagatacaactttaaaattcagagcaataacttcagctaccaagtcttttacgaatag

SEQ ID NO: 246377 - DNA, 3957 bp, Artificial Sequence
  Description of Artificial Sequence: Synthetic coding sequence
atgcttcggacctcaggactcgccctgcttgccctcgtatctgccgtgggacctagccaggcaagcggattcactgagaaaggcctttccctgctggggtatcagctgtgctcccatagagtcacccacaccgtgcagaaagtagaagcagtgcagacgtcctacacatcttatgtgtcttgtggagggtggatcccgtggagacgatgtcccaagatggtatatagaactcaatatttggtggttgaggtccccgaatcccggaatgtcaccgattgctgcgaaggttacgagcagctaggcctctattgtgtgctccctctgaaccagtctggccaattcacctccaggcctggcgcttgtcctgctgagggccctgaacctagcacatcaccatgctccctagacatagattgtccaggactggagaagtgttgcccttggtccggtggacgctactgtatggccccagcgcctcaagccccagagagagaccctgtcggaagctggtataacgttaccattttagtaaagatggactttaaggagttacagcaggtggaccctaggcttttgaatcacatgaggctgctgcatagcttggtgacctccgctttgcagccaatggcctccacagtgcaccatctccatagcgccccaggcaacgcaagcacaacggtttctagactcctgttgggactacctagaccattgccagtagcggacgttagcactttactgggcgacattgcaaagagggtttatgaagtcatttccgttcaggtccaggacgtcaatgaatgcttttacgaggagttgaacgcttgttctggtagggagctgtgcgccaatctggagggaagttattggtgcgtttgtcaccaggaggctcccgctacaagtcctcgcaaactcaaccttgagtgggaagactgtccaccagtcagcgactacgtcgtgttaaacgtgacatccgatagttttcaggtcagctggcgcttgaacagtacccagaatcatacattccacgtgagggtatatagaggcatggagctcctcagaagtgctaggactcaaagccaggctctggccgtagcgggtttggaagcgggagtgctttaccgcgtgaagacttcttatcagggctgcggagcagacgttagcaccacactgacaattaagaccaatgcccaggtgttcgaggtaactataaagatcgttaatcacaatctaacagagaagcttctgaatcgcagtagcgtagaataccaagacttttcccgtcaactcctgcatgaggtggagtcatcctttccaccagtcgtttccgatctctataggagtgggaaactccggatgcagatcgtgagcctgcaagccggttcagttgttgtccgcctaaaactcacggtgcaggaccccggttttccaatgggcatatctacacttgcaccaatcctgcagccactactggccagtactgtgtttcagatagaccggcaaggaaccagagtccaggattgggacgagtgcgttgattccgccgagcacgattgtagtcctgccgcatggtgcatcaatctagagggtagttatacatgccagtgccgcactacccgagacgccacaccctcacgcgctggcagagcttgcgagggcgacctggtgagccctatgggagggggattaagcgccgcaactggcgtcaccgtgccgggactaggcacaggaaccgcagccttggggctggaaaacttcacgctgagcccatctcccggatatccccaggggacccctgcagcgggtcaagcctggactccggaaccctccccacggcgaggcggatctaacgtggtgggttacgataggaacaacaccggaaaaggcgttgaacaagagctgcagggcaattcgataatggagcccccttcatggccgagccccaccgaagacccgactggtcactttctgtggcatgccacaaggtctacgagagaaaccctgctgaaccccacatggctcagaaacgaggactctggtccttcaggctcagtcgatttgccactgactagcactttgaccgcactgaagactcctgcgtgtgtgcccgtgtccataggccgaataatggtctcaaatgtgacctcaaccggctttcatctggcctgggaggctgacctagctatggattcaacttttcagctcactttaacttcaatgtggtcacccgctgttgtcctagagacgtggaacacttcagtcaccttgtccggacttgagccaggcgttttgcaccttgtggaaatcatggccaaagcttgtggcaaggaaggggcaagagcgcatctaaaagtaagaaccgcggctaggaagctcattggtaaagtgcgcatcaagaacgtgcggtactcagagtctttccggaatgcttcctctcaagaatatagagacttcctcgagttgttctttcggatggtgcgtggctctctacccgcaactatgtgccaacacatggatgctggcggtgtgaggatggaagtagtttcggttaccaatggttctatcgtggtggagtttcatctgctgattattgccgatgtggatgtccaggaggtgtctgctgctttcctcaccgcatttcagacggtccctctgctggaagttatacggggagacaccttcattcaagactacgacgagtgcgaacggaaagaggatgactgcgtgcccggaaccagttgcagaaatacattgggctcattcacctgttcctgcgaggggggagccccagattttcctgtggaatattccgagcgcccttgtgaaggggatagcccgggtaatgaaacttgggctacctcccctgagcgaccactcaccactgccggaactaaggccgctttcgtgcaggggacatcccccaccccccagggtcttccccagcggttgaacttgactggtgccgtgcgtgtgctgtgcgagatcgaaaaggtggtggtggctatccagaagaggtttctgcagcaggagtcgataccagagtcatccttgtacctcagccatccgtcatgcaatgtgtcacacagcaatggaacacatgttcttctggaagcagggtggagtgaatgcgggacccttatgcagagcaatatgactaacactgtggtgcgtactactcttcggaacgatctgagccaggagggcataatacatcatctgaaaattctgagtccaatctattgcgcgtttcagaatgacttacttacatctagtggcttcaccctggaatggggcgtgtacacaatcattgaggatctccacggcgcagggaattttgttacagagatgcaactattcataggtgattcacccatacctcagaattatagcgtttcagcttcagacgatgtgcgcatcgaggtaggattatatagacagaaatccaacctgaaggtggtgctaaccgagtgctgggcaacaccctcttcgaacgccagggatccaattaccttcagctttataaacaacagctgtcccgtcccaaacacctacacgaacgttatagagaacggcaactccaacaaggcacagtttaagctcaggatctttagcttcataaatgattcgattgtctatctgcactgcaaactgcgagtgtgcatggagagcccaggtgcgacgtgtaaaattaactgtaacaacttccgcttgctacagaacagcgagacctctgctactcaccaaatgagttggggacccctgattcgctcagaaggtgagccccctcatgcagaagccggactcggagccggatacgtcgtgcttatagttgttgctattttcgtcctggttgctggtacagctacattgctgattgtccggtatcagcggatgaatggtcggtataatttcaagattcagagcaacaacttttcttaccaggtattttacgagtag

SEQ ID NO: 246378 - DNA, 4341 bp, Artificial Sequence
  Description of Artificial Sequence: Synthetic coding sequence
atgctccggaccagcggcctggcactgctcgcgttagtgagcgccgtcggcccttcccaggcatctggcttcacggagaaaggcctgagtcttctggggtatcagttatgctcacaccgagtaacccatacagtccaaaaggttgaggcagtgcagacctcatacacctcatatgtatcttgcggagggtggataccttggaggcggtgtcccaagatggtgtataggacccaatacctggtggtagaggttccagaatcgcggaatgtgacagattgttgtgagggatatgaacagctcggactctattgcgtcctgcccctcaatcagagtggccagttcacatcaagacctggcgcttgccccgcagaggggccagagccgagcacaagcccatgctcgctagatatcgactgccctggtctcgagaagtgctgtccgtggtctggaggaaggtattgcatggcacctgcccctcaggcccctgagcgcgatccagtcgggagctggtataacgttacgattctggtaaagatggacttcaaagagctacaacaagtagacccaagattattgaaccatatgcgtttgctccactctctagtgacctccgcactgcagccaatggcctcaacagtgcatcatttacactctgctcccggtaacgctagtacaaccgtgtcccgcttattacttggcctgcctcgccctctgcccgtggctgacgtcagcactctgcttggggatatcgccaagagagtgtacgaagtgatcagcgtccaggtgcaggatgtaaatgagtgcttttacgaggagcttaacgcctgtagtggcagagaactatgcgctaacctagaaggcagctactggtgtgtctgccatcaggaagcccctgctacttctccacgcaagctgaacctggaatgggaggattgcccacctgtctctgattacgtcgtgttaaacgttactagcgactcttttcaggtcagctggaggctcaatagcacacagaaccacacttttcatgttagagtatatagaggcatggagcttcttcggtctgctcgaacccaaagtcaggcactggcagtggcaggattagaggctggtgtcctttaccgggtcaaaacctcttatcagggatgcggagctgatgtttctacaaccctgaccattaaaaccaatgcccaggtcttcgaggtaactatcaaaatcgttaatcacaatctgaccgagaagctactgaacaggtcctcagttgaataccaggacttcagccgacagctcctgcacgaggtcgagtcctctttcccacccgtggtctctgacctgtatcgcagcggaaaacttcgaatgcagattgtgtcactgcaagccggatcagtggtggtgcgattgaaactgaccgtccaggaccctgggttcccaatgggtatcagcacgcttgcgccaattctgcagcccctcctcgcaagcactgtgtttcaaatcgaccggcaggggactcgggtccaagattgggacgagtgcgtcgactctgctgagcatgattgtagtccggcagcatggtgcattaatctcgaagggtcttacacctgtcagtgtagaacaacacgggacgccactccaagcagagctgggagagcatgcgaaggcgatcttgtatcaccaatgggaggcggtctgtctgccgcaacaggcgtcacagtacctgggctcggcacagggactgcagcattgggcctggagaacttcacgttgtctccaagccctggttatccccaggggacgccggcagccggtcaggcgtggacacccgaaccttcaccacgcagggggggtagtaacgtggtaggttacgatcgcaataacactggaaaaggagtcgagcaggaggtcccatctactgctcccggattgggtatggaccagggatccccatcacaagttaatccctctcagggatcgccttcacaaggatctctaagacaggaatccacgtcccaggctagcccatcccagaggagcaccagtcagggatcgcccagccaagtgaatccgtctcagcgctctacttctcacgcaaactcttcgcagggatccccaagccaaggatcaccatctcaggaaagcccatctcagggcagcacgtcacaggccagcccctctcatcgcaatacgattggcgtgatagggacgactagcagccctaaagcgactgggtcaacacatagcttccctccaggcgctaccgacggccctctggcattacccggacagctacagggcaactctataatggagcctccatcatggccgagccctacagaagatccaaccggtcacttcctctggcacgccacacgttctacgagagagacccttctaaaccctacttggttgcgaaacgaagacagtggacccagcgggagcgtggacctgccgcttaccagcacgctcacagctctgaagacacctgcgtgtgtcccagtgtctattgggagaattatggtgtcaaatgtgacaagcacaggatttcacctagcatgggaggctgatctcgctatggatagtacatttcagctgacactgaccagcatgtggagccccgctgtagtcctcgagacctggaatacttctgtgaccctgtcaggtctggaaccgggtgtgctacacctcgtggagatcatggctaaagcatgtggcaaagagggcgcaagggcccacttgaaagtgagaactgccgcaaggaagctgatcggcaaggttaggatcaagaacgtccgctactccgaatcgttcagaaatgccagctcacaggaatatcgcgatttcctggagctgtttttcagaatggtgcgaggcagcttgccagcgaccatgtgccaacacatggatgccggaggtgtgcgtatggaagtagtttccgtaaccaacggctctatagttgtggagtttcatttactgatcatcgccgacgtggatgtccaggaagtctccgctgcgtttctgactgcatttcagaccgtcccattattggaggtcatcaggggcgacacgttcatccaggactacgatgaatgtgagcgcaaagaggacgactgcgttcctggcacttcatgtagaaacaccctcgggagctttacctgctcctgcgagggcggtgcaccggacttccccgtcgagtactcagagcggccttgtgaaggggactcgccgggaaatgagacatgggcgacatctcctgaacgcccactcacgaccgctggaacaaaggccgcatttgtgcaaggtaccagccctactccgcagggcctgcctcagcggcttaacctaacgggagcagtgagggttctatgcgagatcgaaaaggtggtcgtcgcgatacagaaaagatttttgcagcaggagtccataccagaatcttcactgtacctgagtcatccttcatgcaatgtgtcacattcaaacggtacccacgtgctcttggaggctggctggtcagagtgtggaacacttatgcagtcaaatatgacgaatacagtagtgaggacaacccttcggaatgacctgagccaggagggcataatccaccatctcaaaatcttaagccccatttattgcgcattccagaacgacctgctaacatctagtgggtttaccctcgagtggggggtgtatactattattgaggacttgcatggagccggaaactttgtgactgagatgcagctcttcattggagattcgcccattcctcagaactactcagtgagcgcctccgatgacgtcagaatagaagttggactataccggcagaaaagcaacctcaaggtggtgctgaccgaatgttgggccaccccatcgtctaacgccagggatcccatcacgttcagcttcataaataattcctgtcccgtgcccaatacctacaccaacgtcattgagaacggaaactccaataaggcacagttcaagctaaggattttctccttcattaacgatagtatcgtctacctacattgcaagctgcgcgtgtgtatggagagtcctggggctacctgtaaaatcaattgtaataactttaggctcttgcaaaacagcgaaacctctgcaactcatcaaatgtcctggggtcctcttatcaggtccgagggggagccaccccacgctgaagccggtcttggagccggatacgtcgtgctcatcgtggtagccatatttgtgcttgtggcaggcactgcgacactgctgatcgtgaggtaccagagaatgaatggtaggtataacttcaaaatccaatcaaataatttctcgtaccaggtgttctacgaatag

SEQ ID NO: 246379 - DNA, 234 bp, Artificial Sequence
  Description of Artificial Sequence: Synthetic coding sequence
cctgtcggatcctggtataatgtgacaatcctagttaaaatggacttcaaggagctgcagcaggttgacccaagactgctcaaccacatgaggctgctccattcactgatgagtatgagcgtttccatgcgctccagcatgcccgctctcgaggggaactgcgcacagacctggagggcccgaacaggcgcatcagttactcgcaaacttcagccacgtctccacggctcctag

SEQ ID NO: 246380 - DNA, 411 bp, Artificial Sequence
  Description of Artificial Sequence: Synthetic coding sequence
atgcagttgttcattggtgattcccccatacctcaaaactattcagtgtccgcttccgatgacgttagaattgaggtgggtttatacaggcagaaaagtaatctgaaggtcgtcctgactgagtgctgggcgactccttcatcgaacgctcgcgaccctatcaccttttcgttcatcaacaactcctgccccgtccctaatacttatacaaatgtgatcgaaaatggaaattccaataaagcccagttcaagctgcggatcttcagctttatcaacgattcaattgtctatttacactgtaagctccgcgtgtgcatggaaagccctggtgccacatgtaagatcgcagccttgggtcgccgtacccatgtggactggtgggcctttccgatctcacagtggttgtcatag

SEQ ID NO: 246381 - DNA, 1221 bp, Artificial Sequence
  Description of Artificial Sequence: Synthetic coding sequence
atgaaaaaaaagcaacagcaccctggaggcggagctgatccttggccacatggggcacccatgggaggcgcaccccctggcctgggcagttggaagaggcgtgtccccttattacctttcctgcggttcagcctccgggactatggcttctgcatggccaccctactcgtgttctgtctcggcagcctgctttaccagctgtctgggggaccacccaggtttctcctcgacctcaggcagtacctgggaaactctacttatctcgacgaccatggcccacctccatcaaaagtcctgccatttcctagccaggtggtctacaacagggttggtaagtgtggctcgcgcacagtggtcctgctcttgagaattttgtctgaaaagcatgggttcaacctagtaacctctgacatccacaataagacccggctcacgaagaacgaacagatggagctgatcaagaacatttccaccgctgagcagccatatctgtttacgaggcacgttcatttcttaaatttttctaggtttggtggcgaccagcccgtttacatcaacatcatacgggatcccgtgaatcgattcctaagcaattattttttccgcagatttggtgattggaggggcgagcagaaccatatgattcgcactcctagtatgcgccaagaagaaaggtacctggacatcaatgagtgtattctggagaactaccccgaatgttccaatccgagattattttacatcatcccctatttttgcggtcagcaccccaggtgcagggagcccggtgaatgggctctggagcgggcaaaactgaatgtcaatgaaaatttcttactggtagggattctggaggaactggaagatgtcctcttgttgcttgagcggttccttcctcattatttcaagggtgtactctcaatctacaaagaccctgagcatcgcaagctgggaaatatgactgtaactgttaaaaaaacagtgccaagccccgaagcagtgcagatcttgtaccagcggatgcgatatgagtatgaattctaccattacgtgaaggagcaatttcacctgctaaaaagaaagttcggtctgaagagtcatgtttctaaaccacctctgagaccccactttttcatccccacaccactggagactgaggagccaattgatgacgaggaacaggacgatgagaaatggcttgaagatatctataagaggtag

SEQ ID NO: 246382 - DNA, 2274 bp, Artificial Sequence
  Description of Artificial Sequence: Synthetic coding sequence
atggtgcccgatacggcttgcgtgctcctactgaccctggcggcactgggcgcttccggtcagggtcagtccccactcgggagtgacctcgggccacagatgctgcgagaactccaggagactaatgccgctcttcaagacgtgagggagctccttcgccagcaggttcgcgagattacattccttaagaatacagtaatggagtgcgatgcctgcggcatgcagcagtccgtgaggaccggcctccccagtgtgcggccactgttgcactgtgcgcctggattttgtttccccggagtggcgtgcattcagacggagtcgggcgctcggtgtggtccctgcccagcagggtttacaggcaatgggagtcactgtacagacgtaaacgagtgcaacgcccatccgtgtttccctagggtgcggtgcatcaacacttcaccgggtttccgctgtgaagcatgtccaccagggtattctgggcctacccatcagggggtgggcttagcgtttgccaaagcaaataaacaggtgtgcacagatataaacgagtgcgaaactgggcaacacaattgcgtgcctaactctgtgtgtataaacacaagaggttccttccagtgtgggccttgccagcctgggtttgtgggggatcaggcctcaggctgccagcgacgcgcacagaggttttgtcctgatggctcgcctagtgaatgccacgaacacgcagattgcgtcctggaacgggacggaagccgttcctgtgtgtgcgccgttgggtgggccggaaatggaatcctgtgcggcagggacaccgacctggatggatttccagatgagaaattacgctgccccgaacgacagtgcaggaaggataactgcgtgacggttcccaactctggtcaggaagatgtcgatcgggacggcatcggcgacgcgtgtgatccagacgccgatggagacggcgttccgaatgagaaggacaactgccctctggttcgcaatcctgaccaaaggaatacagatgaagataagtggggcgacgcctgcgataactgtcgctcccagaagaatgacgatcaaaaagacactgaccaagatggcaggggggatgcctgcgacgatgatattgatggcgatcgtattaggaatcaggctgacaactgcccaagggtgcccaattccgatcagaaagattctgacggtgacgggattggcgacgcttgcgataattgtccacagaagtctaacccagaccaggcggacgtagaccacgattttgtgggggatgcatgtgattcggatcaagatcaggatggcgatggccaccaagattctcgggacaattgcccaaccgtcccaaatagcgcccaggaggatagtgaccacgacgggcagggtgacgcgtgcgacgatgatgacgataatgacggcgtgcccgacagccgcgacaattgcagattggtccctaatcctggacaggaggatgccgatcgggatggggtaggggatgtgtgccaggacgactttgacgcagacaaggtcgttgataaaattgacgtgtgtcccgagaacgcagaagttaccctgacagactttcgggcttttcaaaccgtggtgcttgaccccgaaggcgacgcccagatagaccccaactgggttgtcctgaatcagggcagggaaatcgtccagactatgaatagcgatccaggtttggctgttggatatacagcctttaacggtgtagattttgagggcaccttccacgtgaatactgtgactgatgacgactacgctggctttattttcgggtaccaggactcgagtagcttctacgtcgtgatgtggaagcagatggagcagacttactggcaagccaaccctttcagggctgtcgcagagcccggtattcagttgaaggccgtcaagtcttccactggcccaggcgaacagttaaggaatgctttgtggcatacgggtgacacagaatcgcaagtgaggctgttgtggaaggaccctagaaatgtgggatggaaagacaaaaaatcatatcgttggtttttgcagcaccggcctcaggtgggatatataagggtgcggttctatgaaggtcctgagctcgtcgcggactcaaacgtagttttagataccacgatgaggggcggacgtctgggggtgttctgcttcagccaggaaaacatcatctgggcgaatctccggtaccgctgcaacgatactatcccggaagactatgaaacccatcaacttagacaggcctag

SEQ ID NO: 246383 - DNA, 822 bp, Artificial Sequence
  Description of Artificial Sequence: Synthetic coding sequence
atggcgtccgctgcagccgcagaagccgaaaaggggtcacccgtggtggtgggactattggtggttgggaatattataatcttactcagtggcctaagcctttttgctgagaccatctgggtgactgctgatcagtaccgggtgtacccactcatgggcgtgtctggcaaagatgatgtcttcgccggagcctggatcgctattttttgcggattctcattcttcatggttgcctctttcggtgtgggcgctgcactttgtcgccgtcgctccatggtccttacttatctggttcttatgctgattgtctatattttcgagtgtgcaagctgcatcacgtcctacacccatcgggattatatggtgagcaacccctctttaatcaccaagcagatgctcacattctattctgcggacaccgatcaaggacaagagctgacccgtctctgggaccgagtcatgatagaacaagagtgctgcgggacgagcggcccaatggactgggtgaatttcacctcggcattccgtgctgccacccctgaagtggtgtttccatggccccctctgtgttgccgccgtactgggaactttattcccttaaacgaagagggatgccggttaggacatatggactacttgttcaccaaagcaggagtgcaatggcacaacttaagttcattgcagcggcttcccccaggcttcaagggattttcacatctctctttccaatccagctgggactatagggctgccagcaacactagcgctaccccatcgacagcaacccgaggagtttcacggggactgggtctcccaagctag

SEQ ID NO: 246384 - DNA, 783 bp, Artificial Sequence
  Description of Artificial Sequence: Synthetic coding sequence
atggcaaaggataacagtactgtgcgctgctttcagggacttcttattttcgggaacgtaatcattggctgctgtggaattgctcttacagccgaatgcatcttcttcgtttccgatcagcactctctgtacccccttctcgaggcgaccgataacgatgatatctacggcgctgcctggattggcatcttcgtcgggatctgtttattctgtctgtcagtgctgggtatcgtaggtatcatgaagtcttctcgcaagatcctcttagcttactttattctcatgtttatcgtgtacgccttcgaagtcgcctcctgtatcacggccgctactcagcaggatttctttacaccaaacctttttctgaagcagatgctggagaggtaccaaaacaactccccccctaacaacgatgaccagtggaaaaataacggcgtgaccaagacatgggaccgcctgatgttacaggataattgctgtggtgtgaatggcccttccgactggcaaaagtacactagcgcttttaggaccgagaacaatgacgccgattacccatggccaaggcagtgctgcgtgatgaataatttaaaggagcccctgaacctcgaagcttgcaagttgggagtccccggtttttatcataaccaggggtgctatgagttgatttcaggtcctatgaacaggcatgcgtggggtgtggcatggtttggattcgccatcctctgctggactttttgggtcctgttgggaacaatgttttactggagcagaatcgagtattag

SEQ ID NO: 246385 - DNA, 510 bp, Artificial Sequence
  Description of Artificial Sequence: Synthetic coding sequence
atggctaaggataattccactgtgcggtgttttcagggtcttcttatctttgggaatgtgataatcggctgctgtgggatcgctctgaccgccgaatgcatatttttcgtgtcagatcagcattctctttaccctctgctcgaggccaccgataacgatgatatatacggggcagcttggatcggcatctttgtaggaatatgtcttttctgtttgtcggtgcttgggatcgtcggaattatgaagtcgagcagaaagatccttctggcttatttcattctaatgttcatcgtttacgcatttgaggtcgcttcttgcattacagcagcaacccaacaggacttttttactcctaatctcttcctcaaacagatgctggagaggtatcagaacaattctcctccgaataacgacgaccaatggaaaaacaacggtgtaacgaagacctgggaccgcctgatgttgcaggacaactgctgtggggtcaacggcccttccgattggcaatag

SEQ ID NO: 246386 - DNA, 570 bp, Artificial Sequence
  Description of Artificial Sequence: Synthetic coding sequence
atggcgaaggacaactcaactgtgcggtgtttccaaggactgttaatttttggaaatgtgattattgggtgctgtggaatagctcttacagccgagtgcatattctttgtaagtgaccaacatagtctgtatccccttcttgaagcaaccgacaacgacgacatctatggagccgcttggattggcatcttcgtagggatctgcctcttctgcctgtcagtcctgggaatcgtggggatcatgaaaagctcccggaaaatcctgctcgcctacttcattctgatgttcatcgtgtacgctttcgaggttgccagctgcatcacagcagctacccaacaggacttctttacacctaacctgtttttaaagcagatgcttgagcgctaccaaaacaactcacctcctaacaacgatgatcagtggaaaaataatggcgtgaccaagacctgggaccgactcatgctgcaggataattgctgcggggttaacggcccatccgattggcagaagtacacctccgcttttcgcaccgagaataacgacgccgactacccttggccccgtcagtag

SEQ ID NO: 246387 - DNA, 555 bp, Artificial Sequence
  Description of Artificial Sequence: Synthetic coding sequence
atggctcctttgctgcccataaggaccttgcctctaatcttgatcctgctcgccctgctctcacctggcgctgcagacttcaacattagttcattgagtgggcttttgtcacctgctttgacagagagcctgctggttgcacttcccccatgccaccttaccggagggaatgctacactgatggtgagacgagctaacgacagcaaggtcgtcactagttcattcgtggtgccaccctgccggggacgcagggagttagtgtccgtagtagattcaggggctggttttacagtgacaagactgtctgcctatcaagttaccaatctcgtccctggaacaaagttttatatctcgtatctggttaaaaagggcacagcaacagagagcagtagggagattcctatgtctaccctccctagacgtaacatggagtctataggtttggggatggcgcgaactgggggtatggtcgtgattactgtgcttcttagtgtcgctatgttcctcctggtgctaggcttcatcatcgccctcgccctgggatctcgaaagtag

SEQ ID NO: 246388 - DNA, 333 bp, Artificial Sequence
  Description of Artificial Sequence: Synthetic coding sequence
atgagcatgaccgatctgctgaacgccgaggatataaagaaggctgtgggggctttttcagctacggactcattcgaccataaaaagttctttcagatggtgggtctgaagaagaagtccgcagatgacgtgaagaaagtctttcatatgttggataaagacaagtccggctttattgaagaggacgaattgggcttcatcctcaaaggcttttcgcccgatgcacgagacctgagtgctaaggaaacaaaaatgttaatggccgctggagacaaagatggcgacggcaagattggcgtggacgagttcagcacactagtggcggaatcgtag

SEQ ID NO: 246389 - DNA, 501 bp, Artificial Sequence
  Description of Artificial Sequence: Synthetic coding sequence
atgcctccactgtgggctctcctcgccctgggttgcctgcgctttggcagcgctgtgaatttgcagccgcagctagccagtgtcaccttcgctacaaataaccctactctgacgacagtggcactcgaaaagccattatgtatgttcgatagtaaggaggccctgactggcacgcatgaggtgtacctgtacgtgttagtggattctgttactccctattctaccatcgacacctggcccggtagaaggtccggcggtatgatcgtaataaccagcatactaggatcactccctttcttcttgctggtggggtttgccggtgccattgcactgtctttggtggacatgggcagttctgatggtgagaccacccatgactcccaaatcactcaggaggccgtgcccaagtctctcggggcaagcgaatctagttacactagcgtgaacaggggcccaccattagatagagccgaggtgtactcaagcaagctgcaggactag

SEQ ID NO: 246390 - DNA, 963 bp, Artificial Sequence
  Description of Artificial Sequence: Synthetic coding sequence
atggggctgccttgggggcagccccatcttgggttacagatgctgctcctggcgctcaattgtctgcgacccagcttgagcctcggcgaatggggctcttggatggacgcttcttctcagactcagggtgcaggaggacctgcaggagttatcggaccatgggctcccgcacccctgaggctgggggaggccgcacctgggactccgactccggtgtccgtcgctcatctgctgtcgcccgtggctaccgaattagtgccctacacgccacaaatcacggcctgggacttggaaggcaaagtgacagctaccactttctccctagagcagcccagatgcgttttcgacggactggccagtgcctctgacacagtatggttagttgtcgcattttctaatgcctcccgtggcttccagaatccagagacgttggcggacatcccagccagcccacaactactcactgatggacattatatgacccttcccctatcaccagaccaactgccatgtggagacccaatggctgggtcaggtggagctccagtacttcgggtgggacatgaccatggctgtcatcagcaacctttctgcaacgctcccctccccggtcctggcccatatagagaagaccctaggatccatcgccatctagctcgggcagccaagtggcagcacgacagacactacctgcatcccctgttcagtggacggccacccaccctaggcctgctgggctcactctatcacgcccttctgcagccagtggtggctgggggaggtcctggcgctgccgcagaccgtctgctgcacggccaggccctccatgatccgcctcaccctactcagcgcggtcgtcacaccgctgggggtctccaagcatggccgggaccacccccacagcctcagccccttgcatggcccctgtgcatgggcctgggtgagatgggacgctgggagtag

SEQ ID NO: 246391 - DNA, 831 bp, Artificial Sequence
  Description of Artificial Sequence: Synthetic coding sequence
atggggttaccatgggggcaaccacacctgggtctacagatgttgctactggcactgaactgcttgcgcccaagcctgtccctggagctggtcccttacacgccgcagattaccgcatgggatctggagggaaaggtcacagcaacgacattcagtctggagcaacctagatgcgtgtttgacggtctggcctctgcgagtgacacagtgtggctcgtggtcgcttttagcaacgcctcaaggggctttcagaaccccgaaacactcgccgacattcctgcttctcctcagctacttactgatggacactatatgactctaccactgtcccccgaccagttgccatgcggggacccaatggccggatcaggcggtgctcctgttttgcgggtgggacacgaccacggctgtcatcagcaaccattttgcaatgctcctttacctggccctggcccataccgcgttaaatttctccttatggatacccgtgggagcccccgtgccgaaacaaagtggtctgaccccattactctacatcagggcaagacacccggaagcatagatacctggcccggaaggcgctctggctccatgattgttatcaccagcattctcagtagtctggccggattgttgctcttggcctttttagccgcttctactatgcgcttctccagcctgtggtggcccgaggaagcgcctgagcaacttcgtataggttctttcatgggtaagagatatatgacccaccacattcctccccgtgaagctgccacactgcctgtgggatgtaagccgggtctggatcctctaccttccttgtccccttag

SEQ ID NO: 246392 - DNA, 963 bp, Artificial Sequence
  Description of Artificial Sequence: Synthetic coding sequence
atgggtttgccgtggggacagccacatctcgggttgcaaatgctgctgctggcattgaattgcctccgaccatcactgagcctgggcgaatgggggagttggatggacgccagctctcagacccagggggctggtggacctgcgggtgtgataggcccttgggcacctgccccactccggttgggcgaggccgctcccggaacccctaccccagtgtctgtggcacacctgctctcccccgttgcaaccgaactagtgccctacacgccccagataactgcgtgggacttggaggggaaagtgaccgcaaccacgtttagccttgagcagccccgatgcgtttttgacggattagccagtgccagcgacactgtgtggcttgtcgttgctttttcaaatgcctcccgaggattccagaatccagagaccttggccgacatccctgctagccctcagctactgacggatggacattacatgaccttgccactgtcccccgaccagttgccttgtggagatcctatggctgggtcaggcggagcccctgttctaagagtgggacacgaccatgggtgtcaccagcaaccgttttgtaatgcaccactcccaggcccaggtccttacagagaagatccgagaattcaccgacacctggctagagcggctaaatggcagcatgaccgtcattatttgcacccgctattctccggacgtccacccactctggggctgttgggatcactgtaccacgccctactgcagccagtcgtggctgggggtggcccaggagccgctgcagataggctcctccacggacaagctctgcacgacccccctcaccccactcaaagaggtaggcataccgccggaggcctccaagcctggccaggacctcctccacagccccaacctttagcctggccactctgcatggggctcggcgagatgggtagatgggaatag

SEQ ID NO: 246393 - DNA, 831 bp, Artificial Sequence
  Description of Artificial Sequence: Synthetic coding sequence
atggggctgccctggggacagccacacttagggttacagatgcttttgctcgcactgaactgcctgcggccttcattaagtttggaactggtaccgtacactccccaaattacggcgtgggacttagagggcaaggtcaccgctacgacctttagcctcgagcagccacggtgcgtatttgacggcctggcaagtgcctccgacactgtgtggttggtcgttgctttctctaatgcatctcgaggatttcagaatcccgaaaccctggctgacatccctgcatctccccaactgctgaccgatgggcattatatgacccttcccctgtccccagaccagctgccctgtggggatccaatggcgggaagcggtggcgcaccagtgctgcgggtgggacacgaccacggatgtcatcagcaacctttttgtaatgcccctctgcccggtccaggaccctatagggtcaagttccttctgatggatactagagggagcccaagagctgagactaaatggtcagacccaatcactctgcatcagggtaaaactcccggaagcattgatacatggccgggtcgtcgcagcggcagtatgatcgttatcacatcaatactgtccagcctggctggtctacttctcctggcctttctggctgcatcgaccatgcgtttctcgtcactgtggtggcccgaagaggctccagaacagctgcgtattggttctttcatgggaaaaagatatatgacacaccacataccccctcgagaagcagcaactctcccagtgggctgtaagccgggtctggaccctctgcctagtctttcaccctag

SEQ ID NO: 246394 - DNA, 963 bp, Artificial Sequence
  Description of Artificial Sequence: Synthetic coding sequence
atgggacttccctgggggcagccgcacttaggactgcaaatgttgttgctggccttgaattgcctgaggcctagcctcagcctgggagagtggggatcttggatggacgctagcagtcagacacagggtgcaggcggtccggcaggggttatcgggccatgggctcccgcacctctgaggctcggggaagctgcacctgggacacccactcccgtaagcgtggcccacctgctgtcccccgtggctaccgagttggtcccctacaccccccagataacagcgtgggacctggagggcaaggtcaccgcgactacctttagcttagagcagccgcgttgtgtttttgacggcctggcaagcgctagcgataccgtttggctggtggtcgcattctctaacgcatctcggggattccagaatcctgagacactcgccgacattcccgctagcccccaactgctaacagatggtcactatatgaccttaccactgtctcccgatcaactgccatgtggcgaccctatggcaggtagcgggggagctccagtgttgagagttggccacgatcacggttgtcatcagcagccattctgcaacgctccgctgccagggccaggcccttatcgcgaggaccctagaattcaccgacatctggccagagccgctaaatggcagcacgatagacactacctgcacccattgttcagcggcaggcccccaactctgggactccttgggtccctttaccacgctctattgcagcccgtggttgcaggcggtggtccaggcgctgcagccgacaggctcctgcatgggcaggcactgcacgacccaccacaccccacgcagcggggtcgacataccgccggtggacttcaagcttggcctggtcctcccccacagccccagccgctggcctggcccctttgcatgggactgggcgagatgggacgctgggagtag

SEQ ID NO: 246395 - DNA, 1104 bp, Artificial Sequence
  Description of Artificial Sequence: Synthetic coding sequence
atggaagcaaacggactcggaccacagggatttcctgaactcaagaacgacaccttcctgagagcagcttggggcgaagagaccgactacacccctgtgtggtgtatgcgccaggctgggaggtacctcccagaatttcgggagacacgcgcagcccaggacttcttctccacttgtagaagcccggaagcatgctgtgaactgaccctgcagcccttgcgaaggttcccactggacgccgcaattatctttagtgatatcctagtggtgcctcaggctttaggtatggaggtaaccatggtccccggaaaaggacccagttttccagagccgcttagggaagagcaagacctcgagagattaagggatcccgaagttgtggcaagcgagctcgggtacgtgtttcaggccattacattaacccgccagaggctcgctgggagagtgcctctcatcggcttcgcgggtgctccctggactctgatgacttacatggtcgaaggaggaggttcttctacaatggcccaagccaaacgttggctctaccagagacctcaagcttcccatcagctcctgcggatcctgacggacgccttggttccatacctcgtaggacaggtggtggcgggagcccaggccctgcagctgtttgagtcccacgccggacacctcggtccgcagttgttcaacaagtttgccctcccctatatccgagacgtggcaaaacaggtgaaggcccgtttaagggaagctggcctcgctcccgtgcccatgattatctttgcaaaggacggtcattttgccctggaagaactcgcccaggcaggttatgaggtagtaggattggactggactgttgctccaaaaaaggcccgagagtgcgtcggtaaaaccgtgactttacagggtaacctcgatccatgcgccctttacgcaagtgaggaggagataggccagctggtgaagcaaatgctggacgacttcggaccccatagatacatcgctaaccttgggcacgggctgtacccagacatggatcccgagcacgtgggggcatttgtcgatgctgtgcacaagcatagtcgcttgctgcgtcagaattag

SEQ ID NO: 246396 - DNA, 582 bp, Artificial Sequence
  Description of Artificial Sequence: Synthetic coding sequence
atggaggcaaatggacttgggcctcagggattccctgaactgaaaaacgatacttttctgcgcgcagcttggggagaagagacagactacactcccgtgtggtgcatgcgtcaggccggaaggtacctacccgagttccgggaaactagagcagcccaagatttcttttctacctgtaggtcacccgaagcctgttgcgagctgactctgcaggctttggggatggaggtgactatggtgccaggtaagggaccatccttcccggagcctctacgggaagaacaggatctcgagaggttacgggaccctgaggttgtggcttctgaactggggtacgttttccaggcaatcactcttaccagacagcggctggctggacgtgtgcccctgattggctttgctggagcaccctggaccctgatgacatatatggttgaaggcggaggcagctctactatggcacaagccaaaaggtggttgtaccaaagacctcaggcatcacaccagctcttgaggattcttacagatgccttggtcccatacctggttgggcaggtggtggctggcgctcaggctctgtag

SEQ ID NO: 246397 - DNA, 684 bp, Artificial Sequence
  Description of Artificial Sequence: Synthetic coding sequence
cctcaaggcttccctgaactgaagaacgacacgtttctgagggccgcttggggcgaggagaccgactacactcctgtgtggtgcatgcgccaggccggacggtatctcccagagtttagagaaacccgggcagctcaggattttttttctacatgcagatcccccgaggcgtgttgcgagctaacattacagccattaagaaggtttcccctggacgccgcaattattttcagcgatattctcgtcgtgccccaagctttgggcatggaagtgacaatggtccccggtaaagggccttcctttccggagccgttgcgggaggaacaggatctcgaaaggctgagggatcccgaagtggtcgcgagcgaactcggatacgtcttccaggccattaccttaacacgacaacgcctggccggtcgggtcccccttattgggttcgcgggagcgccagccttgcagctgttcgagtctcatgccggacacctcggaccccaattatttaataaattcgctctgccttatattcgggatgtcgctaagcaggtcaaagccaggttgcgagaagccggtttggccccagttcccatgattatttttgcgaaagatgggcactttgcgctggaagagttggcccaggccggatatgaagtagtgggactggattggactgtagccccttag

SEQ ID NO: 246398 - DNA, 687 bp, Artificial Sequence
  Description of Artificial Sequence: Synthetic coding sequence
taaccacagggtttcccggaactgaaaaacgatacattcctccgggctgcttggggggaagagaccgattacactcccgtttggtgtatgcgacaggccggaagatatctgccagaatttcgtgagacccgtgctgcccaggacttcttttccacctgtagaagcccagaagcttgttgtgagctgacactccagccattacgcagattcccattagatgccgcaatcatcttttcagacatcctcgtggtcccacaagcgttaggcatggaggtcacgatggtgcctggcaaaggcccatcttttcccgagccgctgcgggaggagcaagacctggagaggttaagagatcccgaagtcgtggcttccgagctcggatacgtcttccaggccattacactgactagacaacgcctggctgggagagttcccctcatcgggttcgccggagctcccgcactccagttatttgaaagtcatgctggccacttaggtcctcaactatttaataaattcgcgctgccatatatccgagatgtagcgaagcaggtgaaagctcgactccgcgaagccggtctggcccctgtacccatgatcatatttgctaaggatggccacttcgccctggaagagctcgctcaggcaggatacgaagtggtgggcctggactggacagtggccccttag

SEQ ID NO: 246399 - DNA, 582 bp, Artificial Sequence
  Description of Artificial Sequence: Synthetic coding sequence
atggaggccaacggattgggccctcaagggtttccggagcttaaaaatgatacattcctgagagctgcctggggggaagaaacagattacacacccgtgtggtgtatgaggcaggccggtagatacctgcccgagttcagggagacccgcgctgcgcaagacttcttctccacttgccgttcacctgaggcctgctgtgagttaaccttgcaggctcttggaatggaagttaccatggtgccaggtaaaggtccaagctttcctgagcctctgcgcgaggagcaggacctcgaacgcctgcgcgaccctgaagttgtggcttcagaactgggctacgttttccaggccatcactctcactaggcagcgcctggctgggagagtgccactgatcggcttcgcgggagctccttggacccttatgacctacatggtcgaaggagggggaagttctactatggcccaggccaagcgatggttataccagcggcctcaagcatctcatcagttgctgcgcatactaaccgacgccctggtaccttacctggtgggacaggtggtcgcgggagcgcaggcactgtag

SEQ ID NO: 246400 - DNA, 402 bp, Artificial Sequence
  Description of Artificial Sequence: Synthetic coding sequence
atgaaggtcctgctgcttaaggacgcaaaggaggatgactgtggacaagacccttacatccgtgaactggggctgtacggactcgaggcaaccctgattccagtgctgagctttgagtttctgtccctgccgagcttctctgagaagttgagccacccagaggattacggaggactaatcttcacaagcccgcgagctgtggaagccgcagagctgtgcttggagcaaaacaataagacagaggtctgggagcggtctcttaaagagaaatggaacgccaaaagtgtttacgtggttggcaatgctacagctagtttggtatccaaaataggtctggacactgagggagaaacctgcggcaatgctgagaagctggcagagtatatttgctcatcaaaatag

SEQ ID NO: 246401 - DNA, 420 bp, Artificial Sequence
  Description of Artificial Sequence: Synthetic coding sequence
atgaaagttctgcttctcaaagatgccaaggaggacgattgtgggcaagacccttacattagggaacttgggctgtacggactcgaagctactctcatcccggtgctctcatttgagttcctctctcttccttctttctcagagaagttgagtcaccccgaagattatggaggactgattttcacgtctcctagggcagtcgaggccgcagagctctgtctggagcagaataacaagacagaggtttgggaacgaagcctgaaagagaagtggaatgctaagagcgtttacgttgtcggcaatgccacagcctcgcttgtatccaagattggcctggacaccgagggtgaaacgtgcggcaatgccgagaagctcgcagagtacatttgcagttccgaagaagtcaaaggtatcttctag

SEQ ID NO: 246402 - DNA, 798 bp, Artificial Sequence
  Description of Artificial Sequence: Synthetic coding sequence
atgaaggtgctcctcctcaaggatgctaaagaagatgactgtggccaggacccctacatacgggagcttggactctacggcttggaggccactctcatacctgtgcttagtttcgaattcctttcactccctagcttcagtgagaaattatcgcacccagaagattatggcggactgattttcacttccccgcgagccgtggaggcagctgagttgtgtctggagcagaataacaagaccgaggtctgggagcgatcccttaaagagaagtggaacgctaagagcgtttatgtggtcggtaacgctaccgcttcattggtatccaaaataggccttgatacggaaggggagacatgcgggaatgcggagaagctggctgagtacatttgcagccgggagagttcagcactcccactgctttttccatgcggaaatttgaagcgagagatcctgccgaaagccttgaaggataagggcatcgctatggaatccatcaccgtgtatcagacagtggcccatcccggtattcaagggaacctcaactcatactatagtcaacagggcgtcccagctagcattacatttttctcgccctcgggactgacctacagcctgaagcatattcaagagctgtccggggacaatatcgaccagattaaattcgccgctatcggacccacaaccgcacgggcactggctgcccaggggttacctgtgtcttgcaccgctgagtcgccaaccccgcaagctttagctactggcattcgaaaggcgcttcagccgcatggttgttgttag

SEQ ID NO: 246403 - DNA, 798 bp, Artificial Sequence
  Description of Artificial Sequence: Synthetic coding sequence
atgaaggtcctcctgctgaaggatgctaaggaggatgactgcggccaggacccatacatccgtgagctgggcctttacgggttagaggcaaccctgatccctgtactgagctttgagtttctgtcattgccgtcattctcagagaaactgagccacccggaggactacggagggctcatttttactagccccagagcagtggaagcggcagagctctgcctagaacagaacaataaaaccgaagtgtgggaacgttccctgaaggagaaatggaacgctaagagcgtctatgtggtggggaatgccactgccagcttggtatccaagatcgggctggatactgaaggtgaaacctgcggtaatgctgagaagctcgcagaatacatttgttcacgggaatcttcagccctacccctcctgttcccttgtgggaacctcaagagagagatccttccaaaggctctgaaagataagggtattgctatggagagcattactgtgtatcagaccgttgctcatccaggaatacagggtaacctgaacagctattattctcaacagggggtgccagcaagcattacctttttctctccatccggactcacctactcactgaagcacatacaggagctaagcggagacaacatagatcagatcaaattcgcggcaataggacccaccaccgccagggcactcgcagctcaaggtctgcccgtttcttgtaccgctgagagccctacacctcaggcactggccaccgggatccgtaaagccctgcagccacacgggtgttgttag

SEQ ID NO: 246404 - DNA, 558 bp, Artificial Sequence
  Description of Artificial Sequence: Synthetic coding sequence
atgaaagtgctcctcctaaaggacgcaaaggaggacgattgcgggcaggatccttatatccgtctcagtcaccccgaagactacgggggtctgatctttacatcaccgagagctgtcgaggccgcagaattgtgcctggagcaaaacaacaaaactgaggtttgggagagatccttgaaagagaaatggaacgcgaaatctgtgtatgtcgtgggaaacgccacagccagtctggtctctaagatcggcctcgacaccgaaggggagacctgcggcaacgctgaaaagcttgccgaatatatatgctctcgcgagtcatccgctctcccccttttgtttccatgcggaaatctaaagagggaaatactccccaaggccttaaaagataaaggcatcgcaatggagtcaatcacggtctaccagaccgttgctcaccccggaatccagggcaaccttaactcctactatagccaacaaggggtgcccgcaagcattacattcttctcgccgagcggtttaacttattccctgaaacacattcaagagcttagcggctag

SEQ ID NO: 246405 - DNA, 2700 bp, Artificial Sequence
  Description of Artificial Sequence: Synthetic coding sequence
atggaccgaaaagttgcccgagagttcagacacaaagtggacttcctcattgagaacgatgccgaaaaggactacctctacgacgtgctgcgcatgtaccatcagacaatggacgtggccgtgctggtgggtgacttgaagttagttatcaatgaaccctcccggctgccactgttcgacgcgataagacctctaattccactgaagcatcaagttgaatacgatcagctcactcccaggcggtccagaaaactcaaagaggttaggttggacagactacaccccgagggactcggacttagtgtccgcggaggactggagttcgggtgcgggctgtttataagtcacctgatcaagggcggacaagccgatagcgtggggctgcaggtgggcgatgagatcgtgagaatcaacgggtactccatcagttcctgcacccacgaagaggtgatcaacctgataaggacaaaaaagaccgtatcaatcaaggttcgtcacattggccttatccccgtaaagtcttctcctgacgaaccccttacgtggcagtacgtggatcagttcgtctccgagagtggtggtgtccgaggctccctggggagtcctgggaaccgtgaaaataaggagaagaaggtgtttatctccctggtaggatcccggggtctaggctgctctatctcttctggccctattcagaagcctgggattttcatttcgcacgtgaagccgggttcccttagcgctgaagtgggcctggaaattggggatcagattgtcgaggtgaatggcgtagattttagcaatcttgaccacaaagaggccgtgaatgtgctgaagagctcacgatctctgaccatatctattgtggcggctgccggacgtgagctgttcatgactgatcgagagcgcctggccgaggcccgtcagcgtgagcttcagcgccaggaattgcttatgcagaagagactggcaatggaatcaaacaaaatcttacaggaacaacaggaaatggagagacaacggagaaaagagatcgcccaaaaagcggcagaggaaaacgagagataccggaaagagatggaacagattgtggaagaggaggagaaatttaagaagcaatgggaggaggactggggttccaaggagcagctgctcctgccgaaaaccattacagcagaggtgcaccccgtccccctaagaaagccaaagtctttcggttggttttatagatatgatggaaaatttccgacaattcggaagaaaggcaaagacaagaaaaaggccaagtacggctcactgcaggatctacgtaaaaataaaaaggagctcgagtttgagcagaaactctacaaggagaaagaggagatgctggagaaggagaaacaactcaagattaacagactagcgcaggaagtgtccgaaacggagcgcgaggaccttgaagaatccgagaaaattcaatattgggtagagcgcctgtgccagacccgactcgagcagatcagttctgccgataatgagatcagcgagatgacaaccggcccacccccaccaccacctagcgtgagtccactggcgcctccgctgagacgctttgccggtggtcttcatttacacactacagacctcgacgacatccccttagatatgttctactatccgcctaaaaccccctcagccttgcccgtgatgccccatcctccccctagtaaccctccccataaggttcctgccccaccggttctgcctctgtccggtcacgtatccgcctccagctccccctgggttcagcgtacccctccacccatccccatcccccctcctcctagcgtacccactcaggatctcacccctactcggcctctgccctccgcgctggaagaggccctgagcaatcacccctttcggacaggtgacactgggaaccccgtagaggactgggaagccaaaaaccacagcggcaaaccaaccaattcgccagtacctgagcagtccttccctcctacacctaaaaccttctgcccaagcccccagccaccaagggggccaggcgtctctacaatttcgaaacccgtgatggtgcatcaggagccaaattttatctaccgcccagccgtgaagtccgaagtgctgccccaggagatgctaaaacgcatggtcgtatatcagaccgcttttcgtcaagactttaggaagtatgaagaagggttcgacccctactccatgttcacacccgaacaaataatggggaaggatgtacgactgctgaggattaaaaaagaagggagtttggatttggccttggagggaggggtcgatagcccaatcgggaaagtagtggtgtcagccgtttatgaacgtggcgcagcagagcggcacggagggatcgtaaagggcgacgagatcatggctattaacggaaagatcgtgacggactatacactcgctgaggccgaagccgcactccaaaaagcttggaaccagggaggcgactggattgatcttgtggtggcagtgtgtccaccaaaggaatacgacgatgagttggctagcttgcccagcagtgtggccgagagccctcagcctgtgcggaagctgctggaggacagagccgctgtacatagacacggttttttgctccagcttgaaccaaccgacctgcttcttaagtccaaacgaggaaaccagatccatagatag

SEQ ID NO: 246406 - DNA, 1659 bp, Artificial Sequence
  Description of Artificial Sequence: Synthetic coding sequence
atggaccggaaggttgcaagagaatttaggcataaggttgatttcctcatcgagaatgatgcagagaaggactacctgtatgacgttcttaggatgtatcaccaaacaatggatgtcgccgtcctggttggtgacctgaaactagtcatcaatgaaccttctcgtctcccgttgtttgacgccattagaccgctcatcccactgaaacaccaggttgagtatgaccagctgaccccacggcgtagtaggaaactgaaagaggtcaggttggatagactccaccccgaggggctgggactgtctgttaggggcggactggagtttggatgcgggctttttatttctcatctgattaaagggggacaggcggattccgtcggcttgcaggtaggagacgagatcgtccggattaacggttacagcattagcagctgcacccatgaggaagtcataaaccttataagaacgaagaaaacggtgtccatcaaagtccggcatattggtctcatccctgtgaaaagttcacctgatgaaccactgacctggcagtacgtcgatcaatttgtgagtgaaagtggaggagtcagaggttctctgggcagcccaggcaaccgggagaataaagagaagaaggtattcatctctctcgtggggagtcgcggactcggatgctccataagcagcggccctatccaaaagccaggaatctttatctctcacgtcaagcctggatctttgtccgccgaggtgggactggaaatcggtgaccaaatcgtggaagtaaatggggtggacttcagtaacctcgatcataaagaggctgtaaacgtcttgaagtcaagtcgttccctgacaataagtatagtggcggctgcgggacgggaactatttatgacggatagggaacgcctggccgaggccagacagcgggaattgcaaagacaggagctgcttatgcagaagcggttggccatggagtctaataaaatactccaggagcagcaagagatggaaagacaaaggcgaaaagaaatagctcaaaaggccgctgaggagaacgagcgttatagaaaggagatggagcagattgttgaagaagaggaaaaattcaagaagcaatgggaggaggattggggatccaaggaacagctcctgctcccaaagaccattaccgccgaggtgcatcctgtgcctctgagaaagccgaaatatgatcaaggagttgagcctgaacttgaacccgcagacgaccttgatggcggaaccgaggagcaaggggaacaagacttcaggaaatacgaggaggggttcgacccctactctatgtttacgcccgaacaaattatgggaaaggatgtgaggttgctccggattaagaaggagggaagtctggatctggctctggaaggtggggtggattcgccgatcggcaaggttgtggtgagtgcagtatatgaaaggggtgccgcagaacgtcacggcggaattgtcaaaggcgacgagatcatggcaattaacggtaaaatcgtcaccgattatactcttgccgaggccgaagcggcattgcagaaagcctggaaccaaggcggagattggatcgatcttgtggttgcggtttgcccaccgaaagagtacgatgacgagcttactttcttctag

SEQ ID NO: 246407 - DNA, 1602 bp, Artificial Sequence
  Description of Artificial Sequence: Synthetic coding sequence
atggatcgaaaggtggccagggagttcagacacaaggttgactttctgatagaaaacgatgctgagaaagattatctttacgacgtcctgaggatgtatcaccagacaatggatgttgcagtcttggtaggggatttaaagttggtcatcaacgaaccctcacgtctccccctctttgatgccatacgacccctcattccactgaagcaccaggtggagtacgaccagctgactccgcgacggtcccgaaagctcaaagaagtcaggttggatcggttgcatcccgaaggccttggactcagcgtacgtgggggacttgagttcggatgtgggctgtttatctcccacctcatcaagggcggacaggcagattctgtgggacttcaggtaggcgatgagatcgtccggatcaatgggtactctattagctcgtgcactcacgaggaggtaattaatctgatacgaaccaaaaagaccgtgtccatcaaagttcgccatataggcctcattcccgtgaagtctagtccagacgagcccctgacatggcaatatgtagatcagtttgtgtctgaatccggcggtgtgagaggatccctcgggagcccgggtaacagggaaaataaggagaagaaagtctttatcagcctcgtgggctcccgcggactcggttgttcaatcagttccggccctatccagaagcccggtatctttatctcccatgttaaacctggctccttatctgccgaggtagggcttgaaattggtgaccagattgtggaggtcaatggagtcgacttcagtaacctggatcataaagaaggccgtgaactgttcatgaccgatagggagcggttggcggaggcacgccaacgggaactgcagcgacaggagttattaatgcagaaaagattggccatggaatccaacaagattcttcaggagcagcaggagatggaacggcagaggcgcaaagaaatagcacagaaagccgcagaggagaatgaaagataccgcaaagagatggaacagatagtggaagaggaagagaagttcaagaaacagtgggaggaggattggggctcgaaagaacagttgctgttgcccaagacaataaccgcagaggtgcatccagtacccctacgcaaaccaaaatacgatcagggtgttgagcccgaactggaacccgctgacgacctcgacggcggaaccgaggaacagggagagcaggattttcggaaatatgaagaaggctttgatccttactctatgtttacacctgaacaaatcatgggcaaggacgttagactgctgcggattaagaaagagggctccctggaccttgctctggagggcggagtcgatagcccaattggtaaagtggtcgtgtctgccgtgtacgaacggggagcagccgagcgtcatggaggcattgtgaagggcgacgagatcatggccatcaacggaaagatcgtcacagactacacacttgcagaggctgaggctgccttacagaaggcctggaatcaaggcggtgattggattgacctggttgtggccgtgtgtccacccaaagagtatgatgatgaacttacattcttttag

SEQ ID NO: 246408 - DNA, 1566 bp, Artificial Sequence
  Description of Artificial Sequence: Synthetic coding sequence
atgtaccaccaaactatggacgtcgcagttttggtaggtgacctcaaactggtgattaacgagccgagccggctgcctctgtttgatgccatccggcctctaatcccgcttaagcatcaagtggagtacgaccagctgactccacggagaagccgcaagttaaaagaagtgagactcgaccggctgcatccggagggactgggtctgtccgtacgaggtggcctggaattcggttgcggactctttatttctcacttaatcaagggcggtcaagctgattctgtaggccttcaagtgggagatgagatagtgcggatcaacggctactccatcagcagctgtactcacgaagaagtaatcaatctcatccgaacaaagaagactgtgtccattaaagtgcgccatattgggctgattcccgttaagagttctcctgatgagcccttaacgtggcagtacgtagaccagtttgtgtccgaatccgggggagtgcgaggaagccttggaagtccaggtaaccgtgagaacaaggagaaaaaagttttcatatccctggtcggctccaggggactgggatgcagtatttcttcaggcccaattcagaaaccaggtattttcatcagtcacgtcaaacccggtagcctcagcgcagaagtcggtttggagatcggagatcagattgtggaagtgaacggtgtagatttcagcaatcttgaccacaaagaggctgttaatgtcctaaaatcttctagatcacttacgattagcatcgtggcagccgctggaagagaacttttcatgacagacagagagcgactggccgaggctagacagcgcgaactgcaacgccaggaactgcttatgcagaaaagactggcaatggagtccaacaagattctgcaggagcagcaggagatggaaaggcagcgaagaaaagagattgcccaaaaagccgctgaggagaacgaaagataccgaaaagagatggagcaaatagtggaagaggaggagaaatttaagaaacaatgggaggaagactggggaagcaaggagcagttactgcttcctaagaccatcaccgctgaggtgcatccagttccactgagaaagcccaaatatgaccagggcgtagaacctgaactggaacccgcagacgaccttgacgggggtaccgaggagcagggagaacaagattttcgcaaatatgaggagggttttgatccatacagcatgtttactcctgagcagattatgggcaaggatgtccgcctgttacgcataaagaaagagggcagtctggacctggcacttgaaggcggtgtggattcaccaatcggcaaagtggttgttagcgctgtttacgagagaggagccgctgagcggcacggtgggatcgttaaaggtgacgaaatcatggccataaatggcaagatagtcactgattatacactcgcagaggcagaggctgctctgcaaaaggcgtggaaccaaggcggtgactggatagatctggtcgtggctgtatgtccgccaaaggagtacgacgacgagctcaccttcttctag

SEQ ID NO: 246409 - DNA, 2112 bp, Artificial Sequence
  Description of Artificial Sequence: Synthetic coding sequence
atgtccgctagagccacccgacccaggagcagacgcggtagacatgcccctcctggggaattagatcccgtggcagaaagcagcgaggaggttgaagctgcctctgggtccagcaagccaagcttcgctcctccaccagtaagctccgggctggagcagttaggccctatggaggaagttagtggacaaggcctaggcagccgcaccgacaaaaaaatggatggcggttccggaagagagctcgcttccgccccagaagtaccccacaaacccgctgtggaggctcaccaggccccagaggccgctctccagtacaaggaaactgtgccacctgggaacggcgctccagacgtgtttcaaacactccagcacacactgtcatccttagaggccgcagccgcagcctggcgtcaccagccgccttcacactctggccctatggagttcgaggggacttcagaaggaggcgctggctccttaggcaagcaggaaggtgccggatcttgccaaagagaggccgctcggcttgcagagcgaaacgcttggctgcgcctggccctgtccagccgggaggatgagttagtgcggacccaggcatcccttgaagccatccgggctgagaaggaaacactgcaaaaggaagttcaagagctgcaggactcactcctgaggctggaaccgtgtccacatctcagtcacaaccaggccggtggttcgggatccggatctagcagctcagaagccgatcgggaaccatgggagactcaggatagtttttcactggcgcaccccctgctgcgacgtctgcgaagccatagtagtacccagatactcgggagtctccccaaccaacccctctcccctgaaatgcacattatggaagcccaaatggagcagctgcggggttctatagagaagttaaagtgctttaataggctcctgagtgccgtgctgcagggatacaagggtcgctgcgaggggctgtcaatgcagctggggcagcgcgaagccgaggctaccgctcttcacctcgccctccaatattcagagcattgtgaagaggcctatcgcgtgctcctcgcgctccgggaggcagattctggcgctggagatgaggcaccaatgtcagacttacaggccgctgaaaaggaggcttggagactcttggcccaggaggaggccgcaatggatgccggagcccaacagaatccccagccgagtccagagggttcttccgtagacaaaccgacaccacaagaggtcgcctttcagctgcgcagctacgttcaacgccttcaggaacgacggtccctcatgaaaatcctcagtgaacccggacccactttagcacctatgcccactgtccccagggccgaggcgatggtacaggcaatcctgggaactcaggctgggcctgccctgcctaggctggaaaaaacccaaatccaacaagaccttgtcgctgcgagggaggccctagctgatctcatgctcagactccagctggtgcgacgagagaagcggggactggagctgcgagaagctgcattacgagcacttggaccagcacacgttctgctcctggaacagttgcgctgggaacgggctgaacttcaagccggtggggctaattcaagcggcggacacagctcagggggagggtcctcaggagatgaagaagagtggtaccagggccttcctgctgtgccaggcggaacctcaggtattgatggcggtcaagtcggcagagcttgggatcctgagaagcttgcccaggagctcgccgcatctttgaccaggaccctagatctgcaggaacagctgcaaagtctgcgtcgcgagttagaacaggtggcacagaaggggagggctcggaggagtcaatccgctgaactgaatcgcgacctttgtaaagctcatagtgccctggtgttggctttccggggagcccatcggaaacaagaggagcagagacgcaagttggaacagcagatggcactgatggaagcgcagcaagccgaggaggttgcagttctcgaagctaccgcccgagctctcggaaaacctaggcctccacttcctccacctcagctcggagatactttcctctag

SEQ ID NO: 246410 - DNA, 1152 bp, Artificial Sequence
  Description of Artificial Sequence: Synthetic coding sequence
atgtctgcgcgtgctacacggccaagatcccggcgtggaaggcatgcccctccaggcgaactggatccggtggcggaatcctccgaggaggtcgaggcggcatcaggctctagcaagccctctttcgccccaccgcctgtctcttccggacttgagcagctgggacccatggaagaggtgtccggtcaaggactaggctctcggactgacaagaaaatggacggtgggtccggccgtgagcttgcttctgcaccggaggttcctcataagcccgcagtggaagcacaccaggctccagaagccgctctgcaatacaaggaaactgtcccaccaggcaacggagcacctgacgtgtttcagaccttgcagcatacactcagctcactcgaagctgccgcagccgcatggcgccaccagcccccttcgcactccggcccaatggagtttgagggcaccagcgagggaggcgctggctctctgggaaagcaggagggcgcaggctcctgccaaagggaagcagcacgactggctgaacggaacgcatggctgagactcgctctgagcagcagggaggatgagttggtgagaactcaggcaagcctggaagccatccgcgcagagaaagagaccctgcagaaagaggtgcaagaactgcaggattcgttactgcggcttgagccttgtccccatttgagccacaatcaggccggtggcagcgggagcggctcctcttcctcagaggctgatcgcgagccatgggagacccaggacagtttcagtctggcccacccgttgctgagacgtcttaggtctcactcatctacccaaatactcggaagcctccccaaccagccactttccccagaaatgcacattatggaggcacaaatggaacagcttagaggcagcattgaaaaattaaagtgtttcaatcggctgttaagcgccgtgttgcagggctataagggtcggtgcgagggactgtctatgcaacttggacagcgcgaggctgaagcaaccgcacttcacctggcactccagtacagagtattgctctgtcatcccggttggtccgcagtggtgccgtcctggttaacagccacctctgcatctcccgtgcaagttattcttctcccccagccacccgagtag

SEQ ID NO: 246411 - DNA, 1920 bp, Artificial Sequence
  Description of Artificial Sequence: Synthetic coding sequence
atgttacatcccaccgataaaaagatggatggtgggtctggtcgagaacttgctagcgcacccgaggtgccgcacaaaccagccgtcgaagcacatcaagccccagaggctgctctccagtacaaggagacggttccaccaggaaacggcgctccagacgtgtttcagaccctacaacacaccctgtcatccctggaggctgcagcagctgcttggcgacatcagcccccttcccattccggccctatggagtttgagggtacatctgaggggggagcgggatcgcttgggaagcaggagggcgctggctcttgccagagagaggcagcccgactggccgagagaaacgcttggctcaggctggccctgagctcccgcgaggacgaactggttcggacccaggcatccctggaggctatcagagcagaaaaagaaacactgcagaaagaagtgcaagagttacaggactctctgttgcggctggagccatgcccacacctgagccataatcaggccggtggaagcggttcgggttcatcaagttcagaggctgacagagagccttgggagacccaggactctttttcccttgctcacccacttctccggaggttaaggtctcatagttccacacagatactgggatctctccctaatcaacctctgtcccctgagatgcacatcatggaggcccaaatggagcagctgcgtggctcaatcgagaaactcaaatgtttcaatagactgctttcagcggttctgcagggatacaagggtaggtgcgaggggttatcaatgcagcttggacaaagggaggcggaggccacagccctccatctggccttgcaatacagcgaacactgtgaggaggcctatagggttctcttagccctacgcgaggcagactccggagcaggggacgaggcgccaatgtctgacctccaggctgccgagaaggaggcttggcggctcctggcccaggaagaggctgccatggatgctggtgcccagcagaacccacagccgagtcctgagggatcttcagtggataaacctacacctcaggaggtagccttccagctgaggagttatgtccagcgcttgcaggagaggaggtcactgatgaagattctatccgagcctggtcccactctcgcccctatgccgactgtgccccgtgccgaagctatggttcaggcgattctcggaacccaagccggtcctgctctgccgagactggagaaaacacagattcaacaggatctggtagcggcacgtgaggcccttgcagacttgatgctccgactccagttagtccggcgagagaaaaggggcctggagctgcgagaggccgctctcagggctctggggcctgcccatgtcctgctgctggagcagttgaggtgggaacgcgcagagttacaggcagggggagcgaacagttcaggcggacacagtagcggtggcggatcatccggggatgaggaggagtggtaccaaggtctccccgcagttcctggcggtacatctggcatcgatgggggacaggtgggaagagcctgggatcccgagaagttggcccaggagctggcagcttcgctgaccagaaccctggatctgcaggagcagctgcagtcacttcgacgtgaactggagcaggtagcacagaaagggagggcccgacgatcccagtcggctgaattaaatcgtgatttatgtaaggcccattcggctctggtcctggcctttaggggagcgcatcggaaacaagaagagcagcgtcgaaagcttgagcagcagatggcattgatggaggcccagcaggccgaagaggtagccgtcttggaagctacagccagggctctgggtaaacctagacccccacttcctcccccacaactaggcgacacttttctgtag

SEQ ID NO: 246412 - DNA, 1386 bp, Artificial Sequence
  Description of Artificial Sequence: Synthetic coding sequence
atgaatgatcaataccaccgcgcagctagagatggttatctggagttgttaaaggaggctactcggaaggagctcaatgccccagacgaggacggaatgacaccgactttgtgggccgcttatcatggtaacttggagtctcttagactcatcgtgtctcgagggggtgaccctgataaatgcgatatctgggggaatactcctctccacctggcagcctccaatggacatttacactgcctctccttccttgtgtcgttcggggctaatatttggtgtctggacaatgattatcacacccctttggacatggcagccatgaaaggacacatggagtgtgtgcgttatcttgattctatagcagcaaaacaatcctcacttaacccaaaactggtaggaaaacttaaggacaaggcatttagagaggccgagcgaagaattagagaatgtgcaaagctgcaacggcgacaccatgagaggatggagcgccgttatcgtcgagagctagcagaaaggagcgatacgttgtcttttagctctctgacttcatccactctttcgcggagattgcagcaccttgctctgggatcccatcttccatactctcaggcgaccctgcacggtactgctcgcggaaaaaccaagatgcagaaaaaactggaacgaagaaaacaaggcggtgagggaacctttaaagttagcgaagacggtaggaagtctgcacggtctctcagcgggctgcagctaggcagcgacgtcatgttcgtgcggcagggcacatatgcgaatcccaaggagtgggggcgtgctcctctgcgggatatgttcctgtcagacgaagactccgtttcgcgggcaacactggcggctgagcctgcgcactccgaagtgtccacagactccggccatgactcactgtttacgcggcctggtttggggactatggtatttcgcagaaactacctgagcagcgggctgcatggactggggagagaagatgggggtttggacggggtgggggcacccagggggaggctccagtcctcgccctctctggatgatgactccctgggttccgccaacagcctgcaggatcgaagttgcggggaagagctcccctgggatgagttggatcttggcctagatgaggacctggaaccggaaacgtcgcctttggagactttcctcgcatctctccatatggaagacttcgccgctctccttaggcaagagaagattgacttggaagctctgatgttgtgttccgatttggacttgcggtctatttcagttcctctgggacccaggaaaaagatccttggagctgtgagacggaggcgacaggccatggagagaccacctgccctggaagataccgaattatag

SEQ ID NO: 246413 - DNA, 15609 bp, Artificial Sequence
  Description of Artificial Sequence: Synthetic coding sequence
atgaactgtccagtcctgagtctgggctcgggttttctttttcaggttatcgaaatgctgatattcgcttactttgccagtatttctctgacggagtccaggggactcttcccgaggctggagaacgtgggggcttttaaaaaggtaagcatcgttcctacgcaggcggtgtgtggcttgcctgataggagcactttttgtcacagttctgccgcagccgaaagtatacaattttgcacacagcggttctgtattcaggactgcccataccggtcctcacatcccacctacaccgctttgttctctgcagggttatcgagctgcatcacacccgacaaaaatgatctccaccctaatgcccactctaattcagctagctttatcttcgggaaccacaagagctgctttagttcccctccctcccctaagctcatggcttctttcacgctggccgtgtggctgaagcccgaacagcaaggagtgatgtgcgtgatcgagaaaacagtcgatggtcaaattgtttttaagttgaccatctcagaaaaggagactatgttctattacaggaccgtaaatgggctccaacctccgataaaggttatgaccctgggcagaattctagtgaagaagtggattcatctaagtgtacaggtgcaccagactaagattagtttcttcatcaacggggtggagaaggaccacaccccattcaatgccaggacgctgtccggttctattacagactttgcatcagggacagtgcagattgggcagtcactcaatggtctggaacagtttgtgggtcgaatgcaggacttccgactgtaccaggtggctctcactaatagagagatcctcgaggtcttctctggcgacctgcttaggctccatgcgcagtcgcactgccggtgtcccggtagtcatcctagggtgcatcctctggcccagcggtattgcattcctaatgacgcaggggataccgcggataaccgagttagccgcctgaaccccgaggctcaccctctatctttcgtcaacgataatgacgttggaacctcttgggtgtccaatgtgttcaccaacataacccagctcaatcagggtgtgaccataagtgtggaccttgaaaatggacagtatcaagttttctacataatcatccagttcttttctccccagcctaccgaaatcagaattcagcggaaaaaagagaattccctagattgggaggactggcagtattttgctagaaattgtggtgctttcggaatgaagaataatggggacctcgagaagccggattccgtgaattgtcttcaactgtcgaactttacaccttacagcagaggcaatgtaacattcagtatacttacccccggacccaactacaggcctgggtacaacaacttctataacacaccctctctgcaggagttcgttaaagcaacccaaataagatttcacttccacggccagtattacactacagagacagccgtgaacttgcgccatcggtactacgctgttgatgagataaccatctccggaagatgtcagtgccacggacatgcggataactgtgacacaacctcacagccttatcgctgcctttgttcccaggaatcttttactgaaggcctgcactgcgaccggtgtctgccactgtacaatgacaagccattcagacaaggggaccaagtgtacgcatttaactgcaagccgtgccaatgcaacagtcacagcaagtcctgccactataacatctccgtcgatccttttccattcgaacactttcggggagggggaggcgtctgcgatgactgtgagcacaatactactgggagaaactgtgagctctgcaaggattacttcttccgtcaggtgggcgctgacccctctgctatcgatgtgtgtaagccttgtgactgcgacacggtcggaacacgaaatggaagtatcctatgtgatcaaataggagggcagtgcaactgcaagcgtcatgtatctggacgacaatgcaaccagtgtcaaaatggtttctacaacctgcaggagctcgacccagacggttgctcaccttgcaattgtaacacaagtggtacagtggacggcgacattacttgccatcagaactccgggcaatgtaagtgtaaggcaaacgtaatcggtttacgctgcgaccattgtaatttcggcttcaagttcctgagatcatttaacgacgtgggctgcgaaccttgtcagtgcaatctacacggctcagtaaacaagttttgcaatccccacagtggccagtgtgagtgtaagaaagaggcaaaagggttgcaatgcgacacttgcagagaaaatttttatggccttgacgtgacaaactgtaaagcgtgcgactgtgacactgcgggttccttgccgggaactgtctgcaatgccaaaactgggcaatgtatttgcaagcctaacgttgagggcaggcaatgcaataaatgcctggaggggaacttctatctaaggcagaataacagctttttgtgccttccttgcaactgcgataaaacaggaaccatcaacggcagcctcctttgtaataagtcaaccgggcaatgtccatgtaagttgggggtcacgggactgagatgcaaccagtgcgagccccaccgatataatctcaccatcgacaatttccagcactgccaaatgtgcgagtgtgatagcctggggacactgccaggaacaatttgcgatcccatctccggccagtgcctgtgtgtgcccaaccgacaaggtcgcaggtgtaaccagtgccagcccggattttatataagccccggaaacgcaaccggttgcctaccatgttcatgccacaccacgggcgcagtcaaccacatatgcaacagtttgacaggccagtgtgtgtgccaggacgcctccatcgcaggacagagatgtgaccagtgtaaggatcattacttcggattcgatcctcaaactggacggtgtcaaccatgtaactgtcaccttagtggcgctttgaatgagacatgccaccttgtcactggccagtgcttttgtaagcagttcgtgacaggaagcaaatgtgacgcctgtgtgccgtcagcctcccatctcgatgtaaataacctgctgggatgtagcaagacccccttccaacaacccccaccccgtggccaggtgcagtcttcttccgcaataaatctatcctggtcgccccctgattcacctaatgcccactggctgacttatagcctgcttcgggatggattcgagatatacactactgaagatcaatacccgtattcgattcagtatttcctggatactgatttactgccatataccaagtacagctactacattgagacaaccaatgttcacggtagtacacgttctgtggcagtcacttacaaaaccaagccaggagtgcccgaagggaatctgacgttaagctacataattccaatcggcagtgattccgtgactctcacatggactacactgtccaatcagtccggacccattgagaaatacattctgagctgcgctcctctcgccggaggtcagccctgtgtgagttacgaggggcatgaaacttcggccactatctggaatctggtaccctttgccaagtacgactttagcgtgcaagcatgtacctcaggcggatgtctccactccctgcccatcactgttaccaccgcccaggctccacctcagaggttgtccccacctaaaatgcaaaagattagctctaccgagctgcacgtggaatggtccccacctgccgagctgaacggcataataatccggtacgagctgtacatgaggcggctgcgaagtaccaaggaaactactagtgaagagagcagggtcttccagtcctctgggtggctgtcgcctcacagctttgtggagagcgctaatgagaacgctttgaaacctccgcagacaatgactacgatcaccggcctcgaaccctacacaaaatacgagtttcgagttttggccgtcaatatggccggaagtgtgtccagtgcttgggtatccgagaggacaggcgaaagtgcaccagtgttcatgatcccaccctcggttttcccactcagcagctatagcttgaatataagttgggaaaaacccgctgataacgtgacccgaggcaaggtcgttggctatgacatcaacatgttatccgagcaatctccacagcagtcaatccctatggcattctctcagctactgcacacagccaagagtcaggaactgtcctacacagtggaaggactgaaaccttaccggatttacgagttcactataaccctatgtaactccgtcgggtgcgtcacgagcgcctccggggcaggacagaccctcgccgcagccccagctcagttacggccacctctagtgaaaggtatcaactcgaccacaatccatctgagatggttcccgcctgaggagctaaatggtcccagtccaatttatcagttggagcggagagagtccagccttccggcactcatgaccacgatgatgaaagggatacgttttatagggaacggctactgtaaatttccttccagcacgcaccctgtgaataccgacttcacagggattaaggcttccttccggaccaaagtacccgaaggattgatcgtgttcgccgcttcgcctggcaaccaagaagagtacttcgccctccagctcaaaaaggggagactctacttcttgttcgatccccaaggtagccccgtggaggtaaccacgactaacgatcacggaaagcagtacagcgacggcaagtggcacgaaatcatagccattaggcaccaggccttcgggcaaattacactggacggcatttacactggttcctccgcaatcctgaatggttcaaccgtaattggcgataatactggggtgtttcttggagggctccctagatcgtataccattctgaggaaggatccggagatcattcaaaagggatttgtcggatgcctcaaggatgtccactttatgaaaaattataacccatctgccatctgggagcccctagactggcagtcttccgaagaacaaataaatgtgtataacagctgggagggttgccccgctagcctaaacgagggggctcagtttctgggagcaggttttctcgaactgcacccgtatatgttccatggcggtatgaacttcgagatctcatttaaattccggaccgaccagcttaacgggcttctgttgtttgtatacaacaaagacggcccagatttcctcgccatggaactgaaaagcggtatcctcacgttcagacttaatacttccctggccttcacacaggttgatcttttactggggttgtcttattgtaacgggaaatggaacaaggtcataataaagaaggaggggtccttcatctctgccagtgtgaatggcttaatgaaacatgcctccgagtctggtgaccagcctttggtggtgaactccccagtctatgtcggcggaataccacaagaactcctgaacagttatcagcatctctgcctggagcagggcttcggagggtgcatgaaggacgttaaattcacccgaggcgctgtggttaaccttgcatcagtgtcaagcggagcagtccgcgtgaacttggacggttgcttaagcacagactccgctgttaattgccggggaaacgacagtattcttgtctatcagggcaaagagcagtcagtttacgaaggcggtcttcagcccttcaccgaatatctgtatcgtgtaatagcctcacatgagggtggcagtgtgtatagcgattggtctcggggtcgtactactggcgctgctccacagtccgtaccgacgccttcaagagtccgctctttgaatggatacagcattgaggttacttgggacgaacctgttgtgcggggagtcattgagaagtacattttaaaggcctatagcgaagactcaactaggccgcctcggatgccaagtgcctcagctgaatttgtgaacacttccaatctgactggaatcctcaccgggctgctcccatttaagaactacgccgtgacactcaccgcctgcacacttgctgggtgtacagagagctctcacgcgctaaatatttcaaccccccaagaagccccacaggaggtgcagccaccggtggccaaatctctgccatcttccctcttactttcatggaatcctccaaagaaggcaaacggcatcattacacagtactgtctctacatggacggcaggctcatctattccgggtcagaagaaaactatatcgtcactgaccttgcagtgtttactccccaccagttccttcttagtgcctgcacccacgtggggtgtacgaattcctcctgggtgctgttatatacagcccaactgccaccggaacacgttgactccccagtgctcacagttttagacagccgaaccattcatattcagtggaaacagcccagaaagatctctggtatcctggagaggtatgtgctgtacatgagtaaccatacacatgattttacgatttggagtgtgatttataacagcacagagctgttccaggaccacatgctgcagtacgtcctcccaggaaataaatacttgatcaagttaggtgcgtgcacggggggaggttgtacagtgtccgaagcaagcgaggctttaaccgatgaagatatccctgagggagttccagcgcctaaagcacattcttatagccccgattcctttaacgtaagctggacagaaccagagtaccccaacggggtcattacttcctatggcctttatcttgatggcatcctgatacataacagcagtgagttgagttacagggcctatggctttgcaccctggagtctgcacagttttcgggtccaagcatgcaccgccaaagggtgtgcgcttggacctctcgtagaaaaccgtaccctggaggctccacctgaggggacagtgaacgtttttgtaaagacccagggctcccggaaggcccacgtgcgatgggaggccccattcaggcccaatggcctgctcacccactccgttctattcaccggaatcttttatgtggacccagttggaaacaattacactctcctaaacgtgaccaaggtgatgtatagcggtgaggagacaaatctatgggtgctgatcgacggactggttcctttcaccaactatacagtccaggtaaacatcagcaatagccaaggtagtctgattactgatccaataaccatcgccatgccgcctggagcacctgacggtgtgcttcctcctcgcttatccagtgccacgcctaccagtctgcaggtcgtttggagcactcctgcccgtaacaacgctccagggtctcctaggtaccagctgcagatgcggagtggcgacagcacccacgggtttctagagcttttcagtaatccatcagcgtctctttcttatgaggtgtcagacttgcagccatatacagaatacatgtttaggctcgtcgcctcgaacggatttggtagtgcccactctagctggattccttttatgacagccgaagataaacccggacctgttgtgcccccaatcctgctggacgtgaagtccagaatgatgctagtcacgtggcaacatcccaggaagtcaaatggcgtcattacacattacaacatctacctgcacggcagactgtacttgaggacaccaggaaatgtcacaaattgtaccgtgatgcacctgcacccttatacggcgtataagttccaagtagaggcatgtacctcgaagggctgctccctgtcgcctgaatctcagactgtgtggactttgcccggagccccagaagggatcccttcacctgagctgtttagcgacacacctacatctgtgataatatcatggcagccaccaacccacccaaatgggctagtagagaattttacaatcgagcggcgtgtgaaaggaaaggaggaggtcaccacgctggtcacactgcccaggtcccattccatgcggttcatcgataagacctcggccctcagcccttggaccaagtacgaataccgagtcttaatgagcaccctgcacgggggtacgaactcatcagcttgggtggaggtgaccacgcgccctagtcgaccagctggagtgcaacctccagtcgtgactgtgttagagcctgatgctgttcaggtgacgtggaaacctcccctgattcagaatggtgatatcctttcttatgagatacatatgccagacccccatatcacattaaccaatgtaaccagtgctgtgctttctcagaaagtgactcacctgataccctttacaaactattctgtcacaatagttgcctgttccggcggaaatggctatctcggaggatgcacagaatcactccctacatatgttaccactcatcccactgtcccccagaacgtaggccctttgtccgtcatccctttgtcggaaagttatgtagtgatcagttggcaaccgcctagcaagccaaacggacccaacctcaggtatgagctcctccggcgaaaaattcagcagcccctcgcctcgaatccgcctgaagatctgaacaggtggcacaacatttactctggaacacaatggctgtatgaagacaagggactctctaggttcacaacttatgagtatatgctgttcgtacacaatagcgtgggctttactccatcccgtgaggtaactgtgaccactctggccggtttaccggaacgtggtgccaacctaacagcgagtgtgcttaaccacaccgccatagacgtgagatgggccaagccaaccgttcaggatctgcagggcgaagtcgaatattataccctattttggtctagcgctacatctaatgattcactgaagattctgccagacgtcaattcacacgtcattggccatctgaaacccaacaccgaatattggatttttattagcgtgttcaatggggtgcactctatcaacagcgccggactgcacgctactacatgtgacggagagccacaaggaatgttacctccagaagttgtcatcattaatagtaccgctgtgagagtgatatggacctcaccaagcaacccaaatggagtagttactgagtatagtatttacgtgaacaacaagctttataagactggaatgaatgttcccggaagctttattctcagggatctgtcaccattcactatctatgacatacaggtggaagtgtgcacaatatatgcctgtgtgaaatctaatggcacccagattactaccgtggaagacacaccatcagacatcccgacaccaactatccgaggcataacatcacggagcctccagatcgattgggtgtcccctcgcaagccaaacggcatcattcttggatacgacctgctctggaagacctggtacccctgtgctaaaacccagaagctggtacaggatcaatccgacgaactgtgcaaggcagtcaggtgtcagaaacccgaaagtatctgcggtcacatatgctattcatctgaggccaaagtgtgctgcaatggtgtactgtacaacccaaagccaggacatcgatgctgcgaagagaagtacatacctttcgtgttgaatagtacaggcgtatgctgcggtggaagaatacaggaagcccaacccaatcaccagtgctgctcggggtactatgctcggatcctccctggtgaagtctgctgtcctgacgaacagcacaatagggtgtccgtaggtataggcgactcttgctgcgggaggatgccctattcaacatcaggaaatcaaatttgttgtgctggcagacttcacgatgggcatggacagaaatgttgtgggagacaaatcgtctcgaatgacctagagtgttgtggcggagaagagggggtggtgtacaaccgtcttcctggaatgttttgttgcggccaggactacgtgaacatgtccgatacaatctgttgttctgcttcctcaggcgaaagcaaagcgcatatcaagaaaaacgaccctgtgccagttaaatgctgcgaaaccgagctgattccaaagtctcagaaatgctgcaacggggtggggtataaccctctgaagtacgtgtgtagcgacaaaatttcaactggaatgatgatgaaggaaacaaaggagtgccggatcctgtgtcccgcaagcatggaagctacagagcactgtggtagatgtgacttcaacttcacatcccacatttgcacagtgataagggggtctcacaactctacaggaaaagcttcaatcgaggaaatgtgttccagcgcggaggagacaatccacaccggctctgtgaacacatatagttatacagacgtgaatctgaagccttatatgacttatgaatacaggatctccgcctggaatagttacggcagagggctgtccaaggcagtccgcgctcgaaccaaggaggatgtgccccagggcgtaagcccacccacatggaccaagattgacaatctggaggacacaattgtcctgaattggcgaaagcccattcagagcaacggtcccataatctattatatccttctgcgaaacgggatcgaacgctttcgcggaacatcactcagtttttccgataaagaagggattcagccctttcaggagtatagttatcaactgaaggcttgtaccgtcgccggatgcgcaacttccagcaaagtggtggccgcaactacgcaaggcgtcccagaaagcatacttccgccaagtattaccgctctgtccgctgtggcactgcacctctcttggtccgtgccagagaaatcgaacggtgtcattaaggagtaccaaatcaggcaggttggcaagggactgattcacacagacacaaccgataggaggcagcacacagtcaccggcctccagccctatactaactactctttcaccctcacagcctgtacctccgccggatgtacatcctcagagcctttcctgggtcaaaccctccaggccgctcccgagggcgtgtgggtcacccccaggcatattataatcaattcaacgactgtggaactatattggtctttgccagaaaagcctaacgggctcgtatctcagtaccagctgagccggaacggcaatctcctatttctcggtggatcagaggagcagaactttacggataaaaacctcgaacctaactccaggtacacatacaagcttgaggtcaaaacaggcggtggctcttcagcctccgatgattacattgtccaaacccctatgtcaacacccgaggagatataccccccttacaacattaccgtcattggcccttattcaatcttcgtggcttggataccccctggaatattgatccctgaaatccccgtggagtataatgtcctcctcaacgatggaagcgtaacaccacttgcattcagtgtgggacaccaccaatccacactgttggaaaacctgacaccttttacccaatacgagatcaggatacaagcctgccaaaacggttcctgcggagtctcaagccggatgtttgtgaagacgcctgaggcagcacctatggacctcaacagtcctgtgctgaaagccctgggatccgcatgtattgagataaagtggatgcccccagagaaaccgaatggcatcatcataaattattttatatatcggcgaccagcaggtatagaagaagagagtgtgctgttcgtatggtccgagggcgctctggaatttatggacgagggcgatacactgcgtcctttcaccttgtatgagtaccgcgtgcgggcatgtaattccaaagggagcgttgagtctctgtggtccttaacacaaaccctcgaggcccctcctcaagactttccagccccatgggctcaggctacttctgctcacagtgtgctgctgaattggaccaagccagagagccccaatgggataattagccactatagagtcgtgtaccaagagcggcctgatgacccgacctttaattctccaaccgtacacgcatttaccgtgaagggcaccagtcaccaggcacacctgtacgggttagagcccttcacaacctataggatcggtgtggtggctgcaaaccacgccggagagattctctctccttggacactgatccaaacactggaaagctccccctctgggctgagaaacttcatcgtggaacaaaaggaaaatggacgtgccttgctcctgcagtggagcgagcccatgagaactaacggagttatcaaaacatacaacattttctccgacggcttcttagaatactcggggttgaatagacagttcctgttcaggagactggacccatttacgctttacacgctcaccttagaggcttgcactcgcgcaggctgtgcgcattctgcccctcaaccactgtggactgatgaagcccctcccgattcacagctggccccaacagtgcatagtgtgaagtcaacctccgtggagctgtcctggagtgaacccgtgaacccgaacggcaagatcattaggtacgaagtgatccgtaggtgctttgaaggtaaggcatggggaaaccaaaccattcaggcggacgaaaagatcgtcttcacggagtacaacacagaaagaaacactttcatgtacaatgatacaggactccaaccttggacacagtgtgagtataagatttatacatggaatagtgctgggcacacctgctcctcatggaatgtggttaggacgcttcaggcccctcctgaggggctcagtccaccagtgatctcatacgtctctatgaatccacaaaagctattgatctcctggatcccccctgagcagagcaatgggatcatccagtcctatcgcttacagcgaaacgagatgctatacccgtttagctttgatccagtaacgtttaattatacagatgaagagctgttgccttttagtacatattcctacgcccttcaggcatgcacatctggtggctgttccacctctaaaccaacttccatcaccacgctggaagctgcaccatcggaggtgtcacctcctgatctgtgggccgtttcagctacacagatgaacgtgtgctggagtccaccgactgtgcagaatggtaaaatcaccaagtacctcgttaggtacgacaacaaggagtcgctcgccggacaaggactgtgtcttctggtgagccatctgcagccctactcacagtataacttttctctcgtggcttgcaccaatggtgggtgcaccgcaagtgtgagcaagagtgcatggacgatggaagctctaccggaaaatatggattcccccactctgcaggtgactgggagcgaatcaatcgaaatcacttggaaaccacctagaaaccccaatggccaaatccgctcgtatgagcttaggagggacgggaccatcgtttacacgggcttggagacgcgttacagggactttactctaaccccaggagtggagtacagctacacagtcactgcctccaattcccagggtggaattctgtccccactggttaaagaccgcaccagcccgtcagcccctagcggaatggagccaccaaaattgcaagcgcgaggccctcaggagatcctggtgaactgggatcccccagtgaggaccaacggtgatataatcaactacacgctatttattagggagcttttcgagagagagactaagatcatacatatcaataccacacacaattctttcggcatgcaaagttatatagttaaccagttgaagccattccacaggtacgagattcgtatccaagcctgcaccaccctaggctgtgcatcttccgattggactttcatccagacccctgagatcgcacctctgatgcagcccccaccacacctggaagttcagatggctccgggaggctttcagccaaccgtctcgctactgtggaccggccctctccagccaaacggcaaagtattgtactacgagctttatagacggcagattgcaacgcaaccgcgaaaatcaaaccccgtcctgatctacaatggtagcagcacctcttttattgattccgagctgctgcccttcaccgaatacgagtaccaggtgtgggccgtcaacagcgctgggaaagcgcctagctcatggacttggtgcagaacaggtcctgcccctcctgaaggcctcagggcaccaacatttcatgtaatttcgagcacccaggccgtggtgaatatcagcgcccctggaaagcccaacggcattgtttcattgtatcgtctcttttcttcttcagcccacggagcagagaccgtgctgtctgagggcatggccactcagcagacactgcacggtctgcaggcattcacaaactattctatcggagtggaagcatgcacatgttttaactgctgtagtaaaggcccaactgcggagctgaggactcatccagctccaccttctggtctcagttctccgcagataggtacccttgcctcacggaccgccagttttagatggtccccacccatgttccccaacggagtaatccactcatatgaattgcagtttcatgtcgcttgtccaccagacagcgcactcccctgtacaccatctcagatcgagacgaaatatacagggctcgggcagaaggccagcctcgggggactgcagccctatactacatacaaactgagagttgtggcccacaacgaggtgggctctactgcctccgagtggatcagctttacgacccaaaaggagctgcctcagtacagggccccattttctgtggattccaatttgagcgtagtgtgcgtgaactggtcagatacttttctgctgaatggccaactgaaggagtatgtgctcacagatgggggtcgcagggtatattctggccttgacacaaccctatatatcccgaggacagcagataagacatttttctttcaagttatatgcactaccgatgagggttcagtcaagacacccctgattcagtatgacaccagcacaggactggggctggttttaaccaccccagggaagaagaaaggctcgcggtcaaaaagtacggagttttacagcgaattgtggttcattgttcttatggctatgctcggcttaattttgctggccatctttctgtccctgatcttgcaaaggaagatccacaaggagccctacattcgggagcgcccacctttggtgcccctgcagaagagaatgagccctcttaatgtgtaccccccaggcgaaaaccacatgggcctggccgataccaagatccccaggagcggcacgcctgttagtatccgaagcaaccgaagcgcttgtgtgctgagaatcccttctcagaaccagaccagccttacatactcccagggctcgttgcataggtctgtctctcaattgatggacatccaggacaagaaggtactgatggacaatagtttatgggaagcaatcatgggccacaactctggcttgtacgtggacgaagaagatctgatgaacgctataaaggatttctcttcagttacaaaagagagaaccactttcaccgatacacacctctac

SEQ ID NO: 246414 - DNA, 4641 bp, Artificial Sequence
  Description of Artificial Sequence: Synthetic coding sequence
atgaattgtcctgtgttgtctctcggcagcgggtttcttttccaggtgatagagatgctgattttcgcctattttgccagtatctctctgaccgaatcccggggactttttccacgcttagaaaacgtgggtgctttcaaaaaagtaagcattgtccctacgcaggccgtctgtgggctgcccgatcgaagtacattctgtcattccagcgctgccgcagaaagcatccagttctgtacacagcgtttctgtatccaagattgtccatatagatctagtcatcccacgtatactgctctcttcagcgctggactatccagttgcattacacctgataagaatgacctccaccccaatgctcattcaaacagtgcttcgtttatctttggaaatcacaagtcatgcttctctagccccccaagccctaagctcatggccagctttacactggccgtgtggctcaagccagagcagcagggagttatgtgcgtcatcgaaaaaacagttgatggacagatcgtgtttaaattgaccatatctgaaaaggagacaatgttttactaccgtactgtgaacggactgcagcccccaattaaagtgatgacattgggtaggatcttggtgaaaaaatggatccacctcagtgttcaagtccaccagaccaaaatctcattcttcatcaatggcgtggagaaagaccacacacccttcaatgctcgtaccctctccggaagtatcaccgactttgcttctggcaccgtacagataggccagtcgttaaacggtttggagcagtttgtggggcgaatgcaggattttcggctataccaagttgcgttaacaaatcgggagatcctggaagtcttctcaggggacttactccggctgcatgcacagtcgcattgcaggtgtccgggaagccatcccagagtgcatccacttgctcaacgctattgtatccccaacgacgcgggtgacaccgctgacaatagggtaagcaggctgaaccccgaggcccacccactctctttcgtgaacgacaatgacgtggggaccagctgggtgagcaacgtcttcaccaacatcactcaactgaatcagggagtcacaatctctgtggatctcgaaaatggtcaatatcaggtgttctacattattattcagttcttttctccacaaccaactgagatccgcattcagcgtaagaaagaaaattcactggattgggaagactggcagtatttcgctagaaattgcggagccttcggcatgaagaataacggcgacttggaaaagcctgatagtgttaactgtctccagctgtccaatttcacaccttactctcgtgggaacgtcacattttcaatcctgactcctgggcctaattataggcccggttacaataatttttataacactcccagtctacaagagttcgttaaagccacgcagatccgcttccattttcacggtcagtattacacgacggagacagcagttaatttgagacatagatattatgccgtggatgagatcacaatcagcggacggtgccaatgtcatggccacgctgataactgcgacactacttcccaaccgtatagatgtctttgttcgcaggagagcttcactgaaggcctgcactgcgaccggtgcctgcctctatataatgataagccctttcgccaaggtgaccaggtgtatgcttttaactgtaagccctgccagtgtaattctcattctaagagctgtcactacaatatctccgtcgatccatttccgtttgagcactttagaggcggtgggggagtttgtgatgactgcgaacacaatacaacaggccgaaattgcgaactgtgcaaggactatttctttaggcaggttggtgcagaccctagtgctattgacgtgtgtaaaccttgtgattgcgatacggtggggacaaggaatggaagcatcctttgtgatcagatcgggggacaatgcaattgcaaaaggcatgtgtccggccgacagtgtaaccagtgtcagaacgggttttataatctgcaagaattagacccggatggatgcagtccttgtaactgcaacacttcagggactgttgatggcgacataacttgccaccaaaattccggacagtgcaagtgtaaggccaatgtgattgggttgagatgcgatcactgcaactttggattcaaattcttgcggtcattcaatgacgtgggatgtgagccttgtcagtgtaacctccatgggagtgttaataagttctgtaatccccatagtggccagtgcgagtgcaagaaggaagcaaaaggactgcagtgcgacacctgtcgagaaaacttttatggattggatgtaactaattgtaaagcttgtgactgcgacactgcaggaagcttgcctgggacagtctgtaacgcaaaaactgggcagtgtatctgcaaaccaaacgttgaaggtcggcagtgcaacaagtgcctcgagggcaatttctacctgcgacagaacaattcttttctgtgcctgccatgtaattgtgataaaactggtaccatcaacggcagcctgttgtgcaacaagtctacaggccagtgcccttgtaagctcggggttacaggactgcgctgcaatcagtgtgaaccacatagatacaacctcacgattgataattttcagcattgtcagatgtgtgaatgtgacagcctgggaacactcccgggaacaatttgcgaccctattagcgggcaatgtctctgtgtgcccaatcgtcaaggtcgacgctgtaaccagtgccagcccggtttctatatcagccccggaaatgctaccgggtgtctcccctgctcttgccacacaactggcgctgtgaatcacatttgtaattctctcacaggtcagtgtgtctgccaagatgccagcattgctggccagcgttgtgaccaatgtaaggaccactacttcggatttgatccacaaactgggagatgccagccctgtaactgccacctcagtggggcattaaacgaaacatgtcacctcgtgacaggtcagtgcttctgtaaacagtttgtgaccggatctaagtgcgacgcatgtgtgccaagcgcttctcatctcgatgtgaacaatcttctgggttgttccaagacgccctttcagcagccaccacctcggggacaggtccagtcaagtagtgcaatcaatctgtcatggagccctccagacagccctaacgcccactggttaacctatagtttgctccgtgacgggttcgaaatatatacaacagaggatcagtacccctatagcatccagtactttcttgacacagacctgttgccttacacaaaatactcctattatatcgagaccacaaatgtacacggctccaccaggtcagtggctgtcacctataagacgaagcccggagtcccggaaggcaacttaaccctttcttatatcattcccatcggctccgatagcgtgaccctgacttggacgaccctcagtaaccagtccggccctatcgagaaatatatcctttcatgcgctcctctagccggaggacaaccctgcgtgtcctacgaggggcacgagactagcgccaccatctggaacctggtgcccttcgcaaagtacgacttctctgttcaggcctgcaccagcggaggatgcctgcactccctgccaatcactgtgaccaccgcacaggctcccccacagcggttgtcacccccaaagatgcaaaagatctcttctaccgaacttcacgtcgagtggtcgcctccggctgaattgaatgggatcattataaggtatgaactttatatgcgacgtctgcgtagcacaaaagagaccacatctgaagaatcacgtgtgttccaaagctccgggtggctgagccctcatagcttcgtggagtcagcaaacgagaatgcccttaagcctcctcaaaccatgaccacaattacggggctcgagccctatacaaagtacgaattccgcgtgctggctgtgaacatggccggtagcgtctcctcagcctgggtctctgaacggacaggcgaaagcgctccagtgttcatgattccaccctctgtctttcccctttcttcttattcattgaatatttcgtgggagaagcccgcagataatgtgacgagaggcaaagtggtcgggtatgacattaatatgctatccgagcagagtcctcagcagtccattcccatggcattctcccaactgttacacacagccaaatctcaggaattgtcatatacagtcgaggggctcaagccttacaggatatatgagtttaccatcacactctgcaatagtgttggctgtgtgacttctgccagtggagccggacagacgctggccgctgcaccggctcaattaaggcctccccttgtgaaaggcatcaactccaccaccatccacctgcggtggttccctcctgaagagctgaatggcccatcccccatctaccagttggagcggcgagagtcaagtctgcccgcactgatgactaccatgatgaaagggatacgattcatagggaacggctactgtaagtttcccagttctacccatccagtgaacaccgatttcaccggtaagtgcgtatag

SEQ ID NO: 246415 - DNA, 15681 bp, Artificial Sequence
  Description of Artificial Sequence: Synthetic coding sequence
atgaactgccctgtgctcagcctggggagcggctttctattccaggtaattgagatgctgattttcgcctatttcgccagcattagcctgacagaatcaagaggcttatttcccaggttggagaacgtcggtgctttcaaaaaggtgtctattgtacctacccaggcggtttgcgggttgcctgaccggagcacattctgccactcatccgctgccgcagaaagtattcagttttgcacccagcggttttgtattcaggattgcccctaccgatcaagccaccccacatatacggccttattttcagcaggtctatcctcatgtatcacccccgataagaacgatctccatcctaacgctcacagtaactccgcctcctttattttcggaaaccataagtcttgtttctcatcacctcccagtcctaaattaatggctagttttactctggcagtgtggctgaagcccgaacaacagggcgttatgtgcgtcattgagaagaccgtggacggccagatagtgtttaagcttaccatttccgagaaagagactatgttttattatagaactgtgaacggcctccagcccccaattaaggtgatgacactgggtaggattctggttaaaaaatggattcatctgtccgtgcaagtacatcagaccaaaatatcctttttcataaatggtgtggaaaaggatcataccccatttaatgccagaacactatcaggtagtatcacggatttcgcgagcggaaccgttcaaatcggccagtcattaaacgggcttgaacagttcgttggtcgcatgcaggattttaggttgtatcaagtcgcgctgaccaatcgagagatccttgaagtgttctcaggtgaccttctaagactccacgcacagagtcactgtagatgtcctgggtcacatcctagggtgcatccactcgcacagcggtattgtattcccaatgatgccggtgatacagccgataacagggtctcacggctcaaccctgaagctcatccactgtcattcgtcaatgataacgacgtgggaaccagttgggtaagtaacgtcttcacgaacatcacccagttaaatcagggagtcactatcagcgtagacttagaaaacgggcagtatcaggttttttacattatcatacagtttttctccccacagcctactgagatacgaattcagcggaaaaaggagaacagtctggactgggaggattggcaatacttcgcacgtaactgtggtgcctttggtatgaaaaataacggcgatctcgagaaacctgattcagtgaactgtcttcaattatccaattttactccatattcccggggaaacgtgactttctctatcctgacccctggccctaactaccggcctgggtacaataatttttataatacccccagcttgcaggaatttgtgaaagctacccagattagatttcacttccacggccagtactatacaaccgaaacggcagtgaacctgcgtcacagatattatgcagttgatgaaattaccatttctggcagatgccagtgtcacggacacgccgacaattgtgatactacgtctcagccatatcgatgcctctgctctcaggaaagcttcactgagggactccactgtgatcgttgcttgcccctctacaatgacaaaccttttagacaaggcgatcaagtctacgcgtttaactgcaagccttgtcagtgtaactcccactcaaaatcatgtcactacaacatatctgtggatccattccccttcgagcattttagagggggagggggtgtctgtgatgactgcgaacacaacaccacaggacgaaattgcgagctctgtaaggactatttttttcgccaagttggcgcagacccaagcgcaatcgatgtgtgtaagccctgcgattgtgatactgtaggaaccagaaatggtagcatcctttgtgatcaaatcggcggacagtgcaattgcaaacgccatgtgagtggtagacaatgtaaccaatgccagaatggtttctataatctgcaggaactggaccctgacggctgttcaccatgtaactgtaacacctccggaaccgttgacggagacattacatgtcatcagaattcaggacagtgtaagtgcaaagctaatgttataggtctccgctgtgaccattgcaactttggatttaagtttctaagaagttttaatgacgtagggtgcgaaccgtgtcaatgtaatcttcacggctccgtgaataaattctgcaacccccactccggacagtgcgagtgtaaaaaggaggcgaagggccttcagtgcgacacgtgccgggaaaatttctacgggttggatgtgacaaattgcaaggcctgtgactgcgacactgccggatccctgccgggaacagtttgcaatgcaaaaacgggccagtgcatttgcaaacctaatgtcgagggacgacagtgcaacaaatgtttggaaggcaacttctacctgcggcagaataacagctttctttgtctgccttgtaactgcgataaaacaggcaccattaatgggagccttctttgtaataaatccactggccagtgcccatgtaaactcggagtgactggcctgaggtgcaaccaatgtgagcctcaccgatataacctgaccatcgataatttccaacactgccagatgtgtgagtgcgattctcttggaacactgcctggcaccatctgtgatccaatatccgggcagtgtctctgtgtgcctaacagacaggggagacgatgtaaccagtgccaaccgggtttttatatatcccctggcaacgccaccggctgtctcccctgctcctgccataccaccggggctgtgaatcatatctgcaattccttaactggacagtgtgtatgccaggacgcctcaatcgccggacagcgctgcgatcagtgcaaagatcactatttcgggtttgatcctcagactggacggtgtcagccatgtaattgccacctgtccggtgccttaaacgagacatgtcatctggtcacagggcagtgcttctgtaagcaattcgttactgggtccaagtgcgatgcttgtgttccatccgcatcacatttagacgtgaacaatctgctgggttgcagcaaaaccccattccagcagcctcctcctcgtggtcaggtccaatcatcctctgccattaacctgtcttggagtccacctgattcccccaatgcccattggctaacatacagcctgctgcgcgatgggttcgagatttatactaccgaggatcagtatccatattctattcaatacttcttggacacagacttgttgccttatacaaagtacagttattacatcgagacaaccaatgtacacggttctacacgaagtgtcgctgtgacatataaaactaagcctggtgttcctgaaggcaacctcactctgtcatacattataccgattggtagcgattctgtcaccctgacttggacaaccctgtccaatcaatccggacctattgaaaaatacattcttagctgtgctccgctggctggtggccagccttgtgtgtcatacgaaggacacgagactagtgcaacaatttggaacctcgttcctttcgccaaatatgactttagcgtgcaggcttgcaccagtgggggatgcctgcattctctccccataactgtcaccactgctcaggctccccctcagagactgagcccaccaaaaatgcaaaaaatctcttccactgaactccatgttgagtggtcacctcctgctgagttaaatggcattatcatccggtacgaactttacatgagaagactaagatccaccaaagagacgaccagcgaagaaagccgagttttccagagcagcggatggctgtccccgcactcctttgtcgaatcagctaacgaaaatgctttaaagcctccccaaaccatgacaactatcactggactggaaccttacacaaagtacgagtttcgcgtcctggccgtgaacatggcgggatcggtctcttctgcctgggtctcagaacgtaccggggaatctgctcctgtgtttatgatccctcctagcgtgttccctctgagcagctatagcctgaacatcagctgggagaaaccagccgataacgtgacgagagggaaggttgtgggttacgacataaatatgctgagtgaacaaagtcctcagcaaagtataccaatggctttttctcagctgcttcatacagcgaagtcacaggaactaagctacaccgttgaggggctaaaaccgtatcggatctacgagtttacaattactctgtgcaattctgtcggttgcgtgacatcggctagtggcgcaggacaaaccctcgccgcagcccctgcccagcttagacctccactggtaaaggggatcaattccacaaccatccatctccgatggttcccgcctgaggaactgaacgggccaagccctatttatcagctcgagcgtcgtgagtcttcccttccggctcttatgaccacaatgatgaaagggatcaggttcatcggaaacggatactgcaagtttccatcatccacacaccctgtaaatacagattttacaggaattaaggctagtttccggacgaaggtgcctgaggggctgattgttttcgccgcttcgcccggaaaccaggaagagtacttcgcgttgcaactgaaaaaggggagactgtacttcctgttcgatccacaaggctcgcccgtggaagtgacaactacgaatgaccatggcaagcagtactccgatggaaaatggcacgaaatcatcgctataagacatcaggcctttggacagatcactctggatggaatatatacgggctccagtgccattctcaacggatcaacagtaattggggataatacaggtgtgtttctgggtggactccccaggagctatacaattctacggaaggaccccgaaattattcagaaagggtttgttggttgcttaaaggatgtacactttatgaaaaactataatccatcagctatttgggaaccactagactggcagtctagtgaggaacaaataaacgtgtacaacagctgggaggggtgtcctgccagtttgaacgaaggggctcaattcctaggggcaggctttctggagttacatccctatatgttccacggaggcatgaattttgaaatctcttttaaatttaggacggatcagctgaatggtctgcttctcttcgtgtacaacaaggacgggccagacttcctggctatggagttgaagagtggcattctgactttcaggctgaacaccagtctcgcatttactcaggtggatctgctgctgggactgtcctattgcaatggtaaatggaataaggtgataattaagaaggagggctctttcatttcagcatcagtgaatggcttgatgaaacacgcatccgagagtggcgatcagccactggtcgtaaatagcccagtgtatgtgggaggaatcccccaggaacttctcaactcataccagcatctgtgcctggagcagggtttcgggggttgcatgaaagacgtgaagtttacaaggggagccgtggtaaatctggcgagcgtatcttctggggctgtccgggtcaatttggatggctgcttatcaaccgactcggcagtaaactgtcgaggcaacgacagcattctcgtctaccaggggaaagaacagtctgtgtacgaaggagggctgcagccttttaccgagtacttgtacagggttattgcgtcacatgaaggcggaagcgtgtatagtgactggtcacgaggtcgcaccacaggcgctgctccacaatccgtgcccactccctcaagggttcgctccctcaacgggtattccatcgaagtgacttgggatgaaccagtcgtgagaggcgtgattgaaaaatacattctgaaggcctattccgaggactcaacccggcctcctcgaatgccctcagcaagcgctgagttcgtgaatacatccaatctgaccgggatcctgactgggctactgccctttaagaattacgccgttacactgactgcatgtaccttagcgggttgcacagagagctctcacgctctgaacatcagtactccccaagaggcccctcaagaggttcaaccacccgtcgctaaatcattgcctagcagtcttcttctgagctggaaccctcccaagaaagcaaacggcatcataacacaatactgtttatatatggacgggagactgatttactcaggtagtgaagagaactacatcgtcaccgacctcgccgtgttcactccacaccagtttctgctatctgcttgcacccatgttgggtgcactaactcttcctgggtactgctttataccgcacagttacctcctgaacacgtggattcgccggtgttgactgtactcgactcgagaacgatccacattcaatggaaacagccccgtaagatcagtggcattctggagcgctatgtactttacatgtctaaccacactcacgacttcacaatctggtcagtgatatataactctaccgagctgttccaagatcatatgcttcaatacgtcctccccggtaataaatacttgatcaaactgggcgcttgtacgggaggcggttgcacagttagtgaggcgagtgaggcactgactgacgaggatattccagaaggagtacccgcacctaaagcgcattcctattcgccggattcttttaacgtatcctggacggagcctgaatatcccaatggagtaattaccagttacggcttgtacctcgatggcatcctgatacacaattcatcagagctgagctaccgggcttatggttttgcaccttggtcattgcatagctttcgagtacaagcctgtaccgccaagggttgcgctttgggccctctcgttgagaatcgtacacttgaggccccaccagagggtacggttaatgtcttcgtgaagactcagggaagccgcaaggctcacgtgagatgggaggccccattccgtccaaacggactcctgacccactcagttctctttaccggtattttctatgtagaccccgtcggtaacaattacacgctgctgaatgtgactaaagtcatgtattctggggaggagaccaatctgtgggtactgatagacgggctggttccctttacaaactacacagtgcaggttaacatctccaacagccagggcagtctgattacagatcccatcaccatcgctatgccccctggcgctccagatggagttctgccccctcgtctttcttcagccacacccacttctttacaggtcgtgtggtctactccagcacggaacaacgcgccaggctctccaagatatcagctgcagatgcgcagtggggatagcacgcacggattcctcgaactatttagcaacccctctgcatcactgagttacgaagtttcagacctgcaaccttataccgagtacatgttccgcttggttgcttccaatggatttgggtctgcacactccagttggatcccatttatgactgccgaggataagcccggacctgtcgtcccccctatcctgctggatgtgaaaagccgaatgatgctcgtcacctggcagcacccacggaagagtaacggagttataacacactataacatatatctccacggacgactttatctccggacccccggaaatgttaccaattgtaccgtcatgcacctgcacccgtatactgcgtataagtttcaggttgaagcgtgtacttcaaaaggctgtagcttgagcccggagagccagactgtttggacattaccaggggcacccgagggcatcccttcaccggagctgttcagcgataccccgacttccgtgattatctcatggcagccccctacacatcctaacggactggtggagaatttcacaatcgaacgcagggtaaagggtaaggaggaggtgactacgcttgttactctcccgagaagtcactccatgagatttatcgataagacctcagccctgtctccgtggaccaagtatgagtatagggtcctgatgagcacccttcacggcggaactaactcctctgcttgggtggaagtaacgacccgccctagcaggcctgcgggagtgcaacctcctgtcgtcacagtgttagaaccagatgctgtgcaggttacttggaagccccctctgatccagaacggagacattttaagttatgagatccatatgcctgatccccatatcactcttacaaacgtcacatctgccgtcctctctcaaaaggtgacccacctcattccctttaccaattatagcgtaactatcgtggcttgttccggtggaaatgggtacctggggggatgcacagaaagcctgcccacatacgtcacaacccatcccaccgtgccacagaatgttggtcccctgtctgttatccccctttccgaatcctacgtggttatctcctggcaacccccatcaaagcctaacggcccaaacctccgctatgagctgctgaggcgcaagattcaacagcccctcgcttctaatccacccgaagatctgaaccggtggcacaacatttattcgggcacacaatggttgtatgaggacaagggtttatcgcgattcacaacctatgagtatatgttattcgtccataactcagtggggttcacaccaagccgggaggtgactgtgaccacactggccggactccccgaacgcggagcgaacctgacagcatctgtgcttaaccacaccgcaatcgatgtcaggtgggccaagcccacagtccaggacctgcagggcgaagtcgaatactatactctcttttggtcatctgccacctctaatgactcactcaagattctgccagacgtgaacagtcacgtcatcgggcatctgaagcccaatactgaatactggattttcatttccgtcttcaatggtgttcatagcatcaactctgccggactgcatgcaaccacctgtgatggggaaccccagggcatgctcccccctgaggtcgtgattatcaatagcaccgccgtccgggtgatctggacttcacccagtaatccgaacggagttgtcacggagtactctatatatgtaaataataagttgtacaaaacagggatgaacgtaccaggctcgttcatcctcagggatttatccccttttacaatctatgatatccaggtggaggtttgcaccatatacgcatgtgtgaaatcgaatggcactcagatcaccaccgtggaagacacccccagtgacattccaacaccgaccataagaggcatcacgtcaaggtcccttcagatagactgggtttctccccgaaagccaaatggaatcattcttgggtatgacctactctggaaaacatggtacccctgcgccaagacccagaagctggtgcaggaccagtctgatgaactctgtaaggccgttaggtgccagaaaccggagagcatctgcggccacatatgttatagctccgaggcaaaagtctgctgcaacggcgtgctttacaatcctaaacccggacataggtgttgcgaggaaaagtacatcccattcgtgttgaactcaactggagtttgttgcggcggtaggattcaggaggcacagccaaaccatcaatgttgttcaggttactatgccagaattttgcctggagaagtctgttgcccggatgagcagcataacagagtttcagttggtatcggggactcctgttgtgggagaatgccttattctacctctggtaaccagatttgttgcgctgggaggctacacgatggccatggccaaaagtgctgtggacgacagatagtgtccaatgacctggagtgttgtggcggagaagaaggtgttgtgtataacagactaccaggcatgttctgctgcggccaggattacgttaatatgagcgatacgatttgttgcagcgcttcctctggggagagcaaggcccatatcaagaagaacgaccctgtgccggtgaagtgttgcgaaaccgaactcataccaaagagccagaagtgttgcaacggagtgggctacaaccctctgaaatatgtctgcagcgataaaatcagcacagggatgatgatgaaagaaacgaaagagtgtcggatcctatgccctgcctctatggaggctaccgaacattgtgggcgatgcgactttaactttaccagtcatatctgtaccgtgattcggggtagccataattcaacgggcaaagcctctatcgaagagatgtgttcatccgcagaggagacaatccacaccggatcagtaaatacctattcctatacagatgtgaacctgaagccatatatgacttatgaataccgaatatccgcctggaatagttatgggaggggccttagcaaagctgtccgtgctagaacaaaggaggacgtgccgcagggtgtcagccctcccacctggacaaagatcgataacctggaagacaccattgtgctgaattggcgcaagccaattcagtctaatggaccaataatctattatatccttcttaggaacggcatagaaagattccgcggtacttctctcagcttcagtgacaaggagggcatccaaccttttcaagagtactcgtatcagctgaaggcttgtaccgtggcaggatgtgctactagttccaaagttgtagctgcaaccacccagggggtacccgaatccatcctccccccttcaattactgctttgagtgctgtggccctacacctctcctggtcagtcccggagaagtccaacggggtgatcaaagagtaccagatcaggcaggttgggaaaggcctgatccataccgataccactgaccgaagacagcatacagtgactggccttcagccctacaccaattacagcttcactcttaccgcctgcacgtccgcgggttgtacatcctccgaaccattccttggtcagacattgcaggctgcccctgagggcgtgtgggtgactcctcgccatatcataatcaacagcacaacggtggagctatactggagtttgccagagaagcccaacggtctggtgtctcagtaccagctatcaagaaatggcaatctgttattcttagggggaagtgaggagcaaaattttaccgataagaacctggagccgaacagccggtacacttataagctcgaggttaagaccgggggaggttcctccgcgtcggatgattacatagtgcagaccccaatgtctacgcctgaggagatttaccccccatataacatcactgtgataggcccttatagcatctttgttgcgtggatcccgccaggcatactcataccagagattcccgtagaatataacgtcctgctgaacgatggttccgtgacaccgctggcttttagtgtaggacaccaccagtccacactcctggagaacctcaccccgtttacacagtacgaaattcggatccaggcttgtcagaacgggtcgtgcggggtctcaagtcggatgtttgttaaaaccccagaggccgctcccatggatttaaattcccctgtcctgaaagcgctcggcagcgcctgtatcgagatcaagtggatgcctccagagaaacctaatggcataatcatcaactacttcatctaccgaagacctgcaggtatcgaggaagagtctgtgctcttcgtatggagtgagggagccctcgagtttatggatgagggcgataccctccgaccctttactctgtacgagtatagagtcagggcatgcaattcgaaaggatccgtggaaagcctgtggtccttgacgcagactttggaagctcctccgcaggattttccagcgccttgggcgcaggctacatcagcccactccgtgttgctgaattggacgaagcccgaatccccaaatggaatcatcagtcattacagagtggtgtaccaagagaggcccgacgaccccacgtttaactctccaacagtccatgcttttacagtgaagggaactagtcatcaggcacatctgtacgggctagagccatttactacctaccgcataggagtggtggccgcaaaccatgctggagagatcctcagtccctggacattgatccagacgctggaatcttctcccagtggcctgcggaactttatcgtggagcagaaagagaacggcagggcccttctcctgcagtggtcagagccaatgcgcacaaacggagtgatcaaaacttataatatcttcagcgatggctttctggagtactcaggtctaaatcggcagttcttgtttcggcgactcgacccttttaccctatacactctgactcttgaagcttgcacccgggcagggtgtgcacatagcgcaccgcaacccttgtggactgacgaagccccacctgactcacaattggccccaacagtgcactccgtcaaatctactagtgtggagctctcatggtcggagcctgtgaaccctaacggcaagattattcggtacgaggtgatcaggcgctgtttcgaaggcaaggcatggggaaatcaaacgatacaggcagacgaaaaaatcgtcttcacagagtataacacagagcgtaacacattcatgtataatgatacgggattgcaaccatggacacaatgcgaatataagatatatacctggaactccgcaggccacacgtgttcctcatggaacgtcgtcaggactctgcaggccccacccgaagggctgtcaccccctgtgattagttacgtgagcatgaatccccaaaaactgttaatttcttggatccctcccgaacaatcaaacggcattatccaatcctacagactgcagcgcaacgaaatgctgtaccccttctccttcgaccccgtgacctttaactacacagacgaggagctgctgccattttcaacatacagctatgccctgcaggcgtgtacatctggcggttgctctacatcaaagcccacaagcatcacgacactggaggccgcacctagcgaggtatctccacccgatctgtgggcagtcagcgcaacacagatgaatgtctgctggagtccaccaacagtacaaaatggcaaaattaccaaatacctcgtgagatatgataacaaagagagcctggctggccagggcctctgcctcttagtgtcacatcttcaaccgtattcccagtataacttttcactcgtggcttgtaccaatggtggctgtaccgcttccgtctctaagtctgcctggaccatggaggctctccctgaaaatatggactcgcccactcttcaggtcaccggcagcgagagtatcgagatcacatggaagccccctcgtaatcccaacggacagattagatcttacgagcttagaagggacggtactattgtatacaccgggctcgagacccggtacagagactttactcttacacctggggtggagtactcttacacagtgacagcatcaaattctcagggcggaatactcagccccttggttaaagatcgtacaagccctagcgccccaagtggaatggagccccctaaactgcaagccagagggcctcaggagatcctcgtgaattgggaccctccggttagaactaatggggacattattaactacaccctctttatcagagagctgttcgagcgggaaactaaaataatccatattaataccacccacaactcgttcggcatgcagtcctacatcgtgaatcaactgaaacctttccacaggtatgaaattagaattcaggcctgcactaccttagggtgtgcttccagcgattggaccttcatccaaacccccgagatcgccccactgatgcagcccccaccccatttagaggtgcaaatggcgccaggcggattccaacctacagtcagtctgctgtggactggacccctacaacctaatgggaaggtgctgtattatgagctgtataggcggcaaatagcgacgcaaccaaggaagagcaatccagtactgatttataatgggagttcaacatccttcatagattctgagctcctgccgttcacggaatacgagtatcaagtgtgggctgtaaactctgcagggaaagctccaagtagctggacatggtgcaggactggtccggctccaccggagggcctccgtgcaccaacttttcatgtgatctccagcacgcaagctgtggtgaacatttccgcccctggtaaaccaaatggaatcgtgagtttatatcggctcttttcttcctctgcacacggagcagagacagtcttaagtgaaggtatggctactcagcagacactccacgggttgcaggcctttacaaattactctattggcgtcgaggcgtgcacttgtttcaactgttgctcaaagggccctaccgccgagctgcggacccaccccgcacctccttccggactgtcatcaccgcaaatcggcacacttgcctcccgcaccgcctcatttaggtggagccccccaatgttccctaatggtgtgattcacagttatgaactgcagttccatgtggcctgccccccagactccgccttgccatgtacgcctagccagatagagacaaagtatacaggcctggggcaaaaggcctctttgggtggtttgcagccatacacaacctacaaactgagggtcgttgcccacaatgaggtagggtcaaccgcgtcagagtggatttcttttactacacagaaagagctcccgcaatatagagctccttttagcgtagacagcaatttgtcagtggtctgtgttaattggtctgatactttccttctaaacggccagttgaaggagtacgtgttgaccgatggcggacggagggtttactccgggttggatacaactttgtatattcctagaacagccgacaagaccttcttcttccaggtgatctgcaccacagacgaaggatctgttaagacccctctgatccagtacgacacaagcactgggctcggcctggtgctcaccactcccggaaaaaaaaaggggtcccggtccaagagtaccgaattctattcagaactgtggttcatcgtcctcatggctatgttgggactaatcctgctcgcaatttttctgagtctcattctgcagagaaagatccacaaggaaccctacatacgggaacgacccccactggtaccactccagaaacggatgtcaccgctcaatgtgtatcccccaggcgagaatcacatgttcgattccgtagcagacatctctgacgtgagtagcaacgttaccctgaaatcctacacgatgcattttgaagggttagcagacactaagatacccagatctggcacacccgtttctatccgtagcaatcggtccgcgtgtgtactgcgcattccctctcaaaaccaaacttcgttgacttactcacaggggtccctgcatcggagcgtgtctcaacttatggatatccaggacaaaaaagtcctgatggacaattctctgtgggaagccatcatggggcacaactcaggtctgtatgtggatgaggaggatctaatgaacgccattaaggatttttcgtcagtgaccaaggaacggactacgttcaccgatactcacctgtaa

SEQ ID NO: 246416 - DNA, 2538 bp, Artificial Sequence
  Description of Artificial Sequence: Synthetic coding sequence
atgcggaccgaggccgtggtaaacagtcagggccaaacggattacttaacgaaggattctgatcaggacgtggccctcaaactggcacaggaacgcgctgagatcgttgcgaaatatgaccgtgggcgagaaggggcagagatcgagccatgggaagacgccgattacttggtgtacaaggtgacagacagatttggctttctccacgaggaagagctgcctgaccataatgtggcagtcgaaaggcagaagcacctggaaattgagaggactacaaagtggctgaaaatgctcaaaggttgggagaagtataagaacaccgagaaattccatcggaggatctataaggggatacctctgcagctgaggggagaagtatgggctctactgcttgaaatcccgaaaatgaaagaggagaccagagatctgtattctaaattaaagcaccgggctcgcggttgtagccctgacattaggcagattgatctagacgtcaaccggaccttcagggaccatatcatgttcagggaccggtacggcgtgaaacagcagtctctttttcacgtgctagccgcatactcaatttataatacagaggtgggctattgccaaggcatgtctcagatcacagctctcctcctcatgtacatgaacgaggaagatgcattctgggctctggtcaagctctttagtggcccaaaacatgcaatgcacggctttttcgtgcaaggatttcctaaattgctacgatttcaggagcatcacgagaaaatactcaataagtttctatccaagttgaagcagcaccttgactcccaagagatttacaccagcttctatacaatgaagtggtttttccagtgcttcctggatagaacccccttcaccttgaatctaaggatctgggatatttatatcttcgaaggcgaaagggtgttgactgccatgtcctacactatattaaagctccacaagaaacaccttatgaagttatctatggaggagctggtggagttcttccaagagactcttgccaaagacttctttttcgaggacgacttcgtcattgagcagctgcagatctcgatgaccgagctcaagcgcgcaaagctggacttacccgaaccaggaaaggaggatgagtacccgaagaagcccctgggccagttgccacctgagctccagagttggggcgtgcatcatttatctaacggccagcggtctgtggggcgtccatcccccttggcctcggggaggagagaatcaggcgctccacacagacgccacgagcacagtcctcaccctcagagccggactggtaccccagagcgagcccagcccccaaggcggaagtctgtggaagaagagagcaagaagctcaaggatgaggccgattttcagcggaagctcccctccggcccacaggatagctcccggcagtataatcatgcagctgccaaccagaattctaacgcaacgagtaacatccggaaggagttcgtgcccaagtggaataagccgagtgacgtgagcgcaactgagcggaccgctaagtacacaatggagggtaagggcagggccgcacatcccgctctggctgtaactgtccccggtcccgctgaagtacgcgtgtccaacgtgcgacccaagatgaaagcactggatgctgaggacggtaagaggggaagtacggcatcacagtacgataacgtgccaggtccagaactcgactcaggcgcatccgtcgaggaggcactggagcgggcatacagccaatccccacgacacgccctgtatcctcccagtcccaggaagcatgctgagcccagttctagcccctctaaggtcagcaataaattcacgtttaaagtacagccgccaagccacgctcgctacccctcccagttggatggtgaagccaggggtcttgcccaccccccttcctattctaacccgccagtatatcacggaaattctcccaagcacttccctactgcaaactcttccttcgcatccccacagttctcccctggcacccagttgaacccatcacgacgaccacatggatccacattatccgtctcagcctccccagaaaaatcttactctcgaccaagcccacttgtgctcccgagttccagaatcgaggtgttacccgtggatacaggtgccggaggttatagtggtaatagcgggtcgccaaagaacgggaagttaattattccgccagttgattacctgcctgacaatcggacatggtctgaggtttcttacacttaccgcccagagacacaaggacagtcgtggacacgcgacgcgagccgcggaaacctgcctaagtatagcgcatttcaattagcaccattccaagaccacggtctgcccgcagtgtccgtggatagtcccgttaggtacaaagcttctcccgctgccgaggatgcctctccctcaggttacccttactcgggtcctccccctccagcgtaccattatcgcaatcgcgacggactgagcattcaggaaagcgtcctgctgtag

SEQ ID NO: 246417 - DNA, 2487 bp, Artificial Sequence
  Description of Artificial Sequence: Synthetic coding sequence
atgaattcggatcaagatgtcgcactcaaattggcccaggaaagggctgagatcgtagctaagtacgatcgcggtcgcgagggggctgagatagaaccttgggaagacgccgattatttagtgtacaaagtgactgaccggtttggcttcctgcacgaggaggagctgcctgaccacaatgtcgccgtggaacgtcaaaagcatctcgagatcgaaagaactaccaagtggctgaagatgcttaaggggtgggagaagtacaagaatactgagaagtttcacagacgcatctacaagggcattcccctgcagttaaggggggaagtctgggctctgcttctggaaatacccaaaatgaaagaagaaacgcgggacctctacagcaaactaaaacaccgtgcccgtgggtgttcacctgacattcgccagatcgatctggacgtcaaccggacgttccgggatcacatcatgtttcgcgaccgatacggcgtaaagcagcagtccctgttccacgttctggccgcatacagcatttataacacggaagttgggtactgtcagggcatgagccagataaccgctcttctacttatgtacatgaacgaggaggatgccttctgggccctcgtaaagttgtttagtgggcctaaacacgctatgcatgggttctttgtgcaggggttccccaagcttctgaggtttcaagagcatcacgaaaaaatcttgaataaattcctgtcgaaactgaagcagcatctcgattctcaggagatctacacctctttctacacaatgaaatggttttttcagtgtttcctggacagaactccattcacattgaatctgcgaatctgggatatatatatcttcgaaggggaaagagtgctcaccgccatgtcctataccattctgaaattacacaaaaaacatctcatgaagctgtctatggaggagcttgtggagttcttccaagaaacccttgccaaggatttcttcttcgaggatgacttcgtgatcgagcaactccaaattagtatgactgaactcaaacgggcaaaacttgacttacctgagcctgggaaggaagacgagtacccaaagaaaccgctgggccagctgcccccagaattgcagtcctggggagtgcaccacctgtccaacgggcagagatcagtgggcaggccctcgcccctggcctctggacgcagagagtcaggggctccacataggaggcacgaacacagcccgcatccacagtcccgcactggcacccctgagagggcacagcctcctaggcggaaatcagtggaggaggaaagcaagaaactcaaggatgaggcagatttccagcgcaaactgccatctggcccacaggactcgagcaggcagtataatcacgctgcagctaatcagaacagcaacgcgacctcaaacatacgcaaggagttcgtcccaaaatggaacaaaccatccgatgtcagtgcgaccgagaggacggcaaagtacaccatggagggcaaaggaagggcggcacacccagcactcgccgtgactgtgcccggacccgctgaggtgagggtaagcaacgtgcgcccaaaaatgaaggctctggatgccgaagacggtaaaagaggtagtactgcttcgcagtatgacaatgtccccggaccagagcttgattccggggctagcgtcgaagaagccctggaaagggcctactcccagtcccctagacacgcactgtatccaccgagcccaaggaaacacgcggagcctagcagctccccgtcaaaagtatctaataaatttacattcaaggtccagcctccgtcccacgctagatacccttcacagctggacggagaggctcggggtctggcccatcccccatcttatagcaatccacccgtttatcacgggaactctccaaaacactttcccacagctaatagcagttttgccagcccccaattctcccccggtacacagctgaatcctagccgcagacctcacggctcgactttgtctgtatccgcctcaccagagaaatcctatagcaggccgtctcctctggtactgccttcttctcgaatagaagtcctgccagttgacaccggtgccggaggctattcaggcaattccggctcccccaaaaacggcaagctgattatcccgccagtggactacttaccagacaatcgcacttggtcagaggtctcgtacacttatcgtccggagacacaggggcagtcatggacacgcgacgcatccagaggcaaccttcctaaatactcagccttccagcttgctccatttcaggatcatggtctccccgctgtgtccgtggattctccagtccgttataaagcatctccggctgcggaggacgcttcgcctagtggctatccatactcaggaccccctccacctgcttaccactatcgtaatcgagacggcctgtctattcaggagtcggtgctgctgtag

SEQ ID NO: 246418 - DNA, 2487 bp, Artificial Sequence
  Description of Artificial Sequence: Synthetic coding sequence
atgaatagtgatcaggacgttgccctgaagctggcgcaggaacgggctgagatcgtggccaagtacgacagggggagagagggagctgagatcgaaccatgggaggacgcagattacctggtgtacaaagtgactgaccgctttggctttctccacgaggaagagcttcccgaccacaacgtagctgtggagaggcagaagcatttagaaattgagagaaccacgaagtggctgaaaatgctgaaaggctgggaaaagtataaaaacaccgaaaaatttcatcggagaatatataaagggatccccctgcagcttaggggcgaggtgtgggcactgcttctcgagatccctaagatgaaggaagaaactagagacctatacagtaaactcaaacatagagccagaggctgctcaccagacatccggcaaattgacttggacgtcaatagaaccttccgggatcacataatgtttcgcgataggtatggggtgaaacaacaatccctgtttcacgtcctggcggcatattctatctataatactgaggttggctattgtcaagggatgtcacagattaccgctcttttgctgatgtacatgaacgaagaagatgctttctgggccctggtgaagctcttttccggccctaaacacgctatgcacgggttcttcgtgcaaggatttcctaaattactcaggttccaggaacaccatgaaaagattttaaataagttcttgtcaaaactgaagcaacatctggattctcaggagatttatacctctttttataccatgaagtggttcttccagtgcttcctcgaccgaactccttttaccctgaatttgcggatctgggacatttacatcttcgagggcgagagggtgctgacagctatgtcctacacaattttgaagctgcacaaaaaacatctgatgaagttgagcatggaagagttagtcgagtttttccaggagaccctggctaaggattttttcttcgaggatgactttgtgattgaacagttgcaaatcagcatgaccgagctcaagcgagctaaactggacctgcccgagcccggaaaagaggacgaatatccgaagaagcccctggggcagcttccccctgaacttcaatcctggggggtacatcatctctccaacggccagaggagtgttgggagacctagcccgctggcctccggcagacgtgaaagcggtgcaccacatagaagacatgagcactcgccacaccctcaatctcgcaccggcactccagaacgtgcacagcctcctaggcgaaaatccgttgaggaggagagcaaaaaactgaaggacgaggccgacttccagaggaagctgccaagcggccctcaggactcatcaaggcaatataaccacgccgctgcgaaccaaaatagtaatgccactagcaacattagaaaagagttcgtaccaaagtggaataagccatccgatgtctcagccactgaacgaactgccaaatacaccatggaaggcaagggtagagccgcacaccctgcactcgctgtgaccgtgcccggacctgccgaggttcgcgtatcaaacgtaaggccaaaaatgaaagcactcgacgctgaggacgggaaacggggatcgaccgcctcccagtatgataacgtacccggacctgaactggattccggggcttccgtagaagaggccttggagagggcctattcacagtccccaagacacgccctgtatcctccatctcccaggaaacatgcagagcctagctcctcgccctctaaagtatctaacaagtttaccttcaaggtgcagccgccatcgcacgcaaggtatccaagccagctggacggagaagctagggggttagcccatccacccagctactccaatcccccagtttaccacggcaacagccccaaacattttcctacagcaaactcctctttcgccagccctcagtttagtcccggaacacagttaaacccaagtcgccgtccacatgggagcacgctttctgtgagtgcatcccctgagaagtcttatagcaggccctcccccctggtgcttccaagctccagaatagaggtccttcccgtcgacaccggcgctggtggatactccgggaactctggctcacctaaaaatggaaaattgataattcctcccgtggactatcttcctgataatagaacttggtccgaagtttcttacacctaccgccctgagacgcaggggcaatcatggaccagggacgcatccagaggcaaccttcccaaatacagcgcctttcagctggccccatttcaggatcacggactacctgcggtgtccgtggattcgcccgtcaggtataaagcaagtccggctgccgaagatgcttctccaagtgggtatccctactccggaccaccccctccagcgtaccactatcggaaccgggacggcctgagcatccaggaatcggttctcctttag

SEQ ID NO: 246419 - DNA, 762 bp, Artificial Sequence
  Description of Artificial Sequence: Synthetic coding sequence
atggccgctgccttccgcaaagcagccaagagccgccagagagaacaccgcgaacggtcacagcctggatttcgaaaacacctgggccttctggaaaagaaaaaggattacaaacttcgggcagacgactacaggaaaaagcaggagtacctgaaggctctcaggaagaaagccctggagaagaatcctgatgagttctattacaaaatgacaagagtcaagttgcaggacggagtccacatcatcaaggaaacgaaagaagaggtaaccccagagcaactgaaattgatgcgtacacaggacgttaagtacatcgagatgaagagagtggcggaagcgaagaaaattgaacgtctaaaaagcgaactacacctcttggacttccagggcaagcagcaaaacaaacacgtgtttttctttgacaccaagaaggaagtggagcagttcgacgtggccactcatctacagactgctccagaactcgtggatagagtattcaacagaccgcgaattgaaaccctgcaaaaggaaaaagtgaaaggggtgaccaaccagacaggtctgaaacggatcgctaaagagcgtcagaagcaatataattgcctgacccagcgaatcgagagggagaaaaaactctttgttattgcccaaaagattcagacacgcaaagatctaatggacaaaactcagaaggtgaaggtgaagaaagaaactgtgaacagccctgcaatatacaaattccagagccggagaaagaggtag

SEQ ID NO: 246420 - DNA, 447 bp, Artificial Sequence
  Description of Artificial Sequence: Synthetic coding sequence
atggcagccgcatttcggaaggcagccaagagtaggcagagggaacatcgggaacgatcccagcccggtttccggaaacatctcgggctcctcgagaagaaaaaggactacaagctgcgtgctgacgattacagaaaaaagcaagagtacctcaaggccctccgaaagaaagccctggagaagaatcctgacgaattctactataagatgactagagtaaagctgcaggatggggtacatattataaaggagacaaaggaagaagtgacccccgagcagctaaagctgatgaggacacaggacgtaaaatacatagaaatgaaaagagtcgcggaagccaagaaaattgaacgtttgaagtctgagctgcacctgctggacttccagggtaagcagcaaaacaaacatgtcttcttcttcgatactaagaaagaagctaactcatag

SEQ ID NO: 246421 - DNA, 2124 bp, Artificial Sequence
  Description of Artificial Sequence: Synthetic coding sequence
atgccagaagaggcaggctttccccctgctaaaaggtttcgcccaggatcgggacccccaagccgtgcgggatcattcccccctggccgacaggtggtcatgttactcactgctgggagcggcggtaggggcggtggcggaggcaggagacagcagccacctctcgcccagccatccgcctccccctatcctgaggccgttgagctccaacggcgaagcctgcccatttttcaagctcggggtcagctcctggcgcagttacgaaatctcgataacgctgtgttgatcggtgaaacaggttctgggaagaccacccagattccacagtacctgtacgaaggcggtatcagtagacagggcattatagcagtgacccagcctaggcgggtagctgcgatctcgctagcgacccgcgtgagtgatgagaagagaacagaattgggcaaacttgtaggatacaccgtgcgctttgacgacgtgaccagtgaagacacaaggatcaaattcctcaccgacggcatgctgttgcgcgaagccatctccgacagcctgctgcgaaagtattcctgtgttattctggatgaggctcatgaaagaacaatccacactgatgtcctgtttggagtggtcaaagcggcacagaaacgcaggaaggagcttggtaaactgcctcttaaggttatcgtcatgtccgcaacaatggatgtggacctcttctctcagtatttcaatggcgctcctgtcctgtatctagagggccgtcagcacccaatccaggttttctataccaagcagccccagaacgattatttacacgccgctctagtgagtgtttttcagattcaccaggaagccccaagctcacaggacattctggttttcttaaccggccaggaagagatagaggctatgtcaaagacctgccgtgacattgccaagcatctcccggacggatgtcccgctatgctcgtcctgccattgtacgcgagtctcccctatgcccagcagttacgtgttttccaaggcgcacccaagggctacagaaaagtgataatctccactaacattgccgagaccagcatcaccatcaccggtatcaagtacgtggtggacaccggaatggtgaaagctaagaagtacaatcccgattctggcctagaggtgctcgccgtacagcgagtctcaaaaacgcaggcgtggcagaggaccggccgagctggcagggaagactctggtatctgttacaggctgtataccgaggatgagttcgagaagttcgataaaatgaccgttccagagatccagcgctgcaacctggcctcagttatgcttcaactcctggcgatgaaggtgcctaacgtgctcaccttcgattttatgagcaagccatcacccgatcacattcaggcagccattgctcagctcgatttgttgggtgctctggagcacaaagatgatcagctgacactgacccccatgggtaggaaaatggccgcttttccactcgaaccaaagttcgccaagactatccttatgtcaccaaaattccattgtacggaggagatcctgaccatagtgtcactactctcagttgatagcgtgctgcataatcccccttcacggcgtgaagaggtgcagggtgtgcgcaaaaaattcatttcgtccgagggggatcacatgacgctgttaaacatttaccggactttcaagaatcttggagggaacaaagactggtgcaaagagaacttcgtgaacagcaaaaatatgaccctggtcgccgaggtgagagcgcaattgagagacatctgtctcaaaatgagcatgcctattgcatccagccggggagacgtcgagtctgtgagaaggtgtttggcacacagtttgttcatgtctacggccgagctgcaacccgatggaacttacgctacaacagatacacaccagcctgtggctatacacccgagctcagtgctgtttcattgcaagcccgcttgtgtggtttataccgagctgttgtacaccaacaagtgctacatgagagacctgtgcgtgattgacgctcagtggctgtatgaggccgcacctgagtactttcggcgaaagctacgcacggcacgcaactag

SEQ ID NO: 246422 - DNA, 1566 bp, Artificial Sequence
  Description of Artificial Sequence: Synthetic coding sequence
atgcgaccagactggaaagccggagccggtcctggcggtccccctcagaagcccgcacctagttctcaacggaaacctcccgcacgaccttccgcagcagccgcagccattgccgtggcagccgcagaagaagagcggcgattgcggcaacgtaaccgattgagactggaggaagacaagccagccgtggaaaggtgcttagaagagcttgtcttcggcgacgtcgagaacgacgaggacgccctgttacgtcgcttgcggggacctcgtgtgcaggaacacgaggactcgggagactcagaggtagagaacgaggccaaggggaacttcccccctcagaaaaaacctgtatgggtggatgaggaggacgaagacgaagagatggttgatatgatgaataacagatttcgcaaagatatgatgaaaaacgcgagtgagtcaaagctctccaaagataatctgaaaaaaagattgaaggaagaatttcaacatgcaatgggcggagttcccgcatgggcggagactaccaagagaaagacaagctccgatgatgagtctgaagaggatgaggatgacttgctccagagaaccggaaatttcatttctacctcgaccagtttgcccaggggcattttgaagatgaaaaattgtcagcatgcgaacgctgaaagacctactgttgcaaggatctcctctgtacagtttcaccctggggcacagatcgtgatggtggccggtttggacaacgcagtgtctctgttccaagtggatgggaagaccaacccaaaaatccaatccatctatcttgagcggttcccaatcttcaaggcctgttttagcgccaatggtgaagaggtgcttgcaacttccacacacagtaaagttttatatgtgtatgacatgctcgctgggaaactcattccagtccaccaggttcgcggactcaaggagaagatcgtgagatcattcgaagtatccccagacggaagcttcttactgattaacgggatcgccggatatctgcatcttttagccatgaagacaaaggagctaattggctctatgaagatcaacgggcgtgtagcggcttctacattttccagcgattctaaaaaggtgtatgcctccagtggggacggtgaggtctacgtgtgggacgtgaacagtcgcaaatgcttgaaccggttcgtggatgaaggaagcctgtatggactgagtattgccacgtctcgcaatgggcagtatgttgcgtgcggcagtaactgtggggtggtgaacatttataatcaggactcctgtctgcaggaaacaaatcctaaacccatcaaggccattatgaacctcgtgactggagtaacgtctctcaccttcaacccgaccaccgagatactggctatcgcgtcagagaagatgaaggaggccgtgcggttggtccacctgccatcctgcacagtcttcagcaacttcccagtgatcaagaacaagaacattagtcacgtccacacaatggacttcagccctaggtccggctattttgctctgggaaatgagaaggcgcgtccctag

SEQ ID NO: 246423 - DNA, 8358 bp, Artificial Sequence
  Description of Artificial Sequence: Synthetic coding sequence
atgaagacaaagcccgtgagtcacaagacggagaatacttatagatttctgacattcgcagaacgcctgggcaatgtgaatattgatattatccatagaatagaccgtaccgcatcttatgaggaagaggttgaaacctatttcttcgagggcctgctgaaatggcgcgagttaaatctgactgagcatttcggcaaattctacaaggaagtgatcgataaatgccagagttttaaccagcttgtctaccaccagaacgaaatcgtgcagagcctcaagacccacctgcaggtgaaaaattccttcgcctaccaacctctcctggacctggtggtgcagctcgctcgcgacctccaaatggatttctatccacacttcccggagttttttttgaccattacctctatactcgagacccaggatacagagcttctggaatgggcgttcaccagtctttcttacctctacaagtacctgtggcggctcatggtaaaggacatgagttccatctatagcatgtacagcaccttgttagcccacaaaaagctacatatacgcaacttcgccgctgagtcctttacattcttaatgcgaaaggtgtccgacaagaatgcactcttcaatctcatgttcttggacctcgataaacaccctgaaaaagtggagggagtcggccagctcctcttcgagatgtgtaaaggggtgaggaacatgttccacagctgcaccgggcaggccgtaaaacttatactacggaaactgggtccggttacagaaaccgagacacagctgccatggatgctaattggagagacactgaagaatatggtgaaaagcacagtgtcctatatttccaaggagcatttcgggacattcttcgagtgcctacaagagtcattgttggatctgcacaccaaagtgaccaaaactaactgctgcgaaagctccgaacagatcaagagactgttagagacctatctgatcctggtgaagcacggttctggcaccaagattcccacccccgcagacgtgtgtaaagtactgtctcagacgctccaggttgcgagcttgtccacttcatgctgggaaactttattggacgtaattagtgccctaatcctaggcgaaaatgtgtccctgccagagacactgataaaggagacgatagagaaaatcttcgagtctagatttgaaaagcgcctcatcttttcgttctcagaggtgatgtttgccatgaaacagttcgaacagttgttcctgcccagctttctgtcctacattgtcaactgtttcctgattgatgacgctgtggtgaaagacgaggccttggcaatcctcgccaagcttattctcaacaaagccgcaccgccaactgcaggctcaatggcaatcgaaaagtacccactggtgttttcaccccagatggtgggcttctatataaaacaaaagaaaacccgcagcaagggaagaaatgagcaatttccagtgctcgaccatcttctgagcatcatcaaattacccccaaacaaggataccacctacttgtcgcagtcatgggctgcgctggttgttcttccgcatattaggccattggaaaaggaaaaagtgattccgctagttaccggcttcatagaggcgttgttcatgacagttgataaaggctccttcgggaaaggaaatctgttcgttctttgccaggccgtgaatacattgttgtctttggaggaaagctctgaactcctacatttggtgccagtcgagcgtgttaagaatttagtattgacattccctctggagccaagcgtgctgctcctgactgatttgtactatcagcgtctcgctctgtgcggatgtaaggggcctttgtcccaggaagcactgatggaacttttccctaaactgcaagcgaacatttcaacgggagtaagcaagatccggctgctgactatccggatcttgaaccacttcgacgtgcagctgccagagtctatggaggacgacgggctgtctgagaggcagtccgtatttgccattcttaggcaagccgagcttgtgcccgcaaccgtgaatgactatagagagaaactgctccaccttcggaagttgaggcatgacgtggtgcagaccgcagtgcccgacgggcctcttcaggaagtgccgctaagatacctacttggaatgctgtacatcaacttctctgccctgtgggatcccgtgatcgaactaataagctctcacgcccatgaaatggagaataaacagttctggaaggtctactacgaacacctggagaaggcggctacacacgcagagaaagaactgcagaacgacatgacagacgagaagtccgttggggacgagtcctgggaacaaacacaagaaggtgatgtgggcgctctttatcacgagcagcttgcacttaagaccgattgtcaagagcgccttgatcacaccaacttccgttttctactgtggcgtgctctgacaaagttcccggagagagtggaaccacgaagtcgcgagctgtccccactgttcctgcggttcattaacaacgagtattatcctgctgaccttcaagtggcccctactcaagatctcagaagaaaggggaagggtatggtagccgaagagatagaagaagagcccgctgccggtgatgacgaggaactggaggaggaggctgtgccacaggacgaaagctcccagaaaaagaagacgcggagagccgcagccaaacagctgatcgcacacctgcaggtcttcagtaaattctccaatccaagggctctgtacctggagtcaaagctgtatgaactttacttgcagctgctcctgcaccaggaccagatggttcagaaaatcactctggattgcataatgacatataagcacccccacgtcctaccttaccgggagaacctgcagagattgctggaggacaggtcctttaaagaggagatcgtccactttagcataagcgaagataacgctgtcgtaaagacagctcaccgggcagatctcttccctatcctgatgagaatcctctatggccgaatgaaaaacaaaactgggtcaaagacccagggaaaatcagccagtggcactcgcatggcaatagtattgagatttttggccggaactcagccagaagagatccaaatttttcttgatcttcttttcgaaccagttcgacactttaagaatggagaatgccactctgcagtcattcaggctgtggaggacttagacctgtccaaggtgctgcccttaggaagacagcacgggatcctcaatagtcttgaaatcgttcttaagaatatcagccacttgatctcagcgtacctccccaagatcctacagattttattatgcatgactgctacagtaagtcacattctggaccaaagggaaaaaatccaactacgcttcattaaccccttgaaaaacttacgcaggctgggaataaagatggtgacagacatattccttgattgggaatcgtatcaatttaggaccgaggagatcgatgcagtcttccacggggctgtctggcctcaaatctcaagacttggaagcgagtcccaatactcgcctaccccgttgctgaagttgatctccatatggtcccgtaacgctaggtacttccccttgctggctaagcaaaaacctggacaccccgaatgtgacattctgaccaatgtgtttgctatcctgtccgcgaaaaacttgagtgacgctacagccagcatcgtgatggacatcgttgacgatttactgaatctccccgacttcgagcccacagaaactgtccttaacctcctggtaactggatgtgtctaccccggaatcgcggagaatataggcgaaagcattacaatcggaggtcgcctgattcttccacacgtgcccgcaattcttcagtatctgtccaaaaccacaatctctgccgaaaaggtcaaaaagaagaagaatagggcccaagtctccaaggaattaggcatcttatctaaaatctccaagtttatgaaggataaggaacagagcagtgttcttatcacgctgctgttacccttcctgcaccgcggtaacattgccgaggacaccgaagtggatatcctggtgaccgtccagaatttgttaaaacactgtgtagacccaacgtcattcctgaagccaattgcaaaactgtttagtgtgatcaaaaataaactttcaaggaagctcctctgtacagtgtttgagacattaagtgactttgaatccgggctgaagtatataacagacgtggttaagttgaacgcctttgatcagcggcacctggatgacattaattttgatgtgcgttttgaaacattccaaactatcacatcttatatcaaagagatgcagatagtggacgttaactacctgatccctgttatgcacaattgcttctataacctggagcttggagatatgagcctctcggacaatgcctccatgtgcctaatgagcataatcaaaaaactggcagctcttaacgtaaccgagaaagactatagagaaatcatccacaggagcttactggaaaaactccggaagggacttaagagccaaacagagagtattcagcaggactacactacaatcctgagctgtctaatacagacttttcctaatcagctggaattcaaggacctggtgcaattgactcactatcatgatcccgagatggatttttttgaaaacatgaagcacatccaaatacatagaagagctcgtgctctcaaaaagctcgcaaagcagcttatggagggaaaggtggtgctgagctcaaagtcactccagaactacatcatgccttatgcaatgactcccatttttgatgaaaagatgttaaaacacgagaatataactactgccgcaacggaaattataggagcgatctgcaagcatttatcttggagtgcctatatgtattatctgaagcattttatacatgttttgcaaactgggcaaatcaatcagaaactgggggtttcgctgcttgtgattgtacttgaggcctttcacttcgatcacaagactctcgaagaacaaatgggtaaaattgaaaatgaagaaaacgctatagaagcgattgagctcccagagccggaggcgatggaactagaaagggtggacgaagaggagaaggagtacacctgtaagtcattatctgataacggccagcctggcacacccgatccggcagactccggcggaaccagtgctaaggagagtgaatgtatcaccaagccggtgtcattcctgccccagaacaaggaagagattgagcgcaccatcaaaaatatccagggcacaattaccggggatatactgccacgtctgcataaatgtctggccagcactacgaaaagagaggaggaacataaattagtgaaaagcaaagttgtgaacgatgaagaagtcgtgcgcgtccccctcgcgttcgccatggtcaagctgatgcagtctctcccacaggaggttatggaggcgaatctaccatcaatcctcttgaaggtatgcgcgttacttaaaaaccgggctcaggagatccgcgacattgccaggagcacactggctaagatcattgaggatctaggggtccacttcttgttatatgtgctgaaggagttgcagacaactcttgttcgcggataccaagtccatgtgctgaccttcactgttcatatgttgttgcagggactcaccaacaagttgcaggtgggggacttggactcctgccttgacatcatgattgagatctttaaccacgaactctttggagctgtggccgaagagaaggaggtgaagcagatcctgtctaaggtgatggaagctaggcgcagtaaaagctacgacagctacgagatcctgggcaagtttgttggcaaggaccaagttaccaaacttatccttccgcttaaagaaatcttacaaaataccacgtcacttaagcttgctcggaaggtccatgaaacgctgcgaaggatcactgtggggctgatagtgaaccaggagatgactgctgagtcaattttactgttgagctacgggctcatatctgaaaatctaccactgctgacagagaaggagaagaacccggtggctcctgcccctgaccctcgactacctcctcagtcttgcctcctcctcccccctacacctgtcagaggcggacagaaagccgttgtgtcacgcaaaaccaatatgcacatatttatcgaatctggtctgaggctcttgcacctgtccctgaaaactagtaagatcaagagctccggcgagtgtgttctggagatgctggatccatttgtgtcattgctaatcgactgcttgggatctatggacgtgaaagtcataactggcgcactgcagtgtctaatctgggtattgcggttcccactcccaagcatcgaaacgaaagccgaacaactgaccaagcatcttttcttgctgttgaaagactacgccaagctcggtgctgcaagagggcagaactttcacctcgttgtgaattgcttcaagtgcgtaacgatcctggtgaaaaaggtcaagtcctaccagattaccgagaagcagctgcaggtgcttcttgcttacgcagaggaggacatctatgacacttctaggcaggccacagcattcggcttattaaaagcgatactgtcccggaagctgctcgtgcctgagatcgacgaggttatgagaaaagtttccaagctggccgtatcggcccagtctgaaccagctcgggttcagtgccgccaggtcttcctcaagtatatcctggactatcctctgggggacaagttgagacctaaccttgaattcatgctcgcgcaacttaattacgaacacgagactggcagagagtccaccctcgagatgatagcctacctgttcgacaccttcccacagggcctgctgcacgagaattgtggcatgttctttatacccttatgcctcatgacaatcaacgacgactcggccacttgtaagaagatggcctccatgactataaaatcactattaggtaaaatatctctggaaaaaaaagactggctgttcgacatggtgacaacatggtttggcgctaagaaaagacttaaccgtcagttggccgcattgatctgcgggctctttgtagagtcagaaggagtggacttcgaaaaaaggttaggcaccgtcttgccggttatcgagaaggaaattgacccggaaaacttcaaggacatcatggaggagactgaggaaaaggccgcagataggctgctctttagctttttgactctaatcaccaagctcattaaggaatgcaatatcatacaattcaccaagccagctgaaacgctgagcaagatctggagccacgtgcacagtcatttgcgccaccctcacaactgggtctggttgacggcagcacagattttcggcctgctcttcgcctcatgccagcctgaggagcttattcagaagtggaacaccaagaaaactaaaaagcacctgcccgagccggttgctataaaattcctggctagtgatctggaccagaaaatgaagagcatatctctggcctcctgtcaccagctgcattctaagttccttgaccagagcctcggggaacaggtggttaagaacttgctgtttgcggcaaaggtgttgtacctgcttgagctgtattgtgaagataagcagagtaaaattaaggaagacttggaggaacaagaagcattggaggatggggtggcttgtgccgacgagaaggcagagagcgacggtgaagagaaggaggaggtgaaggaagaattagggaggccagcgacgctgttatggcttatccaaaaactgtcccgaatcgccaaacttgaagctgcatactctcccaggaatcctttgaaacggacctgtatcttcaagtttttaggtgcggtggccatggacctgggaattgacaaagtcaagccctacttgcccatgattattgctcccttattccgggaactgaattctacatactccgaacaggatcctttgctaaagaatcttagccaagagattatcgaactgctgaaaaagcttgtagggctggaaagtttctccctggctttcgcctctgtgcagaaacaggcaaatgagaagcgagcactcagaaagaaacgcaaagctctggaatttgtcacaaaccctgatattgccgcaaaaaagaaaatgaagaaacacaaaaacaaatcagaggcgaaaaaaaggaagatagagtttcttcgtccaggatataaggcaaaaaggcagaagagccattcactgaaagacttggctatggtcgaatag

SEQ ID NO: 246424 - DNA, 1440 bp, Artificial Sequence
  Description of Artificial Sequence: Synthetic coding sequence
atggtcggtaggagcaggagacggggtgcagccaaatgggcagccgtgagagccaaagcaggtccaacacttactgacgagaatggggacgacctaggtctgcccccatcccccggagatacatcctactatcaagaccaggtggatgacttccatgaggctcggagccgtgctgccttggccaagggatggaacgaggtgcaaagcggggatgaggaagatggcgaggaagaggaggaggaagtactggccttggacatggatgacgaggacgatgaggacggcggtaacgctggcgaggaggaggaggaagaaaatgcagatgatgatggagggtcctctgtccaatcagaggcagaagcctcagtcgacccgagcctgagctggggtcagagaaagaagctgtattacgataccgattacggctctaaatcacgaggaagacagtcacaacaggaggctgaggaggaggaacgcgaggaggaggaggaggcacagataatccagcgccgacttgcgcaggccctccaggaagatgactttggcgtggcttgggtcgaggcgttcgccaaaccagtgccacaggtagacgaggctgagacccgcgtcgtgaaggatctggcaaaagtgtccgttaaggaaaaactgaaaatgttacggaaagaatctcccgaactgctggagctgattgaagacctcaaagtgaagttgactgaggtcaaagacgaactggagcccctgctggagctcgtggagcaagggatcattccacccggaaaaggatctcaatacctgagaactaagtataatctgtacctgaattactgctcgaatatctctttctatctgatacttaaggcgagacgcgttcccgcacatggacacccggtgattgagcggcttgttacctataggaacctcatcaacaaactctccgtcgttgaccaaaagctcagttcagagatacggcacctactcactttgaaggacgacgctgtgaagaaggagttgatccccaaagcaaagtctaccaagcctaagccaaaaagcgtaagcaaaacgtcggcggcagcgtgcgccgtgacagacttgtccgacgattccgattttgatgagaaggccaaacttaaatattataaggaaatcgaagataggcagaagctcaagcgcaagaaggaagaaaactccacggaagagcaggctcttgaagaccagaacgcgaagagagcaatcacctatcagattgcaaaaaataggggactcaccccgaggagaaagaaaattgatcggaaccccagggtaaagcaccgcgagaagtttcgtagggcaaagatacgtcggagaggccaggtgagagaagtgcgcaaggaagagcaaagatatagcggtgaactgtccggaatacgggctggggtgaagaagtccataaaattgaagtag

SEQ ID NO: 246425 - DNA, 756 bp, Artificial Sequence
  Description of Artificial Sequence: Synthetic coding sequence
tgaatcggcttgatgagtttaagcaaggggctactggaggagaaataccgctacctgttcaaggaagtcgccggaccgaccgagatgtgcgatcaacggcagctgggcctgttactgcacgacgcaatacaaatcccacggcaactgggggaggtagcagcattcgggggaagcaacatcgagcccagcgtcagaagctgttttcagcagaacaataacaaacccgagatcagtgtaaaggaatttattgactggatgcacctggagccacagagcatggtgtggctgcctgtattgcaccgcgttgcagccgctgagaccgcaaaacaccaagcgaagtgcaatatttgcaaagaatgcccaatcgttgggtttcggtaccggagcttgaagcattttaactacgacgtatgccagagctgctttttttcaggacgcacagccaaggggcataaactgcattaccccatggtagaatactgcattcctactaccagtggtgaggacgtcagagattttacgaaggttttgaaaaacaaattccgaagtaaaaagtacttcgcaaagcatccccgactgggctacctgcctgtgcagacagtgctggagggggacaacctcgagactccgagccagagcccgcagttatttcatgacgacacacactccaggatagaacagtatgctacccgtctggcccaaatggaacgcaccaatggctctttcttgacagattcctcctcgactaccggttag

SEQ ID NO: 246426 - DNA, 201 bp, Artificial Sequence
  Description of Artificial Sequence: Synthetic coding sequence
atgataggtctgaactttaatctccgagaattgctcaccaaattcgagaaagatattcaggctgagatcgacgctcacaacgacatctttaaaagtatcgatggcaacaggcagaaaatggtgaaagcactcgggaacagcgaagaggccaccatgctacagcaccgtttggatgatatgaatcagcggtggaatgattag

SEQ ID NO: 246427 - DNA, 2967 bp, Artificial Sequence
  Description of Artificial Sequence: Synthetic coding sequence
atgcaaattctcagatgcctgcaaaagtgtggtaaattaaagatgatggccgttgtcagaacctcattgcaaaaagttgtcgttttgctacaccgactgcagcgcatggcagtttccagccccaggtatcagaagctatgtaaagatattcaggccgagatcgacgcacataatgacatttttaaatcaatcgatggcaaccgacaaaaaatggtgaaggctctcggaaactcagaggaagccacgatgctccaacatcggctggacgacatgaatcagaggtggaacgatctgaaagctaagagtgcgtcaatccgagcccatctagaggcatccgcagagaagtggaacagactgctgatgagcttggaggaactcatcaaatggctcaatatgaaagatgaagagttgaaaaagcagatgcctattggaggcgatgtccctgcccttcagcttcaatacgatcattgtaaagctttgagaagggaactcaaagagaaggagtattccgtgctgaacgcagttgaccaggccagggtatttctggccgatcagccgatcgaggccccagaggagcctagaaggaaccttcaatccaaaacagaacttactcctgaagaacgcgcacaaaaaattgcaaaagctatgcggaagcaatctagtgaggttaaggaaaaatgggagtctctcaacgcagtcaccagcaactggcaaaagcaggtggacaaggctctggagaagcttcgtgatttgcagggcgctatggatgacttagatgcagacatgaaagaagcggaaagcgtgagaaatggatggaagcctgtcggggacctccttattgactcattgcaggatcacatcgaaaaaattatggcatttagggaggaaatcgccccaatcaactttaaggtaaagactgtcaatgacctgtcaagccagctctcgcccttagacctgcatcccagtttaaaaatgtcacgccaactggatgatctgaatatgcggtggaagctgcttcaagtgtcagtggacgatagactgaagcagctacaggaagcacacagagacttcggcccaagctcacaacatttcctgtccaccagcgttcaactaccgtggcagagatcaatatcccacaacaaggttccttattacatcaatcatcagacccagaccacatgctgggaccatcctaaaatgaccgagttgttccagtctctggccgaccttaataacgtccggttcagcgcctatcgaacagccattaaaatcaggcgcctccagaaggcactgtgcctggacctgcttgagctaagtaccacaaacgagatcttcaaacaacataaactcaatcaaaacgatcagctgctgtccgtccctgacgtgattaactgccttaccactacatatgacgggctggagcaaatgcacaaagacctggtgaatgttccactttgcgtggatatgtgcctgaattggctactgaacgtatatgatacaggcaggaccggtaagatccgcgtgcaaagtctgaagatcggattaatgtcattaagcaaagggctactcgaagagaaatataggtatctcttcaaggaggttgctggacctacagaaatgtgcgatcagcgccagttagggcttctgctgcacgacgcgattcagatcccacggcaactcggcgaagtggccgcttttgggggatcaaacatcgagccatctgtacgcagctgctttcagcagaataacaacaagccagaaatctcggttaaggagtttattgactggatgcatctggaaccgcaatctatggtgtggctgcctgtgttgcatcgtgtggcagcagcggaaacagcaaaacaccaggccaagtgtaacatctgtaaagaatgtccaattgtcggttttcggtatcgtagcctcaagcattttaactatgacgtgtgtcaatcttgcttcttttccgggcgtacagcgaagggacataaacttcactatcccatggtggagtactgtatccctacaacgtccggcgaggatgtgagggactttacaaaagtgcttaagaataagttccgttcaaaaaagtacttcgcaaaacacccaaggctgggctatctcccagtgcagactgtacttgagggagacaacttggagacgccgattacccttatatccatgtggcccgagcactacgaccctagccagtcccctcagttattccacgacgacactcattcacgtattgagcagtatgctacacgcctggctcaaatggagaggacgaacggaagcttcctgactgattccagcagtactacagggtcagttgaggacgagcatgccctcattcaacagtattgccaaaccttggggggtgagagcccagtgtcccaacctcagtctccagcccagattctgaagtccgtggagcgagaggagaggggcgagttagaaaggattatcgcggacttagaggaggaacagcgaaatttgcaagtggaatatgagcagcttaaggatcagcacctcagacgaggactgcccgtggggtccccacccgaatctatcatttctccccaccatacttccgaagattccgaactcattgctgaggccaagcttctgcggcagcacaaaggcaggctggaggcccgtatgcagatactagaagatcacaataaacagttagaaagtcagttgcataggctgagacaactgctggagcagcctgaatcggactctagaatcaacggagtaagcccatgggcttctccacagcatagcgcattgtcctactctttggatcccgacgcttctggcccacaattccaccaggcagccggagaagacttactggccccaccgcatgacacatccaccgacctcacagaagttatggagcagatacactccacgtttccttcttgctgcccaaacgtgccctctcggcctcaagccatgtag

SEQ ID NO: 246428 - DNA, 3069 bp, Artificial Sequence
  Description of Artificial Sequence: Synthetic coding sequence
atggctaagtacggagagcacgaagcctctcctgataatggtcagaatgagtttagcgacattattaagagccgcagtgatgaacacaatgatgtccagaaaaagacctttacaaagtggatcaatgcaaggttctcaaagtcagggaagccccctattaacgacatgtttaccgatctcaaggatgggaggaagctcttggacctgctcgaggggctcacaggaaccagtctccctaaggagagggggtcgactcgtgtgcatgcgctgaacaacgttaatagagtgctccaggtcttgcaccagaataatgtagaacttgtgaacatcggaggaactgatatagtggatggcaaccacaaactcaccctgggtctcctgtggtctattatacttcactggcaagtaaaggatgtgatgaaggatgtcatgagcgatctgcagcagactaattcagaaaagatcctcctgtcctgggtgcggcaaactaccaggccatacagccaggtaaacgtccttaacttcacaacctcatggactgatggtttggccttcaatgcggttctgcacaggcataagccggacctcttctcctgggacaaggtcgtaaagatgagccctatcgagagacttgagcacgcctttagtaaagcccagacttacctcggtattgagaagcttctggatcctgaagacgtcgctgtgcagttacccgataagaagagtattatcatgtacctgacctccctcttcgaggtcctgccacagcaagtgaccattgacgccatcagagaagtagagaccctgccaaggaagtacaaaaaggaatgcgaggaggaagccataaacatccagtccacagcccctgaggaggagcacgaaagcccgagagccgaaaccccttccactgtcacggaagtcgatatggatctagatagttatcagatcgccctcgaagaggtgttgacttggctcctgagcgccgaggacacattccaggaacaggacgacatctcggacgatgtagaggaagttaaggatcagttcgcaacccacgaggccttcatgatggagctaacagcccaccaaagcagcgtgggctcggttctgcaggccggaaatcagttaattactcagggaactctctctgatgaagaggaattcgaaattcaggagcagatgaccttacttaatgccagatgggaagcgttgcgtgtggagagtatggatcggcagtcccggctacacgacgtactaatggagttgcagaagaagcagttgcagcagctgtctgcttggctgaccctgacagaagagagaattcagaaaatggagacctgccctttagacgacgatgtcaaaagcttacaaaaacttctggaggaacacaaaagcctgcagtccgacctcgaagccgagcaggtgaaggttaatagcctgacacatatggtagttatcgtggatgagaactcaggagagtcagctaccgctattctggaggatcagttgcagaagctaggggagaggtggactgccgtttgtcgctggacagaggagagatggaatcgcttgcaggaaatcaacatcctctggcaagagttgttagaggaacagtgtctcctgaaagcctggcttacagaaaaggaggaggcgctcaataaggtgcagactagtaactttaaggaccagaaagagctgagcgtctcggtgcgaagacttgccattctgaaagaggatatggagatgaagcgccaaacgttggatcagctgtctgaaataggccaggacgtcggccagctgctggacaattctaaggcgtctaagaaaattaactccgatagcgaagaattgacccagagatgggattcactggtccagagattagaggattctagtaatcaggttactcaagcggtagccaagttggggatgagccagataccccaaaaggatctcctcgagacagtgcgcgtgagagagcaagctattaccaaaaagtctaagcaggaactgcctcccccaccaccgccaaagaagagacagattcacgtggatatcgaagcgaaaaagaaatttgacgccatctcggccgaattgttgaattggattttgaagtggaagaccgcgatccagacaaccgaaattaaagagtacatgaaaatgcaggatactagcgaaatgaagaagaagctaaaagccctggagaaggagcagagggagcgcatacctagagctgatgagctgaaccagaccgggcagattcttgtcgagcagatgggaaaagagggtctgccaaccgaagagatcaaaaacgtgctggaaaaagtttcaagcgaatggaagaacgtgagccagcatcttgaggacctggagagaaagattcagctgcaagaagatataaacgcgtactttaagcaacttgatgaactagagaaggtaatcaagacaaaagaagaatgggtcaagcatacctcaatttccgagagcagtcggcagtccttacctagccttaaagattcctgtcaaagggagctgaccaatttgttagggctacatccgaaaatagagatggctagggcatcatgttccgcgttaatgtcacaacccagtgctcctgactttgtccagaggggttttgatagctttttgggtcggtaccaggccgttcaggaggctgttgaggaccgccagcagcacttggaaaatgaactaaaaggccaaccgggtcacgcctatcttgagacactgaagaccctgaaggatgttttaaatgattctgagaataaagcacaggttagtttgaatgtcctcaacgacctcgctaaggtggaaaaagcattacaggagaagaagactctggatgagattttggaaaaccaaaagccagccctacataaactagccgaagaaacaaaggccttagaaaagaacgtacatcccgatgtggagaagctttacaagcaggaattcgatgacgtccagggcaagtggaacaaactgaaggtcctcgtgtccaaagacttgcacttgttagaggagattgcgttaacactgcgcgcttttgaatag

SEQ ID NO: 246429 - DNA, 10302 bp, Artificial Sequence
  Description of Artificial Sequence: Synthetic coding sequence
atggccaaatacggagaacacgaggctagtcccgataatgggcaaaatgagttttccgatataatcaaatccagatctgatgaacacaatgatgttcaaaagaaaacattcaccaaatggatcaacgcccgtttcagcaaaagcggaaagccacccattaatgatatgttcaccgacctgaaagacggacgcaaacttttagatctgctcgaaggtctcacggggacttccctgccgaaggaacgaggctccactcgggttcatgccctgaataacgtgaaccgcgtccttcaggtcctccaccagaataatgtcgagttagtgaatataggaggaaccgatatcgtagatggcaatcacaagcttactctcggactgctgtggtcaataattctgcactggcaggtcaaggatgtgatgaaagacgtcatgtccgacttacagcagacaaacagtgagaagatcctcctatcctgggtgcgacagactacgaggccgtattctcaggttaatgtattaaatttcactacaagttggaccgacggactggcatttaatgcggtactccataggcacaagcccgacctgtttagctgggataaggtcgttaagatgtccccaatcgagagactcgagcatgctttttccaaggcccagacctaccttggaatagaaaaacttttagaccctgaggatgtggccgtgcagctgccagacaaaaaatctataattatgtacctgacctctttgtttgaggtgctgccgcagcaggtcaccatcgacgcgatcagggaggtcgaaactctgccaaggaaatacaaaaaggagtgcgaggaagaagcaataaatatccaaagcactgctccagaggaagaacacgagagtccacgagctgaaacgccgagcactgtgaccgaggttgacatggacttagattcctaccagatcgcccttgaagaagtgctcacctggttactgtctgcggaggatactttccaggagcaggatgatatctcagatgatgtcgaggaggtcaaagaccagttcgccactcacgaagccttcatgatggagctgactgcccaccaatccagtgttgggagtgtgctacaagcaggaaaccagctcatcacacaggggacgctgtctgacgaagaagaattcgaaatacaggagcagatgacgctactcaatgcacgatgggaggctcttcgggttgagtccatggatcgacagtctcgactgcacgacgtcctgatggagcttcagaagaaacagctgcagcagctaagcgcttggctgacactgacggaggaacggattcagaagatggaaacctgcccactggacgacgacgtgaagagcctgcagaaactattggaggagcataagtcattacagtctgaccttgaggccgagcaggtgaaggtgaactccctgacccacatggtcgtgattgtagacgaaaacagtggagagagcgccactgctatcctcgaagatcagctccagaagttgggggaacgatggactgccgtgtgtcgttggacggaagaaaggtggaaccggctgcaggagatcaacatcctttggcaagagctgctggaagagcagtgtctgctaaaggcctggctgacagagaaggaggaggcgctgaataaggtacagacttccaatttcaaagaccagaaagaactcagcgtttccgtgcggagactggctatcttaaaggaggatatggagatgaagcgccaaaccctggaccagttgtctgagatcgggcaagatgtggggcagctcctggacaactccaaggctagtaaaaagatcaattccgactccgaagaattgacacagcgctgggacagtctcgtgcagcgtctggaggacagcagcaatcaggtgacccaggccgtggccaaactcggcatgtcccagatcccacagaaagacctgcttgaaacggtgagggtgagagagcaagccattaccaagaagtctaagcaagagctgcctcctcccccaccacctaaaaaaaggcaaatccacgtcgatatcgaggctaagaagaagttcgatgccatttctgccgagctgctaaactggatcctgaaatggaagactgccatccagacgaccgagatcaaagagtacatgaagatgcaggacacatcagagatgaagaagaagttaaaagccttggaaaaagaacagagagagcgtatccccagggcggatgagctgaaccagactggccagatcctggttgagcagatgggcaaagaaggactccccaccgaagagatcaagaacgtcctcgaaaaggtgtcttcggagtggaagaatgtatctcagcatctcgaggatttagagcgcaaaatccaactacaagaggacattaacgcctattttaagcaactcgacgagctggaaaaagtcatcaagaccaaagaagaatgggtgaagcatacatctatctcggaaagctcgcgacagtcactgccaagcctcaaagattcttgccaacgcgagctgactaacttactgggactccaccctaaaatcgagatggcccgagcttcatgctccgccctgatgtcccagccatctgcccctgactttgtgcaacgtggatttgatagctttcttgggcgatatcaggcagtgcaagaagcggtggaagacagacaacagcacctcgagaatgaactcaaagggcagccagggcacgcctacttggagacattaaaaaccctcaaagacgttctcaacgattcagaaaataaagctcaggtgtcgcttaacgtcttgaacgatttggcgaaagtggagaaggctctgcaagaaaagaagaccctggacgagattctcgagaatcaaaagcctgcactacataaactcgccgaagaaaccaaagctctggagaagaatgtgcacccagacgtcgagaaactgtataagcaagagtttgacgatgtccagggcaagtggaacaaactcaaagtactggtgtctaaagatctgcatctgctcgaggaaattgccctcactctgcgagccttcgaagcggactccaccgtgatcgagaagtggatggacggcgtgaaggattttttgatgaaacaacaagccgctcagggagatgacgccggtctgcagcggcagctcgaccagtgttcagccttcgtgaatgagatcgagacaattgagtcctctctgaagaatatgaaggagatagaaacaaatctacgatcaggtcccgtggcagggatcaagacatgggtacagacgcgcctgggtgactaccagacccaactggaaaagctgtcgaaggagatcgccacccagaagagccgtttgtcggagtcccaggaaaaagccgctaatctcaaaaaagacctcgccgaaatgcaggagtggatgacgcaagctgaagaggagtatttggaaagagattttgagtacaaaagtccagaggaactcgagtccgcggtggaagaaatgaagagggcgaaggaggatgtgctgcagaaggaggtcagggtaaagatccttaaggataatattaaactgctcgcggctaaggtgccttccggcggacaggaactaaccagcgaacttaacgtcgtgttagagaactaccagcttctgtgtaacaggatccggggaaagtgtcacacacttgaggaagtgtggagttgttggatcgagctgctacattatcttgatctggagacaacttggctcaacaccctggaagagagaatgaaatcgactgaggttctacctgagaagaccgatgccgtgaatgaggcactggaatctcttgagagtgtgctgcggcacccagcagacaacagaacacaaattcgtgagctgggacagacacttatcgacggaggcattctggatgatataattagcgagaagctggaggcattcaattctcgatacgaggacctctcccatttagctgagagtaagcaaatctcccttgagaagcagctgcaagtccttcgggagacagaccagatgctgcaggttctgcaggaatctctgggagagctggataagcagttgaccacctacctgaccgaccgcattgatgcctttcaggtgccacaagaagcccaaaaaatccaggctgagatcagcgcccacgagctcactctcgaggagctcaggcgcaatatgcgatcccagccactcaccagccccgagtcacgaactgcaagagggggatcccagatggacgtgctgcagcgcaagctgagagaggtaagtactaaatttcagctgttccagaaaccagctaattttgagcagcgaatgctcgactgtaagcgcgtcctcgatggcgtaaaggccgagcttcacgtgcttgatgtcaaggacgtggaccctgacgtcatccaaacccatttagacaagtgcatgaagctttacaaaactctttccgaagtgaagctggaggtggagacagtgatcaagaccggcaggcacatcgttcagaagcaacagactgataaccctaaaggcatggacgaacagttaaccagcctgaaagttctgtacaacgatcttggggctcaggtaacagagggaaagcaggatctcgagagggctagccagttggccaggaagatgaaaaaagaagccgcttcgttatcagaatggctgagcgcaacggagacagaactcgtgcagaagtctacaagtgaaggtctgctaggagacctggacacagagatatcctgggctaagaatgtgctcaaggacctcgagaaacgaaaggcagacttgaacacaatcaccgagtccagcgcggcactccagaatctaattgaaggatcagagcctattctcgaagagagactgtgtgttttaaacgcaggctggtccagggtgcgcacatggactgaggactggtgcaataccctaatgaaccaccaaaatcagctcgagattttcgacggtaacgttgcacacatctctacatggctgtatcaggcggaggcactcctcgacgaaatcgaaaagaagcccacgtcaaagcaggaagaaatcgttaaaagacttgtttcagaactagatgacgctaatctgcaagtggaaaacgtcagggaccaggcactgattttgatgaatgcacgcggttcctcaagccgagagctcgtagagccaaaactggccgagctgaatcggaattttgagaaggtgagccagcatatcaaatctgcaaagctgcttattgcacaagagccattgtatcagtgtttagtgaccaccgagaccttcgagacaggcgtgccattttcagacctggagaagctagaaaatgatattgaaaatatgctgaagtttgtagagaagcatctcgagagctcagacgaagatgagaagatggatgaagaatcagcacagattgaggaggttctccaacgcggagaggaaatgttacatcagcccatggaagacaacaagaaggagaagataaggctgcagctgctgctgctgcacacccgttacaacaaaatcaaggccatacccattcaacagaggaagatgggccagctcgcatccggcatccggagttctcttctgcctaccgattacctggtggaaattaacaaaatccttctttgcatggatgacgtggagctgtcactgaatgtgccggagctgaatacggccatttacgaggatttttcttttcaggaagattctctgaaaaatataaaagaccagctggacaagctgggggaacagattgcggtgatccatgagaaacagccggacgtcatcctggaggcatcaggtcctgaggccatccaaattcgtgacaccttgacgcagttaaatgccaagtgggaccgcattaacagaatgtactctgatcgaaaaggctgttttgatcgggctatggaggagtggaggcagtttcactgcgatctgaacgatctgacccagtggattacagaggctgaagagctgctggtggacacttgtgcccctggaggctcactcgatttagaaaaggcacgcatacaccagcaagaactggaggtaggtatttcaagccatcagccgagcttcgccgcactcaaccggaccggggatggtatagttcagaaactgagccaggccgatgggagtttcctaaaggaaaaactcgcgggtttgaaccagcggtgggacgctatcgttgcggaagtaaaagatcgccagcccaggcttaaaggcgaaagcaaacaggttatgaagtatcgacatcaacttgacgaaatcatttgttggctcaccaaagctgagcatgcgatgcagaaacggagcaccacagagttgggagaaaacctgcaagagttgcgggatctgacccaagagatggaggttcacgccgagaaactgaagtggctgaaccggacggaattggaaatgctttctgacaaatccctgagccttccagaacgagacaaaatttctgaaagcttgcgcacagtgaacatgacatggaataagatctgtagggaggtaccaactaccctgaaggagtgtatccaagagccttccagcgtgagccagactagaatcgcggctcaccccaatgtccagaaagtggtgctggtgagcagtgcctcagacatccccgttcagtcccaccgtacttcagaaatcagcatcccagcggaccttgacaagacaataaccgaactcgcagattggctggttctgattgaccagatgctgaagtctaacattgtgacagtgggagatgtcgaggagattaataagaccgtctcccgcatgaagattaccaaggcggatctcgaacagcgtcacccgcagcttgactacgtattcactttggctcaaaatctgaagaataaggcctcttcttcggacatgagaactgcaattactgaaaagcttgaacgggtgaagaaccagtgggacgggacccagcacggcgtggagctacgccaacaacagctcgaggatatgatcatcgatagcttacagtgggatgaccatcgtgaagagacggaggaacttatgcgaaaatacgaggctcggctctacattctccagcaggcacggcgtgaccccttgacgaagcaaatcagcgacaaccagattctccttcaggagttgggcccaggtgacgggatcgtcatggcattcgacaacgtgttacagaaactcctcgaagagtacggctccgatgacacacgaaacgttaaggagaccacagaatatctgaagacatcatggatcaatctgaagcagtctatcgcagacaggcagaacgcactcgaagccgagtggcgtacagtgcaggcaagccgcagagatcttgagaatttcttgaaatggatccaggaagccgagacaactgtgaacgtgcttgtggatgcaagccatcgtgaaaatgccttgcaggatagcatcttagcacgagaattgaagcagcagatgcaggatatacaggcagaaattgacgctcataacgatatttttaaatctattgacggcaaccgccagaagatggtgaaggccctcgggaatagcgaggaagccaccatgctgcagcatcggttggacgacatgaatcagaggtggaacgatttaaaagcaaagtccgccagcatcagggcgcacctggaagccagtgcagagaagtggaatcgactgctaatgtcgctggaggagctgatcaagtggttgaatatgaaagacgaggagctgaagaagcaaatgcctataggcggagatgtgcccgcactgcagctgcagtatgatcactgcaaagctctgaggcgggaattgaaagagaaagaatacagtgtcttaaacgcagtggaccaagctcgggtgtttctggcagatcagccgattgaggctcctgaagaaccacggagaaacctgcaatctaaaacagaactcactccagaggagcgcgctcagaagattgccaaggcaatgcggaaacaatcatcagaggttaaagagaaatgggagagcctgaacgcagttacgtccaattggcagaagcaggtggataaggctcttgagaaactgcgagatctccagggggcaatggacgatctggatgccgatatgaaagaggcagaatccgtacgcaatggatggaagcctgtaggcgacctactgattgacagtctgcaggaccatatcgagaagatcatggcctttagagaggagatagctcccattaactttaaggtaaagaccgtgaatgatcttagcagccagttgagccctctggacctccacccctcccttaagatgagccggcagctggatgacctaaatatgcgctggaagctgctccaggtgagcgtggacgatcgcttgaaacaattacaagaggctcaccgggacttcggcccatcatcacagcacttcctatcaacttcagtccaacttccgtggcaacgtagcatatcccacaacaaagtgccctactatataaatcaccaaacgcagactacgtgctgggatcacccaaagatgacagagttattccagtccctcgcagatttaaacaatgtacgtttcagcgcttacagaactgccataaagatccgacgactgcaaaaggccctgtgcttagaccttttggaactgtcgaccactaacgaaatctttaagcaacacaagcttaatcagaacgaccaactgcttagcgtgcccgacgttatcaactgtctgacgactacttatgatggcctggagcagatgcacaaagacctcgtgaacgtccccctctgtgtggacatgtgtctgaattggctgttgaacgtgtatgataccgggaggaccggcaagatccgggtccaatctttgaagattggactaatgtccctctcgaaaggtcttctcgaggagaaataccgctacctcttcaaggaggttgccggtcctacagagatgtgtgatcaacgacaactgggcctgctactccacgatgctatccagattccccgacaactgggcgaagtagccgctttcggcggttccaacatcgagccatccgtgagatcctgctttcagcagaataataataaaccggagattagtgtcaaggaattcatcgactggatgcacctggagcctcagagcatggtatggttgcctgtgctccaccgagtggctgctgctgagaccgccaagcaccaggcaaagtgcaatatttgcaaagagtgtcccattgtcggctttcgttaccgctccctcaagcacttcaattatgatgtgtgccagagttgtttctttagcggaagaaccgcaaagggacacaagttgcactatcctatggtggagtactgcatacccaccacatccggcgaggacgtgagggactttacgaaagtcctgaagaacaagttccgaagtaagaagtactttgcgaaacaccctcgcctcggctacctgcctgttcagacagtgttggaaggcgacaacttagaaacaccaatcactcttattagcatgtggcccgagcactatgaccctagccagagccctcagctcttccacgacgacactcactctagaatagaacaatatgctacacgattggcccagatggagcggacaaacggaagcttcttaaccgactcatccagcaccacgggatcggttgaggatgaacacgccctcattcaacaatattgccagactctaggtggagaaagccctgtgtcccagcctcagagccctgcccaaatccttaagtctgtggagcgggaagagagaggagaacttgagcggataatcgcagatctcgaagaagaacagcggaacttacaggtagaatatgagcaactcaaggatcagcacctcagaagggggctcccggtgggtagcccccctgaaagcatcattagccctcaccatacgtccgaagacagtgagctaattgccgaggcaaaattgttacggcagcataaaggcaggctggaggccaggatgcaaatcctggaggaccataataagcagcttgagagccagctacataggttaaggcaactgcttgaacaacctgagagcgattcccgtataaacggcgtgagtccctgggccagtcctcagcatagtgccctgtcctattcccttgatccagatgcatctgggccacaattccatcaggctgcgggtgaggatctcctagctccaccacacgacacttcaacagaccttacagaagtcatggagcagatccatagtacattcccatcgtgctgccctaacgtgccctcccggccacaggcaatgtag

SEQ ID NO: 246430 - DNA, 555 bp, Artificial Sequence
  Description of Artificial Sequence: Synthetic coding sequence
atgcacctggaaccccagagtatggtgtggctcccggtgttacaccgagtagccgcagctgagactgcgaagcaccaggccaagtgtaacatctgcaaagagtgccccattgttggctttagataccgatctctgaagcacttcaattatgacgtgtgtcaatcctgtttttttagcggtcgcacagcaaaaggacataaactgcattatccgatggtcgaatactgtattcctaccactagcggggaggatgtgagggacttcactaaagtccttaagaataagtttaggtctaaaaaatatttcgccaaacatcccaggctggggtatctgcccgtgcaaaccgtcctggagggagataacctcgagaccccatcccagtcgcctcagttgttccatgatgatacccactcacgcatcgagcagtatgctacaaggcttgcccagatggaacgaaccaacgggtcttttcttacagactcttctagtaccaccggttctgtagaggacgaacacgcactcattcaacagtactgtcagacccttggaggttag

SEQ ID NO: 246431 - DNA, 462 bp, Artificial Sequence
  Description of Artificial Sequence: Synthetic coding sequence
atgtcaggcctggccgcaaccacgtttcattggaagaagtgcaggctcgatttaccgggacacgtggcactgcaagcatgcaaacgacttccggatgaacataatgatgtgcagaagaaaacattcactaagtggataaacgccagattcagcaaatcaggaaagcctccaataaacgatatgttcaccgatctcaaggatggccgtaagctgctcgacctgctggagggcctgaccgggaccagtctgccaaaggaacgaggttcaaccagggtgcacgccttaaataatgtaaatagggttctgcaagtgctgcaccagaacaacgtcgagctcgtcaatatcggcggtactgacatcgtggacggaaatcacaaactgaccctgggattgctatggtccataatactgcactggcaggttgacgtgatgaaagacgtcatgagcgaccttcagcaatag

SEQ ID NO: 246432 - DNA, 546 bp, Artificial Sequence
  Description of Artificial Sequence: Synthetic coding sequence
atgcatctggagcctcaatctatggtatggctgcctgtactacacagagtcgcagctgcggagactgctaaacatcaggcaaaatgcaacatctgtaaagagtgccccattgtgggttttaggtaccgaagccttaaacatttcaattacgacgtgtgtcaatcctgtttcttctccggccgtaccgctaagggtcataagcttcattatcctatggtggagtactgtattcctaccacttccggcgaggatgtacgggacttcacgaaggtgttgaaaaacaagttccggtccaagaaatattttgcgaagcatcctcggctcggatatctgcctgtgcagactgttctggaaggggacaacctggaaactcctattacgctcatttcaatgtggcccgagcactacgaccccagccaatcgccccagctgttccatgatgacacccactcaagaatcgaacagtatgcgacccggctggcccaaatggaacggacaaatggtagcttcctgacagatagcagtagtactaccggttcggtgtag

SEQ ID NO: 246433 - DNA, 144 bp, Artificial Sequence
  Description of Artificial Sequence: Synthetic coding sequence
atggccaagtatggagagcatgaggcctcccctgataatggccagaatgagttcagcgatataattaagtctcggtcggatgagcacaacgacgtgcagaagaaaactttcacaaaatggatcaacgccagattctccaaatag

SEQ ID NO: 246434 - DNA, 561 bp, Artificial Sequence
  Description of Artificial Sequence: Synthetic coding sequence
atgctggaggaggaagagtggtatcggagtctcaagcactttaattacgacgtttgccagtcgtgtttcttttctggcagaactgccaaaggtcataagctgcattaccctatggtagaatactgcattcccactacttccggcgaggacgtgcgcgacttcactaaagttctaaagaacaagttcaggagtaagaagtactttgcaaagcaccctcgactaggctacctccctgtccaaactgtgctggagggcgacaacctcgaaactccttcacagagtcctcagctgtttcatgacgacacacactcccgaatcgaacaatacgcgacccgattggctcagatggagagaacaaacggttcttttcttacagactcttcctccacaacgggctctgttgaagacgagcatgccctgatccagcagtattgccagaccctgggtggggagagccctgtgagccaaccccagtcacccgctcaaatcctcaagagcgtcgagagagaggagcgtggcgagctggaaagaatcattgcggatctagaggaagagcagtag

SEQ ID NO: 246435 - DNA, 201 bp, Artificial Sequence
  Description of Artificial Sequence: Synthetic coding sequence
atgattggactaaacttcaatctccgagagctgcttaccaagttcgaaaaagatattcaggctgagatcgatgctcacaatgacatatttaaatcaatagatgggaaccggcagaaaatggtgaaagcactcgggaactctgaagaggctaccatgctacagcatcggctcgacgatatgaatcagcgatggaacgactag

SEQ ID NO: 246436 - DNA, 555 bp, Artificial Sequence
  Description of Artificial Sequence: Synthetic coding sequence
atgcacctggaacctcagagcatggtgtggctgccagtgctccacagagtggcagccgcagaaaccgctaagcaccaggccaaatgcaacatttgcaaagaatgtccaatcgttggattccggtatcgcagtcttaagcattttaattatgacgtgtgccagtcatgtttcttttctgggaggactgctaaggggcataaactacactaccctatggtggagtattgtatcccaacaacctccggagaggatgtccgagatttcacaaaggtgctgaagaacaaattcaggtccaaaaagtatttcgcgaaacacccacgactgggttacttaccggtccagactgttttggagggcgataatcttgaaaccccatcacagtcacctcagctattccatgacgatacccactctcgtattgaacaatacgccacaaggctggcacaaatggagcggacaaacggatctttcttaactgacagcagttctactacggggtcagtagaagatgagcacgccctgatccagcagtactgccaaactctaggcggatag

SEQ ID NO: 246437 - DNA, 2100 bp, Artificial Sequence
  Description of Artificial Sequence: Synthetic coding sequence
atgtcggccagcgcaagcgttggcggtccagtaccccagcctcctcctggtcctgccgctgctctcccaccaggatccgccgcacgagccctgcatgttgagctaccgtcacagcagagaaggctgaggcaccttcgcaatatagctgctcgcaatattgttaaccggaacgggcaccagcttctggatacatacttcaccctccacctttgtagcacagagaagatctataaggagttctaccggtcggaggtgataaagaatagtctgaatccaacttggcgctctctggacttcgggataatgcccgatcgcttggacacttccgtctcctgttttgttgtaaagatatggggcggtaaggagaacatctatcagctgctaatcgagtggaaagtctgtcttgacggactgaagtacctgggtcagcagattcacgctcggaaccaaaatgagattatattcggactgaatgatggatactacggagcccctttcgagcataagggctattcaaacgcacagaaaactattttgctacaggtggatcagaattgcgtccgcaattcgtacgacgtgttctcactgctcagacttcaccgcgctcagtgcgccataaagcagacccaggtcactgtccagaaaattggcaaagaaattgaggaaaaactgcggctgaccagtacgagcaacgagctcaagaaaaagtctgagtgcctgcagctgaaaatcctggtccttcagaatgaactcgaacgccagaaaaaggctctggggagagaagtggccctcctccacaagcaacagatagcactccaggataaggggagtgccttctcagcagagcatctcaagctccaacttcagaaggaatcgctgaacgaactcagaaaagaatgtaccgccaagcgcgagctttttttaaagacaaacgcgcagcttaccatccgctgtcggcagttattgtctgagctatcctacatataccctattgatctaaacgaacataaagattattttgtatgtggcgtaaagttacccaactccgaggacttccaagccaaggacgacggatccatcgctgtggcccttggatacactgctcacctcgtgagcatgatcagcttcttcctgcaggtccctcttaggtaccccatcattcataaggggagccggtcaactattaaggataatatcaacgacaagcttacagagaaggaacgcgaatttcccttatatccgaaaggaggcgaaaaacttcaattcgactacggcgtgtacctgctgaacaaaaacatcgcacagttgcgttatcagcacgggctggggaccccggacttaaggcagacattgcctaaccttaaaaatttcatggaacatggattaatggtgcgctgtgacaggcaccacacatccagtgcaattcctgtaccgaagcgacagagcagtattttcggaggtgcagacgtgggctttagtgggggtatcccttcacctgacaaaggacacagaaagcgagcctcctcggaaaacgagcggctccaatacaagacaccgccaccttcctataatagcgcgttagcacagccggtaacaacagttccctctatgggggagactgagcggaagatcacgtctctgagctctagtttagacacctcacttgacttcagcaaagagaacaaaaaaaagggtgaggatctggtcggttcccttaatggcggtcatgccaacgtgcatccaagccaggagcaaggcgaggctctttccggtcatcgtgctacggtgaacgggacgctgctgccttccgagcaggcaggatctgcatccgtgcagctacctggtgagtttcacccagtttctgaggccgaactgtgctgcactgtcgagcaagccgaggagataattgggcttgaggctaccggcttcgctagcggcgaccaacttgaggccttcaactgcatacccgtggatagcgccgtggcagttgaatgcgacgagcaggttttaggtgagttcgaagaattctctcgccgaatttacgccttgaatgaaaatgtgtcctcatttcgacggccaagacggtccagcgataagtag

SEQ ID NO: 246438 - DNA, 768 bp, Artificial Sequence
  Description of Artificial Sequence: Synthetic coding sequence
atgttcatatccgtggcccagcgccagcgagaaaacgcattcagctgttccaccttcctaaggtgtgaccggcaccacacaagctctgccatccccgtgcccaagcggcagtcatctatatttggaggggcagatgttggcttttcgggcggaatcccctctcccgataaagggcatcgtaaacgagcctccagtgaaaatgagcgccttcaatacaagactcccccaccatcttacaattcagcactggcccagccagtcacaacggtgcctagtatgggagaaaccgagagaaagatcacgtccttaagtagttcgctagacacaagcttggacttctcaaaggaaaacaaaaagaagggagaggatctcgtaggcagcctgaatggcggtcacgccaacgtgcacccctctcaagagcaaggagaggccctcagtgggcatcgggcaaccgtgaacggtacactcttaccgtctgagcaggcgggtagcgccagcgtgcagctgcccggagagtttcatcccgtgtcagaggcagagctgtgctgcactgtagaacaggcagaggaaattatcggcctagaggccaccggattcgcgtccggcgatcagctggaagcatttaattgtatcccagtcgactcagccgtggcagtcgaatgcgatgagcaggtgcttggagaattcgaagaattctctcggaggatatacgccctgaatgaaaacgtctcctccttcaggcgtccacggcgtagcagcgacaaatag

SEQ ID NO: 246439 - DNA, 984 bp, Artificial Sequence
  Description of Artificial Sequence: Synthetic coding sequence
atgattagtttcttcctccaggtcccactgcgctacccgattatacacaagggttccaggtccactataaaggataacattaacgacaagcttacagagaaggaaagggagttccctctgtacccgaagggcggagaaaagctccagttcgactacggcgtgtacctgctgaataaaaacatcgcccagctgcgataccagcatggacttggtactcctgacctgcgccagacacttccaaacttaaagaacttcatggagcacgggctgatggtgcgctgcgatcggcaccatacgagtagcgctattccggtgccaaagcggcaatcctcgatctttgggggagccgatgtggggtttagcggcggaataccaagccccgataagggccacaggaaaagagctagctccgaaaacgagcgcctgcagtataaaacgcccccaccctcatacaactctgccctggctcagccagtgaccacagttcctagtatgggggagaccgagaggaaaattacttcactgtcttcaagtctggatacgagcctggacttctctaaggaaaataagaagaaaggtgaggacctagtcggatccctgaatgggggacacgccaacgttcacccttcccaggagcaaggcgaggcacttagcggacatagagcaacagtgaatggaacactgctcccatctgaacaggcgggttcagctagtgtccaactgccaggggagttccaccccgtgagcgaagcggaattgtgctgcaccgtggagcaggccgaggagatcatcggactggaagctaccggattcgcatccggtgaccagctggaggcatttaactgcatcccagtggactctgccgtcgctgtcgagtgcgacgagcaagtcctgggcgaatttgaagaattttctagacgtatctacgcgctgaacgagaacgtcagctctttcaggagaccacgtcggtcttccgataagtag

SEQ ID NO: 246440 - DNA, 4251 bp, Artificial Sequence
  Description of Artificial Sequence: Synthetic coding sequence
atgaagagtctgaagagtcgcctccggagacaagacgtgccaggccctgcctcttccggagccgcagctgctagtgcgcacgctgctgactggaataaatacgacgacaggctcatgaaggctgccgagcgtggtgatgtagagaaggtaacctccattctggctaagaagggggtgaacccaggaaagctggatgtagaagggagaagcgtttttcatgtggtgacatcaaagggtaatctggaatgcctgaatgctatactgatccacggcgtggacataaccacttctgataccgccggacgaaatgcgttacacctggcggcaaagtacggtcacgccttgtgtctacagaaactactgcagtataattgtccaacagaacatgctgatctgcaggggcgtaccgcgctccacgacgccgcaatggcggactgtcccagttcgatccaactcctttgtgatcacggcgctagtgtgaatgcaaaagacgtagacgggaggacacccctggttctggccacccaaatgagtaggccgaccatctgtcagctcctcatcgatcggggagcagatgtcaatagcagagacaaacagaacaggaccgcacttatgctggggtgtgagtatggctgcagagatgcagtcgaggtgctaatcaaaaatggagccgacatctccctgttggatgccctcggccacgattcctcctactacgcacggataggcgacaacctggatatactgacattgctgaagaccgcgtctgaaaataccaataagggcagggaattgtggaagaagggcccaagcctgcaacaaaggaacctgacacatatgcaggacgaggttaacgttaagtcccaccaacgcgagcaccagaacatacaagacctagagattgagaatgaagaccttaaggagcggctcagaaagattcaacaagaacagcgtattctgctggacaaggtgaacggcttgcaactgcagctgaatgaagaggtgatggtcgcggacgacctcgagagtgagagagagaaactcaaatctttgcttgcagccaaggaaaagcaacacgaggagtctctcagaacaattgaagcactcaagaatcgatttaagtacttcgaaagtgatcatcttggaagcgggtcccatttttctaatcgcaaggaggacatgctgctgaagcagggacagatgtacatggccgactcgcagtgcacatctcctggaattccagcccacatgcagagcaggagcatgcttcgccctcttgagctgtccttgccaagtcagacttcatattctgagaacgaaattctgaagaaggagctggaagcaatgagaactttctgtgaaagtgccaagcaggatcggctgaaactgcagaacgaactcgcccacaaagtggccgaatgtaaggcactggccctggaatgcgagcgagtgaaagaagattcagacgagcagatcaagcagctcgaagatgccttaaaggacgtgcagaaaaggatgtatgagagtgagggcaaagtgaagcaaatgcagactcacttcctcgccctaaaagaacatctaacctcagaagctgcatctggaaatcacaggctgactgaggagctgaaagaccagctgaaggacctgaaggtgaaatacgagggggcatccgccgaggttggcaagctgcggaaccagatcaaacagaatgaaatgattgtggaggaatttaagcgggacgaaggtaaactgatcgaggagaataagcggttacagaaagagctctcaatgtgcgagatggaacgagagaaaaagggcaggaaggtcaccgagatggagggccaggcgaaagaactgtctgccaagctggccctatctattccagctgaaaaatttgagaacatgaagagcagtctgtccaacgaggtaaatgagaaggcgaagaagttggtggaaatggaacgggagcacgagaagtctctcagtgaaatccgccagctcaagagagaactcgagaatgtcaaggccaaattggcacagcatgtaaaaccagaagagcatgaacaggtaaaatctcgtcttgaacagaagagcggagagctaggcaaaaaaattactgaattaactctgaaaaaccagacactccagaaggagattgagaaagtgtaccttgataacaaattactgaaagaacaggcccacaacttaactatcgagatgaagaaccactatgtacctcttaaggtaagcgaggacatgaagaaatcccatgacgctattatcgacgacctgaaccgaaaactgttggatgttacacagaagtacacagagaagaaactggaaatggagaaactcctacttgagaacgattccctgtctaaggacgtctcccgactggaaacggtgtttgtcccacccgagaaacacgaaaaagaaatcattgcccttaaaagcaacatcgttgagctgaagaagcagctgtcagaactgaaaaagaaatgcggtgaggatcaggaaaagattcatgccctcacttcggagaatacgaatctgaagaagatgatgagcaatcagtacgtcccagtaaaaactcacgaggaggtgaagatgaccttgaacgacactctagccaagaccaacagagagctgctggatgtgaagaaaaaattcgaggatatcaatcaggagtttgtcaagattaaagacaagaatgaaatcctgaaaagaaacttggagaacacccaaaatcagatcaaagccgagtacatttcactggcagagcacgaagccaaaatgtcaagccttagtcaaagcatgcgtaaggttcaggatagcaatgctgagatcctggccaattacaggaagggccaggaggaaattgttacactccacgcagagattaaggcccagaagaaggaacttgataccatacaggagtgcattaaggtcaaatatgcccctatcgtgtcgttcgaagaatgtgagcgcaaattcaaggctacagaaaaggaactgaaggatcaattgtcagaacagacacagaaatatagtgtgagtgaggaagaagttaaaaagaacaaacaggagaatgacaagctgaaaaaggagatcttcacactgcagaaagaccttcgcgacaaaacagtactgattgagaagtcccatgagatggagcgtgccttgtccaggaagacagacgagttaaataagcagctgaaggacctctcacagaaatatacggaggtaaagaatgtaaaggagaagctagtggaagagaacgccaaacagacatccgagatccttgccgtgcaaaatctgttacagaagcagcacgtgccattggaacaagttgaggccttaaagaagagcctgaatggcaccatcgagaaccttaaggaagagctcaagagcatgcaaagatgttacgaaaaagaacagcagactgtaacaaagctgcaccaacttttagagaaccagaagaatagctctgtgcccctcgccgagcacctgcagattaaagaggcctttgagaaagaagtaggaatcatcaaggcctctttacgcgaaaaggaagaagagtcccaaaataaaatggaagaggtgtctaaactccagtccgaggtgcagaatacaaagcaagccttgaagaaacttgagacccgggaggtggtcgatttgagcaagtataaggccacgaagtcagatctggagacacagatatctagcttaaatgaaaagctggctaacctcaacaggaaatacgaggaggtctgcgaggaggtcctacacgctaaaaagaaagaaatctccgccaaggacgagaaagaattgttgcactttagtatcgaacaggagatcaaagatcagaaagagcggtgcgacaagtctttgaccacaatcaccgaattgcagcggagaatccaggagtccgcaaagcagattgaagctaaagacaacaagattacggaactgttgaacgatgtcgaaaggcttaaacaagcccttaacgggcttagccagctcacctataccagcgggaatccaacaaaacgccagtcccagctcattgacacccttcagcaccaggtcaaatctctggagcaacagctggccgatgccgataggcagcaccaagaggtgattgctatttaccgaacccacctgctgtccgctgctcaagggcacatggacgaggacgtgcaagaggctctgcttcagatcatccagatgagacaggggctggtctgttag

SEQ ID NO: 246441 - DNA, 4212 bp, Artificial Sequence
  Description of Artificial Sequence: Synthetic coding sequence
atgatgaattgctggttttcttgcacccctaaaaatcggcatgctgccgactggaataaatatgatgatagactcatgaaagccgcagagcggggagacgtcgaaaaggtaactagcatcctcgcaaagaaaggcgtcaacccgggtaagttagacgtcgaggggaggagcgtcttccatgtggtgactagtaaaggcaatctcgagtgtttaaatgccatcttgatccacggggtagatataacgacatctgatactgctgggaggaatgcactacatttggccgcaaaatacgggcacgctctgtgcctgcagaagctcttgcagtacaattgtcctaccgaacacgcggacctgcaggggagaaccgccctgcacgacgcagccatggccgattgcccgtcctctatacagctgctgtgtgaccacggtgcgtctgtgaatgccaaagacgtcgacggacgaacccccttggtgctggcaacacagatgtctaggcccaccatttgccagctcctgatcgatcggggtgccgatgtgaatagccgcgataagcagaaccgcaccgccctcatgttaggatgcgagtacgggtgtagagatgcagtggaagtgctcatcaagaacggagccgacatctcattactggacgccctgggacacgattcatcctattacgctaggataggcgacaatctggatattctgaccctgctcaagaccgcatctgagaacaccaacaaaggcagagagctgtggaaaaaaggcccatctcttcagcagagaaacctaactcatatgcaggatgaagtgaatgtgaaatcgcaccagcgcgagcatcaaaatattcaagacctagagatagaaaacgaagatttaaaggagaggctgcgcaagatccaacaagagcagaggatcttgctcgacaaagtgaatggtctgcagcttcagctgaacgaggaagtgatggtggccgatgacctggagagtgagagggagaaactcaaatccttattagccgctaaggaaaaacagcatgaagagtctctgagaactatcgaagctcttaaaaaccgctttaaatattttgaatctgatcaccttggcagcggctctcactttagcaacaggaaggaggacatgttgctgaagcaaggccaaatgtatatggctgattctcagtgtacaagtcccggtattccagcccacatgcagtcaagatccatgttgaggccactggagctgtccctaccttcccagacatcctactctgagaacgaaatccttaagaaggagctggaagccatgcggaccttctgcgagtccgctaagcaggatagattaaagctccaaaatgaactggcccacaaggtcgccgaatgtaaggccctcgccttagaatgtgagcgggtcaaggaggatagcgacgagcagatcaagcagctggaggatgcactcaaggacgtacagaagcggatgtatgagtctgagggcaaagtaaaacagatgcagactcatttccttgctttgaaagagcatttgaccagtgaagcggcatctggcaatcaccgcctcacagaagagctgaaagaccaactcaaggacctgaaggtgaagtatgagggggcttccgctgaggtgggtaagctcagaaatcaaatcaagcaaaacgagatgatcgtggaggagttcaaacgcgacgaggggaaactgatcgaggagaataaaaggctccagaaagaattaagcatgtgcgagatggaaagggagaaaaagggacgtaaggtcacagaaatggagggacaggccaaagagttgtcggccaaattagctctctccatcccggcagagaagttcgagaatatgaaaagctctctctccaacgaagtgaatgagaaggccaagaaacttgttgaaatggaaagggagcacgaaaagagtctgtctgagatccgccagctaaaaagagaactggagaacgtgaaagctaagctggcccagcacgtaaagccagaggagcatgaacaggtgaagagcaggttggaacagaagtctggcgaactagggaaaaagattactgagctcactctaaagaaccaaaccctgcagaaggagatagaaaaggtctatctggataataagttgctcaaagaacaagcacataatctgacaatcgaaatgaaaaatcattatgttccacttaaagtctctgaggacatgaaaaagagccatgacgctatcatcgacgacctcaacagaaaactgttagacgtaacccagaagtataccgagaaaaagctggagatggaaaaacttttgctggagaacgacagcctgagcaaggacgttagcagattagagaccgtcttcgtgcccccagagaaacacgaaaaggagatcatcgccttgaagtctaatattgtcgagcttaagaagcagctgagcgagcttaagaagaaatgcggagaggaccaggagaaaattcacgctcttactagtgaaaatacaaacttgaagaaaatgatgtcaaaccagtacgtgcctgtcaagacccatgaagaagtgaagatgaccctcaacgatacgctagcgaaaacgaaccgtgagttgctcgacgtgaagaagaaatttgaggatatcaaccaggagttcgtcaagataaaggataaaaacgagattcttaaacgcaacctagaaaacacgcagaatcaaatcaaagcagagtacatttccctggccgagcatgaagccaaaatgtccagcctgtcccaaagcatgcggaaggtgcaggactctaatgctgaaatcttggccaactatcggaagggtcaggaagagatagtcaccctgcacgcagagataaaagcccagaagaaggagctggacacgatccaggaatgtataaaggttaaatacgcacccatcgtgtctttcgaagagtgcgaacggaagttcaaagcaacagagaaggagctcaaagatcagcttagcgagcagacacagaagtactcagtatccgaagaggaggtaaaaaagaacaaacaggagaatgataaactgaaaaaagagatctttacactgcagaaggatctgcgggataagacagtgctcatcgaaaaatcccatgagatggaacgggcattgtcgcgaaagacggacgaattgaacaaacagctcaaggacctgtcccagaagtatacagaagtcaaaaatgtaaaagagaagttggtcgaagaaaatgcgaagcagacttcagaaatcctggccgtacagaacttgctgcagaaacaacacgttcccctggagcaggtggaggcgcttaaaaaatctctgaacggcacaatcgaaaatttaaaagaagaactaaagtctatgcagcggtgttatgaaaaggagcagcaaactgttactaaactgcatcagctccttgaaaaccagaagaactcaagcgtcccactcgccgaacacctacagatcaaggaggccttcgagaaggaggtaggcatcataaaggccagtctgcgcgagaaagaagaggagagtcagaacaaaatggaagaagtcagcaagttgcagtctgaggtgcagaatactaagcaggcccttaaaaaacttgagactagggaggtggtcgacctgtctaaatataaagccaccaagtcagatctggagactcagattagcagcttgaatgaaaaattggcaaatttgaatcggaaatacgaagaggtgtgcgaggaggtcctccatgctaagaagaaggaaatttcagcaaaggatgaaaaggaactccttcacttcagtattgaacaggagatcaaggaccaaaaggagcggtgtgataaaagcctcaccacaatcaccgaactccagcgcaggattcaagaaagtgctaagcagatagaagccaaagacaacaaaatcaccgaactgctgaatgacgtagagagactgaagcaagctctgaacggactgtctcagctcacctacacgagcggcaatccaacgaaaaggcagagccagctaatcgacaccctgcaacaccaggtgaagtcgcttgagcagcagcttgctgacgcggatagacaacaccaggaagtcatagccatctataggacgcacctgctgtcagctgcccagggacacatggatgaagatgtgcaggaggcccttctgcaaatcatccagatgcgccagggtctggtatgctag

SEQ ID NO: 246442 - DNA, 1686 bp, Artificial Sequence
  Description of Artificial Sequence: Synthetic coding sequence
atgatgaattgttggttctcttgtactcctaagaaccgccatgcagccgactggaacaagtatgatgatagacttatgaaggcagccgagcggggtgacgtggaaaaagtaacgtcaatcttagctaagaaaggggttaatccaggcaaactggacgtggaaggacgcagcgtttttcacgtagtgaccagtaagggcaaccttgagtgtttaaatgcaatactcattcacggggtagatatcaccacctcagatacagcgggacgaaatgctttacatttggcagccaagtatggacatgctctttgtctgcagaagcttctgcagtataactgtcctactgagcacgcggatctccaggggagaaccgcccttcacgacgccgctatggccgattgtccttccagtatccaactgctgtgcgatcatggcgcatccgtcaatgcaaaagatgtagacgggaggactccactcgttctggccactcagatgagtcgaccgacgatctgtcagcttctgattgaccgtggagccgacgtcaacagtagggacaagcagaaccggactgctctgatgctaggatgcgagtatggttgtcgagatgctgttgaggtcttaattaaaaacggcgctgatattagtctcctggacgccctgggacatgactcaagttactatgccagaataggagacaaccttgacatattgaccctgctgaaaacagcttccgagaacaccaacaaggggagagagttgtggaaaaaaggcccaagtttgcagcagagaaatcttactcacatgcaggacgaagtaaatgtaaaaagccatcaaagggagcaccaaaacattcaggacttagaaattgaaaatgaggatctgaaggaaagattgcggaaaattcagcaagaacagaggatcctgcttgataaagtgaacggtttacagctgcagttaaacgaacgtgagaagctcaaatccttgctggccgcaaaggagaagcagcacgaagaatccctcagaacaattgaggctctgaaaaatcggtttaaatatttcgagtccgaccacctggggagtggaagccactttagcaatagaaaggaggacatgctgttaaagcagggtcagatgtacatggctgactcgcaatgcactagcccaggtatcccggctcacatgcagtccaggagcatgctgcggcctcttgagttgtccttgcccagtcagacttcatattcagagaacgaaatcctgaagaaggagctggaagccatgcgcactttctgcgagtctgcgaaacaggacaggttgaagttacagaacgaacttgcccacaaggtggccgaatgcaaggcccttgccttggaatgcgaacgggtgaaagaggattctgatgaacagatcaagcagttagaggacgcccttaaagacgtgcagaagagaatgtacgaatccgaaggaaaagtgaaacagatgcagactcacttcctggcactgaaagaacatttgacaagtgaagccgcatctggcaaccacagactcaccgaggaactcaaggaccaactgaaggatctgaaggtgaagtatgaaggcgcatccgccgaggtgggaaagctgaggaatcaaataaagcagaacgagatgatcgtggaggaattcaaaagggacgaaggcaaactcatctag

SEQ ID NO: 246443 - DNA, 4206 bp, Artificial Sequence
  Description of Artificial Sequence: Synthetic coding sequence
atgatgaactgttggttctcatgtacgcctaaaaatcgacatgctgccgactggaacaagtatgacgaccggttaatgaaagctgcagaacgtggagacgttgaaaaagtaaccagtatcctcgccaaaaaaggagtgaacccgggtaaactggacgtggagggtcgatctgtgttccatgtggtgacttctaaaggcaacctagaatgtctcaatgccatcctcattcacggagtggacatcacaacaagtgacaccgccggacgaaacgccctgcacttagctgcgaagtatgggcatgccctctgtctgcagaagctgttacagtacaactgtcccaccgagcatgctgacctccagggcagaaccgcactgcacgatgcagctatggcggactgccctagctccatacagttgctttgtgatcatggagccagcgtcaacgcaaaggacgtggacggcaggacacccttggtccttgcaacccaaatgtcacggcctacaatctgtcagttgctgatcgacaggggggctgatgtgaattcccgagacaaacagaataggaccgctcttatgctcgggtgcgagtacggatgcagggatgcagtcgaggtgctgattaaaaatggagcagacatatccctccttgatgctctgggacatgatagcagttattacgcccgaatcggagataaccttgatattttgactctgctgaagacggcatctgagaacaccaacaaagggagagagttgtggaaaaaaggaccttccctgcaacagagaaacctgacacacatgcaggacgaagttaacgtcaagtcccatcagcgcgagcaccagaacatccaggatctggagatcgagaacgaagacctgaaagagagactaagaaagattcaacaggagcaacggattctgttagataaggtcaatggactgcagcttcagctgaatgaggaggtcatggtggccgacgatctggagtctgagcgcgagaagctgaaaagtctgctggcagccaaggagaagcagcacgaggagtctctgcggaccattgaggccctcaaaaatagatttaagtattttgaaagtgaccacctcggctcaggatcccactttagaaaagaggatatgttactgaaacaagggcagatgtacatggcggacagccagtgtacctctccgggaattcccgcacacatgcagagccgcagtatgcttaggccgttggagttatccctgccatcacagacctcctacagcgagaacgagatcttgaaaaaggaattggaggcaatgcggactttctgcgagagcgccaaacaggacagattaaagttgcaaaatgagctggcccacaaagtggccgaatgcaaggcacttgcactggagtgtgagcgagtgaaggaggactcagacgagcagataaagcagcttgaggacgcattaaaggacgtacagaaacgcatgtacgaatcagagggcaaggtcaagcagatgcagacccattttctggccctgaaagaacacctcaccagtgaggcggcatcggggaaccaccgcctgacagaagaattaaaagatcagcttaaagacttgaaggtgaagtatgagggagcatcagctgaggtcgggaagcttaggaaccagatcaaacaaaatgagatgatcgtcgaagagtttaagcgcgacgaaggaaaacttattgaggagaacaagcgtctccagaaagaattatccatgtgtgagatggagagggagaaaaaggggcgaaaggtcaccgaaatggagggacaggccaaggaactgtcagctaagttagccttatctatccctgccgaaaaatttgaaaatatgaagtcatctctgagtaatgaagtaaacgaaaaggccaaaaagctcgttgagatggagagggaacacgagaagagcctgtctgaaattcgtcagctgaagagagaactcgaaaacgttaaagccaaactcgctcagcatgttaagccggaagagcacgagcaggttaagtctcgacttgaacagaaatcaggcgaactcggcaagaagataaccgagttgacactgaaaaaccaaacattgcagaaagagattgagaaggtgtatctagacaacaaactcctaaaagaacaggcccacaacctgactattgaaatgaagaaccactacgttccccttaaagtgtctgaagatatgaagaaaagccacgacgctattattgatgacttaaatcgcaaactcctggacgtcacacagaagtataccgagaaaaagttggagatggagaagctgctgctggaaaacgatagcctttccaaagatgtttcgcgcctggaaaccgtgttcgtgccacctgagaaacacgaaaaggagattatagcgctgaaaagcaatatcgtcgagttgaaaaagcagctgagtgagctgaaaaaaaaatgcggagaggaccaggagaagattcatgctttaacatcagagaatactaatcttaaaaagatgatgagtaatcagtatgtgccagttaaaactcatgaagaagtgaagatgaccctgaacgatacattagctaaaaccaatcgggagctgctggatgtgaagaaaaagtttgaagatatcaatcaggagtttgtaaagataaaggacaagaacgagattctgaagagaaacctcgagaacacccagaatcagattaaggctgagtatataagtctcgcagaacacgaggcgaagatgtcctcactcagtcaaagcatgaggaaggtgcaagactcaaacgccgagatccttgccaactatcggaagggccaggaagagatcgtgaccctgcacgcagagataaaggcccagaagaaagagttggacacaatacaagaatgcatcaaggtgaaatacgctcccattgtgagctttgaggaatgtgagcgaaaattcaaggccaccgaaaaagaacttaaggatcagctttccgaacagacacaaaagtattctgtttccgaagaagaagtgaaaaaaaataagcaggagaacgataagctcaagaaggaaatattcacactacaaaaggatctcagagataagactgtcctgatcgaaaaatcccatgagatggaacgcgctctgtccaggaaaactgacgagctgaataagcagcttaaggatttaagtcagaaatacaccgaagtcaaaaatgtaaaagagaaattggtggaggagaatgcaaaacagacatccgaaatcctagctgttcagaacttacttcagaagcagcacgttccactggaacaggtggaggctctgaaaaagtccctgaatggcaccatcgagaacttgaaagaagaacttaaaagtatgcagcgatgttacgaaaaggagcagcagacagttacgaaactgcatcaactcctcgaaaaccagaagaattctagcgtgccattagcagaacatctgcagataaaggaggcctttgaaaaagaagtcggtattatcaaagcatccctcagagagaaagaagaggagtcccagaataaaatggaggaagtatcaaagctgcagtccgaagtccagaatacaaaacaggcgctgaagaagcttgaaacaagagaagtagttgacttgtctaagtataaggcaactaaatctgacttggaaacccagatatctagcctgaatgagaagctggccaacctgaatcgcaaatacgaggaggtgtgtgaagaagtgctgcacgccaagaaaaaagagatatcagccaaagatgagaaagaactactccatttttcaattgagcaggagatcaaggaccagaaggagcgctgcgacaagtcattgacgactatcactgaactgcagcgacggatccaggagtccgccaagcaaattgaggctaaagataacaaaatcactgaacttctgaatgacgtggaaaggctgaaacaagcactgaacggactttcacagcttacctacacgtccggcaacccgactaagcgtcagtcccaactaatcgatacgctccagcaccaagtgaaatccctggagcaacagctagctgatgctgaccgccagcatcaggaggtgatagctatataccgtactcacctgctttcggccgctcaaggccatatggacgaggatgtccaggaggccttgctgcagattatacaaatgcgtcagggcttggtttgttag

SEQ ID NO: 246444 - DNA, 3195 bp, Artificial Sequence
  Description of Artificial Sequence: Synthetic coding sequence
atggtgcttggtacagttttactgccgcctaattcctacggcagggaccaggacacatcactttgctgcctctgcacagaggctagtgaaagcgctctgcctgaccttacagaccactttgcatcctgtgtcgaggacggatttgagggggacaaaaccggaggcagctcccccgaggctctccacaggccatatgggtgcgacgtcgaaccacaagctctgaatgaggctatccggtggagctccaaggaaaatctgctgggcgcaaccgaatccgatcctaacctgttcgtcgccctttacgatttcgttgcttccggcgacaacacattgtccatcacaaaaggcgagaaactacgcgtcctgggatataatcaaaatggggagtggtcagaggtaaggtcaaagaatgggcagggatgggttccaagcaactacatcactccggtgaattctctggaaaagcattcatggtaccacggccctgtgtcccgaagcgccgcagaatacctcctctccagtctcatcaatggatctttcctggtacgggagtccgagagctctccaggacagctgtcaatttctctccgatatgagggacgagtctaccactacagaatcaacaccacagctgatggaaaggtctacgtgacggctgaaagtagatttagcactctggccgagctggtgcaccaccacagcactgtagccgatggactggtgactacgttacactaccctgccccaaaatgtaataagcccacagtgtacggagtcagtcctatccatgataaatgggagatggagagaactgacattactatgaagcacaaactgggcggaggtcagtatggtgaggtttacgttggcgtttggaaaaagtattccttgaccgtggccgtgaaaactttgaaggaagacaccatggaagtggaggaattcctgaaagaagccgcagtgatgaaggagatcaagcaccccaacctggtgcaattgctcggagtctgcacactcgagccccctttttatatagtgacagagtatatgccatatgggaatctcctcgattatctgagggagtgcaacagagaagaggtcacagccgtggtgcttttgtacatggccacgcaaatatccagtgccatggaatatctggagaaaaagaacttcatccacagggatctcgctgctagaaattgtttggtcggcgaaaatcatgtggtgaaagttgcagatttcggattgtcaaggttgatgactggggatacttataccgctcacgcgggtgcaaagtttcctatcaagtggacagcacccgagtcacttgcgtataacactttttctattaaatctgatgtctgggcgtttggtgtcttgctgtgggagattgccacatatggcatgagcccataccctggcattgacttgtctcaagtctacgatctcctggaaaaaggataccgaatggaacagcctgagggatgccccccaaaagtgtatgaacttatgcgggcatgctggaaatggtcgcctgcagaccggccatccttcgcggagacacatcaggcctttgaaactatgtttcacgattcctctattagtgaggaagtggctgaggaactgggcagggccgcatcatccagttccgtggtcccttacctgcctcgcctacccatacttcccagcaaaacaaggactttgaagaagcaagtggagaacaaggagaacatagagggagctcaggatgcaacggagaacagtgcctcttcgctagcccctggtttcattagaggcgcacaggcttcttctgggtcgccggctctgccgaggaagcagcgcgataagtcccctagcagcctcctggaggacgcgaaagagacctgtttcacccgcgatcggaagggcggtttcttttcatcctttatgaaaaaacgcaacgcccctactccccctaagcgatccagcagctttcgggagatggagaatcaaccgcataaaaagtacgaactgaccggactccccgagcaagaccggatggcaatgaccctccctagaaattgccagaggtccaaacttcagctggagcgtacagtgtcaacctcctcgcagcctgaggaaaacgtagaccgggcaaacgatatgctcccaaaaaagagcgaggagtccgctgccccaagtagggaaaggcccaaagccaaactcctgccccgtggagctacagcactaccgcttcggaccccgtccggggacctggctataactgagaaagacccgccaggggtaggtgtcgcaggggtggcagccgctcctaaaggaaaggaaaaaaatggcggagcacgactgggcatggcaggagttcctgaggatggagaacagccgggatggccctctccagctaaggcggctccggtcctgccaacaacacacaaccacaaagtgcccgtcctgatttctcctaccctcaagcacactccggcagacgtgcagcttattggcacagattctcaaggcaacaagttcaaattgctgtctgaacaccaggtaacttcgtcaggcgacaaggacaggcctagacgcgtgaaacccaagtgcgcgccacccccaccaccggtgatgcggttgctgcaacaccccagtatctgcagcgacccgactgaagagcctaccgctttgacagcaggtcagtcaacttccgagactcaagaaggagggaaaaaagccgcactgggcgctgtgccaattagtggcaaggccggacgccctgtgatgccccctccgcaggtgcctctccccactagcagcatttctcctgccaaaatggctaacggcactgcaggaaccaaagtggccctacgtaagaccaaacaggctgccgagaaaatatcagccgataaaatctcaaaggaagccctcctcgaatgtgccgacctgctgtccagcgccttgaccgagcccgtgccaaattcacagcttgtggacaccgggcaccaattgctcgattattgctcaggctacgttgactgtataccgcagaccagaaacaagtttgccttccgagaagcagtgtctaaactggaattatctcttcaggagctgcaagtgtcgagcgctgccgcaggagtacccggaaccaaccctgtcctaaataatctgctcagttgtgtacaggagatttctgacgtcgtgcagagatag

SEQ ID NO: 246445 - DNA, 1629 bp, Artificial Sequence
  Description of Artificial Sequence: Synthetic coding sequence
atgggccagcaagtgggacgggtgggggaggcacctgggctgcagcaaccacagcccaggggcatccgtggatcttccgctgcacggcctagtggcaggcgccgagatcctgccggaaggaccaccgaaaccggttttaatatctttacacagcacgaagcactgcacaggccctacggctgtgacgtcgagccacaagccctaaacgaggccattaggtggtcttcgaaggaaaatctgctgggcgcaactgagagcgacccgaatctgttcgtcgcgctgtatgacttcgtggcttcaggggacaacaccttatctatcactaaaggtgaaaagctcagagtcttgggatacaaccagaatggcgagtggtcagaggtgcgctccaaaaacggccaggggtgggtcccctcgaactacattactcccgtcaattctttagagaaacactcatggtatcatgggcctgtgagccggtctgccgcagagtaccttctttcatccctcattaatggcagctttctggtgagagaaagtgagtcgagccctgggcaactcagcatcagcttgcggtacgaagggagggtgtaccactatcggatcaacacgactgccgacggtaaagtctacgtgacagcggagagccgttttagtacccttgccgagctggtgcatcaccattctaccgtggcagacgggctggttaccaccctgcactatccagctcccaaatgtaataagcccacagtgtacggagtctccccaatccacgacaaatgggagatggaaaggacagacataaccatgaaacataaactaggcggaggccagtatggagaggtctacgtgggggtgtggaaaaaatactcattgaccgttgctgtgaagaccctcaaggaggatacaatggaggtggaggagtttctgaaggaagcggcagtgatgaaagaaatcaagcatcccaacttagtgcagctcctgggtgtatgcacgttggagccccctttctatatagtgactgaatacatgccatacggtaacctgctcgactatttaagggaatgtaatcgggaagaggttacagctgttgttttgctgtacatggctacccagatatcttctgccatggagtacctcgaaaagaagaacttcattcacagggatctggctgccagaaattgcttggtgggggaaaatcacgttgttaaggtggcagactttggcctgtcaagacttatgaccggggacacctataccgctcatgctggagcgaagttcccgatcaaatggactgcgcctgaaagtctagcatacaatacgttttccattaagtcagatgtgtgggcgttcggagtgctactatgggagattgcaacttatggaatgagcccttacccagggattgatctgtcccaggtttatgaccttctggaaaagggatacagaatggaacaaccagaggggtgccctcctaaggtctacgaacttatgcgggcttgttggaaatggtcgcctgccgacagacccagcttcgctgagacccaccaagcctttgagacgatgttccatgactcttcaatttctgaagtcctcttgcattgcgcaaatcagacctgcatcacactgtag

SEQ ID NO: 246446 - DNA, 3441 bp, Artificial Sequence
  Description of Artificial Sequence: Synthetic coding sequence
atggtactggggacagtcctcttacctcccaatagctatgggagagaccaagacacttcactgtgctgcttgtgtacggaggccagcgaatctgcactgccagacctgactgaggcactccaccgaccgtatgggtgtgatgtcgagccgcaggccctgaacgaggcaatacggtggtcatcgaaagagaacctcttaggggctactgagtctgacccaaacctcttcgtcgccctgtacgacttcgtggccagtggggacaacactctcagcatcacgaaaggggagaaactccgcgtactgggctataaccaaaacggagaatggagcgaagtccggtctaagaacggacaggggtgggttccttcgaattacatcacccccgtgaactcgctggagaagcattcctggtaccacggacccgtgtcacgaagcgccgcagagtatcttctgagttcgctcattaatgggagctttctggtgagggaatcagagtcctccccgggtcaactgtcaatctcactgcgctatgaaggacgcgtttaccattaccgaataaatacgaccgctgatgggaaggtgtacgttaccgcagagtctagattttccactttagcagagcttgtgcatcaccacagcactgtggccgatgggttagtcactacacttcattatcctgcaccgaagtgcaataagccaacagtatatggggtgtccccaatccacgataagtgggagatggagcgcacggacatcaccatgaaacataaattgggcggaggccagtacggtgaagtgtacgtcggcgtttggaaaaagtattctcttacggttgccgtgaagaccttgaaagaagatactatggaagtcgaagaatttcttaaagaagcagcggttatgaaagagatcaagcatcccaatctggtacaactgttgggtgtgtgcactctcgagcctccattctacattgtgacggaatatatgccctacggtaacctgcttgactatctcagggagtgtaatcgggaggaggtaacagcagtggtgctgttatatatggccactcaaataagctcagctatggagtacttggagaagaaaaacttcattcacagggatctggcggcaaggaattgtctagtaggagaaaaccacgttgtcaaagtggccgatttcggattgtcacggttgatgacaggggatacctacactgcgcacgccggtgctaagtttcccattaagtggactgcaccggaatccctggcctacaatacgttcagtatcaagtcagatgtctgggcattcggagtgttgctttgggagatcgccacatacggaatgagcccctatcccggtatcgatctaagccaggtgtatgacctccttgaaaagggctaccgcatggaacagccagaaggatgtcctcccaaggtctatgagcttatgagggcatgctggaagtggtcaccggctgatcgaccctcttttgctgaaacccatcaggcattcgaaactatgtttcacgattcaagcatatccgaggaagtggcagaggagctgggccgagctgcttctagtagcagcgttgtaccgtatctacctcggcttccaatactgccttcaaaaactagaactctgaagaaacaggtggaaaacaaagaaaacattgaaggagcccaagatgccacagagaatagcgccagttcactcgcaccaggattcatccgaggtgcacaggcatccagcggttcccctgccttgccacgtaaacagcgtgataagtccccaagttcactgctagaggatgcaaaggaaacctgttttactcgggatcgtaaagggggattcttctctagcttcatgaagaaacgaaatgctcctacaccacccaagcgctcatcctccttccgggagatggagaaccagccacataagaaatacgaattaaccgggaactttagcagcgtggcttcgctccagcacgccgacgggttctccttcacaccagctcaacaggaggccaacctggtacctcccaaatgttacggaggctctttcgcgcaaaggaatctgtgcaacgatgacggagggggaggcggaggcagcggaacagcgggtggcggatggtccggcatcaccggcttcttcactccccgactcataaaaaagaccttaggcctacgagcaggcaagcccacagcctccgacgatacgtcaaaaccctttccccgaagtaactcaacaagtagtatgtcttcagggctgcccgagcaggatcggatggccatgacattgccgagaaattgccagcgctctaaacttcagctggagcggactgttagtaccagcagccagcccgaagagaatgtggacagggctaacgacatgctgcccaaaaaatctgaagaatccgcagccccttcacgagaaaggccaaaggcgaagctcttacccagaggcgcaacggccctgccattaaggaccccctcaggtgacctagcaattacagagaaggatcctcccggtgttggggtggcgggagtcgccgcagctcccaagggaaaagaaaagaacggcggagccagactgggtatggccggagtccccgaagacggggagcagcccggttggccttctccggcaaaagccgctccagtactgcctactacccataatcataaggtgcctgtgcttatttctcctaccctgaagcacacaccagcagatgtgcaattgattgggaccgactctcaggggaacaagtttaagctcctgtctgaacaccaggtgacctcttcaggcgacaaagaccgcccacgaagagtgaagccaaaatgtgcccctccacccccacctgttatgaggctgttgcagcatcccagcatttgtagcgaccccacagaagagcccactgcactgaccgctggacagagcacttccgaaacgcaggagggaggcaaaaaggccgctctgggcgcagtgcctatcagcggtaaagctggtcgcccagtgatgccacctccccaggtcccgctgccaacctcatccatctcgcccgctaagatggctaatggtactgcagggactaaggttgcactgcgcaaaactaagcaggccgctgaaaaaatctcggccgataagatttctaaagaggcccttttggagtgtgccgacctgctgagctcagccttgactgagcccgtaccgaatagccagctggttgacactggccatcagcttttggattactgttctggatatgtcgattgcattcctcagacccgtaacaagttcgccttccgcgaggcggtgtcgaagctggagctttccctgcaagaacttcaagtgtctagcgctgctgccggtgtaccaggaaccaatcctgttctgaataatttactttcctgcgtgcaggagataagcgacgttgtgcaaagatag

SEQ ID NO: 246447 - DNA, 3549 bp, Artificial Sequence
  Description of Artificial Sequence: Synthetic coding sequence
atggggcagcaggtcggccgagtcggcgaggctcccggactgcagcagccccagccacgagggatcagggggagctctgcagctaggcccagtggaaggagacgagaccccgcaggaaggactacagaaaccggtttcaatattttcacgcagcacgatcacttcgcctcatgtgtcgaggacggtttcgagggtgacaagactgggggttcaagccccgaagcgttgcataggccatacggttgcgatgtggaaccccaggctctgaacgaggcaatcaggtggtctagcaaagagaatctgctcggtgctacggaatcggaccctaacctgtttgtggcgctttatgacttcgtggcttctggggataacacgctaagtatcaccaagggcgagaaacttagagttctggggtacaatcaaaatggggagtggtcggaagtgcggtctaagaatggccaggggtgggtcccatctaattacattactcccgttaattcacttgaaaagcacagctggtatcatggccctgtttcccggtccgctgctgaatatctgcttagcagtctgattaatggcagctttttagtacgtgagtccgagtcatcacctggacagctctcaatcagcttacgttatgaggggagggtttaccactaccggatcaacactaccgccgatgggaaagtgtatgtgaccgcggagtctcggttctcaactctggccgagctggtccatcaccactctacagtcgctgacggcctggtcactactctccactatccagcacccaaatgtaacaaaccaaccgtctatggcgtgtcaccaattcatgataagtgggaaatggagagaaccgacataacaatgaagcataagttgggtggaggacagtatggcgaggtgtatgtgggggtgtggaaaaaatactcactaactgtggccgttaaaacactgaaggaggatacaatggaagttgaagagttccttaaggaggctgcagttatgaaggagattaagcaccctaatctggtccagctgctaggggtgtgcacactggaaccacctttttacattgtgactgagtacatgccctatgggaatcttctggactacctgcgcgagtgcaatcgggaggaagtcaccgccgtagttctcttgtatatggccacccagattagttcagctatggagtacctggaaaagaagaacttcatccacagggacctcgccgctaggaattgtttggtgggggagaaccacgtcgtcaaagtggcggatttcggcctgagccgactgatgacaggtgacacctatacagcccatgcgggagccaaattccccatcaagtggacagctcccgaatctttagcctataatacctttagtatcaaaagcgacgtgtgggcgtttggagttctgctctgggagatcgcaacgtacggaatgagcccctacccaggaatagatctgtctcaggtgtatgacctgctggagaaaggctaccgtatggagcaaccggagggatgcccaccaaaggtttacgaactcatgagagcctgttggaaatggagccctgcggatagacctagttttgcagaaacccaccaggcctttgaaactatgttccatgattcttcgatctcggaggaagtggcagaggagttagggagggcagcctccagcagctctgtggtcccctacctgcctaggctgcccatactgccgtctaaaaccaggacgttaaaaaaacaggtggagaacaaggagaacattgagggcgcacaagatgcaacagagaattcagcttccagcctcgctcctggattcattcgaggagcacaggcatcatccggctccccagcactgccaaggaaacaacgggacaagtcgccaagctctctgctggaggacgccaaagagacctgctttacgcgcgatcgtaaaggtggtttcttctcttcttttatgaagaaacggaatgctcctacaccaccaaagagatcttcttcttttagagaaatggagaaccaaccgcataaaaaatacgaactgacgggtaacttcagttcagttgcatcgttacagcatgccgatggtttctccttcacccccgcacaacaggaggccaacctagtgccccctaaatgttatgggggtagtttcgcccaacgcaatttgtgtaatgacgacgggggaggcggaggaggtagcggaaccgcaggcggtgggtggtccggtatcaccgggtttttcacacccaggcttataaaaaagacacttggacttagagccggtaagcctaccgcctctgacgatacgagcaagcctttccctaggagcaacagcacctcctccatgagtagcggtctgcccgagcaggatcgcatggcgatgaccctccctagaaactgtcagcgcagcaagcttcagttggaacgaactgtgtctaccagctcccaaccagaggagaatgtcgatcgcgctaatgacatgctgccaaaaaagtccgaggagtctgccgcaccaagccgggagagaccaaaagctaaactgttgccaagaggtgccaccgctctcccattgagaacacctagtggtgatctggccattacggaaaaggaccccccaggagtcggcgtagcaggggtggccgcagcaccgaaaggaaaggaaaagaacggtggggctagacttggaatggctggcgtaccagaagatggagagcagccaggctggccttcaccggctaaggccgctcctgtgctgcccacaacacacaaccataaggtacccgttctgattagccctaccctgaagcacacacccgctgatgtgcagctgataggtacagacagccagggcaacaagttcaagctccttagtgagcatcaggttacgtctagcggtgacaaggatcgtccacgtcgcgtgaagcctaagtgtgctcctcctcccccaccagtgatgcgcttgctgcaacatccttctatctgctcagatcctaccgaagaacctactgcactgaccgcgggtcaatccacctctgaaacacaggagggaggaaaaaaggccgctctgggcgcagtgccaatatccggaaaggccggtcgacccgtcatgccccctccccaggtccccctcccaacgagctcaatctctcccgctaaaatggctaacgggacagccggaaccaaggtagctttgcgaaaaactaagcaagccgcagagaaaatctctgcagataagatctccaaagaggccctcctggagtgtgccgatctgttgtcttcagcgctgactgagcccgtccctaacagtcagctggttgacactgggcatcagctgctggattactgtagtgggtatgtcgattgtattccccagacccggaacaagttcgccttcagagaagccgtgagcaaactggagctttcactacaggagctgcaagtttcttccgctgctgctggagtgccaggaaccaatcccgtattaaacaacttgttatcatgcgtccaggaaattagtgatgtggttcaacggtag

SEQ ID NO: 246448 - DNA, 3132 bp, Artificial Sequence
  Description of Artificial Sequence: Synthetic coding sequence
atggtcctggggacagtgttactccctcccaacagctacgggagagaccaggacacaagtctgtgttgcctgtgtaccgaagcttcagagtcagcgctgccagatctgacagaggcactgcaccggccttatggatgcgatgtcgaacctcaggctctgaacgaggccatccgttggtcctctaaggagaatctcctcggcgcaaccgaaagtgatccaaatctctttgtcgccctttatgatttcgtagcctccggagacaatactctgagcataactaagggggagaaactgcgagtcctaggatacaaccagaatggagaatggagcgaggtccggagcaagaacggccaaggttgggtaccatccaattacattacgccagtcaactctctcgaaaagcactcgtggtaccacggtccagtctcccgaagcgcagcagaatatcttctgtcaagcctcattaacggctcatttctggtgcgcgagagtgagtccagcccaggtcagctttcaatctcactcagatacgaaggtcgcgtgtatcactaccgaatcaatacgactgcagatgggaaggtttatgtgacagctgagtcgaggttctctaccctggcggaactagtccaccaccatagtacagttgctgacggactcgtgaccactctccattatccagcgccaaaatgcaacaaaccaactgtctatggcgtgtcgcccatccatgataaatgggaaatggagcggactgatatcaccatgaagcataaattgggtggcggacaatacggggaggtgtatgtgggcgtctggaagaagtactcactgaccgtcgccgttaaaacgctgaaagaggacacaatggaggtggaagaattcttgaaagaggcagctgtgatgaaagagattaaacacccaaatctggtgcagctgctcggtgtctgtacgcttgagccaccattttacatagtgactgagtatatgccatacgggaatcttttggactacttgagagagtgtaacagagaggaagtcactgccgtcgttcttctgtacatggcaacccagattagctctgcaatggagtatcttgagaaaaaaaatttcattcatcgcgacctcgctgctagaaactgccttgtcggggaaaatcacgttgtgaaggtagcagactttggcctctccaggctcatgaccggagatacatatactgcacatgcaggcgcaaaatttccaatcaagtggactgcgcctgagtcacttgcatacaacaccttcagtatcaagagtgacgtttgggcctttggcgtgctgctatgggaaatcgctacatatggtatgtctccatatcccggtatagacctgtcacaggtatatgacttgctcgagaagggatacagaatggaacagccagagggctgcccccctaaagtctacgaactcatgcgcgcttgctggaaatggtctccagcggaccggccttcatttgccgagacccaccaagcgtttgagaccatgtttcatgactcttctatttctgaggaggtcgctgaggagttgggacgagctgctagttctagttccgtggtgccttacttgccacgactgccaatccttccgagtaagactcgtactctcaagaagcaagtagagaacaaggaaaatatcgagggagcccaggacgccactgaaaactcagcctccagtttggcgccaggattcattcggggagcccaggcaagtagtggaagtcctgccttgcctagaaagcagagagacaagagccctagttcactgctggaagacgcgaaggagacctgtttcacaagggacaggaagggagggttcttttctagtttcatgaagaagagaaatgcgcctacacccccaaaaagatcctcttcctttcgggagatggagaatcagccccacaaaaagtacgaattgaccggcttgccagagcaggatcggatggccatgaccctacccagaaactgtcagagatctaagctgcaactggaaagaactgtcagtacaagctcccaacctgaggaaaacgtagaccgcgcaaacgacatgcttcccaaaaagtcggaagaatccgcggcaccgtcccgagaaagacccaaggcgaaactgctgccgaggggtgcgacagccctccctctaagaacccctagtggggatcttgctattaccgaaaaagaccctccaggcgtgggtgtggccggtgttgccgctgctcctaaaggaaaggaaaaaaacggtggtgctcgcttgggcatggcaggggtgccagaggacggagagcaacccggatggccatcaccggcaaaggcagctcccgttctccctacaacccacaatcataaggtcccagtcctaatttcccctacgctaaaacatacgccagctgatgtgcaactcatcggaaccgactcccagggcaacaagttcaagctcctttccgaacaccaagtgacttcctccggcgataaagaccggccacgtagggtcaagcccaagtgtgcccctcctccacccccagtcatgagattgcttcagcaccccagcatctgcagtgacccaaccgaggagcctacagctctgacagctggacagtctacgtccgagacacaggaggggggaaagaaagctgccctgggcgcagtgcccattagcggtaaagccggaaggccagtgatgcctcctcctcaggtccccctgcctacaagttcaatctctcccgcaaagatggccaacggaacagcaggcacaaaagtggcactgaggaaaacgaagcaggccgctgaaaagatatctgccgataaaataagcaaagaggccttgctcgaatgtgccgacctgttgtctagcgcgctgactgagccagtgcccaactcacaactggtagatactgggcatcagctgctcgattactgctccggctatgtagattgcattccacagacccggaacaagttcgctttccgcgaagctgtgtcaaagttggaattaagcctgcaagagctacaagtgtcaagcgcggcagccggtgtgcctggcaccaaccctgtgcttaataacctgctctcatgcgtgcaggagatttcagacgtggttcagcgctag

SEQ ID NO: 246449 - DNA, 3504 bp, Artificial Sequence
  Description of Artificial Sequence: Synthetic coding sequence
atggttctgggcactgtcctgttgccccctaactcttatggcagagaccaggataccagtctgtgttgtctttgtacagaggcaagtgagtccgctctgcccgatctcacagaccacttcgccagctgcgtggaagatggcttcgaaggcgacaaaacaggaggttcgagcccagaagccctgcaccgcccatacggatgtgacgtagagccgcaggccctgaacgaggccatacgctggtcgtctaaagagaatctcctaggagccaccgaatcagatccaaacctgttcgtggctctgtatgacttcgttgcttccggagacaacactctgagcataaccaaaggagaaaaacttcgcgtgttaggttacaaccaaaatggagagtggtccgaggtacgatcaaaaaacggccaaggttgggttcctagcaactacattacccccgtcaattccttggaaaagcatagttggtaccacggcccagtgagcagaagcgccgctgagtacctcttgagttccttaatcaatggaagtttccttgtcagggagtcagagtcttctcccggacaactttcaatttcactgcgttatgaggggagagtataccattatcgcataaatactaccgccgacggcaaggtctatgtaactgcagagtccagattctctaccctggctgaactggttcaccaccattcgactgtggccgatggactggttactacgctgcactacccagctccaaaatgtaacaagccaaccgtctatggcgtcagcccgattcacgacaagtgggagatggagaggactgatatcacaatgaagcataagctaggaggagggcaatacggagaagtttacgtgggtgtgtggaaaaagtactctctaacagtggctgttaaaactttgaaagaggatactatggaggtggaggaatttctgaaggaggccgctgtgatgaaggagattaagcatcccaaccttgtgcagcttttgggggtgtgtaccctggaacccccattttacatagtcactgaatatatgccctacgggaacctgctcgattatttaagggagtgtaaccgcgaggaagttaccgccgtggtgcttctgtacatggctacacagatctcttccgctatggagtatttggaaaaaaagaactttatccatagagatttggcggctcgcaattgtcttgtcggcgaaaaccatgttgtcaaggtggctgacttcgggctctcgcgcctgatgactggcgatacgtacacagcgcatgcgggagccaagttcccgattaaatggactgcccctgagagtctggcctataacacattttccatcaagagtgatgtgtgggcatttggcgtcctgctctgggaaatagccacatacggaatgtccccctatcccggtatcgacctttctcaagtgtacgacctgttggagaagggataccgaatggagcaacctgagggatgtccgcctaaagtgtatgaactcatgcgagcttgttggaaatggtctcccgctgatcggcctagtttcgcagagactcatcaggcttttgaaacaatgtttcatgatagtagtatcagcgaagaagttgctgaggaactaggaagagccgcttcaagctcaagtgtggtgccatatctgcccagactgccaatcctcccatccaagaccaggacgctgaaaaaacaggttgagaacaaggagaatatcgagggggcacaagatgccacagaaaacagtgcctcctcattggcaccagggttcatacggggagcccaagcaagctccgggtcgccagctctgccacgaaagcaacgagacaaatctccgagtagcttgttggaagatgctaaggagacatgctttacccgcgatcgcaaagggggatttttctcgagcttcatgaaaaaaagaaacgccccaacaccgcctaaacggagcagcagcttccgtgaaatggaaaatcagcctcataagaagtacgaactaactggcaacttcagctctgttgcaagcctgcagcatgccgatggtttcagtttcacaccagctcagcaggaggctaatctggtgcctcccaagtgctatgggggatcatttgctcagcgcaatctgtgtaacgacgatgggggtggtggaggagggtccggcaccgcaggtggcggatggagtggtatcacagggttctttactccccgtctgatcaagaagaccctgggattaagggctggtaaaccaacagcctcagacgataccagcaagccctttccccgaagcaactccacaagcagcatgagcagcggcctgccagagcaggacagaatggcgatgacgctgccaaggaactgccagcggtcaaaattacaattggagcgtaccgtctccacgtcttcgcagcccgaagaaaatgtggaccgcgcaaatgatatgctgccaaaaaaatctgaggagtccgcggcacctagtagggagagaccaaaagccaaactgttacccaggggagctaccgctctgcctctgcgcaccccgtccggtgacttagcaatcacggaaaaggatccccctggggtcggagtggcaggggtcgccgctgctcctaaagggaaagagaagaacggaggagccagacttggaatggccggagtccccgaagatggggaacagcccggatggcccagcccagctaaggccgcacccgtcctgcctaccacccataatcataaggtccccgtattgattagtcctaccctgaaacacacacctgcagatgtccaactgattgggacagattctcagggtaataaatttaagctgctgtcggaacaccaagttaccagctccggcgacaaggatcgtcctaggcgtgtcaagcccaaatgcgcccctcctcctcccccagtgatgagattgttacagcacccctctatttgcagcgacccgactgaggaacctacagctctcacagcagggcaaagtacaagcgagacacaggagggtggcaaaaaggccgctctaggagcagtacctatctcagggaaggccggaaggccagtcatgccccctcctcaagtgcccctgcctacaagcagcatctcccccgctaaaatggctaacggaactgctggcactaaagtagctctgcgcaaaactaagcaggcagctgagaagataagcgctgataagatctccaaagaagctctcttggaatgcgcagatctgctgtcttctgcgttgacagagccagttcctaattctcagctggtggatactggtcaccagctcctggactattgttctggctacgtggattgcatcccgcaaacccggaataagttcgcctttcgcgaagccgtgagtaagctggaactaagtttacaggaattacaggtcagttccgccgctgctggcgtccctggaacaaatcccgttctgaataatcttctgtcttgcgtgcaggagatcagcgacgtggtgcagcgctag

SEQ ID NO: 246450 - DNA, 3486 bp, Artificial Sequence
  Description of Artificial Sequence: Synthetic coding sequence
atgggtcagcaggtaggtagagtgggtgaggctcccggactgcagcagccccagcccaggggaattagggggtccagcgcagctaggccgtctggaagacggcgtgacccagcagggaggacaactgagaccgggtttaacatcttcactcagcacgaggccctgcacaggccatatggttgtgacgtggaacctcaggccctgaatgaagccattcgatggtccagcaaagagaatttactgggggcaaccgaatctgatcctaacttgtttgtagcactctatgattttgtggctagcggggacaatactctcagtatcaccaagggggaaaaactgcgggttttaggatacaaccaaaacggagagtggtcagaggttagatcaaagaatggccaggggtgggtgcccagcaactacattacccccgtaaattctttggaaaaacattcctggtaccacggcccagtctctagatctgcggctgagtatctgctctctagcctcatcaatggctcctttttagtacgcgaaagcgagtcttcccccggacagttgtcaattagcttacgatacgagggcagggtttaccattaccgcattaacaccaccgccgacggtaaagtgtacgtgactgccgaaagccgattcagcactctggccgagttggtgcaccatcatagcacggtggccgatggcctcgtgacaacgttacactatcctgcacccaagtgtaataaacccaccgtatatggcgtttctcccattcatgataaatgggagatggagaggactgacataaccatgaagcataaacttgggggtggtcagtatggcgaagtgtacgtgggggtgtggaagaagtattccttaaccgtggcggtgaagacccttaaggaggacacaatggaggtcgaagagtttctgaaggaagctgctgtgatgaaagagattaagcaccccaatttagtgcagctactgggtgtttgcacgctggaacctccattctacatcgtcacagagtacatgccctacggcaatctgcttgattatctgcgggagtgtaaccgtgaggaggtgacagccgtcgttctgctgtatatggccactcaaatctccagtgcgatggaatacctcgagaaaaaaaacttcattcacagggatctagccgcacggaactgtttggtaggcgagaaccacgtggtaaaagttgcagacttcggattgtccaggctcatgacgggggatacatacacggctcatgccggagccaagttccctattaaatggacagccccagagtcgcttgcctataacacgttttccatcaaatcagatgtgtgggcctttggagtcctcctgtgggaaattgccacttacgggatgagcccttatccaggaatcgacctgagtcaagtatatgatcttctcgagaaaggctacagaatggaacagccagaagggtgcccgcctaaggtgtacgagctcatgcgagcctgttggaagtggagccccgctgaccggccaagcttcgccgaaacacaccaagcctttgaaacaatgttccacgattcatctatcagcgaggaggttgccgaggagctgggtcgcgcagcctcttccagctccgtggtgccgtacctgcctaggctaccaattcttccatctaaaacgaggacgctaaaaaaacaagtggaaaataaggaaaacatagaaggagcccaagatgcgacagaaaattcggccagctcattggccccaggtttcattcggggtgcacaggccagcagcggttcaccggcacttcctcgaaaacagcgagacaaatctcccagtagtctcctggaggacgcgaaagagacatgtttcacccgggacagaaagggcggatttttttccagcttcatgaagaaaaggaatgccccaacaccaccaaaacgatcaagttcattccgggagatggaaaatcagccgcataaaaagtacgaactgacaggaaatttttcatccgtggcttcattgcagcatgctgatgggttttcatttacacctgcacagcaagaggctaacctggtcccacccaagtgttacggcggatcatttgcccagaggaatctttgtaacgacgacggcggaggcggtggcggaagcgggaccgccggtgggggttggagcggtatcactggttttttcacgccacggctgattaagaaaaccctgggactgagggctggcaagccaaccgccagcgacgacacaagcaagccttttccacgttccaattctactagttccatgagcagcggcctgcccgaacaggacaggatggctatgaccctgcctagaaattgccaacgatctaaactgcagctcgaaaggacggtctcaacttccagccaaccagaagaaaacgtggacagagctaacgatatgctgccaaaaaagtccgaagagtccgccgctccatccagggagcgccctaaggccaaattgcttcccagaggggcaactgcgctccctttgagaacacccagcggtgatctcgctatcacagagaaggatcctccaggggtgggtgtggcaggtgtagctgccgcacctaaagggaaggagaagaacggcggtgcaagacttggcatggccggtgtgccagaagacggggagcagcctggatggccctccccagctaaagctgcgcctgtgctaccgactacccataaccataaggttccagtcttgattagtcccacacttaaacacacgcctgccgatgtacagctcatcggcacagacagccagggcaacaagttcaaactgttaagcgaacaccaagtaacaagctccggggataaggaccgcccacgcagagtgaaacccaaatgcgcccctccgccaccaccggttatgcggttgttgcagcatccttccatttgcagtgatcccactgaagaacctactgctctgaccgcgggtcagtctaccagcgagacacaagaaggaggcaagaaggcagccttgggggcagtgcccatttctggcaaggctgggaggcctgtcatgccaccccctcaggtgcccttgcccacctcctccatttcacctgccaaaatggccaatggaacagccggaacaaaggtagcgctgcgcaagactaagcaagccgcagaaaagataagcgccgataagatctccaaggaggctcttcttgaatgtgccgatctgctctcctcagctcttacagaacctgtgcccaattcccagctggtggataccgggcaccaacttcttgattactgcagcggctatgtcgactgtatcccgcagacacggaacaagttcgccttccgggaggctgtgagcaagttggagttgtcactgcaggaactccaggtcagttcggccgcagccggagttcctggaacaaaccccgtgctcaacaacttgctcagctgcgtgcaggaaatttccgacgttgtccagagatag

SEQ ID NO: 246451 - DNA, 3177 bp, Artificial Sequence
  Description of Artificial Sequence: Synthetic coding sequence
atgggacagcaggtgggacgggtgggtgaggcgcctggcctccagcagccacagccgcgtggcatacgcggtagctctgctgccaggccttctggaagaaggagggatcctgccggacggaccactgaaaccggattcaacatttttacgcagcatgaggccctacacaggccatatgggtgcgacgtcgagccacaggccctgaatgaggccataaggtggagctccaaggaaaatcttctaggggctactgaaagtgatccgaacctcttcgtcgccctgtatgactttgtcgccagcggagataatacactatctatcacgaaaggggagaagctcagggttctgggatataaccagaacggtgaatggagtgaggtaagatctaaaaacgggcaaggctgggtgcccagcaactacattacccctgttaacagcctggaaaagcacagctggtaccatgggcctgtgtcgagaagcgcagctgagtacctgttgtcatcgctcatcaatggaagcttcctcgtgagagaatctgaatcatctccagggcaattaagcatcagcctccggtacgaaggtcgggtgtaccactatcgcattaataccaccgcagatgggaaggtgtacgtgaccgcagagtctaggttcagtaccctggccgagctggtgcaccaccattccacggtggctgatggtcttgtgacaaccctccactatccagctcccaagtgtaataaaccgaccgtatatggtgtcagccctattcatgataagtgggaaatggagcggaccgacattaccatgaagcacaagttgggcggtggacagtacggcgaagtttacgttggcgtctggaaaaaatacagcctaacagtggccgtcaagactctgaaagaagacacaatggaggtggaagaattcctgaaggaggccgcagtaatgaaagagatcaaacacccgaacctggtccagttactgggagtttgtactctcgaaccgccattctatatcgtgaccgaatacatgccttatggtaatctgctggactatctgcgcgagtgtaacagggaggaagtgaccgcggtggtactcctatacatggctacccagatttcgtccgcgatggaatacctcgaaaagaaaaatttcattcatcgagacctggcagcccgaaactgcctggtgggcgaaaaccacgtcgtaaaagtggctgatttcggtctatcaaggttgatgacgggtgacacttacacagcccacgctggtgccaaatttccaattaaatggacggccccagaatccctggcttacaataccttctcaataaaatcggacgtgtgggcctttggggtactgctctgggaaattgccacctacggaatgagcccttaccccggaatcgatctgtcccaagtgtacgacctactggagaaaggctatcggatggaacaacccgaaggctgccctcctaaggtgtacgaactgatgagggcttgttggaagtggagtcccgctgatcgccctagttttgcagagacacaccaggccttcgagaccatgtttcacgattctagcatttccgaagaggtcgccgaagagcttgggcgagccgcatcttcaagttccgtagttccatatctcccacgtctccctatactgccctcaaagactagaacgctgaagaagcaggtggaaaacaaagaaaacattgagggagcgcaggacgccactgagaacagcgcctcttctctggccccaggcttcatcagaggcgctcaggcaagtagtggaagccctgcactacctagaaagcagagagataagtcaccgtcaagcctgttagaggacgctaaagagacatgcttcacaagagatagaaaggggggtttcttcagttcatttatgaagaaaagaaacgctcctactccaccaaaacgaagctccagcttcagagagatggagaatcagcctcacaaaaaatatgaattaaccggattgcctgagcaagaccgcatggctatgacactgccaagaaattgccaaagaagtaaactgcaactggagcgcactgtatcaacaagttcgcagcctgaggagaatgtggatagagctaatgacatgctgccaaaaaaaagcgaggagtctgccgctccctcaagggagcgccctaaagccaaattactgccccgtggagccacggctttacccctccgtactccctccggcgacctggccatcaccgagaaggacccccctggagtgggggttgccggtgtggcagctgccccaaaagggaaggaaaagaacgggggagcaaggctcggaatggcaggcgtgcctgaagatggggaacagcccggttggccatcacccgcaaaggccgcaccagtgttgccgacaacacataaccataaagttccagtgctgatctcccccacattaaagcacaccccagctgatgttcagctgatcggaaccgattctcagggtaacaagtttaagctcctgagcgagcatcaggtaacatctagtggggacaaggatagaccacgtagggtaaagccaaaatgcgcacctccccctccaccagtgatgagattgttacagcatccgtctatttgttcagacccaactgaagagcctacagctctgaccgctggtcaatccacaagcgagacccaggaagggggaaaaaaagctgccctgggcgcagtcccaatttctggcaaagctggaaggccagttatgccgcctcctcaagtccccctccccaccagctccatttcacccgcaaagatggccaatgggacggctgggactaaagtggctctgagaaaaaccaagcaggccgctgaaaaaatctcggcggacaagatctctaaggaggcattgctagaatgtgctgatctcctgtcaagcgccctgaccgaacccgtacctaactctcagctggtagacaccgggcatcaactgctggactactgtagtgggtatgtggactgcattccgcagacaaggaataagtttgccttccgcgaagctgtgtcgaagctggaattgtctctccaggaactacaggtgtcatccgcagccgcaggcgtgcctgggaccaatcctgtacttaacaacctgctgtcctgtgtccaagagatctccgacgtggtgcagcggtag

SEQ ID NO: 246452 - DNA, 3240 bp, Artificial Sequence
  Description of Artificial Sequence: Synthetic coding sequence
atgggacagcaggtaggtcgggtcggagaagcgcctggattacagcaaccgcagccacggggaatccgtggttcgagcgccgctcgaccaagcgggcgtagacgtgaccccgcaggcaggacaactgagaccggatttaatattttcacacagcatgatcacttcgcctcttgcgttgaagacgggttcgaaggggacaaaactggcggtagcagtcccgaagccctgcatcgcccttatggatgcgacgtggagccacaggcattgaatgaggctatccggtggagttctaaagaaaacttgctgggagcaacggaatccgatcccaatctcttcgtggccctgtacgatttcgtcgccagcggcgataacacactgtctatcactaagggcgagaagcttcgagtactcggctacaatcaaaatggggaatggagtgaagtgcgctccaaaaatggtcaagggtgggtccctagcaattatattacgcctgtgaactcactggagaagcattcgtggtatcatggcccagtctcccggtccgccgctgagtacctgctctccagcctgataaacgggagcttcttggtacgcgagtccgagtcctctcctggacagctgtcaatcagcctgcgttatgaaggacgtgtgtatcactatcgcatcaacacaaccgccgatggcaaggtttatgtcactgctgaaagtaggttcagtacactcgccgaacttgtacaccaccattccaccgtcgctgatggcctggtcacaaccctccactaccctgcgccaaagtgcaataagccaacagtgtacggagtctcgcctatccatgacaagtgggagatggaacggacagacatcactatgaagcacaaactgggcggtggccagtatggcgaggtgtacgtaggtgtttggaaaaaatattccttaactgtggctgttaaaactcttaaggaagatactatggaagtggaagaattcttaaaggaggctgcggtcatgaaagagattaaacatcctaatcttgtgcaattacttggggtctgtaccctggaaccgcctttttacatcgtcaccgaatatatgccttatgggaacctccttgactacctgcgtgagtgtaatcgcgaagaggtaacagctgttgttctcctgtatatggcaactcagatatcatcagctatggaatacctggagaagaaaaacttcatccatagggacttggcagccaggaactgtctggtgggagagaaccacgtagttaaggtagctgatttcggactctcacgtttgatgactggtgacacctacacggcacatgctggtgccaagttcccgatcaagtggaccgcccctgagtccctggcgtataacactttctcgatcaagagtgacgtgtgggctttcggcgtgctcttgtgggagatcgcgacctacgggatgtcaccctatcccggtatcgacttatcccaggtgtatgacttgcttgagaaaggctaccggatggaacaaccggagggatgtcccccaaaggtgtacgagctgatgcgcgcatgctggaaatggagccccgctgaccggcctagctttgctgagacacaccaggctttcgagaccatgtttcatgacagctcaatctcggaggaggtcgcagaggagctggggagagctgcgtctagttcctcagttgttccctatttgcccagactgccaattcttccaagtaagacacgcacgctgaagaagcaagttgaaaacaaggaaaacatcgagggcgctcaagatgctacagagaactccgcctctagtctggcgcctggctttatccgaggcgcacaagccagcagcggcagtccagctctgccccgaaaacagagggataaaagtccgtcctcactcctggaagatgctaaggaaacttgctttactcgggacagaaagggaggtttttttagctctttcatgaagaagaggaatgcccctacgccacccaagagatcctcttctttcagggagatggaaaaccagcctcataagaaatatgagctgacaggtctgccagaacaggatcgcatggcaatgacccttcccagaaattgtcaacggagtaaattacagctggagagaacggtttctacatcttctcaacccgaggaaaatgtggaccgggctaacgacatgctgcccaaaaagtccgaggaatccgctgcccctagccgagagcgccctaaggctaagctgctcccccgaggggcaacggccttacctctcaggacaccctccggcgatttggccatcacggaaaaggatccacctggtgtgggcgtggcgggagtggctgctgcaccaaaaggcaaggagaaaaatggcggtgccagattgggaatggctggggtacctgaggacggggaacaacctggctggcctagccccgcaaaagccgctcccgtgctgccaacaacacataaccacaaggtgccggtcctgatcagtcccactctgaagcatacccccgctgacgtgcaactcattggaacggactcccagggcaacaagtttaagctgctgtccgaacatcaggtgacctctagcggtgataaggacagaccaaggcgagtgaagcccaaatgtgcaccgccaccacctccagtcatgaggcttctgcaacatccgtcaatctgctccgacccaacggaagagccaaccgccctcacagccggtcaaagtacttccgaaacccaggaagggggaaaaaaggcagccctcggtgcggtgcccattagtggaaaggccggaaggccggtgatgcctccgcctcaggtgccactacccacatcctctatttcacccgctaaaatggccaacgggaccgcgggaaccaaggtggcgctacgcaagacaaagcaggccgctgagaaaatttccgcggataagatctcaaaggaggcactcctcgagtgtgctgatttgcttagctcagcgttaaccgagccagtacccaattcccagctagttgataccgggcatcagctcctggattattgtagtgggtatgttgattgcatccctcaaaccaggaacaagttcgcctttcgggaggccgtgtctaaattggagctgtctctgcaggaactccaggtatcatcagctgccgcaggtgtccccggaacaaatcctgtgctaaataaccttctttcctgtgtgcaggaaatctccgacgtagtgcagagatag

SEQ ID NO: 246453 - DNA, 2349 bp, Artificial Sequence
  Description of Artificial Sequence: Synthetic coding sequence
atgaatcctgaaaaggacttcgccccattgactcccaatattgtcagggcccttaatgataaactgtacgaaaagcgcaaggttgctgctctggaaatagaaaagctcgtccgggagtttgtggctcagaacaatactgtccagattaagcacgttattcaaactctgagtcaggaattcgccctttctcaacatccccatagtcgaaagggcggtttgattgggctcgcggcttgttctatcgcattgggcaaagacagcgggctttacctgaaagagctaatcgaaccagtgctcacttgctttaacgatgcggatagcaggctgagatattacgcttgtgaagcactgtacaacatcgtgaaagtcgcaaggggggcagttctgccacatttcaacgttcttttcgacggactgtcgaaactggcagccgatccagatcccaacgttaaatcaggttccgagttacttgacaggctgttgaaagatattgtaactgaatctaataagttcgacctcgtatcctttatcccgttgctgagggagcggatctacagtaataatcagtacgctcggcaattcattataagttggatcctagttctggagagcgtgcccgatatcaacctgctggactacttacccgagatcttggacggcctcttccagatactgggcgataacggtaaagaaattcggaaaatgtgcgaggtcgtccttggcgagtttctgaaagagattaaaaagaatcccagctctgtcaaatttgcggaaatggcgaatattctggtcattcactgccagacaaccgatgacctgattcaattgacagccatgtgttggatgagggaattcattcagctggctggcagggtcatgctgccctatagctctggtatcctcacagccgtcctcccctgcctggcctatgacgatcggaaaaaaagcattaaagaggtcgccaatgtctgtaaccagtctctgatgaaactggtgacacccgaagatgatgaactggacgaactccggccagggcagaggcaggcggagccgactcctgacgacgcactgccgaaacaggaggggactgcctccgggggtcccgacggctcgtgcgacagcagtttcagttcaggcatctccgtgtttactgccgcttctactgagcgggctcctgtgacacttcatctagacgggattgtgcaggtcctcaactgccacttgtctgataccgctattgggatgatgaccagaatcgctgttcttaaatggctctatcacctgtacatcaagacacctaggaaaatgttccgccacactgattccctgttccccatattactgcaaaccctaagtgacgagtcagatgaggtgatactgaaggatctggaggttctggccgagattgccagctccccagcgggacaaaccgatgatccagggccactggatgggcctgatctacaggctagccactcagaattacaggtgccaacgccaggacgggctgggctgttgaataccagtgggacaaagggcctggaatgtagtccctcaacacccactatgaatagctatttttataagtttatgattaatctcctgaagaggttcagctccgagagaaaactgctagaggtgaggggacctttcattattcggcagttgtgtctgctgcttaacgcagagaacatcttccactccatggccgacatcctcctccgggaagaggacttgaagttcgccagtactatggtgcatgcccttaatacgatcctgcttacctcaactgagttgtttcaactgagaaaccaactcaaggatctgaagacccttgagtcacagaacctgttctgctgcttatacagatcttggtgccataatcccgtgacaaccgtatccctgtgtttccttacccagaattatcgtcatgcttacgatcttatccagaaattcggcgatttggaggtcacagtggattttcttgccgaggtggacaaactcgtgcagctgatcgaatgtccgatttttacatatctgagacttcagcttctggatgtcaaaaataacccgtatctgataaaagcgttatacggactcctgatgcttctcccccaatcatctgctttccaacttctctctcatcggcttcagtgtgtgcccaacccagaacttctccagaccgaggacagcctaaaagcagctcccaaatcacaaaaagccgattcaccatctatcgactacgcagaactgctgcagcatttcgagaaggtgcagaacaagcacttggaggtgcgccaccagcgttccgggaggggcgaccacctcgaccgtcgagtggtcctctag

SEQ ID NO: 246454 - DNA, 645 bp, Artificial Sequence
  Description of Artificial Sequence: Synthetic coding sequence
atggctgacatcctactcagggaggaggatttgaaattcgcctcgaccatggtccacgcactcaacactattctgctgactagcactgaactcttccagctacgtaatcagctgaaggacttgaaaaccttagaatctcagaacctattttgctgcctctatcgctcgtggtgtcacaaccctgtgacaaccgtttctttgtgctttctgacacagaactatcgccacgcctacgaccttatccagaaattcggggatcttgaagttaccgtggattttctggccgaggtggacaagctcgttcaattgattgagtgcccgatattcacctacctgcgcctgcagcttctggacgtcaaaaacaacccttacctgatcaaagcactgtacggcctgctgatgctgctgcctcaatcctccgcttttcagttgcttagccataggctacagtgcgttccgaacccagaattgctgcaaactgaggattccctgaaagcagctcctaagagccaaaaggccgacagcccatcaatcgattatgcggagctactacagcattttgagaaagtgcaaaataagcacctggaggtgagacatcaacgctccggtcgcggagatcacttagataggcgggtggttctatag

SEQ ID NO: 246455 - DNA, 1062 bp, Artificial Sequence
  Description of Artificial Sequence: Synthetic coding sequence
atggcctcctcgtggcccccactagaattgcaatcatctaaccaatcccaactgtttccacagaacgccactgcctgtgataatgcgccagaggcctgggatctactgcaccgggtcctgcctacattcatcatttccatctgtttcttcggcctgcttggcaatctcttcgtgctgcttgtgtttctactgcctcgtaggcaactcaatgttgccgaaatctacctcgccaacctggctgcatctgatctcgtgtttgtgctcggattacctttctgggctgaaaacatatggaatcagttcaactggcctttcggtgctctgctgtgtagggtgatcaatggagtgatcaaagcaaacctcttcattagcatattcctggtggtcgcgatctcccaggatcggtacagggtactagtgcatcccatggcgtctaggcgccagcagcgcagacggcaggcgcgtgtgacgtgcgttctcatctgggtggtcgggggactgctaagcatccctacattcctcctgcggagcatccaagcagtgcccgaccttaatatcacggcctgcattctgctactccctcacgaagcctggcatttcgccagaatagttgaactgaacatcctgggatttctactccctctggcggctatagtcttctttaattaccatatactggccagcctgcgaacgcgtgaagaggtgtccagaacccgatgcggcggacgaaaggactctaagactacggcattgattctgactcttgtcgtggctttcctggtatgctgggctccatatcacttttttgcattcttagagtttctcttccaggtgcaagccgtgagagggtgcttttgggaggactttatagatctagggctgcagttggccaacttctttgccttcaccaactctagtctcaacccggtaatctacgtgtttgttggacgcctgtttagaacaaaggtgtgggaattgtacaagcaatgcacccccaaaagtctggcacctataagcagtagccaccggaaagaaatattccagttattttggagaaactag

SEQ ID NO: 246456 - DNA, 1527 bp, Artificial Sequence
  Description of Artificial Sequence: Synthetic coding sequence
atgccacccaagcgcaacgagaagtacaagctgccaatcccattccctgaggggaaagtcctggatgatatggaggggaatcagtgggtactgggaaaaaaaatcggaagcgggggatttggactcatctaccttgcctttccgacaaataaacccgagaaggatgcgagacacgtggttaaggtcgagtatcaggagaatggacctctgttcagcgaactcaaattttaccagagagtcgcgaagaaggactgtattaaaaagtggatcgagcgcaaacagctagattacctgggcatcccactcttctacggttcaggcttaactgaatttaagggacgaagttaccgctttatggtgatggagcgactcggcattgatcttcagaaaatctctggccaaaacgggaccttcaaaaagtcgacagtgcttcaactgggcatccggatgcttgacgtgctcgagtacattcacgagaacgagtacgtgcatggcgacatcaaggccgcaaatctgctgttgggttataagaatccggatcaggtctatctggcagattacgggctttcctatcggtactgccctaacgggaatcataaacaatatcaggaaaaccctcgcaaaggccataacggaaccatcgagtttaccagcctcgacgctcacaagggcgttgccctgtccaggagaagcgacgtggagatcctgggatactgcatgcttcggtggttatgcggaaagctgccctgggaacagaatttaaaggatcctgtggctgtgcaaactgcgaagacaaatctcctggacgagctgcctcagtccgttctgaagtgggcaccatccggttcttcctgctgtgaaattgcacaattcctcgtgtgcgcacactcccttgcctatgacgagaagccgaactaccaggccctcaaaaagattctcaacccccacggtatacctctcggacctctggacttcagtaccaaaggtcagtcaatcaacgtccataccccaaactctcaaaaggtggacagccagaaagcggcaaccaaacaggtgaataaggcccataacagactgatcgagaaaaaggtccattccgagaggtctgccgagtcttgtgcaacctggaaggtacagaaagaagaaaagctgatcgggctgatgaataacgaagctgcgcaggaatcaactcggcgtcggcagaagtaccaggagagccaggaacccctgaacgaagtgaacagcttcccgcagaagattagttacacacagttccctaactcattttacgagcctcaccaggattttacctctcccgatattttcaagaagagccgctcccccagctggtataaatatacaagcacggtgagcaccggcatcaccgatcttgagagctcaaccggcctgtggccaacaatttctcagttcaccctgagcgaggagactaacgcagatgtttattattataggattatcatcccagtactgcttatgcttgtctttctcgctctcttttttttgtag

SEQ ID NO: 246457 - DNA, 1203 bp, Artificial Sequence
  Description of Artificial Sequence: Synthetic coding sequence
atgcctcctaaaagaaacgagaaatacaaactgcctattccttttcccgaggggaaggtgctggacgacatggaaggcaatcagtgggtcctcggaaaaaagattgggtctggtgggttcggcctgatttacctcgccttcccaaccaacaagccagagaaggatgctcggcatgtagtcaaagtggagtaccaggaaaacggaccactcttcagcgagctcaaattttaccagcgcgtggccaagaaggattgtatcaagaagtggatcgagaggaaacagctggactacctggggatacccctgttttacgggagcgggttgactgagttcaaaggccgttcctacaggtttatggtcatggaacggttggggattgatctgcaaaagatcagtggacagaatggcacctttaagaaatctactgtgctgcaactggggatacgcatgttggacgtgctagagtatattcacgaaaacgaatatgtgcacggcgacatcaaagcggcaaatctattgctcggctataagaatcccgaccaggtgtatctggccgattatggcctgtcttatcgatattgccccaacggtaaccacaaacagtatcaagagaatcctaggaaaggacacaacggaacgatcgagtttacctctctggatgcacacaagggcgtggcgctgtcccgcagaagcgacgtcgaaattttgggctactgcatgctaaggtggctttgcggaaaactgccatgggagcagaatctgaaggaccccgtggctgtccagactgccaagaccaatctgcttgatgagcttcctcagtccgtcctgaagtgggccccatcagggtcgagttgttgcgaaatagcacaattcctcgtctgcgcccactcgctcgcttatgatgagaagccgaattatcaggctctgaaaaaaatcttaaatccacatggaatcccactgggtcccctggacttcagcacaaagggtcagagcataaacgtgcacaccccaaactcccagaaagttgattcgcaaaaggccgctactaagcaagtgaacaaggctcacaacaggttaatagaaaagaaagttcactcagagaggagtgctgagtcctgcgctacctggaaagtgcagaaggaagagaagcttattggactcatgaacaacgaggcagcacaaatccgacaactcggctattag

SEQ ID NO: 246458 - DNA, 1191 bp, Artificial Sequence
  Description of Artificial Sequence: Synthetic coding sequence
atgccccctaaacgtaatgagaagtataagcttcctataccttttcctgagggtaaggtgttggatgatatggaggggaatcaatgggttcttggtaaaaagattggctctggagggttcggtttgatctacttggctttccctaccaataagcccgagaaagatgcacgacatgtggtgaaagtcgaatatcaagaaaatggcccactgtttagcgagctgaaattttaccagcgtgtggctaaaaaagactgtatcaagaaatggatcgagaggaaacagctggactatctgggaatccccctcttctatggatccggcctcactgaattcaaagggagatcatataggtttatggtgatggagcggctgggcattgacttgcaaaaaataagtggtcagaacggtacatttaaaaaatcgactgtgttgcagctggggatcagaatgctggacgtccttgagtacatccatgaaaatgaatacgtccacggcgacatcaaggccgctaatctgctgctgggatacaaaaacccagaccaggtctaccttgccgattatggcctctcatatcggtactgccccaatggtaatcacaagcaataccaagaaaacccgagaaagggacacaatggtaccatagagtttacaagtcttgacgcgcataagggcgtggctttgagccgaaggagtgatgttgaaatcctggggtactgtatgttacggtggttgtgcggcaagctgccttgggaacagaaccttaaggatcccgtggctgtgcagacggccaagaccaacctattggatgaactcccacagtcagtcctgaaatgggctccgagcgggagttcctgttgtgagattgcccagtttcttgtctgcgcccactccctcgcctacgacgaaaaacccaactatcaggcacttaagaagatcctgaatcctcatggcatcccgctcggacccctggatttttccacaaaaggccagagcatcaacgtgcacaccccaaacagtcaaaaggtggacagccagaaggctgcaaccaagcaggttaacaaggcccacaacagattgattgagaagaaggtgcactccgaacgttccgccgagtcctgcgccacgtggaaagtccagaaggaagaaaagctgattggcctgatgaacaacgaggcggctcaattccggtag

SEQ ID NO: 246459 - DNA, 876 bp, Artificial Sequence
  Description of Artificial Sequence: Synthetic coding sequence
atgcctcccaaacgaaacgaaaaatataagctgccaatccccttccctgagggtaaagtgcttgacgatatggagggtaaccagtgggtgctaggcaagaagatcggatcaggaggatttggactaatctatcttgccttcccgacaaataagcctgaaaaggatgctcgccatgtggtcaaagttgagtatcaggagaatggcccactgttctctgagttgaagttctaccagcgggtggccaagaaggattgtattgtctttgtggtgaagaaatggatcgagcgtaagcagctggattacctgggcatccccctgttttatggtagcggacttaccgagtttaaagggagaagctatagatttatggtgatggagcgactcggcatagatcttcaaaagatctcagggcagaacggaacatttaaaaagtccacagtcctccagctgggtatccggatgcttgacgtcctggagtacatacacgaaaatgaatacgtgcatggagatataaaagctgcaaatctcctgcttggatacaaaaacccagaccaagtatatctagcggattatggcctttcctaccggtattgccctaacgggaatcacaaacagtaccaagagaacccaagaaagggacacaacggcaccatcgaatttacgtcactggatgcccacaagggggtagccctgagcaggcgctctgatgtagagattctgggatattgcatgctgcggtggttatgtggaaaactgccatgggaacagaatctgaaggatcccgtggccgtgcagactgccaaaaccaaatacaaatttagctcaatctcttcatgtacagctccgggactgaaaggttatataaagggaagttag

SEQ ID NO: 246460 - DNA, 1527 bp, Artificial Sequence
  Description of Artificial Sequence: Synthetic coding sequence
atgccaccgaaacgaaacgagaagtataagctgcccatcccctttcctgagggtaaggtgctagatgatatggaagggaaccagtgggttctggggaagaagattggcagtggcggttttggtcttatataccttgcttttcccactaataagcccgagaaggatgcacgccacgtagtgaaagtagagtatcaggagaacggacccttgttttccgagctaaagttctaccaacgggtggccaaaaaggattgcatcaaaaagtggatcgaaagaaaacagttagactacctcggcatccctctattctacggctccggtctgactgaatttaaggggagaagttaccgctttatggtgatggaacgcctcggcatcgatttgcaaaagatctctggccagaatgggactttcaagaagtccaccgtcctgcagctcggaatacgtatgcttgacgtgctggaatatattcatgagaacgaatatgtgcacggagatattaaagccgctaatctgcttcttgggtacaaaaacccagatcaggtgtatctggctgattacggtctttcttacagatactgtcccaacgggaatcataagcagtatcaggagaaccctagaaaggggcataacggcacgattgagtttacatcattggacgcacataagggcgtggctctatctcgcaggagcgacgtcgaaatcctcggatactgtatgctgcgatggttatgcggaaagttgccgtgggagcagaacctgaaagacccagtggcggtgcaaaccgccaaaacgaacctgctggacgaattaccacaatctgtcctgaagtgggctccgtccggaagttcctgctgcgaaattgcacagttcctggtatgtgcccatagtctagcatacgatgagaagcctaactaccaggcactgaagaagatcctaaacccccatggaatcccattggggccacttgacttctccactaaaggacagtcaattaacgttcacacccccaacagtcagaaggtggattcccagaaggccgcaacaaagcaagtgaacaaagctcacaacagactgattgagaaaaaagtgcatagcgaaagaagcgctgaaagttgcgccacctggaaggttcagaaggaagagaagcttatcgggctcatgaataacgaagcagctcaggaatcgactagaagaaggcagaaataccaagagagccaagagcccttaaacgaggtcaatagctttcctcagaagataagctatacacagttcccaaattccttttatgagccacaccaggatttcacgtctccagacattttcaagaagtcacggtccccttcctggtacaaatacactagtaccgtttccacgggaattaccgatctcgagtcctctacaggtttgtggcctacaattagccagtttacgctaagtgaggaaaccaacgccgacgtctactactaccggattataatccctgtcctcctgatgttagtattcctcgcattgttttttttatag

SEQ ID NO: 246461 - DNA, 1458 bp, Artificial Sequence
  Description of Artificial Sequence: Synthetic coding sequence
atggaggggaaccagtgggtgctcggaaagaagatcggctctggcggtttcggtttgatttacttagctttcccaaccaataaacctgaaaaggatgccaggcatgttgtgaaagtcgaataccaggaaaatggtccgttgttttcggagttaaaattctatcagagggtcgccaagaaggactgcatcaaaaagtggattgaacggaagcaactggattacctggggatccctctgttctacgggtccggactgactgagtttaaggggcgtagttatagattcatggtgatggagaggttggggattgatctccagaagatcagcggacagaatggcacctttaagaagtccacagtgctccagttgggtatccgtatgctggatgttctcgaatatatccacgagaacgaatatgtccacggagacattaaagcagcaaacctgctcctgggctataagaatcctgatcaggtatatttggctgactacggcctaagttataggtattgccccaacggaaatcataagcagtatcaggaaaaccctcggaaaggccacaacggcacaattgaattcacctccctggatgcacataagggtgttgcactgagcaggaggagcgacgtggaaattctggggtattgcatgttgagatggctatgcggcaagttgccatgggagcagaatctgaaagaccctgtagccgtgcaaacagcaaaaactaacttgctggacgaactgcctcagtccgtgctgaaatgggccccatccggttccagttgctgcgaaatagcacagttcttggtgtgcgctcattcccttgcctacgacgagaaacctaattatcaggccctgaaaaagatcttaaacccccacgggattccactgggcccactggacttctccaccaaaggccagtcgatcaacgttcacacccccaatagccagaaggtggattcgcagaaagccgcaaccaagcaggttaataaggcccacaaccggttaattgagaaaaaggtgcattcagagagatctgctgaatcttgcgccacttggaaagtgcagaaggaagaaaaactcatcggcctgatgaacaacgaagctgctcaagaatccaccagacgacgtcagaaataccaggaaagccaagagcccctcaatgaggtcaacagcttcccacagaaaattagttacacccagtttcccaactcgttttatgagcctcaccaagacttcacctctcctgacatcttcaaaaagagtcgatcaccaagctggtacaagtacacaagcaccgtgtctactggaattacggatctggagagctcaacagggttatggcctacaattagtcagttcaccctgagtgaagaaacaaacgccgatgtgtactattacaggattatcattcccgttttgctgatgctggtgtttctggctctgttttttctgtag

SEQ ID NO: 246462 - DNA, 531 bp, Artificial Sequence
  Description of Artificial Sequence: Synthetic coding sequence
atggctatgtcctttgagtggccctggcaatataggttccctccattcttcacactgcagcctaatgtcgatacaaggcagaaacagctggcagcctggtgcagccttgtcctgtcattttgtcggttacacaagcagagctctatgaccgtaatggaagcccaagagtcccccttatttaataacgtgaaattgcagcgcaagttacccgtggaaagtatacaaatcgttcttgaggaactgaggaaaaaagggaatcttgagtggttggataagtccaagagcagctttttaattatgtggcgcagaccagaggagtggggtaaactgatctaccagtgggtgagcagatccggacaaaataattcggtgttcacactgtatgagctaaccaatggggaagacacggaagatgaggaattccacggcttggatgaggctacactcctgcgcgcattgcaagctctgcaacaagagcacaaggcggagattattacagtgagcgacgggagaggcgtcaagttcttttag

SEQ ID NO: 246463 - DNA, 984 bp, Artificial Sequence
  Description of Artificial Sequence: Synthetic coding sequence
atgagctttttagggggtttcttcggtccgatatgtgaaattgatatcgtcctgaatgatggggagactcgcaagatggcagagatgaagaccgaggatggcaaagtcgaaaagcattacctcttctatgacggggaatctgtcagcggtaaggttaatcttgcctttaaacaaccagggaagcgcctggagcatcaagggatccgcatagagttcgtgggacagatcgagcttttcaatgacaaaagtaatacacatgagttcgtgaacctagtgaaggagcttgcccttcccggtgagctaacacagtcaagatcctatgacttcgagttcatgcaagtcgagaaaccttacgagagttatatcggggcaaacgtgcgtctaagatacttcctgaaggtaaccatcgtacgcaggctcaccgatttggtcaaggaatatgatctgattgtgcaccaactagccacctaccccgacgtgaataatagtataaagatggaggtcgggatcgaggattgcttgcatattgaattcgagtacaataaaagcaagtatcacctgaaggatgtgatagtgggcaagatatactttctgctggtgagaataaagattcagcacatggagctgcaactgataaagaaggagatcaccggcatcggcccttccaccacgactgagaccgaaacaatcgctaaatacgaaattatggacggagcgccagtgaagggagaaagtatccccatccggctctttctcgccggatatgacccaacacccaccatgcgggatgtgaacaagaaattctcagtgcggtatttcttgaaccttgtattggtggatgaagaggacaggagatacttcaaacagcaagagatcattctctggagaaaggctcctgaaaaacttcggaagcagcgtacaaacttccatcaacggttcgaatcccccgaatcacaagcaagtgccgagcagcccgagatgtag

SEQ ID NO: 246464 - DNA, 984 bp, Artificial Sequence
  Description of Artificial Sequence: Synthetic coding sequence
atgagctttttgggagggttcttcggccctatctgcgagatcgacatcgtacttaacgacggtgagaccaggaaaatggccgagatgaagacagaagatggaaaggttgagaagcattatctgttctacgatggcgagagcgtatccggaaaggttaacctcgcgtttaagcagcctggcaagagattggagcatcagggaatccggattgagtttgttggacaaattgagctgttcaacgacaagagtaacacacatgaatttgtaaacctcgtgaaagagcttgccttacccggagagctgacccaatcacggagttatgattttgaatttatgcaggtggaaaaaccatacgagagctacatcggcgcaaacgtgagactgcgttacttcctgaaggttacgatcgtccgccgtcttactgacctcgttaaagagtacgatctgatcgtgcatcaattggctacgtatcccgatgtcaacaatagcattaaaatggaggtagggattgaggattgtcttcacatcgaattcgagtataacaaaagtaagtaccatctcaaggacgttattgtgggcaagatttacttcctacttgtgaggatcaagatccagcacatggagctgcagctgatcaaaaaggagatcaccggaattggcccatcgacgacaacagagacagagaccatcgcaaagtacgaaattatggacggggctcctgtaaaaggggagtccattccaatacgcttattcctggccggatatgaccctacacccacaatgcgcgacgttaataaaaaattcagcgtgcggtattttttaaacttagtgttagttgacgaggaagatcggaggtactttaagcaacaagaaataattctctggaggaaggccccagaaaagctgcggaagcagcggaccaactttcatcagcgtttcgagagtcccgaatcgcaggcctccgctgagcagcctgaaatgtag

SEQ ID NO: 246465 - DNA, 756 bp, Artificial Sequence
  Description of Artificial Sequence: Synthetic coding sequence
atgtcatttctcggcggatttttcggcccaatttgtgagatcgatattgttctgaatgatggtgagacacgcaagatggcagagatgaaaacagaagatggaaaggtcgagaagcactatctgttctacgatggagaatccgtgtctggaaaagtgaatttggccttcaaacagcccggtaaaaggctcgagcaccagggcattaggatcgagttcgtgggccaaatcgagctgttcaatgataagtccaatacacacgaatttgtaaacttagtcaaggagctcgcactgcctggtgagctaacacagtctagatcttacgacttcgaatttatgcaagtggaaaagccctatgagagttatattggggctaacgtccgtctgaggtacttcctgaaggttacaatcgttcgccgactaaccgatcttgtcaaagagtatgatctgatcgtacatcagcttgccacttatcctgacgtgaataactcaatcaaaatggaggttggcattgaagattgcctgcacatcgaatttgagtataacaaaagtaaatatcatcttaaagacgtgatcgtaggaaagatctatttcttactggtgcggatcaagatacaacacatggagctccagcttatcaagaaggagatcacaggcattggcccatccaccactactgagacggaaaccattgccaagtatgaaatcatggacggagcaccggtgaagggagataacttcatggaaaagtccagttag

SEQ ID NO: 246466 - DNA, 651 bp, Artificial Sequence
  Description of Artificial Sequence: Synthetic coding sequence
atgcaggtggagaagccgtacgaatcgtatattggcgctaacgtgcggctgcggtacttcctaaaagtgaccatcgtaaggcgacttacagacctcgtgaaggaatacgatctgatcgtgcaccagcttgcaacgtatcctgatgtgaacaactccataaaaatggaggtggggatagaggactgtctacacattgagtttgaatataataagagtaagtaccatctcaaagacgttattgtgggcaaaatttactttctcttggttagaattaagattcagcatatggagcttcagctgatcaagaaggaaataaccggcataggcccatctacgaccacagagacagaaaccattgctaagtacgagataatggacggagccccagtgaagggtgaatccattccaatccgcttgttcctggcagggtacgaccccactcctacgatgcgcgatgtgaacaagaagttcagtgtccgatattttctgaacctcgtcctggtggacgaggaggaccgtaggtattttaagcagcaagagattatcctctggcgcaaggcccctgagaaactccggaagcaaaggacaaactttcatcagagatttgagagtcccgagagccaggcttccgcagagcaaccggagatgtag

SEQ ID NO: 246467 - DNA, 933 bp, Artificial Sequence
  Description of Artificial Sequence: Synthetic coding sequence
atgaccgaaaatccgtttcaagagcgttacagcgtggaggacttatcaacgttcggaatgtgcttgtgcatggtgaggtacgtttacgatgccttttataaggtgaatctcgcttttaaacagcccggtaagcggttggaacatcaaggaatacggatcgagtttgtggggcagatcgaactgttcaacgacaaatccaacacccatgagtttgtgaatctggtcaaagaactggccttacccggagagttgactcagtcccgatcctacgattttgaattcatgcaagtcgaaaagccatacgagtcttatatcggcgcaaacgtccggctgagatactttctgaaggtcacaatcgtgaggcgccttaccgacctggtgaaggagtatgatttgatagtgcatcaacttgctacctaccccgacgtgaacaacagcataaagatggaagttggtattgaagactgtctacatatagagttcgagtacaacaaatccaaataccacttaaaagatgtgatcgttgggaagatctacttcctactggtgcggatcaaaatacaacacatggagcttcaactgattaaaaaggaaatcacaggcataggtcctagtaccactaccgaaaccgagactatagcaaaatatgagataatggacggagccccagtgaagggtgaatcaatacccatccgcctgtttttggcaggctatgatccaacccccacgatgagggatgtgaacaagaaattctccgtgcggtactttctgaacctggtactggttgatgaagaagatcgaagatacttcaagcagcaggaaatcatcctatggaggaaggccccagagaagctgaggaagcagaggactaattttcaccagcgattcgagtccccagaatctcaggcctccgccgagcagcctgaaatgtag

SEQ ID NO: 246468 - DNA, 1011 bp, Artificial Sequence
  Description of Artificial Sequence: Synthetic coding sequence
atgtccttcttcggctttggacagagtgtcgaagtggaaattttgttgaatgacgctgaaagtcgtaaacgggctgagcacaaaacagaagatggtaagaaagagaaatactttctgttctatgatggcgagaccgtgagcgggaaggtaagcttggcacttaagaacccaaacaaacggctggaacatcagggcattaaaatcgagtttatcggccagattgaactctactatgaccggggaaaccatcacgagtttgtgtctctggtgaaggacctcgcacgcccaggagagatcacccaaagccaagcttttgatttcgagtttacccacgtggaaaagccatatgagagctacacgggacagaatgtcaagctgaggtacttcctcagagctaccatttccaggcgtctcaatgacgtcgtcaaggagatggacattgtagtccacaccctgtctacttacccggagttgaatagtagcataaagatggaggttgggatagaagactgcctgcacattgagttcgagtataacaaatccaaatatcacctcaaggatgttatcgtgggaaagatctatttcctgctggtgagaataaaaatcaaacacatggaaatcgatatcatcaagagggaaaccaccggcaccgggcctaatgtgtaccacgagaacgatacgattgcgaagtacgaaattatggacggcgcacccgtcaggggtgagagtatccccatccgactcttcttagccggttatgagctcacgcccactatgcgggatattaataagaaattttccgttcggtattatctcaatctggtgcttatcgatgaggaagagcggagatatttcaagcagcaggaagtggtcctctggaggaaaggcgacattgtgcgaaagtccatgtcccatcaggctgcaattgcctctcaacgctttgaggggactactagtctgggagaagtgcgcaccccctctcagttgtcggacaacaattgcaggcagtag

SEQ ID NO: 246469 - DNA, 666 bp, Artificial Sequence
  Description of Artificial Sequence: Synthetic coding sequence
atgtttcacggtatccctgccacgcccggtatcggcgcaccaggcaataagcccgagctgtatgaagaggttaagctgtataagaacgccagagagagggaaaaatacgataatatggcagagctgttcgcagtggtgaagaccatgcaggcactggagaaggcatacatcaaagattgcgtgtctcctagcgagtacacagcagcctgctcacgcctgctagtccagtataaggcggcatttaggcaagtacagggaagcgagatcagcagcattgatgagttctgtagaaagtttaggctggattgcccccttgcgatggaacggataaaggaggatcgccctattactattaaagatgataagggaaaccttaaccggtgcatcgccgacgtggtcagcctttttattacagtgatggataagcttagactggagatccgggctatggatgaaatccagcctgatttacgcgagcttatggagaccatgcacagaatgagtcatttgccacctgacttcgagggtcggcaaacggtcagtcagtggctgcagacattaagcgggatgagtgcatccgatgagctggacgatagccaggtgcggcagatgctgtttgatctggaatctgcctacaatgccttcaaccggtttttgcacgcctag

SEQ ID NO: 246470 - DNA, 702 bp, Artificial Sequence
  Description of Artificial Sequence: Synthetic coding sequence
atgtttcacggaataccggctactcccggtatcggtgcacctggaaataagcctgagctctacgaagaagtcaaattatataaaaacgcccgtgaacgggagaagtacgataacatggccgagttgttcgccgtagtcaagacaatgcaggccttagaaaaagcctatataaaggactgcgtttcaccctccgagtatactgctgcctgctctagactgctggtccagtataaagccgcttttcgacaggttcaggggtccgaaatcagctccattgatgagttttgcaggaagtttaggctcgactgtcctctggctatggaaagaattaaggaagaccggcctatcactattaaggatgataaaggaaatctgaatcgctgtatcgcggatgtggtctccctttttattaccgtgatggataaactgaggcttgagattagagctatggacgagattcaaccagacctgcgggagctgatggaaacaatgcacaggatgtctcacctgccccctgactttgagggccgacagacagtctcccagtggtgggtgtccctacccgcacggcagagccctgccgtccccgagacactgcccgctagaagatctccggctgttccccttagacccagcgcgcctacatgccctgtccttcatagtcaggccgctgaccctgaaagacatgtgggcgtgcgctag

SEQ ID NO: 246471 - DNA, 666 bp, Artificial Sequence
  Description of Artificial Sequence: Synthetic coding sequence
atgttccacggcattcccgctactccaggcatcggcgctccagggaataaaccagagctgtatgaagaggtgaagctgtataaaaacgcccgagaacgcgagaagtacgataacatggcagagctgttcgccgttgtgaaaactatgcaggcgttagagaaggcatatattaaggattgtgtatcaccctcggaatacaccgcggcatgctctagactccttgtccaatataaggctgctttccggcaggtgcagggctctgagatttcatcaatagatgagttttgtcgaaagttcagactggactgcccactagcaatggagagaataaaggaagaccgcccaatcacgatcaaggacgataaaggcaatcttaatcgatgcattgcggatgtcgtgtccctgttcatcaccgtcatggataaactccgcctggaaattcgtgccatggacgagatccagccagatctgagggagctgatggagacgatgcaccggatgagtcacctgcccccagactttgaggggagacagaccgtgagccagtggctgcagacgctctcaggcatgtccgccagtgacgaattggatgacagccaggtgcgtcaaatgctctttgacttggagtcggcgtacaatgcttttaatagattcttacacgcctag

SEQ ID NO: 246472 - DNA, 1791 bp, Artificial Sequence
  Description of Artificial Sequence: Synthetic coding sequence
atggctgcccacctgtcatacggcagggtaaacctcaacgtgttacgggaggctgtgcgaagagaacttagggaatttctcgataagtgcgccggatcaaaagctatagtgtgggacgaatatctgactggtccctttggacttattgctcaatatagcttgctgaaggagcacgaggtggaaaagatgtttacactgaagggcaatcgcctccccgcagccgacgttaagaacatcattttctttgttcggcctaggctggaactgatggatataatcgctgagaatgtgctcagcgaagaccgtcgcggacctaccagagacttccatatcctcttcgtgccgagaaggtcgcttctgtgtgagcagaggctgaaggacctgggtgtgctggggagttttatccaccgggaagagtattcacttgacctcatccctttcgatggcgacctattaagcatggagtctgagggcgcttttaaggaatgttacttagaaggtgatcagacctcattgtaccatgcagctaagggcttgatgacattgcaagcattgtacggcacaattcctcagattttcggcaaaggggaatgtgcgaggcaagtggcgaacatgatgatacgcatgaagagagagttcacggggtcccagaactccatctttcccgtgtttgataatctacttctactggatcgcaatgttgaccttttgacaccattggccacccagcttacctatgaaggattgattgacgagatctacggcatccaaaattcttatgttaaacttccccctgaaaagttcgccccaaaaaagcaaggcgacggcggaaaggatctgccaacagaagccaagaaactacagcttaactccgctgaggagctgtatgccgagattcgtgacaagaatttcaatgctgttggctcggtcctttccaaaaaggctaaaataattagtgctgccttcgaagagcggcataatgctaaaaccgtgggcgaaattaaacagtttgtcagccaattaccccacatgcaggcagcgagaggtagtctggctaatcatacttccatagccgagctgataaaggacgtcacaacctcagaagacttttttgataagcttacagttgaacaggagtttatgtctggaattgacacagacaaagtgaataactacatcgaagactgtatagcccagaaacattctctgattaaggtgcttcgactggtttgtctgcagtcagtgtgtaacagtggtctgaagcagaaggtgctggactattataagcgtgaaatccttcagacctacgggtatgaacatattctgactttgcacaaccttgagaaagccggtctcttaaagccccaaactggcggaaggaataattacccaactattaggaagacgcttcgcctgtggatggatgacgtgaacgagcagaacccgacagacatttcctatgtctactcaggttatgctccactgagtgtcaggctcgcgcagctgttgtcaaggcccggatggcgcagtattgaagaggtgctgcggatcctgcctggtccacatttcgaagagagacagcctctgccgacaggcctgcagaagaagcgccagcccggagaaaatcgtgttactctgatctttttcctcggtggcgtgaccttcgcagaaatcgcagccctgcgcttcctgtcacagctcgaagatgggggaacagagtatgtgatcgcaaccacgaaactcatgaatggcactagctggattgaggcgctgatggagaagccgttctag

SEQ ID NO: 246473 - DNA, 1854 bp, Artificial Sequence
  Description of Artificial Sequence: Synthetic coding sequence
atggcttttccgcatcggcctgacgctcccgaattgcctgatttcagtatgcttaaacgtctggctcgtgaccagctcatctatctactggagcagctgcccggaaagaaggacctgttcatcgaagctgacctaatgagccccttagaccgaattgcaaacgtgagtatactgaaacagcacgaggtagacaagctatacaaagttgaaaataaaccagcactttcaagcaacgagcagctgtgcttcctggtccggccacgcattaagaatatgagatacatcgccagcctcgtgaacgccgacaagctggccggaagaactagaaaatacaaggtcatttttagtccccagaagttttatgcatgcgagatggtgctggaggaagagggcatttatggggatgtgtcttgcgacgaatgggcgtttagtctgttaccattggatgtggatttgcttagcatggaactgcctgagttcttcagggattactttctggagggagaccaacgatggatcaataccgtcgcccaggcccttcacttgctaagtaccctgtacggacctttcccaaattgctacggcattgggaggtgcgctaaaatggcttacgaactgtggcggaatcttgaggaggaggaggatggagagaccaagggcaggaggccagagatcggacacatctttctgctcgacagggacgtcgatttcgtgacagccctgtgtagccaggtggtttatgaggggctggtggatgatactttcaggataaagtgtggttctgtagattttggtcctgaggtgaccagctccgacaaatctcttaaggtcctgctcaacgctgaggacaaagtttttaatgagatcaggaatgaacattttagtaacgtttttgggttcctttcccagaaggcccgtaatctgcaagcacagtatgataggcgtcggggaatggacatcaaacagatgaaaaatttcgtgtcacaggagctgaagggtctgaagcaggagcaccgtctgctgagcttgcacataggggcttgtgagtccattatgaaaaagaagaccaagcaagactttcaagagctgatcaaaaccgagcacgcattactggaaggcttcaacatcagggagtccacgagctatatcgaggagcatatcgacaggcaggttagtcctattgaatctctgagattgatgtgcctcttatcgatcaccgagaacggcctaataccaaaagactatcggagcctgaagacgcagtacctgcagagctacggtcccgagcaccttttgacattttctaacttacggcgtgctggcctactaaccgagcaagccccaggcgacaccttgacggcagttgaaagcaaggtcagcaaactggtaacagacaaagcagcgggaaagatcacagacgcattctcgagtttggcaaagcgcagtaacttcagagctataagtaaaaaacttaatctcatacccagggttgatggcgagtacgatctcaaggtgcctcgagacatggcttatgtgttcggaggggcatacgtccccctcagctgccggatcatcgagcaggttctggaacgcagaagctggcaaggcctggacgaggtggtacgccttctgaactgcagtgactttgctttcacagatatgactaaggaagacaaggcaagttccgagtccctacgcctcattcttgtggtgttcctcggtggatgtaccttcagcgagatcagcgcgttaaggtttcttggtcgcgaaaagggctataggttcatttttttgaccaccgccgtgacgaatagcgccaggctgatggaagctatgtccgaggtcaaggcctag

SEQ ID NO: 246474 - DNA, 1719 bp, Artificial Sequence
  Description of Artificial Sequence: Synthetic coding sequence
atgagccccctcgacagaatcgccaacgtgtctatactcaagcaacacgaagtggacaagctgtacaaagtggagaacaaacccgctttgtcatctaacgaacagctgtgcttcctcgtacgtccacgtatcaagaacatgcgctacatcgcctcccttgtaaatgcagataagctcgcaggacgcacaaggaaatacaaggtgatcttttctccacagaaattctacgcctgcgaaatggtcttggaggaggaaggcatatatggcgatgtttcatgcgatgaatgggccttcagtctgctgccactcgacgtagacttgttatccatggaactaccagagttttttcgcgattacttcctggagggagaccagcgctggattaataccgttgctcaggctttgcacctgctgtcaaccctgtatggtcctttccctaactgttatggtatcggtcgctgcgcgaaaatggcatatgaactctggagaaacctcgaggaggaagaggatggggaaaccaaaggccgaaggcctgagattgggcacattttcctgttagatagagacgtggatttcgtcaccgccctgtgctcacaggtcgtttatgaggggctggtggacgacacgttcagaataaaatgcggatcagtggacttcggcccagaagtaacaagttccgataagagcttgaaagtcctcctcaacgctgaggacaaggtgtttaacgagattaggaatgaacatttctccaatgtgtttggcttcctctcccagaaagcacgaaacctgcaagcccagtatgaccgcagaaggggcatggacataaaacagatgaagaacttcgtttctcaggagttgaaaggcctgaagcaggaacacaggctcctcagtctccacattggtgcctgcgagtcaattatgaaaaaaaagacaaaacaagacttccaggagctgataaagacagaacacgccttattagaagggttcaacattcgtgagtctacaagttatatcgaggaacacatcgaccgtcaggtgagtcctattgagtcactacgcctcatgtgtttgcttagcattaccgaaaatggtcttataccgaaagactatagatctctgaaaacacagtatctgcagtcatatggaccagagcatctgctgactttcagcaacttgcggagagctgggcttctcaccgagcaggccccaggcgataccctaacagccgtcgaatctaaggtgagcaagctcgtgacagataaggctgcagggaagatcactgacgccttctcatctctggctaaaagatctaacttccgagctatctccaagaagctcaacctgatccctagagtagacggcgagtatgatctgaaggtccctagggacatggcctacgtattcggcggtgcatatgtgccacttagctgcagaattatcgagcaagtgctggaacgcagatcttggcaggggctggatgaagtggttagactgctgaactgttctgactttgctttcacggacatgactaaagaagacaaggcaagtagtgaatcactgagacttatattagtcgtcttcctgggcggatgcaccttctcagaaattagcgccctccgcttcttaggtcgagagaagggctatcgatttatatttcttacaaccgcagtgaccaacagcgcacgtttgatggaggccatgtcagaagtcaaagcctag

SEQ ID NO: 246475 - DNA, 2391 bp, Artificial Sequence
  Description of Artificial Sequence: Synthetic coding sequence
atgcccactacccagcagagtccccaggacgaacaggaaaagctcctcgacgaagctatccaagctgtgaaggtccagtcgttccaaatgaaacggtgcctggacaagaataaactgatggatgcactgaagcacgcctctaatatgcttggtgagcttaggacttccatgctcagccccaaatcctactatgaattatacatggcgatttccgacgaacttcactatttggaagtgtacctgaccgacgagttcgcaaaaggaagaaaggtcgccgatctctatgagttggtacagtatgccggaaacatcattccgaggctgtacctcctcattacagtgggggtggtgtacgtgaaatcttttccacagtctagaaaggatatccttaaggacctggtagagatgtgcagaggagtgcaacaccctctccgaggactttttctcagaaactatctgctgcagtgtactcggaatattctaccagacgagggcgaaccaactgatgaagaaactactggcgacatatctgatagtatggacttcgtcctcctgaatttcgctgaaatgaataagttgtgggtgcggatgcagcaccagggccattctcgggaccgcgaaaaaagagagagagagcggcaggagcttcggatcttggtcgggactaacctggtaagactctcacagcttgaaggggttaacgtcgagaggtataaacagattgtgttgaccggaatcctggagcaggtagttaattgcagggacgcactggcccaggaatacttgatggaatgtattatccaggtgttccctgatgagttccatctgcagactctgaacccctttctccgcgcatgcgctgaattacatcagaatgtaaatgttaagaatattataatcgcccttatcgacaggttagccctcttcgcccatagggaggatggacctggaattccagccgacattaaacttttcgacatcttttctcagcaggtcgccacggttatccaatccagacaggatatgccgagtgaggatgtggtaagtcttcaggtgagtctcataaatttagcaatgaagtgttatcctgaccgggtggactacgtggataaggtgctggaaaccaccgtagagattttcaataagctcaatctggagcacatcgccacttcctctgctgtttccaaagaattaacacgcttgctcaaaatccccgtcgatacatataataatatactgacagtgcttaagctcaaacactttcaccctctgttcgaatatttcgactatgaatctaggaaatccatgtcgtgttacgtgctctctaacgtgctggactataacacagaaatcgtaagccaggaccaggtggactccatcatgaatttggttagcacattgatccaagaccagcctgatcagccggtggaggacccagatccagaggatttcgccgacgagcaaagccttgtcggcaggttcattcacctcttgagatccgaggatcctgatcagcaataccttatcctcaacacggccagaaagcatttcggcgctgggggaaaccaaaggatcagatttacgctgcctccactcgtgtttgccgcttaccagttagccttccgatataaagagaattccaaggttgatgacaagtgggagaagaagtgccaaaaaatctttagtttcgcacaccagacaatcagtgccctgatcaaggcagaacttgcggagttgcctctacggctcttcctgcagggtgccctcgctgccggagaaattgggttcgaaaatcatgagaccgtggcctacgagttcatgtcgcaagcattctcgctgtatgaagacgaaatatcagatagtaaggcccagctggcagcaatcaccctgataataggaactttcgaaaggatgaaatgcttctctgaagaaaaccacgagcctctcaggacccagtgcgctctggccgcaagcaagctgttgaagaaacccgatcaggggagggctgtgagcacttgtgcccacctcttttggtctggcagaaataccgataagaacggtgaagaactgcacggaggcaagcgggtgatggagtgcctaaagaaagcactgaagatcgccaaccaatgcatggatccatccctgcaggtgcagctgtttatcgagattctcaacaggtacatttatttttacgagaaggagaatgatgctgtgaccatacaagtgctcaaccaactgatccagaaaatccgggaagacctccccaatttggaatcatctgaggaaacagaacaaatcaataagcatttccacaacaccctggaacacttacgactcagacgtgaatccccagagagcgaaggtccaatatatgaaggactcattctgtag

SEQ ID NO: 246476 - DNA, 1989 bp, Artificial Sequence
  Description of Artificial Sequence: Synthetic coding sequence
atgtgcaggggcgtgcagcatcccctaaggggcctgttcctgcgcaattacctccttcaatgtactcgcaacatccttcccgatgagggtgaacctactgacgaagaaactacgggcgatatcagcgacagtatggacttcgtcttgctgaatttcgctgaaatgaacaaactgtgggtccgtatgcagcaccaggggcattcgcgggaccgcgagaagagagaaagagagagacaggagctcaggatccttgtgggcacaaacctggtgcggttgtcacagcttgagggagttaacgtggagcggtacaagcaaatagttctcacaggcattctggaacaagtggtgaattgcagggatgcactcgcccaggaataccttatggaatgtatcatccaggtatttcctgatgaattccatttgcaaacattgaacccattccttcgggcttgtgcagagctgcaccagaacgtcaacgtgaagaatattattatagctctgatcgacagactcgcactctttgcccaccgtgaggatggccctggtatccccgcagatataaaactctttgatattttcagccaacaagtggctaccgtgattcagtcaagacaggatatgccttccgaagatgttgtttcacttcaggtctcgctgattaacttagctatgaaatgctacccagacagggtggattacgtggataaagtactggagaccaccgtcgagatatttaacaagctgaacctggaacacatcgctacttcaagcgcggtctccaaagagcttacacgactacttaagattcctgttgatacatataacaacattctgacagtgctaaaactaaagcatttccatcctttattcgaatacttcgactacgaaagtcgcaagagcatgtcctgttatgtgctttcaaatgttctggactataacactgaaatcgtctcccaggaccaggtggactccattatgaacctcgtttcaaccctcattcaggaccaacccgatcaacccgtcgaagaccccgatccagaggactttgccgatgagcagagcttagttggcagattcatacacttattgcgatccgaagacccggaccagcagtacctgatccttaacacggcccgtaagcacttcggagccggtgggaatcagagaatccgttttacccttcccccactcgtatttgccgcttaccagctggcgtttcggtataaggaaaatagtaaggtagacgataagtgggagaagaagtgccaaaagatcttttctttcgcccaccagactatcagtgccctcatcaaggccgagcttgctgagctgccccttcggctttttctgcagggtgcgctggccgctggggaaattgggttcgaaaaccacgaaaccgtggcgtatgaattcatgagccaagccttctcactgtacgaggatgaaatcagcgattcaaaagcgcagttggccgctatcactttgattatcggaaccttcgagcgtatgaaatgcttctcagaggagaaccacgaacccttacggactcagtgtgcattagccgcaagtaagcttctgaaaaagccagaccagggtcgggcagtatctacgtgcgcacatctcttttggtcaggcaggaatacagacaagaatggtgaggagttacacggcggaaaaagggtgatggaatgcctaaaaaaggcccttaaaatcgcaaatcagtgcatggatcccagcctacaagttcagctgtttattgaaattctaaacagatacatctacttctatgagaaggagaacgacgccatagtgactatccaagtcttgaaccagctgatccagaagatccgtgaggatctcccaaacctggaatcctctgaagagacagagcaaatcaataagcactttcacaatacattagaacatcttagactgagacgcgagagtcctgagtccgagggaccgatttacgaaggactgattctatag

SEQ ID NO: 246477 - DNA, 1161 bp, Artificial Sequence
  Description of Artificial Sequence: Synthetic coding sequence
atggatcgattcgtgtggacatctggcctcctggaaattaatgagacactcgttattcagcagagaggcgtgcgcatctatgatggagaagagaagattaagttcgatgccggtaccctactcctctcaactcacagactcatctggcgcgaccagaaaaaccatgaatgctgcatggccattttgcttagccaaatagtgtttatagaggagcaggctgcgggaattggcaaaagcgccaaaattgtcgtgcatctccaccccgcaccccctaataaggaacccggaccttttcagtctagcaaaaattcttacatcaaattatcctttaaggaacatggccagattgaattttaccgccgactgtctgaagaaatgacacagagaagatgggaaaacatgcctgtgagccagtccctccaaacaaatcggggaccccagcctggacgtataagagctgtggggattgtcggcatcgaacgcaagttagaggaaaagcgcaaagaaacggacaagaatatttctgaggcatttgaggatctcagtaagcttatgatcaaggccaaagagatggtcgaactatctaagagcattgccaataaaatcaaggacaagcaaggcgacattactgaggacgagactatccgattcaagagttatttactgtctatgggaatcgccaatcccgttacacgggagacatatggaagtggaacccaataccacatgcagttggccaaacagctcgcaggaatccttcaggtgccccttgaggagcgtgggggaatcatgtctctgaccgaagtgtactgtttggtgaaccgagctagagggatggagctgctgtcgccagaggatcttgtcaacgcctgcaagatgctggaggcactgaaacttcccctgcgactgcgggtgttcgatagtggggtaatggtgattgaactgcagtcccacaaggaagaggaaatggtcgcaagcgccctagagactgtctcagaaaagggaagcctgacttccgaggagtttgcaaaattagtgggcatgagcgtgcttctcgcaaaggagcggctgctgctggccgaaaaaatgggacatctttgccgcgatgatagcgtggaaggactgcgattttacccaaatcttttcatgacacagagttag

SEQ ID NO: 246478 - DNA, 558 bp, Artificial Sequence
  Description of Artificial Sequence: Synthetic coding sequence
atgtcatggctcttccccctgactaagagcgcttcttcatccgctgctggtagccccggtggactcacttctttgcaacagcaaaaacaacgcctgattgagagtctacgcaactcccattcctccattgcagaaattcaaaaagacgtggaatatcgtctgccattcaccattaataacctgaccatcaacataaatattctcctgccaccccagtttccacaagagaaaccggtgattagcgtctacccccctatcaggcaccacctaatggataaacagggggtgtacgtaacgtcacctctggttaataactttacaatgcactctgacctaggcaaaatcattcagtcactcctagacgagttttggaaaaacccgccagttctggcccctacctccacagctttcccctatcagctagagataagatggcaccacccacattgtcttgaaatctctctggcgaggtccagcaattcactggggttttccatctcaagttcaattagttcaaccagaagcaagcaggaatatcatttctttatctgctgctag

SEQ ID NO: 246479 - DNA, 1194 bp, Artificial Sequence
  Description of Artificial Sequence: Synthetic coding sequence
atgagttggctgttccccctaacaaaatccgcctcctccagcgccgcaggctcaccaggcggtctcacctctctccagcagcaaaagcagcgactgatcgagtctctccggaacagccactctagcatcgccgagatccagaaagatgttgaatatcggcttcccttcactattaataacttgacgatcaatatcaatattctactccccccacagttcccccaggagaaaccagtcatttctgtctatccaccgatccggcaccatctgatggataagcaaggagtgtatgttacaagcccacttgttaataatttcacaatgcactcagatctcgggaagatcatacagtctctgctggacgagttctggaagaacccccctgtgcttgccccaacaagcactgctttcccttacttgtattctaacccatcaggaatgtctccctacgccagccagggctttccctttcttcccccatatccgccacaggaagcaaaccggtccattacttctctcagcgtcgccgataccgtgtcaagctcaaccactagtcacactacagctaaaccagccgcaccatcctttggcgtgctcagtaatctgccgctgcctatccctacagtggacgcctctattcccacctcacagaacgggttcggttacaaaatgcccgatgtgccagacgcatttcctgagctctcagagctcagcgtgtcccagctgaccgacatgaatgagcaggaggaggtgcttctcgaacagtttctgaccctcccccagctgaagcagattataactgataaagatgacttagttaaaagtatcgaggaactagctcggaaaaatctcctgctggaaccatcattagaggccaaaagacagacggtgcttgataagtatgaactactaacccagatgaaaagtacctttgagaagaaaatgcaacggcaacacgagctaagtgaatcatgcagtgcaagcgctctgcaggcgagacttaaggtcgctgctcacgaggccgaagaggagtcggataacatcgcagaagactttctggaaggtaagatggaaatcgacgattttctttcatcattcatggagaagagaaccatatgccattgtcggagagcaaaggaggaaaagctgcagcaggcgatagccatgcactcccaattccacgcccctctgtag

SEQ ID NO: 246480 - DNA, 1119 bp, Artificial Sequence
  Description of Artificial Sequence: Synthetic coding sequence
atgagttggctgtttcccttgaccaaatctgcttccagctccgcggctgggagtcccggtggcctgactagtcttcagcaacagaagcagcgacttatcgagtcactccggaacagccactctaggttgctgcccccacagttcccacaggagaagcctgtgatctctgtgtacccccctatacggcaccacctaatggacaagcagggtgtttacgtcacttcgccactggtgaacaatttcacgatgcatagcgacctggggaagatcattcagtcgttactggacgagttttggaagaacccccctgtcctggctccaacctctactgcattcccctacctctactctaatccgtccggcatgtctccgtatgcttcccaggggttccccttcctgcccccttaccccccacaagaggccaacaggagtatcacaagccttagtgtggcagacacagtgtcttcctccacaacaagtcatacaaccgcaaaacctgctgctcctagtttcggcgtgctcagtaatttaccattaccaatacctacggttgacgcctcgatccccacatctcaaaacggttttggctataagatgcctgatgtaccggacgcattcccagagctctctgagctgagcgtctctcaacttactgatatgaacgaacaggaggaggtgctcttagagcaattcctgacactcccacagcttaaacagatcattaccgacaaggacgacctggtgaaaagtatcgaggagttggcccgtaaaaatctcctgcttgaaccctctctggaggccaagcggcagacagttttggacaagtatgagctactcacacagatgaaatctacttttgagaagaagatgcaacggcagcatgagctctccgagagctgctccgcatctgccttacaagccagattgaaggtggcagcacatgaggcggaagaggagtctgataacattgcagaggactttctagagggaaagatggagattgatgacttcctatcatcgtttatggaaaagcggactatatgtcattgcaggagggcaaaggaagaaaaactgcagcaggctatcgccatgcacagccaattccacgcacctctgtag

SEQ ID NO: 246481 - DNA, 858 bp, Artificial Sequence
  Description of Artificial Sequence: Synthetic coding sequence
atggccggagcgggttctgaggccagattcgccggactttctctagtgcagctgaacgagctattggaggacgagggtcagctgaccgagatggtacaaaagatggaggaaacacaaaatgtgcaactgaacaaagagatgacactggcaagcaaccgctccctagctgagggaaatcttctctatcaacctcaactagatacgctaaaagcaaggctgacccagaaataccaagagctgcaggtcctgttcgaagcgtaccagatcaaaaaaaccaaactggatagacagtcatcctcggcttccctcgaaacactgttggccctgctgcaggcagaaggggctaaaatcgaagaggacacagagaacatggccgagaaatttctggatggcgagttgccactcgactccttcatcgacgtgtaccagagcaaaaggaaactcgcccatatgaggagagtcaagattgaaaaactacaggagatggttctcaaggggcagcgactgcctcaggccctcgcacccctgcctccaaggctgcccgagctggcaccgaccgccccattgccctatccggcacctgaggcttcagggcctcccgctgtggcaccacgcaggatacctcctcctcccccaccagttcccgctggcagactggctactccctttacggccgctatgtcatctggacaggccgtgccttaccccggactccagtgtccccctttacccccaagagttgggttgccaacccagcaaggatttagcagccagttcgtcagtccataccctccacctctacctcagcgaccgccacccaggcttcctcctcatcagcccggattcatactccagtag

SEQ ID NO: 246482 - DNA, 1068 bp, Artificial Sequence
  Description of Artificial Sequence: Synthetic coding sequence
atggagacgctgaaagataagaccctgcaggagctcgaggagctccaaaacgacagcgaagctatcgatcagctggcgctggaaagccccgaagtgcaggatttgcagctggagcgcgagatggctttggcaacaaaccgttctctcgccgagagaaacctagaattccaggggcctctggaaatttcccgatccaatctctcggatcgctaccaggagttgaggaagctcgtggagcgctgccaggagcagaaagctaaactggagaagtttagcagcgccctgcaaccaggcacgcttctcgatttactgcaagtggagggtatgaagattgaagaggagtcagaggctatggctgagaaattcctcgaaggcgaagtgcccttggaaacatttttggaaaactttagctccatgagaatgctctctcatcttcgccgtgtgagggtcgaaaagttgcaagaggtcgtacgcaagcccagagccagccaggagctcgcaggggacgctcctccaccccgtccacccccaccagtgagacctgtaccccagggaacacctcctgtggttgaagagcagccacaaccgccattggctatgccaccctaccctctgccatattctccatctccctctctgcccgttggccctacagcccatggagccttaccacccgcaccatttcccgtggtgagtcaaccttcattctactccggacctctgggaccaacttaccccgcagcccagcttggcccaaggggcgctgctggctacagctggtctccgcagaggagcatgcctcccaggcctggctaccccggtacacccatgggtgctagcggacccggttatccgcttcgaggcggacgggctccatcccccggatacccacagcaaagtccctacccagccactgggggaaagcctccataccctatccagccgcagctcccctcctttccgggacagccacaaccctccgttccgctgcagcctccttacccgccagggccagctcctccttatggttttccccctccgccaggcccagcctggcctgggtactag

SEQ ID NO: 246483 - DNA, 447 bp, Artificial Sequence
  Description of Artificial Sequence: Synthetic coding sequence
atggagacactaaaagataaaaccttgcaggagctcgaggagcttcagaacgattcagaagccatcgatcagttagctctggagagccccgaagtccaggatctgcaactggagagggagatggcactggccactaaccggagcctcgcagaaagaaaccttgagttccaaggccctctcgagatatctcgaagcaacttgtctgaccgctaccaggaattgcggaagttggtcgagcgttgccaggaacagaaagctaagctggaaaaattttcatctgctctgcaacccggaactctgctggatctactccaagtggaaggaatgaaaatcgaagaagaatccgaggccatggctgagaagtttttggagggcgaagtcccccttgaaacctttctagaaaatttctcatcaatgcgaatgctctctcacctgcgcagagtgtag

SEQ ID NO: 246484 - DNA, 969 bp, Artificial Sequence
  Description of Artificial Sequence: Synthetic coding sequence
atggagaccctgaaggacaagacgcttcaggaactcgaggagttgcagaacgactccgaagccatcgatcagctcgccctcgagtctccagaggtccaggacctgcagctggaacgcgaaatggcgctggccactaatcgatcactggcagaaagaaacttagaattccagggccctttggagatcagccgaagcaacctcagtgataggtatcaggaactgcgcaagttagtggagcgctgtcaggaacaaaaagcgaagctcgaaaagttctcctctgctttgcagccgggaactttactcgacctcctccaagtggaagggatgaagatcgaggaagagtccgaagctatggctgagaagttcttggagggggaggtacccctggagaccttcttggaaaatttctcatccatgcgaatgctctctcatctgcgccgagtccgcgtcgagaaactccaggaggtggtgcgaaaaccaagggcctcccaggagttggcaggtgacgccccacctcctcggccaccccctcccgtcagacccgtaccccaaggcaccccccctgtcgtcgaggaacagccccaacccccactggccatgccaccttatcccttgccgtactccccatccccgagcttgcctgtggggcctactgctcacggtgccctccccccagcgccatttcccgtggtgtcgcagccatctttttactccggacccctcggtccaacgtacccagcagctcagctaggaccacgaggcgcagcaggatattcgtggagccctcaaagaagcatgccaccccgacctgggtatccaggaactcctatgggagcatctggcccaggatatccactacgaggaggaagagctccatctcctggttatcctcagcaatccccctaccccgcaactgggggaaaaccgccttaccccattcaaccacagctccctttcagcctctgttag

SEQ ID NO: 246485 - DNA, 756 bp, Artificial Sequence
  Description of Artificial Sequence: Synthetic coding sequence
atgtacagagctagggccgctagagccggtcccgaacccggatcccccggacgattcggcatcctgagtactgggcagctgcgcgacctattgcaggacgagcctaaacttgaccgcatcgtgagactgtcacgcaaattccaaggcttgcagctagagcgggaggcctgtcttgcctctaactatgctctggctaaagaaaacctggccctgcgcccacggctggagatgggacgcgcagcactggcgatcaagtaccaggaactccgggaagtcgctgagaactgtgctgacaagcttcagcggctggaagaatctatgcaccgatggtccccccactgcgctcttggttggttacaggcagagttggaagaggccgagcaggaggcagaggagcagatggagcagcttttgctgggcgaacagtcactggaggccttcctcccggcatttcagcgtggtcgggcattggcccacctgcggcgaacacaggccgagaagttgcaagaactgctgcgacgtagagaaagatccgcacagccagcaccaacaagcgccgctgacccaccaaaatcctttccagcagccgctgtgctccccacgggcgcagcaagaggccctcccgcagtccccaggtccttgccacctctagattctagacctgtgcccccactgaaagggtcgcccggatgtccactgggccctgcccctctgttgtcaccaagaccaagccagcctgaaccaccgcatcgctag

SEQ ID NO: 246486 - DNA, 2628 bp, Artificial Sequence
  Description of Artificial Sequence: Synthetic coding sequence
atgcatgatgcttttgagcctgtcccaattctagaaaaattgcctctgcagattgactgcttagccgcatgggaagagtggttactagtgggcaccaagcaaggccacctactcctctaccgcatcagaaaggacgtcggctgcaatcggtttgaggttacacttgagaaatctaacaaaaacttcagcaaaaagatacagcagattcacgtcgtatcacagtttaagattctcgtttcactgcttgaaaacaatatttacgtgcatgatctacttaccttccaacagatcacaaccgtcagtaaggccaagggcgctagcttgttcacatgcgatctgcagcacacagagacaggagaagaggtcctgagaatgtgtgtggccgtaaagaagaaactgcaactatacttttggaaagatcgggaattccatgaactccagggagacttctcggtgccagatgtgcccaagagcatggcctggtgcgagaatagcatctgcgtagggtttaagagggactattacttgattcgcgtggacggtaagggatcaattaaagagttattcccaacaggaaaacagctggagccgctggtagcgccattggccgacggcaaagtggcagtcggacaagacgacctgactgtcgtactcaatgaagaggggatctgcacccaaaaatgtgccctgaactggaccgacattccggtagccatggagcatcagccaccctatataatagccgtgctaccaagatacgttgagatccggacgttcgaacctaggctgctggtacagtcaattgaactgcagcgcccacgcttcataacctctggaggtagcaacattatttatgtggcatctaaccacttcgtgtggagactgattcctgtgcctatggctactcagatccagcagctgttgcaggataaacagttcgaactggcactgcaactggccgagatgaaggatgattccgacagcgagaagcagcagcagattcaccatataaagaatctgtacgcattcaatctcttttgtcaaaaaagatttgatgagagcatgcaagtattcgctaagttaggtacagatcccacacacgtgatggggctataccccgacctcttgcctacagactatcgcaagcagctccagtacccaaatccactgcctgttctctcgggggctgaactggagaaagcccacctggccctgatagactacctgactcagaaaaggagtcagttggtgaagaagctgaacgattccgatcaccagagcagtacatcccctctaatggaggggacgcctaccatcaaaagtaaaaagaaactgctgcagatcattgacaccaccttgctgaaatgttatttgcatactaatgtggcacttgtcgctccactgctccgcttagaaaacaatcattgtcatattgaggaatctgagcatgtcctgaaaaaagctcataagtacagcgaactgattattctctatgaaaaaaagggcctgcacgagaaagcccttcaggtcctggtcgaccagagcaaaaaagcgaacagccccctgaaaggtcatgagaggacggtgcaatacctgcaacacctaggcacagagaatttgcaccttattttctcttatagcgtgtgggtactgcgggacttccccgaggatgggctgaaaatttttactgaagacctgcccgaagtggaatctctgcccagagacagagtgcttggcttcctgatcgagaactttaagggccttgcaatcccctacttggagcacattattcacgtctgggaagaaactggatccaggttccacaattgccttattcagctgtactgcgagaaggtgcagggactcatgaaagagtatctgttgagctttcccgcaggcaagacacccgtgcctgcaggggaagaggagggcgagctgggcgaatataggcagaagctactgatgttcttagagatttcaagctactacgacccaggccgactaatttgcgacttcccctttgacggcctgttagaggaacgtgcactgctcctggggaggatgggaaagcacgagcaggccctttttatctatgtgcacattctgaaggacacacggatggcagaagaatattgtcataagcattacgaccggaacaaagatggcaataaagacgtttacctgagtctgctccgtatgtatctcagccccccttctatccattgtctgggacctatcaagctcgaactgttggaacctaaggccaaccttcaggcagccttgcaggtgctcgagctgcatcacagcaaattggatactacaaaagctcttaacctgctgccagcgaacactcagattaacgatatcaggatctttctggagaaagtgttggaagaaaatgctcagaagaagaggttcaatcaagttttgaaaaacctgctgcacgcggagttcttgcgcgttcaggaggagaggatactgcaccaacaggtcaagtgtattatcacggaggagaaagtgtgcatggtgtgcaagaaaaagatcgggaactctgcatttgctcgctacccgaatggcgtggtcgtacattatttttgttcaaaagaggtaaatccagctgacacatag

SEQ ID NO: 246487 - DNA, 2661 bp, Artificial Sequence
  Description of Artificial Sequence: Synthetic coding sequence
atgcatgacgcatttgaacccgtcccaatcctggagaaactgccactccaaatagattgtctagcagcttgggaggaatggttattggtcggaactaaacagggtcatcttctgctctaccggattagaaaggacgtggtgccggctgatgtggcttcacccgagagcggttcttgtaaccgcttcgaagtcacgctggagaaatccaacaaaaactttagcaaaaagatccagcagattcacgtggtgtcgcagttcaagatcctggtctccctgctcgagaacaatatctatgtgcacgacctgctgacctttcagcagattactaccgtgtctaaggctaaaggggcttcactcttcacctgcgatctgcagcacaccgagactggtgaagaagtgctacggatgtgcgtcgccgtcaagaagaaactgcagctgtatttttggaaggacagagagttccacgagctgcagggggacttctctgtgcccgatgtcccaaagagtatggcatggtgcgagaatagcatatgcgtgggatttaaaagagactattaccttatccgcgttgacggaaagggctccattaaggaattgttccctactggcaagcagctggagcccttggttgctcccttagctgatggcaaggtggcagtcggacaggatgacttgaccgtggttcttaacgaggaggggatctgtacacagaaatgtgccctcaattggaccgacatacccgtcgctatggagcatcagcccccatacatcattgctgttctacccaggtatgttgagatccgcacattcgagcccagacttctggtccagtcaatagaactgcagcgccctcggttcatcacctccggagggtccaatattatctacgtggcctccaaccatttcgtgtggcgactgataccagtaccaatggctactcaaatccaacagctcctgcaggataagcagtttgaactggccctgcagttagctgaaatgaaggacgactccgactctgaaaaacagcagcagattcatcacataaaaaacctgtacgcctttaatttgttctgtcagaagcggtttgacgaatcaatgcaggtgttcgcaaagctcgggactgatccaacacatgtaatgggcttatacccagacttgcttcccactgattacaggaaacagctgcaatatcccaacccccttccggtcctgtccggagccgagctggagaaggcccatctggccctcatcgattatctcactcaaaagagatcacagctggtgaaaaagctgaatgacagcgatcatcaaagttcgacatccccgcttatggagggcacaccaacaatcaaatcaaagaagaaactgctgcagatcattgacactaccctgcttaagtgctacctgcacacaaacgtggcccttgtggccccattactgcgcctggagaataaccattgccatatcgaagagtcagagcatgttctgaagaaggcacataaatatagcgaacttattatactgtacgaaaaaaaaggactgcacgaaaaggctctgcaggtactggtagatcagagcaagaaagccaattcccccttgaaaggtcatgagcggaccgtgcagtacctgcaacacctcggcaccgagaatctgcatttaattttttcttactcggtgtgggtattgagagacttccccgaagatggactgaagatcttcactgaggatctgcccgaggttgaaagtctgccacgcgacagagtgctggggtttcttatcgaaaacttcaagggattggcgatcccatacctggaacacattatccacgtatgggaagagaccggctcaaggttccacaactgtctgattcaactctattgcgaaaaggtccaagggctgatgaaggagtacctcctatcattccctgctggcaagactcccgttcccgctggcgaagaggagggcgagctgggtgagtatcggcagaagctgctgatgtttctagagattagcagctactatgatccaggaaggctcatttgcgactttccttttgacggccttctggaggaacgggctctgctgctgggacgcatgggtaaacatgagcaggccctatttatctacgtgcatattctcaaagacacccgtatggccgaggaatattgccacaagcattacgacaggaacaaggatggaaacaaggatgtgtacctgagcttgctcaggatgtacctgtctccgccttcgatccactgtttgggacccatcaagctggaactactggaaccgaaggctaatctgcaggctgctttacaagtgctcgagctgcaccattccaagttagatacaaccaaagctctaaacctgctgcctgcaaacacgcagattaacgatatccgcattttcctggaaaaagttctagaggagaatgcccagaagaaacgctttaatcaggttctcaaaaatctgctccacgctgagttcttaagggtgcaggaggaaagaatcctgcaccagcaggtcaaatgcattattaccgaggagaaagtctgcatggtttgcaagaaaaagattggtaactctgccttcgctcgataccccaacggagtagtcgttcactatttctgttccaaggaggtgaaccctgcggacacttag

SEQ ID NO: 246488 - DNA, 1314 bp, Artificial Sequence
  Description of Artificial Sequence: Synthetic coding sequence
atgacaacaagtactctgcagaaggcgatcgacctggtgactaaggccaccgaagaagacaaggccaagaattatgaagaagccttacgattataccagcatgccgtagagtatttcctgcacgctattaagtacgaagctcactctgacaaagctaaggagtccattagagccaaatgcgtacaatatcttgatagagcagagaagctcaaggattacctcagatccaaagagaaacacggtaagaagcccgtgaaggagaaccagagcgaagggaaaggtagcgatagtgacagcgaaggcgacaaccccgaaaagaaaaagttgcaagaacagctgatgggcgcagtagtgatggagaaacccaatatacgctggaatgacgttgcgggtctggagggagcaaaggaggcactcaaagaggcagtcatacttcccataaagttcccccacctgtttacagggaaacggacaccatggagaggtatcctgctattcggcccaccgggtaccgggaaatcttacttggcgaaagctgtcgcaaccgaggccaacaattcaaccttcttctctgtgagtagctcagatctgatgtccaaatggctcggagaatctgaaaagctggtgaaaaatcttttcgagcttgccagacaacataagccatctatcatattcatcgacgaagtggactccctgtgtggtagccgcaacgaaaacgaatcggaggcggctcgtaggattaagactgaatttctcgtacagatgcagggtgtgggcaataataatgacggaacccttgttctaggagccacaaacatcccttgggtgttggacagcgctataaggcgtaggtttgaaaaaagaatctacattcccttacctgaggaagctgcgcgtgctcagatgttccgcctacacctgggatctactcctcacaatctgactgacgcgaatatacacgagttggccaggaagacggaggggtactcaggcgcagacataagcatcatcgttagggattcactaatgcagccagtacggaaggtacaaagtgcaactcattttaaaaaggtgtgcggaccctctcgtaccaatccaagtatgatgatagatgacctcctgaccccttgttctcctggagacccaggtgccatggagatgacatggatggatgttcctggggataagctgctcgaaccggtggtgtgtatgagcgacatgctgagatctttagctacaacgcggccaacagttaacgctgacgatctgttaaaggtcaaaaagttctccgaggatttcgggcaagaatcctag

SEQ ID NO: 246489 - DNA, 1335 bp, Artificial Sequence
  Description of Artificial Sequence: Synthetic coding sequence
atgtcttccacctctcccaatcttcagaaagctatcgatcttgcgtccaaagccgcacaggaagataaagctggaaattacgaagaggccctgcagctgtatcaacacgccgtgcagtacttcctacacgtggtcaaatatgaggcccagggtgataaggccaaacaaagtatccgagctaagtgcaccgagtatctggaccgggctgaaaagctgaaagagtatctgaaaaataaggagaaaaaagcacaaaaacccgtgaaggaaggccagcctagtcctgctgatgagaaggggaacgactcggacggagagggcgagtcagacgatccagagaaaaagaagctgcagaaccagctgcaaggggcaattgtgatcgagaggcccaacgtaaagtggagtgatgtggccggattggagggagcgaaagaggcgctcaaagaggccgtgatcctgcccatcaaatttccacaccttttcaccggtaaacggacaccttggcgcggaatcctgctcttcgggccaccaggaacagggaagtcctatctggctaaggccgtggctacagaggccaataattccacattcttctctatatcctcctccgacctggttagcaaatggcttggggaatccgaaaaattggtcaagaacctctttcagcttgccagagagaacaagccttcgattatcttcattgacgaaatcgactccttgtgcggctcgcgatcagagaacgagagtgaagctgccagaaggattaaaaccgaattcctcgtgcagatgcagggtgtaggcgtcgacaacgatggcattcttgtgctgggggctactaacatcccttgggtgctggacagtgcaatcaggcggagattcgagaaacgcatctatatcccactgcccgagcctcacgcccgtgccgctatgtttaaattacatctcggaacgacccaaaattcattaactgaggcggattttagagagcttgggcgaaaaacagatggctacagcggggcagacatctccataatcgtgcgcgacgcattaatgcagcctgttcggaaagtgcaatcagccacccacttcaagaaggtgcgcggtccctcccgcgctgatccaaaccaccttgttgatgatctgttgactccttgttcccccggagatcccggagccatagagatgacatggatggatgtcccaggggacaagttgctggagcccgtcgtgagcatgtcggacatgctgagaagcttgtccaatacaaaaccaacggtcaacgagcatgatctgcttaaactcaagaaattcacggaggactttggccaggagggctag

SEQ ID NO: 246490 - DNA, 630 bp, Artificial Sequence
  Description of Artificial Sequence: Synthetic coding sequence
atggctgaggcagaagaacaggaaaccgggtcattagaagaatccaccgacgagtccgaggaagaggagagcgaggaggagcctaaactgaagtacgagcgcttgtccaatggggtcacggagattctgcagaaggacgctgctagctgtatgactgtgcacgataaattcctcgcgctcggtactcattacggcaaagtatacctgctagatgtccaaggcaatattacacagaagtttgatgtatcgcccgttaaaatcaaccagatttcgcttgacgagtcaggagagcatatgggcgtgtgtagtgaggatgggaaagttcaggtgtttggtctctacagcggagaggagttccacgagacttttgattgccctatcaaaatcattgctgtgcatcctcatttcgtgaggtcatcctgtaagcagttcgtgacaggtgggaaaaagctgttgctgtttgagcggagttggatgaaccggtggaagtccgcggtccttcacgagggcgaaggcaatatcagatccgtgaaatggagagggcatttgatcgcttgggccaacaacatgagtaagaagcccgaagcatggcgagtcgcgaaaaagatgaagtcatacctcaataactag

SEQ ID NO: 246491 - DNA, 2565 bp, Artificial Sequence
  Description of Artificial Sequence: Synthetic coding sequence
atggctgaggcagaagaacaggagacgggtagccttgaagaaagcacagatgaaagtgaggaggaggagtccgaggaggagccaaagctgaaatacgagcgattgtctaacggcgtgaccgagatccttcaaaaagacgctgcctcctgcatgaccgtccatgacaagtttcttgcactcgggactcactacggtaaggtttatcttttggacgtgcaggggaacataactcagaagttcgatgtatctcccgtcaaaatcaaccaaattagcctggacgagtctggagaacatatgggagtgtgctccgaggatggcaaggtgcaggtattcggcttgtactctggcgaagagtttcacgagacatttgactgtcctatcaaaataattgcggtgcaccctcactttgttaggagttcctgcaaacaatttgtgacaggaggtaagaaattgctgctgttcgagaggtcttggatgaataggtggaagagtgccgtgcttcatgaaggtgaaggaaacataagatccgtcaagtggcgcggacacctgattgcttgggccaataacatgggggttaaaatcttcgatattataagcaagcagcgcataacaaacgtgcccagagatgatatcagcctgaggcccgatatgtatccctgttctctgtgctggaaggacaatgtaacactcattatagggtgggggactagcgtcaaggtttgcagcgtgaaggaacgccacgcatctgaaatgagggatttgcccagccgctacgtggaaattgtcagccagtttgagaccgaattctacatatcaggacttgccccattgtgtgatcagctggtcgtgctgagctatgtgaaagagatctctgagaaaactgaaagggagtattgtgcaagacctcgcctcgatatcatccaacctctttctgagacctgcgaggagatttcgtcagacgccttaaccgttcgaggtttccaagaaaatgagtgtagggactaccacctagaatatagtgagggcgagtcactgttttacatagtttcaccacgtgatgtagtagtggcaaaggagagggaccaggatgaccacatcgactggctgcttgagaagaagaaatacgaggaggccctgatggccgctgaaatctcccagaaaaacataaaacgtcacaaaatcctcgatatcgggctggcatatattaatcacctggtcgaacggggtgattacgacatcgcggctcgaaagtgccagaagatattgggcaaaaatgcggctctgtgggaatacgaggtgtacaaatttaaagaaatcgggcagctgaaggcgataagtccgtacctccctcgaggagacccagtcctgaagcctctaatatatgagatgatcctgcacgagtttcttgagtcggactatgaggggttcgcaactctgattagagagtggccaggggatctgtataacaactctgtcattgtccaggcagtgcgagaccatctgaagaaagactcccagaataagacacttttaaagacattagcagaactttacacctatgataagaactatgggaatgccctcgagatttacttgacactccgtcacaaagatgtcttccagctcatacataaacataatctgttcagtagcatcaaggacaagatagtgttattgatggatttcgattctgaaaaggcggttgatatgctgctggacaatgaggataagatttccatcaagaaggtggtggaggaactcgaggatcggcctgaactccaacacgtgtaccttcacaagctctttaaacgtgaccatcataagggtcagaggtatcatgagaaacaaatctctttgtatgccgagtacgaccgtccaaacctgctcccgttcctgagggattccactcactgccccctcgagaaggctttggagatatgccagcagagaaacttcgtggaagagacagtttacctactgagtcggatgggaaatagcagatccgccctaaaaatgatcatggaggaactgcacgacgtagataaagcgatcgaattcgctaaggaacaggatgatggagagctgtgggaggacttaattttgtattcaattgataaacccccttttataaccggtctgctcaacaatatcggcacacatgtggatccgattttgctcatccaccggatcaaagaagggatggaaattcccaacctgagagactccctcgtcaagatcttacaggattataatctacagatcttgcttcgcgagggatgcaagaagattttagtcgctgacagcctttccctactgaagaaaatgcacagaactcagatgaagggcgtgttagtcgatgaagaaaatatttgtgagagttgtctttcccctatcttaccgagcgacgcagccaaacccttttccgtggtggtgttccactgtaggcacatgtttcacaaggaatgcctccctatgcctagtatgaattctgccgcacagttttgtaatatctgctctgccaagaataggggtcccggatcagccatcctcgaaatgaaaaaatag

SEQ ID NO: 246492 - DNA, 2490 bp, Artificial Sequence
  Description of Artificial Sequence: Synthetic coding sequence
atggctgaggcggaggaacaggagaccgggtccttggaggagtcaaccgacgagagcgaggaggaggaatctgaggaagagccgaaactcaagtacgagaggctgtccaatggtgttacagaaatattgcaaaaggatgccgcatcgtgtatgaccgttcatgacaagttcttagctctagggacgcattacgggaaggtgtatctgcttgatgtccaggggaacatcacacagaaatttgatgtagtgcaggtatttgggctgtatagtggagaggagttccacgaaactttcgactgccccatcaaaattatagcagttcacccacacttcgtcaggtctagctgcaagcagttcgttacaggtgggaagaagcttttgctgtttgaacgctcctggatgaatagatggaagtccgcggtactacatgagggggagggtaatatcagatctgtgaagtggcgcggacacttaattgcctgggcaaacaatatgggcgtgaaaatcttcgacatcatttcaaagcaaagaatcacaaacgttcctagagatgacatctcattgcgcccagacatgtacccttgcagtctgtgctggaaagacaacgtgaccttgattattggctgggggaccagtgttaaagtgtgttcagtgaaggagcgccacgcctcggagatgcgagacctccccagccgatacgtggagattgttagccagttcgagaccgagttctacatcagcgggctagctccgctttgcgatcagctggttgtgttgtcttatgtaaaagaaataagcgagaaaacagaaagagaatattgcgctcgtcctcggctggatattatccagcccctgtccgagacctgtgaggagatctctagtgacgctcttactgtgcgcggattccaggaaaatgagtgccgggattaccaccttgaatactcggagggcgagtccttattctatattgtgagtccaagggacgtcgtcgtcgccaaggagcgcgaccaggacgaccatattgactggcttttggaaaagaaaaagtatgaggaggcactgatggcagcggagatatcccagaagaacataaaaaggcacaaaatcctggatatcgggttggcctacataaatcacttggtggagaggggagattacgacatagccgctcggaagtgccaaaagattctgggcaagaacgcagcactgtgggagtatgaggtttacaaatttaaagaaatcggccagctcaaggcaattagcccttatctgccccgtggagaccccgtgctgaaaccactcatctatgagatgatactgcatgaatttttagagtccgactatgaaggctttgccaccctcattcgggagtggcctggggatctctacaacaatagcgtgatcgtgcaagcagtcagagatcacctcaaaaaggactcccaaaacaaaacactccttaagactcttgccgaactttatacatatgataaaaactacggcaatgcgttggagatttacctgacactgagacataaggacgtgttccagctgatccataaacacaacctcttcagttccataaaggacaagattgtgcttttgatggactttgatagtgaaaaagccgttgacatgcttctggacaatgaagataagatctccattaaaaaggtcgtcgaggagctggaagataggcctgagttacaacatgtctatctgcacaagctattcaagagggaccaccataaagggcagagatatcacgaaaagcagatctctttgtacgctgaatacgataggcctaatctactgccgtttttgagggactcaactcattgccccctggagaaagccctggaaatttgtcagcaacgcaatttcgtagaagagaccgtgtatctcctctcccggatgggtaactcaaggagcgctctgaaaatgatcatggaagaactgcatgatgtggataaggccatcgaattcgccaaagaacaggatgacggagagctatgggaagacctgattttatactccattgataagccaccattcattaccgggctcttgaacaatattggaactcatgttgacccgattctcctgattcatagaatcaaggagggtatggaaatcccaaatctcagggactcactggtcaaaattttgcaggactataatctccagatcctcctgcgcgaagggtgtaaaaaaatcctggtggccgactccctgagtttactcaagaaaatgcaccgcacccagatgaaaggcgtcctggtggatgaggagaacatctgtgagtcatgtctgagcccaatcctgccctcagatgcagcaaagccttttagtgttgtggttttccactgcagacacatgttccacaaggaatgtcttcccatgccatctatgaacagcgctgcccagttttgcaacatttgctctgcgaagaacagaggacccggatctgcgatcctggagatgaaaaagtag

SEQ ID NO: 246493 - DNA, 1617 bp, Artificial Sequence
  Description of Artificial Sequence: Synthetic coding sequence
atggtgtacacacagtccgagatcttgcaaaaggaggtatatttgtttgagcggatcgatagtcagaaccgggaaatcatgaaacacctgaaagctatctgtttccttagacccacaaaggagaacgtggactacatcatccaagaattgcggcgacccaagtacacaatttacttcatatatttcagcaatgtgatctctaagtctgacgtgaagtcccttgccgaagccgacgaacaggaagtcgttgcagaggtgcagcaggtgattactaaggaatacgagctgtttgagtttcgtaggactgaggttccacccttgctccttatcctggatcggtgtgacgacgccatcacaccactgcttaaccagtggacataccaagctatggtacacgagctgctgggaattaataataatagaatcgatctgtcgagagtaccgggtatcagcaaagatctgagggaagtggtgctgagcgcggagaacgacgagttttatgcgaataatatgtacctgaatttcgccgagatcggctcaaacattaagaacttaatggaggactttcagaaaaagaaaccgaaagagcaacagaaacttgagtcaatcgctgatatgaaggcatttgtcgagaactatccacagtttaaaaagatgtcggggacagtgtcaaagcacgtgactgtggtgggagaactgtctaggctggtcagcgagcgaaatctgcttgaagtgagtgaggtcgaacaagaattggcctgtcagaacgaccacagtagcgccctgcagaacattaagcggctgctgcagaaccccaaggtcacagaatttgatgcagctcggttggtcatgctctatgctctgcactacgagcgccactcatctaactctctgcccggactcatgatggatctaaggaacaagggcgtgagcgagaaataccgcaagctggtctccgctgtggtcgaatacggcggaaagagggtgcgagggtccgacctgttttcaccaaaggacgcggtcgcgattactaaacagtttttgaaaggcctcaagggagtggaaaatgtatatactcagcatcagccattcctgcatgaaacgctcgaccacctgatcaaaggacggcttaaagaaaatctatatccttacctgggaccctctacactgagagaccggcctcaggatattatcgtgttcgtgatcggcggagctacctacgaggaggccctcaccgtctataatttaaacagaaccactccaggcgtgaggattgtgctcggtggaaccacagtgcataacactaaaagggatggcgtgtccctctgttctcccgcatggtttaggacgccgggactcaagaggagtaccaggctctctctccccaaatgctgggactactcattccctagagggtctagcggattttggactgcacagcccaagcagggggaactgtcatctcatattaaagtttcagagcagaagatgaaacggtggcttggagaggggcactcatttctgtcctgccctcattacagattcagtcttcttaacaaaggagtgggcgaacagctgtgggtgctgtgttggctgcttgagttaatttccagatag

SEQ ID NO: 246494 - DNA, 1713 bp, Artificial Sequence
  Description of Artificial Sequence: Synthetic coding sequence
atgaatgtggtattcgccgtgaaacagtacatcagtaagatgattgaggactccgggcctggaatgaaggtccttttaatggacaaagagactaccggtatcgtttctatggtttatacacagtcggaaattctacagaaggaggtctatctgtttgagcgcatagacagccaaaacagggagattatgaagcatcttaaagctatctgcttcctgagacccaccaaggagaatgtcgactatatcattcaggaattacggagaccaaaatacactatctacttcatttatttcagcaacgtgatctctaagtccgacgtgaagagtctcgcagaagctgacgagcaggaagtggtggccgaggttcaggaattttatggggactatatcgccgtaaatcctcacctgttctcactgaatattctcggatgttgtcagggaaggaattgggaccctgcccagcttagtagaacaactcagggccttacagccctgcttctgagccttaagaagtgtcctatgatcagataccagctcagctccgaagctgccaaaagattagcagagtgtgtgaaacaggtcatcaccaaggaatacgagctgttcgaatttaggaggaccgaggtgcccccattgttgttgattctagaccgctgtgatgacgcaatcaccccactgcttaatcagtggacttaccaggcaatggtgcatgaactccttggcattaacaacaaccggattgatctctcccgggttcctggcatctccaaggatctgcgtgaggtggtgctcagcgcagaaaacgacgaattctatgccaataacatgtacttgaattttgcggaaatcggatcaaatataaagaatttgatggaagatttccaaaagaaaaagccgaaggaacaacagaagcttgagagtatcgcagacatgaaggcttttgtagaaaactaccctcagttcaaaaagatgtcaggaaccgtatcaaaacacgtcactgtggtgggagagctgagtcgactagtctcagaacgcaatctgttagaggttagcgaggtcgaacaagagctggcctgccagaacgatcacagctcagctttgcagaatattaagcgactattgcagaatcctaaggttacagagttcgacgccgcacggctggtcatgctttatgccctgcactatgagaggcattcctctaacagcctcccaggcctgatgatggacttaaggaataaaggggtgagcgagaagtacaggaagctagtgagcgctgtagtagaatacggtggaaaaagagtccggggatccgatctgttcagccccaaagacgcagtggccattacaaagcagttcctcaaaggcctgaaaggcgtggaaaatgtttacactcagcaccagccattcttacacgaaacacttgaccacctgattaagggaagacttaaagagaatctctatccttaccttggcccttccaccctgagagataggccacaggatataattgtgttcgtcatcggaggtgctacttacgaggaagccctcacagtctataacctcaaccgaaccacaccaggtgttcgtattgtccttggaggcacaaccgtgcataacaccaaatcattcttagaggaggtccttgcctccgggctccattcaaggagcaaagagagctcccaggtgacatcccgatccgcgtcaaggcggtag

SEQ ID NO: 246495 - DNA, 951 bp, Artificial Sequence
  Description of Artificial Sequence: Synthetic coding sequence
atgaacgtggtgtttgccgtcaaacaatacatttccaaaatgatcgaagacagcggaccaggtatgaaggtgctcctgatggacaaagagaccaccggcatagtcagcatggtgtatactcaaagcgaaatcttgcaaaaagaagtatatctgttcgagaggattgattcccagaatagggagatcatgaaacacctgaaagcaatttgctttttgcggccaactaaggagaacgtcgattacattatccaggagttacgcaggcctaaatatacgatttactttatttacttcagcaacgtgattagtaagtccgacgtaaagtcactggcggaggctgacgagcaggaggtggtcgccgaggtgcagcaggttatcacaaaagaatacgagttgtttgaatttcggagaactgaggtgccgccactacttctcattctggaccgatgcgatgatgcgattactccactgctgaatcaatggacctaccaggccatggtccacgagctgcttggaatcaacaacaataggatcgacctgtcacgcgtccccggaatatctaaagatctgcgagaggtggtgctgtccgcggagaacgacgaattttacgccaacaatatgtatctgaattttgccgaaatcggatcgaatatcaagaacctgatggaagactttcagaaaaaaaagccgaaggaacaacagaagctagaatcaatcgcagatatgaaggcatttgttgagaattaccctcagttcaaaaaaatgtccggaacagttagcaagcacgttaccgtggtgggtgagctcagtaggctggtgagcgagcggaacttactggaggtgtccgaggtcgaacaggaactggcctgtcagaacgatcactcttccgcgctgcagaatattaagcggctgttgcagaacccaaaagtgaccgaatttgacgctgcttag

SEQ ID NO: 246496 - DNA, 1305 bp, Artificial Sequence
  Description of Artificial Sequence: Synthetic coding sequence
atgaacgtggtattcgccgtcaagcagtacatctctaaaatgatagaggatagcggtcccggtatgaaggtactactgatggacaaagagactactggcatcgtctctatggtttacacccagtccgagatcttacaaaaggaggtgtatctgtttgagaggatcgactcgcagaatcgcgaaatcatgaaacatctcaaggccatctgtttcttgcgcccaaccaaggaaaacgtggattatattattcaagaacttcgtcgccctaaatacactatatatttcatttacttctcaaacgtcatatctaagagcgatgttaagtcactagctgaagcagatgagcaggaagtcgtcgccgaggttcagcaagttattaccaaggaatatgagctcttcgagtttcgacgaacagaggttccaccactcttgctaatactggatcgctgtgacgacgcgataacgcctctgctcaatcagtggacataccaggctatggtgcacgaacttctaggcattaataacaaccggattgatctctcccgcgttcccggtatatctaaggacttaagagaggtcgtacttagtgccgaaaacgacgagttctacgccaataacatgtacctgaatttcgctgagattggcagcaacatcaagaacctgatggaggactttcagaaaaaaaagccaaaggaacaacagaagttggaaagcattgctgacatgaaagcattcgtcgaaaactatccccagttcaagaagatgtccggcactgtttccaaacacgtcactgtggtgggagagctgtcgcgactggtatctgagcggaatttgctcgaagtatcagaagtagagcaagagctcgcctgccagaatgaccactcatcagccttacagaatatcaaacgattgcttcaaaatcccaaggtgacagaattcgatgctgccaggcttgtcatgctctacgcactacactacgagcgacattcctcaaattcgctgcccggtctgatgatggaccttagaaacaaaggggtcagcgagaaatacaggaaactggtgagtgccgtcgtcgagtacggaggcaaaagagtaagggggagtgacctcttttcgccaaaagacgcagtggctattactaagcagtttctcaaaggcctcaaaggggtggagaacgtttatacccagcatcagccattcctgcatgaaactctggaccacctaattaaagggagactcaaggagaatctttacccctatttgggaccatccacgttgcgggacaggattgcctcctgtctgtag

SEQ ID NO: 246497 - DNA, 1338 bp, Artificial Sequence
  Description of Artificial Sequence: Synthetic coding sequence
atgaacgtcgtgtttgcagttaatccgcacctattttcgctgaatatcctgggttgttgtcagggtcgaaactgggatcctgctcagctgtctcgcacaacccaaggcttgacagctttactcctgagtctgaagaagtgtccaatgatcagatatcagctgagcagcgaggccgctaagaggctggccgagtgtgtgaaacaagtaattactaaagaatacgagcttttcgagttccgacgtaccgaggttcccccattgcttctgatactggaccggtgtgacgacgctattacaccattactcaaccagtggacatatcaggccatggtacatgagctgcttggcatcaataacaaccgaatagatcttagtcgggttccagggatcagtaaagatttacgggaggtcgtgctgtccgccgagaacgacgagttttacgccaataatatgtacttgaattttgcagagataggatctaacattaagaacctgatggaagacttccagaaaaaaaaacctaaagaacagcagaaactggagagcatagctgacatgaaggccttcgtggagaactacccccagtttaaaaagatgtcggggaccgtatccaagcacgtgacagtagtgggcgagctgtctaggttggtgtctgagcggaacttacttgaggtgagtgaagtagagcaggagctcgcctgtcaaaacgatcactcttcagctctccaaaatattaaacggctcctgcaaaacccaaaagtaacagaatttgatgcagcacgtttagtgatgctgtatgccctgcactacgaaagacactccagcaactctctgcctgggctgatgatggatttgaggaacaagggggtaagtgaaaagtatcggaaacttgttagcgctgtagttgagtatggtggtaaacgggtgcggggttccgatcttttcagccccaaagatgcagtagcaattactaagcagtttctaaaaggactgaagggagtagaaaacgtttacactcaacaccaacccttcttgcatgagactctagaccatttaatcaaaggcagacttaaagagaatctttatccctacctgggccctagcactctcagggatcggcctcaggacatcatcgtgttcgtgattggaggcgcaacgtatgaggaggcactgacagtttataatctcaaccgcactacacccggtgtgcgcattgtgctgggaggaactacagttcataacacaaaatcctttctcgaggaggttttggcttctggattgcatagccgttccaaggagtcatctcaagtgacctccagatctgctagtcggcgatag

SEQ ID NO: 246498 - DNA, 1128 bp, Artificial Sequence
  Description of Artificial Sequence: Synthetic coding sequence
atgtcccttgccggtggcagagctcccaggaaaactgctgggaatcgcttgtcgggactacttgaagctgaggaagaagacgaattctatcagacaacctatggcggtttcacagaggagtcaggggacgacgagtatcagggagatcagtccgacaccgaggacgaggtggattccgatttcgatatcgacgagggcgacgaaccatcctctgacggcgaagccgaggaacccagacgtaaaaggcgcgttgtcactaaagcctacaaagagcctctaaaaagcctgaggccaagaaaggtgaacacccccgcaggatccagtcagaaagcgagggaggaaaaggcactcctacccctcgaattacaggatgatggctctgactctagaaaatccatgcgtcaatccacggccgagcacacccgacagacctttcttcgcgttcaggagcgacaggggcagtcgaggcgacggaagggccctcactgcgagcgcccactgactcaggaagagttgctccgggaggccaaaatcaccgaggaactgaacctgagatcattggagacctatgaaagactggaagccgataagaagaagcaggtacataagaaacgcaagtgccctggcccaatcataacataccattccgttactgtccctctcgtcggagagcctggccctaaggaggagaatgtcgacatcgagggttctttatgtttcagcttgtcttttgtgctgaggcttgatccggcaccttcagtatccgccttgacaccacatgctgggaccggccctgtgaatcctcccgctagatgctctaggaccttcatcacgttttcagatgatgccaccttcgaggagtggtttccacagggtaggccgccaaaagttcccgtgcgcgaagtgtgcccagtgacacacagacccgctctctatagagatcctgttaccgacataccctacgccaccgccagagcattcaaaatcatcagagaggcatataagaaatatatcacagcccatggtctgcccccaaccgcttcagcattaggtcccggaccccctccaccagagccactgcctggttctggtccgagggcccttaggcagaagatcgtcatcaagtag

SEQ ID NO: 246499 - DNA, 1095 bp, Artificial Sequence
  Description of Artificial Sequence: Synthetic coding sequence
atgagcctggccggtggaagagctcccagaaaaacagctggcaacaggcttagcgggctgttggaagccgaagaggaggatgaattttaccagacgacatacggaggctttaccgaagaatccggcgacgacgagtatcagggagaccagagcgacacagaggatgaagtcgacagtgattttgacattgacgagggcgacgaaccctcaagcgacggggaggccgaagaacctagacgaaagcggcgtgtggttaccaaggcctataaggagcccttgaagtctctgcggcctcgcaaggtgaatacgccagctggttcctcccaaaaagccagagaagagaaagccctgttgcccttagagctgcaagatgacgggtctgactctaggaagtccatgagacagtcaactgccgagcatacacgtcaaacgtttttgcgagtgcaggagcgtcaaggccaatcgagacggagaaagggtccccactgtgaacggcctttaacccaggaagagctcttacgggaagctaagattacggaagagctgaatctccgttccctggagacttatgaacggctggaggcagacaagaagaaacaggtgcataagaaacggaagtgcccaggcccaattattacataccactccgttaccgtcccactcgtgggggaacctgggcctaaggaagagaacgttgatatagagggtctggacccggcaccgtcagttagcgcgttaacacctcacgcaggcactgggcctgtgaacccacccgctcgttgcagtcggacatttattacattctccgatgatgccacgttcgaagagtggttcccccagggcagaccaccaaaagttcccgtgcgggaggtctgtcctgtgacccatagacctgctctttacagggatcctgtaacagacatcccatatgccaccgctagagcctttaaaattattcgggaagcatataagaagtatataaccgcccacgggttgcctcccaccgcttcagccctgggcccaggcccaccgccaccggagccgctgcccggatcgggcccacgcgctttaaggcagaagatcgttattaagtag

SEQ ID NO: 246500 - DNA, 1221 bp, Artificial Sequence
  Description of Artificial Sequence: Synthetic coding sequence
atggcggagaacggcaagaattgtgaccaaaggcgggtcgccatgaataaagaacatcataatggcaactttacagacccatcatccgtgaatgagaagaagagacgagagagggaggagcgacagaatattgtgctgtggcgccaacctctgatcaccctacagtatttcagcttagagatcttagttattctgaaagagtggacaagcaaattgtggcataggcagtctatagtcgtctcatttctccttttgctcgcagtccttatagccacatactacgtagaaggcgtccatcagcaatacgtgcagagaatcgagaagcagtttctgctgtatgcgtactggattgggcttggcattttgtctagcgttggattgggcactggcttgcatacctttctgctttacctggggcctcacatcgcatcagtcaccctggctgcttacgaatgtaattctgtgaactttcccgagcccccatacccagatcagatcatctgccctgacgaggaagggacagaaggcacaatttcactgtggtcgatcatttcaaaggtgagaatcgaggcctgtatgtgggggatcggtaccgctattggcgagctccctccctactttatggccagggccgctcgattatccggagcagaacccgacgacgaggagtaccaggagttcgaagagatgcttgaacatgctgaatccgcacaggatttcgcttcgcgagctaagttggccgtacagaagcttgtgcagaaagtgggcttctttgggattttagcctgcgctagtattccaaatccattgtttgacctggcaggaatcacatgtggacattttctggtacctttctggacattcttcggcgcaacactgattggaaaggcgattatcaaaatgcacattcaaaagatatttgtcatcattactttctccaagcacattgtagagcaaatggtggcctttatcggagctgtccctgggattgggcctagtctgcagaagccattccaggaatacttggaggctcagcgtcagaagctgcaccacaaaagtgaaatgggcacaccccagggagagaactggctgtcttggatgttcgagaaattggtggttgtcatggtgtgttactttattctcagtatcatcaactccatggctcagtcatatgccaagcggatccagcagcgtctgaacagcgaggagaagactaagtag

SEQ ID NO: 246501 - DNA, 930 bp, Artificial Sequence
  Description of Artificial Sequence: Synthetic coding sequence
atggatttaaaatatgttcaaagaattgagaagcaattcttgctgtatgcctactggataggactcggtatcctctcctcagtcggactggggacaggcctgcacaccttcctgctgtacctgggcccacacatcgcgtctgtgacacttgctgcttatgagtgtaattctgtaaattttcccgaacctccatatcccgaccagattatctgcccggatgaggagggaacagaaggtacaatctctctgtggagcattatctctaaagtgcggattgaagcatgtatgtggggtatcggtacagccataggagaattacccccatactttatggcacgcgctgcacgactctccggcgcagaaccagacgacgaggagtaccaggagtttgaagagatgctcgagcacgcggaaagcgcgcaggactttgccagcagagccaagttggcggtacagaaactggttcaaaaggtgggtttctttggaatcctggcatgcgcttccattcccaaccccctgttcgacctggccggtattacatgcgggcactttctcgttcctttttggacattttttggcgctacacttattgggaaggccataattaagatgcacatccagaagatcttcgttattatcacatttagcaaacacattgtggaacagatggtggctttcatcggcgctgtccctggcattgggccttcccttcagaaaccgtttcaggagtatctggaggcccagcgccagaagttacaccacaaatccgaaatggggactcctcagggcgaaaattggcttagttggatgttcgaaaaacttgtagtcgttatggtctgttactttatcctgagcatcataaattcgatggcgcaaagctacgccaagcgaattcagcagcgactgaacagtgaagaaaagaccaaatag

SEQ ID NO: 246502 - DNA, 819 bp, Artificial Sequence
  Description of Artificial Sequence: Synthetic coding sequence
atggacctgaagggaccccatatcgccagcgttaccctggctgcttacgaatgtaattctgtgaacttccctgaaccgccttatcctgaccagataatctgtcccgatgaggagggcacagaaggcacaatttccctgtggagcataatatcgaaagtcaggatcgaagcatgtatgtggggaatcgggaccgctatcggagaactgcctccctattttatggctagggctgccagactctcaggggcagaacccgatgacgaagaataccaggagttcgaggagatgctggagcatgctgaatccgctcaggatttcgcgagtcgtgctaagctggccgtccagaagctcgtgcagaaagttggttttttcggaatccttgcttgcgcctcaatccccaatccccttttcgacctggccggtatcacatgtggccacttccttgtcccgttctggacgttctttggcgctactctgataggaaaagccatcatcaagatgcacattcagaaaatctttgttatcataaccttttcaaaacatatcgtggagcagatggtggccttcattggcgctgtgccaggtattggacctagcctgcagaagccatttcaagagtacctggaagctcaacgccagaagctgcatcacaaaagcgaaatgggaacaccccagggcgagaattggctcagttggatgtttgagaagctcgtggtggtcatggtgtgttacttcatattgtctatcatcaattcgatggcccagagctacgctaaacgcatccagcagcgattaaattccgaggagaaaacaaagtag

SEQ ID NO: 246503 - DNA, 645 bp, Artificial Sequence
  Description of Artificial Sequence: Synthetic coding sequence
atgtggggcattgggaccgccatcggggaactacctccctacttcatggctcgagctgccaggctgtcaggtgccgagccagacgacgaagagtatcaagaattcgaagaaatgttggaacacgcagaatccgctcaggacttcgcatcacgggcaaaactcgccgtgcagaagctcgttcagaaagtgggatttttcgggatactggcctgtgcatccatccccaaccctctgtttgatctagcgggtatcacttgcgggcatttcctggttcccttttggaccttcttcggggcaacactgatcggcaaagcaatcatcaagatgcacattcaaaagatcttcgtcatcataacgttttcaaaacatattgtggagcaaatggtcgccttcattggggcagtaccgggtataggtccttcgctacagaagccatttcaggagtatctggaagcacagcgacagaaactgcaccacaaatctgagatgggcactccacagggcgaaaactggttgagttggatgttcgagaagctcgttgtggtaatggtttgttatttcatcctctcaattatcaacagcatggcgcagagctatgcgaaacgtatccaacagaggctgaacagcgaggaaaaaacaaaatag

SEQ ID NO: 246504 - DNA, 1053 bp, Artificial Sequence
  Description of Artificial Sequence: Synthetic coding sequence
atggctgagaatggcaaaaattgtgaccagagacgtgtcgccatgaataaggagcatcataatgggaacttcacagatccatcttccgtgaatgaaaagaagcggagagaacgggaggaacgtcagaacatagtgctgtggcggcaaccattgatcactctgcagtatttctctctcgaaattctggtgatcctcaaagaatggacttctaagctctggcacagacaaagcattgtggtttctttcttactgctgctagcagttctgattgcgacttattatgtcgagggcgtgcatcagcagtatgtccaacgtattgaaaagcagttcctgctctacgcctactggatcggcctcggcatactgagcagcgtgggcttggggaccgggctccatacctttttactttacctggggatcggcaccgcaatcggcgaattgccaccatacttcatggccagggccgctcgcttaagtggcgctgaaccagatgatgaggagtaccaggaattcgaggagatgctggaacacgctgagtccgcacaggacttcgcaagcagagccaagctggcagtgcagaagctcgtgcaaaaagtgggctttttcgggattctcgcatgtgcatccattcccaatcccctgtttgacctggccggaatcacctgtggtcactttctcgtgcccttctggaccttctttggggcaacactgattggcaaagctataattaagatgcatattcagaaaatcttcgttatcatcaccttctccaagcatatcgttgagcagatggtagcatttatcggcgcagtaccaggcatcggaccgtctctgcagaagcctttccaggagtatttagaggctcaacggcagaagttgcaccataagtccgaaatgggtacaccacaaggggaaaactggctgagctggatgttcgagaaactggtcgtagtgatggtgtgttatttcatcttaagcattattaactccatggcccagagctacgctaagcggatccagcagcgtcttaactccgaggagaagacaaaatag

SEQ ID NO: 246505 - DNA, 1443 bp, Artificial Sequence
  Description of Artificial Sequence: Synthetic coding sequence
atgtccgatgtagcgatcgtgaaggagggttggctgcataagcggggagagtatatcaaaacctggaggccccgatacttccttctgaagaatgacgggacgtttattggttacaaggagcgcccacaggatgttgaccagagggaggcacctctcaacaatttctcggtggctcagtgccagctgatgaagacagagcgccctcgcccaaacaccttcatcattcgctgtttgcagtggaccaccgtaatagaacggactttccacgtggagaccccggaggaaagggaggagtggaccactgcaatacaaacagtggctgatggactgaagaaacaggaggaggaagagatggactttcgaagcggctccccaagtgataattctggggctgaagagatggaggtgagcctggcaaagcccaagcacagggtgaccatgaatgaattcgaatatctcaagctcttggggaaaggcacgttcggcaaggtcatccttgtgaaagagaaggccactggcagatattatgctatgaagatcctgaagaaggaggttatcgtggccaaggacgaggtggcccacacactgacggaaaatagagtgcttcagaatagtcgtcatcctttcctgaccgccttgaaatatagctttcagacccacgatcggctctgttttgtgatggagtatgccaatgggggtgaactttttttccacctatcaagggaaagagtgttctcggaagacagggcaaggttttatggagcagagatagtgtctgcactggactacctccacagcgagaagaacgtggtttatcgtgacctgaaactggaaaatctgatgctggacaaggacggccatatcaagataacagacttcggactctgtaaagagggcatcaaagacggcgctaccatgaagactttctgcggcacaccggagtacctcgcacccgaggttctggaagacaacgactacggaagagctgtggactggtggggcttgggcgttgtgatgtacgagatgatgtgcggcaggctgccattttataaccaagatcacgaaaaactgtttgaactcatcctgatggaagaaatcaggttccctcgaacattaggcccagaagccaaaagtctcctgagcggactgctaaaaaaagaccctaagcaacggctgggtggtggcagcgaggacgcaaaggagatcatgcagcaccggttctttgctgggattgtctggcagcatgtatatgagaagaagttgagtccaccttttaagcctcaagtgacttccgagactgacacaagatactttgacgaagaattcactgcccagatgattaccattacccccccagaccaggatgactccatggagtgcgtagacagcgagcggagacctcactttccccaattcagttacagtgcctctgggaccgcttag

SEQ ID NO: 246506 - DNA, 1443 bp, Artificial Sequence
  Description of Artificial Sequence: Synthetic coding sequence
atgtccgacgtcgcaatcgtcaaggagggctggctacacaagcgaggagaatatataaaaacatggcgacctcggtacttcctgcttaaaaatgacgggacgttcattggctacaaggagcggcctcaggatgtagatcagagagaggccccactgaataattttagcgtggcccagtgccagcttatgaaaacagagagaccaagacctaacacatttattattcggtgtctgcagtggactaccgtgattgagcgcacttttcatgtggaaacccctgaagagagagaggaatggactacagcaattcagactgtcgcggacggcctgaagaagcaagaggaggaggagatggacttccgatccggctcacccagcgacaacagcggggctgaagagatggaggtgtcgctcgccaagcccaagcatcgagtcacaatgaacgaattcgaatatttaaagctgctgggtaaggggacatttggaaaagtgatcctggtgaaggaaaaggccaccggacggtactacgcgatgaaaatactcaagaaagaggttatcgtggccaaggatgaagtggctcatacactaacagagaatcgcgtgctacagaatagccggcatcctttcctaaccgcactcaagtacagcttccagacacatgatagactctgttttgtgatggagtacgcaaatggtggtgaactcttttttcatctctcaagagaacgcgtgttcagtgaagatagagctagattctatggagctgaaatagtgtctgccttggattacctgcacagtgaaaagaacgtcgtctaccgggatctgaaactcgagaacctcatgctggataaagacggccatattaagattactgactttggcctttgcaaagaggggattaaagatggcgctacaatgaaaacgttttgcggcacgcccgagtatctggctccagaggttttagaagacaatgattatggtagggcagtagactggtggggcctcggagtcgtaatgtatgaaatgatgtgcggaagacttcctttctataaccaggatcacgagaagctattcgaactgatattaatggaagagataagattccctcgcaccttgggccctgaagcaaagagcctgttgtcaggacttttgaagaaagatccgaagcagcgcctgggaggaggatcagaggatgccaaggagattatgcagcataggttttttgccggaatcgtgtggcagcacgtgtacgaaaaaaagctgagtcccccattcaagccccaggtgacaagtgaaactgacacccggtattttgacgaggaatttacggcccaaatgatcactatcacacctccagatcaagacgactcaatggaatgcgttgactccgaaagaaggccccatttccctcagttttcgtactctgcaagtggaacagcttag

SEQ ID NO: 246507 - DNA, 1257 bp, Artificial Sequence
  Description of Artificial Sequence: Synthetic coding sequence
atgaagacggaaagacccaggcccaacacgttcatcatccgttgcttgcagtggaccacagtaatcgaaagaacgtttcacgttgaaacacctgaagagagggaggaatggacaacggcaatacagacagttgcggatggtctgaagaagcaggaagaggaggaaatggattttcggtccggatcaccctcggataattccggcgctgaggagatggaagtttccctggctaaacccaaacatagagttacgatgaatgagtttgaataccttaagctactgggcaaaggaacatttgggaaggtgattctggtcaaagagaaggccaccggtcggtactacgcaatgaaaatcctgaaaaaagaggtgatcgtggcaaaggacgaggtcgcccacaccctgaccgaaaatagagtactccagaactcacggcatcctttcctcactgccttaaagtattcatttcaaacccacgaccgtctctgttttgttatggagtacgccaatggcggtgagctcttctttcacctgagtagggagagggtatttagtgaggatagagccaggttttatggggcagaaatagtcagtgctctagactacctgcatagtgagaagaacgtcgtgtaccgggatttaaagttggaaaatttaatgttggacaaagatggacacatcaagattacagactttggcctatgtaaggaggggatcaaggatggcgcaacgatgaagacattttgcgggactcctgagtacctggcacccgaggtcctggaggacaacgattacggtcgggctgtcgactggtggggcctgggcgtagtaatgtatgaaatgatgtgtggtagacttcccttctataaccaagatcacgagaaactgttcgagctgatcctgatggaagagattcgttttccccgaaccttagggccagaggccaaaagcctgctgtcaggactactgaagaaggatcctaagcaacgacttggaggcggaagtgaagacgcaaaagaaatcatgcaacataggttctttgcaggaatcgtctggcagcacgtgtacgaaaaaaagctttcacccccattcaaacctcaggtcaccagtgaaacagataccaggtatttcgacgaagaattcactgcacaaatgattacaattacgcctccggatcaggatgattcaatggaatgtgtggattccgagcggaggccccacttcccccagtttagctactccgcaagcggtactgcctag

SEQ ID NO: 246508 - DNA, 1443 bp, Artificial Sequence
  Description of Artificial Sequence: Synthetic coding sequence
atgagcgatgtcgcgatagtgaaggagggatggttgcataagagaggcgagtacatcaaaacatggcggcctcgctactttttgctcaagaacgatgggacgtttattgggtacaaggaacgcccacaggacgtcgaccagagagaggctcccttgaataacttttccgtggcccagtgtcagctcatgaagaccgaacggccacggccaaatacatttattatccggtgccttcagtggacgacagtgattgagcgaacgtttcatgtggagacacccgaggaaagggaagagtggacaacagcaatccagaccgtagccgacggcctgaaaaaacaggaggaagaagagatggatttccgctccggatcacctagcgataactccggggcagaagaaatggaagtctccctagccaagccaaagcaccgggtgacaatgaacgagttcgaatacctgaaattgctcgggaaggggacattcggtaaggtgattctggtgaaagaaaaggctaccggcaggtattacgccatgaaaatactcaagaaggaggttatagtggcaaaagatgaagtggctcatactttaactgagaacagagtcctgcagaactcacgccaccctttcctgaccgccctcaaatacagttttcagacacacgaccggttgtgtttcgtaatggagtacgctaacgggggagagctgttttttcatctgagcagagaaagagtgttttcggaagaccgagcccgtttctatggggctgaaattgtgtccgcactcgactatctccacagcgaaaagaatgtggtctatcgcgacctcaagctggagaatttaatgcttgacaaggatgggcacataaaaattacagacttcggactttgtaaggaggggataaaggatggcgctacgatgaagaccttctgtggtactcctgaatacttggctcctgaagtccttgaggacaacgattacggacgcgcagtagattggtggggccttggggtggttatgtatgaaatgatgtgcggccgtctgcccttctacaaccaagatcatgaaaaattatttgaacttatcctgatggaagaaattcgatttccaaggacgttggggcctgaggcaaaatccctgctgagcggactgctgaaaaaggatccgaagcagcgattgggaggcggatcagaggatgccaaagagattatgcagcaccgctttttcgctggtattgtctggcagcatgtgtacgaaaaaaaactctcacctcccttcaaaccacaggtgacctctgaaacggacacgcgatatttcgatgaggaatttactgctcagatgatcactataacgccacctgaccaggacgacagcatggagtgcgtggacagtgaacggaggcctcatttccctcagttttcttactctgctagcggcaccgcctag

SEQ ID NO: 246509 - DNA, 1443 bp, Artificial Sequence
  Description of Artificial Sequence: Synthetic coding sequence
atgtcagacgtggccattgtgaaggagggttggctgcacaagcggggtgagtatatcaaaacatggagacctaggtattttctgcttaagaatgacgggacatttattggatacaaggagaggccgcaagatgtggaccagagagaagcccctctgaacaactttagcgtggcccagtgccagttaatgaaaacagaaagacccagacctaacactttcataatccgatgtctgcagtggacaactgtcattgagaggacatttcacgtcgagacaccagaggagagagaagagtggaccactgctatacagacagtcgccgacggccttaagaaacaggaagaggaagagatggacttcagaagcggctcaccttccgataattccggcgctgaagagatggaggtttctttggctaaacccaagcatcgtgtgactatgaatgaatttgagtatctgaagctgcttgggaagggcacattcggcaaagtgattctcgttaaagagaaggctacgggcaggtactacgcaatgaagatcctgaaaaaggaggtcatcgtagctaaagacgaggtggcgcatacacttacagagaatagggtgttacaaaacagcaggcacccctttctgactgcgctgaagtacagcttccagacccacgatcggctttgcttcgtaatggaatacgcaaatggaggtgaactgttttttcacctgtcccgcgaaagggtcttcagcgaggatcgtgcccgattttatggggctgaaatcgtgtcagctttagactacctgcactcagaaaagaacgtggtgtaccgggatctgaaactggagaacctaatgctggacaaggacgggcatatcaaaatcactgactttggcctgtgcaaagagggcattaaagatggtgctaccatgaaaactttctgtggaacaccagaataccttgccccagaagtcttggaagataatgactatgggagggccgttgactggtggggactcggcgtggtcatgtacgaaatgatgtgtggcagacttcccttctacaaccaggaccacgagaagttgttcgagctgatcctcatggaggagatccggttccctcggactctcggtccagaagccaagagtctgctgagtgggctcttaaaaaaagaccctaaacaacggctgggaggcggatcagaggatgctaaagaaatcatgcagcaccggttctttgccggtattgtctggcaacacgtctacgagaagaagctgagtccacccttcaagccccaggtgacttctgaaaccgacaccagatatttcgacgaggagtttacagctcagatgatcactataacccccccagatcaggatgatagcatggagtgcgtcgatagcgagcgcaggccccactttcctcagttttcatacagtgcttcaggtacagcttag

SEQ ID NO: 246510 - DNA, 1443 bp, Artificial Sequence
  Description of Artificial Sequence: Synthetic coding sequence
atgtccgacgtcgcaatagtcaaagaaggctggcttcacaaacgcggagaatacattaagacctggcgaccgcgttatttcctcctgaaaaacgatgggacattcattggctacaaggaaaggccccaggatgtggaccagcgggaggcaccactgaataacttcagcgtggctcaatgtcagctgatgaaaaccgagcggcctagaccaaacacttttatcatcagatgtctgcagtggaccactgtgatcgaacgaaccttccacgtcgaaacacctgaggaaagagaggaatggacaaccgccatccagactgtcgcagatggcctgaaaaagcaggaagaagaggaaatggacttccgatccggctctccgtcagacaatagtggagcagaggagatggaggtgtctctggctaagcccaaacaccgtgtgaccatgaatgagtttgagtatctgaaactgctcggcaaaggtacttttggcaaagtgatcctggtgaaagaaaaggcaacagggcgatactacgccatgaagatcttgaagaaggaagttatcgtggccaaggacgaggtggcccacacgttgactgaaaatcgggtgctgcagaattctagacatcctttcctcactgcattaaagtactcatttcagacgcatgatagactttgcttcgtgatggagtacgcaaacgggggagagctgttctttcacttatcgcgggaaagggtcttcagcgaagatcgtgccaggttctatggggcagagatcgtgtcagccctggattatctacatagcgagaaaaacgtggtttaccgcgacttgaagctggaaaacctgatgctggataaggacggacacattaagattaccgactttgggctctgtaaggaaggaataaaggacggagccactatgaaaacattttgcggcactcctgagtacctcgctcctgaagtcctggaagataacgactatggcagggctgtcgattggtggggattaggggtcgtaatgtatgaaatgatgtgtggcaggctcccattttataatcaggatcatgagaaacttttcgaactgatccttatggaggaaatcagatttccaagaactcttggacctgaggccaagtcacttttatccgggctgttaaagaaagaccccaagcagagactggggggtggcagcgaagacgccaaagagattatgcagcatcgattctttgctggtattgtctggcagcacgtgtatgaaaagaagcttagtcctccctttaagccacaagtgacttcggagaccgatacacgatatttcgacgaagagttcaccgctcaaatgattaccatcactccgcctgatcaagacgactccatggagtgcgttgatagcgagcgaaggccgcacttccctcaattctcctactctgcttctggcaccgcctag

SEQ ID NO: 246511 - DNA, 279 bp, Artificial Sequence
  Description of Artificial Sequence: Synthetic coding sequence
atgagcgatgtggccatcgttaaggaaggctggttgcacaaaagaggcgagtacatcaagacatggaggcctaggtatttcctactgaaaaatgatggcacgtttatcggatacaaagagcggccacaggatgtcgatcaaagagaggctcctctgaataattttagcgtggctcagtgtcagcttatgaaaaccgagcggccacgccctaatacctttattatccggtgcttacaatggaccacagtcattgagagaaccttccacgttgagacgtag

SEQ ID NO: 246512 - DNA, 2421 bp, Artificial Sequence
  Description of Artificial Sequence: Synthetic coding sequence
atggcttctggcgcagattccaagggagacgacctatcgacagcaattttaaagcaaaagaaccgccctaatcgtctgatcgtggatgaggccataaatgaagacaactccgtagtttcccttagccagcccaaaatggatgagcttcagctgtttcggggtgacactgtgctcttgaagggaaaaaagagacgcgaagccgtttgtatcgtgctgtccgatgacacatgcagcgatgagaaaattagaatgaacagggtcgtccggaataacctgagggtgcgtctgggtgacgtgatatccatccagccttgccctgatgtcaaatacgggaagagaatccacgtcctgccaatcgacgacactgtggagggcatcaccggcaacctttttgaggtttatctgaagccttacttcctggaggcatacagacccatcaggaaaggcgatattttccttgtgagagggggaatgagagctgtcgagtttaaggtcgttgaaaccgacccctcgccctattgcattgtggcaccagacacagttattcattgcgagggcgagcccattaaaagggaagatgaggaggagagcttgaacgaggtgggttatgatgatattgggggatgtcggaagcagctggcgcagatcaaagaaatggtcgagcttccactgcgtcatccagctttatttaaggcaattggagtcaaacctccaagaggcatcctattgtatggtcctcctgggaccggcaagacgcttattgccagggcagtagctaacgagacaggagctttcttctttcttattaacggaccagaaataatgtccaaactcgcaggtgaatctgagtccaacctgaggaaagccttcgaggaggcggaaaagaatgcaccagccattatcttcatcgacgaactggacgcaatcgcaccaaagcgagaaaagacccatggggaagtagagcgcaggattgtatcacagctcctgactttgatggacgggctgaagcaacgcgctcatgtgatagttatggcagcaaccaacaggcccaacagtatcgaccctgccctcagacggtttggcagattcgaccgcgaggttgatatcgggatcccagacgctaccggtcggctcgagatcctacagatacacacaaaaaatatgaaactcgctgacgatgtcgacttggagcaggtggccaatgagacccatgggcatgtgggggcagacctagccgcactgtgttctgaggcagctctccaagccatcaggaaaaaaatggacctgatcgacctggaagacgagactattgacgcagaagtgatgaatagccttgcagtcacaatggatgatttcaggtgggcactcagccaatccaatccaagcgctctcagggaaacggtagttgaggttcctcaagtgacctgggaggatatagggggactcgaagacgtaaaaagggagctgcaggagctcgtgcagtaccccgtcgagcatccggacaagtttttaaaatttggcatgacaccatctaagggagttctgttctacggccctcctgggtgtggaaagacgctcctggccaaggctattgctaacgagtgtcaggccaatttcatttctattaagggccctgaactcctaaccatgtggttcggcgaaagcgaggctaatgtccgggagatcttcgataaagcccgtcaggcggctccttgcgtgttatttttcgatgagcttgatagcattgctaaggccaggggtggtaatatcggcgacggcggaggagccgctgacagggtaattaaccagatacttacagagatggatggcatgagcaccaaaaaaaacgtgttcataatcggtgccaccaacaggcccgatatcattgacccggcaattctcaggcctggcagactggaccagctgatctacattcctctgcccgatgagaagtctagggtggctatactgaaagctaatctccggaaatctcctgtggctaaggatgtcgacctagaatttctcgcaaaaatgactaacgggttttccggggctgacttgactgaaatatgccaacgcgcatgcaagcttgcaatcagggaaagtattgaatctgagatcaggcgggagcgggagaggcagactaatccaagcgccatggaggtggaagaagatgatcctgtcccggaaattcggagggaccacttcgaggaagccatgcgctttgccaggcgctctgtgtctgacaacgacatcaggaagtatgagatgttcgcacaaacattgcagcaaagtagaggttttgggtccttccgctttccatccggcaaccagggcggagccggtccctctcagggatctggtggcggtacaggtggctctgtatacaccgaagacaatgatgatgacctttacggctag

SEQ ID NO: 246513 - DNA, 3669 bp, Artificial Sequence
  Description of Artificial Sequence: Synthetic coding sequence
atgtctcaaccgcctccgcctccaccccctctgcccccaccgcctccaccaccagaggctccacagactcccagctcactggctagcgctgctgcgtcaggaggattgttgaaacggagggatcgacgcatcctgtccggtagttgccccgacccgaagtgccaggctcgattattcttcccagcttctggaagtgtcagtatcgaatgtaccgagtgtggccagagacacgaacagcagcagctcctcggcgtggaggaggttacggacccagacgtggtcctgcataatctcctcaggaatgcgttattgggcgtcaccggggcacccaaaaagaacactgagctggtgaaggtgatgggcctctcaaattaccattgcaagctgctgagcccgattctggccagatacgggatggacaaacagactggacgcgctaagctgttgagggacatgaaccagggggaactgttcgattgtgccctgttaggagatcgggctttcctgatcgagcctgagcatgtgaataccgtgggatatgggaaggacagatccggcagtcttttatatcttcacgataccttagaagatataaagcgcgcaaacaaatcccaggagtgcctgattccggttcacgttgatggagatggacattgtctagtgcatgcagtgtctcgcgctttagtaggtagggagctgttctggcacgcccttagagagaatctgaaacagcatttccaacagcaccttgcacgttatcaagccctgtttcatgattttattgacgccgctgagtgggaggatatcattaatgaatgcgatcctcttttcgtgccaccagagggcgtccccctaggcttacggaatatccatatcttcgggctggccaatgttctgcatagacccatcattctgctggacagtctctctggtatgcgctccagcggcgattacagcgccaccttcttaccaggcctgattccagctgagaaatgtacggggaaggacggacacctgaacaagcctatatgtatagcctggtcttcctctggcagaaaccattacatacctctggtcggcattaagggagccgctttgccgaaattgcctatgaatctgcttcccaaagcgtggggggttccccaggatttgatcaagaaatacatcaaactcgaggaggatggcggttgtgtaataggaggcgaccgaagtttgcaggacaaatacctgttgagacttgtcgccgcaatggaggaggtctttatggataagcacggcatccatccttctttggtggctgacgtccaccagtatttttacagacgtacaggcgtgatcggggtgcaacccgaggaggtgaccgcagcggctaagaaagcagttatggataatagactgcataaatgcctcctgtgtggcgctctctccgagttacatgtgccccctgagtggctggctccaggaggaaaactgtacaacctggctaaatctacccacggtcaactgcgaactgataagaattattccttccccctcaacaacctcgtatgctcgtatgacagtgtgaaggacgtcctggtgcctgactacggaatgagcaaccttaccgcttgcaattggtgtcatggaacctctgttcgcaaagttcggggagatggaagcatcgtgtatcttgacggggatcgaaccaacagccgcagcaccggcggaaagtgcgggtgtgggtttaaacacttttgggacggaaaagagtatgacaacctccctgaggcctttcccataactctggagtggggcggaagagtggttcgagaaactgtatactggttccagtatgaatccgatagttcactgaacagcaacgtatatgacgtggcgatgaagttggtgacaaaacactttccaggggagttcggctctgagattctcgtgcagaaggttgttcacacgattctgcaccagaccgcaaagaagaaccccgacgactacacacccgtgaacatagacggtgcgcatgcccagagagtaggggacgtgcaaggtcaggaatccgaatcacagctgcccacaaaaatcatcctcaccggccagaagactaagacccttcacaaagaggaactaaatatgagcaaaactgaacgcactattcaacagaatataacagagcaggcctctgttatgcagaaacgaaaaactgagaaattgaaacaagaacaaaaaggacagccaaggaccgtatcaccgtcgactatccgtgacgggccatcctctgcccctgctacccccacaaaggctccctactccccgaccaccagcaaagagaagaagatcagaatcacaaccaatgacggtcgccagagcatggttactctgaaatcctctacaacctttttcgagttgcaggagagcatagcacgcgagtttaatatccccccttacctgcaatgcatccggtatggtttccctcccaaagaactcatgccgcctcaagccggtatggagaaggagcctgtgccactccagcacggcgaccgcatcaccatcgagattctgaaaagcaaggccgaaggagggcagtctgctgccgcacatagcgcccataccgtgaagcaagaggacattgccgtcactggaaaactttcctcaaaggagcttcaggagcaggccgagaaggaaatgtatagcttgtgtctgttggccacgctgatgggcgaggacgtctggtcatacgccaaagggcttcctcatatgtttcagcagggaggggtcttttactccattatgaagaagactatgggtatggccgatggtaagcactgcacattccctcatctccctgggaagacctttgtctacaacgcctccgaagaccggctggagttgtgcgtggatgccgcagggcacttcccaataggccctgacgtggaagacttagtcaaagaagccgtaagccaggtgagagccgaagcaaccacaaggtcgagggagagcagcccatcccatggcctcttgaagctgggcagtggcggtgtcgtgaaaaagaagtcggaacagctacacaacgtcacggcctttcaggggaaagggcactcgctgggtaccgcttctggtaacccccatctggatcccagggccagggaaaccagtgtggtaagaaaacacaacaccggcacagactttagcaattcatctactaaaacagaaccctcagtgttcaccgcttcctcatccaactctgaattgattcggattgcccctggcgtagtcaccatgagggatggtcgtcaactcgatcccgacctggttgaagcacagcgcaaaaaattgcaggagatggtatctagtatccaagccagcatggatcgtcacttgcgagatcaatccactgagcaaagtccgagtgatctgccgcagaggaagactgaagtcgtctcttcctcggctaagtcagggtccctccaaactgggttgccagagagctttccactgacagggggtacggagaacttaaacactgaaaccacagatggttgtgtggcagacgccctgggcgctgcgttcgcgaccaggtccaaagctcagcgagggaactctgttgaggaactcgaggagatggattcccaggatgcagagatgacaaacactaccgagccaatggaccactcgtag

SEQ ID NO: 246514 - DNA, 3381 bp, Artificial Sequence
  Description of Artificial Sequence: Synthetic coding sequence
atggaacccaatgattctacctcaacagccgtcgaggaacccgactcacttgaagtcctggttaagaccctcgattcccaaaccaggacttttatcgtcggcgcacagatgaatgtgaaggagtttaaggagcacattgccgcatctgtgtctatccccagtgaaaaacagaggttaatataccaggggagggtcctgcaggacgataagaaactacaggaatacaacgtgggcggaaaagtcatccacctcgtggaaagggcccctccccagacacacttgcctagtggcgcatcatcaggtaccgggtctgcaagcgctacgcatggaggcggtagcccaccaggtactcggggtccgggtgcttcagtacatgacaggaacgcaaattcatacgtcatggtgggaacattcaacctcccttctgatggttccgccgtcgacgtccatatcaacatggagcaggcccctatccaatcagaacccagagtgcgactggtcatggctcagcatatgatccgagacatccagaccctcttgtcacggatggagtgtcgagggggacctcagccacagcacagtcagccccctcctcagcccccagccgtcacccccgaaccagtggctctttcctctcaaacgagtgagcccgtggaatctgaggcccctcctagagaacccatggaggccgaagaggttgaggaaagagcacctgctcagaacccggaactcacgccaggcccagcaccagccggacctacaccagcaccagaaacgaacgccccaaatcatccctccccagcagagtatgtagaggtcttacaggagctgcagcgattagagtcacggttacagcctttcttgcagcggtattatgaggtgctcggagctgccgctactacagattataataacaatcacgaaggccgagaagaggatcagcgtctcataaatcttgtgggggagagtctgagactgctggggaatacctttgttgccctgagcgacctgcgctgcaatctcgcctgcacaccaccacggcatctgcatgtggttaggccaatgtcccactacacaactccaatggtgctgcagcaagctgccatacctatacagatcaatgtgggtacaacagtgacaatgaccggaaacggaacaaggccgccacccacccccaatgctgaggccccacctcctggcccaggccaggccagttctgttgcaccaagttctaccaatgtggaaagtagcgccgagggggctccccctcccggacctgcccctcctccagctacctctcaccctcgtgtgatccgtatcagccatcagtctgttgagcctgtagtgatgatgcatatgaatatccaggatagtgggacccagcctggtggagttcccagcgctcccaccggcccattgggcccaccgggacatggacagactctcggtcagcaggtccctggtttccccaccgctcctacccgggtcgtgattgctagacctacacccccacaggccaggccttcacaccccggaggacctcccgtgtctggaactctccaaggcgctgggctgggcaccaacgccagcctggctcagatggtgtccggactggtcggccagttgctgatgcaacctgtgttagttgcgcagggaacgccgggaatggcacctcccccagcccctgctacagcaagtgcctcagctggcactacaaatactgccacaactgctggacccgcaccaggcggtcctgcccagcctccacccaccccacagccctccatggcagatctccagttctcacagcttctggggaacctgctgggcccagccggtcccggagccggaggtagcggagtcgcttctcctacaatcacggtggccatgccaggcgtgcccgcattccttcagggtatgacagatttccttcaagccacccagaccgccccaccgccacctccgcctcctccccctcctccccctgctcccgagcagcagacaatgccaccccctggaagtccgtctggcggtgctggatctcctggcggattgggcttagaatctttgtcacccgagttcttcacgagcgtcgtgcagggtgttttgtcaagcctgctaggcagcctgggagccagggcagggtctagcgagagtatcgccgcatttattcagagactcagtggatcatctaacatatttgaacccggtgccgacggggcactcggttttttcggggctctgctctccctcctgtgccagaacttctctatggtggacgtcgtgatgctcctgcatgggcatttccagccactgcagaggctgcagccccagctgcggtctttcttccatcaacactatctagggggtcaagaaccaacacctagtaatatcaggatggccactcacacacttataaccgggctggaggagtacgtgcgcgagtcatttagtctggttcaggttcaacctggcgtggatataatcagaaccaaccttgagttcttgcaggaacaatttaacagcatcgcggcacacgtcctccattgtaccgacagtgggttcggagccagattgttagagctgtgcaatcagggtttgtttgagtgcctcgctctgaatttgcattgtttaggcggacaacagatggaactggctgccgtgattaatggtaggatcagaaggatgagcaggggcgtcaaccccagtctcgtgtcctggcttacaactatgatggggctcagattacaagtggtgctggagcatatgcccgttggccctgatgccatcctgagatatgttaggcgggtgggggatcccccacagcccttgcccgaggagccgatggaagttcagggagctgaacgtgcttctcctgagccccagagagagaacgcgtcccctgcccctgggacaacagctgaggaggctatgtctaggggccctccccctgccccagaaggcggaagtcgagatgaacaggacggagcttcagcggaaactgagccttgggccgctgcagtgccaccggagtgggtcccaatcatccagcaggatatccagtcccagcggaaagtgaaaccgcaaccccctctgtccgatgcctacctgtccggaatgccggctaaacgtcgcaaaaccatgcagggtgagggtccccagctcctgctcagtgaagctgttagccgtgccgctaaagccgcaggggcaagacctctgaccagtcccgagtcactgagccgcgatctcgaggcaccggaggtgcaggagagctacagacaacagctcaggagcgacattcagaagcggctccaggaagaccctaactatagtccacagagattccccaatgcccaacgggcttttgccgacgacccgtag

SEQ ID NO: 246515 - DNA, 3795 bp, Artificial Sequence
  Description of Artificial Sequence: Synthetic coding sequence
atgtccacattgtacgtctccccacaccccgatgcttttccctctctccgggcactgatcgccgcaaggtacggagaggcaggagaaggcccaggatgggggggtgcccacccccgaatctgcctccaaccaccacccaccagccgaacacccttccccccaccacgactcccggcactggaacagggccctgggggattgtgggtttggggggcaactgcagtcgctcagctgctgtggcccgctggtctgggaggtcccggtggtagcagggctgcggtgctggttcaacagtgggtcagctatgctgatactgagcttatccctgccgcttgtggagccacgctgccggctctcggcctaaggagcagcgcacaagatccgcaagccgtgctgggcgctttgggccgtgcgctctctccactcgaagagtggctccggttacacacctatcttgccggagaggcacctacgctggcagacttagcagccgtgacggccctgcttttgccttttcgctacgtcctcgatccacctgcccgacggatctggaacaacgtgacaaggtggtttgtgacttgtgtccggcaacccgagttccgggcagtgttgggcgaggtggtcctctattccggcgcacggcctctgagtcaccaaccaggaccggaagcaccagccctgcctaaaactgcggctcagctgaagaaagaggcaaagaagcgcgagaaactcgagaagtttcagcagaagcaaaaaattcagcagcagcaaccacccccaggagagaagaaacccaagccggaaaaaagggagaagcgcgatcctggggtgattacttacgatctcccgacacctcctggcgagaaaaaggacgtgtcgggcccaatgcccgacagctactcacctagatacgtggaagccgcatggtacccctggtgggagcagcaggggttctttaagcccgagtacggccgacctaacgtttccgctgctaacccgaggggcgtcttcatgatgtgcatccctccccctaatgtaaccggaagcctccatcttggccatgcgttaacgaatgccattcaggatagtcttacgagatggcatcggatgcggggtgaaactaccctctggaatccaggttgtgaccacgcagggattgcaactcaggtggtggtggaaaagaaactatggcgtgagcaggggctttcacggcatcaactgggaagggaagcattcttgcaggaggtatggaaatggaaggaagaaaaaggtgatcggatctaccaccagctgaagaagctgggctcctcattggattgggacagggcgtgtttcaccatggatcccaagttatctgccgctgttacggaggctttcgtcagactacacgaagaaggtatcatatatcgcagtacccgactcgtcaactggagttgcacactaaactctgccatctccgatatagaagttgacaagaaggagctcacaggcaggactctcctgtccgttcccggatacaaggagaaagttgaattcggagtgctcgttagctttgcctacaaagtccaggggtccgattcagatgaggaggtcgttgttgcgaccacacgcatcgagacaatgctgggagacgtggccgttgccgtgcaccccaaggacacccggtaccagcatctaaagggtaaaaacgttatccatccctttttgtctcgatccctgccaattgtgtttgacgaatttgtggacatggactttggaaccggagcagtaaaaataacccccgctcatgaccagaacgattatgaagtcggacagcggcacggactggaggccattagcattatggattcccgcggagccctgattaacgttccgcctccctttctgggccttccaaggttcgaagctcgcaaagccgtgctggtggcgctgaaagagcgagggctgtttcgagggattgaggataatccaatggtggtgcctctatgtaaccgaagcaaagatgtggtggaaccgttgctgcgacctcagtggtacgtgcgctgcggggaaatggcccaggcagcgtcagccgctgtgacccggggagatctgcggattctgcccgaggctcaccaacggacatggcacgcatggatggataatatacgtgagtggtgtatctcacggcagctatggtgggggcataggattcctgcttattttgtgaccgtctccgacccagcggtgcctcccggtgaagatccagacgggagatattgggtcagcgggcgtaacgaggctgaggcgagggagaaagcagccaaggagttcggcgtgtctcctgacaagatcagccttcagcaggacgaggatgtgctcgatacgtggttcagctctggcctcttcccactgtctatccttggctggcccaatcagagtgaggatttgtcagtattctaccccggaaccctattggagaccgggcatgacatcctgtttttctgggtggctcggatggtgatgctcgggctgaagctgaccggacgcctgcccttccgtgaggtctacctgcacgccattgtccgcgatgctcatgggaggaagatgtctaagagcttaggcaatgttattgaccccttagacgtaatctatggcatttccctccaaggactccacaatcaactgctgaatagtaaccttgacccctctgaggtggagaaggccaaggaagggcagaaagccgatttccctgcaggcattccagaatgtggaacagacgctctgagatttggcctttgcgcttatatgagccaaggtcgcgacatcaaccttgatgttaataggattctgggataccgccacttttgcaacaaattgtggaacgctaccaaatttgcactgcgcggtcttgggaagggcttcgtgccttcaccaacttcccagcctggtggacatgaatccctggtcgaccggtggatacgaagccgcttgaccgaagcggttcgactctctaaccaaggatttcaggcatacgactttcccgctgtaactaccgcccagtacagtttctggctgtacgagttatgtgatgtttatctcgaatgcctgaagcccgtattgaacggtgttgaccaggtcgccgctgagtgcgccaggcagacgctgtacacttgcctggatgtgggcctgcgcctgctcagtccatttatgccattcgtaactgaagagttgttccaaagattacctcggagaatgccccaggccccaccttctctctgcgtgacgccctaccctgagcccagcgagtgttcctggaaggacccagaggctgaggcggctctggaattggccctgtccatcacccgagccgttaggagccttcgagccgattataacctgactcgaatccgccctgactgttttcttgaagtggcggatgaggcaacaggggctctggcgtccgcagtcagtgggtatgtacaggccttagcttccgcaggcgtagtcgccgtgttggcccttggcgctcccgctcctcaaggctgtgccgttgccctcgccagtgaccgttgtagcatacatcttcaactgcaaggcctagtggacccagctcgtgagttaggcaagctgcaggcaaaacgggtggaggcccagagacaggcacagcggctgagagagcgtcgcgcagcatccggctatccagtcaaagtgccactggaggtgcaggaggcggacgaggcaaaactgcagcagaccgaagctgaactgcgtaaagtcgacgaagcaatagcactcttccagaagatgctgtag

SEQ ID NO: 246516 - DNA, 525 bp, Artificial Sequence
  Description of Artificial Sequence: Synthetic coding sequence
atgtccactttatacgtctccccacatcctgatgctttcccatccctgagagccctgatcgctgccaggtacggggaggcaggtgagggtcctgggtggggcggagcacatcccaggatctgcctccagccaccacccacatcccggacaagcttcccacccccacggctgccagccttagagcagggacccggaggtctttgggtgtggggtgctacggctgtggcccaactcctctggcccgcaggactgggcggtcctggtggctcaagggcagctgtgctggttcagcaatgggtgtcttacgccgacactgagttaatccccgctgcctgtggcgctactctccccgcactggggctgcggtcctccgcccaggacccccaggccgtgttaggagctctcggaagggccctctccccgctggaggagtggcttcggctacatacctacctagctggtgaggccccaaccctcgctgatctggctgccgttacggctcttcttttaccttttcggtactag

SEQ ID NO: 246517 - DNA, 525 bp, Artificial Sequence
  Description of Artificial Sequence: Synthetic coding sequence
atgtcaactttgtatgtgtctcctcatcctgacgcctttcccagtcttcgggcattgattgctgctagatacggcgaggctggcgaaggccctgggtggggcggagcccatccacggatatgcctgcagcctcctccgacttccagaacctccttccccccaccacggctgcctgctctggagcaaggcccaggcggactatgggtgtggggggcaaccgctgttgcacagctcctttggccagccggattgggcggaccagggggatctagagctgccgtgctcgtgcagcagtgggtgtcttacgctgataccgagctgattcccgctgcttgtggggctactctgcctgcgctgggcttaaggagcagtgcacaagaccctcaggccgtcctcggagccctgggaagagctctcagccctctggaggaatggctgcggctccatacataccttgccggtgaggcaccaacccttgcagatcttgcggcagtgaccgctctcctactgccttttcggtattag

SEQ ID NO: 246518 - DNA, 867 bp, Artificial Sequence
  Description of Artificial Sequence: Synthetic coding sequence
taaaaggagaggggtctgtttcgcggaattgaggataatcctatggttgttcctctctgtaaccgctccaaagacgtcgtcgaacccctgctgcgcccacagtgggagtggtgcatttcacgccagctctggtggggccacagaatacctgcctatttcgtgacagtctccgatcccgcagtacctcctggagaggaccctgatgggcgatactgggtgtcaggccgtaatgaggcagaagctcgggaaaaagctgctaaggaatttggagtgagtcctgacaagattagtctacaacaggacgaggacgtactggacacatggttttccagcggactttttcctctctctattctaggatggccgaaccaaagcgaggacctatcagtcttttatcccggaactctgctggagaccggacatgatattttgttcttttgggtagcccgaatggttatgctgggcctgaaactgaccggacgactccccttccgcgaggtttacttgcatgcaattgtaagggacgctcacgggcgtaagatgagcaagagtctgggcaatgtcatcgatccactcgatgtgatctacggaatcagcttgcaaggacttcataaccaactgctgaacagcaatttagaccccagtgaggtggaaaaggctaaggaagggcagaaagcggatttccctgccggaattcctgagtgcggaaccgacgctctgcgctttggactgtgtgcctatatgagtcagggaagagacataaacctggatgtaaacaggattctcggataccggcacttctgcaacaagttatggaacgcaaccaagttcgcactgagaggcctagggaagggtttcgtgccatag

SEQ ID NO: 246519 - DNA, 3795 bp, Artificial Sequence
  Description of Artificial Sequence: Synthetic coding sequence
atgagcaccttgtatgtgtccccacacccggacgccttccccagtctccgggcacttatagccgctcgctatggtgaggcaggcgaaggcccaggctggggaggagcacacccacgaatctgcctccagccccctccgacgagccgcacctcttttcctcctcccagactgccggctctggaacaaggacccggagggctgtgggtttggggcgctacagctgttgcccagctcctgtggccggcaggtctcggaggtcctggcggatcacgcgctgcagtgttagtgcagcagtgggtgagctacgctgacacagaactgatcccagctgcatgcggggcaacgctgcctgcacttggcctgaggtcgtcagctcaggacccgcaggctgtcttgggcgctcttggaagggcactgtctccgctcgaagagtggttgcgcctccatacctacctggcgggtgaagcaccgactctggcagatcttgccgcagtcacagctttgctactgcctttccggtacgtgctcgaccccccagcacgcaggatctggaacaatgtgacccgctggtttgtcacttgcgtcagacagcccgagttcagagccgtgttgggcgaggttgtgctgtatagtggagcgcgaccactgagccatcaaccgggtcccgaggcccctgctttgcccaaaaccgccgctcagttgaagaaggaggcaaagaagcgggagaagctggaaaaattccagcagaagcagaaaattcagcagcagcaaccgccacctggtgagaaaaagcccaaacctgagaaacgggagaagcgcgatcccggtgtgatcacatatgacctacccacccctcccggagaaaagaaggatgttagcggaccaatgcctgacagttactctcccaggtacgtggaggcagcttggtatccatggtgggagcagcaggggttttttaagcctgaatatggtaggcccaacgtgtctgctgctaaccccaggggtgttttcatgatgtgtattccccctcctaacgtgacgggtagtctgcacctaggccacgccctgaccaatgctatacaggactctctcacacgctggcaccgaatgcgcggtgaaaccactctgtggaatccgggttgcgatcacgccggtatcgcaactcaggtcgtcgtggagaagaagctatggcgcgagcaaggactcagcaggcaccagcttggcagggaagccttcttgcaggaggtttggaaatggaaagaggagaaaggggataggatatatcaccagctgaagaagcttggctctagcctagattgggacagagcctgctttactatggatcctaagctgagcgccgctgtcaccgaagcctttgtaagactccatgaggagggaatcatctaccggagtactcggttagttaactggagctgcaccctgaacagtgctatttcagacatcgaggttgacaaaaaagagctcactggacgcacgttgctgagcgttccaggctacaaggagaaggtggaatttggcgtcctggtctcgtttgcgtacaaggtacagggatcggactcagatgaagaagtagttgtggctactactcggatcgagactatgctgggtgacgtggcggtcgctgtgcatcctaaggacacacggtatcagcatttaaaagggaagaacgtgatccacccattcctgagtaggtcactccccatagtgttcgacgaatttgtcgatatggattttggtactggcgctgtgaagattaccccagcacacgaccagaacgattacgaagttgggcagaggcacggattagaagcaataagcatcatggacagccgcggagccctcatcaacgtcccccctcccttcttgggactgcccaggtttgaggcccgtaaggctgtgttggtcgccctgaaagagaggggactgttcaggggcattgaagataaccccatggtagtgccactgtgcaacagatctaaggacgtggtggagccgcttctgcggcctcagtggtacgttcggtgtggtgagatggcccaggctgcctccgcagccgtgactaggggggacctgcgcatactgccagaagcgcatcagcggacctggcatgcctggatggacaatatccgcgagtggtgcatctccaggcagttgtggtgggggcacagaatccctgcttacttcgtcacagtatccgacccagcagttccacctggggaagaccccgatggacggtactgggtttcagggcgtaacgaggccgaggctagagagaaggccgctaaagaatttggagtcagtccggacaagatctcacttcagcaggacgaagatgtcctggacacctggttctccagtggcctcttcccactcagtatcctaggctggccaaaccagtcagaggacctgagcgtgttttatcccggtacgctgctcgagactgggcatgatatcctgttcttctgggtcgccaggatggtgatgttgggcctgaagttgacgggccgtctccccttccgagaggtatacctccatgcgatagtcagggacgcccatggaaggaagatgtctaaaagcctcggtaacgtgattgatcccttggatgtgatctatggaatttccctgcagggcctgcataaccagctacttaactctaacctagaccccagcgaggtggaaaaggcgaaagaggggcagaaagcagactttcccgctggcatcccagaatgcggaactgacgctctaaggttcggcctgtgtgcgtacatgagtcaggggagggatatcaacctggacgtgaaccggatcctgggctaccgacatttctgcaacaaactgtggaatgctacgaaattcgccctccggggtctggggaaagggtttgttccatcccccacctcccagccagggggacacgagtcactcgttgatcgctggatcaggtcccgcctgaccgaggcagtccggttgtctaaccaaggtttccaggcatatgacttcccagcagtgactaccgcacagtatagcttctggctgtacgaactgtgtgacgtatatcttgagtgtttgaagcctgtattaaatggcgtcgatcaggtggccgcagaatgcgcgaggcagaccctgtatacgtgcctggatgtagggttgcgactactctcacctttcatgcctttcgttacagaagagctgtttcagcgcttgcctcgccgaatgcctcaagcacctcctagcctgtgtgtgacaccgtaccccgagccctcagaatgctcttggaaagacccagaggcggaagctgccctggagttggccctctcaataaccagggccgtacgctccctccgagcggattataacctcactaggattaggcccgactgcttccttgaggtggcggatgaggccaccggcgctttggcgagtgcagtgagtggatatgtgcaagctctggccagcgcaggtgtcgtggccgtgctggctctgggggctcccgcaccacagggatgcgccgttgcgctggcctcagatcggtgtagtatccacctacaattgcaaggtttggttgatcctgcgagagagctcgggaaactccaggcaaaacgtgtcgaggcacagagacaagctcagcgcctgcgggagcggagagccgcaagcggataccctgtaaaagtgcctttagaagtacaggaagccgacgaggccaagctccaacagacagaagcggagctgagaaaagttgatgaggcgatcgcattatttcagaagatgctgtag

SEQ ID NO: 246520 - DNA, 1101 bp, Artificial Sequence
  Description of Artificial Sequence: Synthetic coding sequence
atgagcacactgtacgtgtctcctcatccggatgcattcccctctctgagagctctcatcgcagccaggtacggagaagctggtgaaggcccaggctggggcggtgcacacccccgaatctgcctgcaacctcctccaaccagcagaaccccttttcctcctcctcgtctccccgctttggaacaggggccagggggactgtgggtgtggggcgcaacggccgtcgcccaactgctgtggccggctggtctcggaggtcctgggggaagtcgggctgcggtgctggttcaacaatgggtctcctacgccgacacagagctgatcccagcagcctgtggggctactttacccgctctcggactacggagcagtgctcaggatccacaggccgtcctgggtgccctgggacgggctctgtcccctctcgaggagtggctgaggctccatacgtatttggccggtgaagcacctacgctggctgacctagccgcagttaccgccctgcttctccccttcaggtacgtcttggatcctcccgctagacgcatctggaacaacgtaaccagatggttcgtaacatgcgttaggcagccggaatttagggcggtattaggtgaggtggtcctttattcaggagcacgcccactgtcacaccagcctggacccgaggccccagccttacctaaaactgccgctcaattgaaaaaagaagccaagaaacgtgaaaagctggaaaagttccagcagaagcagaaaatacagcagcagcagcctccccctggggaaaagaagcctaagcctgaaaagagggaaaaaagagatcctggcgtgatcacatacgacctccctacccccccaggcgagaagaaggatgtttccggcccaatgcccgactcctattccccacggtacgtggaagcagcctggtacccctggtgggagcagcagggcttctttaaacctgagtacgggagacctaatgtatctgccgctaaccctaggggggtgttcatgatgtgcatcccccctcccaatgtgaccggatcactccacttgggacacgctctgactaatgcaatccaggactcactgacccgctag

SEQ ID NO: 246521 - DNA, 525 bp, Artificial Sequence
  Description of Artificial Sequence: Synthetic coding sequence
atgagtacactctacgtctcaccacatccagatgcctttccttcccttagggcgctgatagcagccaggtatggcgaggccggtgagggcccaggatgggggggagctcatccaaggatttgtctgcaaccccctcctacgtcccgcacaccatttccacctcccagactgcctgcattggagcagggaccgggagggctgtgggtgtggggcgctaccgccgtggctcaactactgtggccagcgggactcggagggcctggcggttcacgcgcagctgtattagtgcaacagtgggtcagttatgcagataccgagctgatccccgctgcttgcggggcaactctaccggctctgggtctgaggtcgtctgcgcaagacccccaggccgtcttgggtgctcttggtcgagccctctctcccttggaggagtggctgcgcctgcacacatacctggccggagaggccccaactttagctgatctcgcggctgttaccgcgttgctgttgccattcaggtactag

SEQ ID NO: 246522 - DNA, 3552 bp, Artificial Sequence
  Description of Artificial Sequence: Synthetic coding sequence
tgagggctgggtggccctggaggatcacgtgccgctgtactagtacagcaatgggtgagctacgccgacaccgaactgatacccgcagcgtgcggagctacactgccagccctggggctaagatctagtgctcaggaccctcaggcagtgctcggagcacttggacgggcattgtcccctcttgaggagtggctacgccttcatacctacctagccggagaagcacctacactcgctgacctggctgctgtgaccgccctcttactgccttttcgctatgtcctggaccctccagcacgcagaatttggaataacgtgaccagatggttcgtgacgtgcgtgagacagccggagtttcgtgctgtgctgggggaggtggtcctgtattcaggcgcaaggcccctgtcccatcaaccaggcccagaggctccggctttaccgaaaaccgctgcccaactgaagaaagaggccaaaaagcgcgagaaactagaaaagtttcagcagaagcagaagatccagcaacagcagccaccacccggagaaaagaaacctaaacctgagaagagagagaagagagaccctggcgttatcacatatgatctgcccactcctcctggcgagaagaaagacgttagtgggcctatgcccgactcctattcgccaaggtacgtggaggcagcctggtacccctggtgggaacagcaaggcttcttcaagccagaatacgggaggcccaatgtgagtgccgctaaccctagaggcgtgttcatgatgtgcatcccgcctcctaatgtcacgggcagtctacatctgggccatgcattaactaacgcaatccaagactccctgactcgctggcataggatgcggggagaaaccacgctatggaaccccggttgcgatcatgctggaatcgccacccaagtcgtggtggagaaaaagctgtggagagaacagggcttgtcccgtcatcaattaggaagagaagcctttctgcaagaagtgtggaagtggaaggaggaaaagggagatcgtatctatcatcaacttaaaaaacttggtagcagcctggattgggaccgggcatgcttcacaatggatccgaagttgtccgcggctgtcacagaggccttcgttagactgcacgaagaagggatcatctacaggtcaactagattggtgaactggtcttgcacgctgaattctgctatctctgacattgaagtcgataagaaagagctgacaggcagaactcttctcagcgtgcccggttacaaggagaaggtggagttcggagtcttagtctcttttgcgtacaaggtgcaagggtccgattcagatgaggaggtagtggttgctaccacacggatcgagacaatgttgggcgatgtggcggtggctgtacaccccaaagatacgcgttatcaacatctcaaagggaaaaacgtcattcaccctttcctgagtaggtctcttcctatcgttttcgacgagttcgtggacatggattttggcacaggcgcagtcaaaatcacaccagcccatgaccagaatgactatgaagtggggcagcgccacggactcgaggccatttccatcatggatagtagaggggcactcatcaatgtgccacctcccttcctcggcttaccccgtttcgaggcccgtaaagctgtgttagtcgccctgaaggagagaggactgttcagaggtatcgaagacaatcctatggtcgtccctctgtgtaatagatctaaggacgttgtagagcccctgcttcggccacagtggtacgtgcgatgtggcgaaatggcgcaggcggctagtgctgctgtgacacggggtgacctacgtatcttgcctgaggcgcaccaacgcacatggcacgcttggatggataacatacgtgagtggtgtatctccagacagctatggtggggccaccgtatccccgcttacttcgtgacagttagcgaccctgctgtgccgccaggggaggatcccgatggcagatattgggtgtcgggtcgaaatgaggcggaagccagagagaaagccgctaaggaattcggcgtttctcccgacaagattagtttgcagcaggatgaggacgtcctcgatacctggttttcctccggacttttcccccttagtatccttggatggccaaaccagagtgaagacctgtcagtgttctaccccggaacactactcgagaccgggcatgacattctgttcttttgggtcgctcggatggtgatgctgggtctcaaactgacagggaggctgcccttcagagaggtctacttgcatgccattgtccgggacgcccacggtagaaagatgagtaaatcccttgggaatgtgatcgatcccctggacgtcatctatggaatctcactgcaggggctccacaaccaactgttgaactcaaatctggacccgtctgaggtcgagaaagctaaggagggccagaaggcagatttcccggctggcattccagagtgtggcacggatgccctacgctttggcctctgcgcttatatgtcacagggcagagatatcaatctggatgtgaatagaatactcgggtacaggcacttttgtaacaaactctggaatgccaccaaatttgcactgcggggactcggcaaggggttcgtcccaagccctacaagccagcccggaggtcacgagtcattggtggatagatggatcaggtcgcggttgaccgaggcagttaggctgtccaaccagggttttcaggcctacgatttccccgctgtcacaaccgcacagtattctttttggttatacgagttgtgcgacgtgtacctcgagtgcttgaaacccgtgctcaacggagtggaccaggtagcagcagagtgcgcaaggcagaccttgtatacatgtctggatgtgggtcttaggcttctgtcgccttttatgccctttgtgaccgaggaactgttccagcggctccctcgccgtatgccacaggcgcctccaagcctgtgcgtgacgccctatccagaacctagcgagtgctcttggaaagatcctgaggctgaggctgccttggaactcgctctatccattacccgggcagttagatcacttcgggctgattacaatctgacccgaatacgcccagattgctttttagaggtcgccgatgaggctacaggagctttagcttccgcagtaagtggctatgtgcaggccttggctagtgccggtgttgtggccgtgctggctctgggggctcccgcaccacagggatgcgcagtggcattggcctctgatcggtgctctatccacctgcagctgcagggcttggtagatccggcacgcgagttggggaaactgcaggctaaaagagtggaagctcaacgccaggcccagaggttgcgcgaaagacgcgctgccagcggttatcccgtgaaagtccctctggaagtacaagaggccgacgaagctaagctgcaacaaaccgaagcggaactccgcaaggtagatgaagccattgctctgtttcagaagatgctctag

SEQ ID NO: 246523 - DNA, 525 bp, Artificial Sequence
  Description of Artificial Sequence: Synthetic coding sequence
atgagtacactttacgtgtcacctcaccccgatgcttttccatccctgcgtgcactcatcgccgcaaggtacggtgaagcgggagagggcccaggctggggtggagcccatccaaggatctgtctccaacctcctcccactagccgcacacccttcccgcctcccagattaccggctctggagcaaggtcctggcggtctgtgggtttggggcgcaacagcggtggcacaactgctgtggcctgcaggtttgggaggtccaggcggttctcgagcagccgttctggtacaacagtgggtaagctacgccgacactgaactaatacctgctgcttgtggagccacactgcccgctttaggattacgcagcagcgcacaagatccccaggccgtgttgggggcactcggacgtgctctatcccccctggaggaatggttgagactgcacacatatctggcaggcgaggccccaacattggcagacctggcggctgtgacagcccttctcctcccattccgctattag

SEQ ID NO: 246524 - DNA, 867 bp, Artificial Sequence
  Description of Artificial Sequence: Synthetic coding sequence
tgaaaggagaggggactttttaggggaatcgaggacaaccctatggtggtgccactgtgcaatcgatcgaaggacgtggtcgaacccctcctccgtcctcagtgggagtggtgcatcagtaggcagttgtggtgggggcacaggattccagcctacttcgtcacagtgtctgacccggcagttccaccaggggaggatccagacggccgttactgggtctccggacggaacgaagccgaggcaagggagaaagctgccaaagagtttggtgtgagccctgacaaaatttctcttcagcaggacgaggatgttctggacacctggttctcctctgggcttttccccttgagcattctcggctggcctaatcagtccgaggacctcagcgtgttttatccaggtactctgctcgaaactggacacgatatactctttttctgggtggcgcgtatggtgatgctagggttaaagcttaccggaaggcttcctttccgcgaagtataccttcacgcaattgtgagagatgcccatggcaggaaaatgtccaaatccctggggaacgtcatagaccctctggacgtgatttacggcatctccctgcaaggcctgcacaatcagctgctgaattcaaacctcgatcctagcgaagttgaaaaagctaaggagggacagaaggctgattttcctgccggaatccccgaatgcggtaccgatgccctacgctttgggctgtgcgcttacatgagccaggggcgtgacataaacctagatgtgaacaggattttgggctacagacacttctgtaataagttatggaacgccactaaattcgccctgcgcggtctaggaaaagggtttgttccctag

SEQ ID NO: 246525 - DNA, 525 bp, Artificial Sequence
  Description of Artificial Sequence: Synthetic coding sequence
atgagtaccctgtatgtttccccccatccagatgcgttcccgtctctgcgagctcttatcgcagcacgttatggagaggcaggagaaggaccgggatggggcggagctcatcctcgcatctgtttgcaaccccctcctactagccgcacgcctttcccgccacccaggcttcccgctctggagcaggggcctgggggactttgggtctggggagccacagctgttgctcagctgctgtggcccgcagggctgggtgggccaggcggatcaagggcagcagtgttggtgcagcagtgggtctcctatgcggataccgagttaattcccgcagcttgtggcgctaccttacccgcattaggcctgcgctctagcgcacaggaccctcaagccgtcctcggcgcactggggagagctctgagcccactggaggaatggctgcgtctgcacacatacctggccggagaggcacccaccctcgctgacctggcagcggtgacagctttactgctaccttttcgctattag

SEQ ID NO: 246526 - DNA, 867 bp, Artificial Sequence
  Description of Artificial Sequence: Synthetic coding sequence
tgaaaggaaagggggctgtttaggggtatagaagataaccccatggtagtgcctctttgcaaccgaagcaaagatgttgtggagcctctgctgcggccacagtgggagtggtgtataagccgccagctctggtgggggcatcgcatcccagcctacttcgtaactgtttccgatcctgccgtgccacctggagaagaccctgatggacggtactgggtgtccggaagaaatgaggctgaggcacgggagaaagccgcaaaagagtttggagtgtcacccgataagattagtctgcaacaggatgaggatgtgttagacacttggttttctagcgggctgtttccgctctctattttgggctggcctaatcagtctgaagacctgtcagtgttctatccgggaaccctcctcgaaacgggccatgacattttgtttttttgggtggctcggatggtgatgctggggctcaaattgaccgggaggctgcctttcagggaggtttaccttcatgccattgttcgcgacgcccatggtcgaaaaatgagtaaatccctgggcaacgtgattgaccccctcgatgtgatctacggcattagcctgcagggattgcacaaccagttgctcaattccaacctcgatcctagcgaggttgaaaaggccaaagaaggacaaaaagctgattttcccgcaggaatacccgaatgcggaaccgatgcactccgctttggactgtgcgcatatatgtcccaggggagggacattaacttagacgtcaacaggattctgggctatcgccatttctgcaacaaattatggaacgccactaaatttgccctgcgtgggctcgggaaaggctttgtgccatag

SEQ ID NO: 246527 - DNA, 867 bp, Artificial Sequence
  Description of Artificial Sequence: Synthetic coding sequence
tgaaaggaacgagggttattccggggaattgaagacaatcccatggtggtccctctctgtaataggtcaaaggatgtggtggagccgttgctgagaccccaatgggaatggtgtattagccgacagctgtggtggggccacaggataccggcttacttcgtgaccgtcagcgaccccgcagtgcccccaggtgaggatccggatgggagatattgggtgtcagggagaaacgaagctgaagctcgggaaaaagctgccaaggaattcggggtgtcccctgataaaatcagcctacagcaggacgaggacgtcctggacacctggttctcttcgggtctcttcccactgtctattttgggttggccaaaccagtcagaggatctaagtgtcttttaccctggtactctcttggaaacaggacatgacattctgtttttctgggtggctagaatggtgatgctaggcttaaagctgacaggcagactacctttcagagaggtctatctccacgcaatcgtgagagatgcccatggtcggaagatgagtaaatctttggggaatgtgatagaccccttggatgtgatatatggcatctctttacaggggctacacaatcagctgttaaactctaatttagaccccagcgaagtcgagaaagcgaaggaaggacagaaagccgattttcccgctgggatcccagagtgtggcaccgacgcactgaggtttggactctgcgcgtacatgtcacaaggcagagacattaacctggatgtgaataggatccttgggtatagacatttctgcaacaagttatggaatgcaacaaagtttgcacttaggggtttaggtaaaggctttgtcccttag

SEQ ID NO: 246528 - DNA, 3795 bp, Artificial Sequence
  Description of Artificial Sequence: Synthetic coding sequence
atgtcgacgctgtacgtttcaccccatccggatgcattcccatccctcagggccctgattgccgctagatatggcgaggccggtgaaggtccaggctggggcggagctcatcctcgcatatgcttgcagcctcctccaacatcacgaacaagttttccccctcctcggttgccagcgctcgaacagggtcctggcggactttgggtgtggggagccacagccgtggcacagcttctttggcctgccggattgggaggccctgggggaagccgcgctgctgtcctggttcaacagtgggtcagttatgcagacactgagctcataccagctgcttgcggcgctactctacctgccctggggctgcgcagcagtgctcaggacccccaagcagttttgggcgcacttggacgggcactgtctcccctggaagagtggctcaggctccacacgtatctcgcaggtgaagcccctacactagctgatctcgccgctgtgaccgccttattattgccttttcggtacgtgcttgatccgccagccaggaggatatggaataatgtgactagatggttcgtgacatgtgttagacagccagagtttcgagcggtgctgggcgaagtcgtcctttactctggcgctcgaccgctctctcatcagccaggacctgaggcccctgcgctgcccaagaccgctgcgcaactcaagaaggaagctaaaaagcgggagaagctcgaaaaattccagcaaaaacaaaaaatccagcagcagcagccaccacccggtgagaagaagcctaagccggagaagagggagaagcgggacccaggagttatcacctacgacctgcctacccctcccggagagaaaaaggacgtgtcagggccaatgcccgactcttacagccccaggtacgtggaagcagcttggtacccttggtgggaacagcagggcttctttaagcctgaatatggacggcctaacgtgagtgcagccaacccccgtggcgtgttcatgatgtgtatccctccacctaacgtgacaggcagcctgcatctcggtcacgctctgactaatgctattcaggattccctgaccaggtggcaccggatgcgaggcgaaacaacgctttggaaccccggttgcgatcacgccggtattgcaactcaggtggtagtggaaaaaaaactctggcgtgagcagggactaagcaggcaccagctaggcagagaagcctttcttcaggaggtttggaagtggaaagaggaaaaaggagatcggatttaccatcagctcaagaagcttgggagtagcttggattgggaccgtgcctgctttactatggacccgaaactgtcggctgccgttacggaagccttcgtgaggctacacgaggaaggcataatctatagatccaccaggctggtgaactggtcttgcacactcaacagcgccataagcgatattgaagtagacaagaaagagttgacaggcaggaccctgctgtcagttcctggttacaaggagaaagtagaattcggagtactcgtgtcttttgcttacaaggtgcagggatcagacagcgatgaagaagtcgtcgttgccacaacacgcatagagacaatgctgggcgacgtcgcagtagcagtgcaccccaaagacacgcgataccagcacctgaaaggaaagaacgttattcatccctttctttcccggtccttgcccatcgtgttcgatgagttcgtcgacatggatttcggaactggtgcagtgaaaataacacccgctcacgaccagaacgattacgaggtaggtcagagacacggcttagaagccattagcattatggacagtaggggcgctctgattaatgtgccgcctccgttcctcggcctacctcgcttcgaagcgcgtaaggccgtgcttgtggctttaaaggagagaggcctctttcggggtatcgaagacaaccccatggtcgtccctctgtgcaacaggagcaaggatgtggtggaacctttactgcggcctcagtggtacgtccgttgcggagagatggcacaggccgcaagtgcagccgtgactaggggcgatctgaggatcctccccgaggcgcaccagcgcacatggcacgcctggatggataacatcagggagtggtgtataagtcggcagctgtggtgggggcacagaatcccggcatattttgtcacggtgtccgaccctgccgtgccccctggcgaggaccctgacgggaggtattgggttagtggacggaatgaagcagaggcccgagaaaaggctgcaaaagagttcggcgtgtccccggataagatatcactgcagcaggatgaagacgtgctggatacgtggttttccagtggccttttccccctatctatactgggctggcctaatcagtcagaggatttgagcgtattttatcccggaaccttactggaaactggccacgacatactgtttttctgggtcgcccgaatggtcatgcttggccttaaactgaccggtagattaccgttccgcgaggtctaccttcacgccatcgtccgggatgctcacggaaggaaaatgagcaaatccctgggcaacgtcattgatcctctcgacgttatatatggcatatctttgcagggactccataatcagctgctgaattccaacctcgatccaagtgaagtcgagaaggccaaagaagggcagaaggcagattttcccgctgggattccagaatgtggtactgacgctctaagattcggcctttgcgcgtacatgtcccagggcagggatattaatctggatgtgaatcgcatccttggttaccgccacttttgcaataaactgtggaatgctaccaagttcgctctacgtgggctggggaaaggcttcgttccctctcccacttcacaaccgggtgggcacgagtccttagtggatcgatggattcggtccaggttgacggaggctgtccgactgtctaatcaggggttccaggcctacgacttcccagccgttaccaccgctcaatattccttttggctttacgaactgtgtgatgtgtacctcgagtgtctgaagccagtgctcaacggagtagatcaggtggcagccgaatgcgccaggcagaccttatatacttgcctcgatgttggactcaggctgctgtcacccttcatgccgtttgttacagaggagttgtttcaacgcctgccccgacggatgccccaggctcctccctccctgtgcgttacaccatatcccgagccatccgagtgctcttggaaggacccagaagcagaggccgcactggagctggcattgagtattaccagggctgtgcgcagtctgcgggctgactataacttaactaggattaggcccgattgctttcttgaagttgctgacgaggctaccggagcactggcttccgccgtctccggctatgtacaggccctagcgagtgcaggtgttgtggccgtgttagccctgggagcacccgctccgcaggggtgtgccgtggctcttgcaagcgaccgctgttctatacatttgcagcttcagggtctggtcgatcccgcaagagaactgggcaaactgcaagccaaaagagtggaggcccagagacaggcccagagattgagggaaagacgggctgctagcggatatcctgtgaaggtgccattggaggtacaggaggccgacgaggccaagctacagcagacagaagcggagctgaggaaagtggacgaagctatcgccttgttccagaagatgctgtag

SEQ ID NO: 246529 - DNA, 525 bp, Artificial Sequence
  Description of Artificial Sequence: Synthetic coding sequence
atgagcactctgtatgtctcaccccatcctgacgctttcccaagtctgagggccctgattgctgcgcgttacggagaggccggtgagggaccaggttggggaggcgctcacccacggatctgcttgcagccgcctcctacgtcccggactccttttcctccccctagactccctgcattagaacaggggccagggggactctgggtgtggggtgcaacagcagtggcccagctgctctggccagccggactgggcggaccaggagggagccgagcagccgttttggtccagcagtgggtgagctacgcagataccgaactgatcccggctgcctgcggtgctactttgccggctctgggtctgagaagctcagctcaggatccacaggccgttttgggcgcactcggcagggctttgagcccacttgaagagtggcttcgcctgcatacttatctggctggcgaagctcccacactggccgacttggctgctgtgacagccctgctgttacccttcagatactag

SEQ ID NO: 246530 - DNA, 894 bp, Artificial Sequence
  Description of Artificial Sequence: Synthetic coding sequence
atgccggactcttatagcccacgctacgtggaggctgcttggtatccctggtgggaacaacagggattcttcaaacccgaatatgggcgtccgaacgtctctgctgccaatccgagaggtgttttcatgatgtgtatcccgccacccaacgtcacaggtagtctgcacctcggtcatgcacttaccaacgcaatacaggattcgctgactcggtggcatcggatgaggggggaaaccaccttgtggaaccccggatgcgaccacgctggaatcgccacacaagtggttgtagaaaaaaaattgtggagggagcaaggcctgagcagacatcagctgggacgcgaagcattcctgcaggaggtttggaaatggaaggaagaaaagggggacaggatttaccaccagctgaagaagttgggctctagtttggattgggatcgtgcatgcttcactatggatcccaagctttcagccgcagtcaccgaggccttcgtccgtttgcatgaagagggcatcatctatcgctctaccaggctggtgaactggtcatgtaccctgaattccgccataagcgacatagaggtcgataagaaagagcttacagggaggactttgctgtctgtgcccggatacaaggaaaaggtggaatttggggtgctggtgtcttttgcatataaggtgcaaggtagcgactctgacgaggaggtggtcgttgccacgacccggatcgaaaccatgttaggcgacgtcgccgtcgctgttcaccccaaggatactagataccaacatctcaaggggaagaatgtgattcaccccttcctgtcaaggtccctgcccatcgtgttcgacgaattcgtcgacatggacttcggaactggacccgcacaggtatag

SEQ ID NO: 246531 - DNA, 867 bp, Artificial Sequence
  Description of Artificial Sequence: Synthetic coding sequence
tagaaggaaagagggttgttcaggggcattgaggataacccgatggtcgttcccctgtgtaatcggagcaaggacgtggttgagccactcctgcgccctcagtgggaatggtgcatatctagacagctgtggtggggccaccgcatacccgcttattttgtgactgtgtctgaccctgcagtcccacctggggaagaccccgatggccgatactgggtctccgggcgaaatgaggcagaagcccgagagaaggccgcaaaagagttcggtgtgtcaccagataaaatctcattgcaacaggacgaggacgtgttggacacttggttttccagtgggctgttccctctttccatcttaggatggccaaaccagagcgaagacctgtcggtattctaccccggtacgcttttggagacaggccatgacattttgttcttctgggtggccagaatggtcatgctgggactgaaacttaccgggaggttgcccttccgcgaggtgtatctgcatgccattgtgcgagatgcccacgggcgtaaaatgagcaagagcctcgggaatgtaatagacccactcgacgtaatctatggcatttcattgcagggcctgcacaaccagctgcttaacagcaacttggatccttcagaagtagaaaaagctaaggagggccagaaagctgattttcccgctgggattccagagtgtggtacggacgctctgcggttcggcttgtgtgcttatatgtctcagggcagagatattaacctggatgtcaatcgcatcctcgggtacagacatttctgcaacaagttgtggaacgccacaaaatttgccctgaggggcttaggaaagggcttcgttccctag

SEQ ID NO: 246532 - DNA, 867 bp, Artificial Sequence
  Description of Artificial Sequence: Synthetic coding sequence
tagaaagaaagggggctgtttcgaggaatagaggataaccccatggtggtcccactttgcaatcgcagcaaagatgtggtggaacctctgctcagaccccaatgggagtggtgcatcagtagacagctatggtgggggcacaggattcctgcctatttcgtaactgtatcagacccagctgtgcccccaggcgaggatccagatggtagatactgggtgtccggcagaaacgaggcggaagctcgggagaaggcggcaaaagagtttggcgtgagccccgacaaaatttctttgcagcaggatgaggacgtgcttgatacatggttttcttctggattattccccctcagcatcttaggatggccgaaccaatcagaagatttgagcgtgttttaccccggtacattactggagacaggccacgacattctgttcttctgggtcgccagaatggttatgctgggtctcaagcttacaggcagactcccctttagagaagtttatctgcatgctatcgtgcgcgacgcgcacggcagaaagatgtcaaagagtttaggaaacgtgatcgatccccttgacgtgatctacggcatcagtcttcagggccttcacaatcagctcctcaacagcaatctggacccatcggaagtagagaaggccaaggaaggacagaaagccgactttcccgctggcataccggaatgtggaaccgatgccctgcgattcggcctatgtgcgtacatgtcacaaggacgtgatataaacctggatgtgaacagaatccttgggtatcggcacttctgtaataaactctggaacgcaaccaaatttgccctccgcggacttggtaaagggtttgtgccttag

SEQ ID NO: 246533 - DNA, 288 bp, Artificial Sequence
  Description of Artificial Sequence: Synthetic coding sequence
tagcccgcaggcctcgggggtcccggaggcagtcgcgcagccgtactggtacagcagtgggtctcttatgcggataccgagttgataccagccgcatgcggagcaactctgcctgctctaggcctgcggtctagcgcgcaggatccccaggcggtgttgggggctcttggacgtgcactttctcccctggaggagtggctgcgtcttcacacgtatctggcaggggaggcaccaaccttggccgaccttgcagccgtgaccgccttgctcctaccctttcgttattag

SEQ ID NO: 246534 - DNA, 3795 bp, Artificial Sequence
  Description of Artificial Sequence: Synthetic coding sequence
atgtccacactctatgtgtccccccaccccgacgcctttcccagcctcagggccctgatagcggctaggtacggagaggccggagagggtccaggctggggtggcgcacatcctaggatctgcttgcaacctccacccacctcacgcaccccgtttcctcctcctcgcttacccgcattggaacagggcccaggtgggctctgggtatggggcgctaccgctgtggcccagctgctatggcctgccggtttagggggtcctgggggatcacgtgcagccgtgctagtgcagcaatgggtgagttatgcagacactgagttaatccccgcagcctgtggtgcgacccttcccgcactgggtcttcggagtagtgctcaggatccacaggccgtattgggggcattggggagagcactgtctccgttggaagaatggctgcggcttcatacctaccttgctggtgaagcccctaccctcgccgatcttgccgcagtgacagcgctcttgctccccttcagatacgtgcttgatcctccagccaggagaatatggaataacgtgactcggtggtttgtgacttgcgttaggcagcctgagttccgcgctgtgcttggagaggttgttctgtattccggtgcccgacctctcagccatcagcccggacccgaggccccagctctgcccaagaccgcagcccaattgaaaaaggaggctaagaagcgggagaaactggaaaagtttcagcaaaagcagaaaatacaacagcagcagcctccacctggagagaaaaaaccgaagcctgaaaagcgggagaagagagacccgggtgtcattacttatgacctccccacacctcctggggaaaagaaagacgtgagcggcccaatgcctgactcttattcccccaggtacgtggaagctgcttggtacccatggtgggagcagcagggattcttcaagcccgagtatggacgcccaaacgtgagcgctgccaatcccagaggagtcttcatgatgtgtataccacccccaaatgtgacgggctctctgcatctgggacacgctctgaccaatgccattcaggactccctgactcgctggcaccgcatgcggggagagactacgctgtggaatcccggatgtgatcatgcagggattgcaactcaggtggtggtggagaagaagttatggcgggaacaagggctttcccgtcatcagctgggacgggaggcatttcttcaggaggtttggaagtggaaggaagagaagggcgaccggatctaccatcagctgaaaaagctgggctcatcgctagactgggaccgtgcatgtttcaccatggatccaaaacttagtgcagctgtgaccgaggcctttgtacgtctgcacgaggaaggaatcatttaccgcagcacccgtctggttaactggagctgtaccttgaactcagccatcagcgacatagaggtagacaagaaagagctcaccggtcggaccttactgtccgtgccaggatataaagaaaaagttgagttcggcgtgctggtgagttttgcgtacaaggttcaggggtctgacagcgacgaagaagtggttgttgccaccacccgcatcgaaactatgttgggtgatgtggccgttgcagtccatcctaaggacacaagatatcagcacctgaagggtaaaaacgtcatacatcccttcctgtccaggagcctgcctattgtatttgatgaatttgtcgacatggattttggtaccggggcagtcaagattacccctgcccatgatcagaatgactatgaggtaggccagaggcatggacttgaggcaattagcattatggatagtaggggagcgctcatcaacgttcctccacctttcttaggcctgccccgattcgaagcaagaaaagcagtcctggttgccctgaaggaaaggggactgtttcgtgggattgaagacaacccaatggtcgtgcccctgtgcaatagaagcaaagatgtagtggaaccgttgctccggccacagtggtatgtgaggtgtggggaaatggcccaggctgcttctgctgccgtgacaagaggcgacctaagaattttgccagaggctcaccagaggacatggcatgcttggatggataatattcgggaatggtgcatctcacgccagctctggtgggggcaccgcatcccagcatacttcgtcactgttagcgatcctgctgtgccccctggcgaggaccctgatggccgttactgggtaagcggccgaaatgaagcagaggcacgagagaaggcagccaaggagttcggcgtgtctccggacaagatttcactgcagcaggacgaggacgtcctggatacctggtttagttctggcctttttcccctgagtatcctgggatggccaaatcagtctgaggatctttctgttttttacccaggaacactcctagagaccggtcatgacatactgttcttctgggtggccagaatggtcatgctgggcctgaaactgacagggaggctgccgtttagggaggtttacctgcacgccatcgtgcgtgacgctcatggacggaagatgtccaaatccctgggaaacgtcattgatccactggacgtgatttacggtatctccctgcaaggcctgcataatcagctgttgaactcgaacttggatccttcggaggtagagaaggccaaggagggacaaaaggctgacttccccgcagggatacctgagtgtgggactgacgccctgagatttggtctgtgcgcctatatgtctcagggcagggacattaacctcgacgtgaacaggattcttggctatcgtcacttttgtaacaaactctggaacgcgacaaagtttgctctccggggactcggcaagggattcgtcccttccccaactagccagccgggaggtcatgaaagcctggtcgatcggtggatccgtagccgcctgacagaggccgtgaggttgagcaaccagggctttcaggcgtacgacttccctgccgtgactactgcccagtactctttttggctttacgaattgtgtgatgtctatttagaatgcctgaagccagtactgaacggggttgaccaggttgcagcagagtgtgccaggcagactctatacacctgcttagacgtcggactgcggcttttatcgccattcatgcctttcgttacagaagagctgtttcagagattacccaggaggatgcctcaagctcctccatccctgtgtgtgactccttacccggagcccagtgagtgtagctggaaagaccctgaagcggaggccgctctggaattggctctcagcataacgagggcagtgcgtagtcttagggccgattataacctgacgcgcatccgcccagactgcttcctggaggttgcagatgaagccactggggcattggccagcgcagtgagcggctatgtgcaggctctggcatcggcaggggtcgtggccgtgctggcgctgggagcccctgccccacaagggtgcgcagtggcccttgccagtgaccgatgctctattcatctgcaactccagggattagttgatcccgcaagggagttgggcaaactccaggccaagagagtggaagcccaaaggcaggctcaacgactgcgggaaagaagagccgcttctgggtaccccgtgaaggtgcccctcgaggtgcaagaggctgacgaagccaaactgcagcagaccgaggcagagctcagaaaagtcgacgaagctatcgcccttttccaaaagatgctttag

SEQ ID NO: 246535 - DNA, 2031 bp, Artificial Sequence
  Description of Artificial Sequence: Synthetic coding sequence
atgtcaacactttatgtgtccccacacccagacgctttccctagcctgcgtgctttgattgcggctagatacggggaagcgggagaagggccaggctgggggggagcccatccacgaatctgtaggctgcctagattcgaggccaggaaggccgtgctcgtggcactcaaagaaagggggctgttccggggaatcgaggataatcctatggtcgtgcctctatgtaataggagtaaggacgtggtggaacccttgttacgcccacaatggtatgtgcgttgtggcgagatggcccaggctgcctccgccgcagtgacacggggtgatctgaggattctgccagaggcccaccaaaggacttggcacgcgtggatggataacatacgggagtggtgcatctcgcggcagctgtggtggggccatcggattcctgcgtatttcgtgactgtgagcgatcctgcagtgcctccaggggaggaccccgatggaaggtactgggtatctggaagaaacgaggccgaggcgcgagaaaaggcagctaaagagttcggcgtgtccccagataagatttcactgcaacaggacgaagacgtgctggacacctggttcagctccggcctgtttcctctgagcattctggggtggccaaatcagtccgaggatttgtccgtattctaccctggtaccctcctggagactgggcacgacatcctgttcttctgggttgcccgaatggttatgttggggctgaagttgactggcagactgccattccgggaggtttacctgcatgccatcgtgcgagatgcacatggacgaaagatgagcaaatcgctcgggaatgtcattgatcccctggacgtgatatatgggatctccctccagggcctgcataatcagctcctcaactctaacctggatccatcagaggtggagaaagcgaaggagggccagaaggccgatttcccagcagggattccagagtgcggcacagatgctctcaggtttggcctctgtgcatacatgtcgcaaggacgcgatattaatcttgatgtgaacaggatccttgggtaccgacacttttgcaacaagttgtggaacgccacgaagtttgccctgagaggtctgggtaaaggcttcgtgcccagcccaactagtcaacctgggggtcacgagtcactggtcgatcgatggatccgctcacgactcacggaggccgtgcgcctatctaaccagggcttccaggcatatgatttccctgcagtcaccacagctcaatatagcttttggctttacgagttgtgcgacgtctacctggaatgcctgaagccagtgctgaacggcgtggaccaggtcgcagcagagtgcgctagacagacactgtacacctgcctggatgtggggcttcgcctactgtcaccctttatgcccttcgtcaccgaagaattattccaacgactgcctagacgtatgcctcaggcgcctccctccttatgcgtcacgccctatcctgagcctagcgagtgctcttggaaggatcccgaggccgaggcagcacttgaattggcgctgtctataactagggccgtgcgaagtctacgggctgactataacctgacccgcatcagacctgattgtttcctggaagtggctgacgaggccaccggagcactggcatcagccgtttccgggtacgtgcaagccctggcttcagctggagtcgtcgccgtgcttgcactgggagctcccgcacctcaggggtgtgcagtggccctggcatcagataggtgcagcatacatctgcagctgcagggcctcgtggatccagctcgagaactgggcaagctgcaggccaaaagggtggaggcacagagacaagctcagcgtttgcgggaacgcagggctgcatcgggctacccagtcaaagttcccctggaagtgcaggaagctgatgaagccaagctgcagcagacggaggcagagctgcggaaagtcgacgaagctatcgctctgttccaaaagatgctgtag

SEQ ID NO: 246536 - DNA, 2031 bp, Artificial Sequence
  Description of Artificial Sequence: Synthetic coding sequence
atgagcacattatacgtttccccgcaccccgacgcgttcccaagtctgcgagcactgatcgccgctaggtatggcgaagccggagagggacccggttggggcggagcccacccgaggatatgccgccttccacggtttgaggctaggaaggctgtcctcgtcgcgctgaaggaacgaggcttatttcggggtattgaagataaccccatggtcgtccccctgtgcaatagaagcaaggatgtggtcgagcccttgttgcggccacagtggtacgtcaggtgtggcgagatggctcaggcagctagcgcagcagtcacccgcggtgatcttcgcatcttaccagaggcccaccagaggacatggcatgcctggatggataatatccgggaatggtgcatttctcggcagctgtggtggggccacaggatccccgcatactttgtcacggtatcagacccggctgtgccacctggggaagatccagatggtagatactgggtcagcggccgaaatgaagctgaagcaagagaaaaggcagccaaggagttcggggtatctccagacaaaatcagtctacagcaggacgaagacgtgctggatacatggttctccagcggtttgtttccgctctcgatcttaggctggccaaaccagagcgaagatctgtccgttttctaccccggaacccttctagagaccggacacgacattctcttcttctgggtcgcacgcatggttatgcttggcctgaagctgaccggtcgattaccattccgtgaagtatacctgcacgctattgtccgggacgcacacggacgaaaaatgtccaaatccctgggtaacgtgattgatcctcttgacgtaatttacggtatttcactgcagggactgcacaatcaactccttaattctaacctggaccccagtgaggttgagaaagcaaaggaaggccagaaagcggactttcctgccggtatacccgaatgtggcaccgacgctctcagattcggcttgtgtgcatacatgtctcaaggtagagatattaatctggatgtgaatcgaattcttggttaccggcacttttgtaataaactctggaacgccactaaattcgcacttaggggactgggcaaaggctttgtccccagtcctacttcacaaccagggggacatgagagcctggtagatagatggatccgctccaggctaacggaagctgtgcgacttagcaatcagggattccaggcttacgattttccagccgtcactacagcccaatactctttctggctgtatgagttatgcgacgtgtatctcgagtgcttaaaaccagttctgaatggggtggatcaagtcgcagccgagtgcgccagacagacattatatacctgcttggatgtggggctccgattgctgtccccgttcatgccgttcgtaactgaggagctcttccagagactgcctaggagaatgccgcaagcccctccttccctgtgtgttaccccatacccagaaccatccgagtgctcatggaaagatcccgaggcggaggccgcactggagctagccctcagcatcacaagagcagtgaggtccctccgagcggactacaacttgacccgaattcggcctgactgctttctggaagttgctgacgaagctacgggtgctctggcctcagcagtgagcggttacgtgcaggccttggctagcgccggagttgtcgcagttctggctctgggtgccccagctccccaggggtgcgcagtggcgctggccagcgatcgttgcagtattcacctgcagctgcaaggcttagtggacccagcccgtgagctcgggaaacttcaggccaagcgggtggaggcgcaacgccaagcccaaagacttcgggaacgaagggccgctagtgggtatcccgtgaaggtccccctggaggtccaggaggccgacgaggctaagctccaacaaaccgaagccgagctgcggaaagtggacgaggccattgctctctttcagaaaatgttgtag

SEQ ID NO: 246537 - DNA, 894 bp, Artificial Sequence
  Description of Artificial Sequence: Synthetic coding sequence
atgccagattcatattccccacgctatgtggaggccgcttggtacccctggtgggaacagcagggcttttttaaacctgagtacggtcgacccaatgtttctgccgcaaatccacgcggtgtatttatgatgtgcattccaccaccaaacgttactggcagtctgcatctaggccacgcgctgactaacgccattcaggatagcctcacccggtggcaccgcatgcgtggcgagactactttgtggaacccaggttgcgaccatgcgggtatagcgacacaggtagtggtggaaaaaaagttatggcgcgagcagggattaagcagacaccaacttggtagggaggcctttctacaggaggtgtggaaatggaaggaggagaagggtgaccgaatctatcatcaattaaaaaaacttggtagcagcctggactgggaccgagcctgcttcacaatggatcctaaactgagtgctgcagtcacagaagcattcgttaggctgcacgaggagggcattatttaccgttcaactcgcttggtcaactggtcctgcactctgaattcagccatttctgatatagaggtcgataaaaaggagctgaccggtcgtactctgctctccgtgcctggatacaaagagaaggttgagttcggagtgctggtcagtttcgcgtacaaagtccaggggagtgactccgacgaggaagttgttgtggctaccacgcggatcgagacaatgctgggagatgtggcggttgctgttcatcctaaagacactcgataccagcatctgaaaggcaagaatgtgattcaccccttcctgtcaagatcactgccaatagtgtttgatgaattcgtggacatggacttcggcacggggcctgcccaggtgtag

SEQ ID NO: 246538 - DNA, 894 bp, Artificial Sequence
  Description of Artificial Sequence: Synthetic coding sequence
atgccagactcatacagtccaagatatgtggaggcagcctggtacccatggtgggagcagcaaggctttttcaaacctgagtacggcagacctaacgtctccgcggctaatcctaggggtgtgttcatgatgtgcatacctcccccaaatgtcaccgggagcctacatctaggtcacgccctgaccaacgctattcaagattctctaactagatggcaccgcatgcggggtgagaccaccttgtggaatccgggatgcgaccacgccggtatcgccacccaagtagttgtagagaagaagttgtggcgggagcagggactctctagacaccagttaggccgtgaggcctttctccaggaagtttggaagtggaaggaggaaaaaggagaccggatttaccatcaactgaaaaaattgggatctagcttggattgggaccgcgcttgcttcacaatggatcccaagctgtcggccgctgtgacagaagccttcgtccgcttacacgaagagggtattatttaccgttctacccgccttgtcaattggagttgcacccttaattcagcaattagcgacatcgaagtcgacaagaaagaactgaccggaaggacactgctttccgtgcccggatacaaagagaaggtggagttcggtgttcttgtgtcattcgcttacaaggttcaagggagcgactctgacgaggaagtagtggtagctaccacgcgcatcgagaccatgctcggcgatgttgcagtagcggtgcaccctaaagatactcgatatcagcaccttaagggaaagaacgttattcaccccttcctgtcccggagccttcccatcgtttttgatgaatttgttgacatggacttcggaacaggccctgcacaggtgtag

SEQ ID NO: 246539 - DNA, 894 bp, Artificial Sequence
  Description of Artificial Sequence: Synthetic coding sequence
atgccggattcatatagcccgcgatacgtcgaagctgcctggtacccatggtgggagcaacagggttttttcaagccagaatacgggagacccaacgtttcggctgcgaatcccaggggtgtctttatgatgtgtatccccccaccaaacgtcacaggcagcctgcatttgggtcatgcactgacaaatgccatccaggacagcctgactcgttggcatcgcatgaggggggagaccaccctgtggaaccctggctgcgaccacgcaggaatagctacccaggtggtggtggagaagaagttgtggcgcgagcagggattgtccagacaccagctgggcagggaagcattcttacaggaggtctggaagtggaaggaggagaagggagatcggatctatcatcagctgaagaagctcggctcttccctggattgggacagagcatgtttcaccatggacccaaagctctccgccgcagtgaccgaagcattcgtcaggctgcatgaagagggcatcatctaccgatcgactagactggtaaactggagctgtacccttaattctgctatttcagacatagaagtcgataaaaaggagctgaccggccgaactttgctgtcagtcccaggctacaaagagaaagtcgagttcggagtgctcgtgagctttgcatacaaagtgcagggaagcgactctgacgaggaggttgttgtggctactacaagaatcgagaccatgctcggggatgtcgcggtggcagtgcatcccaaggatactaggtaccagcatctgaagggaaagaacgttattcacccattcttatcccgctctttgccaatcgtgtttgacgagttcgtggacatggacttcgggaccggtcccgcacaggtgtag

SEQ ID NO: 246540 - DNA, 2031 bp, Artificial Sequence
  Description of Artificial Sequence: Synthetic coding sequence
atgtccactttatatgtttcacctcatcccgatgcttttccatcccttcgcgcattgatcgccgcacggtatggcgaggcaggcgaaggtccgggttgggggggagcccacccaaggatttgcaggctacccagattcgaagcacgtaaggcagtgttagtggccctgaaagaacggggtctttttcggggaattgaagacaacccgatggtcgtacccttgtgcaacaggagcaaggatgttgttgaaccattgttaagacctcaatggtacgtgcgatgcggggagatggcacaggcagcaagcgccgctgtaacacgtggcgatctgagaattctgcccgaagcccatcaacgaacttggcacgcttggatggataacatccgggagtggtgtatcagcaggcagctatggtgggggcatagaatccccgcatattttgtgactgtgtccgatcccgctgttcctcccggagaggacccagacggtcggtactgggtgagtggaagaaacgaagcagaagctagagaaaaggccgctaaagaattcggcgtgtctccagacaaaatcagccttcaacaggatgaagatgtccttgatacgtggttctcctctgggcttttcccactgtcaattcttggatggcccaaccagagtgaagacctgtcagtcttttatcccggtacactgttagagaccggccatgacattctgttcttctgggtggcacgcatggtgatgcttggcctcaagctgaccgggcgactgccatttcgagaagtgtatctgcacgcgattgtacgagacgcccacggcagaaaaatgtccaaaagtctagggaacgtgatagatccactcgacgttatctacggtatatcacttcaaggcctgcataaccaactgttaaattccaatctcgaccctagtgaggtagagaaagccaaagaaggacaaaaggcagattttcctgcaggaatccctgaatgtggaacagacgctctccggttcggtctttgcgcctacatgagtcaggggagggatataaatctggatgtcaataggatcctgggctaccgccatttctgtaacaagctgtggaacgcaaccaagtttgctctgagaggtctcggcaaaggtttcgtaccgtcccccaccagccagccaggaggccacgagtcgcttgttgatcgatggatccgctcacgtctgacagaagccgtgaggctaagcaaccagggctttcaggcctatgatttccctgccgttacaaccgcccagtattctttttggctgtatgagctctgtgatgtgtacctcgaatgcctcaaaccggtgttgaatggcgtggaccaagtggccgcagagtgtgcccgtcaaaccctgtacacatgtcttgatgtaggtctccgtctgttaagtccctttatgccctttgtgaccgaggagctgttccagcggctgccaaggagaatgcctcaggcaccccctagcctgtgcgtcaccccgtaccctgaacccagcgaatgctcttggaaggaccccgaggcagaagccgcactggagctggctttgtccatcacccgggcagtgagaagcctacgcgctgactacaacctgacacgcatcagacccgattgtttcttggaagtggccgatgaggccacgggtgccctcgcctcagctgtatccgggtatgtccaggctctcgcctctgccggagtcgtggctgtgctggctctcggcgcaccagctccccagggttgcgctgtggccttggcaagcgaccgctgcagtatacacctacagctacaggggctcgttgaccccgcaagagagttaggtaagttgcaagccaaacgggtggaggcacaacgccaggcacagagattgagagagcggagagccgcttctgggtacccagtgaaggtgccacttgaagttcaagaggcggatgaagccaagctccaacagacagaggcagagttgcgtaaagtagatgaggcaatcgccctgttccagaagatgctgtag

SEQ ID NO: 246541 - DNA, 2031 bp, Artificial Sequence
  Description of Artificial Sequence: Synthetic coding sequence
atgtcaactttgtacgtctccccgcaccccgatgctttcccttccttacgtgctctgatcgctgccagatatggggaggcaggagaagggccaggttggggaggggcacacccacgcatatgtcggcttccaaggtttgaggcacgtaaggccgtgctcgtggcccttaaagagcggggtctatttagaggcatagaagataatcctatggtggtccccctgtgcaaccgaagcaaagacgtcgtcgaaccacttctacggcctcagtggtatgtgagatgcggcgagatggcccaggccgcttctgccgctgtgacgcgcggagacctccgcatactgcctgaggcccaccagcggacttggcacgcttggatggataacatccgtgaatggtgcattagtcgacagctttggtgggggcataggatccctgcttatttcgtgacagtttccgatcccgctgttcccccaggtgaggatcccgacggccgatattgggtgagcggcagaaatgaggcagaggcccgagaaaaagctgccaaagaattcggcgtttctcctgacaaaatttctctgcagcaggacgaggatgtccttgacacttggttctccagcggcttatttcctctgtctatcctcggctggcccaatcaaagcgaggatctgtctgtcttctacccaggcacactgctcgagaccggacacgatattctgttcttctgggtggcccgaatggtgatgttgggactaaaattgaccggacggcttccctttcgggaagtgtacctacatgctatcgtgagagacgcccacggcaggaaaatgtccaaaagcctggggaacgtcatcgacccattggatgtcatatatggaatttctttacagggacttcacaatcagctgctcaattccaatttggatccctcggaagtcgaaaaggctaaggaggggcagaaggccgattttcccgcagggatacctgaatgtggtaccgacgccctgcgattcgggctgtgtgcttacatgtcccaaggccgtgatatcaacctagatgtaaaccgcatattaggctataggcacttctgtaataagctctggaatgccaccaaatttgctttgaggggcctgggcaagggattcgtgccttccccgactagccagcctggcggacacgagtcgctggttgacaggtggattaggagtagactgaccgaagcagtgagactgagtaaccaggggttccaggcgtatgatttccccgctgtaactactgctcagtactcattctggctctacgagctgtgtgatgtttatctggagtgtcttaagccagtcctgaatggtgttgaccaggttgccgcagagtgcgctcggcagacactctacacctgtctggacgtaggcctgcgattgctgtcacctttcatgccgttcgtaaccgaagagctgttccaaaggctgcccaggcgcatgccccaagccccaccttccctatgcgtaactccctatccagagccaagcgaatgctcctggaaggatcccgaagccgaggccgctcttgagctagcgttgtctataacaagagccgtacggagtctccgcgcagattacaaccttacaaggatcagacccgactgcttcctcgaggtagctgacgaggcaacaggcgctctcgcctcagctgtgtccggttatgtgcaggccctggccagtgccggagtggttgctgtgctggcactgggcgctcccgcaccccaaggatgtgcagtcgccctggccagtgataggtgttctattcacctgcaacttcaaggcttggtggatcctgccagagagctgggcaaactccaggccaagagagtggaagctcaacgacaagcacagcgactgcgggagcggagggctgctagcggttatccagtgaaggtgcctcttgaggtccaggaagccgacgaggcgaaactgcagcaaaccgaagccgagctgagaaaggttgacgaagctatagcactgttccagaaaatgttgtag

SEQ ID NO: 246542 - DNA, 894 bp, Artificial Sequence
  Description of Artificial Sequence: Synthetic coding sequence
atgccggacagctactctccaaggtacgtcgaggctgcatggtatccatggtgggagcagcagggcttcttcaagccagaatacggtcgacccaacgtcagtgctgccaatcccagaggggtgtttatgatgtgtatccccccaccaaatgtgactggaagtttgcacctgggacatgccctcacaaacgcaattcaggactcactaactcggtggcataggatgcgtggcgagacgactttatggaatccaggatgtgaccatgccggtatcgcaacgcaagtggtggttgagaaaaagctctggcgcgagcaaggcctctctcgacaccagctggggagagaggcatttctccaagaggtgtggaaatggaaagaggagaagggagaccgaatctatcatcagctgaaaaagttggggtcgtctttggattgggaccgggcatgttttacgatggaccctaagcttagcgctgctgtcaccgaagcgtttgtgcgtttgcatgaggaagggatcatataccggtcaacccgcctggtcaactggtcttgcactcttaactcggcaatctccgacattgaggttgacaaaaaagaactgaccgggaggactctccttagcgtgcctgggtacaaggagaaggtagagtttggtgtgttagtgagtttcgcttacaaagtccaaggatccgactccgacgaggaagtggtggtggctactacacgcattgagacaatgctaggcgatgtcgccgtggcggtgcatcctaaagacacacgctaccagcatttgaagggcaagaatgtgatccacccatttctgtctcgctccctcccgattgtattcgatgagttcgtcgatatggatttcggtacagggcctgcccaggtatag

SEQ ID NO: 246543 - DNA, 3192 bp, Artificial Sequence
  Description of Artificial Sequence: Synthetic coding sequence
atgccacaccttcccctcgcgtcctttcggccaccgttttggggcttgagacatagcagaggcctaccacgatttcactctgtgtctacccagtctgaaccgcacgggtctcctatctctaggcggaatagggaagccaaacagaagaggttgagggagaaacaagccacactggaggctgaaatcgctggcgagtccaaatcccctgctgaatcaatcaaagcttggaggccaaaggaactagttctttacgagatccctacgaagccaggggaaaaaaaagacgtgtcaggcccactgccaccggcttattccccgcgttatgttgaggccgcttggtatccttggtgggtgagagaaggcttttttaaaccagaataccaggctagactgccgcaggccacgggagagaccttctctatgtgtatcccgcctcccaatgtgaccgggtccctgcatatagggcatgccctgacagtggctattcaagatgctctggtccgctggcaccggatgagaggcgaccaggtgctctgggtccccggttctgatcacgccggtatcgccacacaggcggtggtcgaaaagcagctctggaaggaacggggagtcaggaggcacgagctgtcacgggaggctttcttaagggaggtctggcagtggaaagaagctaagggaggcgagatttgtgaacaattgagagcccttggcgcatcacttgactgggaccgcgaatgttttacaatggatgtagggtcgagtgttgcggttaccgaagccttcgtccggctgtataaagccggattgttgtatcggaatcaccagctcgtaaattggtcgtgtgccttgcggtcagccattagcgacattgaggtggaaaaccgacccctacctggccatacgcagctccgactgcccggttgtccgacaccagtctcctttgggttgctattttcagtggcttttccagttgatggggaaccagatgccgaagtggtcgtaggtacgacaagaccagagacactgccaggggacgtggcagtcgcagttcaccccgatgattctagatatacacacctgcacggcagacagctgagacaccccctgatgggccagcccctgcccctgatcaccgactatgccgttcagccccatgtgggtactggagcagtgaaagtcacacctgcgcattccccagcagatgctgaaatgggggctcggcatggtctttccccattgaatgtgatcgctgaagacggcacaatgacttccctatgtggggattggctgcagggcctgcatcgctttgtggctcgagagaaaataatgtcggtcctgtcagaatggggcttgtttcgaggattgcagaaccaccctatggtgcttccaatctgttccaggtcaggcgacgtgatcgagtacctactcaaaaatcagtggtttgtgcgttgccaagagatgggagctcgggcagccaaagccgtggagagtggggcactagagctctcaccttccttccaccagaaaaattggcagcattggtttagccacatcggagactggtgtgttagtaggcagctctggtggggtcaccaaattccagcgtatctcgtggtggaggatcacgcgcagggcgaggaagattgctgggtggttggtagaagtgaagcggaggcgcgtgaagtggccgctgagttaacgggcagaccaggcgcagaattaactctcgaaagagacccagatgtcctggacacctggtttagcagcgccttattcccattctccgcgttgggctggccacaggagactcctgacctagctaggttctatcccttgtcattgttggagacaggtagtgacctgttgctgttctgggtggggcgtatggtgatgttaggcacacagttaaccggtcagctgccattcagtaaagtattacttcatcccatggtacgggacaggcagggccgaaaaatgtctaaatctctgggtaacgtcctagacccaagggacatcattagcggcgtcgagatgcaggtcttgcaggagaagctgaggtcagggaaccttgaccccgctgagttggcaatagtggcagccgctcagaagaaggactttcctcacggcattccagagtgcggcactgacgcactgcgcttcacgctgtgctctcacggcgtccaggccggagacctgcacctgtccgtgtctgaagtacagtcatgcagacatttttgtaataagatttggaacgcccttcggttcatcctgaacgccctgggggagaaatttgtgccccagcccgctgaagagctatcacctagcagccccatggatgcatggatcctgagtagattagcactggcagcacaagagtgcgagcggggttttttgactcgcgagttgtctttggtaacgcacgccttacatcacttctggctccataacctctgcgatgtgtacttggaggctgtgaagcccgtcctttggcattcccccagacctttagggcctccacaggtgctgttttcatgcgctgacctggggctgcgcctgctggccccacttatgccattcttggccgaagagctgtggcagagacttcctcctagacccggatgtcccccagctccgagcatcagcgtggcaccttatccaagcgcctgcagtctggaacattggcgtcagcccgagttggaacggcgttttagtagggtgcaggaggtggtgcaggtcctgcgcgcactgcgagcaacctaccagttaacaaaggctcgcccaagggtcctacttcagtcgtccgagccaggagaccaaggcctctttgaggcctttctcgaaccactgggaaccctgggttactgcggagctgtgggacttttgccaccaggagccgcagctccctctggttgggcgcaggctccattgagtgacaccgcccaggtttacatggagctgcagggcctagtggatcctcaaatccagctcccgctgcttgccgctagacgatacaagttacagaagcagctggacagccttacagcccgtacccccagcgagggtgaagccggtactcagaggcagcagaagttgtctagtcttcagctcgaactgtctaaactggataaggctgccagccacttgcgacagctaatggacgagccccctgcacctggcagccccgagctgtag

SEQ ID NO: 246544 - DNA, 774 bp, Artificial Sequence
  Description of Artificial Sequence: Synthetic coding sequence
atgccacacctacccttggcttctttccgccctccgttctggggactgcgtcactcacgtggactgccgcgtttccattcagtctccacccagtctgagcctcacggaagtccaatctctcgaaggaaccgtgaggcaaagcagaagagactgcgcgaaaaacaagccactctcgaggcggagatcgccggagaaagtaagtcccccgcagagtctatcaaagcatggcggcctaaagagttggttctgtatgagattcctacgaagcctggagagaagaaagacgtgagtggaccattgccgccagcgtattccccacgctacgtggaggctgcttggtatccttggtgggtgcgggaaggctttttcaaacccgagtatcaggctcgcttaccgcaagctaccggcgaaaccttttcaatgtgtattccacccccaaatgtcactgggagcctccacattggccacgccctgactgtggcaattcaggacgcactcgtacgctggcaccgaatgcgaggcgaccaggtactgtgggtaccaggaagtgatcatgcagggatcgccacccaggcggtcgtggaaaaacagctttggaaagagcgtggcgtgaggcggcatgagctgtctcgagaagcgtttttacgcgaagtatggcagtggaaagaggcgaaaggaggggagatctgcgagcagttaagagctcttggcgctagtttggattgggatagggttttttaccacgggtgttggctcctgtccggttgcgactag

SEQ ID NO: 246545 - DNA, 3192 bp, Artificial Sequence
  Description of Artificial Sequence: Synthetic coding sequence
atgcctcacctgcctctcgcatccttccgcccacccttctggggactacgtcatagccgcggtctgcccaggttccactcagtttcaacccagagcgaaccccacggatcacctatcagcagacggaatcgcgaggccaagcaaaaaagactcagggagaaacaggctacccttgaagccgagatcgcgggagagtcaaagagcccagctgagtcaattaaagcttggcgccctaaagagttagtcctgtacgaaattccaacaaagccaggggaaaaaaaagatgtgagcggtcctttgccccctgcctatagtcctcgatatgtggaagcagcttggtacccgtggtgggtcagggagggcttctttaaacccgaatatcaggccagactgccccaggccacaggagaaactttctcaatgtgtatcccaccccctaatgtgaccggtagcctgcatatcggccacgctttgaccgtggccattcaggatgctctcgtgcgatggcatcgcatgcgcggagaccaagtgctgtgggtgcccggatctgatcacgctgggattgctactcaggccgtggtggaaaagcagctgtggaaggaacggggagtcaggagacacgagctgagccgagaggccttccttagagaagtgtggcagtggaaagaggcgaagggcggtgagatttgcgagcagttaagagcattaggcgctagcctcgactgggacagagaatgttttacgatggacgttgggagctcagtggctgtcactgaagcttttgtcagactttacaaagcaggactgctgtatagaaaccaccagctggtgaactggtcctgcgctctgcgctccgctatcagtgatattgaagtggaaaatcgtccactgcctggccatacacagctgaggctgcctggttgccctacgcccgtgtccttcggtttgcttttttctgttgcctttcctgttgacggcgaaccagacgcagaggtagtggtcggaactacccgcccagaaactttgcctggagacgtcgcagtggctgtccatccagacgatagtagatacacccatcttcatggccgacagctgcgtcatccactaatgggtcagccgttacccctgattacagactatgcagtgcaaccacacgtcggtaccggcgctgtgaaagtgacacccgctcactccccagcagacgccgaaatgggggcacgccacggcctcagcccacttaacgtgatcgcggaggatgggacgatgacaagcctatgtggcgactggctccagggtctacatcgtttcgttgctcgagagaagattatgtctgtgctgagcgagtgggggctgtttagaggactgcagaatcatccaatggtcctgcctatttgctctcggtccggggatgtcatcgaatacctactgaagaatcaatggtttgtgaggtgtcaggaaatgggggcacgcgctgccaaagctgtcgaaagcggcgcactggagctgagcccctcattccatcaaaaaaactggcaacactggttttcccatattggcgattggtgcgtgtcgagacaattgtggtggggccaccagatcccagcatacctggtggttgaggaccatgctcagggcgaggaagactgctgggtggtcggcaggagcgaagccgaggctagagaagtggccgctgagttgacggggagaccaggcgctgagctgacacttgagcgcgatcccgacgtccttgacacctggttctcctccgctctcttccccttctctgccttgggctggccgcaggaaactcccgatctagctaggttctaccctctttctctgctcgaaaccggtagcgatttgctgctgttctgggtcggcaggatggtcatgctcgggactcagttaacggggcagttacctttctccaaggttctgcttcatcccatggtgagggatcgccagggccgaaagatgagcaagtccctcggcaatgtacttgatcccagagacataatctcgggcgtggagatgcaagttctacaggagaagctgaggagtggcaaccttgacccggctgaacttgcgatagtcgccgctgcacagaagaaagatttccctcatggcatacctgaatgtggcactgacgcactgcgattcacactatgctctcatggagtccaggctggcgatttacacctttctgtgtcggaggtccagagctgccgccacttctgcaacaaaatctggaacgcactgcgttttatcctaaatgcattaggtgaaaaattcgtgccgcagcctgccgaagagctctctcccagcagccccatggacgcatggattttgagcagacttgccttagctgctcaagagtgcgagcgcggattcctgactcgcgagctgtctctagtcacccacgcattgcaccatttctggctgcacaatctttgcgacgtgtacctcgaggcagtgaagccagtgttatggcactcgcctagacccctgggccctccacaggtcctgttcagctgtgccgacttaggcctaagactgttggccccactgatgcccttcctagctgaggagctttggcagaggcttcctcctcgacccggatgtccacccgcaccatccattagcgtagccccatacccctccgcttgctccctggagcactggcggcaacccgaacttgaacggagattttcacgggtacaggaggtggttcaggttctgcgggcactgcgagctacttaccagctgacaaaagcacgaccacgggtgctgttgcagagctcagaaccgggtgaccagggactgttcgaggccttcttggagcctctgggcacccttggttattgtggggctgtggggttactgccccctggagccgcagctcctagtgggtgggctcaggctccattgtctgataccgcccaggtttatatggagttgcaggggctggtcgacccacagatccaattaccactcctagcagcccgtaggtataagcttcagaagcagctggattcacttacagcacgcacacctagcgaaggcgaagccggaactcaaagacaacagaagttaagtagccttcagctggaactgtccaaactggataaggctgcgagtcacctgcgacaactcatggatgagccccctgcgcctgggagccccgagctgtag

SEQ ID NO: 246546 - DNA, 348 bp, Artificial Sequence
  Description of Artificial Sequence: Synthetic coding sequence
atgccccacctgcctcttgcgagcttcagacctcctttctggggcttaagacactcccgtggactgcctaggttccactcagttagcacccagtccgaaccccatggctccccaatttcacgaaggaaccgcgaagcaaaacaaaagagactccgcgaaaaacaggccacactggaagccgaaatcgccggtgaaagtaaatcgccggcagaatctattaaagcttggagacctaaggagcttgtgttatacgaaattcctacaaagcccggtgagaaaaaagatgtatccggaccactcccacctgcctacagccccagatatgtggaagctgcctggtacccatag

SEQ ID NO: 246547 - DNA, 981 bp, Artificial Sequence
  Description of Artificial Sequence: Synthetic coding sequence
atgccccacctgccccttgcctcatttaggcctcccttctggggtctgcgacattccagaggcctccccaggtttcacagcgtgtctacccagtctgagcctcatgggtccccgattagcaggaggaaccgcgaagccaagcagaagaggctgagggaaaagcaggccactctagaagccgagatagccggagaatctaaatcgcccgcagaatctataaaagcttggcgccctaaggagctggtcctgtacgagatcccaaccaagccaggagagaagaaagatgtgtccggacctttacccccagcctattctccaaggtatgtggaagccgcatggtacccgtggtgggtgcgggagggttttttcaagccagagtaccaggctagattgccccaggctaccggtgagacattctctatgtgcatacctccgccaaatgtaacaggctccctccatataggccatgcactgacagtggctatccaggatgccctcgtgcggtggcacaggatgagaggagatcaagtcctgtgggttcctggctcagaccacgccggaatcgcgacacaggccgtggttgaaaagcagttgtggaaggagagaggagtgcgtcgacacgagctgtctagagaggccttcctgagggaggtctggcagtggaaggaagcaaagggcggagaaatatgcgagcagctgcgcgcactaggggcatcattagactgggaccgcgagtgttttactatggatgtcggttctagcgtggctgtgacagaggcttttgttaggctgtataaggctggcttgctgtaccggaaccaccagcttgtaaattggtcatgtgcactgaggtcagctattagcgatattgaagtggaaaacagacctctgccaggtcacacacagctgagactccccggatgccccacgcctgttagcttcgggcttttattctctgttgcatttcccgtcgacggctag

SEQ ID NO: 246548 - DNA, 3282 bp, Artificial Sequence
  Description of Artificial Sequence: Synthetic coding sequence
atgggaggcaaggcttggcccaggagggcggtgggcacagccggaggtccctgcgcggaacaaatttcagcgccattccagacattgctgatgccccatctgccactggcctcatttcggccacctttttggggcctcaggcactctcgtggtcttccccgattccacagcgtcagcacccagtccgagcctcatggatccccgatctccagaaggaaccgcgaagcaaagcagaagcgactccgggaaaaacaggccactttggaagcagagattgccggagaaagcaaaagtccagccgaatcaataaaggcatggcgaccaaaggagcttgtcctatacgagatccctaccaaacctggcgaaaaaaaagatgtttctggccctctccctcccgcatatagtcctcgctacgttgaagctgcctggtacccctggtgggtgagagaagggtttttcaaacccgaataccaggcgaggttgccgcaggcaacaggggagacattctctatgtgcattccccctcccaatgtcaccgggtccctgcacattggacatgccctaaccgttgctatccaggacgcacttgtgcggtggcacaggatgcgcggagatcaagtgctgtgggtgcctggctccgatcacgctggcattgccactcaggccgtcgtagaaaaacagctctggaaggagagaggagtgagaagacatgagcttagcagagaagcctttctgcgggaagtgtggcagtggaaggaagccaaaggaggagagatttgcgagcaactgcgagccttgggagcaagtcttgattgggatagagagtgcttcacgatggacgtgggttcatctgtggctgtgacagaggccttcgtgcggctgtataaggccggacttctttataggaatcatcaattggttaactggtcctgtgccctcaggtctgcgattagcgacattgaagtcgaaaacagaccactgcccggacacacacaactccgcctgccaggctgtccgacccctgtttcattcgggttgttattcagtgttgcattcccagtggatggggagcctgacgctgaagtggtggtgggaaccaccaggccagagaccctacctggagacgttgctgtcgccgtccatcccgacgactctagatatacccacctgcacgggaggcagctgcgtcaccctctcatgggccagcccttgcccctcatcaccgattacgcagttcaacctcatgtgggaactggtgcagttaaggtcactcccgcacactctccagcagatgcagagatgggcgctaggcacggcctttcccctttgaatgtgatcgctgaggacggtaccatgaccagtctgtgcggggattggctccagggcctccatcggtttgtggctagagaaaaaatcatgtccgtgttaagcgagtggggactgttccgtggcctgcagaaccaccccatggtactcccgatatgcagtcgctccggggatgtgatcgagtatctgctgaaaaaccagtggtttgttcgatgtcaggagatgggcgcaagagccgcaaaagcagtggagagcggcgcactcgagctctccccgagttttcatcagaagaactggcagcactggttcagtcacattggtgattggtgcgtcagtaggcaactatggtggggacaccagattcccgcttacctcgtcgtcgaggaccatgcccagggcgaagaggattgttgggtcgtgggtagatctgaggccgaagctagggaagttgcggctgagctcactggcaggcctggcgcagaactgaccctagaaagggaccccgacgtgctggacacgtggtttagttcagctctctttcccttttctgcccttgggtggccacaggagacaccggacttagctcgattctaccctctgagtttgctggaaacaggcagcgatctgttattattctgggtcggaaggatggtaatgcttggcactcagctgacaggccaactgccattcagcaaagtcctgttacacccaatggttagagaccgacagggacgcaagatgagtaagagtctgggaaatgttttggatccacgagacattatttcaggagtcgagatgcaagtcctgcaagaaaagctccggagcggaaatttagatcccgcagagctcgcgattgtggccgcagcacagaaaaaggacttcccacatgggattcctgaatgtgggaccgacgcattgaggttcacactctgcagtcatggcgttcaagccggagatcttcatctcagcgtctcagaggtgcagtcatgccggcacttctgcaataagatatggaacgctctgcggttcatcctgaacgcactcggggagaagttcgtcccccagccagcggaggaactgtccccctctagtccaatggatgcatggatcctgagccgcctcgcactcgccgctcaagagtgtgagaggggatttctgactagagagctctccctggtgacccatgcactgcatcacttctggttgcataacctgtgtgacgtgtatcttgaggcagtaaagccagtgttgtggcactcgcctcgccctctgggaccccctcaagttctgttcagctgcgctgatctaggcctgcgactgctggcaccgctaatgcctttcttggctgaagagctttggcaaaggctgccaccaaggcccggatgcccacccgcaccgagcatttcggtcgctccttacccctctgcatgctcattagagcactggcgccagcctgagctggagagacgcttttcccgtgtgcaggaggttgtgcaggtcctaagggctttacgcgcaacctaccagcttacaaaagctcgtccacgcgtcctcttgcagtcctcagaacccggagaccagggcctatttgaggcgtttctcgagcctctcggtactctggggtactgtggggctgtgggtctgttaccacctggggcagccgctcccagcggttgggctcaggcacccttgagcgacacagcacaggtgtacatggagctgcagggacttgtggaccctcagatccagctcccactgctcgccgcacgcagatataagctccaaaaacaattagatagtttgaccgcgcgtaccccatccgaaggtgaggcaggaactcaacggcagcagaaactcagttccctccaactggaattgtcaaagctggataaggccgctagtcacctcaggcaactcatggatgagccaccggctcctggctctcctgagctgtag

SEQ ID NO: 246549 - DNA, 2772 bp, Artificial Sequence
  Description of Artificial Sequence: Synthetic coding sequence
atgtgcatccccccacccaacgttacaggctccctgcacatcgggcatgccctgaccgtcgccattcaggacgcactggttaggtggcaccggatgaggggcgatcaggtgctctgggtccccggtagtgaccacgccggaattgctactcaggccgtggtggagaagcaactgtggaaggaacgcggtgtccgaagacacgaattgagtcgggaagcatttttgcgtgaggtgtggcaatggaaggaggctaagggaggggagatctgcgaacagctccgcgctctcggagcctcactggactgggaccgtgagtgtttcacgatggacgttgggtcgtctgtggccgtgaccgaagctttcgtgagactatacaaggccggactgctgtacagaaaccatcagctggttaattggtcatgcgccctgcggagcgcaatttccgatatcgaagtagagaaccggcctctgcctggtcatactcagttgaggctgcccggatgcccaacccctgtgtcatttggtttgctgtttagcgtggcctttcccgttgatggcgagccggacgcagaagttgtcgtaggcactacacgtcccgaaaccctccctggcgatgtcgctgttgctgtgcacccggatgactcccgttatacacacttacacggccgacagctgcgtcacccactgatggggcagccgctgcctctcattacagactatgccgtacagccacatgtcggcaccggcgctgtgaaggtaactcccgcacactcacctgccgacgcggagatgggggctcgtcacggcctgagccccctcaacgtgatcgcggaggatggtacaatgaccagcctttgcggcgactggctacagggcctgcaccgctttgtggcgagagagaagattatgagcgttctgagcgagtgggggctcttcaggggattgcagaaccaccctatggtgctgccaatctgcagtagaagtggcgacgtcattgagtacctgttgaagaaccagtggttcgtgcgctgtcaggaaatgggagcccgagccgctaaggcggttgagtctggcgctcttgagctctccccctctttccaccagaaaaattggcagcattggtttagtcatataggggattggtgcgtcagccgacaactgtggtgggggcaccagatccccgcatacttagtggtggaagatcacgcccagggcgaagaggactgttgggtagtgggacggtctgaagcggaggccagggaagtggccgcagagctgacgggccgacccggagcagagctcactttggagagagaccccgacgtattagatacctggttcagctccgccctcttcccctttagcgccttaggatggccccaggagaccccagaccttgcgcgattttaccccctcagcctgttggaaaccggcagcgatctattactgttttgggtgggaagaatggtcatgttaggcacccagctgacagggcagcttccctttagcaaggttctgctgcatccaatggtcagagataggcaagggcgtaagatgtcgaagagtcttggaaacgtgctggatccgagagacattatcagtggggttgagatgcaagtgcttcaagagaaactgcgcagcggcaacttagacccagccgaacttgcaatcgtggccgctgctcagaaaaaagacttccctcatgggatccccgaatgtggaaccgatgccctgaggtttactctctgcagtcatggtgttcaggccggtgatctgcatctcagcgtgtctgaagtgcagtcttgccgacacttctgtaacaagatctggaacgctctgaggttcattctcaatgccctcggcgagaagttcgtcccacaacccgctgaggagctttcccccagtagcccaatggacgcctggatactttcacggctcgcgctcgccgcacaggagtgcgagcgtggctttctgacacgggagctgagcctggtgacgcatgctctgcatcatttttggctgcataacctgtgcgatgtgtatctggaagccgtgaagcctgtgctctggcactcaccgaggcctctgggcccaccacaggtgctgttctcatgcgcagacttgggtcttaggctactggccccactcatgccttttttggctgaagagctttggcagaggctgcctccaaggcccggatgtcctcccgcaccgtcaatttcagtggcgccttacccatcagcctgctctctggaacactggaggcagcctgaactcgaaaggagattcagcagggtccaggaagtggtccaggttttacgagctctgagagctacataccaattgaccaaggctaggccacgggtgttgctgcaatctagtgaaccgggtgaccaaggactgtttgaggccttcctggaacccctcggcactctgggctactgcggggcagtgggactgctgcccccaggcgcagcagccccatcagggtgggcccaggcacctctaagcgacactgctcaggtgtacatggaattacaggggttagttgatccacagatccaactgccattgctggccgctcgcagatacaaactccagaaacagctggactcactcacagcgaggactccttcggagggggaggctggcacgcagaggcaacagaagttatccagtctccagctcgagctcagcaagctcgataaggctgcaagtcacttgcggcagctcatggatgagccccctgcacccggatcacctgagctgtag

SEQ ID NO: 246550 - DNA, 885 bp, Artificial Sequence
  Description of Artificial Sequence: Synthetic coding sequence
atggcaagcgcaagcggtgcaatggccaagcacgaacaaattctggtactagatccacccaccgatttgaaattcaaaggaccttttactgacgtcgttaccactaatctgaaactgaggaacccgagtgaccgcaaggtgtgttttaaagtcaaaactacagccccacgtcgctattgcgtccgtcccaactctggtatcattgatcccggaagcaccgtgacggtttctgtgatgctgcagccatttgactacgacccaaatgagaagtccaagcacaagtttatggtgcagacaatctttgctcctcccaatacgagtgacatggaagcagtgtggaaggaggcaaagccagatgagctgatggacagcaaactgcgctgcgtgtttgagatgcctaacgaaaatgacaagctgggcattacccctccgggtaatgcacccactgttacaagtatgtcttctatcaataacaccgtggctacccctgctagctatcacaccaaagatgacccacgcggactaagcgtgttaaagcaagaaaaacaaaagaatgacatggaaccatcaaaagccgtccctttgaatgcgtcgaagcaggacggacccatgccaaaaccacatagtgtttcactaaacgatacagagacaaggaagctcatggaagagtgtaaacgactccagggcgaaatgatgaaactaagtgaagagaaccggcaccttcgtgatgagggcctccgactgcggaaagtcgcacatagcgacaaacctggaagcacctccacggcatcgtttagggacaacgtgacttcccctctgccctccttgttggtggtgattgcagccattttcattgggttttttctggggaagttcattctgtag

SEQ ID NO: 246551 - DNA, 750 bp, Artificial Sequence
  Description of Artificial Sequence: Synthetic coding sequence
atggcatccgcatcaggggcaatggctaaacatgagcagatcctggtgctcgatccacctacggatctgaaatttaagggaccttttacggatgtggtgactacaaatctgaaattacgcaaccctagcgaccgcaaggtttgttttaaggtgaagacgacagcccctcggagatactgtgtgcgccctaactcggggattatcgatcctgggtcgactgttacagtatcggtgatgctccagccatttgactatgatccgaacgagaaatccaagcacaaatttatggtgcagactattttcgctccacctaacacttctgatatggaggccgtctggaaagaagctaaaccggacgaacttatggactccaaactccgctgcgtgtttgagatgccaaacgagaatgacaaactgaacgacatggaaccatctaaagctgtgccattgaacgcatccaagcaggatggacctatgcctaaaccccattctgtgagtctaaatgatacagagacacggaagctgatggaggagtgtaagagactgcagggcgagatgatgaaactctcggaggagaacaggcacctccgcgacgaagggctgcggcttcgtaaggtcgcccacagcgataaaccaggatccaccagtaccgcttcttttcgggacaacgtgacctctcccctcccgagtctgctcgtcgtgattgcagctattttcatcggcttttttctcggaaagttcatactttag

SEQ ID NO: 246552 - DNA, 300 bp, Artificial Sequence
  Description of Artificial Sequence: Synthetic coding sequence
atggccaaggtagaacaggttctgtccttagagcctcagcatgagctcaagttcaggggaccttttacggacgttgtcacgacaaatctgaagctgggaaatcctaccgatagaaacgtttgcttcaaggtgaagactactgcccctaggcgttattgcgtgcgtcccaactctggtatcatcgacgctggcgcaagcatcaacgtgtcaggacgacggtggactgcggacgaagaggactcggccgaacaacagccacatttctcgatctctccgaattgggaagggaggcgcccttag

SEQ ID NO: 246553 - DNA, 732 bp, Artificial Sequence
  Description of Artificial Sequence: Synthetic coding sequence
atggcaaaagtcgagcaggtgctgtctttagagcctcagcacgagttaaagttccgcggtccttttacggacgtggtcaccacaaatctgaaattgggcaacccaacggaccgcaatgtgtgttttaaagtcaagacgacagctccacgcagatactgcgtgcggcctaatagcggaatcatagacgcaggtgcctccattaatgtgagtgttatgctgcagccatttgactatgaccccaacgaaaagagtaagcataaattcatggtacagagtatgttcgccccaaccgatactagtgatatggaggccgtatggaaggaggcaaaacccgaggacttgatggattcaaaactgcgctgcgtgtttgaacttccggcagaaaatgataaaccccacgacgtggagatcaacaaaatcatatctaccacggcatctaagacggaaacaccaattgtaagcaagagtctgtcctcctcattagacgatacggaggtaaagaaggtcatggaggaatgtaagcggttgcagggggaggtgcagaggctcagagaagaaaacaagcaatttaaggaggaagacggcttgagaatgagaaagaccgtccagtccaacagccctataagtgctctggcccctactggtaaagaggaaggcctaagcactaggcttctggctctcgtggtgttgtttttcatagtgggtgtgatcatcggcaaaattgccctctag

SEQ ID NO: 246554 - DNA, 1575 bp, Artificial Sequence
  Description of Artificial Sequence: Synthetic coding sequence
atggataccgaatctacatatagtggttattcttattattcatcccactccaagaagtcccaccggcagggcgaaagaacgcgggagcgtcacaagagtccccgaaataaagacggccgaggttctgaaaagagtgtgacgatccagcctcccacaggtgaacctttactgggaaatgactcaactcgcaccgaagaagtgcaggacgacaattggggggaaaccacgacggcaattaccgggacaagcgagcactccatttcccaggaagatatcgcacggatctctaaagatatggaggattctgtaggcttggactgcaaacgctacctggggctaaccgtggcctcttttctcggcctacttgtattcctaactcctatcgcgttcattctcctacccccaattctttggagggacgaactggaaccctgcggaacaatctgcgagggactttttatcagtatggcctttaaactcttaatcttgcttatcggtacctgggcgttgttcttccggaagaggcgagcagatatgccacgggtgttcgtttttagagccttactgctggtgctgattttcctctttgtggtgtcctattggctgttctacggggtgcggatactggactctcgggataggaattaccaggggattgtgcagtacgccgtgagcctggtggatgctctgctcttcatacactacctggccatcgttctgcttgagctgcgccagctccagcctatgttcacccttcaagtggtgagaagcacagacggagagtctcgtttctattcgttgggccatctgtccattcagagagctgctctggtggttttagagaactactacaaggatttcacgatctataaccccaatttgctcacggcctctaaatttagggcagcaaaacatatggccggacttaaagtatataacgttgatggaccttccaacaacgctactggtcaatctagggccatgattgctgctgcggcaaggaggcgggatagttctcacaatgagctatactatgaggaggcggagcatgaacgcagggtaaaaaagaggaaagccagactggttgtggcggtcgaggaagcctttatccacatacagagactccaagctgaagagcaacagaaggccccaggagaggtgatggaccccagggaagccgctcaggccatctttccatctatggcgagggccttacagaagtacctccgcattacaaggcagcagaattaccattcaatggaaagcatcttgcagcacctcgctttctgtataaccaatggtatgacccccaaggccttcttagaacgatacctttcagccggacctactttacagtacgataaagaccgttggctctctactcagtggcgattggtctctgatgaggctgttaccaacgggcttcgagatggaatcgttttcgtcctgaaatgcctggatttcagtttggtggtgaatgtgaagaagattccattcattatcctgtcagaggaattcatagaccccaagagtcacaaattcgttttacgcctgcagtcagagacatccgtatag

SEQ ID NO: 246555 - DNA, 1575 bp, Artificial Sequence
  Description of Artificial Sequence: Synthetic coding sequence
atggacaccgagtccacttactccggctactcctactactccagccacagtaagaaaagtcatagacagggggagcgtactagggagcggcacaaatcacccagaaacaaagacgggcgagggagtgagaaaagcgtgacgatccagccccctaccggcgaacccctgctcgggaatgacagtacacgtactgaggaggtgcaagatgataactggggcgagaccaccaccgccatcaccggcacaagtgaacactcaatttcacaggaggacatcgctcggatatccaaggacatggaggacagcgtcgggctcgactgtaaacgctacttgggcctgacagtggcgtcgtttctcggactgctggtctttctcaccccaatcgcgttcattctgctgccacccatcttgtggagagacgaattggaaccctgcggaacgatttgcgaaggcctgttcatcagcatggcttttaagctgctaattctactgataggcacgtgggccctatttttcagaaagcgccgtgcagacatgcctcgtgtttttgttttccgggcactactgttggtgctcatttttctttttgtggtgtcctactggctgttttacggtgtgcgtattctggacagcagagatcgtaattatcagggcatcgtgcaatacgctgtgagtctagtcgatgccttactcttcattcattaccttgcaatcgtcctgctggaactgaggcagctacagccaatgttcaccctgcaggtggtgagaagcactgatggtgaaagcaggttctactctttagggcatttatccatccagcgggctgccctcgtggtactcgaaaactattacaaagattttacgatctataatccgaacctattaacggctagcaagttccgcgctgccaagcacatggcgggtttgaaggtttacaatgtggacggtccttcaaataatgctactgggcaaagcagagctatgatagcagcagccgctagaagacgcgacagctcccacaacgagctgtactatgaagaagctgaacacgagaggcgggtcaaaaagcggaaggctaggctggtggtggccgtcgaagaggccttcatccatatccagcgactgcaagcagaagaacagcaaaaggctcctggagaggtcatggatccgagggaagctgcacaggctatctttccatcaatggcacgagctctgcagaaatacctgagaattactcgtcagcaaaactatcatagcatggaaagcatcttacagcacctagccttttgtattaccaacggaatgacgcccaaagctttcttggaacggtacctctctgccggaccaacactccagtacgataaggatcggtggctaagtacacagtggaggttggtcagtgacgaggcggtgactaacggacttcgtgacggaatcgtgttcgtactgaagtgtcttgatttcagcctggtggttaacgtcaaaaagataccatttatcatcctctcggaggagttcatcgaccctaaatctcacaaattcgtcctgagactgcagagcgagacaagtgtgtag

SEQ ID NO: 246556 - DNA, 1575 bp, Artificial Sequence
  Description of Artificial Sequence: Synthetic coding sequence
atggataccgagtccacctattctggctattcctattactcttcccactcaaaaaaaagccaccggcagggcgagaggacccgggagcgtcacaagtccccacggaacaaggatggcagaggttcggagaagtcagtcacgattcaaccgccaacaggagaacctttactggggaatgactcaactaggactgaagaggttcaggatgataactggggagaaacgacaaccgctatcacgggtaccagtgagcacagtattagccaggaggacatcgcacgaattagcaaagacatggaagattccgtggggcttgactgcaagcggtatttgggtctgaccgtggcctcctttctgggtctactcgtgttcctgacacctatagcttttattttgctacctcctattctgtggagagatgaactagaaccctgcggaactatttgcgagggtctttttatctcgatggccttcaaactgctgattctgttaatcggaacctgggctctcttctttagaaaacgccgagctgacatgcctagagtatttgtctttcgagcgctgttgctagtactaattttcctgtttgtggtgtcatattggctcttttatggggtccggatattggattctcgagatagaaactatcagggaattgtgcaatacgccgtgagcctcgtggacgctctactgtttatacactacctggcaattgtcttgctcgagctcaggcagcttcaacccatgtttactttacaggttgtgcgctcaaccgacggggaaagccgcttctactccctgggacatctcagcatccagcgagccgctctggtcgtgttggaaaactattataaggacttcacgatctataatcccaatttgctgacggcctcgaaattcagggcagctaaacatatggccggactgaaagtctacaatgtagacggccctagtaataacgccaccggccagagtagagccatgatagccgctgccgctcggcgtcgcgacagcagtcataacgaactgtactatgaagaagccgagcacgaaaggcgcgtcaagaaacgtaaggccagattggtggtggccgtagaggaggcgttcatccacatacaacggctccaggcagaggaacagcagaaggcccctggggaggttatggaccccagagaagcagctcaggcaatcttcccttctatggctcgggctttacagaagtacttgcgaataacgagacagcaaaactatcactccatggaaagcatcctgcagcatctcgctttctgcatcactaacgggatgactcccaaagcgtttttggaaaggtacctttctgccggtcctacgctccaatacgataaagaccgctggctctcaacccagtggcgtctcgtctcggatgaagcagtgacaaatggccttagagacggcatcgtttttgtgctcaaatgccttgatttttcgttggtcgtgaatgtcaagaagatccccttcatcatcctaagtgaagaatttatcgatcccaagtctcataagtttgttttgcgcctgcagtcggaaacatcagtttag

SEQ ID NO: 246557 - DNA, 1569 bp, Artificial Sequence
  Description of Artificial Sequence: Synthetic coding sequence
atggacaccgagagtacatatagtggctattcgtattacagctcacatagtaagaagagccataggcaaggcgaacgcacgagagagaggcataagagcccacggaataaagacggacgaggatcagaaaagtcggtgaccatccagccacctacaggggaacccctcctcggaaacgatagtacccgcaccgaggaggatgataactggggcgaaacaacaacggcaatcaccgggacaagtgagcacagtatatctcaggaggatattgccaggatctccaaggatatggaggattcagtcggtcttgactgtaagaggtacttaggactcacggttgcttcatttctcggcctgctggtctttctgacccccatcgctttcatcctgcttccacctatcctttggcgggatgagctggagccatgcgggacaatttgtgagggcctatttatctcgatggcctttaaacttctgattctgttgattgggacctgggctctcttctttcggaaaagacgggctgacatgcctagggtgttcgtcttcagggctcttttgctcgtgctcatcttcctcttcgtggtgagctactggctgttctatggggtgcggatactggatagccgggatagaaattaccagggaatagttcaatacgcagtgagcttggtcgatgccctattattcatccattatctggcgatagtcctattggagctgcgccagctgcagcctatgttcacccttcaggtcgtgagatcaacagacggagagtcaaggttctactccctgggacacctgtcgatccagagagcagccttagttgtactggagaattactataaagactttactatctataatccgaacctactcaccgcttctaagtttcgcgcagctaaacacatggccggtctcaaagtatacaacgttgatggcccaagtaataatgctaccggacagtctcgagccatgatcgctgccgctgctcgacgtcgcgatagcagtcacaatgagttgtattacgaggaggctgaacacgagcgaagagtgaagaagcgcaaggcccgtttggtggtggcagttgaggaagccttcatccatattcaacgcctgcaggccgaggaacagcagaaggcacccggtgaggtgatggatcccagggaagcggctcaagcaatcttccccagtatggcgagggcacttcagaagtacctgcggattaccaggcaacaaaattatcatagcatggaatctatcctgcaacacctagccttctgcattactaatggcatgactcccaaggcgttcctggaacgctacctgtctgcgggtcctacactgcagtacgacaaggaccgctggctgtcaacccagtggaggttagtctctgatgaggccgtgacaaatgggctcagggatggaatcgtctttgtactcaagtgcttggacttctcactagttgtgaacgtaaagaaaattcccttcatcattcttagtgaggaatttatcgacccaaagtcgcacaaatttgtgctgagactgcaatccgaaaccagtgtgtag

SEQ ID NO: 246558 - DNA, 1566 bp, Artificial Sequence
  Description of Artificial Sequence: Synthetic coding sequence
atggatactgagtctcagtactcaggctactcctataagagcggtcactcacgctctagcagaaaacacagggatcggcgagaccggcacagaagtaaatctagagatggcggtaggggggataaaagcgtgacaattcaggcgccaggcgaacccctgttagacaatgaatcaactcggggagacgagcgggacgataactggggtgagaccacaacagtagtgactggtacttcggagcattccatcagccacgacgatttgacacgtatcgcgaaggacatggaagactcagtgcctctcgactgttccaggcatttgggggtagcagccggtgccacattagccctcctcagctttttgacccccctggcttttcttctcttacctccactcctttggcgcgaagagcttgagccttgcggtactgcatgcgagggactcttcatatcagtcgccttcaagctgctgattttgctactcggaagttgggctctattctttcgcaggcctaaggccagtctgcctagggtattcgtgctgagggctctgctgatggttttggtgttcctgctggttgtctcctactggctgttctacggagtgcgaatactggacgctcgcgaaaggagctatcagggagtagtgcagttcgcggtgtcactcgtggacgcgctgctattcgttcactacctggctgtggtgctcctagagttgcgccaactccagcctcagtttacactgaaggtcgtgagatcaacagacggcgcttccagattctacaacgtcggacatctgagcatacaacgggtggctgtgtggatactcgagaagtattatcacgatttccccgtatataaccccgcactcctgaacctccccaagagcgtgcttgcgaaaaaggtgagtggcttcaaggtttactccctaggagaagagaacagcacgaacaactccaccggccagtccagggcagttatagcagctgccgcaaggcgcagagacaactcgcataatgagtactattacgaggaggccgagcacgaacgcagagttaggaagaggagagcgaggctggtcgtggctgtggaggaggcgtttacccatatcaaacggctacaggaggaggagcagaagaatcctagggaagttatggatccgcgagaagcagcacaggctatcttcgcctctatggctagagccatgcagaaatatctgcgcaccacaaagcagcaaccttaccacaccatggagagcatacttcagcatctagagttttgcattactcatgacatgaccccaaaggcttttttagaaagatacctcgctgctggccctacaatccagtaccacaaggaacgttggctcgcaaagcaatggacgttggtgtcggaggagcctgtgacaaatggacttaaggacggaattgtattcctgctcaaacgacaggacttttctttggtggtctctacaaagaaggtgccattcttcaagctaagtgaagagtttgtagacccaaaatcacacaaatttgtaatgcgccttcagtcagaaactagcgtgtag

SEQ ID NO: 246559 - DNA, 1542 bp, Artificial Sequence
  Description of Artificial Sequence: Synthetic coding sequence
atgactacgcaactgccggcatatgtcgctattcttctcttctacgtctcccgagccagttgtcaggatacctttacagccgctgtatatgagcacgctgccattctgccaaatgctaccctgacccccgtctccagagaagaagcactggccttaatgaacagaaacttggacatactggaaggcgctatcacgtctgccgctgatcagggagctcatattatcgttacaccagaagatgccatatacgggtggaattttaaccgtgattcactctacccttacctggaggatatccctgaccctgaggtaaactggatcccatgtaataaccgaaacagattcggacagacgccagtgcaagagcgactctcgtgtcttgcgaagaataactctatctacgtcgtcgcaaatattggagataagaaaccttgcgacacatcagacccacagtgcccacctgatggacggtaccaatataatactgacgtggtatttgactctcaggggaagcttgtggcacggtaccataagcagaatctatttatgggcgagaatcagttcaatgtgcctaaggaaccagagatcgtgacctttaacacaacatttggctcatttggtatatttacatgtttcgacatcctgttccacgacccagcagtcaccttggtcaaggattttcatgttgacacaatagtgttcccgacggcctggatgaatgtcctcccacatctgagtgctgtagagtttcacagcgcgtgggccatgggtatgcgtgtaaatttcttggccagcaatatccattatccctctaagaagatgaccggaagtgggatttatgcccctaactctagtagagcttttcattatgacatgaagaccgaagaaggcaagctcctgctctcacagctggactctcatccatcccactccgccgtcgtgaactggacgagttacgcctctagcatagaggccctgtcctcaggaaacaaggagtttaagggtaccgtcttttttgatgagttcacctttgtaaagctgactggtgtcgccggaaattataccgtctgccagaaggatttgtgctgtcacctgtcctataagatgtccgaaaacatcccaaacgaagtgtacgcactgggtgccttcgatgggctccacacagtggaaggcaggtattacttgcagatctgcaccctgttaaaatgcaaaacaactaacttgaacacatgcggagacagcgcggagaccgcatcgacccgcttcgagatgttctctttgtctgggacctttggtacccaatacgtcttcccggaagttctgctgtctgagaatcagctggcccctggcgaatttcaggtctcgacagatgggcgattgttctctctgaagcccactagcggccctgtgctgactgtaactctgttcggcaggctgtatgaaaaggactgggcttcgaacgccagttccgggttgaccgctcaggccaggattatcatgctaatcgttatagcccctatcgtgtgctcactatcatggtag

SEQ ID NO: 246560 - DNA, 1563 bp, Artificial Sequence
  Description of Artificial Sequence: Synthetic coding sequence
atggttacctcctccttccctattagtgttgccgtctttgcactgatcactctgcaggtggggacccaagactcttttatcgcagccgtttacgaacacgcggtaattctacccaataaaaccgagacaccagtctcccaagaagatgctcttaacttgatgaatgagaatatcgacatactggaaacagctataaagcaggccgctgaacagggagcgagaattatcgtgacgccagaggatgccctgtacggatggaagttcactagagagacagttttcccctacctggaagacattcctgaccctcaggtcaactggataccatgccaggacccacacaggttcggacacaccccagtgcaggcaagattatcatgcctcgccaaggataattccatttatgtgctggcaaaccttggggacaagaagccatgtaattccagggacagtacttgcccacccaatggatattttcagtataatacgaatgtggtttataacacggagggtaaactcgtcgccaggtaccacaagtaccacttatactctgagccccagttcaacgtgcctgaaaagcctgagctcgttacatttaacaccgcattcggaagattcggaattttcacctgtttcgatattttcttctatgatcccggagtgaccctagttaaagactttcacgtcgacacaatcctgttccctaccgcctggatgaatgtactgcccttactcaccgccatcgagttccatagcgcctgggctatggggatgggggttaacctcttggtcgcaaatacccaccatgtttccttaaatatgactggctctgggatctatgctcccaatggccctaaagtttatcactatgatatgaaaaccgaactcggaaagttgctcctgtccgaagtggatagccatcccttgagcagtcttgcttatcctacagcggtgaattggaacgcctatgcaacaacgattaagccctttccggtgcaaaagaacaccttccgcggatttatatctcgagacggcttcaattttacagaactattcgaaaatgcaggaaatctcaccgtgtgtcaaaaagagctctgctgtcacctatcctatcgaatgctgcagaaggaggagaacgaagtctacgtcctgggagccttcacagggctgcatggcaggcggaggcgggagtactggcaggtgtgtacgttgctgaaatgcaagacaactaatctgaccacatgcggcaggccagtggagacagcctcaacaaggtttgagatgttcagcctgtcagggacctttgggaccgaatacgtgttcccagaagtgctgctgaccgagattcacctgtcaccgggtaagttcgaagtcctgaaagatgggagactggtgaataaaaatggctctagcggtccaatcctcacagtgagcctgtttggcaggtggtacactaaagactctctctactcttcatgtgggacaagtaattctgccataacctatttactgatttttatcctgttgatgattattgccttgcagaatatagtgatgctttag

SEQ ID NO: 246561 - DNA, 501 bp, Artificial Sequence
  Description of Artificial Sequence: Synthetic coding sequence
atggtcacttcttcatttcccattagcgttgctgtctttgcgctgatcacccttcaggtaggtacccaggattcctttatcgccgcagtgtacgagcacgcggtaattttgccgaataagactgagaccccagtttcccaggaagacgcgttaaatctcatgaacgaaaacatagacattctggagacagcaatcaagcaggctgcggaacagggggctcgcattatagtgaccccagaggatgctctctatggttggaagttcactagagagaccgtgttcccctacctggaggacattccagacccacaggttaactggatcccatgccaggaccctcatcgttttggacatacgcccgttcaggccagacttagttgtctggcaaaagacaatagcatttatgtgttggctaacctcggagataagaaaccatgcaattcaagggactccacgtgtcccccaaatggctatttccagtataatacaaacgtggtttag

SEQ ID NO: 246562 - DNA, 1404 bp, Artificial Sequence
  Description of Artificial Sequence: Synthetic coding sequence
atgaatgaaaacatagacatccttgagacagccataaagcaggcagcagaacagggtgcacggattattgtgacgcctgaggacgctctgtacgggtggaagttcaccagggaaacggtctttccctatctggaggatattcctgaccctcaggttaactggattccttgtcaggatccacacaggtttggccatactcctgttcaagcgagattgtcgtgtctggcaaaagacaattctatctacgtgctcgccaacctaggggataaaaaaccctgcaattctcgggatagcacctgccctccgaatgggtacttccaatacaacactaacgttgtttacaacactgaaggcaaattagtcgcacggtaccacaaataccatctttactcggaaccccaattcaacgttcctgagaagcctgaactggtcacatttaatactgcctttggtagattcgggatttttacatgcttcgatatttttttctacgatccaggcgtgacactggtgaaggactttcacgtcgacaccatcctattccctaccgcctggatgaatgtactgccattattgacagccatcgaatttcattccgcctgggcaatgggtatgggcgtcaaccttctcgtggccaatacccaccacgtgagtcttaatatgaccggcagtggaatctacgccccaaacggacctaaggtctaccattacgacatgaagaccgagctcggtaagctgttactgtcagaagtcgacagccacccactttccagtctggcctacccaaccgccgttaactggaacgcttatgcgactaccatcaagcctttcccggtgcagaagaatacatttagaggctttatctcccgagacggatttaattttacagagctgttcgaaaatgctggtaatcttaccgtatgtcagaaagagctgtgctgtcacctgtcttaccgaatgctgcaaaaagaagagaacgaggtgtacgtgttgggggcttttaccggtctccacgggcgacgccgacgggaatactggcaggtttgcactctcttgaagtgcaagaccacaaatctcacaacttgcggcagaccggtagagaccgcctcaacaaggttcgagatgttttctttgtctggtacatttggcaccgaatatgtgttccctgaggttctgcttactgagatacatttgtcccccggtaagtttgaagtcctgaaagacggacggttagttaataagaacggctcttccggtcccatcttgacggtttctctatttgggcgatggtacaccaaggattccctgtatagttcctgcggtacatccaactcagccattacgtatctcctgatcttcatccttctcatgatcattgccttgcagaacatcgtcatgctctag

SEQ ID NO: 246563 - DNA, 309 bp, Artificial Sequence
  Description of Artificial Sequence: Synthetic coding sequence
atgaacgagaacatcgacatattggagacagccatcaaacaggccgctgagcaaggagccagaattatcgtaacccctgaagacgcactgtacgggtggaaatttaccagggagaccgtttttccttatctggaggacatacctgatcctcaagtaaactggatcccctgccaggacccacaccggtttggccacactcctgtccaagcgaggctttcctgcctggccaaggataactcgatttacgtgctggcaaatctgggagacaaaaaaccttgtaactccagagacagtacttgcccaccttag

SEQ ID NO: 246564 - DNA, 306 bp, Artificial Sequence
  Description of Artificial Sequence: Synthetic coding sequence
atggtgacaagtagctttccaatctctgtggccgtgttcgccttaattacactacaggtcggcacccaggattcgttcatcgcagccgtgtacgaacacgcagttatcctccccaataaaactgagacccctgtgagtcaggaggacgccctcaacctgatgaacgagaacattgacatattggaaactgcaatcaagcaggcggcagaacagggagcaagaattattgtaacaccagaagatgccttgtacgggtggaagttcacgagagagaccgttttcccttatctcgaagatatcccttag

SEQ ID NO: 246565 - DNA, 2931 bp, Artificial Sequence
  Description of Artificial Sequence: Synthetic coding sequence
atggaggagcggaagcacgagacaatgaacccagcccatgtcctgtttgataggtttgtgcaggcaactacatgcaagggcaccctcaaggcctttcaggagctgtgcgatcacctcgagttgaagcctaaagactacagaagcttctaccataaactgaagtccaagctgaattactggaaagctaaagccctatgggctaaactggataagcgtggcagtcacaaagactacaaaaagggcaaagcctgcaccaacactaagtgcctcataatcggcgcaggcccttgtggtcttagaaccgccatcgacctcagcctactcggtgccaaagttgtcgtcattgagaaacgggatgccttcagtagaaataacgtcctgcatttgtggccctttactattcacgatctgcgtggccttggtgcgaagaaattctacgggaagttctgtgccggtgccatcgaccacatttctattcgacagctccagttaatcttacttaaagtggcgctgatcctgggaattgagatccacgtaaatgtagagtttcaggggctcatacaaccccctgaggaccaggaaaacgagaggatcgggtggcgcgctctcgtgcaccccaagacccacccagtgagcgagtacgagttcgaggtcattataggtggcgatgggcgacggaataccctggaaggattccggaggaaggagtttcgcggtaaacttgccatagctatcacagctaacttcatcaaccgaaacacaacggcggaagcaaaggtagaggaaatctcaggggtagcttttatcttcaaccagaaatttttccaggaactgagagaggctaccggcatcgacctcgagaacatcgtgtactacaaagacgacacacactattttgtgatgacagccaaaaaacagtctctgctggataaaggcgttatcctccacgactatgcagacaccgaactgctcctaagcagggagaacgtcgatcaagaagccttgctctcatacgcaagagaggcggctgatttctcaacccagcaacagttgccaagcttggactttgcaataaaccactacggtcaaccagacgttgccatgtttgactttacttgcatgtacgcctccgagaacgctgcgctcgtgcgtgagcagaacggtcaccagctcctcgttgccctcgtgggtgactccctgctggagcccttctggcccatggggactggcatcgctcgaggcttcttagccgctatggactctgcctggatggtcagatcctggagcttggggacgagccccctggaagtcctagccgagcgcgagagcatctatcgcctcctgcctcagactaccccagagaacgtcagcaagaactttagccagtactccattgaccccgtaactcggtacccaaatataaatgtcaactttcttagaccatcacaagtgcggcatctgtacgatacaggcgaaactaaggatatccacctggagatggagtctctcgtgaatagccgcaccactcccaagctgacccggaatgagtctgtcgcaagatcttcaaaactgctgggctggtgccaacgacagaccgatggatacgccggagtgaacgtgaccgacttgaccatgtcctggaaatcagggctggctctttgtgcaatcatccacagatacagaccagacttaatcgacttcgattccctcgacgagcaaaatgtcgagaagaataatcagctcgcgttcgacatcgcagaaaaggaactggggatcagccccattatgacggggaaagagatggcgtcagtcggtgagcctgacaaactctcaatggtcatgtacttaacccagttttacgaaatgtttaaagattctctgcctagttcagacaccctcgatctaaatgctgaggagaaggccgtgctaatcgctagcacgcgaagtcccatctcctttctctccaagctgggacagacgatttcaagaaagcgctctcctaaggataagaaagaaaaggacctcgatggcgctggcaaaaggagaaaaacaagccagtcagaggaagaagaggcacctcgagggcatagaggggaacgtccgactctagtttccacattaaccgatcgtcggatggacgttgctgtgggtaatcaaaataaggtaaagtatatggcaacccagttgttggctaagtttgaagaaaacgcgccagcccaaagtatcgggattaggaggcagctgacgcaagaacgaggagcaagtcagccatcctgttgcctgcccggtcaggtcaggcctgccccaactccaaggtggaagcagggctccatgaaaaaggaatttccacagaatcttggcggaagcgacacatgttacttttgccagaaacgcgtttacgttatggagcgcctgtctgctgaaggcaagttctttcatagaagttgctttaaatgcgaatactgcgctaccactcttcgcctgagtgcttacgcctacgacatcgaggatgggaaattctattgtaaaccccactactgctacagactgtccgggtatgcacaaagaaagaggcctgcggtagctcctctttccggtaaggaggctaagggtcccctccaagacggcgctaccactgacgccaatggaagggccaatgcagtggcctcctctaccgagcgcacgcctggcagcggcgtgaatggtctggaagaaccaagcattgccaagagactgcgcggtacacctgaacggatcgaactggagaattatagactctcccttcggcaggctgaggctctgcaggaggtgcccgaagaaacccaggcagagcataacctaagctccgtacttgacaccggcgctgaggaagacgtagcctctcgatctgccaggcgtgctgcaggacggccacctgccacgagaccctag

SEQ ID NO: 246566 - DNA, 825 bp, Artificial Sequence
  Description of Artificial Sequence: Synthetic coding sequence
atgatcatcagtcacttcccgaagtgcgtcgccgtgtttgccttgctcgccctctccgtcggcgcactcgacacctttatagctgccgtgtacgaacatgctgtgatcctaccgaatcgaacagagaccccagtgagtaaagaagaagccttgctactcatgaacaaaaatatcgacgttctggagaaggccgtgaaattagccgctaagcagggagcccatatcattgttactcctgaagatggaatctatggctggatattcaccagagagtcaatctacccctaccttgaagacattcctgatcccggagtcaattggatcccctgtcgcgacccatggcggtttggcaacacaccggtccaacagcgcttatcatgtcttgccaaggacaattctatctatgtggttgctaacatcggcgataagaagccctgtaacgcgtccgactcacagtgccccccagacggtagatatcagtacaacaccgacgtcgtgtttgactcccaaggaaaactgcttgctaggtaccataagtacaatctgttcgcccctgagatccaattcgacttccctaaggatagcgaactggtgactttcgacactccttttggcaaatttggcatttttacgtgttttgacatattttcacacgaccccgcagtggtggtggtcgacgaattccagctcaccgccttctctacaccgcagcacggtaccactagatgcccttcttccagattgtttccctccattcagcacgggcctaggccatgggagagtatttacctcctgcagatccctactactcctgcctgtacctag

SEQ ID NO: 246567 - DNA, 444 bp, Artificial Sequence
  Description of Artificial Sequence: Synthetic coding sequence
atgattatcagccatttccctaaatgcgttgctgtgtttgccctgttagccctgtcagttggcgcactggatacctttattgcagctgtgtacgagcacgccgtgatactcccaaaccggaccgagaccccagtcagtaaggaagaagcattgctgctgatgaataagaatatcgacgtgctggagaaggccgttaagctcgccgctaagcagggcgctcacattatcgtaactcctgaggacggcatatacggttggatcttcactcgtgaaagtatatacccttatctggaggatattcccgatcccggagtgaattggataccctgccgggacccttggcgcaaatccaagaaaatgaatgagccggtgtcaaaagaactctgttatcactgccacagcgagtgcaatcagtatgggcagtggaaactgtaccggacctag

SEQ ID NO: 246568 - DNA, 624 bp, Artificial Sequence
  Description of Artificial Sequence: Synthetic coding sequence
atgatcatttcacactttcctaaatgtgtggccgtcttcgcactgcttgccctgtcggtgggcgcactcgacacttttatagctgccgtatacgagcacgccgtgatcctgccaaacagaacagaaacacctgtcagtaaggaggaggctttgctcttgatgaataaaaatatcgatgtgctcgaaaaagccgtgaaacttgccgctaagcaaggggcacatataatagtgactccggaagacggaatatatggatggattttcacaagagagagcatctacccttatttggaagacatcccagaccccggtgtgaattggataccctgtcgcgatccgtggcgctttgggaatactcctgtccagcagcggctaagttgtcttgcaaaagacaactccatctatgtggtcgccaatatcggcgacaagaaaccgtgcaacgcgtcggattcccagtgtcctcctgacggacgctatcaatacaacacagatgtagttttcgactcacagggcaaactgctcgccaggtaccataagggagtcgaaagtaccccgcaaaagcaaagccgttgcactacaatgacctggaaacagcgggtggtctcctgttgctatcagaattag

SEQ ID NO: 246569 - DNA, 561 bp, Artificial Sequence
  Description of Artificial Sequence: Synthetic coding sequence
atgtcccctaagccaagagccagtggacccccagccaaggccaccgaggccggaaagcgcaagagtagctcccagcccagccccagtgatcctaagaaaaagaccaccaaagtggctaagaagggaaaagcagtgaggcgtggacggagaggtaagaaaggagcagcaaccaaaatggctgctgttaccgccccagaggccgagagcgcgcctgccgctcccggacccagcgaccaaccttcccaggagctgcctcagcatgagcttccgccagaagaaccggttagtgagggcacacagcacgatccgctgtcccaggaagcagaattggaggaaccattatcacaagagtctgaagtggaagagccactgtcccaggaatctcaagtagaagaacccctgtctcaggagagtgaagtggaagagcccttaagccaggaatcccaggttgaagagcctctgagtcaggagtcggaaatggaggaacccctgtcgcaggagagccaggtcgaggagcccccaagccaggagagtgaaatggaggaacttcccagcgtctag

SEQ ID NO: 246570 - DNA, 621 bp, Artificial Sequence
  Description of Artificial Sequence: Synthetic coding sequence
atgtcaccaaagcctcgcgcatctgggccaccggcaaaagccactgaggcaggaaaacggaaatcctcctctcaacccagcccctccgatcctaagaaaaagacaactaaagtggcgaagaagggaaaggctgtacgaaggggacggcgaggcaaaaaaggcgctgctacaaaaatggcagcagtgactgctcctgaagcagagtccgcccctgcagcgccaggaccatccgaccagccatcccaggagctgccccagcatgaactccccccagaggagcccgtttctgaggggacacaacatgaccctctctcccaagaggctgaattggaagagcccctgagtcaagaatccgaggtagaggagcctctgtctcaagaatctcaggtggaggaaccgctgagtcaagaatctgaagtggaggaacccctatcacaagaatctcaggtggaggaacctctgtcccaagagtccgaggttgaagagccattgagccaggagtcccaggtagaagagcctctgtctcaggagtccgaaatggaagaaccgctttctcaggagtctcaggtggaggagccaccctcccaggagtctgagatggaggagctgccttccgtttag

SEQ ID NO: 246571 - DNA, 420 bp, Artificial Sequence
  Description of Artificial Sequence: Synthetic coding sequence
atgtctccgaaaccacgggcaagcgggcctccggctaaggcaactgaggcagggaaaaggaagagttcgtcacagcctagcccaagcgaccccaagaaaaaaacaacaaaggtagcaaagaaaggaaaggcggtgcggagggggaggaggggaaaaaaaggcgctgccacgaaaatggcagccgtgacagcacccgaagcggagtctgcccctgcggctccaggaccctcagaccagccctcccaggagctgccccagcatgagctcccacctgaagagcccgtaagtgaagggactcagcatgaccctcttagtcaggaatcagaggttgaagagcccctctcccaggagtccgaggtagaggagccgttgactgtctggatggctagtttttcccccgtgagcgagtccacggactag

SEQ ID NO: 246572 - DNA, 561 bp, Artificial Sequence
  Description of Artificial Sequence: Synthetic coding sequence
atgagtcctaaaccccgtgcctccgggcctcctgcaaaagccacggaagccggaaagcggaagtctagctcccagccctctccatctgatcccaaaaagaaaaccactaaggtggctaagaagggtaaggcagtgcggcgtgggaggagaggcaagaagggagcggctaccaagatggctgcggtgaccgcacccgaagccgagtcaggccctgccgctccaggtcccagcgaccagccgtctcaagagcttcctcagcacgagctgccccctgaggagcctgtgtccgaaggcacccagcacgaccctcttagccaagagtccgagctggaagagccgctcagtcaggagagcgaggtggaggagccactttcccaggagagtcaggtagaggaacctctctcccaggaatcagaagtcgaggagcctctgagccaggagagccaagttgaggagccgctatcccaggagagtgaagtcgaagagcccctcagccaggaaagccaggtggaagaaccgctgagccaggagtctgaaatggaggagctgccatccgtctag

SEQ ID NO: 246573 - DNA, 501 bp, Artificial Sequence
  Description of Artificial Sequence: Synthetic coding sequence
atgtccccgaagccccgtgcttctgggcctcctgccaaagccacagaggcaggcaagcgaaagtcatcctcccaacctagcccatcagaccccaagaagaagacaaccaaggtggccaaaaaagggaaggccgtcagaagaggccgtcggggtaaaaaaggagcagccacaaagatggcggcagttactgcccctgaggcggagagcggtccggctgctcccggaccaagtgatcagccctcccaagaactgccgcagcacgaactgcccccagaggaacccgtgtcggaggggacacagcacgatcctctctcccaggagtccgaactggaggaacctctgagtcaggaatcagaggttgaggaacctttgtcacaggagtctcaggtcgaagagcctctgtcgcaggaaagtgaggttgaggagcccctgtcacaggaaagtcaggttgaggagccactgtcacaggaatcagaaatggaagagctgcctagtgtttag

SEQ ID NO: 246574 - DNA, 378 bp, Artificial Sequence
  Description of Artificial Sequence: Synthetic coding sequence
atgagcccaaaaccaagagcatccggcccacctgccaaagcgactgaggccggaaagaggaagtcttcttcgcagccatcaccctcagatccaaagaaaaaaactaccaaagtggccaaaaagggcaaagcagttcgccgtgggaggcgcggaaaaaaaggtgccgcaacaaagatggcagcagtgaccgctccggaagccgagagcggccctgccgcacccggaccttcagatcagccctcacaggagcttcctcagcatgagctcccccctgaagagcctgtgtcggagggaacacagcatgatcctctctcgcaggagagcgaactcgaggaacccctctctcaggagcgccctgcaacacctctgagtccctag

SEQ ID NO: 246575 - DNA, 378 bp, Artificial Sequence
  Description of Artificial Sequence: Synthetic coding sequence
atgtcacctaaaccgagggcttctggccctcccgcaaaggctaaagagaccggaaaacgtaagtcgtcatcgcagccttctccatcaggcccaaaaaaaaaaacgacaaaagtggctgagaaaggggaagccgtaagagggggtcgcagaggtaaaaagggcgctgctacaaagatggctgccgtcaccgcacccgaagctgagtcaggaccagctgctccaggtccttcagaccagcctagtcaagagcttccacaacatgaacttcctcctgaagaacctgtgtctgaggggactcagcacgaccctcttagtcaggaaagtgaattggaagagcccttatcgaaaggcagacctagcactcccctctcgccatag

SEQ ID NO: 246576 - DNA, 2220 bp, Artificial Sequence
  Description of Artificial Sequence: Synthetic coding sequence
atgcccggaaaaatggtagtcatcctgggagcttcgaacatcctttggatcatgttcgcagccagccaggcctttaaaatcgaaacaacccccgagagccgttatttggcccagatcggggatagcgtcagtctgacctgtagcacgaccgggtgtgagtcacccttctttagctggaggacacaaattgattcaccactgaatggcaaggttacaaacgagggaaccacttccaccttgaccatgaacccagtgagtttcggtaacgaacactcttacctgtgcactgcaacatgtgagagcagaaaattagaaaagggaatccaggtcgagatatattcttttcctaaggaccccgagatccacttgtctggtcccttggaggcaggcaagccaatcactgtgaaatgctccgtggccgatgtctatcccttcgatcgcctcgaaatagatcttctgaaaggtgaccacctgatgaagtcacaggagttcctggaggatgctgataggaaatcactggagactaaaagcctggaagtgaccttcacccccgttatcgaagacattggcaaagtccttgtatgtagggctaagctgcatatagatgagatggattccgtgcctacagttcgacaggctgtcaaggagctccaggtctatataagcccaaaaaacaccgtaatctccgtgaatccctcaaccaagctacaagagggagggtcggtgacgatgacctgctcatccgagggtctacccgctccagaaatcttctggtccaaaaagctggacaatggcaacctgcagcatctgtcaggcaatgccaccctcaccttgatagcaatgagaatggaagacagcgggatctatgtgtgtgaaggggtaaatctaataggcaaaaacagaaaggaagtcgagttaatcgtacaggaaaagccctttaccgtggaaatttcccccggacccagaatagcagcccagattggcgatagtgtcatgctgacatgctccgtgatgggctgcgaatctcctagtttctcatggcgcacacagattgactcccctctgagcgggaaggtgcggtctgaaggtaccaatagcacattaacactcagccctgtttcatttgagaatgagcattcttatctatgcacggtgacctgcgggcataagaaactggaaaaaggaatccaggttgaattgtactcgttcccacgcgacccagagatagagatgtctggtggtctggtgaacggcagctccgtgactgtgtcctgtaaggtaccctccgtctatccactcgatcgtttagaaatcgaactgctcaaaggcgagactatcctggagaatatagagttcctcgaggatacagatatgaagtcgcttgagaacaaatcacttgaaatgaccttcatcccgacaatagaggatactgggaaggcactggtttgccaggccaagctccatatcgatgatatggagtttgagccaaaacaacgacagagtacacagactctgtatgttaacgtagccccaagggatactactgttctggtgtccccaagctctatccttgaagaggggtcctccgtaaatatgacatgcctatctcaaggcttccccgctccaaagatattgtggtcacgccagctgcctaatggcgagctacagcctcttagtgagaacgccaccctcacactgatctctaccaaaatggaagatagtggcgtgtacttgtgcgagggcatcaaccaggccggacgcagccgtaaagaagtggaactaattattcaggtaactccgaaggatatcaaactcacagcatttccatctgagtctgtgaaggaaggagacacagtaatcataagctgtacatgtgggaatgtgcccgaaacttggattatcctcaaaaagaaagccgagacgggcgataccgttctgaaaagcattgatggcgcatacaccatccgaaaagctcaattgaaagacgcaggagtgtacgagtgtgaatcaaagaacaaggttggctcccaactccggtccctgacccttgatgtgcagggacgcgagaataacaaggactattttagccctgagctcctggtcctgtacttcgccagctccctcatcatcccagcgatcggcatgattatctacttcgcacggaaagctaacatgaagggctcttattccctggtggaagcccaaaagtcaaaggtgtag

SEQ ID NO: 246577 - DNA, 1944 bp, Artificial Sequence
  Description of Artificial Sequence: Synthetic coding sequence
atgcccggaaagatggtggtgatactgggggctagtaatatactctggattatgttcgctgcctcacaggccttcaagattgagacgacccctgagtcccggtacctggcacagatcggcgactccgtgtcactgacttgctcaacaaccggttgcgagtctccattctttagctggagaacgcagatcgacagcccactcaatgggaaggtgaccaacgaagggaccaccagcaccctgaccatgaatcccgtcagctttggcaatgaacattcttatctctgcaccgccacctgtgaatccagaaagttagagaaagggattcaggttgagatttacagcttcccgaaagatccagaaatacacctctccggaccactcgaggccggaaagcccattacggtgaagtgctccgtggctgacgtctatccattcgatcggttagagatcgacctgctgaaaggagaccaccttatgaagtctcaggagttccttgaggatgcagacagaaagagtttggaaacaaaatcgcttgaagtcactttcacaccggtaattgaggacattgggaaggttcttgtgtgcagggctaagctgcatattgatgagatggattcagttccaacggtccgtcaggcagtgaaagagcttcaggtgtacatttcaccaaagaatactgtgatttcagtcaacccatctactaaattacaagagggagggtctgtgaccatgacttgctccagtgaggggctccccgctccggagatcttttggagtaaaaagctggacaacggtaatctgcagcaccttagtgggaatgccaccttaaccctgatcgccatgcggatggaagactctggcatttatgtatgtgaaggcgtgaatctcattggcaagaaccgaaaagaagttgaactgattgtgcaggcttttcctagggaccctgaaatcgagatgtctggtggactggtgaatggatcttccgtgaccgtgagctgtaaagtgccgagcgtgtatcccctggatcggctggagatagaactgctgaagggcgaaacgatcctggaaaacattgaattcctggaggataccgatatgaagagcctagaaaacaagagtttagagatgaccttcatccctaccattgaggacaccggcaaagctttggtgtgtcaagctaaactacatatcgacgatatggaattcgagccaaagcagaggcagtccacacaaactctatatgtcaacgtggcacccagggacacaaccgtgctggtgagcccctcatctatattggaggagggatctagcgttaacatgacctgtcttagtcaagggttccctgctcccaagatcctgtggtctcggcaactccccaatggtgaactgcagcccctcagtgagaatgccacgttgacattgatctctaccaagatggaggatagcggcgtatatctctgtgaggggatcaaccaggcaggtcgcagtcggaaggaagtggagctgattattcaggtgacccctaaagacatcaagctgaccgccttcccttcggaatccgtgaaagagggggacaccgtgatcatcagttgtacatgcgggaacgtacccgagacatggataatcctgaagaagaaggccgagacgggcgacacggtattgaagtccatagacggggcatatacaatacggaaggcccagctgaaggacgctggcgtctacgaatgcgaatccaagaataaagtaggcagccagcttcgcagtcttaccctcgacgtacagggacgggagaataataaggattacttttcaccagaactgctggtgctctatttcgccagctccttaatcattcctgccattgggatgatcatttattttgccaggaaggcgaacatgaaggggagctactctttagtggaggcccagaagtctaaggtctag

SEQ ID NO: 246578 - DNA, 1623 bp, Artificial Sequence
  Description of Artificial Sequence: Synthetic coding sequence
atgccaggcaagatggttgttatcctcggtgcctccaacatactctggatcatgtttgcagcttctcaggcgtttaagatagagactacacccgaatcaagatatctggctcagattggggactccgttagcttgacatgtagcaccaccgggtgtgagtccccctttttctcctggagaacacagatcgattctcccctcaacggtaaggtgacaaatgaaggcacaacgtctaccctgaccatgaatcccgtcagttttggcaacgagcattcttatttgtgtacggccacctgcgaatccagaaaactggagaaaggtattcaggtagaaatttacagcttcccaaaggacccagaaatccatctcagtggacctctggaagcgggtaagcctattacggtgaaatgcagcgttgccgatgtgtacccctttgaccgcctggagatcgatctgctcaagggtgaccacctcatgaagagtcaggaatttctcgaagacgccgataggaagagccttgaaaccaagtccctcgaggtgacgttcactccagtcattgaagacatcggcaaggtacttgtgtgccgcgcaaagctgcatatcgatgaaatggacagcgttccgacagttcgccaggcggttaaagaactgcaggtgtatatttcccccaaaaatactgtcatctcagtgaaccccagcactaaactgcaggaaggcggaagtgtgaccatgacctgcagtagtgagggactgcccgctcctgaaatattctggtctaagaagcttgataatggcaacctccagcacctgtccggtaatgcaactttaacactgattgctatgaggatggaagattcaggcatatatgtatgtgagggggtgaacctgataggaaagaatcgcaaggaagtggaactaatcgtgcaggtggcgcctcgcgacacgacagtccttgtgtccccttcttcaattctcgaggaaggctcgtctgtgaacatgacttgtctttcccaaggctttcccgcaccgaaaattctgtggagccgtcagttacctaacggggagctgcagcccctgtccgagaacgcgaccctcacactgatctccaccaagatggaagactcgggcgtgtacctgtgcgaggggatcaaccaggcaggcagaagcagaaaggaagtcgagctcatcattcaggtgaccccaaaggatatcaaactgacagcttttccaagcgaatcagtcaaggagggagacactgtcattatctcgtgcacgtgtgggaatgtgcccgaaacttggattatcctgaagaaaaaggcagaaacgggagacactgtgctcaaaagcatcgacggagcctatacgatccggaaggcccagcttaaggacgccggagtctatgagtgtgaaagcaaaaataaggtgggctcgcagctgcgatcgctcactctggatgtgcaggggagagaaaataataaagactacttttctccggagctgttggtgctctactttgcctcatcactcattatcccagctattggcatgattatctatttcgccagaaaagcaaatatgaaaggttcttacagtctggtcgaggcccagaagtcaaaggtgtag

SEQ ID NO: 246579 - DNA, 2034 bp, Artificial Sequence
  Description of Artificial Sequence: Synthetic coding sequence
atgcccggtaagatggtggtgattttaggtgccagtaacattctttggataatgtttgccgcttcccaagcgttcaagattgagaccacacctgagtcgagatacctcgcccagataggagattccgtctcgttgacatgttctacaaccggaagctttcctaaagatccggaaatccacttgtcaggacctttggaggctggaaagccaattacagtgaagtgttcggtggcagatgtgtatcccttcgatcgcttagaaatcgatctccttaaaggagaccacctcatgaaaagccaagagttccttgaggatgcggacaggaagtccctggaaacaaagagcctggaagttaccttcacccctgtcatcgaggatatcggcaaagtcctggtgtgcagagccaagctgcacatcgacgaaatggatagcgtacccacagtgcgccaggctgtgaaagagcttcaggtgtatatttcccccaaaaacaccgttatctcggttaatccttccaccaagctgcaggagggcggttccgtgactatgacttgttcaagcgagggactcccagcccctgaaatcttctggagcaagaagctggataacggcaaccttcaacacctgtccgggaacgccaccctcactctgatcgcaatgcggatggaggactcaggtatttacgtgtgcgagggagtgaacctgatcggcaagaataggaaagaggtcgagttaatcgttcaggagaagcccttcacggtcgaaatctcacctggcccacggattgctgcacaaattggcgattctgttatgctgacttgctccgtgatgggctgcgagtctccgagcttttcctggcgcacacagatcgactctcccctctctggcaaggtacggtccgagggcactaactcaaccctgactctctcccccgtgtcgtttgaaaacgaacattcttatttatgcacagtgacctgtggacataagaagctagaaaaagggatccaagttgagctctactcattccctcgcgatccggagatagagatgtctggcggactcgtcaatggaagcagcgtgacagtcagctgtaaagtgccctccgtttacccactggaccgcctggaaatcgagctgttgaagggagaaaccatcctcgagaatatcgagttccttgaggatacggacatgaagtctttagaaaacaagagcctggagatgacgtttattccaacaattgaggacaccggtaaagccttagtttgccaagccaaactgcacattgacgacatggagttcgaaccaaaacagagacaatctactcaaacactgtatgtgaacgtggctcctcgtgacactacagtcctagtaagcccgtcctcgatcctggaggagggttcttccgtcaacatgacctgtctgtcccaggggtttccggctcctaagattctttggagtcgccagctgcccaatggagaactgcagcctctgagcgagaatgctactctgaccctcatcagcacaaaaatggaggacagtggggtctacctttgcgagggcattaatcaagcgggtcggagccgcaaagaggtggaactgattatccaggtgactcccaaggacattaaactcactgccttcccgtcggaatctgtgaaggaaggagatacagtgatcattagttgtacctgcggaaatgttcctgagacatggataatactaaaaaagaaggctgagacaggcgacactgtgttgaagtcgatcgatggagcttatacgatcaggaaggcacagctgaaggacgcgggagtttatgagtgtgaatcaaaaaacaaggtgggctcacagctccgatcgttgactcttgatgtccagggccgtgaaaataataaggattacttttcccccgaactgctcgtgctatatttcgccagtagtctgattatacctgctattggaatgattatttattttgctcgaaaggcgaacatgaaagggtcctactctctagtcgaggcccagaaaagcaaagtttag

SEQ ID NO: 246580 - DNA, 1566 bp, Artificial Sequence
  Description of Artificial Sequence: Synthetic coding sequence
atggaggcgaactggacggccttcttgtttcaggcacatgaagctagtcaccaccagcagcaggccgctcagaactcgctcctgcctttactgtctagtgcagtcgagccacccgaccaaaaaccgttgctccccatccccatcacacaaaagcctcagggagcacctgagactctgaaggatgcaattggaatcaagaaggagaaacccaaaacttccttcgtatgtacctattgcagtaaggcatttcgcgattcctaccacctaaggcgtcatgaatcctgtcataccggcataaagctggtctctcgcccaaagaaaactcctaccaccgtcgtacctttgatttcaaccattgcgggagatagttccagaacgagcctagtaagtaccattgccggaatcctttctaccgtgacgaccagctcaagcggcactaatccttcttccagcgcttccaccacagcaatgcctgtcacccaaagcgttaaaaagccatctaagccagtaaaaaaaaatcacgcttgcgagatgtgcggcaaggccttcagggacgtctaccatctgaacaggcataagttgagccactccgacgaaaagccattcgaatgtccaatctgcaatcagaggttcaagcggaaagacagaatgacctaccacgtgcgttcgcatgaagggggaataacaaagccctatacctgctcagtatgcggcaaggggttcagccggccagaccacttgtcctgccatgtcaagcacgtgcattctacagaacggccattcaagtgtcagacctgcacagccgcattcgccacaaaagaccggctgcgcacacacatggtaagacacgaaggcaaggtgagttgtaacatttgtggcaaactactgagcgccgcatatatcacaagccatctgaagacccacggacagagccaaagtataaactgcaacacttgcaaacaggggatcagcaagacatgcatgtccgaagagactagcaaccagaagcaacaacagcagcagcagcagcagcagcagcagcagcagcaacagcagcagcagcacgtaacttcatggccgggaaagcaagttgaaaccctgagattgtgggaggaggccgtgaaagcccgaaagaaggaagccgctaatctatgtcagactagcacagccgctacgactcccgtcactttgactacccccttctctatcacctcctctgtgtcaagcggcacaatgtcaaatcctgtgacagtggccgctgcaatgtctatgaggtcaccggtgaacgtgtcctccgcagtcaatatcacttcaccaatgaacatcggacatcccgtaacaatcacctcgcccctgtccatgacctcacccctcacactgactacccccgtgaatctgcccaccccagtgacggctccggtgaatattgctcaccctgtaactattacatcccctatgaatctgccaacccccatgacgctggcagcaccccttaatattgctatgcggccagtggaaagcatgccgtttctacctcaggccctgccaacctcacctccttggtag

SEQ ID NO: 246581 - DNA, 1566 bp, Artificial Sequence
  Description of Artificial Sequence: Synthetic coding sequence
atggaagccaattggaccgccttcctgttccaggcccatgaagcttcacatcaccaacagcaggctgctcagaattccttgcttccactcctgtcaagtgctgtggaacctcccgaccagaagcccctgctgccaattcctatcacgcaaaaaccacagggagcacccgagacccttaaggatgctattggaataaaaaaagagaagcctaagacttcatttgtatgcacttactgtagtaaggccttccgtgattcctaccacctgaggaggcatgagagttgtcataccggaatcaaactggtgtccaggcctaaaaagactcctaccaccgtggtgccacttatcagcacaatcgccggagacagctccaggacaagtctggtttctaccatagccggaatactgtccaccgtgactacgagttctagcgggacgaatcctagtagttccgcgagtactaccgcgatgcccgtcactcagtctgtgaagaagccgtcaaagccggtgaagaaaaatcacgcgtgtgagatgtgcggcaaagcttttcgcgacgtgtaccacctgaaccggcacaagttgtcgcatagcgacgagaaacctttcgagtgccctatctgcaatcagagatttaaaagaaaggacagaatgacctaccatgtgcgctcccatgagggaggcatcacgaaaccgtatacatgcagtgtatgcggtaaagggttcagccgccctgatcacctaagctgtcacgtgaagcacgtccattcaacagaaagaccattcaagtgtcagacgtgcactgcagcctttgcaacaaaggacagactgagaacgcacatggtgcggcacgaaggcaaggtgtcttgcaacatctgtggtaagttgctgtctgccgcttacatcacaagccatctcaaaacacatggacagagtcagtccataaactgcaatacatgtaagcaaggcatcagtaagacttgcatgtcggaagagacgagcaatcaaaagcagcagcagcagcagcaacagcaacaacagcagcaacagcagcaacagcagcagcatgtgaccagctggcctggcaagcaggttgagactctgcgactgtgggaggaggctgtcaaggccagaaaaaaggaggcagccaacctctgccagacctctaccgctgcgaccaccccagtaaccctgaccacgcccttctctattacctcctcagtcagttctggcacaatgagtaaccctgtaaccgttgcagccgctatgtccatgaggtccccagtcaacgtctcctctgctgtcaatatcacaagtccaatgaacataggacaccctgtcacaatcaccagtcctctgtccatgacaagtccattgacactgacaacccccgtgaatctacctaccccagtaaccgcgccagttaacatcgcccaccccgtgaccattacatctcccatgaacttaccaacacccatgacactcgctgcgcctctaaacatcgccatgcggccagtggaaagtatgcccttcctcccgcaagctcttccaacaagtcctccatggtag

SEQ ID NO: 246582 - DNA, 1374 bp, Artificial Sequence
  Description of Artificial Sequence: Synthetic coding sequence
atgcggccaccctcacctctccccgctaggtggctgtgtgtactggccggtgccttagcttgggccctgggccctgccggaggccaggctgccagactgcaggaggagtgtgattatgtgcaaatgattgaggtgcagcataagcagtgtttggaagaggctcagctggaaaacgagacaattggctgctcaaagatgtgggacaacctgacgtgctggccagccaccccacgaggccaggttgtggtccttgcctgccccctgattttcaaactgttctcctcgatacaagggagaaatgtcagccgcagctgcaccgatgaaggctggacccatctcgaaccaggcccttacccaatcgcctgtgggctggatgacaaggcagccagtctggatgagcaacagacaatgttttatgggagcgtcaaaacaggttatacaatcggatacggtctgagcctggccactctgctggtcgcaacagctattctgtctctgttcagaaagttgcattgcacccgcaattatattcatatgcacctgttcatttcttttatcctgcgcgcagctgcagtcttcatcaaagacctagccctcttcgatagtggcgagtctgaccagtgttcagaaggcagtgtaggctgtaaggctgcaatggtcttttttcagtactgcgtgatggcaaacttcttctggctcctggttgaaggcctatatctgtatacgcttttagccgtgagcttcttctctgaacgcaaatatttctggggctacatactgataggctggggggtgccatcaacattcaccatggtgtggaccatcgctcgtatacattttgaagattacggctgctgggacaccatcaacagtagcctttggtggatcattaaaggaccaattttgaccagcatcctggtcaactttatcttgtttatttgcatcattaggattctgctgcaaaaactgcgcccacccgatattcgaaaatcggatagctctccttactctcgcctcgcacggagcacgttgctactgattcctctcttcggcgttcattatataatgttcgcattcttcccagataattttaagcccgaagttaaaatggtctttgaactggtggtggggtccttccagggttttgtagttgccattctctattgttttctgaacggggaagtccaagccgaactccgaaggaagtggcgacggtggcatctgcagggagtgttaggatggaacccaaagtacaggcatccctctgggggatcaaacggagcgacctgttcaacccaggtgtctatgcttactcgagtctccccaggggcacggagatcctcatccttccaggctgaagtgtctctcgtgtag

SEQ ID NO: 246583 - DNA, 1251 bp, Artificial Sequence
  Description of Artificial Sequence: Synthetic coding sequence
atgatcgaggtccaacataaacagtgccttgaggaggcccagttggaaaacgaaaccatcggatgctcaaaaatgtgggataacttaacatgttggcctgccacacctcgtggacaagttgtggtccttgcttgtcccctgatatttaaattattctctagcattcagggacgtaatgtgtcccgatcctgtaccgatgaaggttggacccacctggaacctgggccttacccaatcgcatgtgggctcgatgataaagcagctagcctggatgagcagcagacaatgttctatggctcggtgaagacagggtataccatcggttacggcctctccttggccactttgctggtcgccaccgccattctgtccctcttcaggaaactgcattgtactagaaattatatccatatgcatcttttcatctcattcattctaagagccgcagcagtgtttattaaagatctggccctattcgattcaggggaaagtgatcagtgctccgagggttccgtggggtgcaaggctgccatggtgttcttccagtattgcgtaatggctaactttttctggttgctggtggagggcctgtacctgtataccctgcttgccgtcagcttttttagtgaacgtaagtacttctgggggtatatcctgattggttggggggtgccatccactttcaccatggtgtggactatcgccaggatccacttcgaggactacggctgctgggatacgattaattccagtctgtggtggatcattaagggtccaattttaacatccatcttggtcaacttcatcctgttcatttgtatcattaggattttattacagaaactgcggcctcctgatatccgaaagtctgatagttcgccatacagtcgcctggctcgctctacgctgctgctcattcctctgtttggcgtgcactatattatgtttgcatttttccctgacaattttaaaccagaggtgaagatggtctttgagctggtcgtcggctcttttcaagggttcgtggtggccattctgtactgttttcttaatggggaagtacaggcagagctgcgcaggaaatggcgacggtggcacctccagggcgtgttaggttggaacccgaagtatcggcatccgagcggcggatccaatggagctacatgttctactcaggtctctatgctgactcgagtgagccccggagccagaagaagctccagctttcaggctgaagtgagcctggtatag

SEQ ID NO: 246584 - DNA, 744 bp, Artificial Sequence
  Description of Artificial Sequence: Synthetic coding sequence
atgactcgacagagggtctggatgcgatgggctgtgaggcagccatggtcattctctaacatcgtgagctggctcacttcatccggctgctggtggagggcaagcacttgcacaccttgtctgccttctccaagttccttgtctggctctacaagcggtggcgtgccgtcaactttcaccatggtatggaccatcgctcgaattcacttcgaagattacggatgctgggacaccattaatagctcgctatggtggattatcaaaggaccaatcctgacaagtatcctggtgaatttcatcctcttcatttgtattatccgcatcctcctccagaaactgcgtcccccagacattcgaaaatctgattcatctccatactctcggctggcaagatctactcttctgctgatcccattgttcggtgtccactatattatgtttgcgtttttcccggacaactttaaaccagaggtgaaaatggtgtttgagctcgtggttggctcctttcaggggttcgtggtggcaattctgtactgcttcttgaacggcgaagtgcaagccgaactgcgccgtaagtggaggagatggcacctacagggagttctcggctggaacccaaagtatagacatccatctgggggttctaatggagctacctgcagtacacaggtctcaatgttgacgcgcgtgtcccccggtgctcgtcgatcaagttcattccaggctgaagtgagcctggtttag

SEQ ID NO: 246585 - DNA, 1230 bp, Artificial Sequence
  Description of Artificial Sequence: Synthetic coding sequence
atgcgtgctggacggaggcctcggctgggcccatgggcaggtggctgctctaaaatgtgggacaatctgacttgttggccggcaacacccagggggcaggtggttgtcctagcctgccccctcatttttaaattgttttcctcgattcagggccgaaatgtgtctcggtcatgcacagatgagggctggacgcacttggaaccagggccttatcccattgcttgcggacttgacgacaaagcagcatccctggatgaacagacgatgttctatggctctgtgaaaacagggtataccatcggctacggcttgtcattggctaccctcctggtggccacggctattttgagcctcttcaggaagctccactgtacacgcaactacatccacatgcatttatttatcagcttcattttgcgcgcagcggctgtatttatcaaagatctggcgctttttgactcaggcgaatccgatcagtgtagcgaaggctccgtaggttgcaaggccgcaatggtcttttttcagtattgcgttatggcaaattttttttggctgctcgtggaaggtctgtacctatatacactgttagccgtttctttcttctctgagcgtaaatatttttggggttatatcctgatcgggtggggagtgccctcaacttttactatggtgtggactatcgccaggattcatttcgaggattacggttgttgggacacaattaatagtagcctgtggtggattatcaagggtcccatactgacaagcattctcgtgaattttatactcttcatctgtataatcagaatcctgcttcagaaactccgcccaccagatatccgaaagtccgactcttctccatactccagactcgcgagatccacccttctgctgatacctctgtttggcgttcactatatcatgtttgccttctttccggacaattttaagccggaggtcaagatggtatttgagctcgtcgtcggctcctttcagggattcgtggttgcaattctctattgcttcctgaatggcgaggttcaggcagagctgaggagaaagtggcggcgatggcatctccagggcgtcctgggatggaatccaaagtacagacacccaagtggcggtagcaatggggcaacctgctctacgcaggtgtcaatgctaactcgcgttagccccggagcccgtaggagctcctcctttcaggccgaagtgagcctggtgtag

SEQ ID NO: 246586 - DNA, 1317 bp, Artificial Sequence
  Description of Artificial Sequence: Synthetic coding sequence
atgcggactctgcttcctcctgccctcctgacatgttggctcctcgctcctgtaaactcaatccacccggaatgtcgatttcatttggaaatacaggaggaagagaccaagtgcgccgaacttctgcgctcccagaccgagaaacacaaagcctgcagcggcgtgtgggataatatcacttgctggcgcccagctaatgtgggggagaccgttaccgtgccctgccccaaagtgttctccaatttttatagcaaggcagggaacattagtaaaaactgtactagcgatggatggtcggagacgtttcctgacttcgtggacgcctgtggatacagcgatccagaggacgaaagcaagattacattttatatcttggttaaagctatctacacccttggatatagcgtgtccttgatgagccttgccacgggaagcatcattctctgtctctttcggaagcttcactgtacacgtaactacatccacttgaatctgtttctgtcgttcattcttcgtgccattagcgtgctagttaaggacgacgtgctgtattcgagtagcgggacattgcactgccccgatcaaccaagcagttgggtgggatgcaagttgtccctagtctttttacagtattgtatcatggccaacttcttttggctgcttgtcgaaggattataccttcatacattgctggtggccatgctcccacccaggagatgtttcctggcttatctgctgattggttggggcctgcccacggtctgcatcggtgcatggacggccgctagactctatcttgaggatactggttgttgggatacgaacgaccatagtgttccttggtgggtcatccggatacccattttaatttcaatcatcgtgaacttcgtccttttcattagcatcattcggatcctcctgcagaaactgacttcacctgatgtgggcggtaacgaccagagccagtacaaacggctcgccaaaagcaccctcctgttgattccactgtttggggttcactatatggtgttcgctgtgtttccgatctctatttcctccaagtatcaaattctcttcgaactgtgcctggggtcgttccaaggcctggtcgtggccgttctgtattgcttcctgaacagcgaggtccagtgtgagttgaagcgaaaatggcgctcgaggtgtccgacccctagcgcctcccgggattatcgggtttgcgggtcctcattcagcagaaacgggtctgagggcgctctccagttccacaggggaagtcgagcacagagttttttgcagacggagacttcagtgatttag

SEQ ID NO: 246587 - DNA, 1269 bp, Artificial Sequence
  Description of Artificial Sequence: Synthetic coding sequence
atgcccctttgggaggccccatctgaccaccctgctaatccgccagctacccttcagggtcatacaagcctgcctggttgccaggaagaaccagccagagatccacagtctgggttgccacagataacatccgagtcttctagcttctctgagggcagcctgcccagttggtcatccggtccagctggagcaaagctaaacgcctctcacgagggcatcgggtcgtcgagcgatgggaacggcgactctaaagcggcaaccgagagggtcgtttcggcaatggatacagttagaaggaaacacccagagatcacgttttatattctggttaaggcaatctacacactgggttacagcgtctcactgatgtccctcgctaccgggtccattattctgtgcttgtttcggaagctccattgcacccgaaattatattcatctgaacctattcctctccttcattctccgagcaattagcgtgctcgtgaaagatgacgtattgtattcatcgagtgggacactgcactgcccagatcagccatcttcttgggttggctgcaagctgtctttggtttttctgcagtactgcatcatggccaactttttttggctccttgttgaaggtctgtacctgcataccctgctggttgcgatgttaccaccacgaagatgctttttggcctacctgctcattgggtgggggttgcccaccgtttgtatcggcgcatggactgccgcacggctgtatctggaggacaccggctgttgggatactaacgatcattctgtaccctggtgggtcataagaattcccatcctgatctctattatcgtcaactttgtgcttttcatcagtatcatccgaattctgctacagaaactcacctctcctgatgttggaggcaatgaccaatctcaatataaaagactagcaaagtcaacgcttttactaatccctctctttggcgtccattacatggtcttcgccgtttttcccattagcatcagtagcaaataccagattttattcgagttgtgccttggatcatttcaaggactggttgttgctgtactttattgcttccttaactcagaggttcagtgcgaacttaaacgtaagtggagaagccgctgcccaacgccttccgcctcccgcgattaccgagtgtgtggctcttccttctcccgaaacggatcagaaggtgctctccagttccaccgaggttctagggcgcaaagctttctgcaaacggagacgtctgttatctag

SEQ ID NO: 246588 - DNA, 234 bp, Artificial Sequence
  Description of Artificial Sequence: Synthetic coding sequence
atgcgcacactgttaccaccggcactactgacctgttggcttctggcccctgttaacagtatccatcctgagtgtagattccatctggagatccaggaagaggagactaagtgcgccgaactgttgcgctcacagactgaaaagcacaaaggccatacaaagggtttcattcttatacacgccggaggcctcaagcgtatactcgatcctcacacatatcccctggccccatag

SEQ ID NO: 246589 - DNA, 2022 bp, Artificial Sequence
  Description of Artificial Sequence: Synthetic coding sequence
atgtgctcacgagtgcccctgctgttgccacttctgctgttgctggcccttggcccaggcgttcagggctgcccaagcggatgccaatgctctcaaccccagacagtgttctgcacagctagacaagggactaccgttcccagggatgtacctcctgacacagtcggcttatatgtgtttgaaaatggcataacaatgctggacgctggaagcttcgccggactgcctgggctgcagctgctagacttgtctcagaaccaaattgcatctttgccctcaggggtctttcagccattggccaatctctccaacctcgacttgacggcgaatagacttcatgaaataacaaatgagactttccggggtttgagaaggctggaacgactgtacctgggtaagaaccgaatacgacacattcagcccggagcattcgacaccctcgacagactgctggaactgaaactccaggacaacgaactgcgcgcactgccgcctctgcgactccctaggctgctgctcctggatctgagccataattccttgcttgccctggagcccggtatcttggatacagccaacgtagaggccctccggctagccggactgggcctgcagcagctggatgagggattatttagtcggcttcgcaatctccacgaccttgatgtgtctgacaaccagttggagcgtgtgccgccagtgatcagagggctgcggggactgacccggctcaggctcgccggtaatactcggattgcacagctgcggcctgaagacctagcgggtctggccgcactccaggaactggacgtttcaaatctgagtctccaagcactccctggggatttgagcggcctgttcccgaggctgagactcttagccgcagcgaggaacccgttcaactgcgtttgtccgctctcttggttcgggccttgggtccgggaatctcacgtgactctggcttctcccgaggagacccgctgtcactttccccctaaaaacgctggtagacttttactggagctggattatgctgatttcggatgcccggctactactacaacggccacagtgcctactaccagaccagtggttcgggaacctactgccctttcctccagtctagcacccacctggttgtcgccaactgagcccgctacagaggccccatctcccccaagtacagcgcctcctactgttggtcctgtaccccagccgcaggactgtccaccttcgacttgcttaaatggaggcacttgtcatctaggtactaggcaccacctggcgtgcctatgccccgagggatttacaggcctttactgtgagtctcagatgggccagggtacccgcccatcaccaacgcctgtgactcctcggcctccaaggagtttgaccctgggaatagagcccgtcagcccaacaagtctgcgtgtgggcctgcagagatatctccagggcagttcggtgcagctgcggagcttacgcctcacataccgtaacctgtcagggcctgacaagcgactggtaaccctcaggctccctgctagtctcgccgagtataccgtaacacagctgcgcccaaatgctacttactcagtgtgtgtgatgcctttgggtccagggagggtgccagagggcgaagaggcttgcggagaagcccataccccacctgccgtgcactccaaccatgctcccgttactcaggcacgcgaaggaaatctgcccctgttgatagccccagcacttgccgctgttctcctagccgctctggccgcagtgggagccgcatattgcgtccggaggggcagagcaatggctgcagccgctcaggataagggccaggtggggccaggggcaggcccactggagctggagggggtgaaggtgccactggaacccggacccaaggccaccgagggaggaggagaagcgctgccatcggggtcagaatgtgaggtgccccttatgggcttcccaggacctggactccagtcccccctgcacgcaaagccatatatatag

SEQ ID NO: 246590 - DNA, 2538 bp, Artificial Sequence
  Description of Artificial Sequence: Synthetic coding sequence
atggagttatggaggcaatgcactcactggctgatccagtgccgtgtacttcctcccagtcatcgagtaacctgggatggagcgcaggtgtgcgagttggcccaggctctacgcgacggagttcttctttgtcagctcctcaacaacctgctaccccatgccattaaccttagggaggttaacctgcggccacagatgtcccagtttttgtgtctgaagaatattcggacattcctctcaacatgttgcgaaaagttcgggctcaaaaggtctgagttgtttgaggcgttcgacctgtttgatgtgcaagattttggaaaagtaatctatacactgtccgctctctcgtggaccccgatcgcgcagaacaggggaatcatgcccttcccaaccgaagaggaaagcgtgggagatgaggatatttattcaggtcttagcgatcagatcgatgacacagtcgaggaagatgaggatctgtacgattgtgtagaaaatgaggaagcagagggggacgagatttacgaggacctgatgcgctccgagcctgtatctatgcctccaaagatgacagaatacgataagcgatgctgctgcttgcgcgaaattcagcagacagaggaaaagtatacggacacactcgggtcaatccaacaacatttcctaaaaccgttgcaacggtttctgaagccacaggatatcgaaataatatttatcaacatagaggacttgctcagagttcacacacattttctcaaggagatgaaggaggcattgggcacccccggagctgcaaacttgtaccaggtcttcattaaatacaaagagaggttcttagtgtacggcagatattgctcgcaggtcgagagcgcatccaaacacctcgaccgcgttgcagctgccagggaggatgttcaaatgaaactcgaggagtgcagccagcgcgctaacaacgggaggttcaccctgcgggacctgctgatggttccaatgcagagggtgttaaaataccatctcctgctccaggaactcgtgaagcacacacaggaggccatggagaaggagaaccttaggctggctttagacgccatgcgggatttggcccagtgcgtcaacgaagtgaagagggataacgagaccctgcgtcagattacaaatttccagctttccattgaaaatctggatcaatccctggcccactacggacgcccaaagattgatggggagctgaaaattacttctgtggagagacgctccaagatggacagatatgccttcttacttgacaaggcactcctgatttgcaagcgccgaggcgactcttacgatctgaaggactttgtgaacctacacagttttcaggtgcgcgatgatagcagtggggatcgggataacaagaagtggtcccacatgtttctacttatcgaggaccaaggagctcaagggtatgagttgtttttcaagacccgtgaactcaaaaaaaagtggatggaacaatttgaaatggccatctccaacatatatcccgagaacgccactgctaatggacatgactttcagatgtttagcttcgaagaaactacttcatgcaaagcgtgtcagatgctcctccggggtaccttctatcaaggttatagatgccataggtgccgcgcatccgcccacaaggagtgtcttggtagagtgccaccttgcgggaggcacgggcaggacttccctggcactatgaagaaagataagttgcatcggcgtgctcaggataaaaagcgaaacgaactaggactcccaaaaatggaagtattccaggaatattatggtctcccaccccctccgggagcaatcggcccttttttaagactgaatcccggagatatcgtcgagctgacaaaggcagaagcagagcagaactggtgggaaggcagaaacaccagcaccaacgaaatcggctggttcccttgcaacagggtgaagccatatgtacatggccctcctcaggatctctctgtccacctgtggtacgctggtcctatggagcgtgccggagccgaatctatcctcgcaaatagatcggacggaacatttcttgtccgccagcgcgttaaggacgcggctgagttcgcgatatctataaaatataacgtcgaagtaaagcacatcaaaattatgacagctgagggattgtatcgcatcaccgagaaaaaggcgtttaggggccttacggaactggtggagttttaccagcagaactctctcaaagactgcttcaagtctttggatactactcttcagttccccttcaaagagcccgagaaacgaaccatctcccgtccagcagttggtagcactaaatactttggcacagcaaaagctaggtatgatttctgcgccagggatcggagcgaactgagcctcaaggaaggcgacatcatcaaaatccttaataaaaagggccaacaggggtggtggaggggtgagatttacggacgggtaggttggtttccggctaattacgtggaagaggactatagcgagtattgttag

SEQ ID NO: 246591 - DNA, 2247 bp, Artificial Sequence
  Description of Artificial Sequence: Synthetic coding sequence
atgtctcagttcctgtgtctcaagaacattcggacctttctctccacatgctgtgagaagttcggattgaaacggtccgagcttttcgaggctttcgatttgtttgacgtacaggatttcggcaaagtgatatacaccttgagcgcccttagttggacccccatcgctcagaaccggggtattatgccctttccaaccgaggaggaatccgtgggcgacgaggatatttactccgggttgagtgatcagatcgacgacacagtggaagaggacgaggacctttacgattgcgtggagaacgaggaggctgaaggagatgagatttatgaggacctgatgaggagcgagcccgtgagtatgcctcatttcctcaaaccgctgcagcgtttcctgaagccccaggacattgagatcatatttatcaatattgaggacctgctgcgcgtacacactcacttcttaaaggaaatgaaagaggcactgggcacgcccggagcagcgaatctgtaccaggtgttcattaagtacaaagagcgcttccttgtttacggaaggtactgttcacaagtggagtctgcctctaaacatctcgatcgggtagcagccgctcgcgaggatgtgcaaatgaagctcgaagagtgctcacaacgggctaataacggtcgatttacgttgcgagacttgttgatggtcccgatgcagcgggtccttaaatatcatctactcctgcaggaactggtgaagcacacccaggaggcgatggaaaaggaaaatctgcggctcgccctcgatgccatgcgagatcttgcacagtgcgtaaatgaagtgaagcgagacaatgagacgctccgccagattactaattttcaattaagcattgaaaatttagaccagagcctagctcactacggtcggcctaagatcgacggggagctgaagattacaagcgtcgaaagacggagcaagatggaccgctacgcttttctgctcgacaaagccctgctaatttgtaaacgtcggggtgactcttacgacctcaaagatttcgtgaatttacactcttttcaggtgcgcgatgacagtagtggggatcgcgataacaagaagtggtctcatatgttcctcctaatcgaggaccagggtgcccaggggtacgagcttttcttcaaaactcgggagctgaagaagaagtggatggagcagttcgaaatggccatcagcaatatctacccagagaacgctaccgccaacggccacgatttccagatgttcagttttgaagagacaacttcctgtaaagcttgccagatgcttctgaggggcaccttctatcaaggataccggtgtcatcggtgccgcgcatctgctcacaaggagtgcctggggcgtgtgccgccttgcggtaggcacggacaagattttccgggaactatgaaaaaagacaagctgcaccggcgagctcaggataagaaacgaaatgagttaggacttcccaagatggaggtattccaggagtactacggtttgccaccgccacctggcgcaatcggcccttttctcaggcttaatcctggagatatcgttgaattgaccaaggcagaagcagagcagaactggtgggaagggcgaaacacatccacaaatgaaattgggtggttcccctgcaatcgggttaagccttatgtgcacgggccaccacaggatttgtctgtccacctgtggtacgccggtccaatggagcgagctggtgccgagtctattctagctaacagatcagacgggacctttttggttaggcaaagggtcaaggatgcagcagaatttgcaatcagcatcaaatacaatgtggaggtgaaacacattaaaattatgaccgccgaggggctctacaggattacagagaagaaggccttcaggggtctgactgaattggtggaattttatcaacagaatagcctcaaagattgctttaagagcctggacacaactctccagttcccatttaaggagcccgagaagcgaacaatctcaagaccggctgttggcagcacaaagtactttggcaccgctaaggcgagatacgacttctgcgccagggaccgcagtgaactctcactgaaggagggcgatattataaagatactcaacaaaaaaggtcagcaaggctggtggaggggtgaaatttacggcagggtgggatggtttcccgctaattacgtggaggaagactattccgagtattgttag

SEQ ID NO: 246592 - DNA, 2442 bp, Artificial Sequence
  Description of Artificial Sequence: Synthetic coding sequence
atggagctgtggagacagtgtactcactggcttatccaatgccgcgtactcccgccttcacacagggtgacctgggatggagcacaggtttgtgagctcgcccaggcccttagagatggcgtccttctgtgccagttactcaataacctccttccccacgctatcaatcttagggaggttaatcttcgacctcagatgtcccagtttctgtgcctcaagaatatccgcacctttctgagcacttgttgcgaaaaatttggacttaaaaggtccgagctgttcgaagccttcgacttgttcgatgtgcaagatttcggaaaagtgatctacaccctgagcgccctatcctggactccaatcgctcagaaccgcggaattatgccattccccacagaggaggagagcgtgggggacgaggacatctactctggtctttcagatcagatcgacgataccgtcgaggaggacgaggatctctacgactgtgtcgaaaacgaggaggccgaaggcgatgaaatttacgaggacctgatgaggtctgaacctgtgtcaatgccacattttctcaagccgcttcaacggttcctgaaaccccaggacatcgagataatctttataaacattgaggacctccttcgggtacacactcactttcttaaggaaatgaaagaagctctcggcaccccgggagccgcaaacttgtaccaggtgttcataaagtacaaggagaggtttctggtttacggtcggtactgctcccaggttgaatcagcttccaaacaccttgaccgagtagctgcggctagagaggacgtccagatgaagctggaagagtgcagccagcgggcaaataacggcaggttcaccctgagggacttgcttatggtacctatgcaacgtgttctgaaataccacctgctcttacaggagctggtaaagcacacacaagaggccatggagaaagaaaacctgagactcgccctcgacgccatgagggacctagcccagtgcgtaaatgaggttaaacgagataatgagactctgaggcagatcaccaacttccagttatcgatagaaaatctggatcagtccctggcccattatggtcggcctaaaatcgacggggaacttaagattacttctgtggaaagaagatcaaagatggatagatacgctttcctgttggacaaagccctgctgatctgcaagcgcaggggggactcgtatgacctgaaggattttgtcaacctgcattctttccaggtgagagacgatagttcgggtgaccgtgacaacaagaagtggtcacatatgttcttgctcatcgaggaccagggggcacaaggctatgaactgttcttcaagacccgcgagctgaagaagaaatggatggaacaattcgagatggctatctcaaatatttaccctgagaacgctactgccaacggccatgacttccagatgttttcctttgaggagactacaagctgtaaggcctgtcaaatgctgctccggggaaccttttatcagggttatcgctgtcaccgctgcagagccagcgcccataaggaatgcctgggcagagtgccgccatgtggacgccatggccaggactttcccggtaccatgaaaaaggacaagctgcatcgtcgggctcaagacaagaagcgaaacgaattaggcctccctaaaatggaagtttttcaggaatattacggcctgcctccacctcctggggctattggtccatttctgagactgaaccccggagacatagttgaactcaccaaggccgaggctgagcagaattggtgggagggccgaaatacctctacaaacgagatcggatggtttccatgtaatcgagtaaagccctacgtgcacggacctcctcaagatctgagcgtccacctgtggtatgctggaccaatggaacgggctggggctgagtccatcctggctaaccggtccgacggcacatttctcgtgcgccagcgggtcaaagacgcagccgagtttgctatttctattaagtacaacgtggaggtcaagcatattaaaattatgaccgccgaagggctgtatcggattactgagaaaaaggcttttcgcggactaacggagctcgtcgagttctatcagcagaattctttgaaggactgttttaagtctctggacactacactgcaattcccttttaaggagccagaaaagagaactattagccggccagcagtcgggagtacgaaatattttggcacagccaaagctaggtatgacttttgtgctagagaccgcagcgagttatctctgaaagagggagacatcattaaaatcttgaacaagaaaggccaacaggggtggtggaggggagaaatatacggccgtgttgggtggttccctgccaattacgtggaggaagactattcagagtattgttag

SEQ ID NO: 246593 - DNA, 2538 bp, Artificial Sequence
  Description of Artificial Sequence: Synthetic coding sequence
atggagctttggaggcagtgcacccattggctcatacagtgtagagtgcttccaccatctcaccgtgtgacatgggacggggcacaggtatgtgagctcgcgcaagcactgcgggacggggtcctcctgtgtcaattactgaacaatctcctgccacatgcgatcaacttgcgagaggtgaatttgaggcctcagatgtcgcagtttctttgcctgaaaaacataagaacttttctttcaacttgctgcgagaagttcggactcaaaagatctgagctcttcgaagccttcgatctgttcgatgttcaagactttggaaaagtgatctacactctgagcgcactatcctggacccctattgcccagaacagagggatcatgcctttcccgaccgaagaagagagtgttggggacgaggatatttactccggtcttagtgaccagattgatgacaccgtggaggaggacgaagatctgtatgattgtgttgaaaacgaagaagcagagggagatgagatttatgaagatttgatgaggtcagagccagtttccatgcccccaaaaatgacagagtacgacaaacgctgctgctgcctgagggaaatccagcaaacggaagaaaagtataccgatactttgggttccattcaacagcacttccttaagccactgcagcggttcctcaagcctcaggacattgagattattttcattaacatcgaggatttgttgagagtccacacccattttctgaaagaaatgaaggaagcgctcgggacccccggagctgccaatctgtatcaggttttcattaagtacaaggagcggtttctcgtctacggaagatattgttctcaggtggagtctgcctccaagcacctagacagggtggccgcagccagggaggatgtacaaatgaaactggaggaatgttcccagcgcgctaacaatgggagattcaccttacgggatctattgatggttccaatgcagagggtgctaaaatatcacctgttgctccaagaactcgtcaaacacacgcaggaagctatggagaaagagaatcttcgcctcgccctggatgcgatgagagacctggcacagtgtgtgaacgaagtgaagcgtgacaacgaaacgctcaggcagatcaccaacttccagttgtccattgaaaatttagatcagtctctcgctcattatggccgtcctaaaatcgacggcgagctgaagattacaagcgttgagaggaggtctaagatggacaggtacgcgttcttactagacaaggccttgttgatctgcaagaggcggggagactcttatgatctgaaggattttgtgaatctgcattcgtttcaggtccgcgatgactccagtggggacagagacaataaaaaatggtcccacatgtttctgttgatcgaggatcagggcgcacaagggtatgaattatttttcaagactcgcgagcttaaaaaaaagtggatggagcagttcgaaatggcaatcagcaacatctatcccgagaacgccaccgcaaatgggcatgacttccaaatgttctcgtttgaggaaacaacgagttgcaaagcctgtcagatgttgctccgcggaacgttctaccagggctaccggtgtcatcgttgccgagcctccgcacacaaagaatgccttggaagggttccaccgtgcggccgacatggccaggactttccaggcaccatgaaaaaggataagctccaccggagagcacaggacaagaaacggaatgaactggggttgcctaagatggaggtgttccaggagtactacgggttgcccccaccaccaggggcaatcggaccatttctgagactaaatccaggcgacatcgtggaattaaccaaagccgaagctgaacagaactggtgggaaggccgaaacacttccactaacgagatcggttggtttccctgcaatcgggttaagccatacgtgcatggcccaccccaggatttatctgtacacctctggtacgccggtccaatggagcgcgctggtgccgaaagcatccttgccaatcgcagcgacgggacttttctagtaaggcagcgcgtgaaggatgccgcagaatttgccattagcattaagtacaatgtggaggtgaagcacattaaaattatgacagccgagggcttgtacaggattactgagaagaaagcgtttcggggattaacagaactcgtcgagttctaccagcaaaactcactcaaggattgtttcaagtctctggacacaaccttgcagttcccatttaaggagcctgaaaaaagaactatctcccgcccagccgtcggctcaacgaagtattttggaacagctaaggctaggtatgatttttgtgctagagatcgctcagagctgagcctcaaagagggcgatatcataaagattcttaacaagaaagggcagcagggttggtggcgaggtgagatttacggcagggtgggatggttcccagctaactatgtcgaagaagattattccgaatattgctag

SEQ ID NO: 246594 - DNA, 2607 bp, Artificial Sequence
  Description of Artificial Sequence: Synthetic coding sequence
atggagcagtggcgacagtgcggtcgatggttgatcgactgtaaagtcctgccacctaatcacagagtggtgtggccatcagccgtggtgttcgaccttgcccaggctctgagggatggtgtcctactttgtcagctactccataatttgagccccggatccatcgatctgaaggacataaacttccgccctcagatgtcacagttcctttgcctcaagaatatccgaactttcttgaaagtttgccatgataaattcggactcagaaattctgagcttttcgatcccttcgacctgtttgacgtgcgtgactttggtaaggtcatttctgccgtgagtagactgtcactgcactccattgcgcaaaataaggggatcaggcctttcccgtcagaagaaaccacagaaaatgatgatgacgtgtaccgatctctcgaggagttagcagacgagcacgacttgggcgaagatatttacgactgtgtgccgtgcgaggacggcggagatgacatctatgaggacataattaaagttgaggtacagcagcccatgaagatggggatgaccgaggatgacaaaagaaattgttgtctgctcgagattcaggaaaccgaggccaagtactaccggactctagaagacattgaaaagaattacatgtccccgcttagactggtgctctctcctgctgacatggctgcagtgtttatcaatctggaagaccttattaaagtgcatcatagctttctcagggcaatcgacgtgtcagtgatggtgggagggtcaaccctcgccaaggtatttctagatttcaaggaacggctactgatttatggcgagtactgttcccatatggagcacgcgcaaaatacacttaaccagctgctggcatcccgcgaagattttcgacaaaaagttgaggaatgcaccctgaaagttcaggacggaaagtttaagctgcaggacctcttggtggtccccatgcagagggtgctgaagtatcaccttttactcaaagagctgctctctcattccgcagagagacctgaacggcaacagttgaaagaggctctggaggccatgcaggacttggccatgtatatcaatgaggtaaaaagagataaagaaacgctccgcaaaatctccgagttccaaagtagcattgagaacctgcaggtaaagctggaggagttcggtcgcccaaagattgacggggaattgaaagtgagaagcatcgtgaatcataccaaacaggaccggtatctcttcttgtttgataaggtcgtgattgtgtgcaagcggaaaggatactcctacgagctgaaggaaatcatcgaactgctcttccataagatgacagatgatccaatgaataataaggacgtgaagaagtggagctacgggttttatctgatccatctgcagggaaagcagggatttcagttcttttgtaagacagaggatatgaagcgcaaatggatggaacagtttgaaatggctatgagtaacattaaaccagacaaggctaacgcaaatcatcatagcttccaaatgtatacttttgacaagacgactaactgcaaagcatgcaaaatgtttctccggggaactttttaccagggctacatgtgtacgaagtgcggcgtgggggcacacaaggagtgtttagaggtcatcccaccctgcaagtttcgcaccagtggagatagagacgcctccggggcaggcccagggccaaagatggtggctatgcaaaactaccatggtaaccccgctccacccggtaaacctgttcttacattccaaacaggagatgtactcgagctgctgcggggtgatcccgaatccccatggtgggagggcagacttgtgcagaccagaaaaagtggctattttcctagctcgagtgtaaagccatgccctgtggatggcaggccccctatttctcggcctccctcacgcgagattgattacactgcttacccttggtttgctggcaatatggagcgtcaacagaccgacaacctcctcaaatctcacgcaagcggtacatacttgattcgcgaacgccctgccgaagccgaaagattcgctattagcattaagtttaacgatgaagtcaaacacattaaggtagtggaaaaggacaactggattcatatcacagaagcaaagaagttcgactcacttctagagcttgtcgaatactatcagtgtcattccctcaaggagagtttcaagcagcttgacaccacactgaagtatccctataagtcccgagaacgctctgccagtagggcttcttccaggagccctgcgagttgtgccagttataacttctcctttctaagtccgcagggactgtcctttgctagtcagggcccatctgcgcctttctggagcgtgtttacccctcgagtcatcgggaccgcagtcgctcgctataacttcgcagctcgggacatgagagaattgagtttgagggagggtgatgtcgtcagaatttacagcagaataggaggggatcaagggtggtggaaaggggagacgaatgggaggattggctggttccctagtacctatgtggaagaagaagggattcagtag

SEQ ID NO: 246595 - DNA, 2637 bp, Artificial Sequence
  Description of Artificial Sequence: Synthetic coding sequence
atggaacaatggcgccaatgtgggagatggctaattgactgtaaggtgcttcccccaaaccatcgagtggtgtggccatctgccgtggtgttcgaccttgctcaggcgctgagagacggagttctcctttgtcagctcttacataacctctcacctggctccatagatctcaaagatatcaactttcgtcctcagatgtctcagtttctgtgcttgaaaaatatcagaaccttcctgaaggtgtgccatgacaagttcggcctcagaaacagcgagctattcgatcctttcgatcttttcgatgttcgagacttcgggaaagtgataagcgctgtaagtcgactgagtctgcattctatcgcacaaaacaaaggtattaggccttttccatcagaggagacaacagagaatgacgatgacgtatatagatccttggaggagctggcagatgagcacgatctaggggaggacatttacgattgtgtaccttgtgaagatgggggagacgatatctatgaagacattataaaggtcgaggttcagcagccaatgataagatatatgcaaaagatgggaatgacagaggacgacaagaggaattgctgtctgctggaaatacaggaaactgaggcaaagtactatcggacactagaggatattgaaaaaaattacatgtcccccctacggctagtgttaagcccggctgacatggcagcagtattcatcaacctagaggacttgattaaagtgcaccactcattcttgagagctatcgatgtaagtgtaatggtagggggatcaaccctggccaaggtgttcctcgacttcaaagagcgtctgctgatctacggcgaatattgttctcatatggagcacgcccagaacaccctgaatcagctcctcgctagccgggaggatttccggcagaaggtcgaggaatgtacactgaaggtgcaggatggcaaattcaagctgcaagacttactggttgtccctatgcagcgcgtgctcaagtatcacctgctgttgaaggaacttctgtcacactcggcagagcgccctgaaaggcaacagctgaaggaggctctggaggccatgcaggatctggccatgtacataaacgaggttaagagagataaggagacgttgcgcaagatcagcgaatttcagtcaagtatcgaaaatttacaggtgaagcttgaggaatttgggcgaccgaagatcgacggcgagctgaaggtcaggagtatcgttaatcatactaagcaggaccgctatctgtttctgttcgacaaagtggtgatcgtctgcaaacgcaaggggtactcctacgagttaaaggagatcatcgagctattgttccataagatgacggacgatcccatgaataacaaggacgttaagaagagtcatgggaaaatgtggtcttacggcttttatctgatccaccttcaaggaaagcaggggtttcaatttttctgtaaaacagaggatatgaaacggaaatggatggaacagttcgagatggcgatgagcaacatcaagcctgataaagctaatgctaaccaccattctttccaaatgtatacatttgataagacaaccaactgcaaagcctgcaaaatgttcctaaggggcactttttatcagggatacatgtgcacaaaatgcggggttggggctcacaaggagtgtctggaggtgatccctccgtgcaagttcacatctcctgccgatctcgacgcttctggcgcaggtccagggcctaagatggtggccatgcagaactatcacgggaacccagcccctcctgggaagcccgtcctcacttttcagaccggcgatgtactcgagctgttgaggggggatccagagtccccctggtgggagggcagattggtccaaacgcgtaagtcagggtacttcccctcaagctctgtaaagccttgccctgtggacggacgaccaccaatttctcgacccccttcccgggaaatcgattacacggcatatccttggtttgctggtaacatggaacgccagcagactgataaccttcttaagtcacatgcatcaggtacatatctgatcagggaaagacccgctgaggccgagagatttgccatttccattaagtttaacgatgaggtgaagcatataaaagttgtggaaaaagataactggatccacattacggaggcaaaaaaattcgatagtctgcttgaactggtggagtattaccagtgccactcgttgaaagaatcattcaaacagctcgacactacactgaaatacccgtacaagtctcgtgagcgctctgcctcccgggcttcctctcggtccccagccagttgtgcctcctacaacttttcatttctgtcacctcaggggctctcatttgcttcacaaggcccatccgcccctttctggagtgtctttactcctcgtgtcatagggaccgcagtcgctcggtataacttcgcagccagagacatgcgggaactgagcttaagagagggcgatgttgtgcgtatctacagcaggattggaggcgatcagggatggtggaaaggtgagacaaacgggaggattggctggtttccctcaacatatgtggaagaagagggcatccaatag

SEQ ID NO: 246596 - DNA, 2607 bp, Artificial Sequence
  Description of Artificial Sequence: Synthetic coding sequence
atggagcaatggaggcaatgtgggcgatggctgattgactgcaaggtgctccccccaaaccatcgggttgtatggccaagcgcggtggttttcgatctggcccaggcccttcgagatggcgtgcttctttgccaactccttcataatctctccccgggtagcatcgaccttaaagacattaatttcaggcctcagatgtctcagtttctgtgtctgaagaacatcaggaccttcctgaaggtgtgccatgacaaatttggactgagaaactccgaactgttcgacccatttgatctgttcgatgttcgtgacttcgggaaggtcatcagtgctgtgagtaggctcagtctgcactctatcgcacagaacaaagggatccgaccctttccgagtgaagaaaccactgagaacgatgatgacgtgtaccgtagtctcgaagaattggctgatgaacacgacttaggggaagacatttacgactgcgttccctgtgaagacggcggtgatgatatttacgaagacattatcaaagtcgaagtgcagcagccgatgaagatggggatgaccgaagacgacaagcggaactgctgcctgttggagatccaagagaccgaagccaaatattatcgcaccctggaggatatcgagaagaattatatgtctcctcttcggttggtcctctcaccggcagatatggctgccgtatttattaatctggaggacctgattaaggtgcaccactcctttctgcgagcaatcgatgtgtccgtgatggtcgggggttctacgctcgccaaagtttttctggattttaaagaaaggcttcttatttatggtgaatactgtagccacatggagcatgcccaaaacacccttaatcagctgctcgcaagccgggaggatttcaggcaaaaagtggaagagtgcaccctgaaggtacaggacgggaagtttaaactgcaggatctgcttgtggtccctatgcaacgggtactgaagtaccacctcctgctgaaagagttactgagtcacagcgccgagaggcccgaacggcagcagctgaaggaggcccttgaggcgatgcaagacctagccatgtatattaatgaggtgaagagagataaggaaacgctgaggaaaatttctgagtttcagtctagcatcgaaaatttgcaggttaagctggaagaattcggaaggcccaagatcgatggggagttgaaggtacgttcaatagttaatcacacaaagcaagacagatacctgtttctattcgataaggtggttatcgtttgtaagagaaaaggatatagctacgaactcaaagagatcatcgaactcctgttccacaaaatgacagacgatccaatgaacaacaaggacgtgaagaagtggagttatgggttttacctcatccaccttcaaggcaagcagggattccagttcttctgcaagaccgaagatatgaagcggaagtggatggagcagtttgagatggccatgagtaacataaagcccgacaaggctaacgctaatcatcattctttccagatgtatacatttgataaaactacgaactgtaaggcttgcaaaatgttcttgcgcggtacgttctatcaggggtacatgtgtacaaagtgcggtgtgggcgctcataaggagtgcttggaggtcattcctccttgtaaattcactagccctgcagatctggacgcttcgggtgcaggaccaggccctaagatggtcgccatgcagaactaccatggaaatcctgcgccaccagggaaacccgtactaactttccagaccggagacgtgctggagctccttaggggcgatcctgagtccccatggtgggagggaaggctggttcagacccgcaaaagcggctactttccgagctctagcgtgaagccctgtccagtcgacggacggccacccataagccggccacccagccgtgagattgactatacggcgtacccatggttcgccggtaatatggaaagacagcaaaccgacaacctcctgaaaagtcacgccagcggcacctatttaatcagagagcggccagctgaggccgagcgcttcgcaatttctatcaagtttaacgatgaagtaaaacacattaaagttgtggaaaaagataattggatccacatcacagaagccaaaaaattcgactctctactggaactggtcgagtactaccagtgtcacagcctaaaggaaagcttcaaacagctggacaccaccttgaaatacccttataagagcagggaaagaagtgcaagcagggcgagttcccgttctcccgcaagttgcgctagttataacttttcctttttgtctcctcaaggcctcagcttcgcctctcaaggccctagcgcccctttttggagtgtctttacaccacgagtaatcggcaccgctgtggcccgttataactttgcggctagagacatgagggagctttccttgcgagaaggcgacgtggtgcgcatctattccaggatcggcggagaccagggctggtggaaaggtgagactaacggcaggataggttggttcccctctacgtacgtggaggaggagggtattcagtag

SEQ ID NO: 246597 - DNA, 2520 bp, Artificial Sequence
  Description of Artificial Sequence: Synthetic coding sequence
atggaacagtggcgacaatgtgggaggtggctgatcgactgtaaagtgctcccacctaatcatagagttgtgtggccttccgctgtagtgttcgacttagctcaggccctacgggacggcgtgttactatgccaactcctgcacaacctctcccctggttccatagacctgaaagacattaacttcagacctcagatgtctcaattcctgtgcttgaaaaacatccgaacttttctgaaggtgtgccatgataaatttggattgcggaacagcgagctgtttgatccgttcgacctctttgatgtcagggactttgggaaagtgatatcagcggtgagtcggctgtcactccatagtatcgcacaaaacaaaggaatccggccatttccttctgaagagacgacagaaaatgacgacgatgtatatagatctcttgaggagctggccgacgagcacgatctaggagaagatatctacgactgtgtcccctgtgaagacggcggtgacgacatctacgaggatattattaaggtcgaagttcagcaacccatgaaaatgggcatgaccgaggacgataagaggaattgttgtctcctggagattcaggagaccgaggccaaatattatcgcaccctggaggacatcgagaagaactatatgtcccccctaaggctggtactgtcccctgccgacatggcagccgtattcattaatttggaggacctgattaaggtccatcactccttcctgagagctattgacgtttctgtcatggtgggaggcagcacgttggcgaaggtgtttttggactttaaagaacgcctgctcatctacggagagtattgttctcatatggagcatgcccagaatactctgaatcagctcttggcgtcccgagaggactttcgccagaaggtggaggaatgcaccctgaaagtccaagacggaaagttcaaactgcaagacctcctcgttgtgccaatgcagcgcgtgctgaagtaccacctcctgctaaaggaacttctctcgcatagcgcagaacgccctgaacgtcagcaactgaaagaggctttggaagcgatgcaggaccttgctatgtatattaacgaagtcaaaagagataaagagaccctgaggaaaatcagcgaatttcagtcttcaatcgagaatcttcaagtcaagcttgaggagtttggcaggcctaagattgacggcgaattgaaggtgcgtagcatcgtgaaccataccaagcaggatagatatctgtttctattcgacaaagtggtgattgtgtgcaaaaggaaaggatactcctacgagctgaaagagatcatagagctccttttccataaaatgacggacgatccaatgaataataaagacgttaagaagtggtcatacggcttctaccttatccatctccagggcaaacagggttttcagtttttttgcaaaacagaagatatgaagcgaaaatggatggaacaattcgagatggcgatgagcaacatcaaacccgacaaggcgaacgctaaccatcactcttttcagatgtatacctttgataaaacaacaaattgcaaggcctgtaaaatgtttctcagaggtaccttttatcagggctacatgtgcaccaagtgcggagtgggagcccataaggaatgccttgaggtcattcccccatgtaagttcacatcccccgctgatctggatgcatcgggggctggccctggtccaaagatggtcgcaatgcagaattaccacggtaaccctgcaccgcctggaaagccggttctgaccttccagaccggcgatgtgctggagttgcttcggggagatccagagagtccttggtgggaggggcgactggttcagacacggaaaagcggctactttccctccagctcagtcaaaccttgcccagtcgatggacgcccacctatttctcgtcctccttctcgcgagattgattatacagcatatccctggttcgcgggtaatatggagaggcagcagaccgataatctgctgaagtcacatgccagcgggacctatttgatccgagagcgtcctgctgaagccgagcgttttgccatctccatcaagtttaacgacgaggtcaagcatattaaagtagtagaaaaagacaactggattcacattacagaagccaaaaagttcgacagcttgctcgagctggtggaatactatcagtgtcatagcttgaaagagagtttcaaacagttagacaccaccctcaagtacccttataaatccagggagaggagcgcgtctcgggcatcaagcaggtcaccggtgttcacaccccgtgtaatcggcaccgctgtcgccagatataatttcgcggcacgggacatgagggagctgagtcttagggaaggagacgtcgtgaggatctactcacggatcgggggagatcagggctggtggaaaggcgaaacaaatggacgcatcgggtggtttccgagtacatacgtggaggaagaagggattcagtag

SEQ ID NO: 246598 - DNA, 2544 bp, Artificial Sequence
  Description of Artificial Sequence: Synthetic coding sequence
atggaaccttggaagcagtgcgcccagtggctcatccattgtaaagttctcccaaccaatcacagagttacatgggactccgcccaagtcttcgatctagcacagacattgagagacggggtgctcctgtgccagctgctgaacaatctgagagcacattctatcaacctgaaagaaattaacctgcgccctcaaatgagccagtttctttgtctcaaaaatattaggacttttctgaccgcctgctgtgagaccttcggaatgcgtaaaagcgaactgtttgaagcgttcgatctgtttgacgtgcgcgactttggcaaagtgattgagaccctgtcccgacttagtcggacgcccattgcacttgctacgggaatccggccattcccaacagaagagtctattaacgatgaggacatctacaagggactgcccgacctcattgatgagacgctggtagaagatgaggaagacctgtacgactgcgtctatggcgaagacgagggtggtgaggtctatgaagatctaatgaaggctgaggaagctcatcaaccaaagtgccctgagaacgatatccggagttgttgtctggcagaaatcaagcagacagaggagaagtataccgagacactggagtccatcgagaaatacttcatggccccacttaagcggttcctcacagcagctgagttcgacagcgtctttatcaacatccctgagctggtcaaattgcatcggaacctgatgcaggagattcatgatagcatcgtgaacaagaatgaccaaaacctctatcaggtttttattaactataaagaacgcttggtgatctacggccagtattgttctggagtcgagtctgccatatcctcactggattatatctccaaaactaaggaagacgtcaaacttaaactggaagaatgttcaaagagagctaacaatgggaagttcacgctccgagatctcctagtagtcccaatgcagagggtgctgaagtaccatctcctgctacaggaattggtcaaacacactactgaccccaccgagaaagcaaaccttaagctggccctcgatgccatgaaagatctagctcagtatgtcaatgaagtgaagagggacaatgagacactcagagagattaaacagttccagctgtcaatcgagaacctgaaccagcccgtgttgctttttggtaggcctcagggggatggagagatccggatcactactctggataaacataccaagcaagaacggcacatcttcctatttgacctagctgtcattgtgtgtaaacggaaaggcgacaattatgagatgaaggaaattatcgatttgcaacagtataaaattgccaataaccccacaacagacaaagagaataaaaaatggtcctacgggttttacctgatccatacgcaggggcagaacggccttgagttctactgcaaaactaaagatttgaaaaaaaagtggctggagcagttcgaaatggccctcagcaacatacggcctgactacgctgacagcaattttcacgattttaagatgcacacctttacccgggtaacgtcttgtaaggtgtgccagatgctccttaggggcactttctatcagggctacttgtgttttaaatgtggcgctagggcccataaggagtgcctggggagggtggacaattgcggcagggttaactctggtgagcaggggactctaaaattgcctgagaagagaaccaatggattaaggaggaccccaaagcaggtcgacccaggactaccgaagatgcaggtgatccgaaactacagcggaacaccacctcccgcactgcacgagggaccaccgctccagctgcaggcgggtgacacggttgaactgctcaagggcgacgctcatagcctcttttggcaggggcgtaatctcgcctctggtgaggtaggattctttccttccgatgctgtgaaaccttgcccatgtgtcccaaagccagtagactactcgtgtcagccctggtacgccggtgctatggagcgactccaggcagagaccgagctgataaacagagtgaattctacttatttggtgcgccatcgaactaaagagtccggtgagtatgccatttccatcaagtataataacgaagctaagcatatcaagatcctcacccgagatggcttctttcatattgccgaaaacagaaaatttaagtcactgatggagttagttgaatattacaagcaccatagtctgaaagagggctttagaaccttggacacaaccctacagttcccttacaaagagcccgagcacagtgcaggccagcgcggaaatagggccggaaactccttgctctcccctaaggtcctgggcattgcaattgccagatacgacttctgcgccagggatatgagagagctcagcctactaaaaggagatgttgtcaagatttacacaaaaatgagcgcgaacgggtggtggagaggggaggttaacggcagggtggggtggttcccctctacctatgtggaggaggacgagtag

SEQ ID NO: 246599 - DNA, 1671 bp, Artificial Sequence
  Description of Artificial Sequence: Synthetic coding sequence
atgagtcagttcttatgcctgaaaaacataagaacattcctcacggcatgttgtgaaacttttggcatgagaaagtcagaactctttgaggcctttgatctatttgatgtccgggattttggaaaagtgatcgaaacgctcagtcggttgtcaagaacccccattgccctagccactggcatccgccctttccccactgaagaatcaatcaatgacgaagatatttataagggtctgcctgatcttatagatgagacacttgtagaagacgaggaggatctatatgattgtgtgtatggtgaggatgagggaggcgaggtctatgaggatctgatgaaagcggaagaagctcaccagcctaagtgcccggaaaacgatatcaggtcctgttgtttggctgagataaaacagacggaggaaaagtacacagagacactggagagcatagagaagtacttcatggcacccctaaaaagattcctcactgctgccgagtttgactctgtgtttatcaacatccctgagttggtgaagcttcatcggaacttaatgcaggagatacacgactcaattgttaataaaaacgaccagaacctgtaccaggttttcatcaactacaaagaacgccttgtgatctatggccagtactgctccggcgtagagtcagcaatcagtagtctagactacattagtaagaccaaagaggatgtgaaactgaagcttgaagaatgttccaagagggctaacaacggcaagtttaccctgagagatctgctagtagtcccaatgcagcgggttctcaagtaccacttacttctgcaagagctcgtaaagcacactacagaccccaccgaaaaggccaatctaaagttagctttggatgccatgaaggatcttgcccagtacgtcaatgaagtgaagcgggacaacgagactctcagggaaatcaaacagttccaactaagcattgaaaatctgaatcagcccgtgcttctcttcgggagacctcagggagatggcgaaattagaatcaccactctcgacaagcatactaaacaggagcgccatatatttctcttcgacctggccgttattgtgtgtaaacggaaaggagacaattatgagatgaaggagatcatcgacttgcagcagtacaagatcgctaataacccgactaccgacaaagaaaacaagaaatggagctacggtttctacctgattcatacccaaggtcagaatgggcttgagttttactgcaagacaaaggatttaaagaaaaaatggctcgagcagttcgagatggccctctctaacatcaggccagactatgcagacagcaatttccatgatttcaaaatgcatacatttacccgagtaacctcttgcaaagtatgccaaatgctgctgcgcggaacattctatcaggggtacctgtgttttaagtgtggcgctcgcgctcacaaggagtgccttggtcgggtcgacaattgtggccgagtgaactccggtgaacagggaaccttgaaactccctgaaaagaggaccaacggcctacgacgcacgcctaaacaagtggaccctgacgtcccctgcctgcttcacttcttcattagcatggcccctgccacaagatccatcgttaagtcccaaaagaagaataaaaagttttag

SEQ ID NO: 246600 - DNA, 864 bp, Artificial Sequence
  Description of Artificial Sequence: Synthetic coding sequence
atgcccattttcacattccttagcgagcagggcacattgaagctccctgagaagcgaactaatggcctgcgcaggactcccaaacaggtggaccccggactgcccaaaatgcaggtcatccgcaactattcgggaacaccccctccagccctacatgaaggtcccccattacagttacaggctggagacactgtcgagctccttaaaggcgatgcacattccctgttttggcagggaaggaatttagctagcggcgaggtgggcttctttccgtctgatgctgtcaagccatgtccatgcgtccccaagccagtagattattcctgccagccctggtacgcaggcgcaatggaaaggttgcaggctgagaccgagttaattaatcgagtcaattccacctatctggtgaggcaccggaccaaagaaagcggagaatacgccatcagcattaaatacaacaatgaagctaagcacatcaagatccttacacgagatggtttctttcatattgccgagaataggaaatttaagagccttatggagctggtcgagtactataagcaccatagcctgaaggagggattcaggactctcgataccacactccagtttccctacaaggaacccgagcacagtgccggtcagcgcggaaatcgtgcaggaaacagccttctgtccccgaaggtgttgggcatcgcgatagccagatatgacttctgtgccagggatatgcgtgagctaagcttgctcaaaggcgacgtcgtgaagatttatactaagatgagtgcaaatggatggtggagaggagaggtcaacggccgagtgggctggtttccctccacttatgtagaggaggatgaatag

SEQ ID NO: 246601 - DNA, 2628 bp, Artificial Sequence
  Description of Artificial Sequence: Synthetic coding sequence
atggagccctggaagcagtgtgctcagtggctgatccactgtaaggttctgccaacaaatcaccgcgtcacttgggattcagcccaggtatttgaccttgcccaaacattgagagatggggtccttctgtgccagctgcttaacaacctacgcgcacattccattaatctgaaagagatcaatttaaggccgcagatgagccaatttctgtgtttaaagaatataaggacttttttgacagcctgttgcgaaaccttcggcatgcggaagagcgagttgtttgaggcatttgacctgtttgacgtgcgcgactttggcaaagttatcgaaactttgtcgagactgagccgtaccccaattgccctcgctacagggatccgaccttttcctaccgaagaaagtatcaacgacgaagacatctataagggcttacccgacctgattgatgagactttggtcgaggatgaggaagatctgtatgactgcgtatacggtgaagatgaggggggtgaagtgtacgaggacctcatgaaggccgaagaggctcatcagcctaagtgccctgaaaacgacattcggtcttgctgcctcgccgagatcaagcagaccgaggaaaagtatactgaaacgctcgaaagcattgaaaaatacttcatggccccacttaagcgctttctgactgccgcagagttcgattccgtgtttatcaatattccggaactcgtgaagctgcaccggaacttgatgcaagaaatccacgactctatcgtcaacaaaaacgaccagaacctttaccaggtgtttatcaactacaaggaaagactggtgatctacgggcagtattgctcgggagtggaatctgctatctctagcttggattatatctcaaaaaccaaggaggatgtcaaattgaagctggaggagtgttctaagagagcaaacaacgggaagttcactcttagagacctgctggtggtccctatgcagcgcgtgctgaaataccacctgctgctacaggaattggttaaacataccaccgatccaacagagaaagctaacctcaagctcgcactggacgccatgaaagatctggctcaatatgtcaatgaagtgaaacgagacaacgaaactctacgcgagatcaaacagtttcaactgtcaattgagaatttaaaccagcctgtgctgctatttggacggccacagggcgatggggaaatcagaatcaccacacttgataaacacactaagcaggaacgccacatcttcctgtttgatctggctgtgatagtttgtaaacgcaagggggacaattacgaaatgaaagagatcattgatctccaacagtataaaatagctaataacccaaccaccgataaggagaataagaagtggtcatatggcttctacctgatccacacgcagggtcagaatgggctggagttctattgcaagactaaggaccttaagaagaaatggctggagcagttcgaaatggccctgagtaatattcggcctgactatgctgattcaaacttccatgacttcaagatgcatacgttcaccagagtgacgtcatgtaaggtgtgtcaaatgttactgcggggaaccttttaccagggctacctgtgttttaaatgtggggcaagagctcataaggaatgcctggggagggtggataattgtggacgagttaattcaggggagcaaggcacgctgaagctgcctgaaaaaaggacaaacggactccggagaactcccaagcaggtcgatccgggactgcccaagatgcaggtcattcgaaattattccgggacgcctcctcccgcactacatgagggaccccctctccagctgcaggctggggacacagttgagttactgaagggggatgcacactcccttttttggcagggcaggaaccttgcttcaggcgaagtcggattcttcccaagcgatgccgtaaaaccctgtccttgtgtaccgaaacccgtagactattcttgtcagccatggtacgcaggggcaatggagaggctacaggctgagactgagctgatcaatcgggtgaattccacctacctagtccggcaccgcacgaaagaatcaggtgagtatgcaatttcaataaagtataacaacgaggcgaagcacatcaagatcctaactcgtgatggtttctttcacatcgcagagaatcggaagttcaagtccctaatggagctggttgagtactataaacaccatagtctgaaggaggggtttagaaccctggacacaacactgcagtttccatacaaggagcccgagcacagtgcaggacaacgcggaaaccgggcaggcaactcaagcccgtccctcttctgtggtttctccttcgtaacacctccagactactcttttgtcccacctagcagcactcccttttggtccgtgttgtctcccaaagtcctgggcatcgccattgccagatatgatttctgcgcccgagacatgagagagctaagcctcttgaaaggagacgttgttaagatctacactaaaatgagtgccaatggttggtggcgcggtgaagtgaatggcagagttggctggttccccagtacttacgtggaagaggatgaatag

SEQ ID NO: 246602 - DNA, 756 bp, Artificial Sequence
  Description of Artificial Sequence: Synthetic coding sequence
atgcaggtgatccgaaactacagcgggacccctcccccagccctgcacgaaggacctccactccagcttcaagccggagataccgtcgaactgctaaaaggagatgctcactcacttttttggcaaggtcgcaatctggcaagcggtgaggtaggctttttccctagcgatgccgttaagccctgtccttgtgtgcctaagccggtagactattcctgccaaccctggtatgcgggagccatggagaggctacaggcagaaactgagcttatcaacagggtgaactctacatatcttgtgagacacaggaccaaagaatccggcgagtatgctatctctattaagtacaacaatgaggctaagcatattaagatcctgacaagagacggattttttcacattgctgaaaaccggaagttcaaaagtctgatggagttggtcgagtactacaagcaccattccttaaaggagggttttcgaactcttgatacaaccctgcagttcccctataaagagccagagcactctgcaggacagaggggcaaccgcgctggcaatagcctattgtcccccaaggtgcttggtatagctattgccaggtacgatttttgtgccagagacatgcgggagctgtcccttctgaaaggcgacgtggtgaagatttacaccaagatgtcagcgaacggctggtggcgtggggaggtcaacggcagggtgggctggtttccgagtacttacgtcgaagaagacgaatag

SEQ ID NO: 246603 - DNA, 912 bp, Artificial Sequence
  Description of Artificial Sequence: Synthetic coding sequence
atgtcttcagctcggtttgattcaagcgacaggagcgcctggtacatggggccagtgtctcgccaggaggcccagacacggttacaaggacaacgccacggcatgtttctggtgcgtgactcctcaacatgccccggtgattatgtgttgtctgtgtctgagaatagccgcgttagtcactacatcattaactccctaccgaaccgtaggttcaagatcggggatcaggaattcgaccacctgcccgctctgttagaattttataagattcattacctggatacaactaccctcattgagcctgcacctaggtacccaagccctcccatgggctcagtcagcgccccaaatctgccgacggctgaagataacctggaatacgttaggaccttatatgattttcccggaaatgatgctgaggatctgcccttcaaaaagggggaaatcttggtcatcatcgagaaaccagaggagcagtggtggtctgccagaaacaaggatggaagggtgggtatgatacctgtgccttatgttgaaaagctggtgaggagctccccgcatggcaagcacggaaacaggaactcgaactcttacggcattccagagccggcacatgcatacgcccagccgcagaccacaacaccgttgcctgctgtgtcaggctcccccggtgcggctataactcctctgccttcaactcagaacggaccagtgttcgcaaaggccattcaaaagagggtcccatgcgcgtatgataaaactgcattagctcttgaagtgggcgacatcgtcaaagtgacgcgaatgaacatcaacgggcaatgggagggggaagtcaatgggaggaagggactgtttcccttcacacacgtaaagatcttcgacccacaaaaccccgatgagaatgaatag

SEQ ID NO: 246604 - DNA, 912 bp, Artificial Sequence
  Description of Artificial Sequence: Synthetic coding sequence
atgagctctgcaaggtttgactctagcgatagaagtgcctggtatatgggaccggtgtcgcgtcaggaggctcagactcggctccagggccagcgtcatggtatgtttctcgtccgggattctagcacttgcccaggagactacgtgctctccgtcagtgagaactcacgcgtgtcccactatattatcaactccctaccaaatcggagattcaaaattggagaccaggagtttgatcatctccctgcactgctcgaattctacaaaatccactacctggacaccaccaccctgatcgagcccgctccacggtatccgagcccacctatgggatccgtatccgcaccaaatcttcctaccgcggaggacaacctagagtatgtacggactttgtacgacttccccggaaacgacgctgaggatttgcccttcaagaaaggtgaaattctagttataattgaaaaacctgaggagcagtggtggtcagcccgaaacaaagacggccgagttgggatgattcctgtgccttatgtcgagaaattggtgaggagttcaccccacggcaagcacgggaaccggaactcaaatagttatggtatcccggagccagcccacgcttatgctcagcctcaaaccacaactcccctgccagcagtgtcaggaagccccggagctgctatcacccctctacccagcacccaaaacgggcctgtgttcgcgaaggcgattcagaagcgagtcccctgcgcttacgacaagaccgccctcgcactcgaggtgggcgacatcgttaaagtgacacggatgaacataaatggccagtgggagggcgaggtgaacgggagaaaggggttgtttccattcacgcatgttaagatctttgatccccagaatccagatgagaatgaatag

SEQ ID NO: 246605 - DNA, 3132 bp, Artificial Sequence
  Description of Artificial Sequence: Synthetic coding sequence
atggagtttgtgagggcgctgtggttgggccttgcactggctctggggcctggctcagccggtggccacccacaaccctgcggcgtcctggcaagactggggggatctgttaggctcggcgctttgcttccgcgagcgccactcgctagggcacgcgcacgcgcagcactcgcccgagcagctcttgccccaagacttccgcacaatctaagcctcgagcttgtggtggccgcaccaccagcccgagatcctgcctccttgacacgagggctgtgccaggctctggtaccccctggtgtcgctgcccttttggcatttccagaggctagacctgagctgctgcagttacacttcctcgcagccgcaacagagacacctgtgctgtctttactgcgaagggaagcccgtgcgccattaggagctccaaatccgtttcacctccaactgcactgggcttcgcctctcgagaccctgctggacgtactcgttgccgtccttcaggcccacgcctgggaggatgtgggcctggctctgtgtagaacacaggatcccggaggcctggtcgcactctggacttcgcgggcaggtaggcctccccagctcgtgctcgatctctctagaagagacacaggggatgcgggattgcgggctcggctggctcccatggccgctccagtgggaggcgaagctcccgtccctgccgcagtgctgctgggatgcgatattgcaagagctaggcgcgttctggaggcagtgccgccaggacctcactggctcctggggaccccattaccacccaaagctctgccaaccgcaggcctccctcccggattgctggcacttggcgaagtggctaggcccccactcgaagccgctatacatgatattgtgcagttggtcgctcgagcccttggcagcgctgcacaggtccagccaaaaagggccctgctgccagcacccgtcaactgcggtgaccttcaacccgctgggccagagagcccagggaggttcttggccagattcctggcgaatacttcctttcagggccgaacggggccagtgtgggtgaccggctcttcacaggtccatatgagccgccattttaaggtgtggagcctacgaagagaccccaggggcgcaccggcttgggccaccgttggcagctggagagacggacaattagacctggaaccaggaggtgcgtcagctaggcctccacctcctcagggcgcacaggtttggcccaaactgcgggtagtgacactcctagaacacccattcgtttttgcccgagatcccgatgaggatgggcaatgccctgcaggtcaactctgtctggatcccggaacgaacgactcagctaccctggacgccctgtttgcggctctggccaacggtagcgcacctagggccctccgcaaatgttgttatggctattgcattgatctgctggagcgcttagccgaggatacgccttttgattttgaactctatctggtcggcgatggcaaatacggagccctccgcgatggcagatggactggcctggtgggggacctcttggctgggagagcacacatggccgtgacctcgttttctatcaactctgcacggtcccaggttgtagatttcacatctccgttcttttccacatcattgggaatcatggtgagggcacgggacaccgcaagtcctatcggtgcattcatgtggcccctgcattggtcaacttggctcggagtcttcgccgctctgcacctgactgccctgtttttaacggtgtatgaatggcgaagcccctatggcctgactcctcgcggtcggaacagatccactgttttctcttacagcagtgccttgaatctgtgctacgcaattcttttcagacgaactgtgtcttctaaaacaccgaagtgtccgaccgggcgacttctgatgaacttatgggcaattttctgcctcctggtcctctcttcttataccgccaatctggcagccgtgatggtgggcgacaaaacctttgaagaactctccggcatccatgatccaaagctccatcaccctgcgcaaggatttcggtttggcaccgtctgggagagctccgccgaagcatacatcaagaagtcattccccgatatgcacgctcacatgcggaggcactccgcccctaccacgcctagaggtgttgccatgctgaccagcgaccctccaaagctcaatgccttcattatggataagtcgctgttggactatgaggtgtcaatcgatgccgattgtaaactcctgacagttgggaagccgttcgccatagagggctatggcattggactcccccagaatagtcccttgaccagcaatttgagcgaattcatctcccgatataagagctccggctttatcgacctgcttcatgacaaatggtacaagatggtaccctgcggaaaacgggtatttgccgtgaccgaaactctgcagatgtcaatataccattttgctggcctgtttgtgttgctttgcctgggattaggttcagcattacttagcagtctgggtgagcacgcgttcttccgtcttgccctgccgcgtatccgcaagggcagcagactgcagtactggctgcatacttcacagaagattcatcgggcattgaatactgaaccaccagaagggagcaaagaggagacagcggaagcggagcctagcggtcctgaggttgagcaacagcagcagcagcaagaccagcccacagctccagaaggatggaagagggcaagaagagctgtcgacaaggagcgacgcgtgcgctttttgctcgaacccgcagtggtagtggcacctgaagccgacgccgaagccgaggcagcaccgagggagggaccagtttggctgtgttcgtacggccgacctccagctgctcgccctactggagctccccagcccggtgagctccaggaacttgagagacgtattgaggtggctcgtgaacgtctgcgacaggcactggttcgcagggggcagcttttggcacagcttggggactccgcaaggcatcggccaaggcgactgctgcaggccagagcggcacccgctgaggcgcctccacactctggcaggcctggatcccaggaatag

SEQ ID NO: 246606 - DNA, 2502 bp, Artificial Sequence
  Description of Artificial Sequence: Synthetic coding sequence
atgcatcagctgtttaggctcgttctgggccagaaggatcttagtagagcaggcgaccttttttctctggacgactcggaaattgaggattctctgaccgaagcgttggagcaaattaaaataatcagcagttcttcagattaccagacaaataacaatgaccaggccgtggtcgagatatgtatcaccagaataacaacagctatcagggagaccgagtcaatcgagaaacacgccaaagcccttgtcggactttgggatagctgcctggaacacaacctgaggccctttggaaaagacgaggacacaccacacgccaagattgccagcgacattatgtcctgtatcctgcagaactacaatcggcctccggtcatggccctcgccattcctattgctgttaagttcttgcataggggtaataaagagctgtgtcgaaatatgtcaaactatctttctcttgccgctatcaccaaggccgacctccttgcagaccacactgaagtgatcgtgaagagtatcctgcagggaaatacaatgctcctgcgcgtgctccctgccgtttacgagaagcagccacaacctatcaacagacaccttacagagctgctggcactaatgagccagttggaacagccggagcagtatcatcttctgaggctgttacacgtcgcagctaaaaaaaaacaactcgaagttgtgcagaagtgcattccttttcttataggccacctaaaggatagcacacataatgatattattctgaacatcctcatcgaaatcgccgtgtatgagcccgttgccctgaatagcttcctgcctatgcttaaagagatcggcgagagattcccatatctcacaggacagatggccaggatctacggcgcagtggggcacgtcgatgaggagcgcgcaaggtcatgtctgacttatctagtgagccaactggccaatatggagcactcattccatcacattctgctgctagaaatcaagagcatcacagatacattcagttccattctggggccacagagcagggacatcttccgaatgagtaattcctttaccgcgatcgccaaattgttgaccagacaactcgaaaataccaaggctgggtcaggcagacggaaaatcagcactgaaattgagttccctgagaagctggaagaaaccaaactgatagtcaccgagaacgaggaccacgaaaaactccaagttaagatccaggccttcgaggacaaaatcaacgcaggcagcaatactccaggctctatccggcgatactccctcgggcaggtgtcaaaagaagagagaaagaacattaggtttaacaggagcaaatctttggcatttcacaccatgttaacaaagggcgtcggttccgatgatggagaggatgagaaccgcggagatatcccggcttcgataagcttgtccgaaattgacccattaggacaggggaatgacaagctgcctttcaagactgacacagaacggagccaactgggcgaaagttcggtttcctaccccaacatcatccatatcgactccgaaaatttgagcgaaacagttaaggagaattcacaagaggagactcccgagaccactgccagcccaatcgagtaccaagacaagttgtatcttcacctcaagaagaacttatcgaaagtgaaagcatacgcgatggagattggcaagaaaatacccgtgcccgatcagtgcacaatcgaagacactgttcgtagctgtgtagcaaagctgttcttcacgtgctccctgaagggacactattgtctctactctaagtctagcttcatcttaataagccaagagccccagccgtggatacagattatgtttctcttccaacagtctttatttcccgaacccctgtccatccagtcccattccgtccaattcctgcgggctctatgggagaagacacaggccggaggggctcacagctttgagactgcaatgatggagtcaacattccctcaacaaaaagatctcgatcaagtccagttgcacctggaggaggtgcgtttcttcgatgtcttcgggttctctgagaccgccggagcctggcagtgctttatgtgcaacaatcccgaaaaggccaccgtcgtgaatcaggatggccagccgcttatcgaagggaagttgaaagagaagcaggtgcgatggaaatttatcaaacggtggaaaacgcgttacttcaccctggctggtaaccagctgctttttcagaagggaaagtccaaggatgaccccgacgactgccccatagagctgtccaaagttcagtccgtgaaggctgtggcgaagaagcggagagacaggtctctcccacgggcttttgagatctttactgacaacaaaacatacgtgttcaaggcgaaagatgagaaaaatgcggaggaatggctgcagtgcatcaacgtggcagtggcacaggcaaaggagagggagtccagggaggtaaccacatacttgtag

SEQ ID NO: 246607 - DNA, 2502 bp, Artificial Sequence
  Description of Artificial Sequence: Synthetic coding sequence
atgcatcaactttttcggctggtgctaggacagaaagacttatcccgcgctggcgacctgttcagtctagacgactcggagattgaggattcgctgaccgaggcgctcgaacaaataaagataatttcgagctcatccgactaccagacaaacaataatgatcaggctgttgtggaaatctgcatcactcgaatcacaactgccatcagggagacggagagcattgaaaaacatgccaaagcgctcgtcggcctatgggacagttgtcttgagcacaacttgcgtccattcggcaaggacgaagatactcctcatgccaaaattgcgagtgatatcatgtcgtgcattttgcaaaactacaaccgacctcctgtcatggccttagcaatccccattgcggtaaaattcttacacagaggaaacaaggagctgtgtcgcaatatgtctaactacctcagccttgctgctattactaaggctgatctattggcggaccatacagaagttatcgtgaaatccatcctccaggggaacacaatgctcttacgtgtgttgcctgctgtctacgaaaaacagcctcagccgattaaccggcacctgacggaactgttggccctgatgagccaactggagcagccggaacagtatcatctactaaggctgctccatgtcgctgcaaagaagaaacagttggaagtggtccagaaatgcatacccttcctgatcgggcacctgaaggattctacccataatgacatcatcctcaatatcctgatcgaaatcgctgtctatgagcccgtcgcccttaacagctttttaccgatgctgaaagaaatcggagagaggttcccctatctgaccggccagatggccaggatctacggggcagtgggccacgtagacgaggagcgggctcgtagctgtctgacgtacttggtcagccagctcgctaacatggagcatagcttccaccatattctgctgcttgaaataaaaagcattacagacactttctcctccatcttgggcccacagagcagggatatattcagaatgtcgaactcattcacagccattgccaaactactgacccgccagttggaaaacaccaaggcagggagtggacggaggaaaatctccaccgagattgaattcccggaaaagttagaagagaccaagctgatcgtgaccgaaaatgaggatcacgagaaactgcaggtgaaaattcaggcttttgaggataagattaatgccggttccaatacaccaggtagtattaggagatatagcctcgggcaagtgagcaaagaggagaggaaaaatattagattcaaccggtcaaaatctctggcatttcacaccatgctgaccaaaggggttggctccgacgatggcgaggatgagaaccggggagacattccagccagcatctccctgagcgagattgaccctctgggccaggggaacgataagctccccttcaaaacggataccgagaggtctcagctcggcgaaagctccgtgtcctaccctaatatcatccacattgactcagagaacctatccgaaaccgtcaaagaaaattcacaggaagaaactcctgagacgactgcatcaccgattgaatatcaggacaaattatatctacacttgaagaagaacttgtctaaagtcaaggcatacgctatggaaattggcaaaaaaattccagttcctgatcagtgtacaattgaggatacggtgaggagctgtgttgccaagctcttctttacctgcagtctgaaaggacactattgcctgtattctaaaagcagctttatcctcatctctcaggaacctcaaccatggatacagattatgtttcttttccagcagtccctgtttcctgaaccactcagcatacagtctcacagcgtacaattcctacgggctctgtgggagaaaacacaagcgggtggcgcacactccttcgaaaccgctatgatggaatctactttcccacagcagaaagatctggatcaggtgcaattacatctggaggaggtgaggttctttgatgttttcggttttagcgaaacagcaggcgcttggcagtgttttatgtgcaacaacccagaaaaagctaccgtggttaatcaagatggtcagcccttgattgagggcaagctcaaggagaaacaggttcgctggaaattcatcaagaggtggaagactagatatttcacactggccggaaaccagttgctgttccagaaaggcaaaagtaaggatgatcccgacgattgccctattgagctgtcgaaagtgcagagcgttaaagcagtggctaagaaacggagggataggtcccttcccagggcttttgaaatcttcactgacaataagacctatgtctttaaagctaaagacgagaagaacgcggaagagtggctgcagtgtatcaatgtggctgttgcccaagctaaggagcgcgagtcaagggaagttaccacgtacctgtag

SEQ ID NO: 246608 - DNA, 2367 bp, Artificial Sequence
  Description of Artificial Sequence: Synthetic coding sequence
atgcaccaactcttccgcctggtgctgggccagaaggatctgtcacgggcaggagacctctttagtctcgacgattctgagattgaagattctctgactgaagcactcgagcagataaagatcatcagttcctcctcagattaccagaccaacaataacgaccaggccgtcgtggagatctgcatcacccggattaccacagctatcagggaaacagagtcaatcgagaagcacgctaaagccttggttggcctgtgggacagttgcctggaacacaacctgaggccgtttggtaaggacgaggatacacctcacgctaagattgcaagcgacatcatgtcttgtattctgcagaactataaccgaccgccagtcatggcattggccattccaatcgcagtcaagttcttgcatagaggcaacaaagaactgtgcaggaacatgagtaactatctgtcactcgccgcaatcactaaggccgacctgctcgcagatcacacggaagtcatagtgaaaagcatccttcagggaaatacgatgctactccgggtgctgcccgctgtctatgagaagcagccacaacccatcaacagacaccttaccgaactcttagccttaatgtcccagctggagcagccagaacaataccacttgcttcgcctgcttcacgttgccgctaaaaaaaagcaactggaagttgtccagaaatgtattccatttttgatcggacacctaaaggacagcactcacaacgacattatcttgaatatcctgatagaaattgcggtatacgagcccgtggccctcaattccttcttgccaatgctgaaagaaataggcgagcggttcccatatctgacaggtcaaatggccaggatttacggcgcagtaggtcacgttgacgaggagcgagccaggtcatgcttgacttacctggtcagccagttggctaatatggagcattcctttcatcacatcctgcttctagaaattaaatccatcacagataccttctcttccattctagggcctcagtccagggacatttttagaatgtctaattcgtttaccgctattgctaagctcctgaccagacagctggagaatacgaaggctggcagcggccgtcgcaaaatcagcacggagatcgagttccccgaaaagctggaggaaaccaagctcatagtgactgagaacgaagatcatgagaaattgcaggtcaaaatacaggcattcgaagacaaaataaatgcaggatccaatacgcctggatctattcgccgatatagtctcggccaggtcagcaaagaggagcggaaaaacataaggtttaaccgcagcaagtctctagcttttcatacaatgttaaccaaaggggtggggagcgacgatggagaagatgagaacagaggggatatccccgctagtatcagcctgtccgagattgaccctctcgggcaggggaacgataaactcccctttaaaactgataccgagcggtcacagttgggcgagtccagtgtgtcatatcccaacatcattcatattgactccgaaaacctgtcagaaaccgtgaaggagaatagccaggaggagacaccagaaacgacggcatcccctatcgaataccaagacaaactgtacttacacttgaagaagaacctgtccaaagtaaaggcctacgccatggagattgggaaaaaaattcccgttccagaccaatgtacaatcgaagacactgtgcgcagttgcgttgcaaagctcttcttcacttgcagtctgaagggtcattactgtttgtatagcaagtcttccttcatcctgatctctcaggagcctcaaccatggatccagattatgtttctttttcagcaagacttagatcaggtacagctgcacctggaggaggtgcgtttctttgatgtatttggttttagtgaaaccgcaggcgcatggcagtgtttcatgtgcaacaatcccgaaaaggcaacagtggtcaaccaggacggccagccactcattgagggaaagctgaaagaaaagcaggtccggtggaagtttattaagcgctggaaaactagatactttactctggctgggaaccaactgctgtttcagaagggaaaaagcaaggatgacccagacgactgtcccattgagctaagcaaggtgcaatctgtaaaggccgttgcaaaaaaacggagggatagatcactgcccagggccttcgagatcttcactgataacaagacatacgtgtttaaggcaaaggacgagaagaacgcagaagaatggttgcagtgcattaatgtggcggtggctcaggctaaagagagggagagtagagaggtcactacctacctctag

SEQ ID NO: 246609 - DNA, 192 bp, Artificial Sequence
  Description of Artificial Sequence: Synthetic coding sequence
atgcatcaactattccgcctggtactagggcagaaagatctgtctcgcgcaggcgacctctttagccttgatgactctgaaatcgaggactccctgacagaggcattagaacagatcaagattatcagtagctcatctgactatcagaccaataacaacgatcaggccgttgtagaaatctgtatcacatag

SEQ ID NO: 246610 - DNA, 642 bp, Artificial Sequence
  Description of Artificial Sequence: Synthetic coding sequence
atgcatcaactttttcggttggtccttggccagaaggacctcagtcgggctggcgatctcttttcgctggacgatagcgagatcgaagactctttgactgaagccctagaacagattaaaataatttctagcagcagcgactatcagaccaataacaatgatcaggccgtagtagaaatctgcatcacacgcatcacaaccgcgatccgagagactgagtccattgagaaacacgcaaaggccctggttgggctctgggacagttgccttgaacataacctgcgcccatttggaaaagatgaagatacccctcatgccaaaattgcatcagatatcatgtcttgcatactacagaactacaacagacctcccgtgatggcactggcaatcccgatcgctgtgaaattcctgcatagagggaataaggagttgtgtcgcaacatgtccaattatttgtccctggctgcaattactaaggctgatttattagcggatcacaccgaggtcattgtgaagagcattctgcaaggtatggtgcggaagctaagtcttggaacctgttttggccgatatctcaaggtcttctcaagttctatttacggcctgtgggaagccaggcccagggtgctggaagctaactag

SEQ ID NO: 246611 - DNA, 498 bp, Artificial Sequence
  Description of Artificial Sequence: Synthetic coding sequence
atgcatcagctgttcaggctggttctcggccagaaagatctgtccagggccggagacctgttctccctggatgactccgagattgaagactcacttactgaggccctcgaacagatcaaaatcatttccagtagcagcgactatcagaccaacaacaacgatcaagctgttgtggaaatttgtattactcgcattactactgcaatacgtgaaactgaaagtatcgagaagcacgcgaaggctctggttggcctgtgggatagctgtctggagcacaacttgcggcctttcggcaaggatgaggatacaccacatgcgaagatagccagcgacatcatgagttgcatcctacaaaactataacaggccgcctgtaatggctcttgctatcccaatcgcagtgaagtttcttcaccgcggtaacaaggaactctgcagaaacatgagcaattatctctctctggccgcaattacaaaagctgacctgcttgccgactag

SEQ ID NO: 246612 - DNA, 168 bp, Artificial Sequence
  Description of Artificial Sequence: Synthetic coding sequence
atgcaccaactgtttagacttgttttggggcaaaaagacctctcccgcgctggcgacttgttttctctggacgacagcgaaattgaggattcgttgaccgaagcgctggagcagatcaaaatcatttcctcaagttccgactaccagactaacaacaatgatcagtag

SEQ ID NO: 246613 - DNA, 642 bp, Artificial Sequence
  Description of Artificial Sequence: Synthetic coding sequence
atgcaccaattattcagactcgttctaggacagaaggacctgagcagagcaggggacctcttcagtcttgatgacagtgaaattgaagacagcctgacagaggccctggagcaaatcaagattatcagtagctcttctgactaccagacaaataacaacgaccaggctgtcgttgaaatctgcatcacccgcattacaacagccataagggagacggagagtatcgagaagcatgctaaggccctggttggactctgggactcatgccttgagcataacctacgaccgtttggcaaggatgaggacacgccacatgctaagatcgccagcgatatcatgtcatgcatcttgcaaaattataataggccccctgtgatggctctcgcaattccaattgctgttaagtttcttcatcgaggtaacaaagagctttgtcgtaatatgtctaattacttgtccttagcagcgataacaaaagctgatctgttggcggaccatacagaggtaatcgtcaagagtatcctgcagggaatggtcaggaaactctccttaggtacatgttttggacggtacctgaaagtgttctccagctccatttacggtttatgggaggcaagaccccgagtgctcgaggccaattag

SEQ ID NO: 246614 - DNA, 534 bp, Artificial Sequence
  Description of Artificial Sequence: Synthetic coding sequence
atgcatcagctgttccgtttggttctgggtcagaaggatctttctagggcgggagacttgttttctctagacgattccgagattgaggactcgctcacggaagccctggaacaaatcaaaattatcagttcatcatcggattaccagacaaataataacgatcaggccgtggtggaaatctgtattacgcgcataacaactgcaattcgtgagacggagagcattgagaagcatgccaaggcacttgttggcctttgggacagctgtcttgagcacaatctgcggccatttggcaaggacgaagatacacctcacgcaaagatcgcgtccgacatcatgtcctgtatacttcaaaattacaaccggccaccagtcatggcattagccattccgatcgcagtcaaatttctgcatcgtggcaataaagaactttgccgaaacatgtctaattacctctctctggcggcaataacaaaggcagatctcctcgctgatcacactgaggtgatcgtaaagagcatactccaagtgtag

SEQ ID NO: 246615 - DNA, 2367 bp, Artificial Sequence
  Description of Artificial Sequence: Synthetic coding sequence
atgcaccagctgtttcgtctggtcctcgggcagaaggatctcagtcgagctggcgatctcttctcgttggacgactccgagatagaggactctttgacggaggcgttagagcaaataaaaattatctcatcatcgagcgattatcagactaacaataacgatcaggctgtagtggagatttgtatcacccggatcacaacagccatcagggaaacagaaagtattgagaagcacgccaaggccctagtcggtctttgggacagttgtctggaacacaacctacggccattcgggaaggacgaggacacacctcatgccaaaatcgcatctgacatcatgtcatgtatcctacaaaactataatcgacctccagtgatggcacttgcaatcccgatcgcagtgaaattcttgcaccgcggaaataaggagctttgccggaatatgagcaactacctatctttagccgctattaccaaagctgatttactggcagaccacacggaggtgatagtcaaatccattttgcagggaaacacaatgcttctcagagttttaccagccgtatatgagaagcagcctcagcccatcaatcggcacctaaccgagctcctggccttgatgtcccagttggagcagccagagcagtaccatctcctgcggcttttgcatgttgcagccaagaagaagcaactggaagtggttcagaaatgcatcccattcctcattggacaccttaaggactctacccataacgatatcattctgaacattctgatcgagatagccgtgtacgagccagtggcgcttaattcattcttaccaatgttgaaagagattggagaacgtttcccctacttaacaggccagatggcccgaatctacggggcagtgggccatgtggacgaggagagagccaggtcctgcctgacttacctggtgtcacagctagctaacatggagcacagcttccaccatattctcctcctggagatcaagtccatcacagataccttttcctcaatattgggccctcagagcagggatatctttagaatgtcgaactcctttacagctattgctaagttgctgactcggcaactggagaacactaaggccggaagcgggcgacgcaaaatttctacagaaattgagttccctgagaaattggaggagactaaactcatagtgactgagaatgaagatcacgagaaactgcaggtcaagatccaggccttcgaggataagataaacgcaggatctaacacacccggatctattagacgttactcactagggcaagtgagcaaagaggagagaaaaaatatcagatttaaccgctccaagtcattggcctttcataccatgctgaccaaaggagttggcagcgacgatggagaggacgagaaccgcggtgatatccctgcttccatatctcttagcgaaatcgaccccctgggtcaaggaaacgacaaactccctttcaaaactgatacagagcgatcacagttgggcgagagttcagtatcctacccaaatatcattcacatcgattctgaaaatctaagcgagaccgtgaaggaaaacagccaggaggagacacctgaaaccactgcctccccaattgagtatcaggacaagctgtatctccatctgaaaaaaaatctgagcaaggttaaagcttacgccatggagattggcaaaaagattccagtgccagaccagtgtacaatagaagacaccgtgcgcagttgtgtggcgaaactctttttcacttgttcactgaagggccattactgcttgtattctaaaagtagctttattctgatttcccaggagcctcagccttggatccagattatgttcctgtttcagcaggacctcgaccaggtccagttgcacttggaggaggtgcgattcttcgatgtttttggcttcagtgagacagctggcgcatggcagtgttttatgtgtaataacccggaaaaggccactgttgtgaaccaggacggtcaacccctgatcgagggcaaactgaaagaaaagcaagtccgatggaagtttatcaaacggtggaaaactcgatattttacactggctgggaaccaattacttttccaaaagggaaagtctaaggatgatcccgacgactgccccatcgaattgtcaaaggttcagtcggtcaaagcggtagcaaaaaagagacgggaccgatctctgccacgcgcatttgagatctttacagataacaaaacatacgtttttaaggctaaagatgagaagaacgccgaggaatggctgcagtgtatcaacgtcgccgtggcccaggctaaggagagggagtcacgtgaagttacaacttatctttag

SEQ ID NO: 246616 - DNA, 3768 bp, Artificial Sequence
  Description of Artificial Sequence: Synthetic coding sequence
atggagcttgcggctctgtgcagatggggtctactactggccctgcttcctcctggagccgcaagcacgcaggtgtgcacaggaactgacatgaagcttcgcctgccagcttccccagagacacacctggatatgctccgccatctctaccaaggttgccaggtggtccagggtaatctggagctcacctatcttccaacaaatgcgtccttaagtttcctacaggatatacaggaggtgcagggctacgtgctgattgctcacaatcaggtccgccaggtgcccctccaaaggttgaggatcgtgaggggaacacaacttttcgaagataattacgcgcttgctgtcctggacaatggggaccctctgaataatacgaccccagtaactggagcaagcccaggcggactgcgagaactccagctgcgtagtctcactgaaatcttaaagggaggtgtgctgatacagagaaatccccaactgtgctatcaggatacgatactttggaaggatattttccacaagaacaatcaactcgcgcttacccttatcgatacaaatcgatcgcgcgcttgtcacccctgcagcccgatgtgcaaagggtcacgctgctggggggagtcttcagaggactgccagtccctgacccggacggtctgtgcagggggatgcgcaagatgcaaaggcccactccccacagactgctgccacgaacagtgcgccgcaggctgcacagggccaaaacacagtgattgcctggcctgtctgcactttaatcactccgggatttgtgagctgcactgccccgcactggtgacttataatactgatacattcgagagtatgcccaacccagaggggagatacaccttcggagcttcttgtgtgactgcctgcccttataactacctgtctaccgacgtgggatcctgtaccctagtttgtccgcttcacaaccaagaggtgaccgctgaggacggcacgcagaggtgcgagaagtgtagcaagccctgcgcccgagtgtgctatggactagggatggaacacctgagagaggtccgcgctgtgaccagcgctaatattcaagagtttgcagggtgtaagaaaatcttcgggtcgctcgccttcctgcccgagtcttttgacggagatcccgcttcaaacactgctcccctgcagcccgaacaacttcaggttttcgagactctggaggagattacggggtacttgtacatctccgcctggcccgatagtctgcccgacttgagtgtgtttcaaaatcttcaagtcattcgcggaagaatcctccacaatggagcttatagcctgaccctccaaggcttaggtatcagttggctgggcctgcggtctctccgggagcttggtagtggactagcacttatacaccataacacccacctctgttttgtccacaccgtgccatgggatcaattgtttcggaacccccatcaggcccttctccatacggcaaatagaccagaagacgagtgcgtgggcgagggcctggcatgccaccaactctgcgcaagggggcattgctgggggcctgggcctacccagtgtgtgaattgctcccagttcctcaggggccaggagtgcgtggaagaatgccgcgttctacaaggcctgcccagagagtacgtgaacgcaaggcactgcctgccctgtcatcccgaatgccagcctcaaaatggctcagtgacgtgctttggaccggaggctgaccagtgcgtcgcgtgtgcccattataaagatccgcctttttgtgtcgctcggtgtccttctggagtaaaacccgacctgtcatacatgccaatatggaagttcccggatgaggaaggagcctgccagccatgccccatcaattgcacccactcctgtgtggaccttgacgataagggttgccccgcagaacagcgggctagccccctcaccagcattatttcagccgttgtgggtatactcctggtggtggtgctgggggtggtgttcggtattctgatcaagcgccgtcagcaaaaaattcgcaagtacaccatgcgcaggcttctgcaggagacagagctggtcgagccattaaccccctctggcgctatgccaaaccaagctcagatgagaatcctgaaggagacagagctgcgtaaagtcaaggtgctcggctccggtgcattcggcaccgtttacaagggcatttggatccctgacggagaaaatgtcaaaatccccgtggccattaaagtactgagagagaacactagtcccaaagctaacaaagagatcttggatgaagcctacgtgatggctggcgttggctcaccttatgtgtctaggctgttgggcatctgcttgacctccacggtacaattggtcacccagcttatgccgtatggctgcctgctggaccatgtgagagagaatcggggacgccttggatcacaagacctgctgaattggtgcatgcagattgcgaaaggaatgtcttacctggaggacgttcgattagtccacagagacctggctgctcgcaacgtgttagtcaaaagtccgaatcacgtcaaaatcacagacttcggactcgcccgtctgttagacatagatgaaacggagtatcacgctgatggaggaaaagtccctatcaagtggatggcactcgaatcaatactgagaaggcgattcacacaccagtctgatgtttggtcgtacggagtgaccgtttgggaactcatgacctttggcgctaaaccatacgatggtattcccgcaagggagatacccgacctattagaaaagggagaacgactgcctcagccccctatttgtaccattgatgtatacatgatcatggtcaagtgctggatgattgactctgaatgcagaccccgttttagagagctggtttccgaatttagtagaatggccagggatcctcaacggttcgtagttattcagaacgaagatctgggcccagcgtctccactagactccactttctatcgttctcttctggaagacgacgatatgggtgacctcgtggacgccgaggaatatcttgtccctcagcagggcttcttctgtcctgatccggcacctggagccggagggatggtgcatcaccggcaccgatcatcgtctacgcgcagcggtggaggcgacctgaccttaggcctagagcctagcgaagaggaggcaccaagatcaccacttgctcccagcgagggcgctggctcggacgtcttcgacggagacctgggaatgggcgcagcgaagggcctgcagagcttgcccacacacgatccctcaccattacagcggtattctgaggaccccacagttccgctgcccagcgagacagatggttatgtcgctccactgacatgctcaccccagcccgagtacgttaaccagccagacgtccgcccacagccgccttcgcctcgggagggtcccctccccgcagctagacctgcgggagccaccctggaaaggcctaagacgctgtctccgggtaagaatggagtggtcaaagacgtgtttgcatttgggggtgccgttgagaaccccgaatatttgacgccacaagggggtgccgctccacagccgcacccaccacccgctttttcccctgcttttgataacctttattattgggaccaagatcctcctgagagaggcgctccgccttcaacctttaaagggacacccacagccgaaaacccagaatacctgggactcgacgtgcctgtctag

SEQ ID NO: 246617 - DNA, 3678 bp, Artificial Sequence
  Description of Artificial Sequence: Synthetic coding sequence
atgaaactccgactccccgctagtccagaaacccatcttgatatgctgaggcacctgtatcaggggtgtcaggtcgttcagggaaaccttgagctcacatatctccctacaaacgccagcctgtctttcctgcaggacatccaggaagtgcagggctatgtgttaattgcccacaatcaagtacggcaggttccattacagcggttacggatagtaaggggcacccaactgttcgaagataattacgcactggcagtcctcgacaacggggacccattaaataacaccacacccgtcacaggagcttcgcctggcggactgagggagcttcagctgagatctctgacggagatccttaaaggaggcgtgctaatacagcgcaacccccagctctgttaccaggacacaatcttgtggaaggatatatttcacaagaataatcagctggcgctgacgctgatagatacgaacaggagtagagcttgccatccatgctctcccatgtgcaagggtagcagatgctggggagagagtagcgaagattgtcaatccctgaccaggacggtgtgtgcgggagggtgtgccagatgtaaaggaccattgcctaccgactgctgccatgagcagtgcgcagccggttgtactggtcccaagcacagtgactgtctcgcctgtctgcacttcaaccattccggaatatgcgagttgcactgccccgcactggtgacttataacaccgacacatttgagtcgatgcctaaccccgagggaaggtatacatttggtgcgagctgtgtgacggcctgcccctacaattacctcagtaccgacgtcgggtcctgcactctggtgtgccccctgcacaatcaggaggtaacggcggaggacggtacccagaggtgtgagaaatgctcaaagccttgcgctagagtttgttacggactggggatggaacacctgagggaggtacgcgctgtgacgagtgcaaacatacaggaattcgctggctgtaaaaagatctttggcagcctcgctttcctccccgaatcattcgatggggatcctgcaagcaacaccgcgcctcttcagccagagcagctgcaggtatttgagaccttagaggaaatcaccggctatttatatatatctgcgtggcctgacagcctgccagacctatcagtgttccaaaatcttcaggtcatccggggtcgcatcctacataatggggcttactcactcacccttcagggcctcggaatatcttggcttggcctgaggtccctccgggagctgggtagtggactggcacttattcatcacaacacacatctgtgctttgtgcatacggtaccttgggatcaactcttccggaacccccatcaagctctgctgcatactgccaatagacctgaggatgagtgtgtgggggaaggattggcatgccatcagctatgcgctcgcggtcactgttggggtcctgggcctacccagtgtgtcaactgttctcagtttctccgtggacaggagtgcgtggaagagtgcagggtcttacaggggctcccaagggagtatgtgaacgccaggcattgcttaccctgccatcctgagtgccagccccagaatggctctgtaacctgtttcggccctgaagccgaccagtgcgtggcttgcgcccactacaaggatcctcccttttgcgtggcgcgttgcccttccggagtgaaaccagatttgtcctacatgccgatctggaagttcccagatgaggagggagcctgtcagccctgccctattaattgcacccactcctgtgtggaccttgacgacaaggggtgtcctgccgagcagcgcgcatccccattgacctctatcatctcagctgtcgttggcattctgctagtcgtggtgttaggtgtggtgtttggaattctgattaagcggcgacagcagaaaattcgcaagtatacaatgcgcagactgctgcaggagacagaattagtggagccccttactccgtccggggcaatgcccaatcaggcacagatgcggattctcaaagagaccgaacttaggaaagtcaaagtcttaggctccggcgctttcggcactgtgtacaagggcatatggattcctgacggcgagaatgtgaagattcctgtcgctatcaaagtcctgagagagaacaccagcccaaaagccaacaaagagatcctcgacgaggcttacgtgatggccggagtggggagtccatatgtctcaagacttctaggaatttgcctgaccagcactgtgcagctggtgacacagctcatgccatacggttgcctcctggaccacgtgagagagaaccgaggtagattaggaagccaggatctgctcaactggtgtatgcagatagccaaaggcatgtcttatttggaagatgtgcggctggtccatcgcgaccttgctgccaggaatgtgctggtgaaaagtcccaatcacgtgaagattactgatttcggcctggccagattgctggacattgatgaaaccgagtatcatgctgatggcggaaaggtgcccattaaatggatggcactggagagcattctgcgccgacggttcacccaccagtccgatgtgtggtcttacggggtaactgtgtgggaactcatgacatttggagctaaaccatatgacgggatacctgctcgagagatacccgacttgctagagaaaggagagaggctgccacagccgccaatatgcaccattgatgtctatatgataatggtcaaatgctggatgattgattcagagtgcaggcctaggttccgggaactagtctccgagttttctcgaatggcacgggaccctcaaagattcgttgtgattcagaatgaggatctggggccagcctcccctcttgattccaccttctaccgctcactgttggaagacgacgacatgggtgacctagtcgacgccgaagaatacttggttccccagcaggggttcttctgccctgatcctgcaccaggagccggaggcatggttcatcaccgacaccgttcttcctccactcgcagcggagggggagatctgactctcggcctcgagccttcagaagaagaggcgccaaggagccccttggctcctagcgagggagcaggctcggatgtgtttgacggcgatctgggtatgggggctgcaaagggtctccaaagcctgcccacacacgatccatctcctcttcagagatacagcgaggacccaacggtccctttgccatccgaaaccgacggatacgtcgccccactgacatgcagcccccagcctgagtacgtaaatcagccggatgtccggcctcaaccacctagccccagagagggcccactgcccgctgcccgtcccgcaggggctaccctggagcggccaaagacactttcccccggaaaaaatggagtggtgaaagacgtttttgctttcggtggtgccgtggagaatcctgaatacctgactccacaggggggagctgcccctcagccgcatcccccacccgcattcagtcccgcttttgacaatctctactattgggatcaagatccccctgagcgtggcgctccccctagtacattcaaggggacccctaccgccgaaaatccggagtacctgggactggacgtgccggtctag

SEQ ID NO: 246618 - DNA, 2940 bp, Artificial Sequence
  Description of Artificial Sequence: Synthetic coding sequence
atggagctggctgctctgtgtcgctgggggctgctgctggccctgctcccccctggtgccgcaagtactcaggataactacctttcaacagacgttggctcatgcacactagtatgcccccttcataatcaggaagtgaccgctgaggatgggacccagcgatgtgagaagtgcagtaaaccctgcgctcgtgtgtgctacggcctggggatggagcatttgcgcgaagtaagggcagtgaccagcgcaaatattcaggaatttgcgggatgcaagaaaatcttcggctctctcgcctttctgcctgaatcctttgatggcgaccctgcctctaataccgccccacttcagcccgaacaactccaggtgttcgagactctggaagagataaccggctacctgtatatttctgcttggcccgatagtctgcccgatctgtcagtctttcagaacctacaagttattcgcggacgcattctccacaacggggcttatagcctcaccttacagggcttaggcatcagctggttggggctgcggagtctgcgggaactgggaagtggactggctcttatccaccataacactcacctgtgctttgtgcacaccgtcccatgggaccagcttttcagaaatcctcaccaggcgctgttgcataccgcaaacaggccagaggacgagtgtgtcggtgagggtcttgcttgtcaccagctatgcgcaagaggacactgctgggggccaggcccaactcagtgcgtgaactgctcccaattcctgaggggccaagagtgtgtcgaggagtgccgggtgttacaagggctccctcgggagtacgtgaatgccagacactgtctgccctgtcaccccgaatgtcaaccacaaaacggctctgtgacatgctttggaccagaagccgatcagtgcgtggcatgtgctcactataaggatccccctttctgcgtggcgcgatgcccttcaggggtgaagcctgacctctcctacatgccaatttggaagttccctgatgaagagggcgcttgccaaccttgccccatcaattgtacccacagttgtgtggacctcgacgataagggctgccctgccgaacaacgcgcatctcctctcacctctattatctccgcggtggtggggatcctgcttgtggtcgtgttaggagttgtgttcggcatcctgattaagagacggcagcaaaagataaggaagtataccatgcgccgactgctgcaggaaaccgagcttgtggagccattgacaccgagcggggcaatgccaaaccaggcccagatgaggattctgaaggagactgaactcagaaaggtgaaggttctgggaagcggtgccttcggaaccgtctataaagggatatggattcccgatggagaaaacgtcaagattccggtcgccatcaaagtgctgagggagaatacctctccaaaggccaacaaagaaattcttgacgaagcttacgtgatggccggagtggggtccccatacgtgtcacgcttgctaggcatatgtctcacgagtaccgtacagctcgtgacacaattaatgccatatgggtgtctgctggaccacgtgcgggaaaaccgcggaaggcttggttcccaggatctactgaactggtgtatgcaaattgcaaaaggaatgtcctacctagaggatgttcgacttgtccatagggacctggccgcaagaaatgtcctcgtgaaaagccctaaccatgtgaagatcacagatttcggcctggccagactgcttgatatcgacgagacagagtaccatgcagatggaggaaaagttccaataaagtggatggccctcgaaagtattctccggcgacgcttcacccaccagagtgacgtttggtcgtacggagtgactgtgtgggagttgatgacattcggcgctaagccatatgatggcattccggctagagagatacctgatctgctggagaaaggcgagcgcctaccccagccgccaatatgtacaattgatgtctacatgatcatggtcaagtgttggatgatcgacagcgagtgtcgccctcgatttagggagttggtaagcgagtttagcagaatggccagagacccacagcggttcgtggtgatccagaatgaggatttaggaccagcctcccctctcgactccaccttctatcgctctctcttggaagacgatgacatgggggacctggtcgacgctgaagaatacctggtgccacagcagggatttttctgccccgatccagccccaggggcagggggaatggttcaccaccggcaccgatcttcatcaacaaggtctggcggaggggatctcaccctgggcctggagccctccgaagaagaggcacctagatccccactggctccatccgaaggcgctggtagtgatgtatttgacggcgacctgggcatgggcgcagctaaaggactgcagtccctgcccacgcatgacccatctcccctacagcgctactctgaggatcccaccgttccactgccaagcgaaaccgacgggtacgtggctcctttgacctgctccccacagcccgaatacgtgaaccagcctgacgtccggcctcagcctccgtcccctcgggaaggccctttacctgccgctagaccagccggagcaactcttgagagacccaaaactttgtctcccggtaagaacggagtagttaaggatgtgtttgcctttggtggtgcagtggagaaccccgagtacctgaccccccaggggggtgccgctccgcagccccaccccccacctgccttttcccccgcattcgacaacctctattattgggaccaagatccacccgagcgtggcgcacccccatccaccttcaaggggacgccgactgctgaaaaccctgagtatttagggctcgacgtaccagtctag

SEQ ID NO: 246619 - DNA, 1812 bp, Artificial Sequence
  Description of Artificial Sequence: Synthetic coding sequence
atgaaactgcgcctcccagcctcgccagaaacacatctcgacatgctgcggcacctgtatcagggttgtcaggtggtccagggaaatctcgagctgacctacctccctaccaacgcatccctatcctttctgcaggacattcaggaggtgcaggggtacgtattgatcgctcataatcaggtccgccaggtccccctccagagactccgcatcgtgagagggacacagctgttcgaagacaactacgccctcgccgtcctcgataatggggatcccctgaacaacacaactccagttactggggcatcgccagggggtttaagagagctccaactgagatctctcaccgagattcttaaagggggagtgctgatccaaaggaatccacagctgtgctatcaagatacaattctgtggaaggacatatttcacaaaaataaccagctagcactgaccttaatcgataccaatcgcagtagagcatgtcacccatgcagcccaatgtgtaaaggctctagatgctggggagaaagcagtgaggattgccagtcactcacacggacggtgtgtgcaggcggttgtgctcgttgcaaagggcctctgcccaccgattgttgtcatgaacaatgcgcggctggctgtaccggaccaaagcatagcgattgcctggcctgtttacacttcaatcacagtggcatctgtgagctgcactgcccagcattggtgacttataacactgacacattcgagtctatgccaaaccccgagggtcgttacacttttggagcatcctgtgtcacagcgtgcccttacaactatctgagcacagacgtgggctcctgcacacttgtatgccccttacataaccaggaagtgacagccgaagacgggacacaacgatgcgagaaatgcagtaaaccttgcgccagagtgtgttatggtcttggaatggagcatctgagggaggtgagggccgttacctccgccaatatacaggagtttgctggatgcaaaaagatattcggcagcctggcattcctgcctgaaagttttgacggcgatcccgcttcaaacaccgccccactgcaaccggagcagttgcaagtgttcgagacccttgaggaaatcacaggctacctgtacatctccgcctggcctgacagcctacctgatttgagcgttttccagaatctgcaggtgatacgaggtcggattctgcacaacggtgcttatagccttacactgcagggccttggtatatcttggctgggcctacggtccctgcgcgagcttggctccggccttgctttgattcaccacaacactcacctgtgcttcgtgcatacagtgccctgggaccagctgtttcgcaatccacaccaggccctccttcacacagcaaatcgccctgaggacgaatgcgtgggcgaaggcctcgcttgtcaccagctctgcgccagaggacactgctgggggcctggccctactcagtgcgtaaattgttcccagtttctgcggggtcaggaatgtgtggaagagtgccgggtcctgcaggggttaccccgtgaatatgtcaacgctaggcactgcctcccttgtcatccagagtgtcagcctcaaaacggttccgtcacctgctttgggccagaggccgatcagtgcgtcgcctgtgcccactacaaggacccaccgttctgtgttgccaggtgtcccagcggcgttaagccagaccttagctacatgccaatctggaagttccctgatgaggagggggcatgtcagccttgtccgatcaactgcacccattcatag

SEQ ID NO: 246620 - DNA, 3678 bp, Artificial Sequence
  Description of Artificial Sequence: Synthetic coding sequence
atgaaactcaggctgcccgcttcaccagaaactcacctggacatgctaaggcatctatatcagggatgccaggtggttcaggggaatctggaacttacctacctgccaacaaacgcaagtctgagttttctgcaagatattcaggaagtgcaaggatacgtactgattgcacacaaccaggtcaggcaggttcccctgcaaagactgcgaatagttagggggacccaattgttcgaggacaattacgcgctcgcagtactggacaacggtgacccgctaaacaatacaaccccagtaacaggagccagtcctgggggactgcgagagctgcagttaaggtccctcaccgagatcctaaagggtggcgtgctcatacagcggaacccccagttatgctatcaggacaccatattgtggaaggatatctttcacaagaacaatcagctggcgctcaccctgattgataccaaccgaagcagagcttgccatccctgtagccctatgtgcaaaggtagccgctgctggggtgagtctagcgaggattgtcaatccctgaccaggacggtgtgcgctggagggtgcgctaggtgtaaggggccactaccaaccgactgctgtcatgagcaatgcgccgcaggctgcaccggccctaaacattcagattgcttagcctgtctccacttcaaccactccggtatctgcgagttacactgtccagcattggtgacctacaacaccgacacctttgaatccatgccaaatccagaaggaagatacacctttggggcaagttgtgtgacagcatgtccatacaactacttatctacagacgtggggtcatgcaccctcgtgtgccctctgcacaatcaggaagtcacggctgaagacggcacccaacgctgcgaaaaatgcagtaagccatgtgcccgagtatgctatgggctaggcatggagcacctccgcgaggtacgggcagtaacatctgccaatatccaggaatttgctggctgcaaaaagatattcgggtccttggcattcctcccggaatccttcgacggggaccccgcaagtaatactgctcctcttcagcctgagcaacttcaggtgttcgaaacacttgaggagatcaccggctacctttacatttcagcttggcccgactcattgccagatctgagtgtctttcagaacctgcaggttatccggggtcggatattgcataacggagcatatagtctcactctgcagggcctgggtatctcatggttaggcctgcggagtctgagagagctcggcagcggcctagccctgattcaccacaatacgcatctgtgctttgtccacaccgttccctgggaccagctttttcgcaacccccatcaggctttgctccacaccgctaatcgcccagaggacgaatgcgttggcgaggggctggcgtgtcatcaactgtgtgccagaggccattgttgggggccaggccctacacaatgcgtgaactgcagccagttcctacgcggtcaggaatgtgtggaagagtgtagagtgctccagggtttgcctcgtgaatacgtcaatgcacgacactgtctgccctgtcatccggagtgccaaccccagaacggctccgtgacttgcttcggcccagaggccgaccagtgtgtagcatgcgctcattacaaggatcccccattctgtgtagccagatgccccagtggggtgaaacctgatctgtcctatatgccgatctggaagttcccagatgaggagggcgcttgccagccctgccctatcaattgcacgcattcatgcgttgacttagatgacaaaggatgccccgctgaacagcgggctagccctctgacttccataatcagcgcagtcgtcggcatactgcttgtggtggttttgggagtcgtgttcgggatcctgattaagcgacgccaacaaaaaattcgcaagtacaccatgcggagactcttgcaggaaaccgaactagtcgagccgctcacaccttccggggctatgccaaaccaagcccagatgcggattcttaaggagaccgagctgaggaaagtcaaagtactagggagcggggcatttggtacagtttacaaggggatatggatcccagacggtgagaacgtcaaaatcccagtggctattaaagtgctgcgcgaaaacacctcaccgaaggctaacaaggagatccttgacgaggcttacgtcatggccggtgtgggctctccttacgtgtccaggcttcttggcatctgcttgacatccactgttcagctcgtgacccagctgatgccctacggctgtctgttagatcacgttagagaaaatagggggcgactgggatcccaggatttactgaactggtgtatgcagatcgccaaaggaatgagttacttagaagatgttaggctggtccatagagatctcgccgctaggaacgtattagtgaaaagcccgaatcatgttaaaattaccgactttgggttggcgcgtcttctggacatagacgagactgaatatcatgctgatgggggtaaggtcccaatcaagtggatggctctggaatccattctgcggaggaggtttactcaccagtcagatgtctggtcatacggtgtgacagtgtgggagctgatgacctttggagctaagccgtacgacggcataccagccagagagatcccggatctcttggagaaaggcgaacggctaccccagccgcctatctgtacaatcgacgtctatatgattatggttaagtgctggatgatagactctgaatgccgtcctcggttcagggagttagtcagtgagtttagcagaatggctcgcgatcctcaacggttcgttgtcatccagaacgaggacctgggtccagcttcccctctggattccaccttctacagatcattactggaggatgacgacatgggggatctggtggacgccgaggaatacctcgttccccagcagggcttcttttgtcctgaccccgctcctggcgcaggcggtatggtccaccaccgacatcgcagtagctcgaccaggagcgggggaggcgacctgaccttgggtcttgagccctctgaggaggaagctccacggtccccactggctcctagcgaaggcgcaggtagcgacgtttttgatggagatttgggaatgggtgccgcaaaaggcctacagagtctgcccacccatgacccaagcccccttcagcgatattccgaagacccaactgtcccgctgcccagtgagactgacgggtacgtcgcacccctgacatgcagtccacagcctgagtacgtgaatcagcccgatgtaaggccccagcctccctccccacgggagggacccctgcccgctgcacggccagcgggtgccacacttgaacgtccaaagacactgtcccctggtaaaaacggagtcgttaaagacgtcttcgccttcgggggagctgtggaaaacccagagtatcttaccccacagggaggcgctgcccctcaaccccacccacctcccgcattctctcccgcattcgacaacttatattattgggatcaggatcccccagagaggggcgctcctccaagcacattcaagggtacgcccacggcagagaaccccgagtatcttggacttgatgttcctgtatag

SEQ ID NO: 246621 - DNA, 3723 bp, Artificial Sequence
  Description of Artificial Sequence: Synthetic coding sequence
atgccaagaggtagttggaagccacaagtgtgcaccggcaccgacatgaaactgaggcttccagcctcccccgagacgcatcttgatatgctccgtcatctttaccaggggtgccaggtggtgcaaggaaacctggaactcacttacctgccaaccaatgcatcactgagttttctccaggacatacaggaagtacaggggtatgtgctgattgcacataatcaggtgcgccaggtgcccctccagaggctgaggattgttcgaggaacccaactcttcgaggacaattatgcgctggctgtgctggataacggggatccccttaacaacacaactccagtaacgggtgcatcaccgggagggttgagagagctccagctgcgctcactgacggagatactgaagggcggagtgctgattcagcggaacccgcagttgtgctatcaagacactatcctgtggaaggacatcttccacaaaaataatcagctcgcgcttacactcatagacaccaaccgcagcagggcatgccatccctgctcgcctatgtgcaagggaagccgttgctggggcgagtcctctgaggattgccagtcgctgaccaggacggtgtgcgccggaggatgtgctcggtgcaagggtccccttccgaccgactgttgccacgaacagtgcgccgcaggatgtacaggacccaagcattccgactgcctcgcctgcctgcactttaatcactccggtatttgcgagcttcactgtccagcattagtgacatataacaccgatacttttgagtcaatgccgaatccagaaggtcggtatacgttcggcgcttcttgcgtgactgcctgtccatataattacctatccaccgatgtgggcagttgtacactggtttgtcccctgcacaaccaagaagtgactgccgaggatggcacccagagatgtgaaaagtgttccaaaccttgcgcccgagtgtgctacggtcttgggatggaacacctacgagaggtacgcgcagtgacaagtgcgaatatccaagaattcgccggatgcaaaaagatttttggcagcctagccttcctgcctgagtcttttgatggagaccccgcatccaacactgcccctctgcagccggaacagctgcaggtgttcgaaactctggaggagattactggctacctgtacatcagtgcttggcccgacagtctgccagatctctcagtgtttcagaacctccaggtgatccggggacgcatcctgcataacggagcttattctctaacactccagggattgggcatctcttggctcggcctcaggtctctgcgtgagctgggctccggactggctctgatccaccataacactcacctgtgcttcgtccatacagttccatgggaccagctgttccgtaacccacatcaagctctcctgcacaccgcaaacagacctgaggacgaatgcgtaggagaggggctggcatgccaccagctgtgtgccaggggccactgctggggcccaggtcccacgcagtgcgtgaactgtagccagttcctgcggggacaggagtgcgtggaggaatgcagagttctccagggtttgcccagggagtacgtgaacgcacgccattgtctgccctgtcacccggagtgtcagccacaaaacggatcagtaacgtgtttcggtccagaggctgatcagtgcgtggcctgtgctcactataaagaccccccattttgtgtggcaaggtgcccatctggcgtgaagcccgatcttagctatatgcccatttggaaatttcctgatgaagagggcgcatgccagccttgtcccataaactgtacacactcttgtgtcgatttggatgacaagggatgccctgccgagcagcgggctagtccactgacctcgatcataagcgctgtagtgggcatcttgctggtcgtggtacttggggtcgtcttcggaatcctgatcaagcggcgacagcaaaaaattagaaaatacacaatgagaaggctgctgcaggaaaccgagctcgtggaaccactaactccgagcggagccatgccgaatcaggcgcaaatgcgcatattgaaggagaccgagctgcggaaagttaaggtcctggggagcggcgctttcggaactgtttacaaaggcatctggatcccagacggcgagaatgtgaaaattcctgttgcaataaaagtcttacgagagaacacatctcctaaagccaataaggagattctcgatgaggcttacgtgatggccggagttggttctccttatgtctctcgtcttctgggaatttgccttaccagtaccgtacaactggtaacacagctcatgccttatggttgcctcctggaccacgtgcgcgagaatcggggtcggctgggctctcaagatcttttgaactggtgcatgcagattgccaagggaatgagctatcttgaagatgtgcggttagtgcatcgagatttggcagcacgcaacgtcctcgtcaagagccctaatcacgtgaagataaccgacttcggtctggcaaggttgctggatatcgacgagacagagtatcacgccgacgggggtaaagtgccaattaaatggatggccttagaatctatcctcagacgcaggttcacccatcaaagcgacgtgtggtcgtatggagtgaccgtgtgggagctaatgacttttggtgcgaagccttacgatggaattccagcacgcgaaatccccgacctgctggaaaagggcgaaaggttacctcagccccctatttgtactatcgatgtgtatatgatcatggttaagtgctggatgatcgactctgagtgtaggcctagattccgagaattggtgagcgaatttagtcggatggccagagatccacagcggtttgtggtcattcaaaacgaggatctggggcctgctagcccactagacagtaccttttataggtctctgctggaagatgacgacatgggagaccttgtggacgcagaggaatatctggtgcctcaacagggattcttctgtcccgacccagcacccggagccggtggtatggttcaccatcgccatcgttctagcagtacaagatccggcggtggagacctcacactggggctcgagcccagcgaagaggaggccccacggtccccattggcaccgagtgaaggagctggcagtgacgtgttcgacggcgatctggggatgggagccgcaaagggtctacaatctttacccactcacgatccttcccctctgcagagatatagcgaggatcctaccgtgccactgccaagcgaaacggatgggtatgtggcaccattgacatgctccccgcagccagagtatgtcaatcaacccgacgtgagaccccagccccctagtccccgagaaggacccctccccgcagctcgacctgctggcgcaaccctagaacgccctaagacactgtcccctgggaagaatggcgtcgtcaaggatgtctttgccttcggcggtgctgtagaaaaccctgaatatcttacgccccaagggggtgctgccccacaaccccaccctcctccggcattttctcctgcattcgataacctctactactgggatcaagatcctcctgagcgcggtgcccctcccagcactttcaaggggacccccaccgccgagaatccagagtaccttggactcgacgtaccagtgtag

SEQ ID NO: 246622 - DNA, 2259 bp, Artificial Sequence
  Description of Artificial Sequence: Synthetic coding sequence
atgggaacgtctgccctttgggccctctggctcctgttggctttatgctgggctcccagggagagcggcgctactggcacagggcgaaaagccaagtgtgaaccatcccagttccagtgcaccaacggtaggtgtatcaccctcctctggaaatgcgacggagacgaagattgcgtggacgggtccgacgagctcgactgtgcaccaccgacctgtggcgcacacgaattccaatgcagtacgtcaagctgtattccaatctcgtgggtatgtgacgatgacgccgactgctccgatcagagtgatgagtcactcgaacagtgcgggcgtcaacccgtgatccacactaaatgtcccgctagtgagattcagtgcggctcaggtgaatgtatccacaaaaagtggcgctgtgacggcgaccctgattgtaaggatggctccgatgaggtcaactgtccttcccggacctgtcggcctgatcagttcgagtgtgaagacgggtcgtgtatccatgggtcccggcaatgcaacgggataagagattgcgtggacgggagcgatgaagtgaattgcaagaacgtaaaccaatgcttgggcccaggaaagttcaaatgtcgctccggagaatgcatcgacatttcaaaagtctgcaaccaggagcaggactgccgggactggtcagacgaacccctgaaggagtgtcacatcaacgagtgccttgtgaataatggtggctgctcccatatttgtaaggatcttgttatcggctacgaatgcgattgcgcagcgggtttcgaactgattgataggaagacctgcggtgacatcgatgaatgtcaaaacccgggtatctgtagccagatctgtatcaatctaaaagggggttataaatgcgagtgctcgaggggataccaaatggacctagccacgggtgtgtgcaaagcggtggggaaggaaccttccctcatcttcactaatagaagggacatccgcaagatcgggcttgagcgaaaggaatacatccagcttgtggaacagctcaggaataccgtcgccctcgacgccgacatcgccgctcaaaagttgttttgggcagacctatcccaaaaagccatcttcagtgcctccatcgatgacaaggtcggcagacatgtgaaaatgatcgataatgtgtacaaccctgccgcaattgcggttgactgggtgtataaaaccatctactggaccgatgccgcatccaagactatttccgtggctaccctcgacgggactaagagaaaatttctgttcaacagtgatttacgggagcccgcttctattgcggtggatccactgagtggctttgtgtattggtctgattggggagaacccgctaagatcgagaaagcgggtatgaacggatttgataggagacccctagtgacagcagacatccagtggcccaatggcatcacgttggatttgataaaatcccgcctgtattggcttgactccaaactacatatgctgtcgtcagtggacctgaacggacaggaccggaggattgttctgaagagccttgaattcttagctcatcccctcgccttaactattttcgaggatcgcgtttattggatcgacggggagaatgaggccgtgtacggggcaaacaaattcacagggtcggaactcgcaacattggttaataatctgaatgacgcacaggacattattgtctaccatgagcttgtccagccctcagggaaaaattggtgtgaggaggacatggaaaacgggggttgcgagtacttgtgtctgcctgcaccccagattaatgatcactcccctaaatacacatgctcatgtcccagcggctataatgtggaggaaaacgggcgagattgccagtcaaccgccaccacagttacatattctgagacgaaagatactaataccactgagatatctgccacatcgggtttggtcccaggagggattaatgtcactactgccgtatctgaagtgagtgtaccgcctaaagggactagcgccgcatgggccattctgcctttgttgctattggttatggccgcagtgggtgggtaccttatgtggcgcaactggcagcacaagaatatgaagagcatgaatttcgataaccccgtgtatttgaaaacaacagaggaagatctgtcaattgatatcggtagacactctgctagtgtaggacacacctacccagcgattagcgtagttagtaccgacgatgacctggcttag

SEQ ID NO: 246623 - DNA, 522 bp, Artificial Sequence
  Description of Artificial Sequence: Synthetic coding sequence
atgggaacttcggcactttgggccctgtggctactgcttgcactgtgttgggctccgcgtgaatctggcgctactggtaccggcaggaaagccaagtgcgagccgtctcagttccagtgcactaatggcaggtgcatcacactgttgtggaagtgtgatggagatgaggactgcgtagatggcagcgacgaaaaaaattgtgtaaagaaaacatgcgcggagtcggattttgtttgtaataacggccaatgcgtcccatctagatggaagtgcgacggggatccagactgtgaggatggatcagatgagtcacccgagcaatgtcggaacatcacctgctccccagatgagttcacttgctcgagtggcaggtgcatctctcggaactttgtgtgtaacggccaggatgactgtagcgacgggtcagacgagcttgactgtgctccacccacttgtggtgctcacgagtttcagtgctcgacgtctagctgcattccaatttcttgggtctgcgacgactag

SEQ ID NO: 246624 - DNA, 2538 bp, Artificial Sequence
  Description of Artificial Sequence: Synthetic coding sequence
atgggcacttcagccctctgggccttgtggctgcttttagccttgtgctgggccccacgtgagagtggcgctactgggactgggagaaaggccaaatgtgagcccagccagttccagtgcacgaacggtaggtgtatcacccttctctggaagtgcgatggcgatgaggattgtgttgacgggtcagatgaaaagaactgtgttaagaaaacctgcgctgagtctgattttgtgtgcaacaatggacaatgcgtgcccagtcgatggaaatgcgacggtgatcccgattgcgaagatggatctgacgagagtcctgagcagtgccacatgcggacctgtcgcattcatgagatttcatgcggggctcacagtactcagtgtattccggtcagttggaggtgtgacggcgagaatgactgtgacagtggggaagatgaggaaaattgcggcaatattacttgcagcccagacgaatttacctgtagctccgggagatgtatcagccgcaatttcgtctgcaacggacaagacgattgctctgatggcagcgacgagctagattgtgcccctcctacttgtggggctcatgagttccaatgcagcacctcctcttgcatacccatctcctgggtgtgcgacgacgacgccgattgctctgatcaaagtgacgaaagcctcgagcagtgcggaaggcagcctgtgattcataccaaatgcccagccagcgaaatccaatgtgggtcgggagaatgcatccacaaaaagtggcggtgtgacggggatcccgactgtaaggatggctccgacgaggtgaattgcccttctcggacttgtagaccagaccagtttgagtgtgaagatgggtcttgtattcatggttcgcggcagtgtaatgggatccgcgattgtgttgacggaagtgacgaagtaaactgtaagaacgtgaatcagtgccttggaccaggaaaattcaaatgtaggagtggagagtgcatagatatatccaaggtctgcaatcaagaacaagactgccgcgactggtccgacgaacctctgaaagagtgccacattaatgagtgcttggtgaacaatggtggctgtagccacatatgtaaggacctggtgatcggctacgagtgcgattgcgcagctggcttcgagctcatcgacaggaagacatgtggagatatcgacgagtgccagaatcctggcatctgcagtcagatttgtataaaccttaaggggggatataaatgcgaatgcagtcgtggctaccagatggacctggccaccggcgtctgtaaggctgtgggcaaggaacctagccttatctttacaaatagaagagacattaggaagatcgggctggagcgaaaggaatatatccagctggtggagcaacttaggaatacagtggctctggacgcggacatagcagcccaaaagcttttctgggcagatttgagccaaaaagcaatatttagcgccagcattgatgataaagttgggaggcacgtaaaaatgattgacaatgtttataatcctgctgccattgcagtggactgggtgtataaaacgatctattggacagacgccgctagtaaaacaatctccgtggctactctggacggcacaaaacgaaaattcctatttaatagcgacctgcgcgaaccagccagcattgccgtggaccctctttccgggtttgtatactggagcgactggggagagcccgctaagatcgagaaggccggtatgaatggtttcgaccggcgacccctcgtgacagctgacatccagtggcccaatggcatcactctggatcttatcaagagtagactgtactggcttgattctaagctccacatgctgtcatccgtcgatctgaacggccaggaccgcaggattgtgcttaagagcctagaatttctagcgcatccactggccctcaccattttcgaggacagggtgtattggattgacggtgagaacgaagctgtgtatggtgccaataagttcactggatccgagctggccaccctagtgaataatctgaacgacgcacaggacatcatagtgtaccacgagctggtgcaacctagcgggaaaaactggtgtgaggaggacatggaaaatggtggatgcgaatatctctgcctgcccgcacctcagatcaatgatcactcgcctaagtatacatgcagctgtccaagtgggtacaacgtggaggagaatggcagggattgtcaaaggatcaacgttaccacggctgtgtcagaagtcagcgttccgcctaagggcacgtctgcagcctgggctatactccccctgctgctgttagtcatggccgcagttggtggctacctgatgtggcgaaactggcagcacaaaaacatgaaatctatgaatttcgataaccccgtctacttgaagaccactgaagaggacctgagcatcgatattggccgacacagcgcctcagtggggcatacatatcccgcaatttctgtagtcagcacagatgatgatctcgcctag

SEQ ID NO: 246625 - DNA, 2622 bp, Artificial Sequence
  Description of Artificial Sequence: Synthetic coding sequence
atgggtacctccgctctatgggccctgtggcttctgctggctctctgctgggcacctagggagagcggggcaacaggaacgggacgtaaagcaaaatgtgaaccaagccaatttcaatgtactaatggacgttgtataactttactgtggaaatgcgatggggacgaggattgtgtcgatggttcggacgaaaaaaattgtgtgaaaaagacttgtgccgaatctgatttcgtctgtaataacggacagtgtgttcccagccggtggaagtgcgatggtgaccctgattgcgaagacggttcagatgaatcgcccgaacagtgccacatgcgtacttgccgaatacacgaaatttcatgtggggcacactctacgcagtgcataccagtcagttggagatgcgacggagaaaacgattgcgactccggagaagatgaggagaattgtggcaatattacatgtagcccagatgaattcacttgctcgagcggcaggtgtatatcccgcaactttgtgtgtaatgggcaggacgactgctctgacggaagcgatgagctggactgtgcccctccgacctgtggtgcacacgagttccaatgcagcacatccagctgcataccaattagttgggtgtgtgatgatgatgcagactgttccgaccagtccgatgagtctctggaacagtgtggccgtcagccagtcattcacaccaagtgtcctgcctctgagatacagtgcggtagcggcgagtgtatccataagaagtggcgatgtgatggcgacccagattgcaaggatggctcggacgaagttaactgcccttcccgcacttgccggccagaccagtttgagtgtgaggatgggtcatgcatccacgggtccagacaatgcaacggcatacgcgattgcgtggacggcagcgatgaggttaattgcaaaaatgtcaaccagtgcttgggccctgggaaatttaagtgcaggtcgggcgagtgcatcgacatatcaaaagtgtgtaatcaggagcaggattgtagagattggtcagacgagccgctcaaagagtgccacatcaacgagtgcctggtgaacaacgggggttgtagccatatttgcaaggacctggtcatcgggtatgagtgtgattgcgcagctggctttgaactcatcgaccggaagacctgtggcgatattgacgagtgccagaatccagggatttgtagccagatttgtatcaatctcaaaggtggctacaagtgtgagtgcagcagaggataccagatggatctcgcgactggcgtgtgcaaggccgtgggaaaggaaccctctctgatcttcaccaacaggcgggacattagaaagatcggccttgaacggaaagagtacatccagttggtcgaacaactgaggaataccgtggctctggatgcagatatcgccgctcaaaaacttttttgggcggacctcagccagaaagcaatttttagcgccagcattgatgataaagtgggcagacatgttaagatgattgataacgtatacaatccagctgccattgcggtcgattgggtttataaaactatttattggaccgacgccgctagcaaaaccataagcgtggccaccctggatgggactaagagaaagtttctattcaatagtgatttgcgtgagcccgcatccatcgccgtggaccctctgagtgggtttgtatattggtctgattggggggagcctgccaaaattgaaaaggcagggatgaatggattcgaccgcagacctttggtgacagcagatatccagtggccgaacggcatcaccctggatctgatcaaatcccggctgtactggctggacagtaagctgcacatgctttcgagcgtcgacctgaatggtcaggatagacgtatcgttttgaaatcactcgaattcctagctcaccctctagccttgacaatcttcgaggatcgagtgtattggattgacggagaaaacgaggccgtgtacggcgcaaataaatttaccgggagtgagcttgcgactctggtcaacaacctaaatgatgcccaggatattatcgtctatcacgagttggtgcagcccagtggaaaaaattggtgtgaggaggatatggagaacggaggctgtgagtacctgtgcctgccagcgcctcaaattaacgaccactctccgaagtatacttgctcttgcccctccgggtacaacgtggaagaaaatggaagggattgccagagtaccgctacaactgtgacttactccgaaaccaaggatacgaataccaccgagatatcagcgaccagcgggctggtccccggtggcatcaacgtgaccaccgcggtcagcgaggtgagtgttcccccaaaggggacatcagctgcctgggctatcttgccactcctgctccttgtcatggcagcagtaggcggttatttgatgtggaggaactggcaacacaagaacatgaagagcatgaatttcgataacccagtatacttaaaaacaacagaggaagacctgagtatcgatattggaaggcactcagcgtcagtggggcacacatacccagcaatcagtgtggtgagtacggatgatgatttggcctag

SEQ ID NO: 246626 - DNA, 729 bp, Artificial Sequence
  Description of Artificial Sequence: Synthetic coding sequence
atgtctgatgagagggaggtggctgaggctgccacaggagaggacgcctctagtcccccacctaaaaccgaggccgcttctgatcctcagcatccagccgctagcgagggcgctgctgctgcagcagccagcccacctcttctgaggtgcctcgtgctgaccgggtttggaggttatgacaaggtaaagctgcaaagtcgtccagccgcacctccagccccagggccaggccaattgacactgagacttagagcatgcggcctaaattttgccgatttaatggctcgccagggcttgtacgatcgtttacctccgctaccggtgacgcccggaatggagggtgcgggagtggtcatagcggtaggcgaaggggtgtccgacagaaaagctggcgaccgcgtgatggtgctcaacagatctggcatgtggcaggaggaggttaccgtgcccagtgtacagaccttcctgatcccggaggcaatgacgttcgaggaagccgcagctttgcttgtgaattacatcacagcttatatggtactattcgatttcggcaatctccagccaggccactccgtcctcgtgcatatggcagctggcggtgtgggaatggctgcagttcaactaccttattccggcgagtgcgattctgtgcgaaacggcttaggtcagcaagctaggggtactgagggcgaatggggacatactagtcatcgcctatctcacgactag

SEQ ID NO: 246627 - DNA, 1182 bp, Artificial Sequence
  Description of Artificial Sequence: Synthetic coding sequence
atgagtgatgaacgggaagtcgcagaagctgcaacaggcgaagatgccagttcgccccctcccaagacagaagccgcatccgaccctcagcaccctgcggcatccgagggggctgctgctgctgccgcatccccgccactgctccgctgcctggtactgacagggtttggcggttacgacaaggtgaagctgcaaagccgacccgcagctccacctgcccctggtccaggacagctgacactgcgcttgcgagcttgcggcttgaacttcgccgacctaatggccaggcagggactctacgaccgcctacctccccttcctgtgacccccggtatggaaggtgctggggtggtaatcgccgtgggcgaaggggtatccgacaggaaggcaggagaccgagtgatggtcctgaaccgaagcggaatgtggcaggaggaggtcactgtccccagcgtgcaaaccttcctgatccctgaggccatgacttttgaagaagccgctgccctgctcgttaactacattacagcttatatggttttatttgatttcggaaatctgcagccgggacactctgtcttagtacacatggcagccggaggcgtcggaatggcagccgtgcagctttgccgaactgtggagaacgtaaccgtctttggtactgcaagcgcctcgaagcacgaagcactcaaagaaaatggagtaacccaccccattgattatcatactacagactacgtagacgagatcaagaaaatctcccccaagggagtagatatagttatggatccattaggtggcagcgatactgctaagggctataacttacttaaaccaatgggtaaggtggttacctatggtatggcgaatcttcttacgggacctaaaagaaatctgatggcactagccagaacttggtggaaccagttcagcgtgaccgcattgcagctcctacaagcgaaccgagctgtgtgtgggttccacttgggctacttagacggcgaagtcgagttggtgtccggggtggtcgctcgcctgttagctctgtacaatcagggccatattaagccgcatattgattccgtatggccattcgagaaggttgctgatgccatgaaacagatgcaggaaaagaagaatgtagggaaagtcctgctggtgccaggcccagaaaaagagaattag

SEQ ID NO: 246628 - DNA, 780 bp, Artificial Sequence
  Description of Artificial Sequence: Synthetic coding sequence
atggtgttaaatagaagcggaatgtggcaggaagaggttactgtcccaagtgtgcagactttcctgatcccagaagcaatgacgttcgaggaagctgcggcacttttggtgaactacattacagcctacatggttctgttcgacttcggtaatctacagccaggccattccgtactggtgcatatggctgccggaggtgtggggatggccgctgtccagctgtgtcgcacagttgaaaatgtgaccgtcttcggtactgcatccgcttcgaaacacgaagctctgaaagaaaatggcgtcacccaccctatcgattatcatactactgattacgtggatgagattaagaagataagtccgaaaggcgtagacatcgtcatggaccccctgggcggttctgatacagccaagggctacaacctgttaaagccaatgggaaaagtagtcacctatggtatggcaaatctgcttacaggccctaaacggaacttaatggctcttgcaagaacatggtggaatcagttcagcgtcaccgcactgcagttattgcaggctaatagggcggtttgtggattccacctgggttatctagatggagaggtggagcttgtctccggagtagtcgctcgactcctggctctctataaccagggacatattaagccgcatatcgacagcgtgtggccctttgagaaagttgcggacgcaatgaaacaaatgcaagagaagaaaaatgtcgggaaggtactcctggttccaggacctgagaaagagaactag

SEQ ID NO: 246629 - DNA, 903 bp, Artificial Sequence
  Description of Artificial Sequence: Synthetic coding sequence
atggctagacaaggactttacgacagactgcctcccctgcctgtgactccaggaatggaaggggcaggcgtggttatagccgtcggggagggtgtgagcgaccggaaagcgggagacagagtgatggtcctgaacaggagcggcatgtggcaggaggaggtcaccgtgccatccgtgcagacttttctgataccagaagcaatgaccttcgaagaggccgcagccctccttgtcaattatatcaccgcctacatggtactcttcgacttcgggaatctccagcctggtcacagcgtcctggtgcatatggcagcaggcggagttggtatggcagccgtccagctgtgcagaacagtggaaaacgtcacagtgtttgggaccgcttccgcatccaagcacgaagccttgaaggagaatggcgttacacacccaatcgattaccacaccaccgactatgtagacgaaattaagaaaatcagtcctaaaggggtggacatcgtcatggatcctctgggcggatccgatacagccaaggggtacaacctattgaaaccgatggggaaggttgtaacatacggcatggccaaccttttaaccggcccaaaacggaaccttatggcattggccaggacctggtggaaccagttttccgtgacggctttacaattgctgcaagccaacagggctgtgtgcgggttccacctcggttacttggacggcgaagtagagttggtgagcggcgtggttgctcgcctcctcgctctctacaatcagggccatattaaacctcatatcgatagcgtctggccctttgagaaggtggcagacgccatgaaacagatgcaggagaaaaagaacgtcggaaaagtgctgctggtcccgggaccggagaaggaaaactag

SEQ ID NO: 246630 - DNA, 654 bp, Artificial Sequence
  Description of Artificial Sequence: Synthetic coding sequence
atgtcaagcgatttcgaaggctatgaacaagatttcgcagtcttgacggccgagataacttctaaaattgcaagagtgcctcgcctgcctcccgacgagaagaagcaaatggtggctaacgtagaaaagcaactggaagaagccaaagagttacttgagcagatggacttagaggtccgcgagataccaccacagagccggggaatgtattctaatcgaatgaggagttataagcaagaaatgggcaaactggaaactgatttcaaacggtcccgaatagcctatagtgacgaagtgaggaatgagctgctgggcgacgatgggaattcctcggagaatcagagggcccatctcctggacaatacagagaggctggagcgatcaagtcggagactggaggcaggttaccagatcgccgtagagactgaacagattggccaagagatgctggagaatctatcccacgatagagagaaaatccaacgcgctcgggaaaggctgagagagactgacgcaaacctcgggaaaagtagccggatcttaacaggcatgctgagaagaatcatccagaaccggattcttctcgttatcctgggcataatcgtggtgattacgattcttatggctataacatttagcgtccgaagacactag

SEQ ID NO: 246631 - DNA, 612 bp, Artificial Sequence
  Description of Artificial Sequence: Synthetic coding sequence
atgagctccgacttcgagggatatgagcaggatttcgcagtcctgaccgccgaaatcacttcgaagattgctcgtgttcctcgcctccccccagacgagaaaaagcagatggtcgccaacgtggagaagcagcttgaggaagcaaaggagctcctcgaacaaatggacctggaggtgcgcgagattcccccacagagcaggggtatgtactcaaatcgcatgcgtagttataaacaggagatgggtaaacttgagactgactttaaaagatcgcgtatagcctattccgacgaggtgcgtaacgaactcctcggcgacgatggaaacagttccgagaatcagcgcgctcacctcttggacaataccgaaagactagagcgatcctccagacgcctggaggctggctatcagattgctgtggagactgaacagatcggtcaggagatgctcgagaacttatcacatgatcgagaaaagatccagcgagccagagagaggttgagggagactgatgctaatctcggcaagagctcccgtatcctcaccggaatgctgaggcggggttgctctgttaagaagcagtgtaaccttagcctggcccctaaggcttag

SEQ ID NO: 246632 - DNA, 432 bp, Artificial Sequence
  Description of Artificial Sequence: Synthetic coding sequence
atgtcagcaccagctcagcctccggctgagggtactgagggcacagcgccaggcggaggccctcctgggcctccccctaacatgacatctaaccgcagactacaacagacccaggctcaggtggaggaggtcgtcgacatcataagagtcaacgtggacaaggtgctggaaagggaccaaaagctttccgagctagacgacagggccgacgcgttgcaggctggagcttcgcagttcgagagcagcgccgctaagctgaagaggaagtactggtggaagaactgcaaaatgatgatcatgctagggcgttggcagctgacccagtactgtctggtcatgtggtccttcccatcgtggacaagaccagaagaagggcctgggggaggtccgaagagtaatctggtcagtgtccagtaccctttcaggaagtag

SEQ ID NO: 246633 - DNA, 354 bp, Artificial Sequence
  Description of Artificial Sequence: Synthetic coding sequence
atgtctgctccggcacaacccccagccgagggtacagaaggaactgcacctggcggtggcccacccggacccccacctaatatgacgagtaataggcgactgcagcaaacccaggcccaggtggaagaagttgtcgatatcatccgggtgaatgtggataaggtactggagagagaccagaagttgagcgagctggatgacagggctgacgccctccaggcgggtgcttcccagtttgaaagcagcgctgcgaagttgaaaagaaagtattggtggaaaaactgtaagatgatgatcatgctcggagcaatttgcgccattatcgtggtagttatagtatctaaatatagatag

SEQ ID NO: 246634 - DNA, 357 bp, Artificial Sequence
  Description of Artificial Sequence: Synthetic coding sequence
atgagtgcacccgctcagccccctgctgagggtacggagggcaccgcccctggcggaggaccaccgggtccccctccaaatatgacaagcaaccgacggttgcaacaaacccaggctcaggtggaggaggtcgttgacataatcagggtgaacgtggacaaggtacttgagagagaccagaagttatcagaattggatgaccgcgcagacgcactccaggcgggtgctagtcaattcgaatccagcgcggctaaactgaagcgcaaatactggtggaagaattgcaagatgatgatcatgcttggagccatatgtgcgattattgtcgtggtgattgttatttatttcttcacttag

SEQ ID NO: 246635 - DNA, 744 bp, Artificial Sequence
  Description of Artificial Sequence: Synthetic coding sequence
atgtccgccccagctcagcctccagcagaaggaaccgagggcacagccccaggagggggtcccccagggccaccgccaaatatgacctccaaccgcagactccaacaaacacaggcgcaggtggaagaggtggttgatattatcagagtcaacgtcgacaaggtgctcgagagggaccagaagctgagcgaactggacgatagggcagacgccctacaggccggtgcctcccagttcgagtccagtgctgccaaactcaagcggaaatattggtggaaaaactgcaaaatgatgattatgctgggcgctatctgcgccattattgttgtcgtaatcgtcatctacttttacctcagaatgtatcatcctttcccagttgtgcattgtcacccccacagctgtcccctgccctccgtctgttctttgaacacattaccccatcccccttccagcatacccgctcaggcatcaccttcacccattcctccattctctctgcgttctttcgcattgtgcccaagtacgctggagatgttgctcgttgcgcagtcaaagagcctgcctgaggaacagcagctagctccaccaccatgcctgctgttcttgtactctcaagtgccccctaagccccaaagggtcggcggacagggcaaaggtcaggggggtgaatggctgaggcggagcacacatgaagctgcccagacctgggaggagaagtccatcggagcacacggggacttttag

SEQ ID NO: 246636 - DNA, 351 bp, Artificial Sequence
  Description of Artificial Sequence: Synthetic coding sequence
atgtcagcccctgctcagcctcctgctgaaggtacggagggcaccgcccctggtggcggaccacctgggccaccccctaatatgacatctaaccgtcggctacagcagacccaggcgcaggtcgaggaagtagtggatatcattcgggtaaatgtggacaaggtcttggagcgtgaccagaagttaagcgaactggatgaccgtgccgatgctctgcaggccggagctagccagttcgagtcgagtgctgcgaaactcaagagaaaatactggtggaaaaattgcaagatgatgattatgcttggagcgatctgtgccattatcgtagtagtgattgttagacgagactag

SEQ ID NO: 246637 - DNA, 351 bp, Artificial Sequence
  Description of Artificial Sequence: Synthetic coding sequence
atgtccgcgacagcagccaccgctcccccagcagcacccgctggtgagggaggtccaccagcccctcctccaaatcttacaagcaaccgccgtttgcagcaaacccaggcgcaggttgacgaggtggttgacattatgcgcgtgaacgttgacaaggttctcgaaagagatcagaagctctctgagctggacgatagagccgacgcgttacaagctggggcttctcagtttgaaacctctgccgcaaagttaaagcgtaaatactggtggaaaaaccttaaaatgatgatcatactcggagtaatctgcgccatcatactgatcatcattatcgtctacttctccacttag

SEQ ID NO: 246638 - DNA, 303 bp, Artificial Sequence
  Description of Artificial Sequence: Synthetic coding sequence
atgtccaccggtcctaccgccgcaacagggtccaacagaagactgcaacagacccagaatcaggttgacgaagtggtggacatcatgagagtaaatgtggataaggtgctcgaaagagatcagaaactgtctgagctcgacgatcgcgctgacgcactgcaggccggagcatcccagttcgagacttccgcggcaaaattgaaaaggaaatactggtggaagaactgcaaaatgtgggcgatcgggatcactgttctggttatattcattataattatcatagtatgggttgtgtcttcctag

SEQ ID NO: 246639 - DNA, 351 bp, Artificial Sequence
  Description of Artificial Sequence: Synthetic coding sequence
atggcgggaatcgaacttgaaaggtgccaacagcaagcgaacgaggtgacagagatcatgagaaataacttcggcaaagtactggagagaggcgtgaaattggcagaactgcagcaaagatcagatcagttgcttgacatgagctctacctttaataaaacaacacagaatctggcccagaagaaatgctgggaaaatatcagataccggatttgtgtggggctcgtcgtcgttggcgtcctgctcatcatactgattgtgttgctggtggtgtttctcccacagtcatctgattcctcctccgctccgagaactcaggatgctggcatcgcttccggcccagggaactag

SEQ ID NO: 246640 - DNA, 783 bp, Artificial Sequence
  Description of Artificial Sequence: Synthetic coding sequence
atggccatcctgtttgccgtcgtggctagaggtactacgattctggcaaagcatgcctggtgcggtggcaatttcttagaagtgacagaacagatcctagccaagattccctccgaaaataataagttaacttatagtcatggaaattacctgtttcattacatctgtcaggataggatcgtgtacctgtgtatcactgacgacgacttcgagagaagcagggcattcaattttttgaacgagatcaaaaagaggtttcagacaacttacggatcccgagcgcagaccgcactgccatatgcaatgaacagtgagttttcctcagtgttagctgcccagctgaagcaccacagtgaaaataaaggactggacaaggtcatggagacccaagcacaggtcgatgagctcaaaggaattatggttcgcaatatagtttgccatctccagaactatcaacaaaagtcctgcagcagtcacgtgtacgaagagccacaggcccactattatcaccaccacagaattaactgcgtgcatctttatcattgctttacctctctctggtggatatacatggcgaaactgtgtgaggagatcggcaagaaaaagctccccctgaccaaggacatgagggagcagggggtaaagtctaacccttgtgattcgtcgctgtctcacacagaccggtggtacttacccgtttcctctaccttgtttagcctgtttaagatactctttcatgccagtaggtttatcttcgtgctgagtacatcactgttcctatag

SEQ ID NO: 246641 - DNA, 663 bp, Artificial Sequence
  Description of Artificial Sequence: Synthetic coding sequence
atggcaatattattcgcggtggtggcacgcggtaccaccattttggctaagcacgcctggtgtgggggaaacttcctcgaagttacagagcagatcctggccaagatcccaagcgagaataataagctaacatactcccacggcaactacctgtttcattatatatgtcaggatcgaattgtgtacctgtgcatcactgatgatgatttcgagcggtccagagccttcaatttccttaatgaaattaaaaaacgctttcagaccacttacgggtcaagagcgcagacggctctaccttacgctatgaacagcgaatttagcagtgtgctcgcggctcagctgaagcaccactcggagaacaaaggattagacaaggtgatggagacacaggcgcaggtcgacgagttaaaaggcatcatggttcggaacatcgacctggtggctcagcgaggagagcggctggagcttctcatcgataaaacagaaaatttggtggacagttctgtgaccttcaagactacgtccagaaacctcgccagagctatgtgtatgaaaaatctcaagttgactatcattatcattattgtaagcatagtgttcatatatatcatcgtctccccactgtgtggcggattcacttggccatcttgcgttaaaaagtag

SEQ ID NO: 246642 - DNA, 540 bp, Artificial Sequence
  Description of Artificial Sequence: Synthetic coding sequence
atggcgatcctcttcgccgtggtggctagaggcactacaatccttgctaaacatgcatggtgtgggggaaactttctggaggactttgaaaggtccagggcatttaacttcttgaatgaaatcaagaagcgtttccagactacgtacggctctcgagcccagaccgctcttccctacgccatgaattctgagttttcctccgtcctcgctgctcagctgaagcatcatagcgaaaacaagggcctcgataaggtgatggagactcaggcacaggtagatgagttgaagggcatcatggtgaggaatatagatctggtagcccagcggggtgagagactcgaacttctcatcgacaagactgaaaacctcgtggattcctctgtcactttcaaaactaccagccggaatctggcacgagccatgtgtatgaagaaccttaagctaaccataatcattataattgtctccatcgtttttatctacattattgtaagcccactttgtggcggtttcacttggccttcttgtgtgaaaaagtag

SEQ ID NO: 246643 - DNA, 303 bp, Artificial Sequence
  Description of Artificial Sequence: Synthetic coding sequence
atggaagaggctagcgaggggggaggaaatgatcgcgtgcgaaatctgcagagtgaagttgaaggagtgaaaaatattatgacacagaacgtggagcgcattttggcgaggggtgagaacctagagcacttacggaacaaaactgaggacctggaggcgacgagtgagcacttcaaaacaacaagccaaaaggtggccaggaagttttggtggaagaacgtgaagatgattgtactcatctgcgtcattgtgttcatcatcatcttgttcatcgttctgttcgccacaggagctttctcatag

SEQ ID NO: 246644 - DNA, 777 bp, Artificial Sequence
  Description of Artificial Sequence: Synthetic coding sequence
atggaagagatgaaaaagacagccattagactgccaaagggtaagcagaagcctattaagacagagtggaactcccgttgcgtgctctttacctactttcagggtgatatttccagcgttgttgacgaacatttctctcgtgcactctcaaatatcaagtccccccaggaacttaccccttcgagccagagcgaaggcgtgatgctgaaaaacgatgactccatgtccccgaaccagtggcggtacagctccccctggacaaaaccccagcctgaggtgcctgtgactaatagagcagctaattgcaacctgcatgtgcctggcccaatggctgttaatcagttctcaccttccttagctaggcgtgcctccgtgcgtcccggagaactctggcatttctcatcccttgcgggaaccagctctctggaacccggttactcacacccattcccagccagacatctggtgccggagccacagcctgatggcaagcgtgagccgttattgagtctcctccaacaagaccgttgcttggcacgccctcaggaatccgcggctcgtgagaacgggaacccaggtcaaatcgccggatccactggactacttttcaatctgccacctggttcagtgcattacaagaagctctacgtgtctagggggtccgcgtcaacctctctgcccaacgagaccctttccgagcttgagacccctggtaaatattccctcaccccacctaatcattgggggcacccccataggtacctgcaacacctgtag

SEQ ID NO: 246645 - DNA, 348 bp, Artificial Sequence
  Description of Artificial Sequence: Synthetic coding sequence
atgaagaaaacggccatccgcctgccgaagggaaagcagaaacctatcaagacagaatggaactctagatgtgttttatttacctacttccagggggatatctcttcagtggtcgacgagcactttagcagagctctttcaaatatcaaatcaccacaggagttgaccccatccagtcaatctgagggagttatgctgaaaaatgacaaaaaactgtacgtgtctcgtggctcggcatccacttcgttgcctaatgaaaccttgtccgagttggagacaccaggcaaatattcgctgacccctcctaatcactggggccacccccaccgttaccttcagcatttgtag

SEQ ID NO: 246646 - DNA, 492 bp, Artificial Sequence
  Description of Artificial Sequence: Synthetic coding sequence
tgaataagctccgtggttgacgaacactttagcagggctctgagcaatattaagtccccccaggagctaacgccatcctcccagagcgagggcgtgatgctgaagaatgatgacagcatgtcaccaaatcagtggcggtatagttccccgtggaccaagccccagccagaggtacctgtgacaaaccgtgccgctaattgcaacctgcacgtccctggacccatggcggtcaatcagtttagtccatccctggcacgccgagcctctgtgaggccaggagaactgtggcacttttcttccctcgctggaacttccagcttagaaccaggctatagtcatccgttccctgcaaggcatctggtgcctgagccacagcctgatggcaaacataagaaactgtacgtcagtcgaggctctgcaagcacatccctacctaacgaaacactgagtgagctcgaaacaccaggtaaatattccctgactcctccgtag

SEQ ID NO: 246647 - DNA, 183 bp, Artificial Sequence
  Description of Artificial Sequence: Synthetic coding sequence
actccctcctcccagtctgagggtgtgatgttgaagaacgataaaaagctttacgtatcacgcggtagcgccagcaccagcctccccaatgaaacactgagtgaattagagacgccagggaaatactcccttactcccccaaatcactggggccacccacataggtatttacagcacctgtag

SEQ ID NO: 246648 - DNA, 954 bp, Artificial Sequence
  Description of Artificial Sequence: Synthetic coding sequence
atgagctgccttgacgttatgtaccaagtctatggacctccgcagccctactttgctgccgcttacaccccttatcaccagaagctggcctattactcaaagatgcaggaggctcaggaatgcaatgccagcccatcaagctctggcagtggatcttcttcattttcatctcagaccccagcatccataaaagaggaggaaggatcccccgagaaagaacgaccccctgaggctgaatacattaacagccgatgcgtgctcttcacatattttcagggggatatcagctccgtcgtggacgaacattttagtcgcgctcttagtcagcctagtagctattccccatcgtgcaccagcagtaaagcgcctaggtcaagcggaccttggcgtgattgcagctttcccatgagccagaggagctttccggcaagtttctggaactctgcataccaagcgcctgtccctccacctcttgggagccccctggcaaccgcccatagtgagctgccttttgccgcagccgacccttatagcccggcagcactgcacgggcacttacatcagggggctactgagccttggcatcacgcccatccccatcacgcccatccgcatcacccctatgcactcgggggagctctcggggctcaggcagccccttatcctcgcccagcggctgtccacgaagtgtacgcccctcatttcgaccccagatatggccctctccttatgcctgctgcctcaggcagacctgctaggctagccaccgcacccgcaccagcaccagggtcgccaccatgcgagctctctggcaaaggagaaccggcaggtgccgcttgggctggtccgggaggacctttcgcatcaccctctggcgatgtcgctcaaggcctgggcttgagcgtggattcagcccgtcgctatagtctgtgtggcgcttccctcctatcgtag

SEQ ID NO: 246649 - DNA, 432 bp, Artificial Sequence
  Description of Artificial Sequence: Synthetic coding sequence
atgtcatgtctcgatgtcatgtatcaggtgtatggaccccctcagccatatttcgccgcagcctacactccctaccaccaaaaactagcttactactctaagatgcaggaggcgcaggagtgtaacgcaagcccctcctctagcgggagcgggtcatcaagcttcagcagccaaactcccgcttctatcaaggaggaggagggctcccccgagaaggagagacccccagaggcagaatacataaattcacgctgcgtgttatttacttattttcagggagacatctcaagcgtcgttgacgagcatttctctagagctctgagccaaccatctagctacagcccctcctgtacatcctctaaagcccctaggtcttcaggtccttggagggcacgccgatatagcttgtgcggtgcttccctgctaagctag

SEQ ID NO: 246650 - DNA, 963 bp, Artificial Sequence
  Description of Artificial Sequence: Synthetic coding sequence
atgtcctgcgccgaggtgatgtatcacccacagccttacggggcaagtcagtacctccctaaccctatggccgcaactacatgccccacagcatactatcaacccgcacctcagcccggacagcagaagaagctggcagtgtttagtaaaatgcaggatagcctggaggtgacccttccaagtaagcaagaggaggaggacgaggaggaggaggaggaagagaaagaccagccagcagaaatggagtacctgaactccagatgcgtgctttttacctactttcagggggatatcggctccgtcgttgatgagcacttttctagagcactaggtcaggcgatcaccctccatccggagagcgcgatttccaagtctaagatgggcctgaccccactgtggagagactcctcggcactttccagccagaggaactcgtttcccacctccttctggacctcgagctaccagccaccgcctgcaccatgtcttggaggggtccatcctgacttccaggttacaggcccaccaggcaccttctcagccgctgatccttccccctggccaggccacaacctgcaccagaccggtcccgcacccccaccagctgtctccgagtcctggccgtatcccctaacaagccaggtttcacctagctattctcatatgcacgatgtctacatgcgccatcaccacccacatgcgcacatgcaccataggcacagacaccaccatcatcatcaccaccccccagctggcagcgccctagacccgtcttacggacctctgctaatgccttccgtccacgctgctcggattccggcaccacaatgtgatatcactaaaaccgagcctaccactgtcacatctgccactagcgcatgggctggggctttccatgggactgtggatatagtcccatccgtgggctttgataccgggtggtcagctatggctcgctcctag

SEQ ID NO: 246651 - DNA, 981 bp, Artificial Sequence
  Description of Artificial Sequence: Synthetic coding sequence
atgtcttgcgcagaggttatgtaccatcctcagccatacggggcaagccagtaccttcccaatcctatggccgctaccacatgtcctacggcctattatcagcccgcacctcagcccggacagcagaagaagcttgccgtcttctccaaaatgcaggacagcctggaagtaacactgcccagtaaacaggaggaagaagatgaggaggaggaggaagaggagaaagatcagcccgctgagatggaatatctgaatagtagatgcgtgctttttacatacttccagggagatattggatcagtggtggacgaacatttctcccgtgccctgggtcaggcaatcactctccaccccgaatctgcgattagcaaaagtaagatgggcctgacgcccttgtggcgcgattcctccgcactgagttcccagagaaacagtttccccaccagcttttggaccagtagttatcagccaccacccgcaccctgtctcggaggggtgcatcctgatttccaggtgactgggcctcccggaactttttcggccgcagacccttctccgtggccgggacataatctgcatcagacaggtccagctccacctcccgctgtttccgagtcttggccttacccacttactagtcaagtcagcccctcttactctcacatgcacgacgtgtatatgagacaccatcatccgcacgctcacatgcatcatcgccaccggcatcatcaccatcatcaccacccaccggcaggcagcgcccttgatccgagctacggcccattgttaatgccctccgtgcacgctgcaaggatccccgcaccccagtgtgacattacgaaaaccgagcccacaaccgttacctcagccacatccgcctgggcgggtgccttccatgggactgttgacatcgtccccagcgtgggcttcgacactggcttgcagcatcaggacaagtccaaggaaagtccctggtattag

SEQ ID NO: 246652 - DNA, 1326 bp, Artificial Sequence
  Description of Artificial Sequence: Synthetic coding sequence
atgaaggccgctgtggatcttaagcctaccttgaccatcattaagaccgagaaggttgacctagagctttttccaagccctgacatggaatgcgctgatgttcctctgttgacgccaagtagcaaagagatgatgtctcaggccctgaaggctaccttcagcggttttaccaaggaacagcagcgactgggcattcccaaagatccaaggcagtggacagaaactcacgtccgggactgggtcatgtgggccgttaacgagttctctcttaagggagtcgacttccagaaattttgtatgaacggggctgccctctgcgctctcgggaaagactgcttcctggagttggctcctgatttcgtgggtgacatcctgtgggagcacttggagattttgcagaaagaagatgtgaaaccctaccaggtgaacggcgtaaaccccgcttaccccgaaagtaggtacaccagcgactactttatttcttacggcattgaacacgcccagtgtgtgcccccaagcgagttcagtgagccatcctttataactgagagttaccagaccttgcatcccatttcctctgaggaattgctgagtctaaaatacgaaaacgactatcccagcgtgatcctgcgcgacccactgcaaacagacactctgcaaaacgactactttgcgatcaaacaggaagttgttactccagacaatatgtgtatgggtcgtacttcaaggggtaaactgggcggacaggattctttcgaatccatcgagtcctatgactcttgtgacagactgacacagagctggtcctcccagagcagttttaattcccttcagcgcgtgcccagttacgattcgtttgattcagaggactatcccgctgccctcccaaaccacaagcccaaggggacgttcaaagattatgttcgggaccgggctgacctcaacaaggacaaaccggtgataccagccgcagcacttgcaggctacactggcagcgggccaattcagctgtggcagttcctgctagaactgttgacggacaaaagctgtcagagctttatcagttggaccggggacgggtgggaattcaagctgagtgaccccgacgaagttgccaggaggtgggggaaacgcaaaaacaaaccaaagatgaactacgagaaattatctcggggacttcgctactactacgataaaaacatcattcataagaccgcgggaaaaaggtatgtgtacaggttcgtgtgtgacctccagagcttacttggctacacccctgaggagttgcatgcaatgttggacgtgaagcccgacgctgacgagtag

SEQ ID NO: 246653 - DNA, 1065 bp, Artificial Sequence
  Description of Artificial Sequence: Synthetic coding sequence
atgaaggccgctgttgacctgaaacctaccttgaccattattaaaactgagaaggttgacctcgagctctttccttctccagacatggagtgtgctgacgtgcccttgctgaccccaagctctaaggagatgatgagccaggctctcaaggctacatttagtggatttaccaaggagcagcaaaggcttggtatcccaaaggacccgaggcagtggactgaaacacatgtgagagattgggtgatgtgggccgtgaatgaattcagtctgaagggagtggattttcagaaattctgcatgaacggagctgctctgtgcgctttggggaaagattgttttctcgagctggcaccggacttcgtcggcgacatcctctgggaacatttggagatcctgcagaaggaggatgtgaaaccttaccaagttaacggggtgaaccccgcatacccagagtcacgctacacctctgactattttatatcttatggaatcgagcacgcccagtgcgtgcccccttccgagttttcagaacccagcttcattacagaatcgtaccagaccctgcatcccataagtagtgaagagttgctcagcctaaagtacgagaacgactacccctctgtcatcctgcgcgatccattacagaccgacaccctccagaatgactactttgccattaaacaggaagttgtaacacctgataacatgtgcatgggcaggacctctagagggagcgggcctatccagctgtggcagtttctgctggaactgctgacagacaaatcctgtcagtccttcatttcctggaccggtgacggctgggagtttaagctaagtgaccctgacgaggttgctaggcgctggggaaaacgaaagaataaacctaagatgaattatgagaagctgtctcgtggcctgcgatactactatgataagaatatcatccacaagaccgctggaaagagatacgtatacagatttgtgtgtgatctgcagtctctcctggggtacactccagaagaattgcacgccatgctggatgtgaaaccagatgcagatgagtag

SEQ ID NO: 246654 - DNA, 1458 bp, Artificial Sequence
  Description of Artificial Sequence: Synthetic coding sequence
atgagttatttcgtggactctgccggttcctcccccgtcccgtacagcgcacctaggcctgcggtggtacgtcaggggccatcaaatacttacgaggaccccaggatgaattgtggcttccaaagcaactaccatcagcagagaccttgttatcccttttgggatgaaatggcgactcaggaggtaccaacaggcctggagcattgtgtgtctgatatggagtgcgcggacgtgcccctgctgactccttcctcaaaggaaatgatgtcacaagccctgaaggccactttttccggcttcacgaaggaacagcagcgcctaggcatccccaaggatcccagacagtggactgaaacacatgtcagggattgggtgatgtgggccgtcaacgaattcagtttgaaaggtgtcgattttcaaaaattctgtatgaacggggcagccctgtgcgctctgggtaaggactgctttctggagctcgccccagatttcgtcggggacatcctctgggagcacctcgagattctgcagaaggaagacgtaaaaccctaccaggttaatggagtaaacccagcataccccgaatctaggtatacctctgactactttattagttatggcatcgaacacgctcagtgtgtgccccctagcgaattctctgaaccatctttcatcaccgagagctatcagacgctgcacccgatttcttcagaagagctgctctctctgaaatacgaaaatgactaccctagtgtgattctgagggatccgctgcagactgacactctccaaaatgattacttcgccatcaaacaagaagtggtgacgcccgacaacatgtgcatggggagaacgtcccgtggcaagctgggcggacaggattccttcgaatccatcgagtcatacgactcgtgcgatcgtctgactcagtcctggagctcacaatcttctttcaacagcttgcaacgagtccccagctatgactcatttgacagcgaagactatccggctgccctcccaaatcataaacccaaggggactttcaaggactatgttcgcgaccgggctgacctcaacaaggacaaacctgtcattccggcagccgctctagctggctacaccgggtcggggcctatccaactatggcagttcctgctagagctccttacagataagagctgtcagtcattcatctcctggacgggagatggctgggagttcaagctgtccgatcccgatgaagtggccaggcgctggggcaagagaaagaacaagcctaagatgaactatgagaagctgagtaggggtctgcgctattactacgacaagaacataatccataagaccgccggaaaacgatatgtctacaggtttgtatgtgatctgcagtcattgttgggttacacccctgaggaattgcacgccatgctggacgttaagcccgacgcagatgaatag

SEQ ID NO: 246655 - DNA, 1065 bp, Artificial Sequence
  Description of Artificial Sequence: Synthetic coding sequence
atgaaagcagccgttgaccttaaaccaactctgaccattattaagacagagaaggtcgatctcgagctgtttcctagtcctgacatggaatgtgccgatgtgcctctgttgacccccagttcaaaggaaatgatgtcccaagccctcaaggccactttttccggttttacaaaggagcagcaaagattaggcatccccaaggaccctaggcagtggacggagacccacgtgcgcgattgggttatgtgggccgtgaatgagttcagtctgaagggcgtggattttcaaaagttctgcatgaacggggctgcactgtgtgccctggggaaggattgtttcctcgagttggctcccgatttcgtgggcgacatactgtgggaacacttggaaattctgcagaaagaggatgtcaaaccctatcaagtgaatggggtgaaccctgcatatcccgaaagtcgctacacttccgactactttataagctatggcatcgaacatgcccagtgcgtgcctccctcagaattttcagagcccagctttatcaccgaatcttatcagacattgcaccccatctcctcagaggaacttcttagtctgaagtacgagaacgactacccatccgtcatcctccgggaccccctgcaaactgataccctgcaaaatgattactttgccataaagcaggaggtcgtaacaccggataatatgtgcatgggaagaaccagccgcggatccggtcctatccagctctggcagtttctgctggagctccttaccgataaatcctgtcaaagttttatctcttggactggggatgggtgggaatttaagctcagcgatcctgacgaagtggcaaggcggtggggaaagcgaaaaaataaaccaaagatgaattacgagaagctctctcgagggctgcgctactattatgacaaaaatattatccacaagactgccggaaagaggtatgtatacagattcgtttgcgaccttcagagcctgcttggctatactccagaggagcttcacgcaatgttagacgttaagccagacgctgatgaatag

SEQ ID NO: 246656 - DNA, 819 bp, Artificial Sequence
  Description of Artificial Sequence: Synthetic coding sequence
atgaaggcagccgtggatctcaagcccaccctgaccatcattaaaaccgagaaagtcgacttggagctgttcccttcgcctgatatggagtgtgcagatgttcccctgctgaccccatcaagtaaggaaatgatgagccaggccttgaaagcgaccttcagcggtttcactaaggaacagcagagattgggaattcctaaggatccaaggcagtggactgagacccatgtgcgcgattgggtgatgtgggccgtgaatgaattttcactgaagggcgtcgacttccagaaattctgtatgaatggagccgcactgtgcgcactgggcaaagactgttttttagaactggcacctgacttcgtgggtgacatactgtgggagcacctggagattctgcagaaggaggatgtgaaaccctatcaggtgaatggtgtgaatccagcgtaccctgaaagccgttatacttccgattactttatttcctacggaatcgagcatgcccagtgtgttccaccttctgaattcagcgagcctagctttatcactgaatcctatcaaaccctccacccgatctcatccgaggagctcctgagcttgaagtacgagaacgattacccgagcgttatactgcgtgaccctctccagaccgatacactccagaatgactacttcgctataaagcaagaggtggtgactcccgacaacatgtgtatgggacgcacaagtcgcggtaagttggggggacaggatagcttcgagagtatcgagtcttacgactcctgtggtcaggagatgggcaaagaagagaaacagacctag

SEQ ID NO: 246657 - DNA, 678 bp, Artificial Sequence
  Description of Artificial Sequence: Synthetic coding sequence
atgaaggccgctgtcgacttgaaaccgactcttactatcatcaaaacagagaaggtggacctagaactctttccaagccccggaaagctgggaggccaggattcattcgaaagcattgagtcatatgacagctgtgatcgcttaactcaaagctggagctctcagagcagcttcaatagtcttcagagggtgccctcctacgatagtttcgacagcgaagactaccccgcagctttgccgaaccacaagccaaagggcacgttcaaggattacgtcagggatcgggctgaccttaacaaggacaaacctgtgatcccagcggctgctctggctggatacactggaagcggccctatccagctgtggcaattcctgcttgagctgcttacggataagtcctgccagtctttcatttcatggactggcgatggatgggaattcaagctatcagatcctgacgaggtagccagacgctggggaaaacgaaaaaacaaacctaaaatgaactatgagaagttgtcacgcggacttcgatattattacgataaaaacattatccataagactgccggaaagcggtatgtctatagatttgtctgtgatttacagtccctcctggggtacacgcccgaggagctgcatgctatgctggatgtgaagccagatgctgacgagtag

SEQ ID NO: 246658 - DNA, 1848 bp, Artificial Sequence
  Description of Artificial Sequence: Synthetic coding sequence
atgaaagcgttacgcctctccgcctctgcattgttctgccttctgcttataaacggtctgggagccgcaccgcctggccgacctgaggctcagccaccgccactgagctcagaacataaggaacccgtcgctggtgatgcggtgcctgggcctaaagatggctctgctcctgaagtcagaggggctaggaatagcgagccccaagacgaaggggagttgttccaaggagttgatccccgagccctcgcggcagtcctgttgcaggccctggatcggcctgcttctcctcccgcacctagcgggtcccagcagggacccgaggaagaggccgcagaagccctgttgacagagaccgtgcggtcccagacccacagtctacctgcacctgaatcgcccgagcctgcagctcctcccaggccgcagactccagaaaatggacccgaagcctctgaccctagcgaagagctggaagcactggcatcattgctccaagaactgcgggacttcagccccagttcagcaaagagacagcaggaaaccgctgccgctgagaccgagacaaggactcacacactgacgagggtaaacttggagagccccggtcccgaaagagtttggagagcatcctggggcgaattccaagccagagtgcccgaacgagcaccacttccacctcctgctcctagccaattccaagctagaatgccagattcaggacctctcccagagacacacaaattcggcgagggagtgtcatctcccaaaacacatttaggagaggccctggcacctctgagcaaggcctatcaaggagttgctgctccgttcccaaaagccaggcgtcccgaaagcgctctcttggggggatcagaagccggagagaggctgcttcagcaaggactggcccaggtggaggcagggcgacgacaggctgaggccacccgccaggccgcagcccaggaagaacgccttgctgatctcgcctccgacttattgcttcaatatctgctgcaagggggagcgagacagagagggctgggagggagaggcctgcaagaggcggctgaggagagagagagtgcaagggaagaagaagaggcagaacaagagcggcgtggcggtgaggaaagagtgggagaagaagacgaagaagccgctgaggcggaggcagaagccgaggaagcagagagggcacgacagaatgccctccttttcgctgaggaagaagatggggaagcaggcgcagaagataagaggagtcaggaggagacacctggccataggaggaaagaagccgaagggacggaggaaggtggcgaagaagaggatgacgaggagatggatccccagactatcgattcgttaatagaattaagtaccaagctgcacctcccagcagatgatgtggtgtcaatcattgaagaggtcgaagaaaagcggaaaagaaaaaaaaatgcccctcccgagcccgtgccgccaccacgcgctgcgccagcaccaacacatgttcgctccccacagccccctccccctgcacccgctccggctagggatgagctacccgactggaacgaggtcctacccccttgggaccgtgaagaagacgaagtctaccctccaggcccttaccacccatttcctaactatatccggccacgaacactgcagccgccttccgcattgagacgcagacactaccaccatgccctccccccatctcggcactatcctgggcgagaggcacaggcccgaagggcccaggaagaggcagaagccgaagaaagaagactgcaggaacaggaggaattggaaaattatatcgaacacgtgcttttaagacgcccttag

SEQ ID NO: 246659 - DNA, 1848 bp, Artificial Sequence
  Description of Artificial Sequence: Synthetic coding sequence
atgaaagctttgaggctttctgcctctgctctcttttgcctgctccttatcaatggactaggcgctgcccctcccggacgtcctgaggcacagccccctccactcagtagtgaacacaaggaaccagttgcgggagacgcggtgccaggtcccaaggacggctctgcgcctgaggtgcggggagccaggaattctgagccccaggacgaaggggagttgttccagggcgtggacccgcgtgccctggcagccgtcctgctgcaggcccttgatcggcctgcctcgccccctgctcctagcgggtctcaacagggtcctgaagaagaggcagcagaagctctgttaaccgagacagtccgaagccagacccatagcctacccgctcccgagagcccagaaccagccgctccacctcgcccacagaccccggagaacggcccagaggcgagcgacccttctgaggaactggaagctttggcatcactccttcaagagcttagagattttagtccttcctccgccaagagacagcaggagactgctgccgctgaaacagaaacccggactcacaccctgacgcgcgtgaacctggagtctcctggcccagagcgggtatggcgtgcgtcttggggggagtttcaggcacgcgtacccgaacgcgcaccgcttcctccgcctgctccaagccagtttcaagccagaatgccggatagcggaccactgccagagacccacaaatttggcgagggggtctcctcgcccaaaacgcacctcggcgaagcactggctccgctgagcaaggcataccagggagtcgccgcacctttcccaaaggctagacggccagaatctgccctgctcggagggtctgaggctggcgaacgcctgttgcagcaggggctggcccaggtcgaggccggaaggaggcaggcagaagcaacccggcaggcggcagcccaagaggagcggctggccgacctcgcaagcgatttactgttgcagtacctgctccaaggaggggctagacagcgcggactggggggacggggactgcaggaagccgctgaagagcgcgagtcagcaagagaggaagaagaggcggaacaggaacgacggggtggtgaggagcgggtaggcgaggaggatgaggaagccgcagaagctgaggcagaggcggaggaggctgaaagagctcgccagaatgctctgctttttgcagaggaggaggatggcgaggctggcgctgaggataaaaggtcccaggaggagactcctgggcataggaggaaagaggccgaaggcaccgaagagggcggtgaggaagaggatgacgaggagatggacccccagactatcgatagcttgatcgagctgagtacgaaactgcacttgcctgcagatgacgtcgtgagcatcatcgaggaagtggaagaaaagaggaaacgtaagaagaacgcaccaccggaacccgtccctccccctagagcggctcccgctccgacccatgtgcggtccccccagccacctccgccagcccctgcgccagctcgcgacgaactgcccgactggaatgaggtactgcccccttgggacagagaggaggatgaggtgtacccccctgggccataccatccattccctaactatattaggccaaggacgctgcagccaccatctgctcttcgcaggagacattatcaccacgcgttgccgccaagccggcactacccagggagagaagcgcaggcgagaagggcccaagaggaagccgaggctgaggaacgcagactccaggaacaggaagagcttgagaattatatcgagcacgtgctgcttaggcgaccttag

SEQ ID NO: 246660 - DNA, 1134 bp, Artificial Sequence
  Description of Artificial Sequence: Synthetic coding sequence
atgaaggctctccgccttagtgcttccgcattattctgtctcctgctgatcaatggattgggcgctgccccacccggacgtccagaagcccagcctcctccactcagcagcgagcataaggagccagtggccggagatgctgtcccgggtcccaaggacgggtcagcaccagaggtccggggagcacgaaatagtgagcctcaggacgagggagaactgttccagggagtagatccaagagccctggccgcagtgctcctacaggctcttgacagacctgcatcgccaccggctcctagcgggagccagcaggggccagaggaggaggcagccgaggctctgctgacggaaacggtccgttcccaaacgcacagccttcccgcacctgaaagccctgaacctgctgcaccacctcgccctcaaaccccagagaatggccctgaagccagcgatccaagcgaggaattggaggcccttgcttcactgctgcaggaactccgggacttctccccctcgtctgccaagcgtcaacaggaaactgccgcagccgagactgagacacggacccataccctcacacgggtgaacctcgaaagcccgggaccagagagagtgtggcgcgcatcctggggcgaatttcaggcgagggtgcctgaacgcgcaccattgcctccccctgctccttcccagtttcaggctaggatgccagacagcggccctctccctgagacacacaagttcggcgaaggcgtgagctcccctaaaactcacctgggcgaggcacttgcccctctctccaaggcctaccaaggtgttgcggctcccttccccaaggccagaagaccagaatccgcgttgttaggaggctcagaagctggagaacgcctgttgcagcagggcctcgctcaggtggaggccggacggaggcaagccgaggccacaaggcaagcagccgctcaagaggaaaggttagccgatctcgcatccgatctcctccttcagtttgctgcgggacgcggtcccgctgctcggccatgtcccttagcgctgccactcagtccagggtgtgtcggtacctgccagacgcccctccccggtcccgagccagagctcccagagctgacaaggggctag

SEQ ID NO: 246661 - DNA, 2484 bp, Artificial Sequence
  Description of Artificial Sequence: Synthetic coding sequence
atgacgaaactttccgcccaagtcaagggatccctcaacattacaacacccggtctgcagatatggcgaatcgaggcgatgcaaatggtgccggtcccatcatccactttcggcagtttctttgatggcgactgctacattattctggccattcataagactgcaagttccctgtcgtacgacattcattactggatcggtcaagatagctctctcgatgagcagggcgcagcggctatctacacaactcaaatggatgacttcctgaagggacgagccgtccagcatagggaggtgcaggggaatgaaagcgaagcattccgcggatatttcaaacagggattagtgataaggaagggaggcgtggctagtggtatgaaacacgtggaaactaattcttatgacgtgcagcggcttctgcacgtcaagggcaagcgcaacgtcgtggctggtgaagtggagatgagctggaagtccttcaaccgaggagatgtcttccttcttgacctcggcaagctgatcatccaatggaatggcccagagagcaccaggatggagagacttcgtggcatgaccctggccaaggagatccgggaccaggagaggggcggacgaacctatgtaggggtcgttgacggagaaaacgagctggccagcccaaagctgatggaggtaatgaaccatgtcttgggcaagcgaagggagttgaaagcagccgtgcctgacaccgtggtggagcctgcactgaaggccgcactgaagctttaccacgttagtgattctgaaggaaacctcgttgtgcgcgaagtggcgacgaggcctctcacgcaggacttgctgtcccatgaagactgctatattctcgatcagggcggactgaagatctacgtctggaaggggaagaaagcgaatgagcaggagaagaagggggcaatgagtcatgccctgaacttcattaaagccaagcagtaccctcctagcacacaagtagaggtccagaatgatggagcagagtcagctgtattccagcagttattccagaaatggaccgcatctaatagaaccagcgggctcggcaagactcacacagtcggctcagtggccaaggtggagcaggttaagtttgacgccacaagtatgcatgtaaaaccacaagtggcagcacagcagaagatggttgacgatggttctggagaggtgcaggtctggcggatcgagaacctggaacttgtgccggtggactcaaagtggctcggccatttctatggaggagattgttatctcctgttgtacacctacctgatcggcgagaagcagcattacctactgtatgtgtggcagggctcccaggccagccaggacgagattaccgcctctgcctaccaagccgttatcttggatcagaaatataacggcgagccggtgcagatacgggtcccaatgggcaaggaaccacctcacctcatgtccatatttaaaggaaggatggtggtgtatcagggcggaacctcaaggactaacaatctagagacaggcccttctaccagactttttcaggtccagggtacaggcgctaataacacaaaagcatttgaggtgcctgctagggccaactttcttaacagcaacgacgtttttgtgctgaagacccaaagttgctgctacctgtggtgcggtaagggctgctccggagacgagagggagatggctaagatggtggccgataccatcagcaggacggagaaacaggtggtggttgaaggccaagaacccgcaaacttctggatggctcttgggggaaaagccccatacgctaacacgaagaggctgcaggaagagaacctcgtcattactccacggttgttcgagtgtagcaataagacaggcagatttctcgcgacagagattcctgactttaaccaagatgatttggaggaagacgacgtcttcctccttgacgtgtgggatcaggtatttttttggattgggaaacatgcaaacgaagaggagaaaaaagctgccgcaaccaccgcccaggagtaccttaagactcacccaagtggtagagaccctgaaactccgattatcgtcgtgaagcagggccacgagccaccaacctttacgggttggtttctggcatgggacccatttaaatggtccaataccaaaagctacgaggacctgaaggctgagctggggaattcaagagattggtcacaaataacagctgaggtgacttccccaaaagttgacgtgtttaacgctaactctaacctctcgtccggtcctctccctatatttccccttgagcagctggtaaacaaaccagtagaagagctcccggaaggggtagacccttcgcggaaggaggaacatctgagcatcgaggacttcacccaggcttttggcatgacccctgcagcgtttagtgcactgcccaggtggaagcagcagaaccttaagaaagagaaaggccttttctag

SEQ ID NO: 246662 - DNA, 1551 bp, Artificial Sequence
  Description of Artificial Sequence: Synthetic coding sequence
atgtcccatgcgctcaacttcattaaagctaaacagtatcctccatccacccaggtcgaggtacagaatgatggcgcagagtctgctgtttttcaacagcttttccaaaagtggactgcctctaaccggaccagcggattggggaaaacccatactgtaggttcagtggcaaaagtggagcaggtgaaattcgatgcgacaagcatgcacgtgaaaccacaggttgccgcacagcagaaaatggtagacgacggctccggagaggtgcaagtatggagaatagagaatctcgaattggtaccggtagattctaagtggttaggacatttttacggaggtgactgctacctcctgttgtacacctatcttataggggagaaacaacactacctcttatatgtatggcagggcagccaggcttcccaggatgagatcaccgccagcgcctaccaggcagttatcctagatcagaagtataatggggaaccagtccagatacgcgtacctatgggaaaagaacctccccacctgatgtcaatctttaaagggcgtatggttgtctatcagggagggacctctcggaccaacaacctggagactggacctagcactagactgtttcaggtgcaaggcacgggagcgaataacacaaaggcctttgaggtccccgcacgcgcaaactttctgaactccaacgatgtttttgttctgaaaacccaatcatgctgttacttatggtgtggaaagggctgcagcggcgacgaacgcgagatggccaagatggtggctgatacaataagccgcactgaaaagcaagtggtggttgaggggcaggaaccagcaaatttttggatggccctgggtggtaaggctccgtacgccaataccaagagactgcaagaagaaaatctcgtgatcactcccaggttattcgaatgtagtaacaaaaccggcaggttcttagctaccgagattccggattttaatcaggacgatctggaggaagacgatgtgtttctgcttgatgtgtgggaccaggtttttttctggattggcaaacatgccaatgaggaagagaagaaggccgcagcaaccacggctcaagaatacctgaagacccacccctccgggagagaccccgaaacccccatcatagtggttaaacaggggcatgaacctccaacattcacgggctggttcctagcttgggatccctttaagtggtctaacactaagtcttacgaggacctcaaagccgagttggggaactcaagggactggagccagatcacagcagaggtcactagtcccaaagtagacgtgttcaacgccaactctaatctgtcgtcaggacccttgccaatcttccctctcgagcaactggtcaacaaacctgtcgaagagctacccgagggggtagacccgtcccggaaagaggaacatctgagcattgaagacttcacccaagcatttggcatgacccctgccgcattttctgctctgcccagatggaagcagcaaaatttaaagaaagaaaagggcctgttctag

SEQ ID NO: 246663 - DNA, 1266 bp, Artificial Sequence
  Description of Artificial Sequence: Synthetic coding sequence
atgactaaactgagtgcccaagtcaaggggagcttgaacattaccaccccgggattgcagatctggagaatcgaggcaatgcagatggtgccagttccaagctcaacattcggcagctttttcgatggtgattgctatatcatcttagcaatccataagacggcctcctccctttcctacgatatccattactggattggccaggacagcagcctggacgagcagggcgcagcagcaatctacacaacacagatggatgatttcctgaaaggcagggcagtacagcaccgggaagtgcagggcaatgagagcgaggcgttcagaggatatttcaagcagggcctagtaatcagaaaggggggagtggcttctggcatgaaacatgtggaaaccaacagttatgatgtgcagcgattgctgcacgtgaagggtaaacgcaacgttgtggccggagaagtagagatgagttggaagtcatttaacaggggagatgtgttcttgctcgatttaggaaagctgattattcagtggaacggccctgagtcaacccgcatggaacgcctaaggggcatgactctggcgaaagagatcagggaccaggaacggggtggacggacatatgtcggcgtggtagatggcgaaaacgagctggccagtcccaaactgatggaggtcatgaatcacgtcctcgggaaacgaagggaactgaaggccgcagtgcccgacactgtggtagagcctgctttgaaagcagccctgaaactataccacgtgtccgactctgagggcaatttagtggtcagggaggtagcaacacggcctctaacccaggatctactgtctcacgaggattgctatatactggaccaaggaggacttaagatctacgtgtggaaaggcaagaaggcgaacgagcaagagaagaaaggggctatgagtcacgcattaaacttcataaaggccaaacagtatcccccatctacgcaggtcgaggtgcagaatgacggtgccgaatctgcagtctttcaacagttattccagaaatggaccgcaagcaatcggactagcggactgggaaaaacacatacagtgggctctgtcggcgagggccaggccggagccgtgagagagccaggtagcagaagctgggccagacgtgcgacatggagtacaacacaccccccttcgcttacctgtatctttaatgaagacttctacgctggcagcggtcttgtcctggcagacggggatgttgacaaactttag

SEQ ID NO: 246664 - DNA, 576 bp, Artificial Sequence
  Description of Artificial Sequence: Synthetic coding sequence
atgggcaagcagaactctaaactcgctcccgaagtaatggaagacttggtcaaaagtaccgaatttaatgagcatgagttgaagcagtggtataagggctttctaaaggattgcccgagtggcaggttgaacttagaagaatttcaacagctttatgtcaagttttttccttatggcgacgccagcaaattcgcacaacatgcgttccggactttcgataagaacggggacggaaccatcgactttcgggaatttatctgtgcccttagtattacctctcgtggttccttcgagcagaagctgaattgggcctttaatatgtatgaccttgacggcgatggtaagatcacccgagtggaaatgctggagataattgaagcaatatacaagatggtcggcacagttattatgatgaaaatgaacgaggacggcctgacccccgagcagcgagttgataaaattttctctaagatggacaaaaacaaggatgatcagattaccctggatgaatttaaggaggcggctaagagtgacccatccattgttttattgctccagtgtgacatacagaaatag

SEQ ID NO: 246665 - DNA, 576 bp, Artificial Sequence
  Description of Artificial Sequence: Synthetic coding sequence
atgggcaagcagaactctaagcttgctcccgaggttatggaagaccttgttaagagcactgagtttaacgagcacgagctgaagcagtggtacaagggattcctgaaagattgcccgtcggggaggctgaacctggaagagtttcagcaactgtacgtgaaattcttcccctacggggacgctagtaaattcgcccagcatgcctttcggacttttgacaaaaacggtgatggcacaattgactttcgcgagttcatatgcgcccttagtatcacaagtcggggtagcttcgaacaaaaactaaactgggccttcaatatgtacgacctggacggcgatggaaagatcactcgcgtggagatgcttgagataattgaagcaatttacaagatggtcggtacggtgatcatgatgaagatgaatgaggatggcctcactcctgagcagcgtgtggacaagattttttccaagatggacaaaaataaggacgatcaaattactctcgacgagttcaaggaagccgctaaatctgatccctctattgttctgctcctccaatgcgatattcagaaatag

SEQ ID NO: 246666 - DNA, 576 bp, Artificial Sequence
  Description of Artificial Sequence: Synthetic coding sequence
atgggcaagcagaatagtaagttagcaccagaggttatggaagacttggtcaaaagcacggagttcaatgaacatgaactgaaacaatggtacaaaggatttctgaaggactgcccctccggcagattaaacctcgaagagttccaacagctttacgttaaatttttcccttacggtgacgccagcaaattcgcccagcacgcgttcaggacatttgacaaaaatggtgatggcacaattgatttcagggaattcatatgcgcactgtccataacttcaaggggatctttcgagcaaaaactgaactgggcatttaatatgtacgatttagatggcgacgggaaaataaccagggtcgagatgctggaaatcatcgaggcaatctataagatggtcggaaccgtgatcatgatgaagatgaatgaagatggcctaacacctgagcagcgcgtcgacaagatcttttccaagatggacaagaataaggacgatcaaattacgctagacgaatttaaggaggctgccaagagtgatccctcaattgttctgcttttgcaatgcgatatccagaaatag

SEQ ID NO: 246667 - DNA, 315 bp, Artificial Sequence
  Description of Artificial Sequence: Synthetic coding sequence
atgggtaaacagaatagcaaactggcacctgaggtcatggaagacctagtgaagagtaccgaatttaacgaacacgagctgaagcagtggtacaagggcttcttgaaggactgtccatccggcaggctgaatttggaggagtttcagcagttgtacgtgaaatttttcccatacggcgatgcctcgaagtttgcacagcacgcctttagaactttcgacaaaaatggggacggcaccattgattttcgtgaatttatctgtgccctcagcatcacctctaggggatcttttgaacagaagttaaattgggcctag

SEQ ID NO: 246668 - DNA, 357 bp, Artificial Sequence
  Description of Artificial Sequence: Synthetic coding sequence
atgggtaaacaaaactcaaaactggcaccggaggtgatggaggatctggtaaaatccacggagttcaatgagcatgagcttaagcagtggtacaagggatttctgaaagactgccccagcgggcgtctcaacctcgaggaattccagcagctttacgtgaaattttttccctatggtgacgctagtaagttcgcacagcacgcttttcgcacctttgataagaatggcgatgggacgatcgatttccgggagttcatatgcgccctgtccatcacttcaagaggctcgtttgagcagaaattgaactgggcgttcaacatgtatgacctggatggggatggtaagataaccagatag

SEQ ID NO: 246669 - DNA, 720 bp, Artificial Sequence
  Description of Artificial Sequence: Synthetic coding sequence
atgacaggcagggacagtctgtcagatgggagaaccagcagccgggctctggtgccaggtggctccccccgaggctctagacctagaggctttgcaattaccgacttgctgggactcgaagccgaattacccgcaccggctggtccgggtcaggggagcggctgcgaggggcctgcagtcgcaccctgtcccggaccaggacttgacgggtcatccctcgcacgaggagcactgccgctgggtttaggtctgttgtgtggcttcggcacacagcccccagccgctgctagagcaccatgcctgctgctggctgacgtcccatttttacctccaagggggccagagcctgccgctccattggccccatcaaggcctcccccagctctggggaggcagaagaggtcggactccgtgagcacttcagacgaggatagccagagtgaggatagaaacgatctcaaagcctctcctacactaggcaagcggaaaaaacggaggcataggacagtctttacggcccaccagcttgaagaactggaaaaggccttctcggaagcgcattacccggatgtttacgcgagagaaatgctggcggttaaaaccgagctgcctgaggaccgcattcaggtatctggagtgccatttcttcgctcaaaggataccacggaaaacgtgtccttcccacattcagtgtctcagtccgctgttccatcactgtag

SEQ ID NO: 246670 - DNA, 1098 bp, Artificial Sequence
  Description of Artificial Sequence: Synthetic coding sequence
atgacgggcagggactcgctcagtgacggtcggacctctagccgagcccttgtgcctggagggtcgccaaggggatctagacctcgcggatttgcaatcactgatcttcttgggctagaagccgagctgccagcaccggctggacccggacaaggatcaggttgcgaaggacccgctgtcgccccttgtcctggacccggactggatggaagctctttagccagaggggctctgccactagggttgggtctgctgtgtggattcggcacccagccacctgctgccgcacgggcaccttgtctgctgttagcggatgtgccatttctgccgccaagaggcccagaacctgcagcacccctagcaccatctcgccctcccccagctctgggaaggcagaaacggtcggatagtgtgagcacatctgacgaagacagtcagagtgaggaccggaacgatttgaaggcatctcctacactcggtaagcgcaaaaagcgaagacatcgcactgtcttcacagctcaccagttggaggagttggagaaggcattctcagaagctcactatcctgacgtgtacgctagagaaatgctcgctgtcaagactgagctgcccgaggaccgcatccaggtgtggtttcagaatcggcgagcaaaatggaggaagcgtgagaagcgctggggagggtcatcggtcatggccgaatacggtctctatggagccatggtgcgccactgcatcccactgcccgactcagtgttgaactcggccgagggtggtctccttggatcctgtgccccttggctgctcggcatgcacaagaagtccatgggaatgataagaaaacccggatccgaagataagctcgctgggctgtggggctccgaccatttcaaggaaggcagcagccaatccgaaagtggatcccagcgcggttcggataaagtatccccggaaaacggattggaggatgtggccattgatctatcaagttccgcacgacaggagacgaagaaggtgcatccaggcgctggcgcacagggcggatccaactccaccgccctggaaggccctcagccaggcaaagtgggggcaacctag

SEQ ID NO: 246671 - DNA, 432 bp, Artificial Sequence
  Description of Artificial Sequence: Synthetic coding sequence
atgaccggtcgggacagcctgagtgacgggaggacttcaagtcgagccttggtgccaggagggtccccaaggggaagccggccacggggttttgcaatcactgacttgctcggcctcgaggctgaattacccgctccagctgggcctggacaaggatcaggctgcgaggggccagcagtagcaccctgtccaggacctggcctagacggatcatccctcgccaggggagctctacccctgggcctgggactgttatgtggctttggcacccagcccccagcagcagcaagggctccatgcctgctcttggcggatgtcccctttctacctcccaggggaccagaacctgctgcccctctggctccttcccggcctcctcccgctttaggcagacagaaaagatctgactcagtgtcaacttccgctatgtag

SEQ ID NO: 246672 - DNA, 843 bp, Artificial Sequence
  Description of Artificial Sequence: Synthetic coding sequence
atgactgggagagattctctgagcgacggcagaacctccagtcgcgctcttgttcctggtggtagccccagagggtcaaggccgaggggcttcgcaatcactgacctgcttggcctggaagccgagttgccagcaccagcgggtccaggacaaggctcgggctgcgaaggccctgctgttgcgccttgcccagggccagggcttgatggttcgagcttggccaggggggctctccccctgggtctcgggctgttgtgtggttttggaactcagcctcctgcagctgcacgggctccgtgtctgctcctcgctgacgtacctttcctcccccctagagggcctgagcccgcagctcccctcgctccctcaagaccccctcctgcgctgggcaggcagaaaagatccgacagtgtctcgacatctgacgaagattctcagtccgaggatcgaaatgacctgaaggccagtcccaccctgggaaaacgcaagaagcgccgacatcgaactgtattcaccgcccaccagctagaggagctggaaaaggcattcagcgaggcccactacccagatgtgtacgcaagggagatgcttgctgtaaagacggaacttcctgaagaccggattcaggtctggtttcagaatagaagggcaaaatggagaaagcgcgagaaaagatggggaggttccagcgttatggctgagtacggcttgtacggcgcaatggttcggcactgcatcccactgccagattctgtgctgaacagcgctgagggaggcctgctaggaagctgcgcaccatggctccttgaaggcgaaacactaggctgccgcgaaatgaagtag

SEQ ID NO: 246673 - DNA, 657 bp, Artificial Sequence
  Description of Artificial Sequence: Synthetic coding sequence
atgacaggaagggattccctcagcgatgggaggacatccagtagagctctggtccccggaggatctccgagaggatcacgacctcgaggctttgcaattaccgacttgctcgggctagaagccgagctccccgctcctgctggacctggtcaaggcagtggctgcgagggccctgccgttgccccatgtcccggaccaggactagatggatcttcactggcacggggagcactacccttaggactaggattactgtgtggattcggtacacagccacccgcagccgctagagcgccatgcctcctgctcgcagacgtcccttttctgccccctcgtgggcctgagcccgctgcccctctggctcccagcaggcccccacctgctctaggaagacaaaaacgcagcgatagtgttagcacatctgacgaagacagtcagagcgaggatcgcaacgatttgaaagcttctcccaccctggggaagagaaaaaagagacggcacaggactgtcttcacagcccaccagctggaggaacttgagaaagcattcagcgaagctcactatccggacgtgtacgctcgagagatgctggcagtcaagacagaactaccagaagatcggatacaaagagtaagacactgggccgctgagaagtag

SEQ ID NO: 246674 - DNA, 906 bp, Artificial Sequence
  Description of Artificial Sequence: Synthetic coding sequence
atgactggaagagactccctgtccgatggaaggacaagttctcgagcacttgtgcctggaggctcccccagaggctctcgcccacgcggattcgcaatcacggatctgttgggacttgaagccgagctcccggcaccagctggccctgggcagggttcaggatgtgaaggcccagctgtcgccccatgccctggaccgggtcttgacggatctagcctagctcgaggagctttgcccctgggcctgggattgttatgcggctttggcacccagcccccagccgctgccagagccccatgcctgttactcgctgacgtgccatttctccctccaaggggtcctgaacctgcggctcctttagctccaagtagaccaccgcctgcgctgggacgacagaagcggagcgattcagtgagcacgtcagatgaggatagccagagtgaggatcgtaatgacctgaaagccagccccacgttgggaaagaggaagaaacgaagacacaggacagtctttaccgcccaccagctcgaggagttagagaaagccttttctgaggcacactatccagacgtgtacgccagggagatgcttgcagtgaaaaccgagctgccagaagatcggatacaggtgtggtttcaaaaccgacgagccaagtggaggaaaagagagaagaggtggggtgggtcgtccgttatggccgagtacggtctgtacggtgctatggtgagacattgcatacccctacccgatagtgtgctgaactctgcagagggaggattgttgggctcctgcgcaccatggctgttagtgcagacgtccgcgccagggggaagcaggagtctggatttcgcaggagacacacaggcacctcagactccttggtggtgcctaatgaccttttcctag

SEQ ID NO: 246675 - DNA, 711 bp, Artificial Sequence
  Description of Artificial Sequence: Synthetic coding sequence
atgaccggcagggatagcttgtcggatggtaggacatcaagcagagcattagtgcccggtggaagccctcgagggtcacgacccagaggctttgctatcaccgacttgttggggcttgaagccgagttgcccgcaccggctgggccagggcaaggatccggctgcgagggcccagcggttgctccctgtcccggtcccggactggacggctcctcgttggcaaggggagcattgcccctcgggctcggacttctgtgtggcttcggcacccagcccccagctgcagccagggccccatgtctccttcttgccgacgtcccttttctgccgccacgcggaccagaacccgcagctccactggctccctccaggcctccccctgcacttggccgacagaaacgttctgacagcgtgagcacctctgacgaagactcacaatcagaggataggaacgatctgaaggcgagccctactctggggaagagaaagaaaagaaggcacagaaccgttttcaccgcacaccagctcgaagaattggagaaagccttttcagaagcacactacccagatgtttacgctagagagatgcttgctgtgaaaactgagctcccagaagatagaatccaatgcaagctgctgctgctggaagcccctgtccattggaccctgcaggaaacccaccgactgcctcgtccacgcggaggcgcttag

SEQ ID NO: 246676 - DNA, 1110 bp, Artificial Sequence
  Description of Artificial Sequence: Synthetic coding sequence
atgcgcgcatgtataagtctggtgctcgccgttttgtgcggactggcctgggccgaagaccacaaggagagcgagccacttccccagctcgaagaagaaacagaggaggcgctggcgagtaacctgtattctgccccaacatcctgccaaggtcggtgctatgaggcgttcgataaacatcaccaatgccattgcaatgccagatgccaggagttcggtaattgctgcaaggacttcgagtctctatgttcggaccacgaggtttctcattcaagtgacgcgattaccaaagaggagatccagagcatttctgagaagatttaccgtgctgacaccaacaaggcccagaaggaagacatcgtactgaactcccagaattgcatctccccgagtgaaactcgcaatcaggtcgaccgatgccccaagccattattcacctatgttaatgagaagctgtttagtaagcccacctacgctgccttcatcaatcttctgaacaattatcaaagggccaccgggcacggcgagcacttttctgcccaggaactggctgaacaggatgctttcctccgcgaaatcatgaagactgcagtgatgaaggagctgtattcattcttgcatcatcagaacagatacggaagtgagcaggagttcgtcgacgatttgaagaatatgtggtttggtctctattcccgtggtaacgaggaaggcgattcctcaggctttgaacacgtttttagcggggaggtcaaaaaaggtaaggtaacagggttccataactggataaggttttacctggaggagaaggagggcctagtcgactactacagtcacatctacgacgggccatgggactcctaccctgacgtcctagctatgcaattcaattgggatggatattacaaggaagtggggtccgcgttcatagggagttctcctgaatttgaatttgccctttatagtctgtgttttatagcacgccctgggaaggtttgtcaactgtccctggggggatatcctcttgctgtccggacctacacatgggataaaagcacatacggaaacggcaagaagtacatagctaccgcttatatcgtcagctccacgtag

SEQ ID NO: 246677 - DNA, 1284 bp, Artificial Sequence
  Description of Artificial Sequence: Synthetic coding sequence
atggaggctatggcggcaagcacttcgcttcctgatccaggagacttcgaccgtaatgtaccgagaatctgcggagtctgtggagatcgggctacaggatttcattttaacgcaatgacctgcgaaggctgtaagggcttctttagacgcagcatgaaacggaaggcattgtttacttgtccctttaacggtgattgtaggattactaaggataacaggcgccactgccaggcatgcagacttaaaagatgtgtggatattgggatgatgaaagagtttattctgacagacgaggaggtccagcgaaagagagagatgattcttaagaggaaggaggaagaagctctgaaggatagtctaaggccaaaactgtctgaggagcagcaacgtattatagctatcctcctagatgcccaccataagacctacgatcccacctactcagacttttgccaatttagaccacccgtccgcgtcaatgatggcggtggctcacatccgtcacgccctaactcgagacacacccccagcttctcaggcgatagctcatccagctgctccgaccactgtatcaccagtagtgatatgatggacagctccagcttcagcaatctcgacctcagtgaggaagacagtgatgatcccagtgtgactcttgaactctcccagctgagcatgcttccacatttagcagacttagtatcatattctatacaaaaagtcatcggctttgccaagatgatccctggtttccgggacctgacgtctgaagatcagatcgtactgctaaaatcttctgcgattgaggtgataatgctgagatcgaatgagagtttcaccatggacgacatgtcgtggacctgcggaaaccaggactataaatatcgggtgagtgacgttaccaaggctggacattcactggagctgattgagcctctgatcaagttccaggtgggcttgaaaaagctgaacctacatgaagaggaacacgtcctgcttatggccatctgtatcgtgagtcctgataggcctggtgtccaggacgcagcgctgattgaagctattcaggaccgcttgtccaataccctgcaaacatatatccggtgtcgccacccaccccctggaagccatttactgtatgccaagatgattcagaaactcgcagatcttagatcattaaatgaagagcactccaagcagtacaggtgtctctcatttcaaccggagtgttccatgaagctcacccctcttgtattagaagtctttggtaacgaaattagctag

SEQ ID NO: 246678 - DNA, 1188 bp, Artificial Sequence
  Description of Artificial Sequence: Synthetic coding sequence
atgtcaatggaacacgcagccctgacagctactggagcgggtgggagctggaggtcaatgaaaaggaaagccctttttacatgtccattcaacggggattgtagaatcaccaaagataaccggaggcactgtcaggcgtgcaggctcaagaggtgcgtggacatcggcatgatgaaagagttcattctgacggatgaagaggttcagcggaaacgagagatgatactcaaacggaaggaggaggaagcattaaaagacagtttaaggccaaaactgagtgaggagcagcagaggatcattgccattttgttggacgcccatcacaagacatacgatcccacatactctgacttctgccaattccgcccacctgtgcgtgtaaatgacggagggggaagccacccctcaagacccaattccagacacacacccagcttcagtggggattcctcctcaagctgtagcgaccactgtatcacaagctccgacatgatggactcctcatctttttccaatttagacttgtctgaggaggatagcgatgatccctcggtgaccctggaactgagtcagttaagcatgctgccccatctggcagacctggtttcctatagcatccagaaggtgattggcttcgccaaaatgatcccaggttttcgtgatttgacctccgaagaccagatcgtcctgctaaagtctagcgccatcgaggtgattatgctgcgtagcaatgaatcattcacaatggatgatatgtcttggacttgcggcaatcaggattacaaataccgcgtgtcagatgtgacaaaagctggacattctctggaacttattgagcctctgatcaaattccaggtcggcctgaagaaactaaatcttcatgaagaagagcacgtgctgttgatggccatttgcatcgtttcgcccgacagacccggtgtgcaggacgctgccctgatcgaagccatccaggatcgcctgtcaaacacattacagacctacattcgatgtcgacatcccccaccaggaagtcacctgctgtacgccaagatgattcagaagctggctgacctaagatccctgaacgaggaacatagcaagcaatacagatgtttgtcctttcagcctgagtgttcaatgaaactcacaccgttagtactagaggtatttggtaacgagatttcatag

SEQ ID NO: 246679 - DNA, 753 bp, Artificial Sequence
  Description of Artificial Sequence: Synthetic coding sequence
atggaagcaatggcagcttctacctctctacccgatccaggcgattttgatagaaatgtcccaaggatttgcggggtatgtggagatagggctaccgggttccatttcaacgcaatgacttgcgagggatgcaagggtttcttccggagaagcatgaaaagaaaagcacttttcacttgcccatttaatggagattgccgaattacgaaggacaaccggaggcattgtcaggcttgccggctcaaaaggtgtgtcgatattggcatgatgaaggagtttattctgaccgacgaggaagtccagagaaaacgcgagatgatccttaaaaggaaggaggaagaggcacttaaagattccctcagacccaagctttcagaggaacaacagagaatcattgccattctgttagatgcccaccataagacttatgatcctacctactcagacttttgtcagtttaggcctcctgtgcgggtgaatgatgggggtgggagccacccttcaagacctaattctaggcatacaccatcattttccggggatagctcctcatcctgttcggaccactgtatcacttcaagtgacatgatggacagctcctcattcagtaatctagacctcagcgaagaagacagcgacgacccctccgtcacactcgaactgtcacaactctcaatgctgccccatctggcggaccttgtgtcctatagcattcagaaggtaatcggtttcgccaagatgataccaggatag

SEQ ID NO: 246680 - DNA, 306 bp, Artificial Sequence
  Description of Artificial Sequence: Synthetic coding sequence
atggaggcaatggccgctagtacatcactgccagatccaggtgactttgacagaaacgtgcccagaatatgtggcgtgtgcggagatcgcgctacaggcttccacttcaatgctatgacttgcgaagggtgcaaaggcttcttccggagaagcatgaagaggaaagccctgtttacttgcccctttaacggagactgtcggatcactaaagataatcggcgtcactgtcaggcttgtcgactgaaaaggtgcgtcgatattggcatgatgaaagagtttatactgaccgacgaagaagtacaatag

SEQ ID NO: 246681 - DNA, 1284 bp, Artificial Sequence
  Description of Artificial Sequence: Synthetic coding sequence
atggaggccatggccgcttcaacctctctgccagacccaggagacttcgaccgaaacgttccccgtatctgcggagtatgtggagacagagccaccggcttccattttaacgccatgacttgtgagggttgcaagggcttttttcgcagaagcatgaagcgtaaagcacttttcacatgtccatttaatggcgactgtcgtatcactaaagacaacaggaggcattgccaagcttgccggctgaagcggtgcgtggatatcggcatgatgaaggagttcatactcaccgacgaggaggtgcagaggaagagggagatgattctgaagcgcaaggaggaagaggcattaaaagactcacttcgccctaagctcagcgaggaacagcaaagaataatcgctatcctcttagacgctcaccataagacctacgacccaacatactctgacttttgccagtttaggccgccagtgcgggtgaatgacggagggggatcgcatccttctcggccaaactctcgccataccccctccttcagcggcgactcgtcatcctcatgctctgaccactgtatcacctcatccgatatgatggattcctcttcattcagtaatttagacctcagtgaggaggattccgatgatccaagcgtcacacttgaattgagccagctttccatgctgcctcatttggccgatttggtgagctacagtatccaaaaagtgattggcttcgcgaagatgatcccagggtttagggatttgacttcagaggatcagatcgtgctcctaaagtcttccgctattgaggttattatgctacgatctaatgagtcattcacaatggacgacatgagctggacctgcggcaatcaggactacaagtatagggtttcagatgttaccaaggccggacactctctcgaactcatcgagcctctcataaagtttcaagtgggcttgaagaagctgaacctacatgaggaagaacacgtgctcctcatggcaatttgtatcgtgtcccccgacagacccggagtccaggatgcagctctgattgaggccatccaggacaggttgagcaatacactgcagacgtacattaggtgtaggcatcctcctcccggaagtcacctgctgtacgccaaaatgattcagaagcttgcggatctccgaagcctgaacgaggagcactctaaacagtatcgctgtttatcatttcaaccagagtgcagtatgaagttaacccccttggtgctggaggtgttcggcaacgagatctcatag

SEQ ID NO: 246682 - DNA, 321 bp, Artificial Sequence
  Description of Artificial Sequence: Synthetic coding sequence
atggaggcgatggcagcctcaactagtctgcccgaccctggcgattttgatcggaacgttccacggatttgtggtgtttgcggcgatagagcgaccggatttcactttaacgccatgacctgtgaaggatgcaaaggattcttccggaggtctatgaagaggaaggctctattcacttgtccttttaacggtgactgtcggatcaccaaagataaccgtaggcattgccaggcgtgtcgtctgaaacgatgcgttgatatcggtatgatgaaagaattcattctcactgatgaagaggtccaaaggaagcgtgaaatgtag

SEQ ID NO: 246683 - DNA, 1434 bp, Artificial Sequence
  Description of Artificial Sequence: Synthetic coding sequence
atggagtggcgaaacaagaagcggtccgactggctgtctatggtcctgcggaccgccggtgttgaagaagctttcggatctgaggtgagtgtgaggccacacagaagggcacccttgggctccacttacctgccaccggcaccaagcggaatggaggctatggccgctagcacctctcttcccgatcccggtgatttcgatcgaaacgtgcctcggatctgcggagtgtgcggggatcgcgctacagggtttcattttaatgccatgacatgcgaggggtgcaaaggtttctttcgaaggtctatgaagcgaaaagcactgttcacgtgccccttcaatggagactgccggattaccaaagacaacaggagacactgccaggcctgtagactgaagagatgcgtggacatcggcatgatgaaggagttcatcctgacagacgaggaggttcagagaaagcgggagatgatcctgaagaggaaagaagaagaggccctgaaagattctttgcgcccaaagctttcggaagaacagcaaaggattatagccatattacttgatgcccaccacaaaacctacgaccctacctatagtgatttttgccaatttagaccacccgtgagagtgaatgacggcggtgggagtcatccctctaggccaaactccaggcacaccccctccttctcaggcgactcctcctcaagttgttctgaccattgtatcacgagtagcgatatgatggactcttcatccttcagtaatctggatctcagtgaagaggatagcgacgatccttccgtcactctggaattatctcagctctcaatgcttccccatctggcggacttggtgtcttattccattcagaaagtcattggcttcgccaaaatgattcctggcttcagagaccttaccagcgaagaccagatcgttctgcttaagtcatcagcgattgaagtgataatgctcagatctaatgagagctttactatggatgacatgtcttggacttgcggcaaccaggattataaataccgtgtgtctgatgtgactaaggcaggacattcactggagcttatagagccgctgattaaattccaggtaggtttgaagaagctcaacctacatgaggaagaacacgtgctgcttatggcaatttgcatcgtaagtccggatcgcccaggcgtacaggatgcagccctcatcgaagcgatccaggacagattgtcgaacaccttacaaacttatatacgctgcagacatccacctccgggaagccacctgttatatgccaagatgatacagaagcttgcagacctcaggtccttgaatgaagaacacagcaaacaataccgctgcctgagtttccagcccgaatgcagtatgaagttaacaccgctggtcctggaagtcttcggcaatgaaattagctag

SEQ ID NO: 246684 - DNA, 279 bp, Artificial Sequence
  Description of Artificial Sequence: Synthetic coding sequence
atgggctcgacctggggttcacccggttgggtccgacttgctttgtgtctaactggacttgtcctatctttgtacgcactccacgtgaaagcagccagagccagggatagggattaccgggctctatgcgatgtgggcaccgccatctcctgttcaagagtgttcagcagcagactccccgcagatactctgggcctgtgtcccgatgcagctgagctgccaggggtgtcccgatggttctgcttgccgggtctggaccccgtcttgagagcattatag

SEQ ID NO: 246685 - DNA, 492 bp, Artificial Sequence
  Description of Artificial Sequence: Synthetic coding sequence
atgggtagcacttgggggtctcccggttgggttcgcctcgccctgtgtctgaccggcctggtattgagtctctacgccttacacgttaaggcagccagggcaagggaccgcgattacagagccctgtgcgacgtagggacagctatctcgtgcagcagagtcttttcctcccgatggggcagaggttttgggttagtcgagcacgtcttggggcaggattcgatccttaaccagtccaactcaatattcggatgcattttctataccctccagctgctcctggggtgtctcaggaccaggtgggccagtgtcctgatgcttctgtccagcttggtctcgttggctgggtccgtgtacctcgcctggatccttttttttgtgctttatgacttctgcattgtgtgcattacaacgtacgccataaacgtgagcctgatgtggctctcattccgcaaggtgcaggagccccagggcaaggccaagagacactag

SEQ ID NO: 246686 - DNA, 5823 bp, Artificial Sequence
  Description of Artificial Sequence: Synthetic coding sequence
atgtcttctgacaccgaaatggaggttttcggaatcgccgcacccttcttgcgaaagtccgagaaagagcgcatagaggcccagaatcagcctttcgatgccaagacttattgctttgtagtggactctaaggaagagtacgccaagggaaaaatcaagagtagtcaggatgggaaggtgacagtggagacggaggacaataggaccctggtggtgaagccagaggatgtctatgccatgaatcccccaaagtttgatagaatcgaagacatggccatgctgactcacttaaacgaacccgcagtattgtacaacctgaaggacaggtacacatcatggatgatatatacctatagcgggctgttctgcgtcaccgtgaatccctacaagtggctgccagtctataaccccgaagtagtggagggctaccgcggtaagaagcgtcaagaagcgcctccacatatattttcgatctctgacaatgcttatcagtttatgctgaccgatagggaaaaccagagcattttgataactggtgagtctggcgcaggcaagactgtcaacacgaagcgtgtgatacagtattttgccactatcgcagctactggtgacttggctaaaaaaaaagattccaagatgaaaggcacattagaggaccagatcatctctgccaatccacttctggaagcattcggcaacgctaaaacagtgagaaatgataacagctctcggttcggcaagtttataagaatacatttcggaacgaccggaaagctggcatccgccgatatagaaacatacctcctggagaagtcccgggtgactttccagctcaaggcggagaggtcataccatatattctatcagattctcagtaacaagaagcccgagctgatcgaactcttgttgattaccacaaacccctacgattacccatttatcagccaaggcgaaatcctcgtggcatctatcgacgacgccgaggaactgctggccaccgactccgccatcgacattctgggatttacccctgaagaaaaatctggtctttacaagctcacaggggctgttatgcactacgggaatatgaagttcaaacagaaacaacgggaagaacaagcagaacccgatgggactgaggtggcagataagacagcctacctgatgggactcaactcgtcagaccttctgaaggccctctgttttcccagggtaaaggtgggtaatgaatacgtgaccaaggggcagacagtggatcaggttcaccatgctgttaacgccctcagcaagtcagtgtatgagaagctgttcctgtggatggtgactcggattaatcagcaactcgacaccaaacttccgagacagcattttatcggggtgttggacatcgcaggcttcgagatattcgaatacaatagcttagaacagctctgcatcaatttcaccaatgagaaactacaacagttttttaatcatcacatgtttgtgctcgaacaggaggaatataagaaagagggcatcgagtggacctttattgacttcggaatggaccttgccgcatgcatcgagctgattgaaaagccgatgggcatcttcagcattctggaggaagaatgcatgttcccaaaggccacggacaccagcttcaagaataagctgtacgatcagcacttgggcaagtctaacaactttcagaaacccaaagttgttaagggacgggctgaggcccacttttccctgatccattatgccggtacggttgactattctgttagtggatggctcgagaaaaacaaggaccccctgaacgagacggtcgtcggtctctaccagaaaagctccaataggctcctggcccacctctacgctacattcgccacagcagatgccgactccgggaaaaagaaggtcgcgaagaagaaagggagttctttccagaccgtttctgcactgtttcgagagaatctgaacaaacttatgtcaaacctgcgcacaactcatcctcatttcgtgagatgtataatcccaaatgaaacaaaaacccccggtgctatggagcacagccttgtgctgcaccagctacggtgtaatggagtacttgaggggataaggatctgtaggaaggggtttccgaataggatactgtacggtgactttaaacaacgctatcgggttctgaacgcctcagccatccctgagggccagtttattgattcaaagaaggcttgcgaaaaactcctggctagcattgatattgaccatactcaatacaagttcgggcacacgaaggtgttttttaaagccggattactgggcactctggaggaaatgagggatgatcgtttggccaaactgattacgcggacccaggctgtgtgtcgtggatttttgatgcgtgtcgagttccagaaaatggtacaacggagagaatccatcttttgtatccagtacaatataaggtcatttatgaacgtgaaacactggccatggatgaagctcttttttaaaattaaaccgttactgaagagcgcggaaactgagaaggaaatggcaactatgaaggaagaattccagaaaaccaaggacgagctggccaagtccgaggccaagcgcaaggagcttgaggaaaaactggtgactctggtgcaggagaagaacgatctccaactccaggtccaagctgaaagcgaaaaccttcttgacgccgaggaacgatgtgatcagctcattaaagcgaagttccaattggaggctaagattaaagaggtaactgaacgcgcagaggatgaggaggagatcaacgcagagctgaccgcgaagaaacgaaagctggaggacgaatgctctgaactcaaaaaggacatagatgaccttgaactcaccctcgctaaggtcgaaaaggaaaaacatgccactgaaaacaaagtgaagaatctgacagaggagctctcaggcctggatgagactatcgccaaacttactagagagaaaaaggctctacaggaagcccaccagcaggctctcgatgacttgcaggcggaggaagacaaggttaactctttaaacaaaaccaagagcaagttggagcagcaagtcgaggatctagagtcctctctggaacaggagaagaaactgcgcgttgatctggaacgcaacaaaagaaaactggaaggcgacttgaagttggctcaagaatccatcctggacttagagaatgataagcagcagttggatgagcgcctgaagaagaaggactttgagtactgtcaactgcagagtaaagttgaagatgagcagacattgggcctccagttccagaagaaaatcaaggagcttcaggcccgtatcgaagagctagaggaggaaattgaggcagaaagagctacacgagccaagaccgagaagcaaagatcagactacgccagagagttagaggaactgtcagagaggcttgaagaggccggaggcgtcaccagtacacaaatagaactcaacaaaaagcgggaggccgagttcctaaagttaaggcgcgatctggaggaggccacattacagcatgaagccatggtcgctgccctccgcaaaaagcacgcagattccgtagccgaactgggtgagcagatcgacaatcttcaacgcgtgaagcagaagctcgagaaggagaagtccgagttcaaactggagattgatgacctcagtagtagtatggagagcgtcagtaagagtaaggcgaatctggaaaagatctgtaggacattggaggatcagctgtcagaggctaggggcaagaacgaagagatccagaggagcctctccgagctcacaacacagaaatcacggctgcagaccgaagctggtgagttaagtagacagctcgaagagaaggagtctatagtgtctcaactctcacgcagcaaacaggcctttacccagcagaccgaggaactcaagaggcagttggaggaagagaataaagctaaaaacgcacttgctcacgctctccagtccagccgtcacgactgcgatttgctgcgagagcagtacgaggaggaacaggaagggaaggctgaactgcagcgcgcattgagtaaagcaaactctgaagtcgctcagtggaggacaaagtacgagacagatgccatccagaggacagaggaattggaagaggcaaaaaaaaaactggcccaacggttacaggatagcgaggagcaggtggaggccgtgaacgcgaagtgtgctagcctcgagaagactaagcagagacttcaaggcgaagtggaagatctgatggtcgatgtcgaacgggctaatagtttagctgcggctctggacaaaaaacagcgtaactttgataaggtcctggccgagtggaaaactaaatgcgaagagagccaggccgaactcgaggcctcactcaaggagtctcgctctctcagtacagagctatttaagctgaagaatgcttacgaagaggccctggatcagttagagaccgtcaagcgagagaacaagaacctcgaacaggagattgctgacttgaccgagcagattgcagagaacggtaaaaccatccacgagctcgaaaaatcacggaaacaaatcgagctggaaaaggccgacatacagctggccctggaagaagccgaagctgccctcgagcatgaagaagccaaaatcctgcggatccaactggaactgacgcaggtcaagtccgagatcgacagaaaaatcgccgagaaagacgaagaaattgaacagctgaaaaggaactaccagcggaccgtggaaacaatgcagagcgccctagacgcagaggtgcgctctcggaacgaagccatcaggctgaaaaagaagatggagggagatcttaatgaaattgaaatccagctctctcatgccaatagacaggccgctgaaaccctgaaacatctgaggagtgtgcagggacaactgaaggacacgcagttgcatctggatgatgccctacggggtcaggaggacctgaaggagcaactggctatagtggagcgcagggccaacctgctgcaggctgaagtagaagaacttagagcaactctggaacaaacggagagggcgaggaaacttgcagaacaggagctattggatagcaatgagagggtgcagctcctccacactcagaatacatctttaatccatacaaaaaaaaagctggaaactgaccttatgcaacttcagtccgaggtggaggatgcctcgcgggacgcccgaaatgcagaggaaaaggccaagaaagcaataaccgatgccgctatgatggcagaggagctgaaaaaagagcaggatacctctgcccacttggagcgaatgaaaaagaacctggagcagacagtgaaagatttacagcacaggctggatgaagctgagcaactggctctaaaaggtgggaaaaagcagatccaaaaactggagacgaggatcagagagctggagttcgagctggaaggcgaacaaaagaagaatacagagtcagtcaagggcctccgcaagtacgagagacgggtgaaagaactgacgtaccaatctgaagaggaccgcaaaaatgtgctaaggctgcaggacctcgtggataagctgcaggtgaaagttaaaagctacaagaggcaggcggaagaagcagatgaacaagcaaatgcacatttgacaaagtttagaaaggcccagcatgagctcgaggaggctgaagaaagagctgacatcgcagaaagccaggtgaacaagctccgcgctaagacaagagactttacatcgtcacgcatggtggtgcacgagtccgaagagtag

SEQ ID NO: 246687 - DNA, 357 bp, Artificial Sequence
  Description of Artificial Sequence: Synthetic coding sequence
atggcaccactcaggcctttgctgattctggccctcctggcttgggttgccctggccgaccaggagagctgcaaagggagatgcacagagggcttcaacgtggacaaaaagtgccagtgtgatgagctctgcagctactatcagagctgttgcaccgattatactgcggaatgtaaaccccaggtgacacgcggtgacgtcttcactatgcccgaagacgagtacaccgtttatgacgatggggaggagaagaacaacgccacggttcacgaacaggtggggggaccctccctgaccagtgatctgcaagcacagagcaaggggaatcctgaacagactcccgtcttaaagccatag

SEQ ID NO: 246688 - DNA, 495 bp, Artificial Sequence
  Description of Artificial Sequence: Synthetic coding sequence
atgagtgtcgaccctttgagttctaaggccttaaagatcaaacgagagctgagtgagaacaccccacacctttctgatgaagccctaatgggtctctccgtccgcgaactcaaccgtcacctaaggggcctatccgcagaggaggttacccgcttgaaacaacgcaggagaacgctgaagaatagaggctacgctgcttcgtgtcgcgtgaagcgcgtctgccagaaggaagaactacaaaagcagaaatctgaactcgagcgcgaggtggacaagctcgcgcgtgaaaatgcggctatgaggctcgagctcgatgcactgcgtgggaaatgtgaagctttgcagggtttcgctcggtcagtcgctgcagccagaggtccggctaccctcgtggcgcctgctagcgtgattaccatcgtgaagtctacgcccggaagtgggtctggaccagcgcatggcccagacccagctcacggccctgctagctgcagttag

SEQ ID NO: 246689 - DNA, 495 bp, Artificial Sequence
  Description of Artificial Sequence: Synthetic coding sequence
atgtctgtggatcctctctcttcaaaagctctgaaaattaaacgcgagcttagtgaaaacacgccccacttgagcgacgaagccctcatgggcctgtccgtacgagagctcaatcggcacctaagaggcctgagcgcagaggaagtcaccagactcaaacagcggcgaagaacactgaagaatcggggatatgccgctagttgcagagtgaagcgggtttgtcagaaggaggaactccaaaaacagaaaagcgagctggaacgggaagtcgataagctggcacgggaaaacgcggcaatgagactggaactcgacgctcttcggggaaaatgtgaggctcttcaaggctttgcccgaagcgtagcagccgctcgcggtcctgctactctggtggcacctgcatccgttatcactatcgtgaagtcaactccaggaagtgggagcgggcctgcgcatggcccagatccagcccacggccctgcctcctgctcctag

SEQ ID NO: 246690 - DNA, 381 bp, Artificial Sequence
  Description of Artificial Sequence: Synthetic coding sequence
atgtctgtggaccccctgtcatcaaaggccctgaagattaagcgagaattatccgagaataccccccacttaagtgacgaagctctgatgggactcagcgtacgtgagctgaatagacatttgcgtgggctttcagcagaggaggttacgcgcctgaaacagcggagacggaccctgaagaatagaggctatgccgcttcatgccgggtcaaacgtgtatgccagaaggaagagctgcaaaagcagaaatcggagttggaacgcgaagttgacaaactggctcgagagaacgccgctatgaggttggaactcgacgctctgcggggaaaatgcgaagctctccaggggtttgccaggagcgttgcggcagcacggggttag

SEQ ID NO: 246691 - DNA, 495 bp, Artificial Sequence
  Description of Artificial Sequence: Synthetic coding sequence
atgtctgtagatcccctttcctcaaaagccttgaagattaaacgcgaattgagcgagaatacacctcacttgtctgacgaggccctgatggggctgtctgtacgggagcttaatcgacacctgcggggactctctgctgaggaggtgacccgactgaagcagcggagacggactctgaagaaccggggatatgccgcatcctgtcgggtaaaaagagtgtgtcaaaaggaagaattacagaagcagaagagcgaacttgaacgggaagtggacaaacttgcacgagaaaacgcggctatgagactggaattggacgctctgaggggtaagtgtgaagctttgcagggctttgcgagatccgtcgctgccgctcggggacccgctactctagtggcaccggcttccgtgatcacaattgtcaagtcaacgccaggatctggctcgggcccagcgcatggcccagaccccgcacacggccctgcttcctgttcttag

SEQ ID NO: 246692 - DNA, 282 bp, Artificial Sequence
  Description of Artificial Sequence: Synthetic coding sequence
atgggcctgtccgtgcgcgagttgaaccgacacctaagaggtctgtctgccgaagaggtcacccgacttaagcagcgcaggagaactctcaagaatcggggatacgccgcttcgtgtcgcgtgaaacgggtgtgccagaaggaagagttgcagaagcagaagtctgaactcgagcgcgaggtcgataagctcgccagagagaacgctgcaatgcgcttagagttggacgcactcaggggcaagtgcgaagcactgcagggcttcgccagatccgtggcctag

SEQ ID NO: 246693 - DNA, 495 bp, Artificial Sequence
  Description of Artificial Sequence: Synthetic coding sequence
atgtcagtcgaccccttatcgagtaaagcattaaagattaagcgggagctgagtgagaacactccgcacttatcggatgaggccctaatggggctgtctgtccgagaactcaatcggcacctccgcggactgagcgcagaagaagtgacaaggcttaaacaaagaagaagaacccttaagaaccgcggatacgcggcatcttgccgcgtgaaacgtgtgtgccaaaaggaggagctacagaaacagaaatctgaacttgagcgcgaagtggataagcttgccagggagaacgcagccatgcgtttggaattagacgcactgcggggtaagtgtgaagcgctgcaggggtttgccaggagcgtagccgcagcgagggggccagctaccctcgtggcccctgccagtgtgatcactattgttaagtctacgcctggctctggctctggccctgcccatggccctgaccccgcacacggccctgccagttgctcatag

SEQ ID NO: 246694 - DNA, 408 bp, Artificial Sequence
  Description of Artificial Sequence: Synthetic coding sequence
atggggctctccgttagagagctcaacaggcatcttcgcggactcagtgcggaggaagttacacgtttgaagcagcgtcgccgaaccctgaagaaccgtggttacgccgcatcctgccgagtgaagagggtgtgtcagaaggaagagctccaaaagcaaaaaagtgagttagagcgggaagtggacaagctcgcaagagagaatgccgcaatgagactagaactggatgcccttagagggaagtgcgaggctttgcagggcttcgctcggagcgtggcagcagcacgtgggcctgcaacccttgtcgcccctgccagcgtgattaccatagtaaagagcacgcctggttcagggagcggcccagcgcatggacccgaccccgcacacggcccagcctcttgctcatag

SEQ ID NO: 246695 - DNA, 489 bp, Artificial Sequence
  Description of Artificial Sequence: Synthetic coding sequence
atgactacacctaataagggcaataaagccctcaaagtcaaaagagaaccgggagagaacggcaccagcttaaccgacgaggaactcgtgacaatgagtgtccgtgaactaaaccagcatttgagggggctatctaaggaggaaattgttcagctgaagcaaaggaggcgcacactcaagaataggggctatgcagcatcgtgcagggttaagcgcgtaacgcagaaggaggaactggaaaagcagaaggcagaattgcagcaggaggtcgaaaagcttgccagtgagaatgctagcatgaaactggagctagacgcactaagaagtaaatatgaggccctgcagacttttgctagaaccgtggcgcgatccccagtagcccctgctcggggtccactggccgctggtcttggccctctggtgccaggtaaggtcgcggcaaccagcgtgataacgatagtcaagagcaaaaccgacgcacggagctag

SEQ ID NO: 246696 - DNA, 489 bp, Artificial Sequence
  Description of Artificial Sequence: Synthetic coding sequence
atgactacgcctaataagggaaataaggcactgaaggttaaaagggagcctggggagaatggcaccagtctgacagacgaagagctggtgactatgtctgtgagggagttgaatcagcatctccgcggtttgagcaaagaggagatagttcagctaaaacagaggcgaagaacactaaaaaatagaggctacgcggcatcgtgccgcgttaaacgtgtgacacagaaggaggagctggagaagcagaaggccgaactgcagcaagaggtagaaaagttggctagtgaaaatgcaagtatgaaacttgagttggacgccctccgttctaaatatgaggcacttcagacctttgccaggaccgtcgcaagaagccccgttgccccagctagggggcctctcgccgcaggcctgggccctctggtgccaggaaaggtggctgcaacgtcagtgatcacaattgtgaaatcaaaaacagacgccaggtcctag

SEQ ID NO: 246697 - DNA, 471 bp, Artificial Sequence
  Description of Artificial Sequence: Synthetic coding sequence
atgacaacaaatccgaaaccaaataaagcactcaaggtgaaaaaggaggccggtgaaaatgccccagtcctgagtgacgatgagttagtctccatgagtgttagggagctaaaccagcacctgcggggactcacaaaggaagaggtcactcgcctgaagcagcgccgaagaacacttaaaaatcggggttacgcagcgtcgtgtagaatcaaaagagttacacagaaagaggaattagagcgccaacgagtggagctgcagcaagaggttgaaaaacttgctagagagaacagctccatgcggctcgaactggatgcgctgagatccaaatacgaggcattgcagacattcgcccgaaccgtcgccagaggaccggtcgcgccaagcaaggtggctaccacttcggtgatcacaatagtcaaatctacggaattatccagcacatctgtaccattctccgctgccagttag

SEQ ID NO: 246698 - DNA, 471 bp, Artificial Sequence
  Description of Artificial Sequence: Synthetic coding sequence
atgacgacaaaccctaaacctaataaggccctgaaagtgaaaaaggaggctggcgagaacgcacccgtcttgagtgatgatgagctggtctctatgtctgtcagagagctgaaccagcatttacgaggtctcacaaaggaggaggtcacccggttgaagcagcggagaaggacactgaagaatcgtgggtacgcagcatcttgtaggatcaagcgcgttactcagaaagaagaattggagcgacagcgcgttgaattgcagcaggaggtggaaaagttagcccgagagaacagtagcatgcggctcgaattagacgcactgagaagcaaatacgaagccctacaaaccttcgccaggaccgtggccaggggccctgtggccccatctaaggtggccaccacttcagttataacaattgtgaagtccactgagctttcatctacgagtgtgccattttccgctgcttcttag

SEQ ID NO: 246699 - DNA, 471 bp, Artificial Sequence
  Description of Artificial Sequence: Synthetic coding sequence
atgacaacaaatcctaagcctaacaaggctctcaaagttaagaaggaagcaggcgagaacgcgccagtgttaagtgacgacgagctggtctctatgagtgtccgggagttgaaccagcacctccggggtcttaccaaagaggaagtcaccaggctgaaacagcgacgcaggacattaaagaaccgaggctacgccgcaagttgccgtattaagcgtgtgacccaaaaggaagagctggagaggcagcgcgtggaactccagcaggaggtggagaaactggcccgagagaactcttctatgaggttggagttagatgcattgagatctaagtatgaggcactgcagacctttgcccgaactgtcgcacggggacccgtggcaccatctaaagtcgccacaacatctgttatcaccattgtgaagtcgacagaactgtcctccaccagcgtccccttttccgcggcttcatag

SEQ ID NO: 246700 - DNA, 1041 bp, Artificial Sequence
  Description of Artificial Sequence: Synthetic coding sequence
atgccctctccgctagcgctaagaccatatctgcggtccgaatttagccctagcgtggacgctcgcccttgctcctctcctagtgagctcccagcgaaattgttactgggcgctactttaccgcgagccccacgcctgcctcgtagacttgcttggtgctctattgattgggaacaagtgtgcctcttacagcggctgggagctgggggatttggaagcgtctataaagcgacctacagaggtgtgccagtggccataaaacaggtcaataagtgcaccaagaatagactggcttctcgcaggagtttctgggccgaacttaacgtggcaagattaagacatgacaacatcgtaagggtggttgccgcttcaacacgaactccggctgggtcaaacagcctgggcaccattattatggaattcggcggaaatgttaccctccaccaggttatttacggggctgccggtcacccagagggtgacgccggagaacctcactgtagaactggcggacaactctccctgggaaagtgcctgaagtactccctggacgtcgtgaacggtctgctgttcctacatagccagtccatcgttcatttggacctcaagcctgccaacattctcatttccgagcaagacgtgtgcaaaataagtgactttggctgctcggagaagctggaagatctactgtgctttcaaactcccagttaccccctgggagggacgtacacacacagagctccagaactgcttaagggcgaaggagtcacacctaaggctgatatctactcttttgccatcactctgtggcagatgacaacaaagcaagctccatactcaggtgagagacagcatattctgtacgcagtggtggcctacgatctgcgcccaagcctcagcgccgcagtttttgaggatagtctgccaggtcagagactgggtgatgtgatacagcggtgctggcgtccctctgcagcacaaagaccatccgccagactgctgttagtggacctgacaagtctgaaagctgaacttggttag

SEQ ID NO: 246701 - DNA, 1839 bp, Artificial Sequence
  Description of Artificial Sequence: Synthetic coding sequence
atggcgcgtcgaccgcgtcacagtatctacagttcagatgaagatgacgaagacttcgagatgtgcgaccacgactacgacggactgcttcccaagtccggcaaaagacacctcggcaaaacccgctggacccgagaagaagacgagaaactgaaaaaattggtcgagcagaacggcactgatgactggaaggtcattgccaattaccttccaaatcgtactgacgtgcagtgccagcatagatggcagaaggtccttaatccggagctcataaaaggtccgtggactaaggaagaagaccagcgagtaattgagctggtgcagaaatacggccctaaacgctggtccgtgattgcaaagcacttgaaaggcaggattgggaaacagtgtcgggagagatggcacaatcacttgaatcctgaagtaaaaaagacctcttggaccgaggaggaagatagaatcatatatcaggcccataagcggttgggtaatcgttgggccgaaattgcaaaactgctgccgggtcgtacggataatgccattaagaatcactggaactctactatgcgcagaaaagtggagcaggaagggtatctgcaggagtcgtcaaaagctagccagcctgccgtggccacctccttccagaagaactctcaccttatgggttttgcccaggcccctcccacagctcaacttcccgctacagggcagcccactgtcaacaatgattacagctattatcacatatcagaggcccaaaatgtgtcctcccacgtgccttacccagtggccctgcatgttaatattgtcaacgtgcctcagccagcggctgccgctatccagaggcactacaacgatgaggaccccgagaaagagaaacgaatcaaggagctcgagttactgctgatgagcacggagaatgagctgaaggggcaacaggtgctgcctactcagaatcatacatgctcttatccaggttggcattccacaaccatagcggaccatacccgcccacatggggattccgccccagtgtcctgtctcggcgagcaccattccactcctagcctcccagccgacccaggttccttacctgaggagtccgcttcaccagcacggtgcatgatagtgcaccaaggcactatcttggacaacgtcaaaaacctgctcgagtttgccgaaaccctgcagtttatcgacagctttctgaataccagcagtaaccacgaaaattcagacctggaaatgccttcattaaccagtacacctctgataggccacaaattgacagtgaccaccccatttcatagggatcaaaccgtgaaaacacagaaggagaatacagtgttccggacgcccgcaatcaaacgatctatactcgaatcctctcctcgcacccccaccccgtttaaacacgctctggccgctcaggaaatcaaatatggcccactcaaaatgctcccacagacgccctcccacctcgtggaggacctgcaggacgttattaagcaggaaagtgacgagtcagggattgtcgcagagttccaggaaaatggccctcctctgctcaaaaagatcaaacaggaagtcgaaagcccaacagacaaatcggggaactttttttgctcacatcattgggaaggggacagtctgaatacacagctgtttactcagacctcccctgtggctgatgctcctaatatattgacttcgtccgtactgatggctcccgcttccgaggacgaggataacgtgctgaaggccttcacagtgcctaagaatcggtccctcgcttcccccctgcaggcaaccaaggcccaaaggctatttcaattttag

SEQ ID NO: 246702 - DNA, 2181 bp, Artificial Sequence
  Description of Artificial Sequence: Synthetic coding sequence
atggccagacgcccaaggcactcaatttactcatccgacgaagatgacgaagattttgaaatgtgtgatcacgactatgacggcctgctcccgaagagtggaaagagacatctgggcaagacaaggtggacaagagaagaggacgagaaactgaaaaaactggtggaacagaacgggaccgatgactggaaggtcattgccaactacttacctaatcgtactgacgtccagtgccagcaccggtggcagaaggtgctgaacccggagctaattaaaggtccatggaccaaggaagaggatcagcgcgttatcgagcttgtgcaaaaatacggtccgaagagatggagcgtcattgcaaaacatcttaagggccgtattgggaaacagtgcagagaacgatggcacaaccatttaaacccagaggtcaaaaaaacatcctggacggaagaagaggatcgcataatctaccaggctcataaacgtctgggtaataggtgggcagagatcgctaagctgcttccaggacggaccgataatgctatcaaaaaccactggaacagtacaatgaggcggaaagtggaacaggagggttatttacaggaatcgagcaaggccagtcagcccgctgtggctactagcttccagaagaatagtcacctgatgggctttgcccaggccccacccacggcccagctccccgctaccggccagccaaccgtgaataatgattactcctactaccacatctccgaggcacaaaatgtttcatcacacgtaccctatccagtagctttgcacgttaacatcgtgaacgttccacagcccgctgccgctgccatccagcggcactataatgatgaagacccagaaaaagagaagaggatcaaggagttagagctccttctcatgtctacagagaacgagctaaaaggccagcaggtactgccaacacaaaatcatacttgcagctaccccggttggcattctactactattgcagatcacacccgtcctcatggcgactccgctccggtgtcctgcctgggggagcaccatagtacgccctctctgcccgctgacccaggctctctgccagaggagtccgccagcccagcgagatgcatgattgtgcatcagggtaccattctggataacgttaagaacctgctcgagtttgccgaaaccctgcagtttattgattcatttttgaacaccagctcgaaccacgaaaatagcgatctcgaaatgcccagtctgacctccacccccttgatcggacataaactgacagtcaccaccccattccaccgcgaccagaccgtgaaaacccagaaagagaataccgtcttcaggacccccgctattaaaaggtcaatcctagaaagctcccctcgcacaccgacccctttcaagcacgcccttgccgctcaggaaatcaagtacggcccactgaagatgttgccgcagactccctcgcatttagttgaagacctacaggatgtgattaaacaggaatcagacgagtccggtatagtagccgaatttcaggaaaacggtcctcctctactgaagaaaattaagcaagaagttgaatcccctaccgataaaagcggaaactttttctgtagccatcattgggagggagattcccttaacacacaactgtttactcagacttcccccgtcgccgacgcgcctacaggagtccaatggcacgactttggctcccttcagccactgccaccaggttttaagaggttttcatgtttatcactgccaagaagctgggattacaggcacccacccccaaggccagcaaatttcgagttcctggtggagactgggttcctgcatgtcggccaggcgggactggagctgctcacaagcggtgacctcccagcgtcagccagccagtccgctaggatcacaggagtgtcacatcgcgcacgtcccgataatatccttacctcctcagtcctgatggcgcctgcatccgaagatgaggacaatgtcctcaaagcctttactgtgcctaaaaataggtcgcttgcttccccattgcagccgtgtagctccacctgggaaccggctagctgcggaaagatggaggaacagatgacctcctcctcccaagcaagaaagtacgtcaacgcattctccgcgagaacattggttatgtag

SEQ ID NO: 246703 - DNA, 2286 bp, Artificial Sequence
  Description of Artificial Sequence: Synthetic coding sequence
atggcccgtcggcctcgacattcaatatatagtagcgacgaggacgatgaagacttcgaaatgtgcgaccacgattacgacggcttactccccaaaagtggcaagcggcacctcgggaagaccagatggaccagagaggaagacgagaaattaaagaagctggtggaacagaacggcacagacgactggaaagtgattgccaattatctgccgaatagaactgacgtgcaatgccagcaccgctggcagaaagtcctaaacccagaactgataaaagggccttggacaaaagaggaagatcaacgggtgatcgaattggtccagaagtatggtcctaagaggtggagtgtcattgcaaaacatctgaaaggacgcatcggaaagcagtgtcgcgagaggtggcacaaccacctgaaccctgaagtcaagaaaacttcctggacagaagaggaagaccgaattatttaccaggcccataagagactgggaaaccgctgggcagaaatcgcaaaacttctgcccggtcggaccgacaacgccatcaagaatcactggaattcaacaatgcggaggaaagtagagcaggagggttatttgcaggaatcctcaaaggcttctcaacctgctgttgccacttcattccagaaaaattctcatctgatgggattcgcgcaggcaccaccaaccgctcagctgccagccactggccagcccacagtcaacaatgactactcctactatcacatctccgaagctcagaacgtgagtagccacgtcccgtatcccgtggcgcttcacgtgaatatcgtgaacgttccacagccagctgctgctgccatacagcggcattacaacgacgaagatcctgagaaagagaaacggattaaagagttagagctgcttcttatgtctaccgagaacgagttaaagggacagcaggtgctgccaacacagaaccatacatgcagctaccccggttggcactccaccacaatcgcagatcacaccaggcctcacggtgactctgccccagtgagttgcctgggcgagcatcacagcacaccaagtctcccggcagaccccggaagcctgcctgaggagtccgctagccccgcacggtgcatgatcgtccatcaggggaccatcctggataatgttaagaacctgctggagtttgccgagacattgcaatttatagattctgattcatcctcctggtgtgacctatctagttttgaattttttgaagaggcagacttctccccaagtcagcaccatactggcaaggcattgcagctacagcagcgcgaaggaaacggtactaagcccgctggcgagccatctcctcgtgtaaacaagcgcatgctgtcagaaagcagtctcgatcctcccaaagtcctgccgcctgcccgacacagcaccatcccattggtgatcctgcgcaagaagagaggacaggctagtccacttgccacgggagattgttctagcttcatctttgccgacgtgtcctcatctacccctaagagatcacccgttaagtctttacccttctccccctcacagtttttgaacacatctagcaatcacgagaactccgacttggagatgccttcactgacctctactccactgatcggacataagctgacagtgacaaccccctttcatagggatcagacggtgaaaacacagaaagagaacactgtgtttagaacccccgcaattaaacgatcaattctggagagctctcccaggactcccaccccctttaagcacgccctggcagcccaggagattaaatacggccctctaaagatgctgccccaaactccttcccatttggttgaggatcttcaggatgtgataaagcaagagtccgatgaaagtggcattgtcgctgaattccaggaaaatggcccaccactcttaaaaaagataaaacaggaggtcgaaagccccaccgacaagtccgggaatttcttctgtagccaccactgggaaggcgacagtctaaatacccagttgttcactcagacctcacctgtcgcggacgcaccaaacattctaacgtctagtgttttgatggcccctgcttccgaggacgaggacaatgtacttaaggccttcaccgtccctaaaaacaggtcactggcctcacccttgcagccatgttcgtcaacttgggaacccgcatcctgcggcaagatggaggagcagatgacaagtagctcacaggctaggaaatatgtcaatgccttcagcgctaggaccttggtgatgtag

SEQ ID NO: 246704 - DNA, 1923 bp, Artificial Sequence
  Description of Artificial Sequence: Synthetic coding sequence
atggcccgaagacccagacactcgatatacagttctgatgaagacgatgaggacttcgagatgtgtgaccacgattacgacggtctcctgccgaagtccggaaagaggcaccttggcaaaacacggtggaccagagaggaggatgagaagttgaaaaaattggtagagcagaacggtaccgatgactggaaagttattgccaactatctaccaaacaggaccgacgtacagtgtcaacaccggtggcagaaggtcctcaacccggagctgatcaagggcccttggacaaaggaggaggaccagcgcgtgattgaactcgtccaaaaatatgggcctaaaaggtggtctgtgattgcgaagcacctcaaaggtcgtatagggaagcagtgtagggagcgatggcacaatcacttaaacccagaggttaagaaaacttcatggacggaggaggaggaccggatcatctatcaggcacacaaacggcttgggaacagatgggcagaaatcgcaaagttgctccccggaagaactgacaatgccataaaaaaccactggaatagcaccatgaggagaaaggtggaacaggagggatacctgcaggagagcagtaaggcgtctcaaccagccgtggctacatcgttccagaagaatagccacttgatgggatttgcccaagcgccacctaccgctcagctccctgctactggccaaccaacagtgaacaacgactattcctattatcatatcagcgaggcgcagaatgtttcatctcacgtgccttatcctgttgcactgcacgtgaacattgtgaacgtgccacagcctgctgccgctgccatccagcgtcactacaatgatgaggacccagagaaagagaaacgcattaaagagttagagctgctgttgatgtcgaccgagaacgagctgaagggtcagcaggtactgcctacccagaatcacacttgttcctatcctgggtggcattccaccactattgccgatcacacccgaccacacggggatagtgctcccgtttcatgcctcggggagcaccattctacacccagcctgcccgctgatccaggctctctccctgaagagagcgcttccccagcgaggtgtatgattgtgcatcagggtactattctcgacaatgtcaaaaatctgcttgagttcgcagagaccctacagttcattgactctttcctgaacactagtagtaaccatgagaacagcgatttggagatgccctccctcaccagcacccctctcatagggcacaagttaacagttaccactccatttcacagagatcaaacagttaaaacccagaaagaaaatactgtgtttcgaacgcccgctattaagaggagcattttggagagcagtccacgcacacctacacctttcaagcacgctttggcagcgcaggagattaagtatgggccacttaaaatgctaccgcagactccgtcccatcttgtagaagacttacaggacgtgattaagcaagaaagcgatgaaagtggaattgtagcagagttccaggagaatggccctcccctcctcaagaagattaagcaggaagtggaatcccctacagataaaagtggcaactttttctgctcccaccattgggagggggactcactgaatacacagctctttacccagacatcaccagtggcagatgccccaaacattcttacaagcagtgtcctgatggcccctgcctctgaggatgaagataacgttttgaaggcctttacagttcccaaaaaccggtccctggcaagtccgctccagccctgcagctcaacttgggagccagcttcgtgcggtaagatggaagagcagatgactagctcttcccaggccagaaaatatgtaaacgccttctccgcccgaactctggttatgtag

SEQ ID NO: 246705 - DNA, 1914 bp, Artificial Sequence
  Description of Artificial Sequence: Synthetic coding sequence
atggccagaagaccccgacatagcatctacagctccgatgaagatgacgaagatttcgaaatgtgcgatcatgactatgatggactgctccccaagtctggtaagcgacacttaggcaagaccaggtggactagggaagaggatgaaaaacttaaaaagcttgttgaacagaatggcaccgacgactggaaggtgatcgccaattacttaccgaacagaacggatgttcagtgccagcatcgctggcaaaaggtgcttaacccggaattgataaaaggaccctggacaaaagaagaggaccaaagggttatcgagcttgttcaaaagtatggtcccaagcggtggtctgtgatcgccaaacatctcaagggccgtattggtaaacagtgcagggagcggtggcacaatcacctcaaccccgaagttaaaaagaccagttggacagaagaagaggacaggataatttatcaagcccataagcgacttggaaaccgttgggcagaaatcgccaaattgcttcccggtaggaccgataacgcaataaaaaaccactggaacagtacaatgcgtcgtaaggtggaacaggaagggtacctccaggagagttctaaagcgagccaaccggcagtagccacctcttttcagaagaacagtcatttgatgggattcgctcaggcgccaccaaccgcgcagctccctgccaccggtcagcctacggtaaacaatgactattcatattaccatatttcagaggctcagaatgtcagttcacacgtgccataccccgtggctctgcacgttaacattgtgaatgttccacagcctgcagcagccgctatccagcgtcattacaacgacgaggaccccgagaaggagaagagaattaaggaactggaattgctactgatgtctaccgaaaacgaactgaaaggccagcagacgcagaaccacacctgctcatatcccggttggcatagcaccacaatagccgaccacaccagacctcacggcgacagtgctcctgttagctgcttaggcgagcatcacagcacgccctccctcccagctgatccaggtagtctccccgaggagtcggcgtctcctgcgcgatgcatgattgtgcaccaaggcaccatcttggacaatgtcaagaacctgttagaattcgccgagacactccagtttatagactcattcttaaacacatcaagtaatcatgaaaactccgatctcgagatgccctctctgacttcaacccccttaatcggacataagctcactgtgaccacgcccttccacagggaccaaaccgtcaagacccagaaggaaaacacggtttttcgtaccccagccatcaaacgctctatcttggagtcctccccgcgtacccccacgccatttaagcacgccctggccgctcaggaaattaaatacggaccactgaagatgttgccacagacaccttcacatttggtggaggacctgcaggatgtgattaagcaagaatccgatgagtctggcatcgtcgccgaatttcaggaaaacggacctccactgctcaaaaagattaagcaggaagtggaatcacccaccgacaagtctggaaatttcttctgtagccaccactgggagggagactcattgaacacccagttgtttacacagactagccccgtcgctgatgctcctaacatccttacctcaagcgtcctcatggccccagccagtgaagatgaggacaatgttcttaaggctttcaccgtacctaagaataggtcgctagcttcccccctgcaaccctgttcctcgacttgggagccggcatcctgtggcaaaatggaagagcaaatgacaagctcttctcaggcaagaaagtacgtcaacgccttttctgccaggacactcgtgatgtag

SEQ ID NO: 246706 - DNA, 240 bp, Artificial Sequence
  Description of Artificial Sequence: Synthetic coding sequence
atggctaggagaccacggcattctatttactctagtgatgaggatgacgaggattttgagatgtgtgatcacgactatgatggactgttgccgaagtcagggaagcgccatctgggaaagacacgctggactagagaagagaataggacagacgtgcaatgccagcaccgatggcagaaagtgttaaaccccgagctgatcaaggggccatggaccaaagaggaggaccagcgaaattag

SEQ ID NO: 246707 - DNA, 312 bp, Artificial Sequence
  Description of Artificial Sequence: Synthetic coding sequence
atggccaggcggccacgccactcaatctacagctcagacgaggacgacgaggacttcgagatgtgcgatcatgactacgacggcttgctccccaagagcggcaaaagacatctcgggaaaaccaggtggacccgagaggaggatgaaaagcttaagaaactggtggagcaaaatggaacagatgattggaaggtgattgccaactacttacctaacaggactgatgtccaatgtcagcacagatggcagaaggttttgaaccccgagctcatcaagggcccttggacgaaggaagaggaccagcgaaactag

SEQ ID NO: 246708 - DNA, 1818 bp, Artificial Sequence
  Description of Artificial Sequence: Synthetic coding sequence
atggccagacgaccacggcacagtatctatagctctgacgaggacgatgaagacttcgaaatgtgtgaccacgactatgatgggttactacccaaatctgggaagagacacctgggcaagactagatggacacgggaagaagatgagaagctgaagaaactggttgagcaaaacggtaccgacgactggaaggtgattgccaattacctacccaacagaaccgatgtacagtgccagcacaggtggcaaaaagttttaaatcccgagctcatcaaagggccatggaccaaggaagaggaccagagagtgatcgagctggtgcagaagtacggacccaaaagatggagtgtgatagcaaaacacctgaagggtaggatcgggaagcagtgccgtgaacgttggcacaatcacctgaatcccgaggtcaagaaaactagctggactgaagaggaagatcggatcatatatcaggcccataagcgcctggggaacagatgggccgaaattgccaagctcttgccagggcgtaccgacaacgccatcaagaaccactggaattcaaccatgcgaaggaaggtcgagcaagaaggctatctgcaggaatctagtaaagcaagccagccagctgtggccacatcttttcagaagaacagccatctgatgggattcgcccaggctccgcctactgcccagcttccagccaccggtcagcccacagtgaacaatgactactcctactaccatatatccgaagctcagaatgtttcatctcacgtgccttatcccgtcgccctgcacgtgaatattgtgaatgttccccagccagcagctgctgctatccaaacccagaaccacacatgcagctatccaggttggcactccaccacaatcgccgatcacacgcgcccacacggagacagtgcacccgtaagctgtttgggtgagcatcacagcacaccatcactaccagctgacccaggttccttgcccgaggaatctgctagcccagccagatgtatgatcgtgcatcagggcacgattctggacaacgttaagaatcttcttgaatttgcagaaacattacaatttattgacagcttcctgaacacatcaagtaatcacgagaattcagaccttgagatgccttcactcaccagcaccccattaatcggtcacaaactgacagtgactactcccttccaccgtgatcagactgtgaagactcaaaaggaaaacacggtgttccggactcctgccataaaacggtcgatccttgaaagctccccaaggaccccaactccatttaaacacgccctggccgcacaggagataaaatacggccctcttaaaatgctgcctcagacacctagtcatctcgtagaagaccttcaggacgtgatcaaacaggagagcgacgaatccggaattgttgctgaatttcaagagaacggccctcctctgctgaaaaagattaaacaagaggtggaaagtcccacagacaagtctggcaatttcttttgcagccatcattgggagggggattctctcaacacacagcttttcactcaaacatccccagtagcagatgcgcctaacattctgacatctagtgtactcatggcacctgcctctgaggatgaggacaacgtgcttaaagcctttaccgtccctaaaaatcgttcactggcttccccattacagccatgctccagtacttgggagcccgcttcctgtgggaagatggaggagcagatgacctcatcatctcaggccagaaagtatgtcaacgccttttctgccagaaccctagtaatgtag

SEQ ID NO: 246709 - DNA, 717 bp, Artificial Sequence
  Description of Artificial Sequence: Synthetic coding sequence
atgctgacaaccttgctgccaattctgttgctctccgggtgggctttctgtagccaagacgcttccgacgggctccagagattgcatatgttgcagatttcctatttcagggatccctatcatgtgtggtaccaggggaacgcgtctcttgggggtcatcttacccacgtgcttgagggccctgacactaacaccacgattattcagcttcagccattgcaggagccagagtcttgggccagaacccagagcggtctgcagagctatcttctccagtttcatgggctggtacggcttgtccaccaggaacggaccttggcctttcctctcaccatccgttgtttcctgggctgtgagctgccacccgaggggtcaagggcacacgtgttcttcgaggtcgccgtgaacggatcaagctttgtgtcctttcgtcctgagcgcgcactgtggcaagcagacactcaagtgacgtccggggtggtcacgttcactcttcagcagctgaacgcctacaatcggaccagatacgaactgcgagagttccttgaagacacgtgcgtgcagtatgtccagaaacacatctcagctgagaatactaaagggtcacagacttcccgctcttacacgtccttggtcctgggtgtgcttgttgggagttttatcatcgctggggtggctgtaggtatattcctgtgtaccggaggtcgcagatgctag

SEQ ID NO: 246710 - DNA, 2031 bp, Artificial Sequence
  Description of Artificial Sequence: Synthetic coding sequence
atgtcaaggcgtactcggtgcgaggacttggacgagctgcattaccaagacacagattctgatgtgcccgagcagagggattccaagtgcaaggtgaagtggacccacgaagaaaatcgtactgatcagcaatgccagtacagatggttgcgcgttctgaaccccgacctggtaaagggcccttggaccaaagaggaggaccagaaggtcattgagctggtaaaaaagtatgggaccaagcaatggaccctgatcgctaagcacctgaaaggcaggctgggcaagcagtgccgcgagagatggcacaaccacctgaaccccgaggtcaagaaaagctgctggacagaggaagaggaccgaattatctgcgaagctcacaaggttctgggcaaccgctgggccgaaattgccaaaatgctccccggacgcacagacaatgctgtcaaaaatcactggaatagtactattaaacgcaaggtggatactggcggtttcctatcagaatctaaggattgcaagccacccgtatatctcctacttgaacttgaagacaaagacggcctgcagtccgcacagcctacagaggggcagggaagccttctgactaactggcccagtgtgcctcctaccatcaaggaggaagaaaactctgaggaagaactggctgctgccactacttctaaagagcaggagccaattgggacagacctggacgccgtgagaacaccagagcccctggaggagttccccaagagggaagaccaagaaggaagtccccctgaaacaagcctaccatacaaatgggttgtagaagcagccaatctgctgatcccggcagtgggctcatccctaagtgaggctctggatctgattgaatcggacccggacgcctggtgcgatctgagcaagttcgatttgccagaggaacctagtgccgaggactcaatcaacaattctttagtccagctccaggcctctcaccagcagcaggtcctcccccctcggcagccctctgcgttggtgccttcagtaacagaatatcgcctcgacggccacactattagtgatctctctcgcagttccagaggcgagctcatcccgatctctcccagtacagaggtggggggatccggcatcggaacacctccatctgtgctcaagcgccagcgaaagaggagggtagctttaagcccagtaactgaaaactcaacctctctgagtttcctggattcctgcaattctctgactccaaaaagtacacccgtcaaaacgctcccattcagccccagtcaatttctgaatttttggaacaaacaagatactctggaactggaaagcccctctctgacctccacacccgtatgtagccagaaagtggtcgtgaccacaccccttcaccgcgacaagacaccgctgcaccaaaaacacgctgccttcgtgacccctgatcagaaatacagtatggataatactcctcatacaccaaccccctttaaaaacgcactggaaaaatatgggcctctgaaacccctgcctcagacccctcatctagaagaagacctgaaggaagttctgcgctccgaggcaggtatagaactcatcattgaggatgacatccggcctgaaaaacagaagcgaaagcccggactgaggcggtcgccaattaagaaggttcgaaaatcactcgccttggatatcgtggacgaagacgttaagctgatgatgtccaccctgcctaagagcctgtccctgccgaccacagctcctagtaactcgtcatcccttaccctgtccgggattaaagaggataactcgttgctcaaccaaggcttcctccaggcgaagccggaaaaggcagctgtggcacagaagccacgcagccattttaccacccccgctcctatgtcttcagcgtggaagaccgtcgcctgtggtggaacccgagaccagctgttcatgcaggagaaggctagacaactattgggtcgccttaagccaagccatactagcagaactctgattctatcctag

SEQ ID NO: 246711 - DNA, 1395 bp, Artificial Sequence
  Description of Artificial Sequence: Synthetic coding sequence
atgcctagctgctccacaagtacaatgccaggtatgatttgtaagaatcctgacctggaattcgactcccttcaaccatgcttctatcccgacgaggacgacttctatttcggagggccagattcgacaccaccaggggaagatatctggaaaaaatttgagctgctgccaacccccccactgtccccgtcacgtgggttcgctgaacattcaagtgagccaccatcatgggtgacggaaatgcttctggagaatgaattatggggaagcccagctgaggaagatgccttcgggctaggtggcctcggcggactgaccccaaatccggttatcctgcaggattgcatgtggtccggcttttccgctcgtgaaaagctggaaagggctgttagcgagaagcttcaacatggtagagggccacccaccgccggatccaccgctcagtctcctggggctggggctgcaagtccggctggcaggggacacggcggagccgctggcgctggccgtgccggagcagcattgccggcagaactggcccaccccgcagccgaatgcgttgacccggctgtggttttcccttttcccgtgaacaaacgggagccggctcctgtgccagcggctccagcaagcgcacccgctgccggacccgctgttgccagtggcgctggaatagccgctcccgctggagccccaggcgtcgcccctcccagacccggtgggcgtcagacgtccgggggtgatcataaggccctgagcacctctggggaggataccctgtccgactctgatgacgaggacgacgaggaagaggacgaagaagaggaaattgatgtagtgaccgtggagaaacgcaggtcaagttcaaacacaaaagcagtgaccacattcaccatcacagtgcggccaaagaatgccgctcttggcccaggaagggcccagtccagcgagctgatcttgaagcgctgccttcccattcaccaacagcacaactatgcagcaccctcaccttatgtagagtctgaggacgcgccaccgcagaaaaagatcaagtcagaagcttctcctaggccactaaagagtgtcatccccccaaaggcaaaatccctgtctcctcgcaatagcgatagtgaggactccgagcgtcgaaggaaccacaatattctggagcgccagaggcggaacgatctacggtcatccttcttgacactgcgagatcatgtgcccgagcttgtcaaaaacgagaaggccgcaaaggtggttatcctgaaaaaagcgaccgagtacgtgcacagcctccaggcagaagagcatcagttgcttctggagaaggaaaaactccaggccagacagcagcagctgctcaagaagattgaacacgcgcgtacatgctag

SEQ ID NO: 246712 - DNA, 1149 bp, Artificial Sequence
  Description of Artificial Sequence: Synthetic coding sequence
atgccttcatgttctacctccacaatgcctgggatgatttgcaagaatcccgatctcgagttcgattctctacagccgtgtttctacccagatgaggatgacttttactttggtggtcccgatagcaccccacccggtgaagacatatggaagaaatttgaactccttcctaccccacctttgtccccctcacgaggtttcgctgagcatagctctgagcccccaagttgggttaccgagatgctgttggagaatgaactttggggatcccccgctgaggaagacgcattcggcctgggcggactcggcggtttgactcctaacccagtgatcctgcaagattgtatgtggtctggcttctccgctcgtgagaagctggagcgggctgtctctgagaagctgcagcatggaagaggccctccaactgcaggctcaacggcccagtctccaggggttgcacctcccagaccaggcggtcgccagacttccgggggagaccacaaagccctgtccaccagtggcgaagacacacttagcgactcagacgatgaggacgacgaggaggaggatgaggaggaagagatcgacgtcgtcaccgtagagaagcggaggtcttcctccaatacaaaagccgtaaccacgttcacaattaccgttagacccaaaaatgctgcccttgggccagggagagctcagtccagcgagttgattctgaaacgttgcctcccgattcatcagcagcacaactacgcagccccaagcccctatgtagagagcgaggatgcaccaccacaaaaaaagatcaaatcagaggccagcccaagaccgctgaagagcgtgattcctccgaaggctaagtctttatcaccacgcaactcagacagtgaggatagcgaacgccgaagaaaccacaatattctggaaaggcagcggcgaaatgaccttcggtccagcttcctgaccctgcgggatcacgtgccagaacttgtgaaaaatgagaaagccgcaaaagtcgtcatactgaaaaaagcaactgagtacgtgcacagtctccaggcagaggagcaccagttgctcctggagaaagagaagctgcaagcaaggcagcagcagctgctcaagaagattgaacacgcacgcacatgctag

SEQ ID NO: 246713 - DNA, 852 bp, Artificial Sequence
  Description of Artificial Sequence: Synthetic coding sequence
atggcagttccgccaacctatgctgatctgggaaaaagcgcccgagatgtcttcaccaaagggtatggctttgggctcatcaagttagaccttaaaacgaaaagcgaaaacggacttgaatttacttcctccggctctgctaacacagagacgactaaggtcactggaagtctggagacaaagtaccggtggaccgaatatggtctcacattcaccgagaagtggaacacagacaacacacttggcacagaaattacagtcgaagaccaattagccagaggactcaagttaacgtttgactcaagcttttctcccaacactggtaaaaaaaatgctaagattaaaaccggctataagagagagcacatcaacctgggctgtgatatggatttcgacatcgcgggacctagtattcggggtgccctggtgctaggttacgaaggatggctagccggataccagatgaactttgagacggccaaaagtagagtcactcagtctaacttcgccgtcggttataaaactgatgaatttcagttgcacacaaacgtcaatgacggaacggagtttggaggttctatttaccagaaagtgaacaaaaagctagagacagcggtgaatctggcttggaccgccggtaacagcaatactcgcttcggcatagcagccaaataccagatcgatcccgatgcttgctttagtgctaaagtgaataactcatctctgattggcctaggatatactcagactctgaaaccgggtatcaagttaacgctgtccgcccttctggacggcaagaacgttaatgcagggggtcataaactggggctggggctggagttccaagcgtag

SEQ ID NO: 246714 - DNA, 852 bp, Artificial Sequence
  Description of Artificial Sequence: Synthetic coding sequence
atggccgtgcctccgacatacgcagatctcggcaagagcgcccgagatgtttttactaagggttacggtttcggtcttattaagttggacctgaagaccaaatctgagaatggactggaatttacaagctcagggtccgcaaataccgagactaccaaagtcactggctctctggaaaccaagtaccggtggacagagtatggccttaccttcacggaaaaatggaacactgataacaccttaggcaccgagataactgtggaggatcagctcgccaggggtctcaagctcacttttgactcctctttttcgcccaacacaggtaagaagaacgccaaaatcaagaccggctataagcgggagcatatcaacctgggatgtgatatggactttgacatcgctgggccaagcattcggggagccctggtcctgggttacgaggggtggctcgcagggtatcagatgaattttgagactgccaaaagcagggtgactcagtctaattttgcagtgggctataaaactgacgagtttcagctgcacaccaacgtgaacgatggaactgaatttgggggaagcatctatcaaaaagttaacaagaaactggaaacagccgtaaatttagcgtggaccgctgggaactccaatactagattcggcattgctgcaaaataccagatagaccccgacgcttgtttctccgccaaggtaaataattcctcattgatcgggctggggtatacccagaccctaaagccaggaattaagctgactctctccgctctgctcgatggtaagaacgtgaatgccggagggcataagctgggcctggggttggagttccaggcctag

SEQ ID NO: 246715 - DNA, 852 bp, Artificial Sequence
  Description of Artificial Sequence: Synthetic coding sequence
atggctgtaccgcctacatatgcggatctagggaagagcgcccgagacgttttcaccaaaggatacggttttggtctgatcaaactagacttaaagaccaagagcgagaacggacttgagttcaccagctcaggctctgcgaacactgagacaacaaaagtcactggcagcctagagacaaagtaccgctggacggaatatggcctaacgttcacagaaaaatggaacactgataataccctgggcaccgagattactgtagaggatcagctagccagaggattgaaactgacttttgactcttccttttcacctaacaccggcaagaagaacgctaaaattaagaccggatataaacgggagcatatcaacttaggttgcgacatggacttcgacatcgccggtcccagcattaggggcgcactggtgctgggatacgagggctggctcgctggctaccaaatgaatttcgaaacggccaagtccagagtaacacagagtaatttcgcggttgggtataaaaccgacgaatttcagctccatactaatgttaacgacggtactgaatttggcggtagcatctaccagaaggttaataaaaagctcgaaaccgctgttaatttggcttggactgccggaaattccaataccagattcggcatcgccgcaaagtaccaaatcgatcctgacgcatgcttttctgctaaagtaaataactctagcttgatcggactagggtacacacaaacgctgaagcccggaatcaaattaacactgtctgctctgctggatgggaaaaacgtcaatgcaggcggacacaaactgggtctgggacttgagttccaggcttag

SEQ ID NO: 246716 - DNA, 849 bp, Artificial Sequence
  Description of Artificial Sequence: Synthetic coding sequence
atggcgacacacggacagacctgcgccagacctatgtgtattccgcctagttatgccgaccttggcaaagccgctcgtgatatcttcaataagggattcgggtttggccttgtgaagcttgacgtaaaaacaaaaagctgttccggggtggagtttagcacgagtggatcgtccaatacagataccggaaaggtgacaggaactttggaaacaaagtataagtggtgcgaatatggtttgacctttacggagaagtggaataccgacaatacattggggactgaaatcgccatagaagatcagatatgccagggcctcaagctcacctttgatactaccttctcacccaacacgggaaaaaagtccggcaagatcaagtcttcctataagagggagtgcataaacctcggttgtgacgtcgacttcgattttgctggcccagccatccatggatctgctgttttcggatatgagggctggcttgccggataccagatgacttttgattctgcgaagtcgaaactgacccgtaacaatttcgctgttggctaccgcactggcgattttcagctgcataccaatgtgaatgacggcactgaattcggaggatccatctaccagaaagtgtgcgaggatctggatacttcagtcaacctagcatggacaagcggcacaaactgcaccagattcggaatcgctgctaagtatcagctggatcctaccgcctctatctcagccaaggtcaataacagtagcttgatcggagtgggatacacacaaacattgcgccctggcgtgaaactgactttgagtgctcttgtggatggaaaatccattaatgccggatag

SEQ ID NO: 246717 - DNA, 930 bp, Artificial Sequence
  Description of Artificial Sequence: Synthetic coding sequence
atgagttggtgcaacgagctccggctccctgcccttaaacaacacagcatcggccgtggactggagtctcacatcacaatgtgcattccccctagctatgcagacctgggcaaagctgcaagagatatcttcaacaagggcttcggattcgggcttgtcaaacttgacgtgaaaacaaagtcttgcagtggggtggaattctctaccagcgggagcagcaacacggatactgggaaggtgacaggaacgctcgagacaaaatataaatggtgtgagtatggactgacatttacagagaaatggaacaccgataacaccttgggcacagaaatcgccatcgaggatcagatatgccaaggtctgaaactcactttcgatacgaccttttcaccaaataccggaaagaagtccggcaaaataaaatcaagctataaacgcgaatgcattaacctgggctgtgacgtagatttcgactttgccggacctgccattcacggctcagccgtttttgggtacgaaggctggttggcagggtaccaaatgacctttgacagcgccaaaagcaagctaacccgaaacaactttgctgtgggataccgaaccggtgactttcagctgcataccaacgtcaatgatggaacagagtttggaggatcaatctatcagaaggtctgcgaagatttggacacctcggtgaatttggcatggacttcaggtaccaattgcacacgttttgggattgccgctaagtatcagttagacccaactgcatcaatctccgcaaaggtcaataactcgtcgttaattggggtgggttatacacagaccctccgccctggtgtgaagttgacactcagcgccttagtggatggtaagtcaatcaatgctggcggtcacaaggtgggactagccctcgaactcgaggcttag

SEQ ID NO: 246718 - DNA, 885 bp, Artificial Sequence
  Description of Artificial Sequence: Synthetic coding sequence
atggctacccacgggcagacttgtgcccgtccaatgtgtatccccccatcttacgctgacctggggaaggctgccagagacatcttcaacaaaggcttcgggttcggcctagtcaagctggatgttaaaactaagagttgcagcggggtggaattttcaacatcaggatccagcaacacagacaccggtaaggtgaccggcaccctcgagacaaaatataagtggtgcgaatacggactgactttcaccgagaagtggaatacagacaatacccttggaacagagattgctattgaagaccaaatctgtcaaggactcaagttgacattcgatacaacttttagcccaaacacagggaagaaaagcggtaaaatcaaatctagttataagagggaatgcataaacctcggttgtgacgtggactttgatttcgccggacccgcaattcacggcagtgccgtcttcggctacgaagggtggctggcgggttaccagatgaccttcgactccgccaagagcaagcttactagaaacaactttgccgttggctatagaactggtgatttccagctgcacactaatgtgaatgacggcacagaatttggtggtagcatataccagaaagtctgcgaagacttagatacttctgtgaaccttgcatggacaagcggtacaaactgtactagattcgggattgctgcaaaataccagcttgacccaactgcttctattagcgcgaaagttaacaactcatcgctgatcggagtgggttacactcagaccctccgacctggagtgaagctgacactgagtgccctggtggacggaaagagtatcaacgccggaggacacaaggtcggcctcgccctcgagcttgaggcttag

SEQ ID NO: 246719 - DNA, 588 bp, Artificial Sequence
  Description of Artificial Sequence: Synthetic coding sequence
atggccacacacggtcagacctgcgcccgacctatgtgcatccccccatcatacgctgatttaggcaaggccgctcgagatatttttaataaaggtttcggctttggcttggttaagctggacgtaaaaaccaagtcttgctctggcgttgaattctcgacgagcggctcgagtaacacagatacgggaaaggtgactggcaccctggaaactaaatataaatggtgtgagtacgggttgacatttaccgagaagtggaacaccgacaatacactcggtactgagatcgcgatagaagaccagatctgccagggattgaagctcactttcgacaccacgttttctcccaatacgggtaaaaagtccggaaaaatcaagagttcctacaaacgcgagtgtatcaacctgggatgcgacgttgatttcgatttcgcaggaccggcaatccacggttccgccgtcttcggctatgagggatggcttgccggataccagatgactttcgattctgccaagtctaagttgacaaggaacaacttcgcagtgggttaccgcactggagactttcaactacacaccaacgtttag

SEQ ID NO: 246720 - DNA, 330 bp, Artificial Sequence
  Description of Artificial Sequence: Synthetic coding sequence
atgtcttggtgcaacgagctgaggttaccagctctgaaacagcacagcattggtagaggactagaaagtcacataacaatgtgtataccgccatcttatgctgacttgggcaaagccgctagagacatctttaataagggtttcgggttcgggttagttaagctagacgtgaagactaagagctgcagcggagtggaattctctaccagcggatcctctaataccgacactgggaaggtcaccggcacccttgaaaccaagtataagtggtgcgagtacggacttacttttacagagaagtggaacacggacaacactctggggacctag

SEQ ID NO: 246721 - DNA, 615 bp, Artificial Sequence
  Description of Artificial Sequence: Synthetic coding sequence
atggctacacatggccaaacttgcgcccgtcctatgtgcatccccccaagctacgccgacctcggcaaggcagccagagatatttttaacaagggattcggatttggccttgtcaaactcgatgtaaagacgaagagttgttccggagtggaatttagcacatcaggtagctctaacaccgatacgggaaaggtgaccggcaccctagagacgaaatacaaatggtgtgagtacggccttacatttaccgagaagtggaacaccgacaatactcttggtacagagatcgctatcgaagaccaaatctgccagggacttaaactgacttttgacaccaccttttcaccaaataccggcaaaaaaagtggaaagatcaaatcttcatacaagcgcgaatgcattaaccttggctgcgacgttgatttcgattttgcaggaccagcgatccacggctcagccgtgttcggctacgaggggtggcttgctggctatcagatgacgttcgactctgctaagtctaaacttacccggaacaacttcgctgtaggctaccggactggcgacttccaactgcacaccaatgtcaatgatggaactgaattcgggggttcttag

SEQ ID NO: 246722 - DNA, 768 bp, Artificial Sequence
  Description of Artificial Sequence: Synthetic coding sequence
atgttggtcatccctgctacccaggaggccgaggagttttccacatctggttcaagtaacacagacacaggcaaggtcaccgggacactggagaccaaatataagtggtgcgagtatgggctaactttcaccgagaagtggaacaccgacaatactctgggaacggagatagcgattgaagatcagatctgtcagggtctgaagctgacatttgataccaccttttccccaaataccgggaagaagagcggcaaaattaaatcgagttacaaaagggagtgcataaatcttgggtgcgacgtagactttgattttgcgggacctgccattcatggatctgcagtgtttggatatgagggctggcttgccggataccagatgacctttgatagcgctaagtctaagttgacgaggaacaacttcgcagttggctaccggaccggggacttccagctccatacaaacgtgaacgatgggacagagttcgggggatcaatctatcaaaaggtctgcgaagatctggacaccagcgtcaatctggcctggacctctggaactaactgcaccagatttggtattgccgcaaagtaccagttggaccccactgcatccattagcgctaaagttaataactcttctctcataggggtgggatacactcagaccctcaggcccggagtaaaactcacattgtctgcccttgtggacggtaagagcatcaacgctggtggccacaaagttgggttggcacttgaactggaagcatag

SEQ ID NO: 246723 - DNA, 885 bp, Artificial Sequence
  Description of Artificial Sequence: Synthetic coding sequence
atggctacacacggccagacctgtgcacgccctatgtgtattccacccagctacgcagacctaggcaaagccgctcgagacatattcaataaagggtttggctttggactcgtcaagctcgacgtcaagactaagagctgttccggagtcgaattcagtacctccgggagctccaacaccgatactgggaaagtgactggaactctggaaactaaatacaagtggtgcgagtatggactgactttcacagagaaatggaacacagacaacaccttgggaaccgaaattgctatcgaggaccaaatctgccagggcctaaagttgacatttgacaccaccttctcccccaacacaggcaaaaagagtggcaaaatcaaatcaagttacaagagagagtgtataaacctgggatgtgacgtcgacttcgatttcgctggacctgccatacacgggagtgccgtctttgggtacgaaggctggcttgccggataccagatgacttttgactccgcaaagtcgaagctcacacgaaataatttcgccgtcggttaccggacgggcgactttcagctgcatactaatgttaacgacggtactgaattcggcggatccatttaccagaaagtgtgtgaggacttagatacctccgtcaatctcgcatggacttctggaactaactgcactagattcgggatcgccgcaaagtaccagctggacccgaccgcaagcattagtgccaaagtgaataactcatccctgattggcgtgggttacacacagaccctgaggccaggcgtcaaacttaccctgagcgcactggtagacggtaagagtatcaatgccggtggtcacaaagtgggccttgccttggagctggaggcctag

SEQ ID NO: 246724 - DNA, 852 bp, Artificial Sequence
  Description of Artificial Sequence: Synthetic coding sequence
atgtgcaatacacctacctactgcgatcttggcaaggcagccaaggacgtgttcaacaaaggctatggcttcgggatggtaaaaatcgatctcaagactaaaagctgctccggggtggaattttcgacctcagggcacgcttacacggacacgggcaaggcttctggaaacctggagacgaagtataaggtttgcaactacgggttgacattcactcagaagtggaacaccgataatactctgggcactgaaatctcctgggaaaataaactggcagaaggtttgaaactgactctggacacgatcttcgtgccgaatacagggaaaaaatcaggaaagctcaaggccagctacaaaagagattgtttttcggtgggaagcaatgtagatatcgacttctccggcccaacaatttatggttgggccgttctcgcctttgaaggctggctggccggttaccaaatgagttttgatactgcaaaaagtaaactgagtcagaataacttcgcgttggggtacaaggccgcagattttcagcttcacactcacgtcaatgacggtacagagttcggaggaagcatctaccagaaggttaatgaaaagatcgagaccagcataaaccttgcctggaccgcgggtagcaataataccaggttcgggatagctgcaaaatacatgctggactgccggacaagccttagtgccaaagttaacaatgccagcctgataggcctgggttacacccagaccctccggccaggagtcaaactaacacttagcgccctgattgacggcaagaatttttccgcgggaggccacaaagtaggtctgggattcgagctcgaggcatag

SEQ ID NO: 246725 - DNA, 855 bp, Artificial Sequence
  Description of Artificial Sequence: Synthetic coding sequence
atgtgcaatactcccacttactgcgatctgggtaaggccgctaaggatgtcttcaataagggatacgggttcggaatggtaaaaattgacctcaagacaaagagttgctccggagtggttgaattctctacttccgggcacgcatacaccgataccggcaaagcatctggcaacctcgagactaaatacaaggtttgcaactatggcctgacgttcacgcaaaagtggaacactgacaatacactggggacagagatctcttgggaaaacaaactggcagagggcctcaaattaactctggacactattttcgtgcctaacaccggaaaaaagtccggcaaactaaaggccagctacaagcgggactgcttttctgtgggaagtaacgtagacatagacttcagtggcccaaccatttacggatgggctgtgttggccttcgagggctggctggccggataccagatgtcttttgacacagccaaatctaagttgtcccagaacaatttcgcgctcggttataaggccgcagacttccagctacatactcacgtcaatgatgggacggagtttggtggaagcatttatcagaaggtgaacgaaaaaatcgagactagtataaatttggcctggactgccggtagtaacaacacccgttttgggatcgccgctaagtacatgcttgactgccggacttcactgtctgctaaagtgaataatgcatccctgattggactgggttacactcagaccttaagaccgggagtgaaactcaccctctccgcactcattgacggaaagaacttcagtgcgggaggccacaaggtgggactggggtttgaattggaagcctag

SEQ ID NO: 246726 - DNA, 498 bp, Artificial Sequence
  Description of Artificial Sequence: Synthetic coding sequence
atgtgcaataccccaacgtactgcgacctgggcaaggccgctaaggatgtctttaataagggctacggcttcgggatggttaagatagatctgaaaactaaatcttgctctggcgtcgagttcagtactagcggccatgcatacactgataccggaaaagcaagtggcaacctggagaccaagtacaaagtgtgtaactacgggctaacattcacgcagaaatggaacaccgacaacacactggggacagagattagttgggaaaacaagctggccgagggactcaagctgaccctcgacacgatctttgtccctaacactggaaaaaaaagtggaaagctgaaggcctcctacaagcgtgattgtttcagtgtgggctccaatgtggacatagattttagcggcccaacaatctacggctgggccgtactggccttcgagggatggctggcaggttaccagatgtctttcgacaccgccaagtctaagctgagttag

SEQ ID NO: 246727 - DNA, 855 bp, Artificial Sequence
  Description of Artificial Sequence: Synthetic coding sequence
atgtgcaacacccctacctactgtgacttggggaaggctgctaaggacgtcttcaataaggggtacggtttcggaatggtgaaaattgatctgaaaactaagtcttgcagcggtgtgatggagtttagtacctccgggcacgcgtacactgatacaggaaaagctagcggtaatttagaaaccaagtacaaagtttgcaattatggcctgacatttacccagaagtggaacactgacaataccctgggcactgaaataagctgggagaacaaactggccgagggcttgaagttaacactagacacaatttttgtccctaatactggcaaaaaaagcggcaaattaaaggcgagctataaacgcgactgtttttccgtgggctccaacgttgacattgacttttcagggcctaccatttatggttgggctgtcctggcttttgaaggctggctggccggttaccaaatgtcattcgatacagccaagtcaaaactgtcacagaataactttgcgcttggctataaagccgctgactttcagcttcacactcacgtgaatgatggaaccgaattcggtggcagcatctaccagaaggtgaatgagaagattgagacgtccattaatttggcttggacagcaggcagcaataacactcgctttggaattgcagcaaagtacatgctagattgcaggacttctctctctgctaaggtcaacaacgctagtctgattgggctgggatatactcagacccttaggcccggagtgaagctcaccctgtcagctctgatcgatggcaagaacttctccgccggtggacataaggtcggactaggctttgagcttgaggcatag

SEQ ID NO: 246728 - DNA, 480 bp, Artificial Sequence
  Description of Artificial Sequence: Synthetic coding sequence
atgtgtaacacacccacctactgcgatttgggcaaagccgctaaagacgtctttaataaaggttatggcttcggtatggttaaaatagaccttaaaacgaaatcctgctccggcgtggagtttagcacaagcggacacgcctacacagacaccgggaaggctagtggcaatttagagactaagtacaaggtctgcaattatggcctgaccttcacccagaagtggaacaccgataacacactgggcactgaaattagttgggaaaacaagctggctgaaggactgaaactgacattggatacaatttttgtgcctaacactggcaagaagtcgggaaagttgaaagcctcctacaaaagggattgtttctctgtagggagcaacgtcgacatcgacttcagcgggcctacgatatacggatgggctgtgctggcctttgaaggctggctagccggatatcagatgagcttcgatacgtag

SEQ ID NO: 246729 - DNA, 1062 bp, Artificial Sequence
  Description of Artificial Sequence: Synthetic coding sequence
atggtgggtgataccctcaaactgctgtcaccattgatgaccagatacttttttttactgttttacagtaccgattcttcagatcttaacgagaaccaacaccccctcgacttcgacgagatggctttcggaaaggtcaaaagcggcattagttttttgattcagacaggcgtcggcattttagggaattcctttctcctttgcttctataatttaatcctgttcaccggacataaactgcggccaacggatcttattctgagccaattagctcttgccaattcaatggtgttgttttttaaaggcattccacagaccatggcggctttcggcctaaagtatctactgaatgacacaggctgtaagttcgtattttattatcaccgcgtaggaacacgcgtgtccctgagcacaatttgcctgttaaacgggtttcaggccatcaaactcaatcccagcatttgccgttggatggagattaagattagatccccacgattcattgatttctgttgcctcctctgctgggcgcctcatgtgctgatgaatgcctcagtccttcttctggtcaacggccctttaaactccaaaaatagctctgccaagaataactacggatattgttcctataaagcctcgaaacgcttctctagcctgcatgccgtgctatattttagtccagacttcatgtctctgggctttatggtatgggcttcaggaagcatggtgttctttctttaccgccacaagcagcaggtccagcataatcattctaatcgactgtcatgcaggcccagccaggaggcaagagccacgcacacaatcatggtgttagtgagctcttttttcgtcttctactccgtgcattctttcctaaccatctggacgactgtggtcgccaatccaggtcagtggatcgtgacaaattctgtgctcgtagccagttgctttcctgctcggagcccatttgtcctgatcatgtctgacactcatatttctcaattctgctttgcttgtagaactcgtaagacacttttcccgaacctggtggtaatgccttag

SEQ ID NO: 246730 - DNA, 594 bp, Artificial Sequence
  Description of Artificial Sequence: Synthetic coding sequence
atggcggcagtgaaggatagttgtggcaaaggcgaaatggcaacaggcaatggtcggcgattgcatctgggtatccctgaagccgtctttgtcgaggatgttgattctttcatgaagcaaccagggaatgaaaccgcagacaccgtgttaaaaaagctggatgagcagtaccagaagtataaattcatggagctaaacctggctcagaagaagcgtcggctcaagggtcagatacccgaaattaagcagactctcgagatactgaaatatatgcaaaagaaaaaggaaagtacgaattcaatggaaactcggtttctgcttgcggacaatttgtactgtaaggcttcagtacctcctacagataagatgtgcctgtggctaggtgctaacgtaatgttggaatacgacatcgacgaagcccaggccctgctcgagaaaaacctctctaccgctacaaaaaatttagattctctagaggaagacctggactttttgagagatcagtttactacaaccgaggtgaacatggccagagtttacaactgggatgtgaagcgcaggaacaaagatgattctactaagaataaagcgtag

SEQ ID NO: 246731 - DNA, 579 bp, Artificial Sequence
  Description of Artificial Sequence: Synthetic coding sequence
atggcaccccagcctatgattcacacgcaacagggcctgcggacttccagtccgagcactccttcaccagaacaccaggaagatgtagacagtttcatgaaacagcccggaaatgagactgctgatacagtgctgaagaagctggacgagcagtaccagaagtataagtttatggagcttaacctggcacagaaaaaacgcagattgaagggacagatccccgaaattaaacagactctggagatcttgaagtatatgcagaagaagaaggagtccaccaatagtatggaaacccggttcttgctggctgacaacctgtattgtaaggcttctgtcccaccgactgacaagatgtgcttgtggctcggggcaaatgtcatgctggaatacgacatcgacgaggcgcaggcactcttggaaaaaaatttgtcaacggccacaaagaatctggactccctggaagaagatctcgacttcctacgcgatcagtttaccacaactgaagtgaacatggctagggtgtataattgggacgtgaaaagacggaacaaggatgacagtaccaagaataaagcttag

SEQ ID NO: 246732 - DNA, 702 bp, Artificial Sequence
  Description of Artificial Sequence: Synthetic coding sequence
atgcggcctcaacaattgcacgcaaccgagataacctcctctgggttcagactcgcttggccgccactactgactgcggattcgggctactatgtcttggagctggtcccttctgctcagcccggtgcagctcgtcgccagcagctgcctggcaatgcaacggattggatttgggccggactcgaccctgatacggactacgatgtggctctagtccccgaatcaaatgttcggttacttcgccctcagatactgagagtgcggacccgcccaggggaggctggccctggcgcaagcggcccagaatctggagcagggccagcgcctacacagctggctgcccttcctgcacctgaggaagctgggccagagagaatagttatcagtcatgcccgaccacggagcttgagagtgtcctgggcaccggcactgggttctgctgcagctcttggctaccatgttcagttcggccctctgcggggtggcgaagcccagagggtggaggtgcccgcagggcgaaattgcaccaccttacagggccttgctccaggtactgcttaccttgtcacagtcacagctgccttcagatctggccgtgagtccgccctgtcagccaaggcctgcactccggacggtccacgcccacggcctcggccagtcccgagggctcctacaccaggaacggcctccagagaaccttag

SEQ ID NO: 246733 - DNA, 1338 bp, Artificial Sequence
  Description of Artificial Sequence: Synthetic coding sequence
atgctgccttggaccgccctggggttggcattatcacttcgtctcgctttggcgagatcaggcgcagagaggggccctcccgcatctgccccaaggggcgatctgatgttccttctggatagttctgctagcgtgtcgcactacgaattttctagagtccgcgagttcgtcgggcagctcgtggctcctttgcccctaggaacgggcgcactaagagcttcgctggtgcatgttggaagccggccttatactgagttccctttcggtcaacattctagcggtgaggctgcacaggatgccgtgcgtgcaagtgcgcagcgcatgggggacacacacaccgggttagcgctcgtttacgcaaaagaacagctgtttgccgaagctagcggagcaagaccaggggtaccgaaagtattggtgtgggttaccgatggtggatcaagcgatccagtgggccctccaatgcaggagttgaaggatctgggggtgactgtgttcattgttagcaccggcaggggaaatttcctggaactttccgccgctgcaagcgcacccgctgaaaaacacctacacttcgtggatgtagacgaccttcacattatcgtccaggagctaagaggctccatcctagatgctatgcgcccacagcagctgcacgcgacagagattacatcatccggcttccgtttggcctggccacctctcctgacagccgactctgggtactacgttctggagctggtgccaagtgcacagcctggtgccgctcgccgacaacaactgcctgggaacgccaccgattggatttgggccggactggacccagataccgactatgatgtggctctggtgccagaatcaaatgttcgcctgctgcgtccacagatacttcgtgttaggacccgacccggagaagccggacccggagcatctggccctgagtccggcgcaggacccgcacctacacagctggcagccttacctgctcctgaggaggcaggcccagaacggatcgtgatctcccatgctcggcctaggtccctcagagttagttgggctcctgcattgggatccgccgctgccttgggataccatgtccagtttggtcccctccggggtggagaagcacagagagttgaggtgcctgcgggaaggaactgcaccaccttacagggcctagcccctgggacagcctatctcgtgacagtgaccgctgcctttcgaagtggaagagagagcgccttgtcggcgaaagcctgcacacctgacggccctcgtccccgtccaaggcccgtccctcgggctcctacacctggaaccgcgtcacgcgaaccgtag

SEQ ID NO: 246734 - DNA, 195 bp, Artificial Sequence
  Description of Artificial Sequence: Synthetic coding sequence
atgctgccctggacagctctgggtctcgcgctgagtctccgactggcattagcccgttctggggcagaacggggtgctcagggccctggcaggcaccgcgtgcactgccagcacaggccacgacaactcccaggagccgtgagccggtgcctgtctccatgtcgagaggcccctgccctatgtggaaggggatag

SEQ ID NO: 246735 - DNA, 978 bp, Artificial Sequence
  Description of Artificial Sequence: Synthetic coding sequence
atgccaagcagtacagccatggctgtcggagccttaagcagttctctgctcgtgacctgttgtctcatggtggctttatgctccccgagtatccccctcgagaagttggcccaagctccggaacagcctggacaggagaagcgcgaacatgccagccgcgacggcccaggccgtgttaatgaattgggaaggcccgctagggacgaggggggatccgggagagattggaagtccaaatctggacggggattggcgggaagggagccgtggtctaaattgaaacaggcgtgggtttcgcagggaggaggtgcaaaggccggagacctccaagtcaggcccaggggggacacaccacaggcagaggctctagccgctgctgcccaggacgcaatcggaccagagctggcacccaccccagagccaccagaagagtatgtgtatcctgattatcgcggtaaaggctgtgtcgacgaatctggcttcgtctatgctataggtgaaaagttcgcccctggaccttccgcatgcccctgcctatgcacggaggaaggacccctgtgtgctcagcccgagtgccccagactgcatcctcggtgcattcatgtggacacctcccaatgttgtccacaatgcaaggagaggaagaactactgtgaattcagaggcaaaacctaccagactttggaagagttcgttgtctctccctgtgaacgctgtcgatgtgaggccaatggagaagtgctttgtacagtgagcgcatgccctcagactgagtgcgtcgaccccgtatacgagcctgaccagtgttgcccaatatgtaaaaacggtccaaactgttttgcagagacggctgtcattcctgctggaagggaagtaaagacagacgaatgtacgatttgtcattgcacatatgaggaggggacctggaggattgagaggcaggctatgtgtacgcgacatgaatgcagacaaatgtag

SEQ ID NO: 246736 - DNA, 750 bp, Artificial Sequence
  Description of Artificial Sequence: Synthetic coding sequence
atgactagtgagacattatggtggctcatcaccctcaaaaaacaactgggcgacaatgaggccataacacaggagatcgtcggatgcgcccatctggagaattacgccttaaaaatgttcttgtacgccgacaatgaggaccgcgcagggcgatttcataaaaacatgataaagtcattttacaccgcaagcctcttaatcgatgtgatcacggtgttcggggagttgacggatgaaaacgtcaagcatcgaaaatacgccaggtggaaagccacctacatacataattgcttgaagaatggcgagacgccccaggcagggccagttgggatagaggaggataacgacatcgaggagaacgaagatgccggtgccgctagcctccccactcagccgacccaaccaagctccagctctacatatgatccctcaaatatgcccagcgggaattacacaggcattcagatccccccaggagcccacgcacccgctaatacaccagcagaagtcccacacagtactggtgttgcctcaaacactattcagccaactccccagaccattccggcaatcgacccagcgctgttcaataccattagccagggagatgtgagattaacccccgaggattttgctcgggctcagaaatactgcaaatatgccggtagcgcactgcagtacgaggacgtttccacagctgtgcaaaacctacagaaagctctcaagctgctcacaactgggcgtgagtag

SEQ ID NO: 246737 - DNA, 924 bp, Artificial Sequence
  Description of Artificial Sequence: Synthetic coding sequence
atggctgcgttagccccactgccccctttgcctgcccaattcaagagtatccagcatcacctacgcacggcgcaagaacatgataaacgcgacccagtggtcgcatactactgtagactctacgccatgcagacagggatgaagattgattcaaagacacctgaatgtaggaagttcctctctaagcttatggatcagctggaggccctaaagaagcagctgggcgataatgaggccatcacacaggagattgtgggctgcgcacacctggagaactacgccctgaagatgtttctctacgccgataatgaggatagagcgggtcgattccacaaaaacatgattaaaagcttttatacagcatccctgctgatcgatgtcattacggttttcggcgagctgactgatgaaaacgtgaagcacagaaagtacgccagatggaaagccacgtatattcataactgtttgaaaaatggtgagacccctcaggctgggcctgtggggatcgaggaggataacgatattgaggagaatgaggatgcaggtgcagcctcactcccaacccagcctacacagccatctagttccagtacctacgaccccagcaacatgcctagtggaaactacacgggaattcaaatcccacctggtgcgcatgctcctgctaacacccccgctgaagtcccccacagtactggcgtcgcttcaaacactattcagcctacaccacagaccattcccgcaatagaccccgctctgtttaacaccatttcccagggggacgtgcggctgactcccgaagatttcgctagagctcaaaaatattgcaaatatgcaggcagtgccctccagtacgaggacgtgtctactgctgtccaaaatttgcaaaaagccctcaagctccttaccacgggtcgtgagtag

SEQ ID NO: 246738 - DNA, 663 bp, Artificial Sequence
  Description of Artificial Sequence: Synthetic coding sequence
gagatggcagcacttgctccactgcctcctcttccagcccaattcaaaagcattcagcatcacttaaggacagcacaggaacatgacaaacgtgatcctgtggtagcctactactgtcgcctgtacgcaatgcagacgggcatgaagatcgacagcaagacccccgagtgcagaaagttcctgagcaagctgatggatcagcttgaggccttgaaaaagcagttgggcgataacgaagcaattacccaagagattgtgggatgtgcccatctcgaaaattatgcgttaaaaatgtttctgtacgcggataacgaagatcgcgctgggaggttccataagaatatgatcaagtccttttacaccgcaagcttactgattgacgtgatcaccgtctttggggagctcacagatgaaaatgttaagcatcgaaaatatgccaggtggaaagctacctatattcacaattgcaaagaatggggtgacagctccagcaggccctgttggctcaagaagataatgattctcaaaaaaatgaagatgctcgaacagccgctgtgccctctgagtcagctctctcaccatcacctccagctgatgacccagcacgccatccgccagctgtattggaatacagacagtagtggttgcacaaggtcctcgtag

SEQ ID NO: 246739 - DNA, 669 bp, Artificial Sequence
  Description of Artificial Sequence: Synthetic coding sequence
atgaccagcgagacgctgtggtggttaatcacactgaaaaagcagctcggtgacaacgaggctataacacaggaaatagtcggctgcgcacacttggaaaactacgccctcaagatgttcctgtacgctgacaatgaagatcgagcgggaagatttcataaaaatatgatcaaatccttttacaccgccagtttgctgatcgacgttataacggtgttcggggaactgaccgacgagaatgttaaacaccggaaatacgcccgttggaaagctacatacatacataactgtctcaaaaacggagagacaccccaagccggaccagtggggattgaagaggacaacgacatcgaagagaatgaggatgctggtgctgcctctctgccaacacagccgacacagccctcgagcagtagcacttacgatccctctaatatgcccagcggaaattacaccggtatccagattccaccgggtgcacatgccccagccaacacccctgccgaggtgccccattccactggagacgtccgactcactcctgaagatttcgcgagagcacagaagtactgcaagtacgccggaagcgcactccagtatgaagatgtgagtaccgctgttcagaatctccagaaggcgttgaagctactaacaacggggagggaatag

SEQ ID NO: 246740 - DNA, 621 bp, Artificial Sequence
  Description of Artificial Sequence: Synthetic coding sequence
atggccgctaataagcctaaaggacagaactccctggcgctgcacaaagtgataatggtcggaagtggtggagtcggtaagagcgctcttaccctccaatttatgtacgacgaattcgtagaagattatgagccaactaaagctgattcctaccggaagaaggttgttctggatggggaagaagtgcagatcgacatacttgacactgcgggacaggaggactatgcagcaatccgcgacaactactttcggtccggggagggtttcctttgtgttttttctatcaccgaaatggagtcctttgccgcaactgccgattttagggagcagatccttcgggttaaagaggacgaaaacgttccatttttattggtggggaacaagagcgatctcgaggataaacgccaggtgagtgtcgaagaggctaagaacagggcggagcaatggaatgttaattacgtggaaacatccgcgaaaacacgcgctaatgtcgacaaagttttctttgatcttatgagagaaatccgcgcacgaaaaatggaagactcgaaggagaagaacggaaaaaaaaagcgtaaaagcctcgccaagcggatccgggaacggtgttgtattctctag

SEQ ID NO: 246741 - DNA, 306 bp, Artificial Sequence
  Description of Artificial Sequence: Synthetic coding sequence
atggccgcaaataaaccaaagggccagaactctctggcccttcacaaagtgatcatggttgggtccggtggcgtgggcaagtcagcattaactctgcaatttatgtacgatgagttcgttgaggattacgagcccacaaaggccgactcttaccgaaagaaagtcgtcctggatggagaggaggtccaaatagacattctggacaccgccggacaggaggattacgccgcaatacgggataattattttagatcaggcgaaggctttctgtgcgtgttctccattactgaaatggaaagcttctag

SEQ ID NO: 246742 - DNA, 621 bp, Artificial Sequence
  Description of Artificial Sequence: Synthetic coding sequence
atggcagccaacaaatctaagggtcagagctccctggcgttgcataaggtcattatggttggctctgggggagtgggtaaatctgccttaaccttgcaatttatgtatgatgagttcgtggaggactacgagcctaccaaagcggattcatatcgcaagaaggtcgtgttagacggagaggaggtgcagatcgatatactggataccgcaggccaggaggactatgctgccattcgtgataactattttaggagtggcgagggctttctgctggtgttctctatcactgagcacgagagttttacagccaccgccgaatttcgtgagcaaattctgcgggtgaaggccgaggaggacaaaatcccccttcttgtcgtcggaaataaatcagatctggaagagcggaggcaggttcctgtggaagaagctcgcagcaaggctgaagagtggggggtccaatatgtcgagacgtctgctaaaacaagggcaaacgtagacaaggttttctttgacctgatgcgcgagataagaaccaagaaaatgtcagagaacaaggacaagaacggtaagaaaagcagtaagaacaagaaaagcttcaaagaaaggtgttgtcttctgtag

SEQ ID NO: 246743 - DNA, 684 bp, Artificial Sequence
  Description of Artificial Sequence: Synthetic coding sequence
atggccgcaaacaagtcgaagggtcagagttctctcgcgctacacaaggtgatcatggttggttctggcggtgtggggaagtcggccctcacacttcaattcatgaacgtcagcaagagtttagcctacgacaagaagaagtacacggctaataagaaggttgagggaatcctagagttcgtggaagattacgaacccactaaggccgacagctatagaaaaaaggtggttctggacggcgaagaggtccaaattgatattctagacactgctggccaggaggattacgctgccattcgggacaattacttcagatccggagagggttttctgctggttttcagtattaccgaacacgaatctttcactgctaccgctgagttccgagaacagatcttgagggtaaaggccgaggaagacaaaatccctttactcgtcgttgggaataaaagcgatctcgaggagaggcggcaggtcccagtggaagaggcacgctctaaggctgaagagtggggtgtgcagtacgtggagacatcggctaaaacgcgcgcaaacgtagacaaggtgttttttgacttgatgagagagataaggacaaagaagatgagcgaaaacaaggacaagaatggcaaaaagagctcaaagaacaagaagtcttttaaggagagatgctgtttactctag

SEQ ID NO: 246744 - DNA, 504 bp, Artificial Sequence
  Description of Artificial Sequence: Synthetic coding sequence
atggctgcaaataaatccaaggggcagagctcccttgcgctccacaaggtgataatggttggaagcggcggtgttgggaaatccgctctgacccttcagtttatgtacgatgagtttgtcgaagattatgagccaacgaaagccgactcctacagaaaaaaggtggtacttgacggcgaagaagttcagattgatattctcgacacggcgggacaggaggattatgccgctatccgtgacaactatttcaggagcggggaaggctttctcttggtattctccattaccgaacacgaatcctttaccgccacagccgaatttcgggaacagattctgagggtcaaggcagaggaggataaaattccccttcttgtcgtcgggaacaagagtgatctcgaagagcggagacaggtaccagtcgaggaggcaagaagcaaagcggaggaatggggggtccagtacgtagaaacatcagccaagacaagagccaacgtggataagtag

SEQ ID NO: 246745 - DNA, 621 bp, Artificial Sequence
  Description of Artificial Sequence: Synthetic coding sequence
atggcagctaacaagtccaaaggccaatccagcctggcgcttcacaaggtgataatggtcgggagcggtggagtaggaaagtctgccttgacactgcagtttatgtatgatgagttcgttgaggactacgaacccactaaagcagattcctaccgcaagaaagtggttctggacggagaggaggtgcagatcgacatactggatactgcaggtcaggaagattatgcagctataagagataactatttcagaagcggcgagggcttcctgcttgtcttctcgataacagagcacgagtcatttactgcaactgccgagtttagagagcagatcctgagggttaaagcggaagaagataaaattcctcttctggtcgtgggtaataaaagtgacctggaggaaaggcgccaggtccctgttgaggaagctcggagcaaggccgaagaatggggcgtgcagtatgttgagacctctgctaaaacacgggctaacgtagataaggtgttcttcgaccttatgcgggaaattcgaaccaagaaaatgtcagaaaacaaagataagaacggaaagaagtcatctaagaataagaagtctttcaaagagcgctgctgcctgctatag

SEQ ID NO: 246746 - DNA, 687 bp, Artificial Sequence
  Description of Artificial Sequence: Synthetic coding sequence
atgaaacagagacagtctgccctgcagtgggtaatatgcgtgagccagcctcagaagacaagcgaaatggccgcaaataaatccaagggacagtcatcgttggctcttcataaagttatcatggtgggctccggcggtgtgggcaagtccgccttgactctgcagttcatgtatgacgaattcgtcgaagattacgaaccaaccaaagctgattcctaccgcaagaaggttgtgctggatggggaggaagtacagatcgatatcttagacacggccggtcaggaggactatgcagcaattcgtgacaattatttccgctccggcgagggcttcttgctggtcttctcaatcacagaacacgagtccttcaccgccaccgcagaattccgggagcagatcctaagggtgaaagcagaagaggataagatcccacttctggttgtaggaaacaaatccgatttagaagaacgcaggcaagtgcctgtggaggaagccagaagcaaggccgaggagtggggagttcagtacgtggagaccagtgcaaagactagggctaacgtggataaagtgttctttgatctgatgagggaaattaggactaagaagatgagtgaaaacaaggacaaaaacgggaaaaaatctagcaagaataagaaaagctttaaagagagatgttgtctgttgtag

SEQ ID NO: 246747 - DNA, 1860 bp, Artificial Sequence
  Description of Artificial Sequence: Synthetic coding sequence
atggccagcggtgcctacaatccgtatatcgagatcattgaacaaccccgtcagcggggaatgcgatttcgttacaagtgcgaaggtaggagcgcaggatccatccccggagagcactccacagacaacaacagaacttatcccagcattcagatcatgaactactacgggaagggaaaagtgcgcatcactctcgtcacaaaaaatgacccttacaagccacacccccacgacctggtgggcaaagactgtagggatggttattatgaagccgaatttggacaggaaagacggccactcttcttccagaatttgggcatacgctgtgtgaaaaaaaaggaggtgaaggaggctatcatcacccgcattaaagccggaattaacccatttaatgtgccagaaaagcaattgaacgatattgaggactgtgatctgaacgtggtcagactgtgttttcaggttttcttgccagacgagcatggcaatctcaccactgcgcttccgcctgtggtttccaacccaatctacgacaatcgcgctcctaataccgctgagcttcggatttgcagagtgaataagaactgcggtagcgttcgtgggggtgatgagatcttcctcctgtgcgataaggtgcagaaggacgatatagaggtccggttcgtgctgaacgactgggaagctaaaggaattttctcgcaggccgatgtgcaccgccaggtcgctatcgttttcaaaaccccaccgtactgcaaggctatcactgagcctgttacagtgaaaatgcagctaaggcggccttctgatcaggaagtgtccgaatcgatggattttcgctatctgccagatgagaaagatacatatggaaacaaagctaagaagcagaagacgacactactgtttcagaagctatgccaggaccacgtggagacagggttccggcacgtcgatcaggatgggctggagttactaacgagcggggacccccctacacttgccagccagagtgcgggaatcaccgtgaatttccccgagcggccaagacccggactgctgggcagtatcggggaaggtaggtactttaaaaaggagcccaaccttttttctcatgacgcggtcgtcagagagatgccaacaggcgtgtcttcccaggccgagagctactacccttctcccggtcccatttcctctgggctgagccaccatgcttctatggcccctctaccgtcttctagctggtcttccgtggctcaccccacccctcgctccgggaatactaatcccctgagtagcttttccaccaggacactgcccagtaattcacaaggcataccaccctttctgcgaatcccggtggggaatgacctgaacgctagcaatgcctgcatctacaataatgcggatgatattgtgggcatggaggcatcaagcatgccctccgctgacttgtacgggatttctgatcctaatatgctgtctaattgcagtgtaaacatgatgaccacctccagcgactctatgggtgagacagacaaccctagacttctaagcatgaatctggaaaatccgagttgcaactcagtcctagacccaagggacctgaggcaactccaccagatgagcagttcttcaatgtctgctggtgccaattccaacacgactgttttcgtgagccagtccgatgccttcgaaggctccgacttcagctgtgccgacaatagcatgatcaacgaatctggccctagtaattcaaccaacccaaactcacacggatttgtgcaggattcacaatacagcggaattggctctatgcaaaacgagcagttgagcgacagttttccttacgaattttttcaggtgtag

SEQ ID NO: 246748 - DNA, 1764 bp, Artificial Sequence
  Description of Artificial Sequence: Synthetic coding sequence
atggccagcggcgcatacaacccttacatcgaaatcatagagcagccgcgacagaggggcatgagatttcgatacaaatgtgaagggcgttcagctggttcgatcccaggcgaacactccacagacaacaatcggacatatccatccattcagattatgaattattacggcaaaggcaaggtgagaatcactctcgtgacaaagaacgacccctataaaccccatccacacgatctggtggggaaggactgccgcgacggttactacgaagctgaattcggccaggagcgccgtcctctgttctttcagaacctcggcattagatgcgtaaaaaaaaaagaagtcaaggaagctattattaccagaatcaaggccggaatcaatccattcaatgtcccggagaagcaactgaatgacattgaggactgcgacctgaacgtagtccgtctgtgtttccaggtgtttctacctgacgaacatggcaatctgaccacagctttgccgccagtggtgtctaatcccatttacgataacagagcacccaatacagcagaactcagaatttgtagggtgaataaaaactgtggcagtgttagggggggagatgagattttcttgctgtgcgacaaagtacaaaaagatgacatcgaggtgaggttcgtgttaaacgactgggaagctaagggtatcttttctcaggccgatgtccacagacaggtagccattgtgtttaagacacctccctattgtaaggcaattacagagcccgtgactgttaagatgcagctgaggcgcccatctgaccaggaggtctcggagagcatggattttcgatacctccccgatgaaaaggatacttacggaaataaggcgaagaaacagaagaccaccctgctatttcagaagctctgtcaggatcacgtgaacttccccgagcgacctcggcctggactcttgggctcaatcggagaagggagatacttcaaaaaagaacccaatctttttagccacgacgccgtcgttagggagatgccgactggtgtgagttcacaggccgaaagctattacccttcacctggtccaatttccagtggcctgtctcaccacgcttccatggcaccgctaccctcctctagctggtcctccgttgcacacccaaccccgcgttccggcaataccaatccgctgtccagcttttccactagaacacttccatctaacagccagggaattccccctttcctgcgcatacccgtgggcaacgacttgaacgctagcaatgcatgtatctataacaatgccgacgacatcgtcggtatggaagcatctagcatgccaagcgccgatctctacggcatcagtgatcctaatatgctcagcaattgttccgtgaatatgatgacgacatcttctgacagcatgggtgagaccgacaaccccaggttgctatctatgaatttagagaatcccagttgtaactcagttctcgaccctagggatctccgtcagctgcatcagatgtccagctcttctatgagtgccggtgccaactctaacaccactgtttttgtttcccaatcagacgcgtttgaagggtccgatttttcctgtgcagacaattccatgataaatgaatctggtccaagtaacagtaccaatccaaactcgcacggcttcgtgcaggattcgcagtattcggggataggcagcatgcagaacgaacaattatccgattcattcccatacgagttctttcaggtctag

SEQ ID NO: 246749 - DNA, 1647 bp, Artificial Sequence
  Description of Artificial Sequence: Synthetic coding sequence
atggacgaattgttccccttgatcttcccagcggaacctgctcaggccagcgggccttatgtagagattatcgaacagcctaagcagcgcggaatgagatttcgctataaatgtgagggccgtagcgctggctcaatcccgggagagaggtctacagacaccaccaagacacaccctacaatcaaaataaacggctatactggcccagggaccgtcaggattagtctcgtgacaaaagacccccctcatcgcccacatccccacgaactggtcggcaaggactgcagggacgggttttacgaggctgagctgtgtcccgatcggtgtatccatagttttcagaatctgggcattcagtgcgtgaaaaagcgtgacttggagcaggctatcagccagcgcatccagaccaacaacaatccatttcaggaagagcagcgaggagactacgacctcaatgctgtgcggctgtgtttccaagtaaccgttcgggacccatccggaagacccctaagactgcccccagttttaagccacccaatatttgataaccgggcacctaataccgctgagcttaagatctgccgggttaaccggaactcaggaagctgtctggggggtgatgaaatctttctcctttgcgataaagtgcaaaaagaggacattgaagtgtacttcactggtccgggttgggaagcacggggttcattctctcaggccgatgtgcatagacaggtggccatcgtttttcggactccaccctacgccgatccatcattgcaagctccagtgagggtgagtatgcagctgcggaggccatctgatagagagttgagcgagcccatggagttccagtacttacctgacaccgacgatagacaccggatcgaggaaaaaaggaagcgcacttacgaaacatttaagagcatcatgaaaaaaagtcctttttcaggcccaaccgatcctagacccccacccaggaggattgctgtgccgagtaggtcttcagccagcgtgccaaagcctgctccgcagccatacccttttactagctctctcagcacgatcaactacgatgagttcccaaccatggtattccccagcggccagatcagccaggcttcggccctcgcccctgcccctccgcaggtgcttccacaggcaccagccccagcccctgcccctgcaatggtgagcgcactcgcccaggccccagccccagtgcccgtcctggctcccggtcctccacaagcagtagcacccccagcgccaaaaccgactcaagccggtgaggggacgttatcagaggcgttacttcagttacaattcgacgacgaagacctgggcgcacttctcgggaattctaccgatccagccgtttttaccgatctggcaagcgtcgataattctgagttccagcagctgcttaatcagggcattcccgttgcgccacacaccacagaacccatgctaatggagtatcccgaagccatcacgcggctggtaactggtgcccagcggcctcccgacccagcacctgcacctctgggggcacccggtcttccgaatggactgctttcgggagatgaggattttagctcaatcgcagacatggacttttccgcactgttgtcccagatctccagttag

SEQ ID NO: 246750 - DNA, 1656 bp, Artificial Sequence
  Description of Artificial Sequence: Synthetic coding sequence
atggacgaactgtttcctctcatctttccagctgagcccgctcaggccagtggcccttacgtggagataattgaacagcctaagcaacgaggaatgcggttccgatacaagtgtgagggtagatccgcaggatcaattccaggcgaaaggtcgacagacaccacaaagacacatcccactattaagatcaatggatatactggcccagggaccgtgagaattagcctcgtaacaaaggaccctcctcatcgacctcatccacacgagctagtgggcaaggattgtagagatggcttttacgaggccgaactttgccctgacaggtgcatacactcttttcagaacctgggaatccaatgcgtgaagaagagagacttggagcaggccataagtcagcgtatccagacgaataataacccatttcaagtgcccatcgaagagcaacgcggtgattatgacctcaatgccgtgaggctctgttttcaggtaactgttcgcgatcctagcggacgccctctccgcctcccgcctgttctttcacaccctatcttcgacaaccgagcccctaatacagccgagctaaagatctgtagggtgaaccgtaactcaggaagttgcttgggcggtgatgaaatcttcctcctttgcgataaagtccaaaaggaggatatcgaggtatactttacaggcccaggttgggaggcacgagggtccttcagccaggctgatgtgcatcggcaggtggcaatcgtcttccgaacgcccccttatgcggacccgtctcttcaggccccagtgagagtgagcatgcagcttcgaaggcccagcgatcgggaattgtctgagccgatggagttccaatacctgccagacacagatgataggcataggatcgaagagaagcgtaaaaggacttacgagacttttaagtctatcatgaaaaaaagcccctttagcgggccaactgatccgaggcctccgcctcgaagaatagctgtacccagccgcagcagcgcatcagtccctaaacctgctccgcagccatacccctttacctcttcactctccactatcaactacgacgagtttccaactatggtctttcccagcggacagatctcccaagcctccgccctggctccggctccccctcaggtacttcctcaggcccctgctcctgccccagcacctgctatggtctcggctcttgcgcaagccccagctcccgtgcccgtgctggcccctggaccgccacaggctgtggccccacccgctcctaaacctacccaggcaggcgaggggaccctttctgaggctctgctccagcttcagttcgacgatgaagaccttggagccttgctcggcaacagcactgacccagccgtcttcacagacctggcatcagtggacaactctgagttccagcagctgctgaaccagggcatccccgtcgccccacacactaccgagccaatgctcatggaatatcccgaagccatcaccagactggtcacgggtgcgcagagaccccctgaccccgctcctgcacctctgggtgcgcctggcctccccaacggccttctgtccggggacgaggacttctcctccattgcggacatggacttcagcgcgctccttagccaaatttcatcttag

SEQ ID NO: 246751 - DNA, 741 bp, Artificial Sequence
  Description of Artificial Sequence: Synthetic coding sequence
atggatgagctgttcccattgatattcccagcagaacctgcccaggcttcggggccatatgtggaaatcattgagcagccaaagcagcgcggaatgaggtttcgctacaagtgcgaagggagaagcgctggaagcattcccggagagcgatcaactgacactaccaaaacccatccgaccataaagataaacgggtataccggccctggcaccgtcaggatttcactagttacaaaagacccgcctcatcgccctcatcctcacgagctggttggaaaggattgtagggacggtttttatgaggcagagctgtgtccagaccgttgtatacattccttccagaatctgggcattcagtgcgtcaaaaaaagggatttggaacaggctatctcccagagaatccagactaataacaatccattccaggtcccaatcgaagagcagcgcggagactacgacctgaacgcggttcgcctatgcttccaagtcacagtgagggacccctccgggcgtccactgaggttgccccctgtgttgtctcacccaatctttgacaacagggcacctaatactgccgaactgaaaatctgtcgtgtcaatcggaacagcgggtcatgcttaggaggagatgagattttcctgctctgcgacaaggttcagaaagaggatatcgaggtttgcccacaagctagtacaccagcgctgagcctgtatgtcattccggaacaccatcagctgtag

SEQ ID NO: 246752 - DNA, 1134 bp, Artificial Sequence
  Description of Artificial Sequence: Synthetic coding sequence
atggacgaattatttcctctaattttccctgctgagccggcacaggcttcaggcccttacgtggagattatagagcagcccaaacagcgcggtatgcgcttccgctacaaatgcgagggacgaagcgccggatctatccccggtgaacggagcactgacacaactaagactcacccaacaataaagatcaacgggtacacgggacctgggaccgtcagaatcagcctagtgaccaaagaccccccacaccgcccacatccccatgagttagtgggtaaagattgccgggacgggttctacgaagcggaactttgtcctgacaggtgcatccattcgtttcaaaacttaggaattcagtgtgtgaagaagagagaccttgagcaagctatctcacagcgtatccagaccaataacaaccccttccaagtgccaatcgaggagcaacgcggagactacgacctcaacgctgtgcggctgtgctttcaagttaccgtgcgcgaccccagcgggcgaccgctgaggctccctcctgttttatcgcacccgatcttcgacaaccgcgcacccaataccgccgagctgaaaatttgtcgggtaaatagaaactccgggagttgccttggcggtgacgagatcttcctcctttgtgataaggtccaaaaggaggacatcgaggtgtatttcacaggtcccggatgggaggccaggggaagcttttcccaggccgatgtgcaccgccaggtggccatcgtgttccgcacgccaccctatgctgacccttctctgcaggcacctgtgcgggtgagtatgcaactgagacgccctagcgaccgggaactttctgaaccgatggagtttcagtatttacctgacacggatgacaggcaccgaatcgaggagaaaagaaagcggacctacgagaccttcaagtctataatgaaaaagagcccattctccgggccaactgacccgagaccaccaccaagaaggatcgctgttcctagccgctctagtgccagcgtgcctaaacccggtaaggatttccttctgtctcattggaacgatcgcttttccagcgtacagctgcggtcaagcggtgatgaggatagttgggcccctttgcaaacatactag

SEQ ID NO: 246753 - DNA, 714 bp, Artificial Sequence
  Description of Artificial Sequence: Synthetic coding sequence
atggatgagctgttcccccttattttccccgctgaacccgctcaagccagcggcccatatgttgaaataatcgagcagccaaagcagagaggaatgcgctttcgctacaaatgtgagggcagatctgcgggaagcattcctggcgaacgcagcacggacacaactaagacacaccctacaatcaaaatcaatgggtacaccggaccaggaacagtgcggatcagccttgtcacgaaggatccccctcatcgccctcacccccacgaattggttggtaaggattgcagagatggcttttatgaagcagaactgtgccctgaccgatgcattcatagctttcaaaatctcggaattcagtgcgttaagaaaagagacctggagcaggctatttctcagcgaatacagaccaacaataacccattccaggtgcctatcgaagagcagaggggggactatgacctcaatgccgtgcggctttgttttcaggtgacggtccgagatccgtccggacgacccctgaggctcccgccagtgctctcccatcccatcttcgacaaccgggctcctaatacagctgagcttaagatttgccgcgtcaatcgcaactcagggtcttgcctggggggtgacgaaatcttcctcttatgcgataaggtgcagaaagctcatgggataccagtgcccgctcgttacagacgatcatcaccagactag

SEQ ID NO: 246754 - DNA, 1278 bp, Artificial Sequence
  Description of Artificial Sequence: Synthetic coding sequence
atggacgagctgttcccgctcattttccctgctgaacctgcccaggcaagcggaccttacgtcgagataattgagcagcctaaacaacgagggatgcggttccgttacaaatgcgagggcaggtctgctggcagtataccaggcgagaggagcactgacaccacaaagacacatccaaccattaaggtctggatgagtgggccactttactttggccagattaatggatatactgggcctggaaccgtgcgaatcagcttggtaactaaggatcctcctcatagaccgcaccctcatgagctggtggggaaggattgccgcgatggtttctatgaggccgaactgtgccccgatagatgcatccactctttccagaacctgggcatccagtgcgttaagaagcgcgacctggagcaggctatcagtcagcgcatacagacaaacaataaccctttccaggttcctattgaggaacaacggggagactacgatctcaatgctgtcagactgtgctttcaagtgacagtccgcgacccctctggaaggcctcttaggctgcccccagtgctttcccaccctatttttgacaaccgggctcctaacaccgcagaactgaaaatctgtcgggttaaccgcaattccggcagctgcctcgggggtgatgagatattcctgctgtgtgataaggtgcagaaggaagacatcgaagtgtactttacaggaccgggatgggaggcaagaggaagtttttcccaggccgatgtacacaggcaggtcgcaatagttttccggactcccccttacgctgacccatccctgcaagcgccagtcagagtgtctatgcaacttagacggcctagtgacagagagctgagcgaaccaatggaattccaatatctgccagatacagatgaccggcaccgcattgaagagaagcgcaaacgtacctatgaaacttttaaatccatcatgaaaaagagcccatttagcggcccaaccgatcccagacccccacccaggaggattgccgttccaagtcgctcctccgcctcagtgcccaagcccgcaccacagccatatcccttcactagctcactctccacaatcaactatgatgagtttccgactatggtcttcccatcaggacaaatttcccaggctagcgctttggctcccgctccaccacaagtgttgccgcaggctccagctcccgctcctgcccctgctatggtaagcgccctggctcaggcccctgagcactgggtggccggagactag

SEQ ID NO: 246755 - DNA, 1314 bp, Artificial Sequence
  Description of Artificial Sequence: Synthetic coding sequence
atgacccaattcctgcctcccaatctgctagccctgttcgccccacgggaccctatcccgtacctgccaccactggaaaagctgccacacgagaagcaccataaccaaccttattgcggaatagcaccctacattcgagagttcgaggatcccagagacgctcccccacccacaagggccgagacccgggaggagagaatggagcgtaaacggagagagaagatcgagcgcagacagcaagaagtcgaaactgaattgaaaatgtgggaccctcataacgaccccaacgcccagggcgacgctttcaaaacactatttgtggccagagtgaactacgacaccacagagtctaaactgcggagagagtttgaggtgtacgggcctatcaaaagaatacatatggtatactccaagcggtcaggtaagccaaggggttacgctttcatcgaatatgaacacgaacgtgacatgcatagcgcttacaagcatgctgatggcaagaaaattgatggtcgccgtgtgctggtagacgttgaacggggaaggacggtaaagggatggagacccagacgccttggaggaggcttggggggtacccggcgaggaggggcagacgtgaacattaggcactcaggcagggacgatacaagccgctatgacgagcgacccggacctagcccactaccccacagagatcgagatcgggaccgggagcgagagagaagggagaggtcacgagagagggataaggagcgggaacgcaggagaagcaggtcaagagatcggaggcggcgtagcagatcccgtgacaaagaggaaaggcgacgctctagggaacgttcaaaggacaaggatcgggaccggaagcgacgaagctcacggtcacgcgaacgggctaggcgcgaaagggagagaaaagaggagttgaggggcggtggaggggacatggctgaaccttctgaggctggcgacgctccacccgacgacggtcccccaggggaactcggcccagacggacctgacgggcctgaagagaaggggagggatcgagatcgagaacgcagacgatcccaccggagtgagcgagaacgtcggcgagatagggacagagatcgggatcgggatagagagcacaagcgcggagaacgcggtagcgagaggggcagagacgaggcccgtggcggaggaggcggtcaagacaacggactggaaggtttaggaaacgactcgcgagatatgtacatggaatctgaagggggtgatggctacttggcacccgaaaacgggtacctgatggaggccgctccagagtag

SEQ ID NO: 246756 - DNA, 1731 bp, Artificial Sequence
  Description of Artificial Sequence: Synthetic coding sequence
atgctaaggagcggcccagcctctgggcctagcgtccctaccggccgtgccatgccatcccgcagggttgctcgtccccctgcagctcccgaactgggcgctcttggtagtcctgacctgagttcattatcactggctgtgagtcgctccacagagattattgatgagtatatcaaggagaatggctttggtctagacggcggtcagcccggtccaggcgaaggacttccaagattggtgtccagaggggctgctagtctgtcaaccgttaccttaggccctgttgccccacccgctaccccccctccatggggttgccctctcggtcggctggtgtctcccgcacctggcccagggccacagccccacttggttattaccgagcagccaaagcagaggggaatgcgattccgctatgagtgtgagggcaggtcggccggatctatattgggagagtccagcactgaggctagcaaaacattacccgcaattgaactgcgggactgcgggggtctgagggaggtcgaggtcacagcatgtctggtctggaaggactggccccatagggtacacccacatagcctggtcgggaaagattgtaccgatggcatttgccgggtcaggttaagaccacatgtgtctcctcgccattccttcaataacctcggtatccagtgcgtacggaaaaaagaaatagaagccgctattgaacgaaaaatacagctggggatcgatccttacaatgccggatcactcaagaaccatcaggaagttgatatgaacgtagttagaatctgtttccaggcttcctatagggaccagcagggacagatgagacgcatggatcccgtccttagtgagcccgtgtatgacaaaaaaagcaccaatacaagcgaactgaggatatgccgaatcaacaaggagtctgggccttgtaccgggggtgaggaactttacctcttgtgtgataaagttcaaaaggaagacatctctgtagtcttttccagggccagttgggaggggcgagccgacttttcacaggccgacgtgcatagacagatagccatcgtttttaagacccccccatacgaagacctcgagattgtggaacctgtgaccgtgaatgtttttctacagaggttgactgacggcgtgtgcagcgaacccctgcctttcacgtatctgccacgggatcacgactcctacggagtcgataaaaaacggaaacgagggatgccagacgtgctgggcgagctgaactctagtgacccacacggtatcgaatccaaacgcaggaagaagaagcctgccattctcgaccatttcctgccgaaccacggatcagggccatttctgccaccaagcgccctgctcccagatcccgattttttttcaggcaccgtgtcattgcccggattagaacctcctggcggtccagatctgctcgatgacggattcgcttatgaccctaccgcccctaccctgtttactatgctggacctacttccgccagcacccccacacgcctctgccgtcgtgtgctctggtggtgctggtgctgttgtaggtgagacccctggccctgaacccctgacgctggattcatatcaggccccaggccctggtgatgggggtactgcgtccctggtagggtctaacatgttccccaaccattatcgggaggccgcattcgggggagggctattgtcccccggacccgaggcaacctag

SEQ ID NO: 246757 - DNA, 1740 bp, Artificial Sequence
  Description of Artificial Sequence: Synthetic coding sequence
atgcttagatccgggccagcttcgggcccatctgtgcctacgggtagagctatgcctagtaggagagtagctaggccgcctgccgcacccgaactcggagccttaggttctcccgacctgagctctttgtctctggcagtgagccggtcaaccgacgagttagaaattatagatgaatatatcaaggagaacggctttggcctggacggaggtcagcccggtccaggagaaggtttaccacgtctcgttagccgcggtgccgcatctctcagcacagtaactctcggccctgtcgccccaccggcaaccccacctccgtggggctgccccctggggaggctcgtgtcccctgcgcctggacccggtcctcagccacacctagtgatcaccgaacagccaaagcagagaggcatgcgcttccgctacgaatgtgagggacgttctgcagggtccattcttggggagtcttcaacggaagcttcgaaaacactgcccgctatcgagctgcgggactgtggtggtctgcgggaggtggaggttactgcatgcttagtgtggaaagactggcctcaccgcgtgcacccacattccttagttggaaaggattgcaccgacggtatctgccgggtgaggctaaggccacacgtgtcacccaggcatagcttcaacaatcttggcattcagtgcgtgcgcaagaaggagatcgaagccgctattgaacggaaaatccagctcgggatcgatccctataatgcaggatccttaaagaatcaccaggaggttgatatgaacgtcgttcgtatttgctttcaggcctcatacagggaccagcagggacagatgcgacgaatggaccccgttctgtccgagccagtctacgacaaaaagtccaccaatacgtcagagttacgaatttgtcgaattaacaaggaaagcggaccttgcactggcggagaggagctgtatctgctgtgtgataaagtgcagaaggaagacatttctgtggtattttccagggctagttgggaggggagggccgacttctcccaggccgacgtacaccgccagatcgcaatagttttcaagactcccccttatgaagatcttgaaatcgtggagcctgtcactgtgaacgtttttttgcagagactgacggacggcgtgtgctctgagccactgccatttacttaccttccacgcgaccacgattcctacggagtcgacaagaagcggaaacgaggaatgcccgatgttctcggcgagctgaacagcagcgatccacacggcattgaatctaagagaagaaaaaaaaaacccgcaatcctagaccattttctgcccaaccatggaagcggcccattccttcctccctctgcactcctgccggaccctgactttttttccgggaccgtgagcctaccaggcctggaaccacccggagggccagatctccttgacgatggcttcgcttatgaccctaccgccccaacactttttacaatgctggacttgctcccacctgctccaccgcacgccagcgccgtggtatgctcaggtggggctggcgctgtggttggcgagacccctggccctgaaccacttaccctggactcctatcaggcccctggcccaggggacggcggaaccgctagtttagtgggcagcaatatgttccctaatcactatcgggaagctgcattcggtggaggcctgctcagtcccggaccagaggctacgtag

SEQ ID NO: 246758 - DNA, 2187 bp, Artificial Sequence
  Description of Artificial Sequence: Synthetic coding sequence
atggaggctgccgcaggaggccgaggttgtttccaacctcatcccggattgcaaaaaacactcgagcagtttcacctttcaagcatgtctagcctcggcggacctgccgcattctccgcacggtgggcacaagaagcttacaagaaggagagtgctaaggaggctggggctgctgccgtgcccgcaccagtgcccgcagcaaccgaaccgcctcccgtgctgcacctgcctgctatccagcctcccccacccgttctcccgggacctttcttcatgccctcggatagatctaccgaacggtgcgaaaccgtcctagaaggcgagaccatcagctgctttgtggtcggcggagaaaaaagactgtgcctcccacagattctcaactcagtgctgcgggactttagcttacagcagataaatgccgtttgcgacgagttacatatctattgttcccggtgcacggccgatcagctggagatcctgaaggtcatgggcatcctccctttctcagccccatcctgcgggctgatcactaagacagacgccgagaggttgtgcaatgcgttactgtatggcggtgcctacccgccaccctgcaaaaaggagctcgcagcctcgcttgcccttggcctcgagctctctgagagatccgtccgggtgtaccatgaatgttttggtaagtgcaaaggactcctggtgcccgagttatacagcagcccatccgctgcgtgcattcaatgcctggattgtaggcttatgtacccacctcataagtttgttgtgcactcccataaagcacttgaaaatcgaacatgtcattgggggttcgacagcgcaaattggagggcatacattctgctatcacaggattacaccggaaaagaggagcaggctaggcttggacgctgtctcgacgacgtgaaggaaaagttcgattatggcaacaagtataagaggcgtgtcccgagggtatccagcgagccccctgcaagtatcaggcctaaaactgacgacactagcagccagtcgcctgcccctagcgaaaaggacaagccctcatcctggttgagaaccctggccggatcatcgaataagtccctgggctgtgtgcacccacgtcaacggctttcggccttccggccttggagtcctgcagtctcggcctctgagaaggagctgagtccgcacctgcccgctctcatccgggacagtttctattcatataaatcctttgaaactgccgtcgcgcctaacgtggcactggcacctccagctcaacagaaggtggtgtcctctcccccttgcgccgctgcagtctccagggcacccgagcccctcgccacctgcacacagccgaggaagagaaaattaacagtcgacacacccggtgcccctgagactttggccccagtggcggctcccgaggaggacaaggactctgaggcggaagttgaagttgagtccagggaagaattcacgtctagcctcagttcgctctcatcccccagctttacctctagctctagcgccaaggacctgggatctcctggggcaagggcgctgccatctgctgtgcctgatgccgcagcgccagccgatgcccctagcgggctggaggcagaactggaacacttgcgacaggccctggagggcggtttggacaccaaggaagccaaggagaagtttctgcacgaagtggttaaaatgcgcgtgaagcaggaggaaaaactgtccgctgccttacaggctaaaagatccctgcatcaagaactggagtttttaagggtggctaaaaaggagaagttacgggaagctaccgaggctaaacgaaaccttagaaaggagatcgaacgcctccgtgccgagaacgaaaagaagatgaaggaggccaacgaatcaagactgaggctgaagagggaattagaacaggcacggcaggctcgggtgtgcgataagggctgtgaggctggccgtctgagggccaagtacagcgctcaaatagaggacctgcaggtcaagctgcagcatgctgaggccgacagagaacagcttcgagcggaccttctaagggagagggaagcgagagaacaccttgaaaaggttgtgaaggagctgcaggagcagctctggcctcgggcacgacccgaggccgctgggtcagagggagcggcagaattggagccttag

SEQ ID NO: 246759 - DNA, 1632 bp, Artificial Sequence
  Description of Artificial Sequence: Synthetic coding sequence
atgggctgtataaagtcaaaggagaataaatcacccgcaatcaagtacagaccagaaaacacaccggagccggtctctacatctgtcagccattatggtgccgaacccaccaccgttagcccatgcccctcatccagtgctaagggcactgccgtgaacttctctagtctgtccatgacaccatttggaggctcttccggagtcacacccttcggcggagcctcctcaagcttctccgttgtcccctcatcttaccccgcagggctcactgggggtgtgaccattttcgttgcactctacgactacgaagcgcgtacaaccgaggacttgtcattcaaaaaaggcgagcgcttccagattattaacaacacagagggtgattggtgggaggcgagatcaatcgccactgggaaaaatggttatatcccttcaaattacgtggctcccgcagactctattcaggctgaagaatggtacttcggcaaaatgggcaggaaggacgcagagcgcttactgttgaacccaggaaatcaaagaggaattttcctggtgagggaatccgaaacaacaaagggggcttactcactgagcatccgggattgggacgaaattcgcggagataacgtaaagcactacaagattagaaaactggataacggagggtactatattaccacacgggcacaattcgacaccttacagaaactggtgaaacattacacggagcacgccgacggtctttgtcacaagttgacaaccgtatgtcctactgtaaaacctcagacgcagggactcgctaaggacgcgtgggagatacccagggaatctcttaggttagaggtcaaactcggtcagggctgttttggcgaggtttggatgggcacttggaacggcactaccaaggttgccatcaaaacattaaagcccggaactatgatgcctgaggctttccttcaggaagctcaaatcatgaagaagctccgccatgataagctcgtaccactctacgctgtagttagcgaggaaccaatttacatagtgaccgaatttatgtcaaagggatctctgctggactttctgaaagaaggcgacggaaagtatttgaaactgccccagcttgttgacatggctgcccagatcgcagatggtatggcctacatagagagaatgaattacatacacagggatttacgcgcagccaatatcttggtgggggaaaatttagtatgcaaaattgccgatttcgggctcgcaagactgatcgaagataacgaatacaccgctaggcagggagcaaagttcccgatcaaatggacggcgcctgaggccgcactctacggtcgcttcacaataaaaagcgatgtgtggtcctttgggatcctccagaccgagcttgtcaccaaggggagggtcccttaccccggaatggttaacagagaggtgctcgagcaggttgagcgtggttaccgcatgccatgccctcagggctgcccagaatctctccacgagttgatgaatctctgttggaagaaagaccctgatgagaggcccacattcgagtacattcagagctttctggaagactatttcaccgcaacagagccccagtaccagcccggagagaatctgtag

SEQ ID NO: 246760 - DNA, 1632 bp, Artificial Sequence
  Description of Artificial Sequence: Synthetic coding sequence
atgggctgtatcaagtcaaaagaaaataaatcacctgcaatcaaataccggcctgagaatacacctgagcctgtctcaaccagcgtctcgcattatggcgcagagccaacaaccgtttccccttgcccaagtagtagcgccaagggaactgccgtcaacttttcaagcttgtccatgacaccgttcggcggaagcagtggcgtgacacccttcggcggtgccagcagttcattttcggtggtgccatcatcatatccggctggattgaccggaggagtcactattttcgttgcactgtacgattacgaagctaggaccacagaagacctatcctttaagaaaggggaacgttttcagatcattaacaataccgaaggggactggtgggaggcacggagtattgccactgggaaaaatggatatatcccgtcgaattacgtcgcgccagccgactccatccaggcagaagaatggtatttcggcaagatgggccgaaaagatgctgagcgcctgcttctgaacccgggaaaccagagaggaatcttccttgtcagggaatccgagaccacaaagggggcatactcgctaagcattcgggattgggacgaaatcaggggtgataatgttaaacattacaagatacggaaacttgacaacggagggtactatataacaacccgcgcacagtttgacacactacagaagctagtgaagcattacacggagcatgccgacggcctgtgccacaaactgactacagtgtgtcctacagtcaagccccaaactcagggactggcaaaagatgcctgggaaattcccagggagagcctccgactggaggtgaaattagggcaggggtgtttcggtgaggtttggatgggaacttggaatggcaccaccaaagtcgcaatcaaaactcttaaaccaggcaccatgatgcctgaggcatttctgcaggaagcacagatcatgaagaagctgaggcatgacaagttagtccctctttatgccgtggtgtctgaggagcctatatacattgtgactgagttcatgagcaaaggctccctgctcgattttctgaaggagggggacgggaagtatcttaaactgcctcaattggtagatatggcagctcagatcgcggatggtatggcctatatagagagaatgaattacatccaccgagacttaagagcagccaacattctggtgggcgaaaatctggtctgcaaaatcgctgattttggattggccagactgattgaggacaacgaatacaccgcaaggcagggggctaagttcccgattaagtggaccgcccctgaggcagcactgtatgggaggttcaccatcaagtcagatgtgtggtcatttggaatcctgcagaccgagctagtgacaaaagggagggtgccttatcccggaatggttaacagagaagtcctcgaacaagtggagcgaggctatcgaatgccttgcccccagggttgccccgaatccttgcacgagctgatgaatctgtgttggaagaaagatcctgatgaacgaccaacatttgaatatatccaaagcttcctcgaggactatttcaccgccactgaaccacagtaccagcctggcgagaatctgtag

SEQ ID NO: 246761 - DNA, 1632 bp, Artificial Sequence
  Description of Artificial Sequence: Synthetic coding sequence
atgggatgtattaaatccaaagaaaataaaagtcccgctataaaatacagacctgagaacacgcctgaacccgtttccacatctgttagccattatggagccgagccgacgaccgtatccccttgcccaagcagttcagcgaaaggaacggctgtgaacttctcaagcttatctatgaccccattcggaggcagctctggagttactccattcgggggagcatcaagttcattctcagttgttccttcaagctacccggcagggctgacaggtggtgtaacaatattcgtagccctatatgactatgaggctagaactacagaggacctgtcctttaagaaaggggaacgattccagattataaataatactgaaggtgattggtgggaagccagatcaatcgcaactgggaagaacggctacatcccctcaaattacgttgcccctgcagactccatacaggccgaggaatggtattttgggaaaatgggtcgaaaggacgctgagcgactgctgttaaacccaggcaaccagcgcggaatttttctcgtgagagagagtgaaactactaagggcgcatacagcttgtcaatccgcgattgggacgagattcgcggagataacgttaagcactacaaaattcgtaaactcgacaatggagggtactatattactacccgcgcacagtttgacaccctccaaaaacttgttaagcactatactgaacacgcagacggcctctgtcacaaattaactaccgtgtgtccaaccgtgaaaccccagacgcaggggctggccaaggacgcttgggagatccctcgagaaagcctcaggctagaggtaaaactcggtcaggggtgcttcggcgaagtgtggatggggacatggaacggaacaaccaaagtcgccattaagaccctgaagcctgggactatgatgcctgaggccttcctgcaggaagctcagatcatgaagaagctgcgtcacgacaaactggtgccactgtacgctgttgtgtcggaggagcccatctacattgtgacagagtttatgtctaagggatcacttcttgattttttaaaggaaggcgatggcaaatacctgaaacttccccagctcgtggatatggctgcacagatcgctgatgggatggcctatatcgaaaggatgaattatatccatagggaccttcgcgctgccaacatattggtgggggaaaacctggtgtgtaagattgcagactttggcttggctagactgattgaagataacgaatatacagctcggcaaggggctaagtttcccattaagtggacagctcctgaagctgctctttatggccgttttaccattaaaagtgacgtttggagctttggcatcttgcagactgagctcgtgacaaagggaagggtcccatatccaggaatggtgaaccgcgaggttctggagcaggtagagaggggttacagaatgccatgtccccaaggctgtcctgagtcactacatgaactgatgaacttgtgttggaaaaaggatcctgacgagcgtcccaccttcgaatacatacagagcttccttgaagactactttacagctaccgaacctcagtatcagccaggagagaatctttag

SEQ ID NO: 246762 - DNA, 1539 bp, Artificial Sequence
  Description of Artificial Sequence: Synthetic coding sequence
atgggctgcatcaaaagcaaggggaaagacagcctgagcgacgatggcgtggacctcaagacccagccggtcagaaatactgagcgcaccatctacgttagagatcctacctccaacaaacagcaacgaccagtacccgagtctcagcttctgccaggacaacggttccaaacaaaggacccagaggagcagggtgacattgtcgttgcgctgtatccttatgacggtatccatcctgatgacttatcttttaagaagggagaaaagatgaaagttttggaagaacacggcgagtggtggaaggcgaaatccctgctgacaaagaaggaaggcttcattcctagtaattatgtagccaaactcaataccttggaaacagaggagtggttttttaaagatataacccggaaagacgccgagcgacaattactggcccctggcaactctgctggagccttcctgattagggaaagcgagaccctcaaggggtcgtttagccttagtgtgagggattttgatccagtccatggtgacgtgatcaagcactacaaaataaggagtctcgataatgggggttattacataagcccacgtattacattcccctgcatctcggacatgattaaacattaccagaaacaggccgatgggctgtgtcggaggctggaaaaggcctgcatctcccctaaaccgcagaagccctgggataaggatgcctgggagatcccaagagaatctataaagctggtgaagagactcggtgctgggcagttcggagaggtctggatgggctactataacaatagtacaaaagtcgcagttaaaactcttaagccagggacaatgtccgtgcaggccttcctggaagaagcaaatctgatgaaaacactgcaacatgataaactcgtgcgactctacgcggtcgtgactagagaagaacctatctacattattacagagtatatggctaaaggatcactcctcgatttcttgaaaagcgacgagggaggcaaggtgctcttacccaagctgattgactttagcgcacagatagccgaaggcatggcctatattgaacggaaaaactatattcacagggacctgcgagccgctaatgtgctcgtgtctgaaagtctgatgtgtaaaattgccgattttggcctggcccgtgtgatcgaggacaacgaatacaccgcccgagagggtgccaagttcccaatcaaatggaccgcccctgaagctattaacttcggttgtttcactatcaaaagtgatgtttggtccttcggcatcctgctgtacgaaatcgtcacttatggaaagataccctatcctggaaggactaatgccgacgtgatgacagcactgagtcagggctacaggatgccgagagtggaaaattgtcccgacgagctctacgacatcatgaagatgtgctggaaggaaaaggcagaagaaagaccgactttcgactacctacagtcggtcctcgacgatttctataccgctacggagggacaataccagcagcagccttag

SEQ ID NO: 246763 - DNA, 453 bp, Artificial Sequence
  Description of Artificial Sequence: Synthetic coding sequence
atgggctgcatcaaaagtaaagggaaggatagcctgtctgacgacggagtggaccttaaaacgcaacccgtgcgcaacacagaaaggactatttatgtgcgggatcccacaagcaataaacagcagagacccgtccccgagtcacagctccttcccggacagcgatttcagactaaagatcctgaggagcagggagatatcgtggtcgctctgtacccctacgacggcatccatcctgacgacctgagcttcaagaaaggagagaaaatgaaagtcttggaggaacacggggagtggtggaaggccaagtcactgctgactaaaaaggagggctttatccctagcaattacgtggctaagcttaacactttggagactgaagagtggttcttcaaggatattaccaggaaggacgcagagcggcagctgctcgcccctgggaattccgcatag

SEQ ID NO: 246764 - DNA, 1476 bp, Artificial Sequence
  Description of Artificial Sequence: Synthetic coding sequence
atgggatgtatcaaatccaaaggcaaggattctctgtctgatgacggagtcgatctcaagacccagccagtaccagagagccagttgttacctggccaaagatttcagacgaaggacccggaggagcagggcgacatagtggttgccctgtacccgtacgatggcatccacccagatgacttgagttttaaaaaaggggagaaaatgaaagtactcgaggaacacggtgaatggtggaaggccaagagtctcttaaccaaaaaggaggggtttattccttcaaactacgtggcaaagctgaatacgctagagacagaggagtggttcttcaaggatataacccgcaaagatgcagagaggcaactgttagctcccggtaactctgccggagctttcctgattagggaaagtgaaaccttgaaggggtcctttagtttgagcgtgagagatttcgatccggtgcacggtgacgtgatcaagcattacaaaatcagaagtctcgacaatggcggatactacataagcccacggataaccttcccttgcatctcagacatgattaaacattaccagaaacaggccgacggcttatgccgccgacttgaaaaggcgtgcatcagcccaaaaccccagaagccgtgggacaaagatgcttgggaaatacctcgggagtcaatcaaattagtgaagcgcttaggcgcaggtcagtttggcgaagtctggatggggtactataataatagtaccaaagtggcagtgaaaaccctcaagcctggaactatgtccgtacaggcattcttggaagaggcaaatctcatgaagacattacagcacgataaactcgtccgactgtacgctgtagtaaccagggaagagccgatctacatcattacagagtacatggcaaaaggatccctactcgattttctgaaaagcgacgaagggggaaaagttctgctcccaaagctgatagatttttcagctcaaatcgcagagggcatggcctacattgaacgaaaaaactatatccaccgggacttaagagccgcaaatgtactggtttccgagtccctgatgtgtaagattgcagatttcggcctcgctagggtaatcgaagacaatgagtacacagccagagagggtgcaaaatttccaattaagtggactgcaccagaagcgattaattttggatgtttcaccattaagtcggatgtgtggtcttttggcattctcctgtacgagattgttacctatggcaaaattccatacccgggacggactaacgcagacgtcatgacggctctctctcagggttacagaatgccgagggtggaaaactgtcccgacgagttatacgacatcatgaaaatgtgttggaaggagaaagccgaagaacgcccaacctttgactatttgcaatctgtactggatgatttctacaccgctacggaaggacagtatcagcagcagccctag

SEQ ID NO: 246765 - DNA, 993 bp, Artificial Sequence
  Description of Artificial Sequence: Synthetic coding sequence
atggccgcagtggactctttttatcttttataccgcgaaatagccagatcgtgcaattgctatatggaagcactggccctggtgggggcatggtatactgcccgtaagtccatcacagtgatctgtgacttttacagtctgattcggctgcattttatccctcgactgggcagcagggctgacctgatcaaacagtacgggaggtgggccgttgtttctggggcaactgacgggattggcaaggcatacgcagaggagctggctagccgcggactgaatatcattctgatttccaggaacgaagagaagctgcaggtggttgctaaagacatcgctgatacttataaggtggaaacagatatcattgttgctgatttcagctccgggagggagatctacctcccaatcagggaggccctcaaggataaggacgttggtatccttgtgaataatgtgggagtgttttatccctatccacagtacttcacccagctcagtgaggataagctgtgggacataatcaatgttaacattgccgctgcatctctgatggtgcatgtcgttttgccaggtatggttgagagaaaaaagggagctattgtgacgataagttcagggtcctgttgcaaaccgacacctcagctcgcagcattcagcgcaagtaaagcctacctagaccattttagccgcgctttgcagtacgaatacgctagcaagggcatctttgtacagtctcttatccctttttatgtggccacttccatgacagcgccaagtaatttcctccacagatgttcttggcttgtgccatcacctaaggtgtacgcccaccacgccgtgagcacattgggtattagcaaacggaccacagggtattggagccactctatacagtttctgttcgctcagtacatgccggagtggttatgggtctggggagccaatatcctgaaccgcagcctgaggaaagaggctctctcctgcacagcctag

SEQ ID NO: 246766 - DNA, 336 bp, Artificial Sequence
  Description of Artificial Sequence: Synthetic coding sequence
atgggcagctcctcatttctagtgcttatggtaagcttagtgctggtaacgcttgtggctgtcgagggcgtaaaggaagggatcgagaaggccggagtgtgcccagcggataatgtaagatgttttaagtccgaccccccacaatgtcacaccgaccaggattgtttgggggagaggaagtgttgctaccttcactgcggctttaagtgcgtaattcccgtcaaggaacttgaggagggagggaacaaggacgaagatgtctcccgaccttaccccgaacccggatgggaggctaagtgtcccggatcctcctccacgcgatgtcctcagaaatag

SEQ ID NO: 246767 - DNA, 675 bp, Artificial Sequence
  Description of Artificial Sequence: Synthetic coding sequence
atgaggacacagtcgctcctgcttctcggcgctctgctggccgtgggctctcaactgccagccgtgtttgggagaaaaaaaggggaaaaaagtggcggttgtccaccggatgacggcccttgcctccttagcgtacccgatcagtgtgtggaagactcccagtgccctttgaccagaaaatgctgctacagggcttgcttcagacagtgcgtgccgcgagtgtccgttaaactggggtcatgcccagaggaccagctcagatgcttaagtcccatgaaccacctgtgtcacaaggattctgactgctcagggaaaaagcggtgttgccacagcgcatgcggcagagactgccgggaccccgctcgaggtacagcccctggatgccctggccaggcaaattccgacctcggttctgttgcactgcatctttcatggggccctacagaaagagtgcatgatggcagaccaggtgccctgcctgctggtcagcattatctatatcagcgctggttccagccatctgacaatcattggcctgctgacacctccttgcagccgattcatccatggttcctactgctgggagtcaaagtccactcactttcttctgaggaaggtctttgtatcactccagtgctatgtaccacggccatccgagcatcccacccctcctag

SEQ ID NO: 246768 - DNA, 372 bp, Artificial Sequence
  Description of Artificial Sequence: Synthetic coding sequence
atgcgaacacaatcactgttattgcttggggcactgcttgcagtgggaagccagcttcctgccgttttcggtaggaagaaaggggaaaagtccggcggttgtcccccagatgacgggccttgcttactctccgttccagaccagtgtgtggaagattcccagtgcccgttaactaggaaatgctgttaccgggcttgtttccgacagtgcgtgcctagagttagcgtgaagctcggaagctgtccagaagaccagttgcgatgtcttagcccaatgaatcacctatgccataaagacagcgactgtagcggtaagaaacggtgttgccactccgcctgcgggagggactgccgggacccagctcgaggctag

SEQ ID NO: 246769 - DNA, 1647 bp, Artificial Sequence
  Description of Artificial Sequence: Synthetic coding sequence
atgcctgctctgagacctctgctacctctgctccttctacttagacttacctctggggcaggtctgctgcctggattgggtagtcaccccggagtttgccctaaccaattatccccaaacttatgggtggatgcacagtccacttgcgagcgagagtgctcacgcgaccaagattgcgcagcagccgaaaagtgctgcattaatgtgtgcggattacactcatgcgtcgctgccaggtttcctggatcaccagccgctcctaccaccgcagcatcttgcgagggattcgtctgcccacaacagggtagcgactgtgatatctgggacggacagcctgtgtgtagatgcagagatcgctgtgaaaaggaaccttcttttacttgcgcctcagatggactgacttactataaccgatgctatatggatgccgaggcatgcctgagaggactccatctacacattgtcccatgtaaacatgtcctcagctggcctccctcatcccccggacctccagaaacgacggctcgcccaacccccggagccgctccagtgcctccagctctttactcttccccaagccctcaagccgtccaagtgggtggcacggcctcgctgcactgcgatgtctccggcaggcctcccccagccgtaacatgggagaagcagagccatcagcgggagaacttgatcatgcggcctgatcaaatgtacgggaacgttgtggttacctctatcggccagctggtgctctataacgctcggccagaagatgcagggttatatacctgtactgctcgcaatgccgctggattgcttagagcggacttcccactgtccgttgtccaaagggagccagccagggatgcagctccatcgatccctgctccagccgaatgcttgcccgatgttcaagcctgcaccgggccaacttccccccacctggtgttatggcactacgaccctcagcgcggagggtgtatgaccttccctgccagaggttgtgacggcgctgctcggggttttgagacttatgaagcttgtcagcaggcctgcgccaggggacctggggacgcctgtgttcttcccgcagtccaaggcccttgtcgcggttgggaacctcggtgggcttacagtcccctactgcaacaatgtcatccttttgtgtacggtggctgcgaaggcaatggcaataattttcacagccgagaatcttgtgaagatgcttgccctgtgccaagaacacccccatgcagggcatgcagactgaggtccaagcttgcgctgtcgttgtgcagatcagattttgccatagtcgggagacttactgaagtgttagaagagccggaggctgcaggaggcattgctcgagtggccttggaggatgtcctcaaagacgataagatgggactaaagtttcttggtaccaaatacctggaagttacactttccggtatggattgggcgtgtccatgccccaacatgacggccggtgatggacccctagtgattatgggcgaagttcgggacggcgtcgcagttctcgatgctggcagctatgtcagagctgccagtgagaaaagagtgaagaaaatccttgagttactcgaaaaacaggcatgtgagttgttgaatcggttccaagactag

SEQ ID NO: 246770 - DNA, 1731 bp, Artificial Sequence
  Description of Artificial Sequence: Synthetic coding sequence
atgtgggcacctcggtgtaggcgcttttggagtcggtgggagcaagttgcggctctgcttctcctactcttgctgctgggagtcccaccacgatcacttgccctgccacctatccgctattcccacgccggtatttgcccaaacgatatgaacccgaacctttgggtcgatgcgcagagcacatgtagacgcgagtgtgagaccgaccaggaatgcgaaacttacgagaaatgttgccctaacgtgtgtggaacaaagagctgcgtggcggcacgatacatggacgtgaaagggaagaaaggacctgttggcatgcccaaagaagccacctgcgaccacttcatgtgcttacagcagggctccgagtgcgatatctgggatgggcagccggtgtgtaaatgtaaagatcggtgcgagaaagaacccagtttcacttgtgcgagcgatgggctcacctattataatagatgttacatggacgctgaggcctgctctaagggaatcaccctggctgtggtaacctgccggtatcacttcacctggcctaatacttccccacctcctcccgagaccactatgcatcccacaacagcttctccagagactccagaactggacatggcagcacctgcattgctcaataatccagtgcaccagagcgtgactatgggagaaacagtttccttcttgtgtgacgtcgttggaaggcctcgacctgagatcacctgggaaaaacagctggaagatagggaaaatgtcgtcatgagaccaaatcatgtgcgcggaaatgtggtggtgactaacatcgcccagcttgttatttacaacgctcagctgcaggacgccggaatctacacctgtacagcaagaaacgtggccggagtgcttcgagccgactttcccctgtccgtggtgcgcggtcatcaggccgcagctacaagcgaaagcagccctaacggaaccgccttcccagctgcggagtgtctgaagcctcccgatagcgaggactgcggcgaagagcagacccggtggcacttcgacgcgcaggcaaacaattgcctgacttttacctttggccattgtcacagaaatctgaatcactttgaaacctatgaggcttgcatgctcgcttgtatgagcggccctctggccgcatgctccctaccggcattgcaggggccatgtaaagcttatgcgccaaggtgggcctacaactctcagactggacaatgtcaaagctttgtttacggcggatgcgaaggaaatggaaacaattttgaatcccgggaggcttgcgaggagagttgcccttttcctcgcggaaaccagcggtgtcgcgcatgcaagcctcgtcagaaactggtgacctcattttgcaggtctgatttcgtaattctgggccgagtcagcgaacttacggaggagcctgactcaggccgagctttggtgacagtggacgaggttctgaaagacgagaagatgggcttgaagtttcttggtcaggagccattggaagtgactctgctccatgttgactgggcctgcccctgtcccaatgtgaccgtctctgagatgccactcatcatcatgggagaggtggacggcggaatggcaatgctgaggcccgatagcttcgtaggagccagttctgcgcgaagggtgagaaaactgcgggaagttatgcacaagaaaacttgcgacgtgttgaaggagttcttgggcttgcattag

SEQ ID NO: 246771 - DNA, 849 bp, Artificial Sequence
  Description of Artificial Sequence: Synthetic coding sequence
atggatgtgaaggggaaaaaggggccagtgggtatgcccaaggaagcaacatgcgatcatttcatgtgcctgcagcaaggttctgaatgcgacatctgggatgggcagccagtgtgcaagtgtaaagatcgctgtgagaaggagccctcctttacctgtgcccaggcaaataactgcctgacattcaccttcggccactgtcatagaaacttgaatcatttcgagacctatgaagcctgtatgctggcttgtatgtcagggcctttggcggcttgttcactccctgctctgcagggcccttgtaaagcatatgccccacggtgggcttacaactcacagacaggccaatgtcagtcctttgtctatggcggatgcgaaggcaatggaaataacttcgagtcccgtgaggcctgtgaggaaagctgcccattcccccgtggaaatcaacgctgtagagcctgtaagcctcggcagaaactggtcacatcgttctgcaggagtgatttcgtcattctaggaagagtgtccgaactcactgaagaaccagactctgggagagcactggtgaccgtggacgaggttttaaaggacgaaaagatgggcctgaaattcctggggcaagagccactcgaggtgacattactgcatgtagactgggcatgcccatgtcccaatgtcacggtcagcgaaatgcctctcattatcatgggggaggtcgatggtggcatggctatgttgcgaccggacagctttgtgggagcatcctccgcccgacgcgttaggaaactcagggaggtgatgcataagaagacatgtgatgtgctcaaggagtttctgggactgcactag

SEQ ID NO: 246772 - DNA, 1509 bp, Artificial Sequence
  Description of Artificial Sequence: Synthetic coding sequence
atgcctttggtgaagaggaatattgagccccgtcatctttgtaggggcgctctgcctgaaggtattacatctgaactggagtgtgtcactaattccacgctggccgctatcattcgtcagctgtccagcctgtctaaacacgccgaagacatttttggcgaactgtttaacgaagcaaacaatttctatataagagcaaactccttacaggaccggatcgacagattggccgtgaaagtgacgcaactcgactccactgtcgaggaggtctccctccaggatatcaacatgaagaaggcatttaaatcaagcaccgtgcaggaccaacaagttgtctccaagaactcaattcccaatcccgtcgcagacatttataaccagtccgacaagccaccacctctgaatatactgactccttatagagacgacaagaaagatggccttaagttctacaccgatcccagctactttttcgacctttggaaggaaaagatgttgcaggataccgaggataagcgcaaggagaaaaggaggcagaaggagcagaagcgcattgatggcactacccgggaagttaaaaaggtgaggaaggctaggaatcggaggcaggagtggaacatgatggcctacgataaggagctgaggccagacaatcgcctcagtcagtctgtctatcatggggctagcagtgaagggtccctgagcccagataccaggtctcatgcatcagacgttactgactattcttaccctgctacccctaaccactcgctccatcctcagccagttacacccagctacgctgctggggatgtgccccctcatgggccagcaagtcaggcggcagaacatgagtaccgccctccatctgccagtgctcggcacatggccttgaaccggccacaacagcctccaccccctccacctccacaggcccctgaaggaagtcaggcctccgcaccgatggccccagctgactacggtatgttgccagctcagattatcgagtattacaatcccagcggccctcccccacccccacccccaccagtgattcccagcgcccaaaccgccttcgtttccccactgcagatgcccatgcaaccaccttttccagcctctgcgtcgagtacccacgcagcaccgccacaccccccatctacgggcctgctagtgacagctcccccacctcccggacccccacccccaccacctggacctccaggaccgggtagctccctgtcatccagtcccatgcatgggcctcctgtcgctgaagcgaagcgtcaggagcccgctcagcccccaatttcagatgcccgttcggatcttctggcagcaatacggatgggcatccagttgaagaaggttcaggagcaacgagagcaagaggctaagcgagagcccgtgggtaacgacgtggcaacaattctgagccgtcgcatcgccgtggagtattccgatagtgatgacgacagtgagtttgatgagaacgactggagcgattag

SEQ ID NO: 246773 - DNA, 1500 bp, Artificial Sequence
  Description of Artificial Sequence: Synthetic coding sequence
atgccattggttaaacgcaatatcgagccgcgacacctttgccgcggagcactcccagagggaattacttctgaactggaatgtgtcaccaactctactcttgcagccattatccgccagttgtcaagcctgtcaaagcatgcagaggacatcttcggtgagttatttaatgaggcaaataatttttacattcgggctaattccctacaggatcggatcgatcgcctggctgttaaagttacccagctcgacagcacagttgaggaggtgagccttcaagacatcaatatgaagaaggcctttaagtcatccaccgtgcaggaccaacaggtggtgagcaaaaattccattcctaatccagttgccgatatctacaatcagtcagacaagccaccgccacttaatatcctgacaccttatagagacgataaaaaggatggcctgaagttctacaccgatcctagttacttctttgacctgtggaaagagaaaatgctgcaggacacagaggacaaaagaaaggagaagaggcgccaaaaacgtgaaaaacataaactgaatccaaatcgaaaccagcaggtgaatgtgcggaaggtccgtacacgcaaggaagagtgggagcggagaaaaatggggatcgagttcatgtctgacgccaagaagctggagcaggctgggtccgctaaggaagatagagtgccatctggctctcatgcctctgacgtgacggactattcttacccagcaacgccaaaccactcccttcacccacaacctgtgaccccctcctacgccgctggggatgtccctcctcatggtccagcgtcacaggccgctgaacacgagtacagacccccatccgccagtgcacgtcatatggctctcaaccgtcctcagcagccccctcccccaccaccgccacaggctccagaaggatcacaggcttctgcccctatggcacctgctgactatgggatgctgccagcacaaatcatcgaatactataatccttcgggaccccctccaccaccccctcctcctgtgataccctccgctcagaccgcctttgtctctccattacagatgcctatgcaacccccattccctgctagcgcttctagcacgcacgcggcacctccccaccctccatcaactggcctgctggtaaccgcacccccaccacccggaccaccccctccaccacctgggcctcccggacccggatcatctctgtcatcctcacctatgcatggtccccctgtcgctgaggcaaagcgacaggagcctgcgcaaccccctatcagcgacgccaggagcgacttgctcgcggcaattcggatgggtattcagctcaaaaaggtgcaggagcagagggaacaagaagcaaagcgcgaacccgtgggtaacgacgtggcgacaattctgtccaggcggatcgctgtggaatacagcgacagcgatgacgactccgagtttgacgaaaatgactggtcggactag

SEQ ID NO: 246774 - DNA, 786 bp, Artificial Sequence
  Description of Artificial Sequence: Synthetic coding sequence
atggagggaggactaggacgcgcagtgtgcctcctgacaggtgcctccagagggttcggcaggactctggcgccactgctcgcctctctgctgagtccagggtccgtcctggtcctgtccgcacggaatgacgaagccctacgtcagttagaggctgaattgggtgccgagcgcagcggtcttcgggttgtcagggtacctgccgacctgggagctgaagctgggctgcagcagctgctaggtgccctgagagaactgcctcgcccaaaaggactccagcgacttctcttgatcaataacgcaggaagtctcggtgatgtaagcaagggatttgtcgacttgagcgactcaacccaggtgaacaactattgggcgctgaatttgactagcatgctgtgccttacatccagcgtgctaaaagcattccctgattctcctgggcttaatcgcaccgtggtgaatatatctagtctctgtgcgctgcagccctttaaagggtgggctctgtactgcgccggaaaagctgccagggatatgctctttcaggtgttagccctggaggagcctaacgttcgcgtgttaaactacgctcccggtccgctggacaccgatatgcagcaactggcaagagagaccagcgtggaccctgatatgaggaagggtctccaggagctgaaagctaaaggcaagctggtggattgcaaggtgagcgctcagaagctcctctcacttctggaaaaagacgaatttaaaagcggggcacatgtcgacttctacgacaaatag

SEQ ID NO: 246775 - DNA, 2430 bp, Artificial Sequence
  Description of Artificial Sequence: Synthetic coding sequence
atggaggacgaacagcctgattctctggagggctgggtgcccgtccgagaagggctgttcgcagaaccagaacgccaccggctgaggttcttggtcgcctggaatggagccgaaggaaagtttgcagttacctgccacgacagaacagctcaacagagaagattgagggagggtgcaaggctcgggccagagccagagcccaagcccgaggccgctgtgtcaccgtcctcctgggccggtctcttgtccgccgcagggctgaggggagctcataggcagctcgcagctctttggccacccctggaaaggtgttttcccagactgccgccagagctggatgtaggagggggtggcgcttggggcctgggcctagggctctgggcactgttatggcccaccagagctgggccaggagaggcagccttgcaggagctgtgcggacagttagagcgatacctcggtgctgctgcagatggatgcggcggtgcgacggtcagggatgctctgttcccagcggagggcggagccgcagattgcgaaagtccccgagaatttagggaacgggctttgagggccagatgggtggaggcagacgctcggctccgccaagtgattcagggacacggaaaagccaatacaatggtagccctgatgaacgtgtaccaagaggaagacgaagcataccaggagctggtgactgtggcaacgatgttcttccagtacctactgcagcccttcagggctatgcgggaggtggcaaccctctgtaagctggatattctgaagtccctcgacgaggatgatttaggccctcggagggttgtggcattggaaaaagaggccgaggagtggacacggagagcagaggaggctgtggtgtccattcaagacattaccgtgaattattttaaggagacagttaaggccctcgccggaatgcagaaggagatggagcaggatgccaaaaggttcggacaggccgcatgggcgacagccattcccagactggaaaaactccaactgatgctcgcacgggaaacactgcagctgatgagggcaaaggagctatgtctgaaccacaaaagagctgagattcaggggaaaatggaagacctacccgagcaggagaaaaataccaacgttgtggacgagctggaaattcaattctacgaaatccagctggagctgtatgaggtgaagttcgaaatactcaaaaatgaggagattcttctgacaacccagttggattcgctgaagcggctgattaaagaaaagcaggacgaggtcgtgtactacgacccatgtgaaaatcccgaggagttgaaggtgattgattgcgtggtcggcctgcaggatgacaaaaacctggaagtgaaagagctgcggaggcaatgccaacagctggaaagcaaacgaggcaggatttgtgctaaaagagcctccctcaggagccggaaagatcagtgtaaagagaaccaccggttcagactgcagcaggcagaagaatccatcagatattcaagacaacaccattctatccagatgaagagggataagattaaggaggaagagcagaaaaagaaagagtggatcaaccaggaaagacagaaaacactccaacgcctgaggtcatttaaggataagcggcttgcccagtccgtcaggaacactagtgggagtgagcctgtggcacccaacctcccttcagacctgagccagcaaatgtgcctgccagctagccacgctgtgtcagtgattcatccttccagtcgcaagaccaggggagtgccgttaagtgaggccggaaatgtgaagagtccaaagtgtcagaattgccacggcaacatccctgtgcaagtgtttgttccagtcggggatcagactcatagcaagagtagtgaggagctgtctctcccgcctccacccccaccccctccacctcctcctcctccaccacctccccctcccccaccgttgcgcgctttgtctagctcgtcacaggcagccacacaccagaacctggggttccgcgctccagtcaaggatgatcagccacgccctctagtatgcgaatctccagctgagagacctcgtgatagtctcgaaagcttttcttgtcccggttctatggacgaggtgctggcatccctcaggcatgggagggccccactacgaaaggtagaggtgcccgctgttagaccccctcacgcaagcattaacgagcacatcctggctgccatcaggcagggagtgaaacttaaaaaagtacatccagacctagggcctaatccttcatcaaagccaacatccaaccgtcgcacttcagacctggagcgctccattaaagcagccttgcaacgcatcaaaagggtgagtgccgactccgaagaggactctgacgaacaggacccaggccagtgggacggctag

SEQ ID NO: 246776 - DNA, 1452 bp, Artificial Sequence
  Description of Artificial Sequence: Synthetic coding sequence
atgcccgtgcccccacccccaccccctcccctgccacctccccctccccctttgggtgccccaccacctccccctccctctgccccacccgtgtcaaccgatacttcttccttaaggagggccgatccaaagggcaggtccgcactgctggctgacatacagcaggggaccaggctgagaaaggtaacccaaatcaacgacaggagcgccccacagatagagagttccaaagggaccaataaagagggaggaggctctgccaacacccggggtgcgtcaacgccaccaacattgggcgatctcttcgcaggagggttcccagtcctaaggccagctggccaacgtgatgttgccggaggaaaaaccggccaaggacccggatcgcgggcaccttctcctaggctgcccaacaagacaatctccggaccccttataccgccagcctcccccaggctgggaaatactagtgaagcccacggggctgcccgaaccgcaccccctaggcccaatgtgcccgcacctcctcccccaactccaccacccccacctcccccattgcccccaccccttccttctagttcccccatcaagacgccactagtgtcccctcccggacccctcacaaagggaaacctccctgtggttgccccacctgttccctgtgcacctcccccacccccaccccctcccccacccacaccgccacctctgcctccagcgtcagtcttgagtgataaagctgtgaagcctcagctggcgcctctccacctgccacctatccccccaccattaccactactgcccccatgcggctaccccggtctcaaagccgaaccagcgagtcctgctcaggacgctcaggaacctcccgctcctcccccaccactccccccatacgcctcttgctcccctcgtgcctctctccccgctcctcccctcccaggtgtgaatagctcaagcgaaacacccccacctcttcctcctaagtcaccatcattccaggcccctccacagaaggccggagcccaggccttaccagcgcctcctgcaccccctggaagccagccattcctccaaaagaaaaggcatgggcgacctggagcgggtggaggtaagttaaaccccccacccgctcctcccgctcggtccccaacgacagaactcagctcaaaaagtcagcaggcaacagcctggacccctacccagcagccaggcggtcagctccgcaacggctcactgcacattatcgacgatttcgagtcgaaattcactttccacagcgttgaagactttccccctcccgacgaatacaagccatgtcaaaagatttatccaagtaaaatccccagatctcggacacctggcccttggctccaagctgaggctgtcggacagtcatccgacgacatcaaagggaggaattcgcagctgtccctgaaaactctccgctag

SEQ ID NO: 246777 - DNA, 1452 bp, Artificial Sequence
  Description of Artificial Sequence: Synthetic coding sequence
atgcctgttccacctccccctcccccaccacttcccccacctcccccacccctaggggcaccccctccccctccgccaagcgctccgccagtgagcaccgataccagctcactcaggcgcgcagatcctaagggaaggagcgctctcctggctgatatccagcagggaacccgcctgcgaaaggtcacccagatcaatgacaggtccgcgccacagattgagagtagcaaaggcaccaataaggaggggggagggtctgctaacacaaggggtgccagtacaccaccaacactgggagacctttttgcgggtggtttccccgtgttgcgccctgctgggcagcgggacgtggctggtggcaagaccggacagggcccaggatcccgtgctccttccccacgactccctaacaaaacgattagtggtccactcatccctccggcttcacccagactcggcaacacctctgaggcacatggcgctgccaggacagcgcctcccagaccgaatgtccccgctcctccacccccaacacctcctccccctccgcctccactgcctccgcctttgccatcctctagcccaatcaagactccactcgtctctccccctggccctctcacaaaagggaatttaccagtggtggccccaccggtgccgtgcgcgcctcccccacctccccctcctccccctccaacaccccctcctctcccccctgcctccgttctaagcgataaagctgtcaaaccccagcttgcaccactgcacctcccgccaattccccctcccttgcctctgcttcccccatgtggttaccctgggcttaaagcggagccagcttcacccgctcaagacgcccaggagccccctgctccccctccgcctttgcctccatacgcctcctgttcacctcgcgctagtctccccgctcctccgctgcccggagttaacagcagcagtgagaccccccctcctctgcccccaaagagcccctcctttcaggcaccccctcagaaagctggagcacaagctctccctgccccaccagcgccacccggttctcagccctttctgcagaagaagaggcacggaaggccaggggctggcggtgggaaactgaatcccccacccgcacctccagcccgttcccctactacggagttaagttctaaatcccagcaggccaccgcctggaccccaacacagcagccgggtgggcagcttcggaatgggtctcttcacattattgacgatttcgagagcaagttcaccttccattctgtcgaagacttcccccctccagatgagtataagccatgccagaaaatttacccaagcaaaatacccaggagtagaacaccaggaccatggctgcaagctgaagccgtgggacagagtagtgacgacataaaggggagaaacagtcaggtcacgcaggctagctgtctttag

SEQ ID NO: 246778 - DNA, 1452 bp, Artificial Sequence
  Description of Artificial Sequence: Synthetic coding sequence
atgccggttcctcccccacctcctccgcctctacctccccctcccccaccacttggcgctcctcccccacccccaccaagtgccccacccgtttccactgatacttctagcctcaggcgagcagatcctaaaggtcggagcgctctcctggccgacatccagcagggcacacgcctccgcaaggtgacccagatcaacgaccgcagcgccccacagattgagagcagcaagggaaccaacaaggaggggggaggcagcgccaacaccagaggagcatccacacctccaaccctcggggacctcttcgcgggaggattcccggtcttgagacctgctggccagagagatgtggcgggtggtaagacagggcaggggccagggagcagggcacctagcccccgattacccaacaaaaccatcagtgggcctctgatcccaccggcttcgccacgtttgggaaatacgtctgaggcacacggggctgccagaacagccccacctaggccaaatgtgcccgctccccctccccctacaccccctccaccaccaccacctctgcctccccctcttccctcctcctcacctatcaaaacaccactggtgtcgcctccgggaccccttactaaaggtaacctgcctgtggtggccccacctgtgccatgcgctccaccaccaccgccaccacctccccctccaacacccccacccctgcccccagcaagcgttctgtctgacaaggccgtgaagccccaattggcccctctgcacttgccaccaattccaccaccgctgcccctcctgcccccatgtggttatccaggtttaaaggctgagccggcatcaccggcacaggatgcccaggagcctcctgccccacccccacctcttcccccatacgcctcatgtagccctcgggcttcattgccagccccacccctccctggagtgaacagtagctctgaaaccccacctcccttacctccaaaaagcccctccttccaggcccctcctcagaaggctggcgctcaggcactgcctgcccctcccgctccgcctgggtcccaacctttcctgcaaaagaagaggcatgggagacctggcgctgggggtggtaagttaaaccctccgcctgcacctcccgcacgatctccaaccaccgaactaagctctaagtcccagcaggctaccgcctggacgccgacacagcagcccggaggacaactgagaaatggctcactccatatcatcgatgatttcgagtccaaatttaccttccacagtgtagaagacttccccccaccagacgaatataaaccttgccaaaagatctacccctccaagattccaagatctcgaactcccggaccttggctgcaggccgaggcagtcggccagtccagtgatgacattaaggggaggaattcccaagttacacaggcaagctgtctgtag

SEQ ID NO: 246779 - DNA, 930 bp, Artificial Sequence
  Description of Artificial Sequence: Synthetic coding sequence
atggccgtgaatcaaagtcacaccgaaaacaggcggggtgccctcattccaaacggtgagagcctcttgaagaggagccccaatgttgagctctcattcccccaacgaagcgaggggagcaacgtgttttcagggagaaagacaggcacactattcctgacgagttaccgggtgatcttcataacaagctgctctatcagcgaccccatgctgtcttttatgatgccttttgacctgatgaccaatttgactgtagagcagcccgttttcgctgccaactttattaaaggcaccatccaggctgccccttacggtggttgggaagggcaggctactttcaaattggtttttcgaaatggggacgctatcgaattcgcacagttgatggtaaaggccgctagtgctgccgcaagagggttcccccttagaacgcttaatgattggttcagcagcatggggatttacgtgattacaggcgaagggaacatgtgcacaccacagatgccttgctcagtcattgtgtacggtgcgcctccagccggatatggcgctccccctcccggatatggagcccctccagccggatacggagcacagcctgtggggaatgaaggcccacccgtaggctatcgtgcatcccccgtgaggtatggagcgccacccctaggatatggtgccccaccagccggttacggagctccacctctcgggtacggcgcaccccctctgggttatggcacccctcctcttggttacggcgctcctcctttgggttacggagcacctcccgctggtaacgagggcccacccgcaggctacagggcttcacctgccggttctggtgctcgaccacaagagagtaccgccgcacaggccccagagaatgaggcctctcttccgagtgcgagctcgagtcaggttcactcctag

SEQ ID NO: 246780 - DNA, 930 bp, Artificial Sequence
  Description of Artificial Sequence: Synthetic coding sequence
atggccgttaatcagagtcacacggaaaataggagaggtgccctgatccctaacggagaaagcctactcaagaggtcccccaacgtcgagctgtcctttcctcagcgttccgaaggatccaatgtgttcagcggaagaaagacaggaaccctgttcttaacaagctatagggtgatatttatcaccagttgcagcataagcgaccctatgctgagcttcatgatgccctttgacttgatgacaaatcttacagttgagcagccggtgttcgccgctaactttatcaaaggtactattcaggccgctccatatgggggatgggaagggcaggccaccttcaagttggtattccgtaatggcgatgcaatcgaattcgcgcaattaatggtgaaggcagccagcgccgctgcccgtggcttcccactgcgcactttaaacgactggttctcctctatggggatctatgtcattactggggagggcaacatgtgcacaccacagatgccttgctctgttattgtctacggagcgcctccagccggatatggggcaccaccccctgggtatggcgctcctccagcgggatatggcgctcagcccgtaggtaacgagggacctcctgtgggatatagggccagccctgtcagatatggtgccccacctctcggttatggggcaccgccagccggttacggcgcacctcctctcggctatggggctccaccccttggctatgggacacccccactgggctacggtgctccaccactgggttacggtgccccaccagccggaaacgaaggcccacctgccggttacagggcttcccccgctggaagtggtgccagacctcaggaaagtacggccgctcaggcccctgaaaacgaggcctcgctccccagtgctagctcaagccaggtccattcttag

SEQ ID NO: 246781 - DNA, 930 bp, Artificial Sequence
  Description of Artificial Sequence: Synthetic coding sequence
atggcagtgaaccagagtcatacagaaaacaggcgcggtgccctgatacctaatggagaatcacttctcaagcgttcccctaatgtcgagctctcctttccccagcgtagcgaaggtagtaatgttttttcggggcgaaaaacgggcacacttttcctaacatcttatagggttatttttattacatcctgttccatatccgaccccatgctgtcattcatgatgccatttgacctcatgactaacctcactgtagaacaacctgtttttgctgcaaatttcattaagggaacgatacaagcagccccttatggcggttgggagggccaggcgaccttcaagctggtattcaggaacggtgatgcaatcgaatttgctcagctgatggttaaggccgcttcagcggctgctaggggattcccccttaggactctgaacgattggttttccagcatgggcatttatgtgattactggcgaaggaaacatgtgcacccctcagatgccctgttccgtcatcgtgtacggggctcccccagccggttacggagcccctccgcctggctacggcgctcccccagccggatatggagctcagcctgttgggaatgagggtccaccagtgggataccgtgcatcccccgtaaggtatggcgctccgcctcttggatacggggctccacctgccggatatggggcaccccctctcggttatggtgctcccccactgggctacggaactccccctttaggttacggcgctccccctttggggtatggagcgccaccagcagggaacgaaggcccaccagccggttatcgcgctagtcccgcaggctctggcgctaggcctcaggagtccacagccgctcaggcacccgagaacgaagcctccctcccttccgcctcaagctcccaggtccactcttag

SEQ ID NO: 246782 - DNA, 708 bp, Artificial Sequence
  Description of Artificial Sequence: Synthetic coding sequence
atgccgtttgacttgatgacaaatctgacagtggaacagccagtctttgcggcaaattttattaagggaaccatccaggcagccccttacgggggttgggaaggacaggctaccttcaaactggtgtttaggaatggagacgcgatagagttcgctcagctgatggtcaaagctgcaagtgctgccgcaagggggttccccctacgcacccttaacgattggttctcttcaatgggcatctacgttatcaccggagaaggcaacatgtgtacgccccagatgccctgttctgttattgtctacggagctccacccgctggctatggggctcctccccctgggtacggtgcaccccctgctggatatggcgctcagccagtggggaacgaaggccctcccgtgggctatcgtgctagccccgtgcgctatggtgcaccgcctttggggtatggcgcacccccagccggatacggcgctccacctttaggctatggagctcctccacttgggtacggtactcctccccttggctatggtgcaccccctttgggctacggcgcaccccctgctggcaacgaaggaccccctgccggatatcgggcatcaccagcaggctcaggggcacgcccacaagagtccactgcagctcaagcccctgaaaacgaggcctctctcccttcagccagtagctctcaggtacacagttag

SEQ ID NO: 246783 - DNA, 1401 bp, Artificial Sequence
  Description of Artificial Sequence: Synthetic coding sequence
atgccttacgaaataaagaaagtgttcgcatctttgcctcaggtagagagaggggtaagcaaaatcatagggggtgatcccaagggaaacaatttcctctataccaacgggaagtgtgtgatcttgcggaacatagatgaccactcacgctttgtcaactgcgtgaggttcagccctgacggtaatcggtttgcaaccgcctccgccgacgggcaaatttacatctacgacgggaaaaccggcgaaaaggtgtgcgccctggggggatcgaaggcccacgacggtggaatctatgctatttcttggtcaccggactccacccatctcctgtcggccagtggcgacaaaaccagcaagatctgggatgtatctgtgaattcagtggtatccacttttcccatgggctctaccgtcctcgaccagcagctcggttgtctttggcagaaggatcaccttctaagcgtgtccctgagcggctatatcaactatttggacaggaacaatccctccaagccactgcatgtgataaagggccattccaaatccatccagtgccttacagtgcacaagaacggcggtaaatcatacatatattcaggttcacacgatggacacatcaattactgggattcagaaaccggtgaaaatgatagcttcgcagggaaggggcacacaaatcaggtcagccggatgacagtggatgaatctggacagctaatttcatgttccatggacgatacggtgagatatacatctttgatgctacgagattactcagggcaaggggtagtgaagctagatgtacagcccaagtgcgtggccgtgggccctggtggctatgcagtggtggtgtgtattggccaaatcgtgttattaaaagaccagcgcaaatgtttctcaatagacaatcctggttacgagccagaagtagtggctgtgcatccgggaggggacaccgtggctattggcggagtcgatggtaatgtcagattgtacagcatcctgggcactaccctgaaggatgaggggaagttacttgaggcaaagggtcccgtgaccgacgtagcttattctcacgatggcgcttttcttgcagtgtgcgatgcctccaaagtggtcactgtgttctcagttgccgacgggtactctgaaaacaatgtcttttatggtcatcacgccaagatcgtctgcctggcctggtccccggacaatgagcacttcgcaagcggaggcatggacatgatggtctacgtctggactctgtccgaccccgaaacccgagtcaaaatccaggacgcgcaccggttgcaccatgttagttcactcgcctggcttgatgaacataccctcgtcactacctcccatgacgcatctgtgaaggaatggacaatcacatactag

SEQ ID NO: 246784 - DNA, 1821 bp, Artificial Sequence
  Description of Artificial Sequence: Synthetic coding sequence
atgccctatgaaatcaagaaagtgttcgcctcactgcctcaggtagagcgcggagtctcgaaaatcattggcggtgatcctaagggcaacaatttcctgtatactaacgggaaatgtgtgatcttaagaaacatagacaatcctgcactcgccgatatttatactgagcatgcccaccaggtggtcgtcgcaaaatacgcccctagtggcttctacattgcctccggagacgtctctggaaaactgaggatctgggataccacacagaaagagcaccttctgaaatacgaataccaaccattcgctggtaaaattaaagacatcgcttggactgaggattctaaacggatagctgtggtcggagaaggtcgggagaaattcggtgctgtgttcctgtgggattctggatcctccgtgggagagatcacagggcataataaggtgatcaatagtgtggatatcaaacagagtcgaccgtatcgcctggcgacggggtctgacgataattgcgccgcttttttcgaaggacccccattcaagttcaaatttactattggagatcactcgcgatttgtaaactgtgtacgattctccccggacggcaataggttcgccaccgctagcgccgacgggcagatctatatctacgatggcaaaacgggagaaaaggtctgtgccctaggtgggtccaaagcccacgacggcggtatatacgctatttcatggtcacccgactcgactcacctgctcagcgcctccggggacaagactagcaaaatatgggacgtctctgtgaattcggtagtcagcaccttccccatgggatctacagtgctcgatcaacagctcgggtgtctgtggcagaaagatcaccttctgtccgtctcactcagcggatatattaactacttagatcggaataatcctagtaaaccgttacacgttataaagggccattccaagtctatccaatgcctaaccgtgcataagaacggcggaaagtcatacatttacagcggtagtcacgacggccacattaattactgggatagtgagaccggtgagaacgatagcttcgcaggcaaagggcacacaaatcaagtctcgaggatgacagttgacgaatcgggacagctcatttcgtgcagtatggatgacaccgtgcgctacacatctctcatgctccgcgattattccgggcagggagtggtgaagctggatgtccagccgaaatgtgttgctgtgggcccaggaggttacgcagtggtagtgtgtatcgggcagatcgtgctgctcaaagaccaaagaaaatgcttcagcatcgacaatcccggatacgagccagaagtggtggcggtccatcccggaggagataccgtggctatcggcggtgtagacggaaacgtgcgcctgtactccattctcggtaccaccctgaaggatgaaggaaaactgctggaagccaaaggtcccgtcactgatgtcgcgtactctcacgatggtgcctttctggctgtctgcgacgcgtccaaagtggtcacagtgttttcagtcgctgacgggtacagtgagaacaacgtattctacgggcatcatgccaaaatcgtgtgtctggcctggagcccggataacgagcactttgcaagtggaggaatggatatgatggtgtatgtgtggacgctgagtgatcctgaaactagggttaaaatccaggacgctcataggttgcaccatgtttcctctttggcatggctggacgagcacactctggttacaacatcacatgacgcctctgtcaaggagtggacaataacttattag

SEQ ID NO: 246785 - DNA, 1326 bp, Artificial Sequence
  Description of Artificial Sequence: Synthetic coding sequence
atgttgacatgggtatggtacctcataatgaccagtgttctacaagcaagtgtttccagtgttgatcatagtcgcttcgtcaattgcgtgcgatttagccctgacggtaatagattcgctaccgcttcagccgatggccagatatacatctatgatggcaagaccggggagaaggtgtgcgccctcggcggatctaaggcccacgacggtggaatctatgcaatcagctggagcccagacagcacccatctgttgtctgccagtggcgacaagacctctaagatctgggacgtgtcagtgaattcggtggtctctaccttccctatgggatctaccgtgctggaccagcagctgggctgcttgtggcagaaagaccatctgctttccgtctcactgtctgggtatataaattacctggatagaaacaatccaagtaagccactgcacgttattaaggggcactccaaatctatccagtgccttactgtgcacaagaatgggggaaagtcctacatttactcaggatcgcatgacggacacattaattactgggatagcgaaactggggagaatgatagctttgcaggaaaaggacacaccaatcaggtgtcacgaatgactgtagatgagtctggccagctgatctcctgcagcatggatgacaccgtacgttatacaagtttaatgctgcgggactacagtggacagggcgttgtgaagttagacgtgcagccgaagtgtgttgccgtgggtcccggtggatatgccgtggtcgtttgcataggacagatcgtcctccttaaggaccaacgcaaatgcttttctattgataaccccggttacgaaccggaggttgttgcggtccatcctggcggtgataccgtagctatcgggggtgtggatggtaatgtacggctgtattctatccttgggacgacattaaaggatgagggcaaactgctggaagccaaggggccagtgactgacgtggcgtactcccacgacggtgccttcctggctgtatgcgatgcaagtaaagtcgtgacagttttctcagtggcggatggctacagtgagaataacgtgttttacggccaccacgccaaaatcgtgtgtcttgcttggagccctgataacgagcactttgcaagcggaggaatggatatgatggtttacgtctggacactctcagatcctgaaacccgcgtgaagatccaggacgcacatcggttgcaccacgtctcatctttagcttggctggatgagcatactctagttacaactagtcacgacgccagcgtgaaggagtggactatcacttattag

SEQ ID NO: 246786 - DNA, 531 bp, Artificial Sequence
  Description of Artificial Sequence: Synthetic coding sequence
ccagcagagactgaaaaggtgtttgccagcctccctcaggtggaaagaggagttagtaaaatcattgggggtgaccccaagggaaacaacttcctctacacaaacggaaagtgcgttatactccgaaacatagatgatcattcaagatttgtgaattgcgtgagattctctccggacggcaatagattcgctactgcgtcggctgacggacagtgcctccccgctccggtgacagctcaatcccgacgactacctaacgcttcacccgacatgcagaacttggacattgctcttccaacttctgccgacagttccagtgagccaaagccacagagtatggaaaagctgcctccctggtccgctcatttcccgtgggccccacgtttttggacaagttcttgggctgcctatggacgacgcacaacctgcagtgtgtctccgtgccctggaacatcgaccatctggacagagacaacccccgcaagtccctgtacaagctcacgcgtaaccgtaaaccgcagtagcgtatag

SEQ ID NO: 246787 - DNA, 1821 bp, Artificial Sequence
  Description of Artificial Sequence: Synthetic coding sequence
atgccctacgagattaaaaaagtctttgcgtcgctgccgcaagtggagcgcggagttagcaagatcatcggtggggatcctaaggggaacaacttcctgtacaccaacgggaaatgtgtaatcctccgcaacattgacaatccagccttggccgatatttacacagagcacgcacaccaggtggttgtggctaagtacgcgccttccggcttttatatcgccagcggcgatgtatccggaaaactgcgcatatgggatacaacacagaaggagcaccttctcaaatatgagtatcaaccctttgcaggcaagattaaggatatagcctggacggaagacagcaagcgcatagcagtcgtaggagagggcagggagaaatttggggcagtgtttctgtgggactccggctcctcggtcggagaaattactggacacaataaggtcattaactccgttgacattaagcagtccagaccttaccgactggccacggggtctgatgacaattgcgctgctttcttcgaaggcccaccatttaaattcaaatttacgattggggatcattcccggtttgtgaattgtgtgaggttctctcccgatggaaatagattcgctacagcttctgctgatggccagatttacatttacgacgggaagacaggcgaaaaggtgtgtgcgctgggaggctccaaggcacacgacggcggaatttacgccatatcttggtcacctgatagtacccacctgctctccgcctccggagataagaccagcaagatctgggatgttagtgtgaattcagttgtgtcaacctttcctatggggtctaccgttctcgaccagcaactggggtgtctctggcaaaaggaccacctgctttccgtgtccctgtctggttacatcaactatctggacagaaacaacccatctaaaccccttcatgtgatcaaggggcacagcaagtctattcaatgcctaacagtgcataaaaatggcggaaagagctatatctatagtggtagccacgatgggcatattaactactgggattcagagactggcgaaaatgattcattcgctggcaagggacatactaatcaggttagcagaatgaccgtagatgaatccggacaactgatctcctgttctatggacgacactgtgaggtatacatccctgatgctgcgcgattacagcgggcagggagttgtgaaactggacgttcagcccaaatgcgtggccgtgggcccaggcggttacgctgtggtggtgtgtatcggtcagatcgtgctcctgaaagaccagcgaaagtgtttctctattgataatcctgggtacgagcccgaagttgtggccgtgcacccgggtggggatacagtcgcaattgggggagtcgacgggaatgtgcgcttgtattctattcttggcacgacgctgaaagatgaaggcaagctcctggaagccaaagggcctgtgaccgatgtggcctactcccatgatggcgcttttttagccgtctgtgatgcttccaaagtggtgaccgtgttctccgtggccgacggctattctgagaacaacgttttctatgggcaccatgcgaagatcgtgtgtcttgcatggagcccagacaacgaacactttgcgagcgggggtatggatatgatggtatacgtgtggaccttgtccgaccccgagacaagggtcaagatccaggatgcacatcggctgcaccatgtcagctctttggcatggctcgatgaacatactctggtgactacatctcacgacgccagcgtgaaggagtggaccataacatattag

SEQ ID NO: 246788 - DNA, 1401 bp, Artificial Sequence
  Description of Artificial Sequence: Synthetic coding sequence
atgccttatgagatcaaaaaagtgttcgccagccttccccaggtggagaggggtgtctcaaagatcatcggcggagaccctaaggggaataattttctctatactaacggtaagtgcgtcatcctgcgaaacattgacgaccacagtaggttcgtgaattgcgtccgcttctcccccgatggtaatcggttcgcaaccgcctctgccgatggccaaatttacatctatgacggcaagacaggggaaaaagtctgtgctctcgggggttccaaagctcacgacggcggtatctacgcaattagttggtcgcctgatagcacgcacctcctctcagcaagcggcgacaaaacatccaaaatttgggacgtaagcgtcaactctgtcgttagcaccttccccatggggtctaccgttctcgaccagcagctgggctgcctttggcagaaagatcatctcttgtccgtctccctctcaggatatatcaattatctggaccgcaacaatccctccaagccgctgcacgtcataaagggccactctaaaagtatacagtgcttgactgtccacaagaatggcggaaagtcgtacatttattctgggtctcatgacggtcatattaactattgggattccgagactggggagaatgatagttttgccggaaagggtcataccaatcaggtatccagaatgactgtcgacgaatccgggcaactgatctcctgcagcatggacgataccgttaggtatacatcactaatgctcagggactactcagggcagggggtcgtgaagctggacgtccaacccaagtgtgttgcggtaggcccaggcggatacgccgtggtggtttgcatcggtcagatcgtgctcctgaaagatcagcggaagtgttttagtatagacaacccagggtacgaacccgaagttgtcgccgtgcacccagggggtgatacggttgcaatcggcggagtcgatggcaacgtgagactttatagtattttgggcacaaccctgaaggacgagggaaaactacttgaggccaaaggtccagttacagacgttgcgtactctcatgacggcgctttcctcgccgtgtgtgatgctagtaaggtcgttaccgtcttcagcgtcgccgacggctactcagagaacaacgtcttctacggacatcacgccaagattgtgtgtctggcatggtctccggataatgaacactttgcctctgggggtatggatatgatggtctatgtttggacgctgtctgaccctgagacgagagttaaaattcaggacgcccacagattgcaccatgtgtcttcattagcttggttagacgagcacacattagtcacgacatcacacgacgcaagcgtgaaggagtggaccattacttactag

SEQ ID NO: 246789 - DNA, 3675 bp, Artificial Sequence
  Description of Artificial Sequence: Synthetic coding sequence
atgttgccttataccgtcaactttaaagttagcgccagaaccctgactggggcacttaacgcacataacaaagcagcagtggactggggttggcagggtctcattgcatatggctgtcactcgctggtcgtagtcattgattccatcactgcccagactctgcaagtcttggaaaagcacaaagctgatgtggttaaggtgaagtgggctagagagaattaccaccacaatatcggttccccctactgtctcagactggcatctgctgacgtgaatggaaaaatcatcgtttgggatgtagccgctggtgttgcccagtgcgagattcaggagcacgcgaagccaatccaagatgtgcagtggctgtggaatcaggatgccagccgtgacctcctcctagccatccacccgccaaattacattgtgttgtggaacgctgacacaggcactaaactatggaaaaaatcctatgccgacaacattctttccttttctttcgacccctttgacccatcacatctcacgctcctgacttcggaagggattgtgttcatctcagacttcagcccttctaagcctccgtctggtccaggaaaaaaagtctacatctcttcgcctcattcatcacctgctcacaataagctggcgaccgccaccggtgcaaagaaggcactaaataaggtgaagattctgatcacgcaggagaaacctagcgctgagttcatcaccttgaacgattgcttacaactcgcatatctgccgtctaagaggaatcatatgcttctgttatacccacgagaaatcctcatcctggatttggaagtaaatcagactgtgggggtcatcgcgatcgaacgcaccggggtgcccttcctgcaggtgatcccgtgtttccaacgggatggcttattctgtctgcatgagaacggatgcataaccttgcgggtgaggcggtcctacaacaacatcttcactacatccaatgaagaacccgatcctgaccctgtccaagaactcacctatgatttacgctcccagtgtgacgctattcgcgtgacgaagaccgtgaggccgtttagcatggtttgctgccctgtcaacgaaaacgcggcagccctggtggtgtccgacggtcgcgtcatgatatgggaactcaagagtgccgtctgtaaccggaactcccggaattccagcagcggtgtttcccctttatactcacctgtgtcattttgcgggataccagttggtgtgctgcaaaataagctgccagatctatcattggataacatgatcggacaaagcgctatcgcaggagaagagcatccacgtgggagcatccttcgggaagtacacctaaagttcctgttaaccggcctgctgtccggattgcccgcaccccagttcgccattaggatgtgtccccctcttaccacaaaaaatatcaagatgtaccagccgttgctggctgttgggacctctaacggcagtgtgctggtgtatcacctaacctccggtctgctccataaagaactctccattcatagttgcgaggtgaaggggattgagtggacgtcgctgacatcattcctctcattcgctacctcaactccaaacaatatgggactggtgcgcaacgagctccagctggtggatctgccaacaggaaggagcatagctttccgcggagaaaggggtaacgatgaaagtgccatcgaaatgatcaaagtgtcacatttaaaacagtatctcgcagtggtgtttcgcgataagcctctagagctgtgggacgtgcgtacgtgtacgcttctaagggagatgagcaaaaatttccccacaatcactgctctagagtggagcccaagtcacaatcttaaatcgctcagaaagaaacaattagcgacccgggaggccatggcacggcagaccgtcgtgtccgatacagaactcagcattgtggaatcttctgtaataagtttgttgcaagaagcagaaagcaagtcagagttatcccaaaacatttctgccagggagcactttgtgttcactgatattgacgggcaggtgtaccaccttacagtggagggtaatagcgtcaaagattctgcccgaattcccccagatggatctatgggttctattacttgcatcgcatggaagggggacaccctcgtgttgggcgacatggatggaaatctcaatttctgggaccttaaaggacgcgtctcccggggtataccaacacataggtcttgggtgaggaagattcgattcgcccctggcaaaggaaatcagaaactgattgctatgtacaatgacggcgctgaggtttgggatacgaaggaagtacagatggttagctccctgagatcgggtaggaatgtgacatttaggattcttgatgtggactggtgcaccagcgataaggtgattctagcatcagatgatggctgtattcgggtgttagagatgtctatgaagagtgcctgtttcagaatggatgaacaggagttgaccgagccagtgtggtgcccatatttgctggtgccaagggcatccctcgccttgaaggcatttttgttgcaccagccctggaatggacaatacagtttggacatttcccacgtggactatccagagaatgaggagattaagaatctgctgcaggagcagctaaacagcctctcaaacgacataaaaaagctgctgctcgatcccgagtttactctgcttcagcggtgtctgctggtgtctcgcctctacggggacgagtctgagctccatttctggacagtcgcagcccattacctgcatagtctgtcccaagaaaagtccgcctctacgaccgctcccaaggaagccgctcctcgcgacaaactctcaaacccacttgacatctgctatgatgttctgtgtgaaaatgcctactttcagaagttccagctggagcgggtaaacctccaggaggtcaaacgatcaacttacgatcacactcgaaagtgtacggatcaattattgttgcttggccagacagatagagcagtccagctgctgctcgagactagtgctgataaccaacactattactgcgattcacttaaggcttgcctggtgactactgtcacctcttcagggccttctcaaagtaccatcaagttggtcgccactaacatgatagctaatggtaaattagcagaaggagtgcagctgctctgcctgattgataaagccgctgacgcatgcagatacctccagacctacggcgaatggaatcgggctgcctggctggcaaaggtgcgcttaaaccccgaagagtgtgccgacgtcctgcgcagatgggtggatcatctctgtagcccccaggtcaatcaaaaaagtaaggcattgctggtgcttctaagcctgggctgcttcttcagcgtcgccgagacactgcattccatgcgttattttgaccgggcagccctgtttgttgaggcttgcctgaaatatggagcgttcgaggtcaccgaagatacggagaaattaattaccgcaatctatgctgattacgccaggtcgctgaagaatcttgggttcaagcaaggtgcggtgctgtttgccagtaaagcaggggcagccggaaaggacctactgaatgagttggagtctccaaaggaagagccgatcgaagagtag

SEQ ID NO: 246790 - DNA, 1371 bp, Artificial Sequence
  Description of Artificial Sequence: Synthetic coding sequence
atgcgcaaaaagtggaagatgggcggtatgaagtacatcttcagtcttttgttttttctgctcttagagggaggcaaaacagagcaggttaaacactcagaaacctactgtatgtttcaggacaaaaaataccgtgtcggagagaggtggcacccgtacctggagccctatggcttagtctattgcgttaattgtatatgttctgaaaacggtaacgttttgtgtagtagagtcaggtgccccaacgtacattgtctttcacctgtgcatatcccccatttatgctgcccgcgttgtcccgactctctcccacccgtaaataataaggtcaccagcaagagttgcgaatacaatgggaccacctaccaacatggcgaactcttcgtagcagaaggtctgtttcagaaccgccagccaaaccaatgtactcaatgtagttgctcggagggcaacgtctattgcggcctgaagacttgtccaaagctaacttgtgcatttcccgtatccgttcccgattcgtgttgtagggtgtgtaggggcgacggcgagctgtcttgggaacatagcgacggggatatctttagacaaccagctaatagggaagctagacacagttatcaccggagccactacgatcccccaccctctaggcaggcagggggtctttcaagatttcctggtgctcggtctcacaggggcgctctgatggactcccagcaagcaagcggtaccattgttcaaattgtgatcaacaacaagcataaacatggccaggtgtgcgtgtccaacgggaaaacatattcccacggcgaatcctggcatcccaacctgcgagcctttggcatcgtggagtgcgtattgtgcacttgtaatgttaccaagcaggagtgcaaaaaaatccactgtcccaacagatacccgtgtaagtatccccagaaaattgatggcaagtgttgcaaagtttgtccaggcaaaaaagcgaaggagcttcccggacagtctttcgacaataagggctacttctgtggagaggaaacaatgcccgtttacgaaagtgtatttatggaagacggcgagacaacaaggaaaatcgctctggaaacagaacgtccacctcaggtcgaagtgcacgtatggactataagaaaaggcatcctccagcatttccacattgaaaagatatccaagcggatgtttgaggagctcccccacttcaagctcgtcaccaggactacactgtcacagtggaagatctttaccgaaggggaggctcagataagccagatgtgttcgagcagggtctgtcgcacagaactcgaagatctggtgaaggtgctgtacctcgagagatcggaaaaagggcactgctag

SEQ ID NO: 246791 - DNA, 1458 bp, Artificial Sequence
  Description of Artificial Sequence: Synthetic coding sequence
atggctgccgtgtggcagcaggtcctggctgtcgacgccaggtataacgcctatcggacccctaccttccctcagttcagaacgcagtacattcggagacgatcacagctgcttcgcgagaacgccaaggccggacacccccctgcactccggagacaatatcttaggctgagggggcagcttcttggccagcgctacggccctttgtcagagccaggaagcgctcgcgcatactctaacagtattgtgcgttcgagtaggacaaccctcgacagaatggaagatttcgaggatgaccccagggctctgggagcccgagggcacaggagatccgttagtaggggaagctaccaactgcaggcacaaatgaatagagccgtgtacgaagacaggcctccaggaagtgtcgtcccgactagcgcagcagaggcttccagagcgatggctggcgacacaagcctttcggaaaattacgccttcgctggaatgtaccacgtgtttgaccagcatgttgacgaagctgtgcccagggtcagatttgcaaacgacgaccggcaccgcttggcctgctgctctctagacgggtctatatccctgtgtcagttggttccagccccacctaccgtcttgagggtgctgagagggcacaccagaggagtgtccgactttgcatggtctctgagcaatgacatcttggtgtcaacgagcctggacgccaccatgagaatttgggcctctgaagatggaaggtgcattcgcgagataccagacccggacagcgctgagctgttgtgttgcaccttccaaccagtaaataataacttgactgttgtgggtaacgctaagcataacgttcacgtaatgaacatcagcaccgggaagaaagtgaagggaggctcttcaaaattaactggcagggtcttggcactgtccttcgacgcaccagggaggctcctgtgggcgggtgatgaccacggctccgtgttttccttcctgtttgatatggccaccggcaaacttaccaaggcaaagcggttggtggtacacgagggctcacctgtgacatctatatcagcgagatcttgggtatctagagaagcacgtgatccttcgctgcttattaacgcatgtctgaataaactcctcctgtatcgggtagtcgataacgaaggaacactgcagttgaagcgctcctttccaatcgagcagtcctcccacccggtgagaagtatcttttgtcctcttatgagcttcaggcagggagcatgcgtcgtcacaggatccgaggacatgtgtgtgcatttctttgacgtagagcgcgctgcaaaggcagctgtcaacaagctgcaggggcacagtgcgccagttttagatgtatcattcaactgtgacgaaagtcttctggcatcttccgatgctagcggcatggtgatcgtgtggcgccgagaacaaaagtag

SEQ ID NO: 246792 - DNA, 1893 bp, Artificial Sequence
  Description of Artificial Sequence: Synthetic coding sequence
atggaagcagtggtgctgccgtggcagatctttggagtgagagaactgcctgtggaaagaggtgtgacgatgaaaggacccaggctgtttcgcgcaccaggccacgtacccactggcctgaagtgccaccctgaccaggaacacatgatataccccctcggctgtacagtactcatccaggccataaacaccaaagagcagaacttcctgcagggtcacggcaataacgtttcctgtcttgcaattagtcggtccggcgagtacattgccagcggccaggtcacgttcatgggctttaaagccgatatcattctgtgggattacaagaacagggagctcttagccagactgtccctgcacaaaggcaaaatcgaggcactagccttctcccctaatgacctctacctcgtgtcactggggggtcccgacgacgggtctgtggtggtttggagtatcgcaaagagggacgccatatgcggctccccagcggcaggcttgaacgtgggcaatgcaactaacgtgatcttttcccggtgtagggacgagatgttcatgaccgccggtaacggaaccatccgggtgtgggagctggatctgcccaatcggaagatttggcccacagaatgtcaaactggccagctgaaacgcatcgtcatgtccattggcgtggatgacgacgatagcttcttctacttaggcactactacaggtgacattctgaaaatgaatcccagaacaaaactgctgactgatgtcggtccagcaaaagacaagtttagcctgggcgtcagcgctattaggtgcctcaagatggggggactattggtcggctctggcgctggactcctggttttttgcaaatctcccggttataagccaatcaagaagatccagctgcaagggggaatcacctccatcactttgcgaggggaagggcaccagtttttagtgggcaccgaggagtctcatatctatcgtgtcagctttactgacttcaaggaaaccctgatcgccacttgtcacttcgacgcagtggaagacattgttttcccattcgggacagctgaattattcgctacctgcgcaaagaaggatatccgcgtgtggcacacctcatccaacagggagttgctgcgtataaccgtgccaaacatgacttgccacggcattgactttatgagagatggcaagagcatcatctctgcgtggaacgatggcaagattagggcctttgcgcctgaaactggcaggctgatgtatgttatcaataacgctcaccgcattggggtgaccgccatcgctacgacttccgactgtaagagggttatatccggagggggagaaggcgaagtgcgcgtgtggcagattggctgccaaactcagaagttagaggaggcactcaaggagcacaaatcctctgtctcatgtatcagggttaagcggaataacgaggaatgcgttacagcaagtacagatgggacatgcattatctgggacttagtgcggctgagacgcaaccagatgattctggcaaacacgttattccagtgcgtttgctaccaccccgaggagtttcagataattaccagcggcactgacaggaagattgcttactgggaggtattcgatggcactgtgattcgcgagctggaagggtccctctctggttctatcaatgggatggatattacgcaagaaggagtgcacttcgtgaccggagggaatgaccaccttgtgaaggtttgggattacaatgagggtgaggttacccatgtcggggtggggcactctgggaatatcactagaatacgcattagcccaggtaatcagtatatagtttccgtgagtgcggacggcgctatacttaggtggaagtatccttacactagctag

SEQ ID NO: 246793 - DNA, 1863 bp, Artificial Sequence
  Description of Artificial Sequence: Synthetic coding sequence
atggataacaagatatcaccagaggcccaggtggcagaattagagttagatgctgttatcggcttcaatggccatgtgcctactggcctgaaatgtcaccccgaccaggagcacatgatttatccattaggctgcacagtgctgatacaggctatcaataccaaggaacagaattttttacaaggccatgggaataacgtgagttgcctggctatcagtcggtccggcgagtatattgcgtctggccaggttacgtttatggggtttaaggcagatatcattctgtgggattacaaaaaccgcgagctcctggccaggctgtccctccacaaggggaagatagaagccctggctttctcaccgaacgatttgtatttggtgtccctcggaggtcccgacgacggatccgtcgtggtttggtctatagcaaagcgagatgctatctgtggctcacccgcagcaggtctcaacgtaggcaacgccactaatgtcattttcagtagatgtagagatgagatgttcatgacagctggcaacggcactataagggtctgggagctggacctgccaaatcgcaaaatttggcccactgagtgccagacaggtcaacttaaaagaattgtgatgagcatcggcgttgatgatgacgatagtttcttctatctgggaaccaccaccggtgacatcctcaaaatgaacccaagaactaagctgctaaccgacgtggggccagctaaggacaagttttccctgggcgtatcagctatccggtgtctgaagatgggaggactattagtcggaagtggagcaggactgctggtgttttgtaagtctccgggatataagccaattaagaaaatccagctgcagggcggtattacctccattaccctaaggggggaaggacaccagtttttagtgggcacagaggagagccatatctaccgcgtttcctttactgacttcaaagagaccttgatcgccacttgtcattttgacgcagtggaggatattgtgttcccatttggaactgcggaactgtttgcaacgtgcgctaagaaagatatcagagtgtggcacacatcatccaatcgtgaattgctgcgcatcacagtgccaaatatgacgtgccacggcatcgattttatgcgtgatggtaagtctattatctccgcctggaacgatggaaagatacgcgcatttgccccagagactggtcgcttaatgtacgttatcaacaacgctcacaggatcggcgtaactgccatcgcaaccaccagcgactgtaagagggttataagcgggggaggagaaggcgaggtccgcgtgtggcagatcggatgtcagacccaaaagctggaggaagctctgaaagagcataaatcctctgtgtcatgcattagggtcaagcggaacaacgaggagtgcgttaccgccagcaccgacggcacgtgcatcatttgggacctagtcaggctgaggcggaaccagatgatccttgctaatacattgttccagtgcgtctgctatcacccagaagagttccaaatcattacgagcggcaccgatcgcaagatcgcctactgggaagtctttgacggcaccgtaatacgagagctggaggggtccctgagcggctctattaacggcatggacattactcaggagggtgttcacttcgtgaccggaggcaatgatcatctggtgaaggtctgggattacaatgagggggaggtgactcatgtgggagtggggcattcaggcaatattactcggattaggataagccccggaaaccaatacatcgtcagtgtgagcgcagatggggcaattcttcggtggaaatacccctacacaagttag

SEQ ID NO: 246794 - DNA, 1659 bp, Artificial Sequence
  Description of Artificial Sequence: Synthetic coding sequence
atggataacaagatctcccctgaggctcaagtcgcagaactcgagctagacgctgtgatcggttttaacgacattattctttgggattataagaatagggagctactcgcccgactgagtttacacaaaggtaaaattgaggctctcgcctttagtcctaacgatctgtatttagtcagcttaggtggtcctgatgatggctctgtggttgtgtggagcatcgccaagagggacgccatctgcggcagtcccgctgctggcctgaacgtgggaaacgccacaaatgtgatctttagtcgttgtagggacgagatgttcatgaccgccggaaacggtaccatccgtgtctgggaacttgatttaccaaaccgcaagatctggcccacagagtgccagaccggacagctgaaacgtatcgtgatgagcattggggtcgatgacgacgattcctttttctacttggggaccactactggagacatcctcaaaatgaaccctcggaccaaattgctgacggatgttggaccagcgaaagataagttctctctgggcgtgagcgccatccgatgccttaagatggggggtcttctcgtcggctccggggcaggtcttctggttttttgtaaaagtcctggctacaaacccatcaaaaagatccagcttcaggggggtattacctcaataaccctgaggggcgaggggcaccagttcttggtcggcacagaagagtcccacatatatagggtaagcttcactgatttcaaagaaaccctcatcgctacctgccactttgatgctgtagaggacatagtctttcccttcggaaccgccgagctgttcgctacttgcgccaagaaggacatccgggtgtggcacactagctcaaatagggagttattgagaatcaccgtgccaaatatgacctgtcatggaatagattttatgcgcgatgggaagtcgattatcagtgcatggaacgacggcaaaatcagagccttcgcccctgaaacggggagactcatgtatgtcattaataacgcgcataggatcggcgtcacagccattgcgacaacctctgattgtaagcgcgttatatccggcggaggtgagggggaggttagagtctggcagattggatgtcagactcaaaagcttgaagaagcactgaaagaacacaagtcttcagtgtcttgtatccgcgtcaaacggaacaacgaggagtgtgtcactgcttctaccgatgggacatgcatcatctgggacttggtgaggctgcggagaaaccagatgatcctggccaatacactctttcagtgtgtgtgctatcacccagaggagttccagatcattacctccgggactgataggaaaattgcctattgggaggtctttgatggtacagtgatccgtgagctggagggatcgctcagcggaagcatcaacgggatggacataacgcaggaaggggttcactttgtcacagggggtaatgatcacttggtgaaggtttgggactataatgagggggaggtaacccatgtgggtgtgggccactctggcaatataacaagaataaggattagcccgggtaaccagtatattgtgtcggttagtgctgatggagctatcttgagatggaagtatccctatactagttag

SEQ ID NO: 246795 - DNA, 3969 bp, Artificial Sequence
  Description of Artificial Sequence: Synthetic coding sequence
atggcttggatgacatacatctctaactggtttgagcaagacgactggtatgaaggcctccagagagctaatatgagccaggtcagacaagtgggcctcctcgccgcaggctgtcagccttggaataaggacgtgtgcgctgcaagcggagacagatttgcgtactgtgcaaccttagctatctacatctaccagctggatcatcgatataacgagttcaaactgcatgcaatcatgagtgaacacaagaagaccattaccgccatcagttggtgcccacataatcctgatctctttgcatcagggtcaaccgacaatcttgtcataatctggaatgtcgccgagcaaaaggtcatcgccaaactagattcaaccaaaggaatccctgcctccttaagttggtgttggaacgcggaggacgtggtggcctttgtgtcgcatcggggtcctcttttcatttggaccatctctggccctgattcaggggtgattgtacataaggatgcacacagtttcttgagtgatatatgtatgttccgatggcacacgcaccagaagggaaaagtggtctttggccatatcgatggcagcctctccattttccaccctgggaataagaatcagaaacatgttctgcgaccggagtcgctggagggcactgatgaagaagatcctgtcaccgctctggagtgggacccactcagtaccgattatcttctggtcgtgaatttgcattacggcatcaggctcgtggacagtgagagcctgtcctgtattaccacctttaacctccctagcgcggctgcctcagttcagtgtttggcttgggtgcctagcgctccaggtatgttcatcaccggcgactcccaggtcggagtcttaagaatatggaatgtatctcggactacaccgatagataacctgaagcttaagaaaaccggctttcattgcctccacgtgttaaactcacctccacgcaaaaaattctcagtgcagtcacccacaaagaaccattatactagctctactagcgaggccgtcccaccgcctactctgacccaaaatcaggctttcagcttgcctcctggccatgcagtgtgttgcttcctggatggtggcgtggggctctatgacatgggggctaaaaaatgggactttctgagagacctggggcatgtcgaaacaattttcgattgcaagttcaagccagatgacccaaacttgcttgctacagctagttttgatggcaccataaaagtctgggatatcaacactctgaccgctgtttacacttcccctggcaacgaaggcgtcatctactcattatcctgggcaccgggaggccttaactgcattgccggaggcaccagtaggaatggtgcatttatctggaatgtgcaaaagggtaaaatcatccagcggttcaacgagcacgggaccaacggaatcttctgtattgcctggagtcacaaagatagcaagaggatcgccacttgttcctcggatggattctgcattatacgcactatcgacggcaaagtactgcataaatataaacatcccgctgcagtgtttggttgcgactggtcccagaacaataaggacatgattgccactgggtgcgaagacactaatgtgagagtttattacgtcgccacaagtagtgatcagcctcttaaagttttttctggccatacagccaaagtgttccacgtcaagtggtctcctctgcgcgagggaattctctgtagcgggagcgacgatggtactgtgaggatttgggactatacacaagatgcgtgcatcaatatcctgaacggccataccgcgcctgttcgcggtttgatgtggaacacagagattccgtacctgctgatctcgggcagttgggattataccattaaggtgtgggatactcgggagggtacatgtgttgacacagtgtacgatcacggagctgacgtgtatgggttgacttgccaccccagtagacccttcaccatggcaagctgctcacgcgactctacagtcagactctggagtttaactgccctggttaccccggtccagattaacatcctcgccgatcgctcatgggaggagattattggaaatacagattacgcaattgagcctggtacacctcccttactctgcggtaaagtgtctcgcgacatcaggcaggagatcgagaagctgacggccaattctcaagtaaaaaagctacgctggttctccgagtgcttatctcctcccggaggatctgataacctttggaatctggtggcggtcataaagggtcaagacgattctttactgccacagaattattgcaaaggcatcatgcatctcaagcacctgattaagttcagaacctctgaggcccaagagttaaccactgttaagatgagcaaattcggagggggtatcggcgtgccagctaaagaagagagacttaaggaagctgccgaaattcacctccgcttaggccagattcagcggtactgtgaactcatggtggagctgggtgagtgggataaggcactttccattgctccaggagtttccgtgaaatactggaagaagctcatgcagagaagggccgatcagctgattcaggaagataaggacgacgtcataccttactgcatcgccattggggatgttaagaagcttgtgcatttcttcatgtcgaggggtcaactgaaagaagctctgttggtggcacaagccgcttgtgaagggaacatgcagcccctccacgtatctgtgcccaaaggcgcttcttactctgacgacatttacaaagaagactttaacgagctcctgcataaggttagtaaggagctcgccgagtggtactttcaggacggtcgagcagtgttggctgcctgctgccacctggccatcgacaacatcgaattggcaatggcctatctgatcaggggcaacgagctcgagctggctgtgtgcgtaggtaccgttcttggggagagcgcagcccctgctacccactatgctctggaactgttggctcgaaagtgtatgatgatcagtgtatgtttcccatgtgtaggctactcagtgcctttctgctatgtgaaccgaaatctggctgctgacttgctactaatgattccagacaatgagttgcatctcataaagctatgtgcgttttatccgggttgcacagaagaaatcaacgatttgcacgataagtgcaagctgccaactgttgaggagtgcatgcagctggccgaaaccgcacgtgccgatgacaacatttttgagacagtcaagtattatctgctgtctcaggaacctgagaaggcactacctatcggcatctccttcgtgaaggagtacatatccagctcagactggactttggacacaatttacccggtcctcgatctcctgagttatatcaggacagaaaagctgctccttcacacctgtaccgaagctagaaatgagttgctaatcctctgtggctacattggagccctgctcgcgattagacgccagtaccaatccattgtgccagccctgtacgaatacacatcccagctgctcaaaaggagagaggtcagtgtgcccctgaagatcgagtatctcagcgaggagctggacgcatggagagcatgcacccagtcgactaaccgcagcctggaggacagtccctatacgcccccaagcgatagccagagaatgatttacgcaacactgctcaaaaggcttaaggaggaatcgctcaaaggaataatcggccctgattatgtaacgggctcaaacttgccatcgcattccgacatccacatatcctgtcttaccggactgaaaatacagggtcccgtcttcttcctagaggacggaaaatccgccattagcctaaacgacgctcttatgtgggccaaagtcaaccctttttcccctctcgggacagggatccgactgaacccattctag

SEQ ID NO: 246796 - DNA, 393 bp, Artificial Sequence
  Description of Artificial Sequence: Synthetic coding sequence
atgtcccaggtccgtcaggtcgggttgctcgctgccggatgtcagccatggaacaaggatgtgtgcgctgcttcgggagacagatttgcatactgcgccacactcgcgatctatatctatcagctggaccaccgatataacgagtttaaactccacgcgattatgagtgaacataagaagactatcaccgctatctcttggtgccctcacaaccccgacctcttcgcgagcggctctaccgataatctggtgatcatttggaatgtagcggaacaaaaggtgatcgcgaagctggatagggccaggcccccttccccaaaaataatctacattaagatcatcaatattatcgaagaaaacatccataatagtgaaatgcagtggatcatctag

SEQ ID NO: 246797 - DNA, 3897 bp, Artificial Sequence
  Description of Artificial Sequence: Synthetic coding sequence
atgagccaggtgcgacaggtaggcctgctggccgcaggatgtcagccatggaataaggacgtgtgtgccgcatcaggcgaccgattcgcttactgcgcaacccttgctatctacatttatcagttggaccacagatataatgaattcaaattgcatgccatcatgtccgaacacaagaaaacaatcaccgccatctcgtggtgtccccacaatccagatctgtttgccagtggctccactgacaacctagtgataatatggaatgtggctgagcagaaggtgattgcgaagctggactcaaccaagggaatccctgcgtcgttgagttggtgctggaatgctgaggatgtggtggcatttgtgagtcaccggggaccactgttcatctggacgatctcaggacctgattccggtgtcatcgttcacaaagatgcccactcatttctgagcgacatttgtatgttcagatggcatactcaccagaaaggcaaggtggtattcggccacatcgatggctccttgagtatttttcacccaggcaacaaaaaccagaagcacgtcttaaggcctgagtcactagagggaacggacgaggaagatcccgtcaccgccctcgaatgggatcctctgtctactgactatctgcttgtggtgaacctccactatggaattagattggtggactccgagtctctgtcttgcatcacaaccttcaacctgccaagcgcagccgctagtgtccagtgtttggcctgggtcccttctgctcccggaatgtttatcaccggcgattcccaggtgggtgtgttgcgaatctggaatgtcagtagaactactccaatagacaacctcaagctcaagaaaacaggcttccactgcttgcacgtgctgaacagtcccccacgaaaaaaattctccgtgcagtctccgaccaagaaccactacacctcatctacctccgaagccgtgccacctcctacccttactcagaaccaggcattttctttgcctcccggtcatgcagtgtgctgttttctagatggcggtgtgggattgtatgatatgggagctaaaaaatgggacttcctaagggacctgggccatgtggaaaccattttcgactgtaaatttaaaccagatgaccccaaccttttagccacagcttcattcgacggcaccatcaaggtgtgggatatcaacactttgaccgccgtatacacctctcctggcaacgagggggtgatttacagcttgagctgggcaccgggaggcctgaactgcattgcaggcggtactagtcgcaatggtgcttttatctggaatgtgcagaaggggaaaatcatccaaaggtttaatgagcacggaaccaatggcatcttttgcattgcttggtctcataaggactccaaacggattgcaacctgctcttctgatggtttctgcatcatcagaacgatagacggaaaagtcttacataagtacaaacatcccgcagcagtttttgggtgtgactggagtcagaacaacaaggacatgattgcaaccggatgcgaagatacaaatgtccgagtgtattatgtggctacctcatcggaccaaccgctcaaagtgttcagcggccacaccgcaaaagtgtttcacgtgaagtggtctcccctgcgggaaggtattctgtgttcaggctcggacgatggtaccgtgcggatctgggattatacgcaagatgcatgcattaacattctgaacggtcacaccgcgccagtgcggggactgatgtggaacacagaaataccgtatctgctcatctcaggcagctgggattacactattaaagtctgggatactcgtgagggcacctgcgtcgatacagtctatgaccatggggcagatgtttatggtctcacctgccatccatcaagacccttcaccatggcttcatgctccagggactctactgtgcgcttgtggtcactgaccgccctggtgaccccggtccagattaacatcctggcggatcgatcttgggaagaaatcattggcaacaccgactacgccatcgaaccgggtacgccacccctcctctgcgggaaggtaagccgtgatatcagacaggaaatcgagaaactgactgctaattcccaggtgaagaagttgcggtggtttagtgagtgcctgagtccaccaggcggatcagacaatttatggaacctggttgcagtcattaagggacaggatgactccctgttaccccagaactattgcaaagggattatgcatctcaagcaccttatcaaattcagaacgagcgaggctcaagagctgactacggtgaagatgagtaagttcggcggaggtataggcgtaccggctaaagaagagaggttgaaggaggccgctgagatccatctgcggttgggccaaatccagaggtattgtgagctcatggtggaactcggggagtgggacaaggccttgtccattgcgccaggtgtctctgtgaagtattggaagaagctgatgcagcgacgtgctgaccaactgatccaagaagacaaggacgacgtgatcccatattgcatagcaataggcgacgttaagaaactggtgcactttttcatgagcagggggcagttaaaggaggccctcctcgtcgctcaggccgcttgcgagggcaacatgcagccattgcatgtgagcgtgcccaagggtgccagctattccgatgacatttacaaggaagatttcaacgagctgctccataaggtgtcaaaggaactggctgagtggtattttcaagacggcagagcggtcttggccgcatgctgtcatctcgcaatcgacaacattgaactagccatggcatacttgatccgcggaaatgaactggagcttgccgtttgcgtgggcaccgttttgggtgaaagcgcagcgccagctacacattacgccctggagttactcgccagaaagtgtatgatgatttcagtttgcttcccctgtgtgggatattccgtgccattttgttatgttaaccgaaacctggctgccgatctcctcctgatgatccctgataacgagctgcacctgattaagctgtgtgccttctatcccggttgcactgaggaaatcaatgacctgcacgacaagtgcaagctgcctacagtggaggaatgcatgcagctggccgaaacagctcgggctgatgataatatcttcgagacagtgaaatattacctcctgagccaggagcctgaaaaagccctccccatcggcatctccttcgtgaaggaatacatcagcagtagtgactggactctggataccatttatcctgtgctggatttgcttagctacatccgtaccgagaagttgctgttgcacacatgtactgaggcacggaatgaactgctcatcctgtgcggttatataggtgctctgctcgccatccgacgccagtaccagtctatagtccctgcactgtacgagtacaccagccaactcctaaaacgccgagaggtgagtgtgcctttaaagatagaatacctttccgaagaattggacgcttggagggcctgtactcagtcaacaaacaggagcctggaagactctccatataccccaccaagcgactcccaacgtatgatttatgctacattactgaaacgcctgaaagaggaaagtttaaagggcatcatcggacccgattacgtaacaggctccaatcttccatctcacagcgatatacatataagctgtctgacgggattgaaaatacaaggcccagtgttcttcctcgaagatgggaagagcgcaatctctcttaatgatgctctgatgtgggcaaaggttaaccccttttcccctctgggcacaggtatcagactaaatccattctag

SEQ ID NO: 246798 - DNA, 3852 bp, Artificial Sequence
  Description of Artificial Sequence: Synthetic coding sequence
atgtctcaggtgaggcaggtgggcctgttggccgctgggtgtcaaccctggaacaaggacgtgtgtgctgcctccggggatcggtttgcttactgtgctacactggctatttacatctatcaactcgatcatcgctataatgagttcaagctgcacgccattatgtcggaacacaagaagacaatcactgcaattagctggtgcccccacaaccctgatctgtttgcctcgggttccactgataatctcgtaattatttggaacgtggcagaacagaaggtgattgctaaactggactctacgaaaggcatcccagccagtctatcatggtgctggaatgcagaggacgtggtggcattcgtgtcgcaccgcggaccactgtttatttggactatttctgggccagattccggggtgatcgtgcataaagacgcgcattcattcctcagtgatatttgcatgttcaggtggcatacccatcagaaaggcaaagtggtctttggccatattgatggcagcctgagtatcttccatccaggcaataaaaatcaaaagcacgtcctccgacctgaaagcctcgagggtacagatgaagaagacccagtgaccgcactggaatgggatcctctgtcaactgattatcttctcgtggttaacctccactacgggattcggttggtggattcagagtcactgagctgcatcactacattcaatcttccctcggccgcagcctcggtgcagtgtctggcctgggttcccagcgccccaggcatgttcatcacaggggactctcaagttggcgtcctgcggatctggaacgtgtcgcgtaccactcccatcgataatctcaaactcaaaaagacgggcttccactgcctccatgtgctcaactccccgcctcggaagaaattctctgttcagtccccaacgaagaatcattacacctcctcaacaagcgaagccgtgccccctccgacgcttacacagaaccaagctttttcccttcctccaggacatgcggtgtgttgcttccttgatgggggagtcggtctgtatgacatgggggctaagaagtgggactttctgcgtgacttggggcatgtcgagacaatcttcgactgcaaatttaaaccagacgaccctaacctcctggctacagcatcatttgatggcaccatcaaggtgtgggacattaacacgttgactgccgtatacacctcaccaggtaacgagggagtaatctattcgctgagctgggccccagggggactcaactgtatcgccggtggtaccagtcgcaatggcgctttcatttggaacgtgcagaaggggaagataattcagagatttaacgaacacggtacaaacggtatattctgcattgcttggtcacataaggattccaaacgtatcgccacctgtagctcagatgggttctgtattattaggacaatcgacggaaaggttttgcacaagtataagcaccccgctgcggtgttcggatgtgactggagtcagaacaacaaagacatgattgccactggctgcgaagacactaatgttcgcgtgtattatgtggccacctcgtccgaccaaccactaaaagtatttagtggtcatactgccaaggtgtttcatgtcaagtggagtccactgagagaaggtattctgtgttccgggtccgacgatggcacagtgcgtatctgggattatacccaggatgcctgcattaacattctgaacgggcataccgcccctgtgcgcggactgatgtggaacactgagattccctatctcttgatcagcgggtcatgggactatactatcaaggtgtgggacacccgggagggtacatgcgtggacactgtttatgatcatggcgctgacgtgtatggactcacatgccaccccagcaggccctttaccatggccagttgctctcgagattcaaccgttagactctggtcgctcacagccctagttactcctgtgcagatcaatatcctggccgatcggtcctgggaggagataatcggaaacacagattatgcaattgaacctgggaccccacctctgctgtgcggcaaagtctcccgtgatatccgccaagaaattgagaagctgaccgccaatagccaggtaaaaaaattgcgctggttcagtgagtgtctctcacctcctggaggctcagataacctgtggaatctggtggccgttatcaagggacaagatgatagtctgcttccgcagaactattgcaaaggcataatgcacctcaagcacctgatcaagtttcgtaccagcgaagcacaggaattaaccactgtcaagatgtccaagttcggcggtggcattggggtgcccgcaaaagaggaacgcctcaaagaagccgctgaaatccacctacgcttggggcagattcagcggtattgcgagctgatggttgagctgggcgagtgggacaaggcactgtccattgccccaggcgtcagcgtcaagtactggaaaaagctgatgcaaagaagagccgaccaactgatccaggaggacaaggatgatgttatcccctattgcatcgccatcggagatgtcaaaaaactggtgcacttctttatgtcccgtggacagctcaaagaggcactcttggtggctcaggcagcctgtgagggaaatatgcagccattacacgtctctgtgcccaagggggcttcatactccgacgatatctacaaggaagacttcaacgaactcttacacaaggtgagcaaggagctggccgagtggtacttccaagatggtagggccgtgcttgctgcatgttgtcacttggcaattgataacattgaattggctatggcctatctaatacggggaaatgaactagagcttgcggtctgtgttggaacagtcctgggtgagagcgcggctcctgccacccactatgcactcgagctcctcgccaggaaatgcatgatgatttctgtgtggaacttggccgcagatctcctgttgatgattcctgacaacgaattgcacctgatcaagctttgcgctttttacccagggtgcacagaggagatcaatgacctccacgataaatgcaaactcccaacggtcgaggaatgcatgcagcttgccgagaccgcacgtgctgatgataatatctttgagactgtgaaatattacctgttaagccaggaacctgaaaaggccttgcctattgggatttcattcgtgaaagagtatatctcaagctcagattggactctggacacaatctaccctgtgttggatctgctttcctatattaggacagaaaaactattgttgcacacctgcactgaggcaagaaatgaactgcttattctttgtggttacataggagcattgttagcaattagaaggcagtaccagtcaatcgtgcccgctctgtatgaatataccagccagctgcttaaacgacgcgaagtttccgtgcccctcaaaatagagtatctgagcgaggagctcgacgcctggcgagcttgcacgcagtccaccaaccgtagcttggaggatagtccctacacaccgcctagcgattctcagagaatgatttacgccaccttactcaagaggctcaaagaagagtctctgaagggtatcatcggccctgattacgtgaccggctcaaatctcccatcacatagtgacatccatatcagctgcctcactggattgaagatacagggccctgtgtttttcctggaggatggcaagagcgcaataagcttaaacgatgcgctgatgtgggctaaagtgaatccattctcaccactggggacaggaattcgtctgaatccattctag

SEQ ID NO: 246799 - DNA, 3549 bp, Artificial Sequence
  Description of Artificial Sequence: Synthetic coding sequence
atgatcacagtgtccaatcaggagggcgataccatcagacaaacccaggttcggtcagagccatctaatatgcagtttttcttaatgaaaatggacgacaggacctctgccgcagagtcaatgatctccgtcgtgttggggaagaagactctgtttttcctgaatctcaatgaaccagacaaccctgccgacttggaatttcagcaggatttcggtaacatcgtttgctacaattggtacggcgatggcagaattatgataggcttttcttgtggccatttcgttgtgatctccacacacaccggcgaactggggcaagagatctttcaggccaggaaccacaaggacaatttgacatctatcgcagtctcgcagaccctgaacaaagtggctacatgtggcgataattgcatcaagatccaggatctagtcgaccttaaggacatgtatgttatcttgaacctcgatgaggagaataaaggattaggcaccctgagctggaccgacgacggccagctgctcgccctcagcacccaacgaggctcccttcacgtcttcctgaccaagctcccgattctgggcgacgcctgcagtacacgcattgcctacctaactagtttgttggaagtaactgttgccaaccccgtggagggagaactaccaataaccgtgagtgttgatgttgaacccaactttgtcgcagtcgggctgtaccacttggctgtggggatgaacaaccgtgcctggttctacgtcctcggagaaaatgctgttaagaaactaaaggatatggaatacctcggcacagtcgcaagcatatgcctgcattcagattacgccgcagccctgtttgaaggtaaagtccagttgcacctaattgaaagcgagatcctggatgcgcaggaagagagggaaacgagactatttcctgccgttgacgataaatgcaggatcttatgccacgccctcaccagtgattttttaatttacgggactgataccggagtcgtgcaatatttctacattgaggattggcagttcgttaatgactatcgacatccagtgtccgttaaaaagatttttccggatcccaacggcaccaggttggtgtttatcgatgagaagtccgatggatttgtgtattgtcccgtgaacgatgctacatacgagattccggacttttctccaactatcaaaggggtgttgtgggagaactggccgatggacaaaggagtattcattgcatacgatgatgataaggtgtacacatatgttttccataaggacaccatccagggagctaaagttatcctagcaggtagtaccaaagtgccctttgctcataaacccttactgctgtataacggcgaattgacatgccagactcaatcaggcaaggtgaacaacatttacctgtcaactcacgggttcttgagtaacctcaaagacacaggccctgacgaactgagaccaatgctggcccagaacctgatgcttaagagattcagcgatgcttgggaaatgtgtaggatccttaatgatgaagccgcatggaacgaattagcaagggcctgcttgcaccacatggaggtcgagttcgcgatccgagtttatagaagaataggtaatgttgggattgttatgtcattggagcaaataaagggcattgaagactataatctgctggccggacatctggccatgtttaccaacgactataacctggcccaggacctgtatctcgccagctcctgcccaatcgctgcccttgagatgagaagagacctgcagcattgggacagtgccctgcagctcgcgaagcatttggcacccgaccagatccccttcatttcaaaagaatatgccattcagttggagtttgctggcgattacgtcaatgctctggcacactatgagaaaggaattactggcgacaataaagaacatgatgaggcgtgcttggcaggcgttgcccagatgagtatcaggatgggtgacatcagaagaggcgtcaatcaggcactcaaacacccctctcgggtccttaagagagactgcggggcaatccttgagaatatgaaacagttcagtgaggccgctcaactgtacgagaaggggctgtattatgacaaggcagcttcagtgtacatacgcagtaagaactgggctaaggtcggggatctgctcccccacgtgagcagccccaagattcatttgcagtacgccaaagccaaggaggctgatggtcggtacaaggaggcagtggttgcgtacgaaaatgcaaagcagtggcaatcagtcattaggatttacctcgatcacttaaacaatccggaaaaagcggtgaatatcgttcgggagacacaatcactggacggagctaaaatggtggcccgtttctttctgcagcttggcgactatggaagtgccattcagttcctcgtgatgagtaagtgcaacaacgaggccttcacccttgcccaacagcacaataagatggagatatatgccgatatcatcggatccgaagatacaaccaacgaagactatcagtcaattgcactgtatttcgagggggagaagagatacctgcaggccggtaaattctttctcctgtgtggccaatattcacgcgcactgaaacatttcctgaaatgtccctcctcggaagacaatgtcgccattgagatggccatagaaactgtgggccaggcaaaagacgaactgctgaccaaccagctgattgatcacctcctgggtgaaaacgacggcatgcccaaggacgccaaatatttattccggctgtacatggctctgaagcaatacagggaggcagcacaaacagctattatcatcgctcgggaagaacaaagcgccggaaattatcgcaacgcccatgatgtgctgtttagtatgtatgcagaacttaagagccagaaaatcaagatcccttcagaaatggccaccaatcttatgattcttcacagttatatcctcgtaaagatccacgtaaagaacggcgaccatatgaagggcgctagaatgctgattcgtgtagcgaataatatctcaaagttcccatcccacatcgtgcccatcctgacaagtacagtcatagagtgccatagggctggactgaaaaacagtgccttctcctttgctgcaatgctgatgcgtcccgagtatcgctccaaaatagatgccaagtataaaaagaaaatagaagggatggtgcggaggccggacatcagcgagattgaagaagcaacaacgccctgtcctttctgcaagttcctgttgcccgagtgcgagttgctttgtcccggttgcaagaacagtatcccatactgtattgccaccggacgacacatgctgaaagacgattggaccgtttgtcctcattgtgatttccctgccctctactccgagctgaagatcatgctgaacaccgaaagtacgtgccccatgtgttccgagcgattgaacgccgctcagctgaagaagatcagcgactgtacgcagtatctgcggacggaggaagagctgtag

SEQ ID NO: 246800 - DNA, 4029 bp, Artificial Sequence
  Description of Artificial Sequence: Synthetic coding sequence
atgaaaaggatttttagccttttggagaagacttggctgggagcacctattcagtttgcctggcagaagaccagcgggaattacctggcggtgaccggggcagactatatcgttaaaatttttgacaggcatgggcagaagaggtctgaaatcaatctccccggtaactgcgtagccatggattgggataaggacggcgacgtactggccgtcatcgccgaaaagagtagctgcatctatctgtgggacgcaaacactaataagacgagtcagctcgataatgggatgagagaccagatgtcctttctcctctggtcaaaggttgggtccttcttggccgtgggaactgtgaagggaaatcttctaatctataaccaccagacctcacgcaagatacccgtgctcggtaaacatacgaagcgtatcacatgtggctgctggaacgctgaaaacctcttagccttagggggagaagataagatgataaccgtatccaaccaagagggcgacaccatccgtcagactcaggtgaggtctgagccttcaaacatgcagttcttcctgatgaaaatggacgaccgaaccagcgcagcagagtcaatgatcagcgtggtgctgggcaagaaaacgctcttcttcctaaaccttaacgagcctgacaaccccgcagatcttgaatttcagcaggattttggcaacatcgtgtgctacaattggtatggggatggacggattatgatcggattctcatgcggacattttgtcgtgatctccacccacacaggagaactgggccaggagatctttcaagcacgcaaccataaagacaacctcacttcaatagccgttagccagacccttaacaaagtggctacctgcggagacaactgcatcaagattcaggacttagttgacctcaaggatatgtatgtaattttgaatctggacgaggagaataagggtcttggtacgctttcttggactgacgacggccagttgctcgcgctgtccacccagcgcggttccttacacgtgtttttgacgaaactcccgattcttggagatgcatgctctactaggattgcttatctcacctccctgctggaagttaccgtagctaacccagtggaaggggaactgccaattaccgtgtctgtggacgtcgaacccaatttcgtggccgtcgggctctatcatctggcggtgggaatgaataaccgcgcatggttctacgtgctcggtgaaaacgccgtcaaaaagcttaaggacatggagtacctgggaacagtggcatcaatctgtctgcactctgactacgccgcagccctgtttgagggcaaggtacagctgcatctaatcgaatctgagattctggatgcacaggaggagcgggagactcggctgtttccagctgtcgacgacaaatgtcgaattctgtgtcatgctctgacctctgattttctcatctacgggaccgacactggcgttgtgcagtatttctacatcgaagattggcaatttgtcaacgattataggcatccggtcagcgtgaagaaaatatttccggaccccaacggtactcgtctggtctttattgacgagaaatctgacgggtttgtgtactgccctgtgaatgatgcgacttatgaaatccctgatttcagtccaactatcaaaggcgtgctctgggagaactggcccatggataagggagtgttcatcgcctacgacgacgacaaggtatacacttacgtgttccacaaagatacgatccagggcgctaaagtgatcctggctggtagtacaaaggtcccgtttgcacataagccactgctcctttacaacggggagctcacatgccagacgcaatcaggaaaagtgaacaatatttatctgtcgacccatgggttcctcagcaacctgaaagacaccggtcccgacgagctcaggcccatgctggctcagaatctgatgctgaaaagattctccgacgcatgggagatgtgccggatccttaatgacgaggcggcatggaacgaactggcgagagcttgcctgcaccacatggaggtcgagtttgccatcagggtctacaggcggattggcaacgtcgggatcgtgatgtctttggagcaaatcaaggggattgaggactacaacctcctggccggacacctcgcaatgttcacaaatgattacaacctggcacaggatctgtatctcgcttcgtcatgtcccatagccgctctggaaatgcgtcgggatctgcagcactgggattcagcacttcaactggcaaaacacttagcccctgatcaaattccattcattagtaaggaatatgcaatccagctggaattcgccggagattacgttaacgccctcgcgcattacgaaaaaggcatcactggagacaacaaggaacacgacgaggcctgcctggccggagtggcacagatgtctatacgcatgggagatatccgcagaggggtgaaccaggccctgaaacacccatcccgggtcttaaagcgcgattgtggtgctattttggagaacatgaagcaattctctgaagctgcccagttgtatgagaaggggctttactacgataaagctgcttctgtgtatattcgtagcaaaaactgggccaaggttggtgatcttttaccccacgtgagctcacctaaaattcacctgcagtacgctaaggcaaaggaggccgatgggagatacaaggaggctgttgtcgcctacgaaaacgccaaacagtggcaaagcgtgatcaggatttatttggaccatctaaataaccccgagaaggctgttaacattgtccgagaaacccagagtctggatggcgcaaagatggtcgcgagattcttcttgcagttaggggattatgggtcggcaatacagttcctggtgatgtccaagtgcaacaacgaggcctttactcttgctcagcagcacaacaaaatggaaatttatgctgatatcatcggctcagaggacacaaccaacgaagactatcaaagcattgccctatacttcgagggagaaaagagatacctgcaggccggtaagttcttcttactttgcggacagtatagtcgcgctctaaagcactttttgaagtgtccttcatctgaggataatgttgctatcgaaatggccattgagacagtaggacaggccaaggatgagcttctgacgaaccaactcatcgaccacctgctcggtgagaacgatggtatgccaaaagacgctaagtatctgttccgtctctatatggctctgaagcagtatagggaggcagctcagactgctatcataattgccagagaggagcaaagcgcagggaattaccgcaacgcccacgacgttctcttttccatgtatgcagaactgaaaagccagaagatcaagattccatcggagatggccacaaatctgatgattctgcactcatatatcctcgtaaagattcatgttaaaaatggggatcatatgaaaggcgctaggatgcttattagagttgctaacaatatttccaaatttcccagtcacatcgtgccgatcctgacctcaactgtgattgagtgtcatcgggctggcttgaagaacagcgcattctcctttgccgcaatgttaatgcggccagagtatagatctaagatcgatgctaagtataaaaaaaaaatcgagggaatggtgagaagacccgatatcagtgagatcgaagaggccaccacaccctgtccattttgcaagttcttgcttcctgagtgcgagctgctgtgtcccggttgtaaaaatagcataccatactgcattgccaccgggaggcatatgcttaaggacgattggaccgtgtgcccacactgcgactttcccgctctgtactctgaactcaaaatcatgctgaacaccgaatctacatgccccatgtgctctgaaagattaaatgcagcccagttgaagaagatttcagattgtactcaatacttaaggactgaggaggagctgtag

SEQ ID NO: 246801 - DNA, 1443 bp, Artificial Sequence
  Description of Artificial Sequence: Synthetic coding sequence
aaaaggatctttagtcttctggagaaaacatggctaggcgcaccaatccaattcgcttggcaaaagacatccggtaattacctggccgtgaccggcgctgactacattgtgaaaatttttgatcggcacggacagaagcgctccgaaattaaccttccaggcaactgcgtggctatggactgggacaaggatggcgacgtactggccgtaatcgctgagaagtcctcatgcatctatctgtgggacgctaacactaataagactagccaacttgacaacggaatgcgtgaccagatgtccttcttgttgtggtccaaagtgggatcctttctagctgtcggcaccgtcaaggggaatctgctaatctataatcatcagacatcccgcaaaatccccgttctcgggaaacatactaaacgcattacatgtggctgttggaacgccgagaatctcttggcacttggaggcgaggataaaatgataacagtttccaatcaggagggggacactatccggcagacacaagtgcggtcagaaccttctaatatgcaattctttctcatgaaaatggacgaccggacttctgccgctgaatccatgatcagcgtggtgctggggaagaaaacacttttttttctgaacctaaatgaacccgataatcccgcagatctggagttccaacaggatttcggcaacatagtttgttacaattggtatggcgacggacgcattatgatcggttttagttgtgggcactttgtcgtaatctccactcacacgggggaacttggccaagaaatcttccaagctcgcaaccataaggacaatctcacatccattgccgtgtcacagacactcaataaggtcgccacctgcggggacaactgtatcaagatccaggacctggtggacctaaaggatatgtacgtgatcctcaatttagacgaggagaataagggccttgggaccctgagttggacagacgacggtcagcttctcgctctaagcacccagcgcggatcgcttcatgtgtttttgaccaagctcccaatcctcggggatgcctgcagtacccgtatcgcctatttgacaagcctccttgaggtaactgtggccaacccggtcgagggggaattgccaattaccgtttcagttgatgttgagccaaatttcgtggctgtgggtttgtaccacctcgcagtagggatgaataaccgcgcatggttctacgtccttggtgagaacgctgtgaaaaaactgaaggatatggagtaccttggcactgtcgcctccatatgccttcattctgattatgccgcagccctgtttgaaggcaaggtccagttgcatctcaaagccaagtcctggatgcttaagaagaatgtgagactgggattctcccagcagtggatgatctccgccgtctcgtacgctatgccctag

SEQ ID NO: 246802 - DNA, 1446 bp, Artificial Sequence
  Description of Artificial Sequence: Synthetic coding sequence
atgaagaggatcttctcactgctggagaagacgtggctaggtgcaccaatccagttcgcgtggcagaagacctccggcaattacctggccgtgacaggggcagattacattgtgaagatttttgaccgccacggccagaagaggagtgaaatcaatctcccaggtaactgcgtggccatggactgggacaaggacggcgacgtccttgctgtgatcgccgaaaagagtagctgcatctatctttgggatgcaaacacaaacaaaacctcccagctggataatggaatgcgtgaccagatgtcatttcttctttggagcaaggtggggtcttttcttgctgtcggcaccgtgaagggcaatctcctcatttacaatcaccagacttcgaggaaaattcccgtcctgggaaagcatacaaagagaatcacgtgcggatgctggaatgctgaaaatcttctggcgttaggaggcgaagacaaaatgatcacagtgagcaaccaggagggagacaccattaggcagacacaggtgcgatcagagccctcaaatatgcagtttttcctgatgaagatggacgaccggacttcagccgcagagtcgatgatctcggtagtcctcggcaagaagacattgtttttcctgaatctgaatgagccggataaccccgcagacctcgaattccagcaggattttggaaacatcgtctgctacaactggtacggagatggccgtattatgatcggattcagctgtggacacttcgttgtcatctcaacgcacacaggcgaactgggccaggaaattttccaagccaggaaccacaaggacaacctcaccagtattgctgtttcccagaccctcaataaggtggctacatgtggtgataactgcatcaagattcaggacctggtagatcttaaagacatgtatgtgattctcaatctggatgaagaaaacaagggcttggggactttgtcttggaccgatgatggacagttacttgccctctcaacccagagagggtccctccacgtctttcttaccaagcttccgattttgggtgacgcatgcagtacccggattgcttatctcacatcgctactggaggtgactgttgccaatcccgtggagggcgaattacctatcaccgtctccgtcgatgtggagccaaacttcgttgctgtgggattataccacctggcagttggtatgaataatcgggcttggttttacgttttgggggagaatgcagtaaagaaactcaaggacatggagtacctggggacagtcgcctctatctgcctgcactctgactacgccgcagctctgttcgaagggaaggtgcagcttcacctaaaagctaaatcatggatgctgaaaaagaatgtcaggcttggattttctcagcaatggatgataagcgctgtcagttatgccatgccttag

SEQ ID NO: 246803 - DNA, 2832 bp, Artificial Sequence
  Description of Artificial Sequence: Synthetic coding sequence
atgggcctgacaaaacaatacctccggtatgtcgcctccgccgtttttggcgtgataggcagccaaaaaggaaacattgtgttcgtgactttgagaggagaaaaaggccgatacgttgctgtgcctgcctgcgagcatgtgttcatttgggaccttcggaagggtgaaaaaatactgatcctgcaaggattaaagcaagaggtgacctgtttatgtcctagtcccgatggtttgcatctggcggtaggttacgaggatggatccattcgcatctttagtctcttgtcgggggaaggcaatgtcaccttcaacgggcacaaggccgctatcaccaccctgaagtacgaccagctgggagggaggctggcaagcgggtcaaaggataccgacattattgtctgggatgttattaacgagtctgggttgtatcgactgaaggggcacaaagatgccattacccaggcactctttctgagagagaagaatctgctcgtcacatcaggcaaggatacaatggtaaagtggtgggacctcgacacacagcattgttttaagactatggtgggccacaggactgaggtgtggggtctcgtgttactaagcgaggagaaaagactgatcaccggggcatctgatagcgaactgcgggtttgggacattgcctatcttcaggaaatcgaggaccctgaagaaccggacccaaaaaagattaagggaagctcacccggaatacaggacacactagaggcggaagacggagcttttgagacagacgaggcgcctgaagatcgcattctgtcatgtcgcaaagctggaagcattatgcgcgaaggcagagaccgtgttgtcaacctggccgtcgataaaacaggacgaatcctggcgtgtcacgggaccgattcggtgttagaattgttttgtatcctctccaagaaggagatccagaagaaaatggacaaaaaaatgaagaaagccaggaagaaagccaagcttcactccagtaagggagaggaagaagatcccgaggttaatgtcgaaatgtctctccaggacgaaattcagcgggttaccaacattaagacttcggccaagatcaaaagcttcgatctgatccactccccgcatggagagctgaaggctgtgttcctgcttcagaataacctcgtggagctgtattccctgaaccctagcctgcctaccccccaacccgtgaggacatctaggatcacaatcggtgggcaccgatccgacgtccgtacgctcagcttcagttccgacaatatcgcagttctttctgcagccgctgacagcataaagatctggaaccggtcaactcttcagtgcataaggacaatgacatgcgagtatgctctgtgtagctttttcgtgcccggagacagacaggttgtcataggtaccaagacaggaaagttacaattgtacgacctcgcctcgggaaacttgctggagaccattgacgcccacgacggggcactctggtctatgagcctctctccggatcaacggggtttcgtgaccggcggagccgataaaagtgtgaaattctgggacttcgagttagttaaagacgagaacagcacacagaaacgcctgagtgtcaaacagacgagaaccctccagcttgatgaagatgtgctttgtgtgagctatagcccgaaccagaagctcttggcagtctcattactggactgtaccgtgaaaattttctacgtggatacccttaaattttttctaagcctgtatggacataagcttcccgtcatttgcatggatattagccacgacggtgctttgatcgccaccggaagtgctgatcgcaatgtcaaaatctgggggttggattttggagactgccacaaatccctcttcgctcatgatgatagcgtgatgtatctgcagtttgtccccaagtcacacctgttcttcaccgccggtaaggatcataaaattaaacaatgggacgctgacaaatttgagcacattcagactcttgaaggccatcatcaggagatctggtgccttgcagtctctccatcgggagattacgttgtctcaagctcccacgacaagtctttgcggttgtgggagaggaccagagagcccctgatcctggaagaggagcgcgaaatggaaagggaggccgaatacgaggagagcgtggccaaggaagatcaacctgccgttcccggagaaactcagggggattcatatttcactggcaaaaaaaccatagaaaccgtcaaggcagccgagagaatcatggaagccatcgagctctaccgagaggagacagctaagatgaaggagcataaggctatctgtaaggccgcaggcaaagaagttcctttacctagtaatccaattcttatggcatacggctcgatcagcccttcagcttacgtacttgagatcttcaaaggtatcaaatcaagcgaactggaggagtccctgctcgtgctgcctttttcatatgtaccagatatactcaagcttttcaacgaatttatacagctcggaagcgatgtcgaactgatttgtagatgcttattctttctactccggatccactttggccaaataactagcaaccaaatgttggtgcccgtgattgaaaaattaagggaaacgaccatcagcaaagtgtcccaggtcagggacgtgattggatttaacatggctggattggactacttgaagagggagtgtgaagccaagtccgaggtcatgttctttgccgacgcaaccagccatctggaggagaaaaaacgcaagcgcaagaagcgagaaaaactgatcctgaccctgacctag

SEQ ID NO: 246804 - DNA, 123 bp, Artificial Sequence
  Description of Artificial Sequence: Synthetic coding sequence
atgggactgaccaaacaatatctcagatatgtcgcaagcgccgtgttcggggtaattggcagccagaagggtctcgcttcacaagcctcgagcagtttcgtgttttttgctaccgagttttag

SEQ ID NO: 246805 - DNA, 1611 bp, Artificial Sequence
  Description of Artificial Sequence: Synthetic coding sequence
atggccacacgggctcagcccggacctttgtctcaagcaggttctgcgggagtagccgctttggccactgtgggggtagcctccggtcccggacctggacggcctggccctctccaggatgagactctgggcgtggcctccgtgccatcccagtggcgggcagtccaaggcattaggtgggagaccaaatcttgccagactgcctctattgcaacagcatctgctagcgcccaggcgagaaatcacgtggatgctcaggtccagactgaggctcctgtccctgtgagtgtccagcctccctcccaatacgatattcccaggctggcagctttcctgcggcgagtggaagctatggtgattagagagttgaacaaaaattggcagtcacacgccttcgacggctttgaggtgaactggaccgaacagcagcagatggtgagctgtctctacactcttggctacccccctgcccaggctcaggggttgcatgtgacctcgattagctggaacagcaccgggagcgtcgtggcttgcgcctatgggagacttgatcacggcgactggtcaactttgaagtcgtttgtgtgcgcttggaacctggaccggagggacctgcgccctcagcaaccgtctgccgtcgtggaggtcccgtctgccgtgttgtgcctcgcctttcacccgacccaaccctctcatgttgctggcggactctacagtggcgaagtcttagtgtgggacctgtcccgactggaggatccactgctatggaggactggcctcaccgacgacacccatacggacccggtgagccaggtggtttggctgccagagcccggtcatagccaccgcttccaggtcttgtccgttgcaactgacggcaaagtgttactttggcagggcataggcgtcggccaacttcagctgaccgaaggatttgccctcgtgatgcagcagttgcccagatctacaaagctcaagaagcatccacgcggagagactgaagtgggcgctaccgccgtggcgttctcatcctttgatcctcgcctgttcatcctggggacggagggcggatttccactgaagtgctctctggctgcaggagaagctgctttaactagaatgcccagctcagtgccactgagggctcctgcccagtttaccttttcgcctcacggcggaccgatatactcagtaagttgcagtccatttcatagaaacctgttcctaagcgcaggtactgatggtcacgtgcacctgtatagtatgctgcaggccccaccacttactagcctccagctatctcttaagtacctttttgccgtgcgctggtccccagtgcggcctctggtttttgctgctgcgtcaggcaagggcgatgttcagctcttcgacctccagaaatcatcccagaagccaacggtgctaataaaacagactcaggatgagtctccggtgtactgcctggagtttaattcccagcagacacaattgctcgcggcaggagatgcccaaggcactgtcaaggtctggcaattatccaccgagtttacagaacaagggccaagggaagccgaggatctggactgcctagctgccgaggtagccgcatag

SEQ ID NO: 246806 - DNA, 420 bp, Artificial Sequence
  Description of Artificial Sequence: Synthetic coding sequence
gccggtgtggcggctctggccaccgtgggcgtggcctcagggccaggccctggacgacctgggccattacaagacgaaactctgggggtggccagcgtcccctctcagtggcgggctgttcagggtataaggtgggaaacaaagtcctgccagactgcaagtattgcaaccgctagtgcttcagcccaggctaggaaccacgttgacgcccaggttcagaccgaggcccctgtgccagtttccgtccagccgcctagccagtatgatattccacggctagcggctttccttcgcagagttgaagctatggtgatccgggagttaaacaagaattggcagtcccacgccttcgatggtttcgaagtgaattggacggaacagcaacagatggctggcccttggggtttagaacacgcttag

SEQ ID NO: 246807 - DNA, 819 bp, Artificial Sequence
  Description of Artificial Sequence: Synthetic coding sequence
ttgtctcaagctggatccgccggagttgctgctcttgccacagtgggcgtggcttccggcccagggcctggtagaccaggtccattgcaggatgaaacgctgggagtggcaagcgttccctcacagtggcgagccgtccagggaataagatgggaaacaaagtcctgtcagacggcctcaatcgcgacagcctctgcctccgcgcaggccagaaaccacgtggatgcacaggtccagaccgaagctcctgtgccagtcagcgtgcagcctccatctcagtatgacattcccaggcttgccgcttttctacgcagggtcgaggccatggtcatccgggaactgaataagaattggcaatcccatgcctttgatggctttgaggttaattggactgagcagcagcagatggtatcgtgtctctataccctgggatatcctcctgcacaggctcaggggttacatgtgacaagcatcagttggaatagcaccgggtccgtagttgcgtgcgcatatgggaggctcgaccacggcgactggagtactcttaagagttttgtgtgtgcctggaaccttgatcggcgagatttaagaccgcagcaaccttcagcggtggtcgaggttccctcagccgtattatgtctggccttccatccaacccagccttcgcacgtggcaggggagctcccagcagttagcgcttcatccccactgagaacccagctgcctgctttacagcgcgctcaaggcagttttccatgggctttgtggccaggcgataggaaagcgggtcctgatccattgtcccttgaaccacgatag

SEQ ID NO: 246808 - DNA, 3513 bp, Artificial Sequence
  Description of Artificial Sequence: Synthetic coding sequence
atgttcttttatctctctaaaaaaatcagcattccaaataacgtaaaattgcagtgtgtctcctggaataaggagcagggctttattgcctgcggaggtgaggatggattgctgaaagtgctaaagctggagacccaaaccgacgacgctaagctacggggactcgcggctccatctaatctctcaatgaatcagaccctcgagggacactccggctctgtccaggtggtgacctggaacgagcagtaccaaaagctgaccacctctgacgaaaatggccttattattgtttggatgctctacaagggaagctggatcgaagagatgatcaataacagaaacaaaagcgtcgtgaggtccatgtcctggaacgcagatgggcaaaagatttgcatcgtatacgaagatggagcagtgatcgttggtagtgtcgatggaaacaggatttggggcaaagatttaaagggcatccagctttcgcacgtcacatggtccgctgactcaaaggtactactgttcggcatggccaatggcgagatccacatctacgacaatcagggcaacttcatgatcaagatgaagctctcctgcctggtgaatgtgaccggagcgatatccatcgccggaattcattggtaccatgggaccgagggatatgtggagcctgactgcccctgtctggcagtgtgcttcgacaatgggcgatgtcagataatgcgacatgaaaatgatcagaatccagtgctgattgacacaggcatgtacgtggtcggtattcaatggaatcatatgggctcggtgctggcagttgccggattccagaaagctgcaatgcaggacaaagacgtgaacattgtccagttctacacacccttcggggaacatttggggacattaaaagtgcctgggaaggagattagcgcactgtcatgggagggtggcggtctgaagattgccctcgccgttgacagcttcatctatttcgctaacatccgaccaaactacaaatggggttactgctctaacactgtagtgtacgcctatactcgcccagaccgtcccgaatattgcgtggtcttctgggataccaagaataatgagaagtatgtcaagtacgtgaaggggctgatcagcataacaacatgcggggatttctgcattctcgccaccaaggcggatgagaaccacccccaattcgtcctggtgctgtgtaactcgattgggactccactcgacccaaaatatatcgatattgtgcccctctttgtagccatgacgaagacccacgtcatcgccgcatcaaaggaggccttttacacttggcagtacagagtagcgaaaaaactcactgcactggagattaaccagatcactaggtcccgcaaagaggggcgagagcggatctaccatgtggacgacaccccttcagggagcatggacggggtgctggattatagcaagacgatacaaggcacacgtgaccctatctgcgctatcaccgcttccgataagatactcatagtcgggagagaatccggaaccatccagagatactctctacctaacgtaggcctaattcagaagtattccctgaattgtagagcttatcagttgagcctgaattgcaactcatctcgcctggctattatagatataagtggagtgctcacattcttcgacttagatgccagagtgactgatagtaccggccagcaggtggtaggggaactgcttaaactcgaacggagagatgtctgggacatgaaatgggccaaggacaacccggatctgttcgccatgatggaaaagacccgcatgtatgtcttccggaatttggacccagaggaaccaatccagacatccggctacatctgtaattttgaagaccttgaaatcaaatcagtgctgttagatgagattctaaaggacccagaacaccctaataaagattatctgatcaacttcgaaatcaggagcttacgagatagtcgggctctaattgaaaaggtgggaatcaaggatgccagtcagttcattgaggacaatccccatccgaggctctggcggctgctcgccgaggctgctctgcagaagctcgacctttacacagcagagcaagcatttgttcgatgcaaagactatcaggggattaagtttgtcaagcgtctgggaaagctgctcagtgagagcatgaagcaggccgaagtggtcgggtacttcgggaggttcgaggaagcagaacggacctatttggagatggaccggcgtgacctggcaatcggactgaggctgaagctcggcgactggttccgagtactccagctgttgaagacaggttccggggacgccgatgactcactactagaacaggccaataatgcgattggcgactacttcgccgataggcagaagtggttaaacgctgtgcagtactacgtgcaaggcagaaatcaagagagactcgccgagtgttactacatgttagaagactacgaggggcttgagaacttggccatttctcttcctgagaatcataagctactgccagagatcgcgcagatgtttgtacgggtgggcatgtgcgagcaggccgtcaccgctttcctgaaatgttctcagcctaaggcggctgttgacacttgcgtgcacttgaaccagtggaacaaggccgtcgagttagcaaaaaaccattcaatgaaggagatcggaagtctactcgccagatacgcaagtcacttactggagaagaacaaaacacttgatgcaattgagctgtatagaaaggctaactacttctttgacgcagctaagctgatgtttaaaatcgccgatgaagaggccaaaaaaggttctaagcctctgcgggtgaagaagctttatgtgcttagcgccctgctcatcgagcagtaccacgaacagatgaaaaatgctcagaggggcaaggtgaagggaaaatcttcagaagctacctcagctcttgctgggctactagaagaagaggtgctgtccaccaccgatcggttcaccgacaacgcctggcgcggagccgaggcctaccacttctttattcttgcccaacgtcagctgtatgaggggtgcgtcgacacggccctcaagacagcgctgcacctaaaggattacgaggatatcatccctcccgttgagatttatagcttattggccctttgcgcttgtgcctcccgggctttcggcacctgttccaaggcctttatcaagcttaaatcactggagaccctcagctcagagcaaaaacagcagtatgaagaccttgcactcgagatattcactaaacacacaagtaaggataatcggaagccagagcttgattctctgatggagggcggagaagggaagctccctacttgcgtggccaccgggtcgccgattacagagtaccagttctggatgtgctctgtctgcaagcatggagtgctggcacaagagatttcccattactcattctgccctctgtgtcactctcctgtgggatag

SEQ ID NO: 246809 - DNA, 3546 bp, Artificial Sequence
  Description of Artificial Sequence: Synthetic coding sequence
atgttcttctatttatctaagaagatctcaataccaaataacgtcaaactccagtgtgtaagctggaacaaagagcagggattcatagcatgcggcggagaggatgggctcctgaaggtgctgaagctggaaacacagacagacgacgcaaaattgaggggcctagctgccccaagtaacctgagtatgaatcagaccctcgagggccactctgggagtgttcaggtcgtgacctggaacgagcaataccaaaagctgacaacatctgatgagaatgggctgataattgtttggatgctctataaagggtcatggatagaggagatgattaataacaggaataagagtgtagttcggtccatgtcatggaacgccgatggccagaagatttgcatcgtatatgaggacggggctgtgattgtaggttctgtggatggtaaccggatctggggtaaagacctcaagggcatacagctttctcacgtcacctggagtgcagattccaaggtactgctgttcggcatggctaacggcgagattcacatttacgacaaccaaggaaattttatgatcaaaatgaagctgtcttgccttgttaacgtgactggtgcgatcagtattgccggtattcattggtaccacggaaccgaaggttatgtagagcccgattgtccctgtctcgcggtctgttttgataacggaagatgccagatcatgagacacgaaaatgaccagaacccagtcctgatcgatacaggcatgtacgtagttgggattcagtggaaccacatgggctcggtcctggccgtagccggattccagaaggcagctatgcaggataaggatgtcaacattgtccagttttacactcccttcggggagcacctgggcacactaaaggtacctggcaaggaaatttccgccctttcctgggagggcggtggattgaagatcgccctggcagtggactctttcatctatttcgccaatataagacccaattacaaatggggttactgtagtaacaccgtggtgtatgcctataccagaccagacagaccagagtattgtgtagtgttctgggataccaagaataatgagaaatatgttaaatacgtcaagggcctgatctccataaccacctgcggcgatttctgtatcctggccacaaaggctgatgagaatcatccccaggaagaaaacgagatggagaccttcggtgctacctttgtcctggtcttgtgcaattctatagggacgccattggacccgaagtatattgatatcgtgcctttatttgtggctatgacaaaaacccatgtgatcgcagcctctaaggaggccttttatacctggcagtatagagtcgctaaaaagctcacggccctcgagatcaaccaaatcactcggtctaggaaggagggccgagaacgaatctaccatgtggacgatactccgagtgggtcaatggatggcgtgctcgactacagtaaaaccattcaggggacacgggatcctatctgtgcaataactgcttccgataaaattctgatcgtgggtagagaatctgggacaattcagcgctactcactgcctaacgtggggctcattcagaaatactctctcaactgccgggcataccaactctcgctcaactgcaatagtagccggttggccatcatagacatttctggcgtattgacttttttcgatctggacgcgcgtgtgacggactcaacaggtcagcaagttgtcggcgagctactgaaactcgaaaggagagacgtgtgggatatgaaatgggccaaagacaatcccgacctctttgcgatgatggagaaaacacgaatgtacgtgtttcggaatctcgacccggaagagccaatacagaccagcgggtacatatgcaactttgaggacctggagatcaaatcagtgctgttggacgagatactaaaagaccccgaacaccccaacaaggattacctgatcaactttgagatcagaagtctgagagactcccgcgctctcatcgaaaaggttgggatcaaagacgcatctcagttcatcgaagacaacccgcacccacggctgtggcgacttttggcagaggctgccctccagaaactcgacctgtacactgcagagcaggcctttgttcgttgtaaggactatcaaggtataaaatttgtaaaacgactgggcaaactgctgagcgaatcaatgaaacaagcggaagttgtgggctactttggccgatttgaggaagccgagagaacctacctggagatggatagacgcgacctcgcaatcgggctccgactaaagttgggggactggttccgagtgctgcagctattaaaaacagggagtggcgatgccgacgactccctcttagagcaggccaataacgccattggagattacttcgcggataggcagaagtggctgaacgccgttcagtattatgtccagggacgcaatcaggagagactggcggaatgttattacatgctagaggactatgaagggctggagaacttagctatcagcctgcccgagaatcacaaacttcttcctgaaatcgctcagatgtttgtacgagtgggtatgtgtgagcaggcagtgaccgcattcttgaaatgcagccagcccaaagcagccgtggatacttgtgtgcacctaaaccagtggaataaagcagtcgagctcgcaaagaaccactctatgaaggagattggcagtttgctggcaaggtacgctagccacctcctggaaaagaataagaccctggacgccattgaactatacaggaaagctaattatttcttcgatgccgcaaaactcatgtttaagatagcggatgaagaggcaaagaagggtagtaagcctttacgcgtgaaaaaactatatgtgctatccgcacttctgattgaacagtatcatgagcagatgaagaatgctcagaggggcaaggtgaagggtaagtcaagtgaagccacttcagcacttgcagggttgttagaagaagaggttctttccactacagataggtttaccgacaacgcgtggcgcggagctgaggcataccatttttttatcctcgctcagcgtcaactgtatgaaggctgcgtggacacagccctgaagacggctctccatctaaaggattacgaggatatcatcccaccagtagagatctactcattgcttgctctttgtgcctgtgcaagccgggcattcgggacctgtagcaaggcctttatcaaactcaagagtctggaaacactgagcagtgagcagaagcagcagtacgaggatcttgccctagaaatttttaccaagcacacttcgaaggacaaccgaaagccagaattagattccttaatggaaggtggcgagggaaagctgccgacgtgtgttgctactggctctcctatcactgagtatcagttctggatgtgtagtgtctgcaagcacggagtgcttgcacaagaaatcagtcattactcattttgtcccctttgccacagccccgtgggctag

SEQ ID NO: 246810 - DNA, 1680 bp, Artificial Sequence
  Description of Artificial Sequence: Synthetic coding sequence
atgacaaaaacccatgttattgccgctagcaaggaggctttctacacctggcagtaccgcgtggccaaaaagctgacagcgcttgaaattaatcagatcacccgctcccggaaagagggcagggagcgcatctatcatgttgatgatacaccttcaggttcaatggacggcgtcctcgactattcaaagacaatccagggcacccgcgaccctatctgcgctataaccgctagtgacaaaatcttgatcgttggaagagagtctgggaccattcagagatactccttgcctaatgtcggcctgatacagaagtacagtctgaactgtcgagcttatcaattgtcgctaaactgtaactctagtaggctcgcgatcatcgatatttccggagttttaactttttttgatctggacgcgagggtaaccgacagcacggggcagcaggtagtgggtgagctgctcaaattggaaaggagagacgtatgggacatgaaatgggccaaagataatcccgacctctttgccatgatggaaaagacaaggatgtacgtgtttcgaaatctcgaccccgaagagcctatccagaccagcggatacatctgcaactttgaggaccttgaaattaagagcgtgttattggacgagatccttaaggatccagaacaccctaataaagactatctaattaactttgagattcgctctttacgggactctagagccctgatcgagaaagtggggattaaagatgcgtctcagtttattgaggataacccacatcctcggctgtggcgtctcctggctgaggctgcactgcaaaagctggatctgtacacagccgaacaggccttcgtgcggtgcaaggactatcagggcatcaagtttgtcaagcgactcgggaagctcctcagtgaatctatgaagcaggcagaggtggtgggatattttggacggttcgaggaagctgagcggacgtacctggagatggatcgaagagatctcgcaattggactccgtctgaagctgggagattggtttcgcgtcctgcagctgctcaaaactgggtccggtgacgctgatgattctttacttgagcaggccaacaatgcaataggcgactacttcgccgatcgccaaaaatggttgaacgccgtacagtattatgtacaagggcgaaaccaggaaagactggccgagtgttactacatgttagaggactatgaaggcctggaaaatctcgctatcagcttacccgagaatcacaagcttttgcccattgcggatgaagaagctaagaagggtagcaagcccctccgagtcaagaaactttacgtcttatccgctcttctcattgagcaataccacgagcagatgaagaatgctcagcggggaaaagtaaagggcaagtcttctgaagctacttccgccttggctgggttgttggaggaagaggtgttgtccaccactgaccgattcaccgacaacgcatggagaggcgctgaagcttaccacttttttatcctcgcacagcggcaactttacgagggatgtgttgacacggccctgaaaacagtggagaagggcaactgtcaacatgcactgccccaggaagctcaatcattgagcatcaatagcggctgcgccgtctatgcaaatacagtgagtctgttgcggaagtag

SEQ ID NO: 246811 - DNA, 2856 bp, Artificial Sequence
  Description of Artificial Sequence: Synthetic coding sequence
atgtgctgtacggagggctcactgcgaaagagggacagccaacgcgctcctgaagccgtgctatgcctccagttatggcaacggactgtgccattagatactctgaaaggcctaggcacgtgtttcccttccggccctgagctgcgcggagcaggcattgcggctgccatggagagggcttccgagcgccgaaccgcttctgccctgtttgcaggattcagagcgctgggtttatttagtaacgacatcccacatgttgtacgattctcggcgttgaagagaagattctatgtgacgacttgcgtgggcaagtctttccatacttatgacgtgcagaaactgtctctcgtagccgtctccaattccgtcccacaggacatctgctgcatggccgctgatggccgtttggttttcgcagcatatggcaacgtgtttagcgcctttgcacgaaataaagagatcgtgcacactttcaaaggacacaaggccgagatccatttcctgcagccgttcggtgaccacatcatttccgtggatacggatggaatattaatcatctggcatatttacagcgaagaggaatatttacaacttacttttgataaatccgtatttaagattagtgctatcctgcatccctcaacatacctcaacaagatcctgctgggctcagagcaggggtcattacagctttggaatgtgaaatccaataagctcctgtacacattccccggatggaaggtgggtgtgactgccttacagcaagccccagctgtggacgtggtggcaatcggccttatgtccggacaggtcataattcacaatattaagtttaatgagacactgatgaagttcaggcaggattggggaccgataacctccatttcctttaggacagatgggcaccctgtaatggcagccggttccccttgtgggcatataggcttgtgggatcttgaagacaagaagctcatcaaccaaatgagaaacgcccatagcactgctatagcagggctcactttcctgcatagagagcctctgctggtcactaatggcgcagacaatgctctgcgcatttggattttcgacggtcccacaggcgaagggcgtctgctgagattcaggatgggacacagcgccccactcactaatatccgatactacggtcagaatggacagcagatccttagtgcatctcaggacggcacacttcagagcttctccaccgtgcacgagaaatttaacaagagtcttgggcatggcctcattaataaaaagagggtgaaacgcaaaggtctgcagaacacaatgagtgtgcgccttcccccaattaccaaattcgcggcagaagaggcgagagagagcgattgggatggcattatcgcttgccatcaagggaagctgtcgtgttctacctggaactaccagaagtcaacaatcggagcatactttttgaaacctaaggagcttaagaaggatgacattacagctacagcagtggacatcacttcttgcggcaactttgcggtcatagggctgtcaagcggcacagtcgacgtgtataacatgcagtccggcattcatcggggttcttttggcaaggatcaggcacataagggatcggtccggggagtggcggttgatgggctgaaccagctgacagtgacgaccggcagtgaaggcctgctaaagttttggaattttaaaaataagatccttattcactccgttagcctttcctcaagcccgaatatcatgttgctccatcgcgatagcgggatacttggtctagcactggatgatttcagtatatctgtgctcgatatagaaactaggaaaatcgtgagagagttctcgggccaccagggacagattaatgatatggcctttagtcctgacggcagatggcttatctcggctgccatggactgctctatccggacttgggatctgcctagcggctgtcttatagattgttttttgcttgactcagctccactcaacgtgagcatgagccctacaggcgacttcctagccacatcacacgtggatcatctgggtatatatctatggagcaatattagtctttatagcgtagtgagcctccggccattgccagcggactacgtcccatcaatagttatgttgccaggaacctgtcagactcaagacgtggaggtctctgaagagaccgtggagccgtcagatgagttgatcgaatacgactcccccgagcagcttaatgagcagctggtgactctgtccctgttaccggagagtagatggaagaacctactgaatctggacgtgatcaagaagaagaacaagcctaaggaaccacctaaggtgccgaaaagcgctccatttttcatccccactataccaggcctcgtgcccaggtacgcggcacctgaacaaaacaatgatccacagcagagcaaggtggtgaacctgggggtcctggcccagaagtctgatttctgccttaaattggaagaagggctggtcaacaacaagtatgataccgcgctcaacctattgaaggagtcaggccctagcggcatcgaaactgagcttagatccctatctcccgattgcggaggttccatcgaagtcatgcaaagcttcttgaagatgatcggtatgatgctcgacaggaagcgtgatttcgagctcgcgcaggcctacctcgcactgtttctaaagttacatctgaagatgctaccatcggaaccagtactgttggaagagatcacaaatctcagctcacaggttgaagagaactggacacacctgcagagcctgttcaaccaatccatgtgcatacttaattatttgaaatcagcactgctctag

SEQ ID NO: 246812 - DNA, 2856 bp, Artificial Sequence
  Description of Artificial Sequence: Synthetic coding sequence
atgtgttgtacagaaggttctttacggaagagagacagccagagagcgcctgaggccgtcttgtgcctccagctctggcaaagaaccgtaccacttgacacactgaaagggctagggacatgttttcccagcggccctgagctacgaggagccggaatcgcggctgcgatggaacgcgcaagcgagagaaggactgcatcagccctgtttgccggattcagggctctcgggcttttcagtaacgacataccacacgtggttagattttccgccttgaagagaaggttctatgtcaccacctgtgtaggcaaaagctttcacacatacgatgtacaaaaacttagtcttgttgccgtgtctaactcagtaccacaggacatttgttgtatggccgcagacggaagactggttttcgcggcttatggtaatgtgttcagtgcattcgctagaaacaaagaaattgtccataccttcaaggggcataaggctgagattcatttcctgcagcctttcggcgatcacatcatatctgtcgacacggatggcattttgataatttggcatatttatagcgaggaagagtatctccagctcacattcgataagtccgtatttaaaatctctgctatccttcaccctagcacctacttgaataagatcctgctgggctcagagcaaggcagtcttcagctgtggaacgtgaagagcaacaaattgctctatacatttccaggttggaaggtgggtgtaaccgcgcttcaacaggccccagctgtggacgtggtagccattggcctcatgtcagggcaggtgataatacataatatcaagttcaatgagacactcatgaagttccgccaagattggggccctattactagcatctctttcaggacagatggccatccagtcatggccgcaggctctccatgtggccacattggtttatgggatctggaagataagaagcttatcaaccagatgagaaatgcccattccaccgctattgcagggctcacattcttacaccgggaaccgcttctggtgaccaacggcgctgataacgcattacggatttggatatttgatggaccgacaggcgaaggcagactcttgcgcttccggatgggacattccgcaccactaaccaatatcaggtactatggccagaacggacagcaaatcctgtcagcgtcccaggatggcacgctccagagcttttctacggtgcacgagaaattcaacaaatctctggggcacggcctcatcaacaaaaaaagagttaaacggaaagggttgcagaacactatgtcagtccggctccctccgataaccaaatttgccgctgaggaggctcgggagagcgactgggatggcataatcgcttgccaccaggggaagctctcctgcagtacttggaattatcagaagagtacaataggagcttactttctgaagcctaaggaactcaagaaagacgacatcacagccacagcagtcgacataacgtcctgcgggaacttcgccgtgatcgggctcagctctggaaccgtagatgtgtacaatatgcagtctggcatccatcgagggtccttcgggaaagaccaagcgcacaaggggagtgtgcgcggtgtcgctgtggatgggcttaatcagttaacagttacaaccgggtccgaaggtttgctgaagttttggaactttaagaacaagatcttaattcactctgtgagcctgagctccagtcccaacatcatgcttttgcaccgggacagcgggatcctcggactagctcttgatgacttctcaatctccgttctagatatagagacaaggaaaatcgtaagggagttctcaggtcaccaggggcagatcaacgacatggcctttagtcccgacggacgctggctgatctccgctgctatggactgcagcattcgtacttgggatttgcccagtggttgcctgatcgattgctttctgctcgactccgcaccattgaatgtttcaatgtcccccaccggagattttctggccacttcacatgttgatcacttggggatttacctgtggtctaacattagtctatacagtgtggtttcactaagacctctcccagccgactacgtcccctcgatagttatgcttcccggaacatgccagacccaggatgtcgaggtgtccgaagagacagtcgagccatctgacgaactaatcgaatatgatagccccgagcagctgaacgagcagctggtcactctctcgttgttgccagaatccaggtggaagaacctcctcaacctcgatgtgataaagaagaagaacaaaccaaaggagccgcctaaggtgcctaagtctgcgccattttttatcccaactatacccggactcgttccaaggtacgccgcacccgagcagaataatgaccctcagcagagcaaggtcgtgaatctcggggtgctggcccagaagtccgacttctgcctcaaactagaggagggcctggtgaacaataagtatgacacagccctgaacttgttgaaggagtccggacccagcggcatcgaaaccgagctacgctctctctccccagactgtggaggaagcattgaagtgatgcagagcttcctgaaaatgataggaatgatgctggaccgcaagagagatttcgaactagcccaggcctaccttgccctgttcttgaaactgcatctgaaaatgcttccttcggaaccagtgctgttggaggaaattactaacttgagctcccaggtggaagagaactggactcatctgcagtcgctgttcaaccagtccatgtgtatactaaattacctgaagtccgctctgttgtag

SEQ ID NO: 246813 - DNA, 1239 bp, Artificial Sequence
  Description of Artificial Sequence: Synthetic coding sequence
atggcagggtccgtcggacttgcactgtgtggtcaaactctggtcgtacggggtggaagtagatttttggcaacctcgattgccagtagtgacgatgattccctgttcatttatgattgcagcgctgccgaaaaaaaaagtcaggagaacaagggggaagacgcccctcttgaccagggaagtggtgccatccttgcctcaaccttctcaaagtctggaagttactttgcattgactgatgattctaaacgtctgatactgtttcgcacgaagccttggcaatgcttgtctgtgaggactgtcgcccgaaggtgtactgccctgacattcatcgctagcgaagaaaaggtcctggtggctgataagtccggggacgtttactcattcagtgtcttggagccacatggctgcggcagactggaactgggtcatctgtcaatgctgttggatgtcgcagtcagcccggacgaccgatttattctcactgcagaccgcgatgagaagatccgcgtttcctgggcagccgctccccactctatcgagagtttctgcctgggccacaccgagtttgtgtccagaatcagcgttgtcccgactcagccaggcctcttgctctcctcttccggcgacgggaccctccgtctgtgggagtatcgctccggccgtcagcttcactgctgccatctcgcgtcactccaggagcttgtggacccacaggctcctcaaaaattcgcagcatcgcgcatagcgttttggtgtcaggagaactgcgttgctctgttatgtgatggtaccccagtcgtttacatatttcagcttgacgccagacggcagcagctggtctacaggcagcagctggcctttcagcatcaagtgtgggatgtggctttcgaagaaacccaggggctgtgggtgctgcaggactgtcaggaggcccctctggtgctgtatcgccctgtgggagaccagtggcagtccgtgccggagagcacagtgctgaagaaagtaagcggtgtgctgaggggcaactgggccatgctggaagggtctgccggagccgacgcctcctttagctcgctctacaaggcaacgttcgataacgtgacttcctacctgaagaagaaggaagaacgtcttcaacaacaacttgaaaagaagcagagacgccgtagcccaccacctggcccagacgggcatgccaaaaaaatgcggcctggggaggccacactctcatgctag

SEQ ID NO: 246814 - DNA, 1239 bp, Artificial Sequence
  Description of Artificial Sequence: Synthetic coding sequence
atggcagggtccgtggggttggccctgtgtggacagacactagttgtacggggaggctcacggttcttggccacgagcatcgcatcctcagacgacgactccctcttcatctatgactgttccgcagctgagaagaagtcacaggaaaacaaaggagaagacgctccgctcgaccagggctccggtgcaatcctggcgtccacattttccaaatctggaagctattttgcgctgactgacgattctaagcgtctcatcctgttccgaacaaagccctggcagtgcctgtcggtacggactgtggctagacgttgtaccgccctgacttttatcgcatcggaagaaaaggtgttagtggctgataagtcgggggacgtctacagcttctctgtgttagaacctcacgggtgtggaagactcgagctcggacacctttcaatgctactggacgttgccgtttccccagacgaccggttcattctaactgccgaccgtgatgaaaaaattcgggtgtcctgggccgctgcaccacacagtattgaatccttttgtcttggtcacaccgaatttgtgtccaggatatctgtggtgcccacccagcccggtctcttgctcagttcctcaggggacggcaccctgaggctgtgggagtaccggagcggaagacagctgcattgctgccatctagccagtctccaagaactggtagatccccaggcccctcaaaagttcgcagcctctaggatcgccttttggtgtcaggaaaattgcgtagccctgctttgcgacggaacccccgtggtgtacattttccaattggatgccagacgccaacagctcgtttatagacagcaattggctttccaacaccaggtgtgggatgtggcatttgaggagacgcagggcctttgggtgctgcaggactgccaggaggcccctctggttctgtaccgcccagtcggcgatcagtggcagtctgttcccgagtcgacggtcctaaagaaggtgtccggggtgctgcgcggaaattgggcaatgctggaagggtctgccggtgcagacgcctccttttcatccctgtacaaggccacgttcgacaacgtgactagctacctgaaaaaaaaagaggaaagactccaacagcagctggaaaagaagcagaggcgaaggtcgcctcctcccggtccagatgggcacgccaaaaaaatgagacccggtgaggccacactaagctgttag

SEQ ID NO: 246815 - DNA, 2034 bp, Artificial Sequence
  Description of Artificial Sequence: Synthetic coding sequence
atggcggctcatcatagacagaatactgccggacggaggaaggtacaggtgtcctacgtgattagggacgaagtagagaagtacaatcgcaatggcgtaaacgcgttgcagctcgatccagccctgaaccgcctgttcacagctggaagggacagcattattaggatctggtccgtgaaccaacataagcaggacccttacatcgcctctatggaacatcatactgactgggtgaatgacatcgttctgtgctgtaatggcaagacactgattagcgcctcatctgacaccaccgtaaaggtatggaatgctcataagggtttctgcatgagcacactgcggacacacaaagactacgtgaaagctcttgcctacgcaaaggataaggagttagtggcctcagctggcctcgacagacagatcttcctgtgggatgtaaacactttgaccgctctcacagcgtcaaataacactgtgaccacctcctccctctcgggtaacaaggactctatttacagtttggcaatgaaccagttgggaaccattatagtgtcaggttctacagagaaagtgcttcgagtgtgggaccccagaacttgcgcgaagctgatgaagcttaaaggacataccgacaatgtgaaggccctgttgctgaaccgtgatgggacgcagtgtctgtccgggtccagcgacggcacgataagactgtggagcttagggcaacagaggtgcatagccacataccgggtccatgacgagggcgtttgggccctacaggtcaacgacgcttttactcacgtttactctgggggacgcgataggaagatttattgcacggatttgcggaatccagacattagagtgctgatctgtgaagaaaaggcgccagtgttgaagatggaattggaccgctctgctgatcccccacccgcaatctgggtcgccaccacaaagtccacagtaaacaaatggactctcaaggggattcacaattttcgggcttccggtgactacgacaacgattgtaccaacccgatcactcccctttgtacacagccagaccaggttattaaagggggagctagtatcattcagtgtcacattctcaatgacaaacgacatattctaaccaaggataccaataataatgttgcttattgggacgtactcaaggcgtgcaaagttgaggacctgggcaaggttgatttcgaggatgagataaaaaaaaggtttaagatggtgtacgtgcctaactggttttcagtggacctcaagacaggtatgttgactatcaccctggatgagtcagactgcttcgccgcatgggtaagtgcgaaagatgcgggttttagtagccccgatggttctgacccaaagttgaacctcggagggctgctccttcaggccctcttggagtattggccacgaacccacgtgaaccccatggacgaggaggagaatgaggtgaaccacgtgaatggcgagcaggagaatcgcgttcagaaggggaatggctacttccaagtgcctcctcacacccccgtcattttcggggaggcaggcggtcgaaccctgtttcgtttgttgtgtagagattctggaggggagaccgaatccatgctgctgaacgagactgtacctcagtgggtcattgatattactgtggataaaaacatgccaaagttcaacaaaatacccttttaccttcagcctcacgcttccagcggggctaaaacactgaaaaaagacaggctttctgcctccgacatgcttcaggtgcgcaaagtgatggagcacgtttacgaaaagatcattaatctggacaatgagtcccagactacctcttcatctaacaatgagaagcctggtgaacaggagaaagaggaagacattgcagttctggccgaggaaaaaatagagctcctctgtcaggaccaggtcctggatcctaacatggaccttcgtaccgtgaagcactttatctggaagagcggaggtgatctcacgttgcattataggcagaagtccacgtag

SEQ ID NO: 246816 - DNA, 1788 bp, Artificial Sequence
  Description of Artificial Sequence: Synthetic coding sequence
atggaatgccagtccgcccaagtcatcagtgcttcttccgacacgacggttaaggtgtggaacgctcataagggtttctgcatgagcaccctgaggacacataaggactacgtgaaagcactggcctatgccaaagacaaggagctggtggcgtctgccggactggatagacaaatctttctgtgggacgtgaacactttaactgctctgactgcctccaacaatacagttacaacctcttccttatctggcaataaggactccatctactctctcgcaatgaatcaattaggcacaatcatcgtgagcggtagtaccgagaaagtactgagagtgtgggatcccagaacttgtgccaaactgatgaaattaaaagggcacactgacaacgtcaaggcacttctgctgaaccgcgacggaacccagtgtctttctggatcctctgatgggactatccgcttatggtccctcgggcagcagcggtgcatcgctacatatagggtgcatgatgagggtgtttgggctctacaggtgaacgatgcgtttactcatgtgtacagtgggggacgagaccggaagatctactgcaccgacctaaggaaccccgatatccgcgtgctgatatgcgaggagaaagcgcctgtccttaaaatggaactagaccggagcgctgatcctccgcctgctatttgggttgcaacgaccaagagcaccgtcaacaaatggactctcaaaggaatccataattttagggcatccggagattatgataatgactgtaccaaccctatcacccccctgtgcacccaaccagatcaagtgataaagggcggagcaagcatcattcagtgtcatatcctcaatgataagagacatattctgaccaaggataccaataacaatgtagcctactgggatgttttaaaagcttgcaaagtagaagaccttggcaaagtggattttgaagacgaaatcaaaaagagatttaaaatggtttacgttcctaactggttttccgtcgacttaaagaccggtatgctgacaatcacgcttgacgagagtgattgttttgccgcttgggtctctgccaaggacgccggattttcctcccctgacggatccgaccctaagttgaacctgggaggcttgctgctgcaagccttactcgaatactggcctcgtacacacgtgaaccccatggatgaagaggagaacgaagtaaaccatgtcaatggagagcaggaaaaccgcgttcagaaggggaacggatattttcaggtgcctccacacacccctgtgatctttggggaagctggcggacgaactctatttcgactgctatgtcgcgactcgggcggtgagacggagtccatgctcctcaacgaaaccgttcctcagtgggtcatcgacataaccgttgacaaaaacatgcctaaattcaacaagatccccttctacctgcagccccatgcaagctccggagccaaaacacttaagaaggatcgtctgtcagcaagcgacatgcttcaggtgaggaaagtgatggagcacgtctacgaaaaaatcatcaacctggataatgagtcccagaccacctcctcctcgaacaatgaaaaacccggagaacaggaaaaagaggaagatattgcagtgttggctgaggagaagatagagctcctttgtcaagaccaggtcctggatcctaacatggacctgcgtactgtgaagcactttatatggaaatctggcggagatctcacattgcactaccgccagaagagcacttag

SEQ ID NO: 246817 - DNA, 366 bp, Artificial Sequence
  Description of Artificial Sequence: Synthetic coding sequence
atgcccaaattcaataaaattcccttctatctgcagccccatgccagttccggggctaaaacactgaagaaagatagacttagtgctagcgacatgctgcaagtacggaaagtaatggagcatgtgtacgagaaaatcatcaatctagacaacgagtcacaaacaacctcatcatctaataacgaaaagcccggtgagcaggagaaggaggaagacattgccgtgctggctgaggaaaaaatcgagctgctctgccaggaccaagtgagggtgctcgatccaaatatggacctacgcaccgttaagcactttatttggaagagcgggggtgatctcacactgcattacaggcagaagtccacttag

SEQ ID NO: 246818 - DNA, 1209 bp, Artificial Sequence
  Description of Artificial Sequence: Synthetic coding sequence
atggcagcccatcataggcaaaacaccgcagggagacgaaaggtacagtgtctcagtgggagttcagacggcactatccgcctgtggtcactgggccagcagaggtgcattgctacatacagggtgcacgatgagggcgtctgggcgctgcaggtcaacgatgcctttacccatgtatactccggtggtagagatcggaagatttattgtaccgacctgcgcaatcccgacattcgagttctcatttgcgaagagaaggcccctgtgctgaaaatggaactcgacaggtcagccgacccccctccagctatatgggtcgcaaccactaagtctaccgtgaataagtgggcctgcaaagtggaggatctgggtaaggtagatttcgaggacgagattaagaaaaggtttaaaatggtgtacgtcccaaactggttctccgtggaccttaaaacggggatgctcacaattaccttggacgagagcgactgcttcgccgcttgggtgtcagccaaggacgccggattctcctcaccagatggctccgaccccaaattaaacttggggggactgttactccaggccctacttgaatattggccccgaacccatgtgaaccctatggatgaagaggagaatgaagtgaaccatgtgaatggtgaacaggaaaacagagtgcagaagggaaacgggtacttccaggtgccacctcatacaccagtgatattcggtgaagccggaggtagaaccttgtttcgcctgctttgcagggacagcggcggagaaaccgaatcaatgctgttgaatgaaaccgttccacagtgggttatcgatataactgtcgataagaacatgccaaaattcaataagatccccttctatctgcagccacacgcatccagtggggctaagacactgaaaaaggatcgcctgagcgctagcgacatgcttcaagtgagaaaggtcatggagcacgtctacgaaaaaattattaatttggacaacgaaagtcaaaccacctcgtcctcgaataatgagaaaccaggcgagcaggaaaaagaggaagacatcgccgtgttagcggaagagaaaattgagctgctctgtcaagaccaggtgctggaccctaatatggatctgcggacggtcaaacacttcatttggaaaagtggtggggacttaactctgcattaccggcagaaatcgacctag

SEQ ID NO: 246819 - DNA, 651 bp, Artificial Sequence
  Description of Artificial Sequence: Synthetic coding sequence
atggatgcattagaagactacgtatggccacgtgccacaagtgagctgatcttactaccagttacgggactggagtgtgttggagatcgtctcctagcaggcgagggccctgacgtcctggtctatagcctcgattttggtggccatctgagaatgataaaacgggtgcagaacctattgggacattacctcatccacggatttagggtgcggccagagccaaacggtgatctggatcttgaagccatggtggctgtctttgggagcaaggggctgcgcgtcgtgaaaataagctggggccaaggccacttttgggagctctggcgctctgggctctggaacatgtcagactggatctgggacgcgcgatggctggaaggaaatattgctctggcactgggacataatagcgtcgttctctacgacccggtggtgggatgtattctccaggaagtgccgtgcacagatagatgcaccttgagttctgcttgcttgatcggtgatgcgtggaaagaacttaccatcgttgccggagccgtgagcaaccagcttctggtgtggtaccctgcaactgcttttaccctgtatttgtccgctcgccctactcctttttgttgcgtgttgacaccccgaatgtgtactaggttgtag

SEQ ID NO: 246820 - DNA, 3456 bp, Artificial Sequence
  Description of Artificial Sequence: Synthetic coding sequence
atgggaagcgccgctagatgggagggatctttctccagagagttttcaagcctgctcagtagaggctgcctgtccacaagcaggattgatatggacgccctcgaggactacgtgtggcccagggcgactagtgagttgatcctgttgccagtcacagggttagaatgtgttggtgacagactgctggccggagagggccctgacgtgcttgtttatagccttgactttggtggacatctccggatgattaagcgcgtgcagaacctactcggacattatctgatacatgggttccgagtaagacccgaacccaacggcgacttggatctggaagccatggtggccgtgtttggttcgaaagggcttcgcgttgtgaagattagctggggtcagggacacttctgggaactgtggcggtcaggactgtggaatatgtcagactggatatgggacgcgcgatggctagagggcaatatcgctctggctctgggccacaactccgtggtgttatacgacccagtggtcggttgcattctgcaggaggtcccctgcactgataggtgtactctgagcagcgcctgtctgataggtgatgcatggaaagaactgaccatagttgctggagctgtcagtaaccagctattggtttggtatcccgctaccgccctggccgataataagcccgtggctcccgatcgcaggatctccgggcatgtaggcattatcttctcaatgtcttacctggaatccaaaggcctactcgcaactgcttccgaggatcgttcagtacgcatctggaaggtgggtgatctgcgcgttccgggtggaagggtccagaacatcggccactgtttcgggcatagcgcacgcgtgtggcaggtgaagttactcgagaattatctgatcagcgcaggagaagactgtgtgtgtttggtgtggtcgcacgaaggcgaaatcctccaagcctttcggggtcaccagggacgaggaataagggctatcgccgctcacgaacgccaggcttgggtgattactggcggagacgatagtgggattcgtttgtggcatctcgtaggacgaggatatcggggactcggagtgtccgccctgtgctttaaaagtagaagtaggccaggaacacttaaggccgtcaccttagctggctcctggaggctgcttgccgttacagataccggggctctgtacctgtacgatgttgaggtgaaatgctgggaacagttgctggaggacaagcatttccagagttattgcctgctggaggctgctccaggccctgagggctttgggctatgcgccatggcgaatggggaaggccgagttaaagtagttcccatcaacacgccaacagcggctgtggatcaaacactgttccccggtaaggtccacagcctgtcttgggcgttgcgcggatatgaagaactgttgctcctggccagtggaccaggcggtgttgtcgcttgtctggaaatcagtgccgctccatccggcaaagccatttttgtgaaggagcgttgcaggtacctcttgcccccatccaaacaacgctggcacacctgctccgcatttctccctcccggtgattttctggtttgtggggatcggcgagggtccgtcctgctgtttccgtctcggcctggcttgctgaaggatccaggagtcggcggaaaggccagggcgggagccggtgctccagtcgtaggatctgggtctagtggcggagggaatgcgttcaccgggcttggccctgtctccactctgcctagcctgcatggaaagcaaggggtgacctctgtgacatgccatggcggttatgtctacaccacagggagagacggggcttattatcaacttttcgtgcgagacgggcagttacagccagttctaaggcagaaaagctgtagaggcatgaattggctggccggtctccggatcgtacctgatgggagtatggtgattctggggttccacgccaacgaatttgtggtctggaatccaagatcccatgagaaactgcatatagtaaactgcgggggtggacaccggtcctgggcattcagtgacaccgaagccgcaatggcgtttgcctacctaaaagatggcgatgtgatgctgtatagggctttaggtgggtgcacccggcctcacgttattcttcgcgaaggccttcatggccgagagattacctgtgtcaaacgggtcggaacaatcacactaggaccggaatacggggtgccaagtttcatgcagccggacgacttggaacctggtagcgagggaccagacctgaccgatatcgttattacatgcagtgaggacacaacagtgtgtgttctggccctgcctactactactggctctgcccacgcacttactgccgtgtgcaaccacatttccagtgtcagggccgtcgcagtttgggggataggcacacccggtggaccccaggacccccaacctggtcttacagcccatgtcgtatcagcaggaggacgcgctgagatgcattgcttttctatcatggtgaccccggacccatctacacccagccgccttgcatgtcacgttatgcacctgtctagtcatagactggatgagtactgggacaggcagaggaaccgtcatcgcatggtcaaagtagatcctgaaacccgctacatgtctttggccgtctgcgagcttgaccagccaggcctaggcccactggtcgctgcagcatgttccgatggcgcagtccgtctgtttctgcttcaggattccgggagaatcctgcagctcctggccgagactttccatcataagagatgcgtcttgaaggtgcacagcttcactcacgaggctccaaatcagaggaggcgtctcctgctgtgttcggccgctacagacggatccctggccttttgggacctgacaacaatgttggaccacgatagtacggttctcgagccacctgtggaccccggtctaccatacaggctgggcaccccgtcgctcacactacaggcccatagctgcggtattaactcactccatactctgccaacacgagagggacaccatttggtggccagcggctcggaggacggaagtctccacgtatttgtcctcgcagtggagatgctccagctcgaagaggctgtgggagaggccggactcgtaccgcagctcagggtactggaagagtactctgtgccttgcgcgcatgccgcacatgtcacaggcctcaagatcctgtccccttctatcatggtgtcagccagtatcgaccaacgcctaacattctggcgcctaggacatggagaacctaccttcatgaattctaccgtgttccacgtccctgacgtcgcagatatggactgctggccggtcagcccagagtttggacacaggtgtgcattgggtgggcaggggctggaggtctacaactggtatgactag

SEQ ID NO: 246821 - DNA, 3213 bp, Artificial Sequence
  Description of Artificial Sequence: Synthetic coding sequence
atgatcaaaagggtgcaaaacctactgggtcactatctgatccacggtttccgagtgcgcccagaacccaacggagaccttgatctcgaggctatggtggccgtgtttggaagcaaggggttgcgagtcgtgaagatatcttggggtcagggtcatttctgggaactgtggcggtctgggctatggaatatgagcgattggatctgggatgctaggtggcttgaaggcaacattgccctcgctttgggccacaacagcgtcgtgctgtacgatccggtggtggggtgcatcctgcaagaagtgccctgcacggatagatgcaccctgagtagtgcatgcctgatcggagatgcttggaaagagcttaccatcgtggccggtgctgtgtctaaccagttgcttgtttggtatccggcaacagccctggctgataacaaaccagtggctcccgatagaaggatctctggccatgtgggcatcatcttttctatgtcttatctggaatcaaagggtctgctcgccaccgcttctgaagacaggtccgtgaggatttggaaagtcggagaccttagagtgcccggagggagggtgcagaatatcgggcactgcttcggacactccgctcgtgtctggcaggtcaaacttctggagaactacttgatttctgctggggaagattgcgtgtgtctggtctggtcccacgaaggggaaattttgcaagcctttcggggacatcagggcagaggaattcgcgctatcgcggctcatgagcgtcaggcctgggttataaccggcggtgacgacagcgggattcgcctctggcatctggttggacgcggatatcggggactcggggtctccgcactgtgttttaaaagcaggagcagaccaggtactttaaaggccgttacgctcgctggatcgtggcgcttactcgccgtgaccgataccggagcactatacttatacgatgttgaggtgaaatgttgggagcagttattggaagacaaacactttcaaagctattgtctgctcgaggccgctccaggccctgaaggcttcgggctgtgcgctatggctaacggagaggggagagtgaaggtggtgccaattaacaccccgaccgctgccgtggaccagaccctcttccctgggaaagtacactccctctcttgggccctgcgcggatacgaggagctcttactgctggcatccggtcccggtggggttgtggcatgtctggaaatctctgcagctcccagcgggaaggccatttttgtcaaggaaagatgtcgctatctgctccctccgtctaaacagagatggcatacctgcagcgcgttcctaccacctggtgatttccttgtctgtggcgacagacgcggatcagtgcttctgttcccttcgcgtccagggctgttaaaggaccccggagtgggtgggaaagcccgagccggagctggcgctcctgtagtcgggagcgggtcttccggagggggtaatgcatttaccggattgggacctgtctctactctgccctccttgcatggcaagcagggggtgacctcggtgacttgccacggagggtatgtgtacactacaggtagggacggggcttactatcagctcttcgtaagggatgggcagctgcagcccgtgttgcgccagaaaagctgtagaggaatgaactggctggcgggtctgcgcattgtcccagacggtagtatggttatcctcggctttcacgctaatgaatttgtggtctggaaccctaggtcacatgaaaaattgcacattgtgaactgcgggggaggtcaccgaagctgggccttctctgataccgaggccgcaatggccttcgcttacctgaaggatggggatgtgatgttatatcgtgccctggggggttgtacacgacctcacgtcatactgagggaaggtctgcatgggagggagataacatgtgtcaaacgggttggaactataacactaggacctgagtacggcgtgccaagcttcatgcagccggatgatttggaacctggctcggagggccctgacctgacagacatcgttattacctgctctgaagacactactgtctgcgtattggccctgcccactacaaccgggtccgcacacgctctcactgccgtgtgcaatcacatatcctcagtgcgggcagtggcagtgtgggggattggaaccccgggaggaccccaagaccctcaacctgggctgaccgctcacgtggtttctgccggaggtcgggcagaaatgcattgcttttcaataatggtgactcctgatccctcaaccccatctcggttagcatgccatgtgatgcatctgtcttctcataggcttgacgagtactgggacaggcagcgtaacagacacagaatggtcaaagttgaccctgaaactcgttatatgagtctggctgtctgtgagctggatcaacccggtttagggccactggtagccgcagcatgctccgacggcgctgtgaggctcttcttgctgcaggacagtggcagaatcctgcagctgctcgccgaaactttccaccacaagcgatgcgttctgaaagtgcatagtttcacccacgaggccccaaaccagcggcgaagactgctattgtgctctgccgcaacggatggctcgctagctttctgggacctgaccacaatgcttgaccacgattctacggtgctggaacccccagtggaccctggcctgccatatcggcttggtactcccagcttgactctacaggctcactcttgcggaattaatagcctgcacaccttgcccacacgcgagggacaccacctcgtggcctccggatccgaggacggcagcttacatgtgttcgtactggccgttgagatgctgcagctcgaagaagccgtgggggaagccggactggtcccccagttaagggtgttggaagaatacagcgtgccgtgcgcacacgctgcccacgtgactggactgaagattttaagtccctccataatggtgtcagcgtccatcgaccaacggttgactttctggagactcgggcacggagagccaacattcatgaactctacagtgtttcatgtcccagacgtagccgacatggattgttggcccgttagccccgagttcggtcatcggtgtgcgctgggtgggcagggtctcgaagtgtataactggtatgattag

SEQ ID NO: 246822 - DNA, 4557 bp, Artificial Sequence
  Description of Artificial Sequence: Synthetic coding sequence
atggccgctgtgggttccgggggatacgcacggaatgatgccggagaaaagctgccttccgtgatggctggcgtgccggctcgaagaggacagtcctcacccccaccagcgccacccatttgcctgcgacggaggaccagattgtctactgcatcggaagagacagtgcagaatagggtgagtctggagaaagtcctcggcataacagcacagaactccagtggcctgacttgcgaccccggaactggccatgtggcatatctggcaggatgtgtcgtggtgattctagatccgaaagagaataagcaacagcacatcttcaacaccgcgcgaaagtcgttatctgccttggctttctctcccgacgggaagtacatagtgactggagaaaatggccacaggcctgccgtgagaatttgggacgtggaggagaagaatcaagtcgctgagatgctggggcataagtatggagtcgcctgtgtggcgttctctcccaacatgaaacacatcgtgtctatggggtatcaacacgacatggttttgaacgtgtgggattggaagaaggacattgtggtagctagcaacaaggtctcgtgtagggtgatagcgctctccttctccgaagactcctcctacttcgtaaccgttggaaacagacatgtgcgattctggttcctcgaagtgtcgaccgagacgaaggttacctctaccgtgccactggttggtaggagcgggatcctcggagaactccacaataatatcttttgtggagtggcatgcgggagagggagaatggccggtagcaccttctgtgtctcatactcaggcttgttgtgccaatttaatgaaaaacgagttttagagaagtggataaacttaaaagtgagcctctcatcatgtttatgtgtatctcaggaactgatattttgtggttgcaccgatggtatagtccgtatcttccaggcccattccctgcactaccttgccaatctgcccaaaccccactacctgggagtggacgttgctcagggactcgagcccagctttctgtttcacaggaaggccgaggccgtctatcccgatactgttgctctcactttcgaccccatccaccagtggctttcgtgcgtgtacaaggatcatagcatctatatttgggatgtgaaagacatcaaccgcgtgggcaaggtctggagtgaattgtttcacagctcttacgtttggaatgtggaggtgtatccagaatttgaggatcagcgggcatgtctcccatctgggtcatttctgacctgctcttcagataatacaatcaggttctggaatctagactcatccccagactcgcattggcagaaaaacattttttctaacacgctgctgaaggttgtgtacgtggagaacgacatccaacacctgcaggatatgagccacttccctgatagagggagcgagaatggcactcctatggacgtgaaggccggagtgcgagtcatgcaggtgagtccagacggccaacacctggcctccggggatcggtctgggaatttaagaattcatgagttacactttatggatgagctagtgaaggtggaggcccacgacgcagaggtactgtgtcttgaatactccaagcctgaaacgggcctcactctgttagcctcagcctctcgagacagactgatccatgttctcaatgtcgaaaaaaattataatctggagcagacattagacgatcattcctcgtccattacggctatcaagtttgccggtaatagagacattcagatgatctcatgcggcgcagataaatcaatctactttagatctgcacagcagggaagcgatgggctgcacttcgtgcgtacgcaccatgtagcagagaaaacgaccttatatgacatggatatcgatattactcagaagtatgtggcagtcgcctgtcaggacagaaacgtacgggtctataataccgttaatggaaagcagaaaaagtgctacaaagggtcccagggggacgaaggctccttactcaaggtacatgtcgatccttccggcacattcctcgcgacatcctgctcagacaagagtatcagtgtgatcgacttctactcaggcgagtgcatagcaaaaatgtttgggcattcagagattatcacatccatgaaatttacttatgactgtcatcacctgatcactgtatctggagactcctgcgtgttcatttggcacttgggtccggagattacaaactgtatgaagcaacacttgctcgagattgaccaccgacagcagcaacagcatactaacgataagaaacggagcggccatcctagacaagacacctacgtgtccaccccttccgagatccactccctgtctccgggagaacagaccgaagatgatctcgaggaagagtgtgaacccgaagagatgctcaagaccccttccaaggactctctggatcctgatcccagatgtctgctgaccaacggaaagctccccttatgggccaagagactcttaggggatgacgatgtggctgacggactggctttccatgccaagcgctcctatcagcctcacggaagatgggcagaaagagctggccaggaaccactaaagaccatcttagacgcccaggacctggattgctattttacacctatgaaaccagagtctttagaaaacagcattctcgatagcttagaaccccagtctttggcctctcttctctccgagtccgagagtccacaggaagccggacggggacacccaagctttctgccccagcaaaaggagtcaagcgaggcttcagagctaatcctgtattcactggaggctgaagtaacagtgaccggaaccgattcccagtattgtcgcaaggaagtcgaagcaggacccggagaccagcagggtgattcctatctgagagtgagttctgacagtcctaaggaccagtctccgccagaagactccggggagtccgaagcagacttggaatgtagtttcgccgctattcactcaccagcacctccccctgacccagctcccaggttcgcgacaagcctcccacacttccccggatgcgccggtcctacagaagacgagttgtcgttgcccgaagggcctagcgttcccagtagctccctgccgcagacccccgagcaagaaaaatttctgaggcaccacttcgaaaccctgaccgaatctccatgtcgggctctaggagatgttgaggcaagcgaagctgaggatcacttcttcaacccgaggctgagtataagcacacagtttttgtctagcttgcagaaggcatcacgctttacacacacctttcctccaagagccactcagtgtcttgtaaaaagtcccgaggttaagttgatggatcgtggcggatctcagccacgcgctggaaccggatacgcgtcaccagatcgcacccacgtacttgcggctggtaaagccgaggagactctggaggcttggaggccgcctccaccctgtctcacaagtctggctagctgtgtaccggcttcttctgtcctccccacagaccgaaacctccccacccctaccagcgcaccaacccctggattagcccagggggtacatgccccaagtacatgctcctacatggaggcaacagctagctcaagggcacgaataagtaggagtattagcctgggagactctgagggacccattgtggcaactctggcacagccgctgcgccgtccatcttctgttggtgagttggcctctctggggcaggagctgcaggcaatcaccacagcgaccaccccctcattggatagtgagggacaggagccggcactgcggtcctgggggaatcacgaagcaagggccaacctgaggctgaccctttcgtccgcttgtgacggcctactgcagccgcctgtggacacgcagccaggggtcacggtgcctgctgtctccttccctgccccatctccagtggaggagagcgccctgcgccttcacggtagcgcctttcgaccatcactgcctgcacccgagtctccgggactcccagcccatccctctaatcctcagctgcccgaggctcgcccaggtataccaggagggactgcaagtctcctcgaaccaacgtctggggctctcggtctccttcagggctcaccggctaggtggagtgagccttgggtaccagtagaggctctcccaccatctccactggagctgtcacgcgtggggaacattctccacaggttacaaactactttccaggaagcgcttgacctgtatcgggtactcgtatcatcagggcaggtcgacaccggccagcagcaggccaggactgaactggtgtcgacgttcctctggatacactcacagctggaggctgagtgtctggtgggcacctcagtggcacccgcacaggctttacctagccccggaccaccttcccctcctactttatacccgctggcaagtcctgacctgcaggctctgctcgaacactactctgagctcttggtgcaggccgtgaggagaaaagctaggggacactag

SEQ ID NO: 246823 - DNA, 1245 bp, Artificial Sequence
  Description of Artificial Sequence: Synthetic coding sequence
atggctgccgtagggagcggcggatacgcgaggaacgacgctggggaaaagctgcctagtgtgatggcaggtgtgcctgcaagacgtgggcaatcatcgccaccaccagcccctccaatctgcttgaggaggaggactcggctcagcactgcgtctgaggagacagtccagaatcgcgtgtctctagagaaggtgcttggcattaccgcccagaatagttctggactgacgtgtgatcccggaaccgggcacgttgcgtatttggccggatgcgtagtggtgattcttgaccctaaagagaataaacagcaacatattttcaacacagccagaaaatcgctcagcgccctagccttctcaccagacgggaagtacattgtgaccggtgagaatggacatagacctgcagttcggatctgggatgtggaagaaaagaaccaggttgctgagatgttaggccacaagtacggtgtggcctgtgtcgcattctctcctaacatgaaacacattgtttcaatgggctaccaacacgatatggtcctgaacgtgtgggattggaaaaaggacattgtggtcgcaagcaataaggtgtcttgccgcgtgatcgcactgtcattttcagaagatagctcctactttgtgacagtgggcaaccgacatgtgagattttggttcctagaagtgagcacggagactaaagtgacttctactgttcctctggtgggcagatctggtatactgggcgaactccacaataacattttttgcggcgtggcctgtggaaggggcagaatggcagggtcaactttctgcgtttcttattctgggctcttgtgtcagtttaatgagaagagagtgttagaaaagtggatcaatttgaaggtcagcctgtcttcctgcttatgtgttagccaggagctgattttttgcggatgcacagacggaatagtgcggatcttccaggctcactcactgcattatctggcaaaccttccaaagccgcactacttgggggtcgatgttgctcagggactggaaccgtccttcttgttccaccgaaaggcggaagcggtctacccagatactgtggccttaacgtttgaccctattcatcagtggctctcttgcgtttacaaggaccactccatttacatatgggatgtcaaggacataaacagggtcggcaaggtgtggtcagagctgttccactcctcttacgtttggaatgtggaagctttgtcgtag

SEQ ID NO: 246824 - DNA, 1452 bp, Artificial Sequence
  Description of Artificial Sequence: Synthetic coding sequence
atggccgcagtgggctctggagggtatgcaagaaatgacgccggtgaaaaactgcctagtgtgatggcaggagtcccagcgagaaggggtcagtccagccctcctcccgctccgccaatctgcctgagacggcgaactcggctgagcacagcatcggaggagaccgtccagaaccgggtgtctcttgaaaaggtgctcggcatcacagctcagaattcctctggactcacttgtgatcctggcaccggtcacgtggcctacctcgctgggtgtgtggttgttattttagacccaaaagagaataaacagcaacatatttttaacaccgccagaaaatccctctcagccctggccttctcaccagacggtaaatatattgttaccggggagaacggtcacaggccggctgtaaggatttgggacgtggaggagaaaaaccaggtagccgagatgctgggtcataaatacggtgtggcttgcgtcgcttttagccctaatatgaaacacatcgtttccatgggataccagcacgacatggtgctgaatgtatgggactggaagaaggatattgtggtcgcatccaacaaggtgagttgccgtgtgatagccctctctttttcagaggactcaagctactttgtcaccgtcggaaatagacacgtgcgcttctggtttctggaagtctcaactgagaccaaggttacctccaccgtgccccttgttggtagatccggcatactcggagagctgcataacaatatcttctgtggagtcgcctgtggcagaggaaggatggccggtagtactttctgcgtgtcatatagcgggcttctgtgccagttcaatgagaagagggtgcttgaaaagtggatcaacctcaaggtctccctttccagctgtctgtgcgtctcccaagagctcattttctgtggctgtacagacggcatcgtccgcatcttccaggcccactcgttgcactacctggcaaacctgcctaagccccattatctgggcgtggatgtcgctcaagggctcgaacccagttttctgtttcatcggaaggctgaagctgtgtacccagacaccgtcgctctgactttcgaccccattcatcaatggcttagttgcgtctataaggaccatagcatttacatctgggacgtgaaggacatcaatagagttggcaaggtctggtcggagctttttcatagtagttatgtgtggaatgtcgaagtctaccccgagtttgaggatcaacgggcttgccttccctcgggctcgttcctgacttgctcgtctgacaacacaatcaggttttggaatctggattcatcacccgactcccactggcaaaaaaacattttttcaaatctagcccctgcactgcagatgtgcggcaggggccactctcgacaacctaacactccctcgcccggagaaatcgctagctag

SEQ ID NO: 246825 - DNA, 4572 bp, Artificial Sequence
  Description of Artificial Sequence: Synthetic coding sequence
atggccgctgtggggtccggcggatacgctcgcaatgacgccggtgagaagctgcctagcgtcatggccggtgtgcccgctcgacgagggcaatccagcccgccacctgcccctcccatttgtcttcgcagacgcacaaggctctctacagctagtgaagagacagtccagaatagggtctccttggaaaaggttcttggcataacagcgcagaattcgagcgggctgacttgtgatcctggaacaggccacgttgcctatttggccggttgtgtagtcgttattttggaccctaaagagaataagcagcagcatatatttaataccgcaaggaagagcctgagcgctttggctttcagtcctgatggaaagtatatcgtaacaggggaaaatggacatcggcctgccgtccgcatctgggatgtggaggagaaaaaccaagtcgccgaaatgctggggcataagtacggcgtcgcctgtgtcgctttctccccaaacatgaaacacatcgtgtctatgggatatcagcatgatatggtgctcaacgtgtgggactggaagaaggacattgtggtggccagcaataaagtgagctgtcgcgtaatcgctctttctttctcagaggatagctcctactttgttacagttggcaaccgacacgtgaggttttggtttctggaagtgtccacggaaacaaaagtgacttccaccgtcccactggttggcagaagcgggatactgggagagcttcacaataacatattttgcggggtggcgtgtggcagaggtagaatggccggaagtacattctgtgttagttattcaggactgctctgccagttcaatgagaaaagggttttggagaagtggattaatctcaaagtgtcactgagctcttgtctttgcgttagccaagaactgatcttctgcggatgtaccgatggcatcgtcaggatctttcaggcccatagtctgcattaccttgctaatctccctaaacctcactaccttggtgtcgacgttgcccaaggactagaaccttccttcttgttccacagaaaggctgaggctgtgtaccctgacaccgttgcactgacttttgaccctatccatcagtggctgtcgtgcgtatataaggaccacagcatttacatatgggatgtgaaggacataaaccgggtgggcaaggtttggtccgaactcttccatagctcctacgtttggaacgtggaagtttaccccgaattcgaggaccagagggcctgcctgccttctgggtcctttctgacatgcagctccgacaatactatcaggttctggaatctcgatagcagcccagatagtcactggcagaagaatattttctctaatacactcctgaaggttgtatatgttgaaaacgatattcagcacctgcaggacatgagtcatttcccagacagaggctccgagaatggaacccccatggacgttaaggctggggtgagggtcatgcaggtctcacctgatggccagcatcttgcttcaggagaccggagcggcaacttgcggatccacgaactacactttatggatgaattggtcaaggtcgaagcacacgatgccgaggtgctgtgtctggagtactctaagcccgagaccgggttgaccctcctggcatcggcatccagagatcgactgattcacgtcctaaatgtagaaaagaattataatttggagcagacactggacgaccactcatcctcaatcaccgcaatcaagttcgccggaaaccgcgatatccagatgatcagctgcggtgcagacaagagcatttactttagatccgcccaacagggatctgatggactgcatttcgtgagaacccaccatgtggcagagaaaacaaccctgtacgacatggatatagacatcacacaaaagtatgtcgccgttgcttgtcaggatagaaacgttcgtgtatacaacacagtgaacggcaagcaaaaaaaatgttataaaggatcacagggcgacgagggtagcctgcttaaggtccatgtcgatcccagcggtacattccttgcgacgtcatgttcagacaagtcaatcagcgtaatcgacttttattctggcgagtgtatagctaaaatgttcgggcactctgagataataacttcaatgaagtttacatatgactgtcaccacctgattaccgtcagcggagacagctgtgtttttatctggcatctggggccagagatcacgaactgtatgaaacagcacttactggaaatcgaccatcgccaacagcagcagcatactaacgataaaaaacgctcaggccatccgcgtcaagatacatacgtgagcacaccgtctgagattcattcactgtcccctggcgagcagactgaggatgacttggaggaggagtgcgagccagaagagatgcttaaaacccctagcaaggactcactggatccggatcccaggtgccttctgactaacgggaagctgcccctttgggcaaagcgcctccttggcgatgacgatgtggcggacgggttggcatttcacgccaagcgaagttatcagccccacgggcgatgggccgaacgcgctggtcaagagccgctgaaaacaatcctggatgcccaggacctggattgctacttcacgcccatgaaaccagaaagcctcgaaaatagcatcctggatagtctggagccacagtctttggcttccctgctgtccgagagtgagtcaccccaggaggcaggaagaggccacccatccttcctccctcagcaaaaggaatccagcgaggcctccgagttgattttatatagcctggaagcagaggtgacggtgaccggaaccgactctcagtactgccgcaaggaagtggaggcgggtcctggcgatcagcagggagactcttatttgcgggtatcgagcgatagtcctaaagaccagtcacctcctgaagactccggagagagtgaagctgacctggagtgcagcttcgccgcaattcactcacctgcacccccaccagaccccgcaccaaggtttgctacaagtctgccacacttccccggatgcgcaggtccgacagaggacgaattgtctttaccagaaggaccctcagtgcccagtagtagcttaccacagactcccgaacaggaaaaattccttcgtcatcatttcgagaccctgaccgagagcccttgtcgtgaattattccccgctgccttaggagatgtggaggcatctgaggccgaggatcatttcttcaacccccgactgtccatcagtacgcaattccttagctcgttgcaaaaggccagccgattcactcacacgtttccaccccgtgccacacagtgccttgtcaaatcaccagaggtcaagctcatggaccgcggaggcagtcagcctcgggctggtacgggatacgcctctcccgacaggactcacgtgctggccgctggcaaagcggaggaaactctggaagcttggagacctccccctccttgcctgacctcacttgctagctgcgttcccgcaagttctgtgctgcccaccgatagaaatcttccgactccaacgtccgccccaaccccagggttggcccaaggtgttcatgccccttcaacttgttcatacatggaagcgaccgcctcttctcgtgcaaggatctctagaagtattagcctcggcgatagcgagggcccaatcgtggcaacactggcccaaccgctgagaaggcctagcagcgtgggagaacttgcttctttgggccaggaactccaagccattaccacggcaacgacaccaagcctcgactctgaaggccaagagcccgcactgcgcagttgggggaaccatgaagcaagagcaaacctacgactgactctatctagcgcatgtgatggattactgcagcccccagtggacacacagccaggggtaacagttccagccgtatcattcccagccccaagccccgtggaagagtccgccctcaggctacacggtagcgcattccgccctagcttgcctgctcccgagtcaccaggcctgcccgcacatccaagcaatccccagctccccgaggccagaccaggcatccctggaggcaccgccagtctcctcgagcctactagcggagccttggggctactccagggatctcctgctcggtggagtgagccgtgggtacccgtcgaggctttgccaccctctcctctcgagcttagccgcgtgggaaacatcctgcatcgcctgcagactacattccaagaggcacttgacctgtatcgcgtattagttagcagtgggcaggtggataccggacaacaacaggccaggaccgaactggtaagcacttttctctggatccacagtcagcttgaggccgaatgtctcgtgggcacatccgttgctcctgcacaggccctcccctcccccggacccccatctccacctaccttgtaccctctcgcttctcctgacttgcaggccctgctggaacactacagcgaactcctagtccaggccgtgcgtagaaaggccaggggacactag

SEQ ID NO: 246826 - DNA, 1302 bp, Artificial Sequence
  Description of Artificial Sequence: Synthetic coding sequence
ggcggatatgctagaaatgatgccggagaaaaactgccgtccgtgatggcaggcgtgccagcacggagaggccagtcctccccgcctcctgcaccgcctatctgcttgcggagaaggacacgtctgtctactgcctccgaagaaaccgtacagaatcgcgtgtcgctcgaaaaggtcctgggaatcaccgcccagaactcttctggtcttacttgtgatccgggaacaggccatgttgcctatcttgcaggcatgtggagaatgggcccagccagtgagagctgtggggaggatagtatcgcaccctcactgtcacgcactgtcccaggcatgtattgtgtcgtggttatcctagatcccaaggaaaacaagcagcagcacatctttaatactgcgagaaaatccctctccgctctggcctttagccctgacggaaaatatattgtgaccggggaaaacggccaccgccctgctgttcggatatgggatgtagaggaaaagaaccaggtcgctgaaatgctggggcataaatacggagttgcttgcgttgcttttagtccgaacatgaagcatatcgttagcatgggttaccagcacgatatggttttaaacgtgtgggattggaagaaagatattgtagtcgcctccaacaaagtttcttgccgggtgatcgcattatccttttcagaggattcctcttacttcgtgacggtgggaaatcggcacgtgcgtttttggtttttggaggtttccacagagactaaagttacctcaactgtaccactggtgggcagatcgggtatcctcggcgaacttcacaataacatcttctgcggggtggcctgtggaagaggaagaatggccggaagtactttctgtgtcagttacagtgggttgctgtgtcagtttaacgaaaaacgagtgcttgaaaagtggatcaatctgaaggtgtctttgtctagttgtttatgtgtgagtcaggagctcattttctgcgggtgtactgacgggatagttcgaatcttccaggcccactccttgcactacctagcaaacctgccaaagccccattacctgggcgtcgacgtcgcccagggtctggaaccaagctttcttttccatagaaaagcagaggcagtttatccagacacagtagccctgactttcgatccgatccatcagtggctctcctgcgtgtacaaggaccacagtatttacatctgggatgtcaaagacatcaatcgtgtgggaaaggtgtggagcgaacttttccattcgagttatgtgtggaatgtcgaatag

SEQ ID NO: 246827 - DNA, 2097 bp, Artificial Sequence
  Description of Artificial Sequence: Synthetic coding sequence
atgtccgcagtcgttgcccaaaccctgcacgtctttggattgcgctcacacgttgctaacaacatcttttactttgacgaacagatcattatatttcctagtgggaatcattgtgttaaatacaacgtggatcagaagtggcagaaatttattccgggtagcgagaaaagtcaaggtatgctggctctgtcaatcagccccaatcggcgatatctggccatttcagaaactgttcaggagaaacccgctataactatctacgaactgagcagcatcccttgccgtaagaggaaagttttaaataactttgactttcaggtgcagaaatttatttcaatggccttctcccctgacagtaagtatttgctagcgcagacctcacccccagagtctaacctggtgtattggttgtgggaaaagcaaaaagtgatggccattgtaaggattgacacacagaacaacccagtatatcaggtgtcctttagtccccaagacaatacacaggtttgcgtgaccggtaatggtatgtttaagttgctgagatttgctgagggcaccctcaaacagacctcgtttcagcgtggcgagcctcaaaactacctggcgcatacatgggtggccgacgataagatcgtagtgggcactgatacagggaagctgttcctcttcgagtccggagatcagcgatgggagacttctataatggtaaaggagcccaccaatgggagcaagagtttggatgtgatccaagagagcgaaagtctaatagagttcccccctgtctcttctcccctcccctcctacgaacaaatggtagccgcaagcagtcattcccaaatgtcgatgccccaggtctttgccattgccgcatacagcaaaggttttgcctgctccgcagggccaggacgggttctgttatttgaaaaaatggaggagaaagacttctacagggaatctcgggagattagaatccccgtggatccccagtctaacgacccgagtcaatctgacaaacaagatgtcctttgtctgtgcttttctcccagcgaggagacattagtggccagtacctccaagaaccagctgtattcaattaccatgtctcttactgagatttccaagggagagcctgcccattttgagtacttaatgtatccactgcacagtgccccaatcaccggcctggcaacgtgtatccgcaaacccctgatcgcaacatgcagtctggatcgaagcataagactgtggaattatgagacgaataccctggagttgtttaaggagtaccaggaggaagcttatagtatttctctgcatcctagcgggcattttatcgtggtgggcttcgcggataagttgaggctaatgaacctgttaatcgacgatatccgttcttttaaagagtactcagttcggggatgcggcgagtgttcatttagtaacggtggacatctatttgctgccgtgaacggcaacgtgatccatgtgtacaccaccacaagcctggaaaatatctccagcctgaaggggcatacaggaaaaataagaagtatcgtgtggaacgccgacgattcgaaactgatctctgggggtacagatggtgcagtatatgagtggaacctatccaccggcaagcgcgagaccgagtgcgttttgaaatcctgctcctacaattgcgtaactgtcagtcctgacgcgaagattattttcgctgtgggtagtgaccatacgttaaaagaaatcgccgacagtttgattttgcgcgaaatatctgcattcgatgtgacctatacagccattgtcatctcccactcaggccgaatgatgttcgtcggaactagtgttggcactattagagcaatgaaataccccctgcccctccagaaagagttcaacgaataccaagctcacgcagggccaatcactaaagtgagccgggcactctcgccaggcacacagagtcacacatgccttttacgtgccttatttattccatctacttcacagtgtctcttctctctccttctgctgtcatatctttttattcatcatagcctgaaccatcacctgctgacaatgaatattctttttgtttag

SEQ ID NO: 246828 - DNA, 501 bp, Artificial Sequence
  Description of Artificial Sequence: Synthetic coding sequence
atgagtgcagtggtggctcaaactctacacgtctttggccttcgtagccatgtggccaacaatattttctatttcgatgagcaaattattattttcccgtcaggcaaccactgtgtcaagtataatgtagaccaaaagtggcagaaattcatcccaggcagcgaaaagtctcagggtatgctcgcgctcagcataagtccaaaccgcaggtatctggccatcagtgagactgtgcaggaaaaaccggctataaccatatatgagttatcaagcataccatgtcgcaaaaggaaagtcctaaataattttgactttcaagttcagaaatttattagcatggctttctctcccgacagcaaatatctgctcgcgcagacctccccccctgaaagcaacctagtttattggctttgggaaaagcaaaaggtgatggctatagtccgaatagatacacagaataatcctgtgtatcaggtgtccttttcccctcaggataactag

SEQ ID NO: 246829 - DNA, 4473 bp, Artificial Sequence
  Description of Artificial Sequence: Synthetic coding sequence
atggcaggcaattcattggtgctgcctatcgtcctttggggtagaaaagcccctacccattgcattagtgcagtgctgctgactgacgatggagctaccatagtcacaggttgtcatgacgggcagatctgtctatgggatttatcggtggaactgcagatcaaccccagagctctccttttcggtcatacggcctctataacctgtttatctaaagcttgtgcctcttccgacaagcagtacatcgtttcagccagcgaatccggcgaaatgtgcctctgggacgtatccgacggtcggtgtattgagtttacaaagcttgcttgcacacacacaggtatacaattttatcagttcagcgttggaaaccaacgcgagggtcggcttctgtgtcatggtcattatcccgaaatcctggtcgtggacgctactagcctggaagtgctgtattctctcgttagcaaaattagtcccgattggattagcagtatgtcaataatccgttcacatcggacccaggaagataccgtcgtggccctcagcgtcactgggattctgaaggtgtggatcgttactagcgagatttctgatatgcaggatactgagccaattttcgaggaagagtccaagccaatctattgccagaattgccagtccatctctttctgcgcctttacacaacgtagcctgctggtggtatgttccaagtattggcgggtgttcgatgcaggggattattccctcctgtgcagcggtcctagcgaaaatgggcagacttggaccggcggagactttgtgtcaagcgacaaagtcatcatatggacagaaaacgggcagagctacatctacaaactgcctgcatcctgcctgcctgcgtccgatagttttcggagtgacgtgggtaaagcagtggaaaatctgataccacccgtgcaacatatccttctcgatcgcaaggataaagagctgctgatctgtcctcctgtcacacgttttttctacggttgcagagaatatttccacaagctcctgatacagggcgatagctcaggccgtctcaatatttggaatattagtgacaccgccgacaagcaaggctctgaggaaggtttggctatgactactagcatttcactgcaggaagccttcgataagcttaacccctgtcctgctgggatcatcgaccagttgtccgtcatcccaaatagcaacgagcccttgaaagtgacggcgagcgtgtacattcccgctcatggtcgcctcgtctgtggtagagaggacggatctatcgtgattgttccggctacgcagacggccatcgtgcagctactgcagggcgagcatatgctgcgaaggggctggcctccccataggaccctccggggacatagaaacaaagtaacttgtctactgtacccacatcaggtcagtgcgcgatatgaccaaaggtatctcatctcgggcggtgttgacttttctgtaatcatttgggacatcttttcaggcgaaatgaagcatatcttttgcgtccacgggggtgaaatcacgcagctcctcgtccctcctgagaattgctctgcccgagtgcagcattgcatctgttctgtggccagcgatcattcggtgggactcctgagcctgcgcgagaaaaaatgtattatgctcgcctcccgtcatctgtttcctatccaggtgatcaagtggcggccaagtgatgactacttggtcgtcggatgttctgacggatcagtttacgtatggcagatggacactggcgctctggaccgctgcgtcatggggataactgctgtcgagatcctcaacgcatgcgacgaggccgttccagcagccgttgacagtctgagccaccccgcagtgaatttaaaacaggcgatgaccagacggagccttgcggcattaaagaatatggcccatcataaactgcagacactggccacaaatctgcttgcatccgaagccagtgataagggaaaccttcccaaatacagccacaacagtttgatggttcaagcgatcaagaccaatctgaccgatcccgatatacacgttctcttctttgatgttgaggcacttataatccagctgctgacggaggaagcatcaaggcctaataccgccctgatcagccccgaaaatctacagaaggctagcgggagctctgacaaagggggaagctttctgactggcaagagagccgctgtattattccagcaggtgaaggaaactatcaaggaaaatataaaagagcacctgcttgatgacgaggaagaggacgaggagatcatgcgccaacggagggaagagagcgatcctgagtataggagttctaagagcaagccactgacactactcgaatataaccttactatggacaccgcaaagctcttcatgtcctgcctccacgcctggggcctgaacgaagtcctggatgaggtctgtcttgatcgcctgggcatgttaaagccacactgtaccgtgagtttcggattgctcagcagaggtggccacatgtctctgatgcttccgggatacaaccagcccgcttgtaagttatcccacgggaaaacagaggtcggcagaaaactacctgcatctgagggagtcggcaagggtacctacggggtctcgagagcagtgactacccagcacctgctgagcatcatctcacttgccaataccctaatgtctatgacgaacgcaacctttatcggcgaccatatgaagaaaggtccgacccggccaccacggcctagcacaccggacctctctaaggccagggggtcgccgcctactagttccaacatcgtgcagggacagataaaacaggtcgctgctccagtggttagcgccagatctgatgctgaccacagtggaagcgatcctccctcggcccctgcgctgcacacgtgttttctcgtgaatgagggctggagccagcttgcagcgatgcactgcgtgatgttgcctgacttgctgggactggacaagttcaggcccccactgcttgagatgctggcccgacgctggcaggacagatgtctcgaggtgcgggaggctgcccaggcactgctgctcgcagagttgcgacgtattgaacaggctggacggaaagaggccattgatgcttgggctccgtacttgcctcagtacattgaccacgtcataagcccaggcgtgacctccgaggccgctcagacaattactacggctcctgacgcaagcgggcctgaggccaaggtccaggaagaggagcatgacctcgttgacgacgatatcacaactggctgcctgtcttcggtgccgcagatgaagaaaatttccactagctatgaggaacgcaggaagcaggccaccgccatcgtgctgttgggggtcatcggagccgaattcggcgcagaaatcgaacctccgaaactgctgactcgccctaggagctcctcacagattccagaggggtttgggttgacatctggaggctccaattatagcttggctaggcatacctgtaaggcactgacattcctgctcctgcagcccccatcccccaaattgcccccacactctactataagacggacagcaattgaccttatcggcagaggcttcaccgtgtgggaaccatacatggatgtgagcgccgtgttaatgggtctcctggaattgtgtgccgatgcagaaaaacaactggcaaacattacaatgggactgcccctctctccagccgctgacagcgctcggtctgcaaggcatgcactctcgctgatcgcaactgctcggccaccggcttttattactactatcgccaaggaagtgcacagacacacggcattggctgcaaacacacagtcacagcaaaatatgcacacaacaaccttggcacgcgcaaaaggtgaaatcctgagagtaattgagatcctcatcgagaaaatgcctactgacgtcgttgatctcttggtcgaagttatggacatcatcatgtattgtctcgagggcagcctggttaagaagaagggcctgcaggagtgtttcccggcaatttgcaggttttatatggtatcttactacgaacgcaatcaccgcattgcggtgggcgctagacacggctccgttgcattgtatgatatacgaacagggaagtgtcagacgattcacgggcacaagggacccatcactgctgtggcctttgctcctgatggtagatacttggctacgtactcgaataccgattcccacatatctttctggcaaatgaatacttccttgctcggaagtatcggaatgctcaacagcgccccacagttacggtgcataaagacctatcaggtgccccctgtgcagcccgcaagccctggaagccacaacgctctcaaactagccaggctaatttggacctccaaccgtaatgtgattcttatggctcacgatgggaaggaacatcggtttatggtgtac

SEQ ID NO: 246830 - DNA, 4374 bp, Artificial Sequence
  Description of Artificial Sequence: Synthetic coding sequence
atggccggaaactccctcgttctaccaattgtgttatggggtagaaaagccccaacccattgtatttccgctgtcctccttactgatgatggtgctaccattgttaccggctgtcatgacggacaaatctgtctgtgggatctgtctgtagaactacagattaacccgagggcactgttattcggccacactgccagtatcacctgcctcagtaaggcttgtgctagttctgacaagcaatatattgtgtcggcttctgagtctggcgagatgtgcttgtgggatgtttctgatggcaggtgcattgagtttactaagctcgcttgcactcataccgggatacagttttatcagtttagtgttggaaaccagagagagggaaggcttctgtgccacggtcactatcctgagatcctggtggtcgacgccaccagcctggaagtcctatactcgctggtcagcaaaatatcgcccgattggatctctagcatgtctatcatccggtcccatagaacacaggaagacacagtggtggctctgagcgtgactggaatcctcaaagtgtggattgttacctcagagatctccgacatgcaggacacagaacccatcttcgaagaggaaagtaagccgatatactgccagaattgccagtctatctccttctgtgcattcacccagagaagcctgctagtggtgtgctcaaagtactggagggtcttcgacgcaggggactactccttactttgtagtgggccatcagagaatggccaaacttggaccggcggagatttcgtgtcatcagacaaagttatcatttggaccgaaaatggccaaagctacatttataagttgcctgccagctgtttaccagccagcgattcattcaggagcgatgttggcaaggccgtcgaaaacctgattcctccggtacagcacatcctcctggatcggaaggacaaggagctgcttatttgcccacctgtgacccggttcttctatggatgtcgcgagtactttcataagctgctcatacagggagactccagcggcaggctgaacatctggaatatttcggacacagcagataaacaaggatcagaggagggtctcgccatgaccacctccatttccctccaagaagccttcgataagctgaatccttgccccgctggaattattgaccaactatctgtcatacctaactcaaatgaaccacttaaggtgaccgcctctgtgtacatccctgcccacggacgtctggtgtgtggacgtgaggacgggagtattgtcatcgtaccagccacccagaccgctatcgtgcagctgcttcagggggagcacatgctgaggaggggctggccacctcatagaaccctgcggggacaccggaacaaagttacatgtctactctaccctcatcaggtgtctgctagatacgatcaaagatatttgatctctggtggagttgatttttcagtgatcatctgggacatttttagcggcgaaatgaaacacatcttttgtgtgcacggcggtgagatcactcagctgcttgtgccaccagaaaactgttccgctcgggtgcaacactgcatctgcagtgtggcgagcgaccactcggtaggccttctttcacttcgggagaaaaagtgtatcatgcttgcttctcgtcatttgttccctattcaggtaatcaaatggcggccttccgacgactacctagtagtcgggtgttcagatgggtccgtgtatgtgtggcagatggacacaggagcactcgacagatgcgtcatgggcatcactgctgtcgaaatcctaaatgcttgtgatgaggccgtgcctgcagccgtggattccttgtctcatcccgctgtgaatctgaaacaggcaatgactcggagatccctcgcggctcttaagaatatggctcaccacaaactacagaccctcgctacaaatctgctcgccagtgaggcttccgataagggaaatctgccaaaatactcccacaattcgctaatggtccaggccatcaagacaaaccttacggatcccgacatccacgtgctgttcttcgatgttgaggccctgataattcaactgctgacagaggaagcatcccggccaaatacagcattaatctcgccggaaaaccttcaaaaggcctccggctctagcgacaagggcggatccttcttgaccgggaaaagggcagcagtgctcttccagcaggtgaaggaaactattaaggagaacataaaagagcacctgctcgacgatgaggaagaagacgaggaaattatgcgacagcgcagagaagagtccgaccccgagtatcggagcagcaagagcaaacccctcacacttttagagtacaacctcacgatggacacagcaaagcttttcatgtcatgccttcacgcttggggcctgaacgaggtgctggacgaggtgtgcctggaccgcctcggaatgctgaaaccgcattgcaccgtgtcctttgggctactgtcacgcggtggtcatatgtctctcatgctgccgggttacaaccaaccggcttgcaagctgtcgcacgggaagaccgaggtgggacgtaagcttccggcttctgaaggagtgggaaaaggcacctacggtgtctcaagagccgtaactacacagcatctactttccatcatttccttggcaaatactctgatgtccatgaccaacgcaactttcattggagatcatatgaaaaagggaccaacccggccacccaggccgagcactcccgacctgtctaaagcgaggggatcgccacctacatcaagtaatatcgtacaggggcagatcaaacaggggtggtcccaattagccgcaatgcactgcgtcatgttgccggacctgttggggcttgacaagtttcgtccacccctgcttgaaatgttagctcgacgatggcaagaccgttgcttagaggtgagagaggcagctcaagcgctcctgttagcagagctgagaagaatcgaacaggccggtcggaaggaagcgatcgatgcttgggctccttacctgccacagtatattgaccacgttatctcacccggtgtcacatccgaggcagcccagactatcacaactgccccagacgcgtctggccctgaggccaaggttcaagaggaggagcacgacctggtcgacgacgacattaccaccgggtgcctgtcatcggtgccccagatgaaaaaaatttcgacttcttatgaggaaagacgtaagcaagccacagcaatcgttctcctgggtgtcatcggcgcagagttcggggctgaaatagaaccaccaaagctccttactcgcccacggtcctccagccagatcccagaaggattcggcttgacaagcggtgggagtaactactcactcgcgcgacacacatgtaaggctttaacgttccttctgctccagccgccatctcccaagctgccaccacattcaacgatcaggcgaacagccatagatctgatcggaagggggttcaccgtgtgggagccttacatggacgtcagtgccgttctgatgggtcttcttgagttgtgcgctgacgccgagaaacagttagccaacatcacaatgggattacctctttctccggctgcagattctgcaaggtccgccagacatgccctgtccttaatcgcgactgctcggccaccagcatttattacgaccatagccaaagaggtgcaccggcacaccgcccttgctgccaatacgcaatcccagcagaatatgcacaccactactctcgcacgcgctaaaggagaaattctgcgggtcattgaaatcctgattgaaaaaatgccaacagacgttgtcgatctgctcgtagaggtaatggacatcataatgtattgcttagagggtagcctggttaaaaagaagggactccaggaatgcttccccgctatctgcaggttctacatggtgtcatactacgagaggaaccatcggatcgcggtgggggctcggcacggctctgtggctttgtacgacatcaggacagggaaatgccagactatacatggccacaaagggcctataaccgcagtcgccttcgcccctgatggaaggtatctggctacctattccaatacagactcccacattagcttttggcaaatgaatacatccttgctgggttctatcggcatgcttaatagcgcccctcagctgcgatgcatcaagacctatcaggttcccccagtgcagcccgcatcccctggttctcataacgccttgaagctggcaagactgatctggacctccaatcgcaacgtgatcctgatggcccacgatggaaaggagcatagattcatggtctag

SEQ ID NO: 246831 - DNA, 4374 bp, Artificial Sequence
  Description of Artificial Sequence: Synthetic coding sequence
atggccggaaatagtctggtgctgccaatcgtgctgtggggccgaaaggctccaacccactgtatcagcgccgtactcctaaccgatgatggagctactatagtgactgggtgccatgacggacagatttgcctgtgggacctgagcgttgaactgcagatcaatccgagagcacttctttttgggcacaccgcatccattacgtgtctgtctaaagcgtgtgcttccagcgataaacagtacatcgttagcgcttcggagtccggagaaatgtgtctgtgggacgtgtccgacgggagatgtatagaatttacaaaacttgcttgtacgcacacgggcatacagttctaccaattttctgtgggtaaccaacgtgaagggagactgctgtgtcacggtcactatcctgaaatccttgtggtagatgctacatccctggaagttttgtactctctcgtgtccaagatctcgccggattggatcagttccatgtccattattaggtcccacaggacacaggaagatacggtagtagccctcagcgtgaccgggatcctgaaggtgtggattgtgacaagcgaaatctcagatatgcaggatactgagcctattttcgaagaagagtctaagccgatctactgtcagaattgccagtcaatctccttctgcgctttcacccagcgatctctcctcgtagtctgttccaagtactggagggtttttgacgctggcgactatagtctgctgtgcagcggacccagcgagaatggccagacttggaccgggggagacttcgtgagttccgataaggtgataatttggacggaaaacgggcaatcgtacatttacaaactgcccgcttcctgtttgccggcttctgactctttccggagcgacgtaggtaaggcagttgaaaacttgatccctccggtgcagcacatcctgttggacaggaaagataaggagctgctgatctgccctccggtgactaggtttttttatggctgtcgcgagtacttccacaaactgctcattcagggagacagttctggaagattgaatatttggaacattagtgacacagcagacaaacagggatccgaggagggcctggccatgacaacatccattagcctgcaggaggcttttgacaaactgaatccctgtcccgcaggaatcatcgatcagctttccgtgatcccaaattccaacgaacctttaaaagtgacagcctccgtgtacatccccgctcacgggcgactggtatgtggtcgtgaggacgggtctattgtcatagtccccgctacacagaccgcgattgtgcaactgctgcagggagaacatatgctgagacgcggatggccccctcaccgaactctgcgcggacatcgcaacaaagtaacttgtctgctgtatccacatcaggtgagcgcccgatacgatcagcgatatcttatttcgggcggagttgatttctccgtgatcatctgggacatattttctggggagatgaaacacatcttttgcgtccacggaggggaaataacgcagctgctggtgccccctgaaaactgttctgctagagtgcagcactgtatttgctcagtagcctccgatcacagtgttggactgctgtctctgagggagaaaaaatgtataatgctggcctcaaggcacttgttccctattcaggttatcaagtggcgtccgagtgatgattacctggtggttgggtgtagcgacgggagcgtctatgtttggcagatggacaccggtgccctcgataggtgtgtcatgggaatcactgccgtagaaatcttaaacgcttgcgacgaggcggtccccgctgctgtcgactctttgagccaccccgcagttaacctaaagcaggctatgacacggaggagcctggccgctctgaaaaatatggcacatcacaagctccagacactggccaccaatctactggcgagtgaagcgagtgataagggaaacctaccaaaatatagtcataactcgctgatggttcaagccatcaaaaccaatctgacggaccctgacatccatgtgttgtttttcgatgtcgaagctctcatcattcagttactgacagaggaagcatcacggcctaacacagcgctcatcagtcccgaaaacctgcaaaaggcttcgggctcctctgacaaggggggttcctttctcactggcaaacgggctgccgttctcttccaacaagtcaaggagactataaaagagaacatcaaagagcatctgttggatgatgaggaggaggacgaggagattatgcggcagcggagagaggaaagcgacccagaatatcggtctagcaagagcaagcctcttacactgctggaatacaatctgacaatggatacggccaaattattcatgtcttgcctgcatgcgtgggggctaaacgaagtcctcgatgaagtgtgcctagatagactgggcatgcttaagccccactgtacagtaagcttcggtctgctgtcacgcggtggacatatgtcgctgatgctccctggatataaccaaccagcctgcaagctgtcccatggtaaaactgaggtcggtcgaaaattgcctgcctccgaaggagtcggaaaagggacctatggcgtgagtcgggctgtgacaacccaacatctgcttagcatcatcagcctggccaatacattgatgagcatgactaacgccacatttattggcgatcatatgaagaagggcccaactcggccacctcggccaagcacacccgacctgagtaaggcgcgtggctcacccccaaccagctctaatatcgtgcaggggcagatcaaacagggctggtcccagttggcagctatgcattgcgtcatgctgcctgacctgctgggcctcgacaagtttcggcctccactgctggaaatgcttgcaagaaggtggcaagatcggtgtctcgaggtgcgggaagctgctcaggctttactgctggccgagctacggcgaatagagcaggctggacggaaggaagccatcgacgcctgggccccttacctcccgcagtatatcgaccatgtgatttcccccggtgtcacctccgaggcagcgcagaccatcactactgccccagacgcctctggaccggaagcgaaagtgcaggaagaggaacatgacctggtagacgatgatattacaaccgggtgtctgtcttctgtgcctcagatgaaaaagatctctacttcatacgaagagagacggaaacaggcaacagccatcgtcctgctgggggtaataggagctgagttcggagcggaaatagagcccccaaagttgctgacacgtcccagatcttcctcccagatccccgagggattcggcttaacgagcggtggttcaaattattccctggcacgccacacatgtaaggccctaactttcctgctgcttcagcctccaagcccaaaactccctccccattccactatccgcagaactgccatagatctgatcgggaggggcttcactgtctgggagccgtacatggacgtgtcagctgtcctgatggggcttctggagctttgcgccgacgccgagaaacaactggctaacataacgatgggattacccttgtcccccgcagctgattctgctaggagcgctaggcacgcactctccctgatcgccactgctcgaccacctgcttttatcacaaccatcgccaaagaggtgcacaggcatacggccctcgcggctaatacgcagtctcagcaaaatatgcacactacaactctcgcgagagcaaaaggagaaatcctgcgggtcattgaaatccttatcgagaaaatgccaactgacgttgtggatctacttgtggaggttatggatatcataatgtactgcttggagggctctttggtgaagaaaaaaggactccaagagtgtttcccggcaatctgccgattctacatggtctcctactatgagcgaaatcacagaatcgccgtgggagcgcgacacggcagcgttgcgctctacgatatcaggaccggtaagtgccaaactatccacgggcataagggcccaattacggccgttgcattcgccccagatggccgttatcttgccacttattctaatacggattctcatatcagtttctggcagatgaacacgagcctgctggggtccatcggcatgctgaactcagctcctcagcttcggtgcataaaaacatatcaggtcccccctgtgcaacccgcatctccaggatcccacaatgcactgaaactggcacgtctcatttggaccagcaataggaacgtgattctgatggcccacgacggtaaggagcataggtttatggtgtag

SEQ ID NO: 246832 - DNA, 2448 bp, Artificial Sequence
  Description of Artificial Sequence: Synthetic coding sequence
atggccggaaactcgcttgtgctaccgatcgttctttggggtcggaaggctccaacccattgcattagcgcagtgctcttgacagatgacggggctacaattgtcacaggatgtcacgatggacagatctgcttgtgggatctgtccgtggaattgcagatcaaccctcgcgctctgttgttcggacacacagccgtgcttttccaacaagtgaaggagaccattaaggagaatattaaagagcacctgcttgacgacgaagaggaggatgaggagattatgcggcaacgcagggaggagtccgatccggagtatcggtcttcaaaaagcaagcccttaaccctcctggagtacaatctgacgatggatacagctaagctctttatgagttgcctgcacgcttggggtcttaacgaagtgttggacgaggtgtgccttgatcggctgggtatgcttaagcctcattgcactgtctctttcgggcttctctcacgtggcggacatatgagccttatgctgcctggctataaccagccagcctgtaaactttcccacggaaaaaccgaggttggaagaaagcttcctgctagcgagggggtgggcaagggtacttacggggtgtcaagggcagtaactactcagcacctcctttccattatctctctggccaacactctaatgagtatgacaaatgccacatttatcggtgaccacatgaaaaaaggacctactcgcccacctcggcctagcacccccgatctgagcaaggcaagagggtcccctcccacaagttcaaacatcgtgcagggccaaatcaaacaggttgccgcacctgtagttagcgcgagatccgatgccgaccacagcggatccgaccctcctagtgctccagctcttcatacctgcttcctggttaatgaaggttggtcccagttggctgccatgcattgcgtcatgctgccagacctccttggcctggataagttccgaccgccattgttggagatgctagccagacgctggcaggatcggtgtcttgaggtgagggaagcagcccaggccctgctgctggctgagttaagaaggattgagcaggctggccgtaaggaagctatcgatgcctgggctccttatctgccacagtacatcgaccacgtcatctctccaggtgtaacctcagaagccgctcaaacaattacaacagcacctgatgcaagtggtccagaagccaaagtacaagaggaggaacatgacttagtggacgacgacatcacaacgggctgtctgtccagcgtgcctcagatgaaaaagataagcacttcttatgaggaacgccgaaagcaggcaacagctatcgtcctcctgggggttataggagccgagttcggcgcagaaatcgaacctcctaaactccttactcgtccgaggtccagctcccagattcctgaaggatttggccttaccagcggtgggtcaaactactccctcgcaaggcatacttgcaaagcactgacctttctgttgctgcagcccccatcgcccaagctaccccctcattcgaccattagacggaccgcaatagatctgattggcagaggctttactgtatgggaaccctacatggacgtcagcgccgtgctgatgggactcctcgagctgtgtgccgatgcagagaagcagttggcaaatatcaccatggggctgccccttagtcctgcagcggactcggccaggagcgccagacatgctctgtccctgattgccactgcccgaccaccagcctttattactactattgccaaagaggtgcaccgccatactgcgttggccgcaaacacacaatctcaacagaatatgcatactaccactttggcgagagcaaaaggagaaattcttagagtaattgagatcctgatcgagaagatgcctaccgatgtggtggacttacttgtagaggttatggacattatcatgtactgtctcgaggggtccctggtgaaaaagaagggattgcaggagtgctttcctgcaatatgcaggttctatatggtttcttattacgagcggaaccataggattgctgtcggggcacggcatggctctgtagctctctatgacatcagaaccggaaaatgccagactattcacgggcacaagggccctattacggccgtcgcgtttgcgccagacgggcgatacctggctacatactctaacaccgactcccatatctcattctggcagatgaatacaagtcttctgggatctataggaatgttgaacagcgcccctcagctgagatgcatcaaaacctaccaagtgcctcctgtgcagccagcctctccaggttcccacaatgcccttaagctggccagactgatttggacaagcaatcgcaacgtcatattgatggcccatgatggcaaagaacaccggtttatggtttag

SEQ ID NO: 246833 - DNA, 3309 bp, Artificial Sequence
  Description of Artificial Sequence: Synthetic coding sequence
atgcggacatcattgcaggccgttgccttatggggccaaaaagcccctcctcatagcataacggccatcatgataactgacgaccagagaaccatagttactggatctcaggaagggcagctgtgcctgtggaacctgtctcatgagttgaagatctctgccaaagaactgctatttggccattctgcctctgtgacttgtctggcccgagcacgtgattttagcaaacagccttacattgtgtcggcggctgaaaatggcgagatgtgcgtttggaacgttacaaatggacaatgtatggagaaagctacgctgccataccgacatacagctatctgctactatcattgctcctttcggatgactggggaaggctggctgctctgttgcggcgagtaccaggacgtgctgatcattgacgctaagacattggctgtcgtgcactctttcagatcctcacaatttccagactggatcaattgtatgtgtatcgtgcactctatgcgaattcaagaggacagtcttctggtggtgagtgtggcaggcgaacttaaggtgtgggatctgtctagctccatcaattcgatccaggagaagcaggacgtgtatgaaaaggaatctaagttcttggaaagcctgaactgtcagaccattaggttctgtacctacactgaacgcctgctcttagtggtgttttccaagtgctggaaggtctacgattactgtgatttctccctcctgctcacggaagtgagcaggaacggacaatttttcgccggaggagaggtgatcgctgctcatcgcatcctgatttggaccgaagatggccactcttatatctatcagctgctcaactctgggctgagtaaatccatttaccccgcagatggaagggttctcaaagaaacaatctatccgcacctgttatgcagtacatcagtacaggaaaacaaggagcaatcacggccatttgtgatgggatacatgaacgagcgtaaggaaccattttataaggtgctctttagtggagaggtaagcggcagaattaccctgtggcacatcccagacgtgccagtgagtaaattcgacggatctcccagggagatccctgtgaccgccacatggacactgcaggacaacttcgacaagcacgatacaatgagccagtccattatcgattatttcagcggcctcaaggatggagctgggacagctgtcgtgacatcttctgagtatatccctagcctcgataaactgatctgcggttgtgaggacggcactatcattattacccaggcgttgaacgccgctaaagccagacttctcgaggggggtagccttgtaaaggacagtccccctcacaaggttctgaagggccaccaccagtccgtgacttcactcttgtatccccatgggctgagcagcaaactggaccagagttggatgctgtccggggacctagacagctgcgtgatcctctgggacattttcacagaagagatcctgcataaattttttctggaagctggcccagtgaccagcctactgatgagtccagaaaagttcaaactgcggggagagcagatcatttgctgcgtttgcggagatcattccgtggcattgctgcatctggagggaaagtcttgtttgttgcacgcccgaaaacacttgtttcccgttaggatgataaagtggcaccccgtggagaactttctgatcgtaggctgcgctgatgacagtgtctatatctgggaaattgagacaggcaccctggagagacatgagaccggagaacgcgctagaattatcctgaattgctgcgatgattctcagctcgtaaagtccgtcctccctattgccagcgaaaccttgaaacataagagtatagagcagagatcttcaagtccttaccagttgggaccattgccgtgccctggattgcaggtcgagagctcgtgtaaagtgactgatgccaaattttgtcctaggccattcaacgtgctacctgtgaagaccaagtggagtaacgtggggtttcacatcctgctgttcgacctagaaaacttagtggagttgctactgcctaccccgttgagcgacgtcgacagcagtagctccttctacggtggcgaggtcctgagacgcgctaagtccactgtcgagaagaagacactcacattgaggaaaagcaaaacggcttgtggtcctctcagtgccgaagcactggctaagccaatcactgaatcgctcgcacagggggacaatacgatcaagttttcggaagaaaacgatggaattaagagacagaaaaagatgaagataagtaagaagatgcagccaaagccgtcccggaaagtagacgctagcttaactatcgacacagccaagcttttcctttcttgtctgctgccatggggcgtcgacaaggacctggactacttgtgtatcaaacatttgaatattctgaaattgcagggccctatcagcctaggaatttccttaaacgaggataacttctccttgatgctgcctggttgggatttgtgtaactctggtatgatcaaagactacagcggcgtgaatctcttcagccgcaaagtcttggacctgtccgacaaatacacagctactttgccaaatcaggtgggtattcctcggggtctcgagaataactgcgacagtctgcgagagagtgatactatcgtgtatctcctcagccgcctgtttctggtgaacaagttggttaacatgccgctggagctggcatgccgtgtgggaagtagctttcgcatggaaagcattcacaataaaatgcgtggagccggaaatgacattctgaacatgagcagcttctatagctgtctgcggaatggtaagaatgaaagtcatgtccctgaagccgatctgagtctgcttaaattaatatcctgttggagagaccagtctgtgcaggtcactgaagcgatccaagccgtgttgttggccgaggtccagcaacacatgaaatcgctgggtaagattccagtgaactctcagcctgtgagcatggcggaaaatggcaactgcgagatgaaacaaatgcttccgaaacttgagtggactgaagagctggaactccagtgtgtgcgaaacaccctgccactgcagacacctgttagcccagtcaagcatgactcaaactccaacagtgctaactttcaggatgtggaggatatgcctgatcggtgtgctcttgaggaaagtgaatctcccggtgagcctcgccatcatagctggatcgccaaagtctgtccctgtaaggtgtcttag

SEQ ID NO: 246834 - DNA, 3309 bp, Artificial Sequence
  Description of Artificial Sequence: Synthetic coding sequence
atgcgcaccagtttgcaagctgtggcactgtgggggcagaaggctccccctcattcaataactgccatcatgatcacggacgaccagagaaccattgtcacaggctcccaggagggccagctctgtttatggaacctctcacatgaattaaaaattagcgccaaggagcttttgtttgggcactcagcctctgtcacttgtctagcacgtgcgagggacttctctaagcagccgtatattgtctcagccgctgagaacggcgaaatgtgcgtgtggaatgtgacaaacggacaatgcatggagaaggcaacactgccctaccgtcacacggccatctgttactaccactgcagctttcgtatgactggagagggctggctcttgtgttgcggagagtatcaagacgttctcatcatagacgcgaagaccctcgccgtagtgcatagtttccggagttcacagtttcccgactggatcaattgtatgtgtattgttcatagtatgcggatccaggaagattctctcttggttgtctccgtagctggggagctcaaagtgtgggatctcagcagttcaattaatagcattcaggagaagcaggatgtttacgaaaaagaatctaaatttctagagagtctaaattgtcagactataagattttgtacctatacagaaagactgctgctcgttgtcttctccaagtgttggaaggtatatgactactgcgacttcagcctgctcttgacagaagtgagcaggaacggtcagttttttgccggtggtgaggtaatcgctgcgcatcgcattctaatctggaccgaggatgggcactcctacatttaccagctcctcaacagcgggctgagcaagagcatttatcccgctgatggcagagtcttgaaggaaaccatctacccacacctcctgtgttccacttccgtgcaggagaacaaggaacagtctagacccttcgttatggggtatatgaacgaaagaaaggaacctttctataaagttctattctctggggaagtgtccggcagaataacattgtggcatatccctgatgtcccagtgtctaagttcgatggatccccgagggagatccccgtgaccgccacttggacactgcaggataacttcgacaagcacgacaccatgtctcaatctattatcgactatttctcagggttaaaggatggggcaggaacagctgttgttacctcttcggagtacataccatcactagacaaactgatctgcggttgcgaggatggaactattattatcacccaggcgctgaatgcagccaaggccaggcttctggaggggggaagcctggttaaagattcccctccccacaaggtgctaaaagggcatcatcagtccgtcacatctctcttgtaccctcacggactttcatcaaaacttgatcagtcttggatgctgtcgggggatctggattcctgtgtgattctctgggatatcttcacagaagaaattctccacaagttttttctggaggccggaccagtgaccagcctgctgatgtctcccgagaagttcaaactgcggggtgaacagatcatctgttgcgtctgcggggatcactctgtggctttgctgcatctggaaggcaagtcttgccttttgcacgcacgcaaacatttgttcccagtgaggatgattaagtggcatcctgttgagaatttcctgatcgtgggctgtgccgatgacagcgtttacatctgggagatcgaaaccggtactctggagaggcacgagactggggaacgcgctaggatcattctgaattgctgcgacgactctcagctggtgaagtccgtgctgccaattgcatctgagactctcaagcacaagtctatcgaacaaaggtcctcaagcccttaccagctgggacctctcccctgccccggattacaggtggaatcttcttgcaaagtgaccgacgcaaagttctgcccgaggccatttaacgtgttacccgttaagactaagtggtctaatgtcgggttccatattcttctctttgacctggaaaaccttgtagagctcctgttgcccaccccactgtcagacgtggacagtagtagttcgttctatggcggtgaggtgctgaggcgcgctaaatctacagtggagaagaaaaccctgactctgcggaaatcaaaaaccgcgtgtgggcctctctccgctgaggccttggcaaagcccattactgagtctctggcacagggggacaacacaatcaagttcagcgaagagaatgacggtattaagcggcagaagaagatgaagatctccaaaaagatgcagccgaaacctagtcgcaaggtggacgctagtctgaccattgacactgctaagcttttcttatcgtgtctgctaccctggggggtggacaaagacctggactatctgtgtatcaaacatctgaacatcctgaagctgcaagggcctatctccctaggaatttctctgaatgaagacaattttagcctcatgctgccaggctgggatttgtgcaatagcggaatgataaaagactatagcggagttaacctgttttccaggaaggtactggacctttcagataagtatacagccaccctgcccaaccaggtgggaatcccaagaggattggaaaataattgtgattccttgagagaaagcgacacgatcgtttatctgctgtcaaggctcttcctggtcaataagctcgtgaatatgccgctggaactggcctgtcgtgtgggcagttcgtttcggatggagtcaatccataataagatgaggggagcgggtaacgacatcctgaacatgtcctctttttattcttgtcttcgtaacggaaaaaacgagtcacatgtgcccgaggcagacctgtccttactgaaactcatctcttgctggcgagaccagtccgttcaggtcaccgaagcaatccaggcggtgctgctggccgaggtccagcagcatatgaaatccctgggtaaaatccccgtgaactcacagccagtgagtatggcagagaatggaaattgtgagatgaaacagatgcttcctaagctggaatggacagaagagttggaactacagtgcgtgcgcaacacgctgcctctccaaacccccgtgagccccgtgaagcacgactcgaactcaaatagtgcaaactttcaggacgtcgaagatatgcctgacaggtgcgccctcgaagagtccgagagtcccggagagccgaggcaccatagctggattgccaaggtttgtccttgtaaggttagctag

SEQ ID NO: 246835 - DNA, 3300 bp, Artificial Sequence
  Description of Artificial Sequence: Synthetic coding sequence
atgcgcacatccctgcaggccgtagccctgtggggccagaaggcccctccacatagtattacggccatcatgatcacagacgaccaacggaccatcgtcaccgggagtcaagagggccaactctgcctatggaatctgtcccatgagctgaaaatctcagcaaaggaactgctgttcggtcacagcgcgtcagtaacttgcctcgctcgggcacgagacttctctaagcagccatacatcgtgtcagccgcagaaaatggagaaatgtgcgtctggaacgtcactaacgggcaatgcatggaaaaggccaccttgccctatagacacactgccatctgttactatcactgctcgtttcgaatgactggggaaggctggctcctctgctgcggcgagtatcaggacgttctgattattgatgctaagaccttggcagtggtgcactccttcagaagcagccagtttccggattggataaattgcatgtgtatcgtacactctatgaggattcaagacagcctcctcgtcgtaagtgtagccggagagctgaaggtttgggacttaagtagtagcattaatagcattcaggagaaacaagacgtgtacgagaaggagtcaaaatttctcgagagtctgaactgccagaccatcaggttttgcacgtacactgagcggcttctcctcgtcgtttttagtaaatgttggaaggtgtacgattactgtgacttttccctcctgttgactgaagttagtagaaacggccagttttttgcgggtggagaagtgatagccgcacacaggatcctgatatggactgaggacggccacagttatatatatcagttactcaactcaggactgtcaaagtctatctaccccgcagacggcagagttctcaaggagactatctatccgcatctgctgtgctcaacaagcgtgcaggaaaacaaaagccggccttttgtgatggggtacatgaacgaaaggaaagagcccttctacaaggtcctgtttagcggggaggtgtctggacgcatcactctgtggcatatccctgatgtcccagtgtcaaagttcgatgggagtccgagagagatacctgtgacggcgacctggacactgcaggataactttgataagcatgacactatgtctcagagtatcatcgactacttttccggtctgaaagacggtgcgggaacggctgtggtgacctcttctgaatacataccaagccttgataagctgatttgcggatgcgaagacggcactatcataatcactcaagcattgaatgccgctaaggccagattgctggagggcggtagtctggttaaggacagtccaccgcataaagtcttgaaagggcaccaccagtcagtgacaagtctgctttacccacacggattgtccagcaaactggatcagagctggatgctttcgggggatctggatagttgtgttatactgtgggacatttttactgaagaaatcctgcacaagttttttctggaagccggacccgtcacttccctgctaatgagccctgaaaaattcaagctcagaggggaacagatcatatgttgtgtttgcggagatcattcagtagcactccttcatctggaggggaaatcctgtttgcttcacgccagaaagcacctgtttccagtacggatgattaagtggcatcctgtggagaatttcttgattgtgggttgtgccgacgactcagtgtatatctgggagattgaaacagggacattagaaaggcatgagacaggggaaagagctcgtataatcctgaactgttgtgacgattcgcagctggtgaagagcgttcttcctatcgccagtgagacactgaaacacaaatctatcgaacagagatccagctctccctaccagctcggtcccctgccatgcccaggactgcaggtcgagagttcctgcaaggttaccgacgcgaagttttgcccgcgtccattcaatgtgctgcctgtgaaaaccaaatggtccaacgtcggtttccacatactgctgttcgatctggaaaacctggttgagctcttgctgccaacccccctttctgatgttgacagctcaagctcattttatgggggtgaagtgctgaggcgggctaaatccacagtggaaaaaaagacactgactcttaggaagtcaaagacagcatgtggcccactgtccgcggaggctttagccaaacctatcaccgagtctctggctcagggtgataataccatcaaattcagcgaagagaatgatggcataaaacggcagaagaaaatgaagatctctaaaaaaatgcaaccgaaaccttctcggaaggtggacgcttccctgacaatcgatactgctaagctctttctgagctgcttgctgccttggggggtggataaagatctcgattacttgtgcatcaaacatctgaacatcttgaagctccaaggtcccatatctcttggaatctcactgaatgaagataacttttccctcatgctccctggctgggatctgtgcaactcaggaatgataaaggattactccggggtcaacctgttcagccgtaaagtcttggatttgagcgacaagtacacagccactttgcctaaccaggtgggaatccccagggggctagaaaacaactgcgactcccttagggagtctgacactattgtctacctcctgtcccgcctctttctcgtgaataagctcgtcaacatgccactggagctagcctgtagagtgggcagtagctttagaatggaatccatccataataagatgcgcggtgccggaaatgacatcctgaacatgtcaagcttttatagctgtctgaggaacgggaaaaacgagagccatgtaccggaagctgacttatccctcctcaagctgatcagttgttggcgagatcaaagtgtccaagtgaccgaagcaatccaagcagtgctcttagctgaagtgcaacagcacatgaaaagtttgggcaaaattcctgtcaactcacagcctgtttctatggctgaaaacggaaactgcgagatgaaacagatgctaccaaagctggaatggaccgaggagctggaactccagtgtgtgcgcaatacgctccctctgcagacacccgtcagccctgtgaaacacgacagtaattcaaacagcgccaatttccaggacgtggaggacatgccagacaggtgcgccctcgaagagtccgagtcgcctggagaaccgcgacatcatagctggatagccaaggtctgtccatgcaaggtcagttag

SEQ ID NO: 246836 - DNA, 2328 bp, Artificial Sequence
  Description of Artificial Sequence: Synthetic coding sequence
atgaggacctcccttcaagccgtggccctctggggtcagaaggcgcctcctcactctatcacagccattatgattaccgatgatcagagaaccatagttaccgggagtcaggagggtcaactgtgtctgtggaacctgagccacgaactgaaaataagcgccaaagagctcctcttcggtcactcagcatcagtaacctgccttgccagagctcgtgacttttcaaagcagccatatatcgtatccgccgctgagaacggagagatgtgcgtgtggaatgtgacaaatggtcagtgtatggagaaggcaaccctcccctacaggcatacagccatctgttattaccattgtagtttccgcatgacgggagagggctggcttctgtgttgcggggaataccaggacgttctcattatcgacgctaaaactctggcggtagtacattccttccgcagttcacagttcccagattggattaattgcatgtgtatcgtgcattccatgcgcattcaagaggatagcctgcttgtcgtgtcagtggcgggtgaattaaaggtctgggatctgtcatcgagtataaactctatacaggaaaagcaagatgtatacgaaaaagagtctaagtttttagagtcactgaattgtcagaccatacgcttttgcacctatacagagcggctgttactggttgtcttttctaagtgctggaaagtctacgattattgcgacttcagcctgctccttacggaagtcagcagaaacggtcagttttttgcaggaggagaggtgatagccgcacaccgcatcctcatctggacggaggatgggcattcttacatctaccagttgctgaacagcggcctgagtaagtctatttatccagccgacggcagggtgctgaaagagacaatctacccgcacctgctgtgctctacttccgtgcaagagaacaaggagcagtcccgaccttttgtgatggggtatatgaatgagagaaaagagccattttacaaagtgttgttcagtggcgaagtgagcggcaggatcaccctgtggcatattccagatgtaccagtgtcaaagtttgatggctcccctcgcgagattcctgtaaccgcaacttggaccctacaggacaactttgataaacatgacaccatgagccagtccataattgactatttctctggcctcaaggacggcgcaggtacagccgtggtcactagctcagagtatattcccagcctcgataagctgatttgtgggtgtgaggatggaacaattatcattacccaggctctcaatgcggctaaagcccgtctgttagagggcggttccttggtcaaggattctcccccacataaagttctgaagggtcatcaccagagcgttactagcttgctgtacccccatggtctcagctcgaaactagatcagagttggatgttgtctggcgaccttgacagctgtgttattctctgggatatctttacagaagaaatactacataaattctttctcgaggccggtccagtaacttctcttctcatgtcccctgagaaattcaagctcagaggcgagcagatcatttgctgcgtatgtggggaccattccgtcgccctcttacacttagagggcaagtcatgtctactgcacgcaaggaagcacttatttccggtgagaatgatcaaatggcatccggtggagaatttcttaatcgtcggttgcgcagacgattctgtgtatatctgggagatcgagacgggcacacttgagagacacgagactggagaacgtgcaaggattattcttaattgctgtgatgactctcagctggtgaagagcgtcctcccaattgcctccgaaaccctcaaacataagagcatcgaacagcgcagctcatcaccttaccagctcggcccattgccttgccctggtttgcaggtcgagtccagctgcaaagtcaccgacgcgaaattttgtcccaggccttttaatgtgctgcccgtcaagactaagtggtcaaacgtcggattccacattcttctcttcgacctagagaatctagtggaactgctgctccccacccctctatcagacgtggattcttcaagctccttttacgggggagaagtgctgcggagagcaaaatctacggtggaaaagaagactctgactttgcggaaatcgaagactgcttgcggaccacttagtgctgaagctctagccaaaccaataacagagtcattggctcagggcgacaacactattaaatttagcgaggaaaacgacgggatcaagcgccagaagaagatgaagatatcctag

SEQ ID NO: 246837 - DNA, 1119 bp, Artificial Sequence
  Description of Artificial Sequence: Synthetic coding sequence
atggagccggctcccagcgcaggagctgaactccaaccacccctgttcgcgaatgcaagcgatgcctatcctagcgcttgcccttccgcaggcgctaacgccagtggaccccctggcgcacggtccgcctcaagcctggccttagccatcgcaattacggccctttactctgccgtgtgtgctgtggggcttctggggaatgtgctggtaatgttcgggatcgtcagatacaccaagatgaagaccgctactaatatttatatcttcaacctggccctggccgacgccctcgcaactagtaccctgccattccaatccgcaaaatatctgatggagacctggccttttggagagttactgtgcaaagccgtgctgagcatcgactactacaacatgttcacctccattttcacgctgaccatgatgtcagtggatcgttacatcgctgtgtgtcacccagtgaaagcactggactttcgaacccccgcaaaggccaaactgattaacatctgtatctgggtcttagcgtccggagtcggtgtcccaatcatggtgatggccgtgactcggcctcgggatggggcagtggtgtgtatgcttcaatttccgtcgccctcatggtattgggacacagtcaccaagatttgtgtctttctgtttgcttttgtcgtgccgatccttattattactgtttgttatggactgatgctcctacggttgagaagcgtccggctcctctctgggagtaaggaaaaagataggtctctcagaaggatcacacgcatggtgcttgtggtcgtgggggcattcgtagtctgttgggcaccgatccatatcttcgttatcgtttggaccctcgtggatattgaccgccgagatcctctggtggttgctgcccttcacctctgcatcgcactggggtatgcaaactcctccctgaatcctgtgctctatgcctttttggatgaaaacttcaaacggtgtttccgccagctttgtcggaaaccatgcggaagacctgacccttcgagcttctctcgggcacgagaggccaccgcgcgagaacgtgtcacagcttgcaccccctcggacgggccaggtggcggagccgcagcctag

SEQ ID NO: 246838 - DNA, 837 bp, Artificial Sequence
  Description of Artificial Sequence: Synthetic coding sequence
atgcggaaagagacacctccccctctagtcccccctgccgctcgtgaatggaatttgccacctaacgcacctgcgtgcatggaaagacagctcgaggcagctcggtaccgcagcgacggagcactgttgctgggggcatcttccttgagtggccgatgctgggctgggtctctctggctgtttaaagatccttgtgcagctcctaatgaaggattttgctctgccggagttcagaccgaggcgggagttgccgacttgacatgggtgggagagagagggattctcgtggcctctgattcggcccacgccgctcaggtgacctgcgtagctgcaagccctcataaggatagcgtttttctatcctgtagtgaagataaccgaattctgctctgggatacacgctgtcctaaacccgcatcacagatcggctgttcggcccctggctacctgcccacgtccctcgcttggcacccgcagcagtccgaggttttcgtgttcggtgatgagaatggtactgtgtcattggtggacacaaaaagcacttcttgtgtgctctctagcgcggtccactcacagtgtgtcacaggcctggtcttctcccctcacagcgtacctttcctggccagtctgtctgaagattgttctctggcagtgcttgattcttccctctctgaattgtttcgatcccaagcacaccgcgatttcgtgcgggatgcaacttggagcccactgaaccacagcttgctgacaaccgtgggctgggatcatcaggtggtccaccatgtagtgcctactgagccgctgcctgcccctggacccgcttctgtgacagagtag

SEQ ID NO: 246839 - DNA, 876 bp, Artificial Sequence
  Description of Artificial Sequence: Synthetic coding sequence
taatgtgccgcacctaatgaaggcttctgctccgcgggagttcagacggaagcgggtgtggccgacctaacatgggtgggagaacgtggaatccttgtggcgtcagactccggggctgtcgaactgtgggaactggatgaaaacgaaaccctgattgtcagcaagttttgtaagtacgagcacgacgatattgtctccacggtgagcgtcctgtctagcggcactcaggcagtgtctggttccaaagatatttgcattaaagtctgggatctggcacagcaggtagtcctgagcagctatagggcacatgccgctcaggtcacttgtgtggcagcgagcccccataaggacagcgtgtttctgtcctgtagcgaagataatagaatcctcctgtgggacacaaggtgtcccaaaccagccagccagatcgggtgcagcgccccaggatacctcccaacgtcgctggcatggcacccacagcaaagcgaggtctttgtgtttggggatgagaacggaaccgtgtcgctcgtcgacaccaagtctacctcctgcgtgctgtcctctgcagtccacagccagtgcgtgactgggttggtattttcaccgcacagactcgatcttagccagccctccccaccctccgattcagtgcccttcttagcatcactaagtgaggactgttctctcgctgtgctggacagctctctgagcgaacttttccggtctcaggctcacagggactttgtaagggacgccacatggtctcccctgaatcattcgcttctgacaaccgtgggctgggaccaccaggtggtgcaccacgtggtgcctaccgagcccctccctgcgccaggaccagcttctgttaccgagtag

SEQ ID NO: 246840 - DNA, 942 bp, Artificial Sequence
  Description of Artificial Sequence: Synthetic coding sequence
atgaagctcaccgactctgtcctgagatcgttccgagtcgccaaggttttccgtgaaaactcagataaaattaactgttttgatttcagcccgaatggagaaaccgtaatttcctcttccgacgacgactccatcgtcctatacgactgccaagaaggcaaacctaagaggaccctgtacagcaaaaagtacggtgtggaccttatccgatacacacatgccgctaatacagttgtttactccagtaacaaaatcgatgacactatccgttatttatcattgcatgacaataaatacattagatatttccccggacattccaaaagggtagtcgccctgtcgatgtccccggtagacgacaccttcatcagtggttctctggacaaaaccatcaggctctgggatttgcgtagtccaaattgccaggggctgatgcaccttcagggcaaaccagtctgtagttttgaccctgaaggtctgatcttcgctgctggtgtaaactcggagatggtcaaactgtatgacctccgtagtttcgataagggccctttcgccacgtttaaaatgcaatacgatcggacctgcgagtggaccggtttgaagttcagcaatgacggaaaactgatccttatcagcactaatggcagtttcataagactgatagacgcatttaaaggcgtcgttatgcacacattcggcggttatgctaacagtaaggcagtgacgctcgaagccagctttacacctgactctcagtttattatgattggctcagaggatggcaaaatccacgtatggaacggcgagagcgggatcaaggttgctgtgctggacggcaagcacaccggacctatcacatgccttcagttcaacccaaagttcatgacatttgcctcagcatgctccaatatggctttttggcttcccaccattgacgactag

SEQ ID NO: 246841 - DNA, 1359 bp, Artificial Sequence
  Description of Artificial Sequence: Synthetic coding sequence
atgatggggtgctttgcactgcagaccgtcgatacagagctgaccgccgacagcgtggagtggtgccccctccaggggtgcagacacctcctcgcttgcggtacttaccagctgcgccgaccggaggatcgtcccgcaggacctcagaataaaggaggaatggaagtcaaggaaccacaggtccgactcgggaggttatttctgtatagcttcaacgacaacaactccatccaccctctggtggaagtccagagaaaagatacctctgccatcctggacatgaagtggtgccatatcccagtggccggacacgcgttgctaggcttagctgacgccagtggaagtattcaattgctccgtctcgtggagagcgaaaagagccatgttttagaaccactgtctagtctagccctggaagaacagtgtctcgccctgagccttgattggtcaaccggcaagacgggacgggctggggaccaacctctcaagatcattagttctgacagcacaggtcagctgcatctgctcatggttaatgaaaccaggcccaggttgcagaaggtggcttcttggcaggcccaccagtttgaggcgtggatcgccgctttcaattattggcacccagagatagtctactctggcggagatgatggactcctgcgtgggtgggacactagggttccaggcaagtttctgtttaccagcaaaagacacaccatgggcgtctgtagtattcaaagctctccccatcgcgaacatatcttggcaaccgggtcttatgatgagcatattcttctgtgggatactcgaaatatgaagcagcctctggcagatacccctgtccagggtggtgtttggcgaatcaagtggcacccattccaccaccatttgttactggctgcctgtatgcactccggcttcaagattttaaattgtcaaaaagccatggaggagcggcaagaggccacagtgctgactagtcatacactgccagatagtcttgtctacggtgccgactggtcatggcttctgtttagatccttgcagcgagcgccttcatggtcgttcccctccaacctgggcactaagacagccgacctcaaaggtgcctccgagttgcctactccatgtcacgaatgcagagaggacaatgacggtgagggccacgcaagaccccagtccgggatgaagcctttaaccgaagggatgaggaagaacggcacctggcttcaggctaccgccgcaaccacacgcgattgcggagttaaccccgaggaggccgatagcgccttcagcctgctcgcaacatgtagtttttacgatcacgccctgcatctgtgggagtgggagggcaactag

SEQ ID NO: 246842 - DNA, 1074 bp, Artificial Sequence
  Description of Artificial Sequence: Synthetic coding sequence
atgagcgcctttgaaaaaccccagatcatagcccacatccagaaggggttcaattatacagtctttgactgtaagtgggttccctgcagcgcaaagtttgttactatggggaacttcgccaggggtactggagtgattcagctttacgagatacagcacggcgatctgaaactcctccgggaaattgagaaggcgaaacccatcaagtgtggtacgtttggagcaacaagcctgcaacagcggtatctggccactggcgacttcggtgggaacttgcacatctggaatctggaggctcccgagatgcctgtctactccgtgaaaggccacaaggagataataaacgcaatcgacggaatcggaggactcggcataggggagggagcccctgaaattgtgaccggtagtcgtgacggcacagtgaaagtgtgggacccacgacagaaggatgatcccgttgcaaatatggagcccgtacaaggggagaataagcgggactgttggactgtcgcctttggaaatgcctacaatcaggaggagagagtcgtgtgtgcaggttacgacaatggcgatatcaagctgtttgatctgaggaatatggcactcaggtgggagaccaacattaaaaacggtgtgtgttctttggagttcgaccgtaaggatatctcaatgaacaagctggtggcaactagccttgagggtaagttccatgttttcgacatgcggacacagcatccaaccaaggggttcgcgtctgtgtctgaaaaggcccacaagtctacagtgtggcaggtcaggcatctccctcagaatagggagctgttcctgactgccggtggtgcgggagggttgcacctgtggaagtacgagtatccgattcagaggtccaagaaagacagcgagggcatcgagatgggcgtggccggaagcgtgtctctgctgcagaacgtgactctgagtacgcaacctattagctccttagactggagccccgataaacgcggtctgtgcgtgtgctccagcttcgaccaaaccgtgcgggtcctgattgtgacaaaacttaacaagatatag

SEQ ID NO: 246843 - DNA, 867 bp, Artificial Sequence
  Description of Artificial Sequence: Synthetic coding sequence
atgtctgctttcgaaaagccacagattatcgcacacatccagaagggtttcaactacaccgtgttcgactgtaagtgggttccctgctcggcgaagttcgtcacaatgggcaatttcgccagaggtacaggggtgatccaactgtatgagattcaacacggagatctcaaattgctccgtgagatagagaaggcaaagcccatcaaatgcggcacctttggggcaacttccttacagcagcgatacctcgccaccggggactttggcggaaatctccacatctggaatctcgaggcccctgagatgcccgtgtactccgtgaagggccataaagagatcatcaacgctatcgacgggatagggggtctgggtattggagagggggcacccgagatcgtcacaggcagcagggacgggaccgtcaaggtctgggacccaagacaaaaagatgatcccgtggctaatatggagcccgttcaaggcgagaacaaaagggattgttggaccgtggcatttgggaatgcatacaatcaagaggagcgcgtcgtgtgcgcaggatatgataacggagacataaagctgttcgatcttaggaacatggctcttcgttgggagaccaacattaagaacggcgtgtgctcattagagtttgatagaaaggatatctccatgaataagctcgtggcgacttccttagaaggtaagttccacgtgtttgacatgcggacacaacatcctacaaaaggattcgcgagtgtgagtgagaaggcccacaagtccaccgtctggcaggttaggcacctgccacagaatagggaactgtttctcacggcaggcggagcaggaggtctacacctctggaaatag

SEQ ID NO: 246844 - DNA, 3816 bp, Artificial Sequence
  Description of Artificial Sequence: Synthetic coding sequence
taaagagactttcagagcgaggtgctccttagtgcgatggaattgtttcatatgacatccggaggcgatgctgccatgttccgagatggtaaggaacctcaaccatctgccgaggcggcagcagccccttcattggccaacataagttgttttacacagaagcttgtagagaaactctatagcggtatgttcagcgcggaccctagacacattttgttatttatcctagaacacataatggtggtgattgaaactgccagctcccaaagggacacagtgctcagcactctgtacagctccctcaataaggtgatcttgtactgtctgtctaagccccagcagtccctctccgagtgtttggggctgctgtctatccttggttttcttcaggagcattgggacgtggttttcgccacttataattccaacatcagctttctactgtgtttaatgcattgtctgctcctcctgaatgaacgcagttatccggagggtttcggactggaacccaagccccgaatgtctacctaccatcaagtattcctgagccccaatgaggacgttaaggagaagcgcgaagacctgccctccctaagcgacgttcagcacaacatccagaagacagtacaaaccttgtggcaacaactggtggcgcagagacaacagacactggaggatgcttttaaaatcgatctctcggtaaaacctggcgagagagaggtgaaaatcgaagaggtgacacctctgtgggaggaaacgatgttgaaagcctggcaacattacctggcttcggaaaagaaaagcctggcctcccggtccaatgtggcccatcatagtaaggtaaccctctggtctggctccctttcaagcgcaatgaaactgatgcccggtagacaggctaaggaccctgagtgcaagaccgaggattttgtttcatgcattgagaactacagaagaaggggacaggaactctatgcctctctgtataaggaccacgtccagagacgcaagtgcggaaacatcaaggccgcaaacgcctgggctcgtatccaggagcaactgttcggggagcttgggttgtggtcacagggcgaagagacaaagccatgctctccctgggaattggactggagggaaggcccagcacgcatgcgcaagcgcattaaacgccttagccccttggaagcactgagctctggcagacataaagaatctcaggacaaaaatgaccatatctcccaaactaacgccgaaaaccaggacgagctgactctgagggaggccgagggtgaaccggacgaggtcggtgtggactgcacacagttaacctttttccccgcactgcacgaatcccttcattcggaagattttctcgaactgtgcagggaacgccaggtaattttgcaggaactcctggataaggagaaggtgacacagaagttctcactcgttattgtccagggacaccttgtctccgagggggttctgctctttggtcaccaacatttctatatctgcgagaactttactttgagtcctactggagacgtgtattgtactcggcattgcctgtccaacattagtgaccctttcatttttaacctgtgttcaaaggataggagcactgatcattactcctgtcagtgccactcatacgcggacatgagggagctgcgacaagctaggttcctgcttcaagacatcgccctcgagattttcttccacaatggctattccaagttcttggtattctataacaacgatcggagcaaagcattcaagtctttttgctccttccagcctagcctcaagggaaaagctacctctgaggacaccctctcactccgcagatatcccggttcagatagaattatgctgcagaaatggcaaaagcgtgatatcagtaatttcgaatatttaatgtatctgaacacagccgctgggcgtacctgcaatgattacatgcaatacccagtgtttccatgggtgctggccgattatacgagcgagacacttaacctggctaatcccaaaatctttagagacctgagtaagcctatgggtgcccagacgaaggagcgaaagctcaaattcattcagcggttcaaagaggttgagaaaacagagggagatatgaccgttcagtgccactactacacacactacagttctgcaattatagtggcatcctacctggtgcgaatgcccccttttactcaggcattctgcgccttgcagggagggtcattcgatgtcgcggacaggatgttccactctgtcaagtcaacgtgggaatcagcctcacgagagaacatgtcagacgtgagggaacttacccccgaattcttctatctgccagagtttctgactaattgcaacggggttgagtttggctgtatgcaggacgggactgtgctgggagatgtgcagttacccccatgggcagatggggaccccagaaaatttatttctctacatagaaaagccctggagtcagattttgttagcgcaaatctgcatcactggatagatcttatctttggttataagcagcagggccctgccgcagtcgatgcggtcaacatcttccacccgtacttctatggagacagaatggaccttagctctattaccgaccctcttattaagagcactatcctcggctttgtatcaaatttcggccaagtgcccaaacagttatttaccaaacctcatccagctaggacggctgccggtaagcctctccctgggaaagacgtgagcaccccagttagccttcccggtcatccgcagccattcttttatagcctccagagtctcaggccctctcaggtcactgtgaaagacatgtatctcttctccttggggtccgagagtccaaaaggagcaattgggcatatcgtgtcaactgaaaagactatcttggctgttgaacgcaataaggtcctgctgcctcctttgtggaaccggactttcagctgggggttcgacgacttctcctgttgcctgggttcctatggatcagataaggtacttatgaccttcgagaatttggctgcctggggtagatgcctctgtgctgtatgtccttctccaaccacgattgttacaagcgggacttcaacggtggtgtgtgtgtgggaactctcaatgactaaggggagacctagaggtctgagactcaggcaggccttatacggacacacccaggctgtcacctgcctcgccgctagcgtcaccttttccctccttgtgtccgggagtcaggactgcacatgtatcttgtgggatcttgaccacctgactcacgttaccagactgcccgctcatcgtgaagggatctccgcaatcacaatcagtgacgtgtccgggactattgtgtcctgcgctggtgcacatctgtctctgtggaacgtgaatggccagccccttgcttctattaccacagcttggggacctgaaggggctataacgtgttgctgtcttatggagggcccagcttgggatacatcacagattatcatcactggatctcaagacggcatggtgcgagtgtggaagacagaagatgtgaaaatgtccgtgccaggcagacctgccggagaggaacctccggctcaaccaccttcccccagaggacacaagtgggagaaaaacctggcgctgtcccgcgaactggatgtaagcattgctctcactggaaagccttcgaagacaagccctgcagtaacagctctagccgtctctagaaatcacactaagctgctggtgggagacgagagagggaggatcttttgctggtctgcggatgggtag

SEQ ID NO: 246845 - DNA, 6804 bp, Artificial Sequence
  Description of Artificial Sequence: Synthetic coding sequence
tagaagcttgctagccaagcgattgagcctgacgtcctgcggcagttcctgggactcggcataccaagctcactctcggccacaaccaagattcttgacagttcccacactcaccggggtaatcccggatgctccggtagccagaccgcacagggattagccgaaggtccatggccggctgcgcctgacgctggcctgcacccaggggttacgcaggccccacagccactcggagaaagccaggattcaaccacggccttgcagacggccctgagcctaatatcgatgacttcccccaggaaccttcagccacagcgcgcagctttggcccctagttttgtcgagttcgatatgagcgtcgagggttatgggtgcctgtttattcctaccctgtccacagtcatgggcacgtccaccgagtatagtgtgtcaggaggcattgggacaggtgcaacccgaccattcccacctccagggggactgactttttcttgctggttcctgatcagcagacacggggctgcaacagaaggccaccctctgcgtttcctgaccttggtgcggcatctggcaaggactgagcagccctttgtgtgttttagcgtgagcctgtgtccagacgatctatccctggtagtgtcaaccgaggagaaagagtttcaacctctcgacgtcatggagccagaagacgatagtgaaccaagtgcaggctgtcaactccaggtccgatgcggtcagctgctcgcctgtggacagtggcatcacctcgccgttgtggtcaccaaagagatgaagcggcattgtaccgtttctacctgcctcgatgggcaggtcatcggtagcgccaaaatgttgtacattcaggccctccctggcccatttctgtccatggatccctctgcttttgtggacgtgtacggatatatcgccacaccgagggtttggaagcagaagagtagccttatctggagactcggtcctacttatctgtttgaagaggccatcagcatggaaaccctggaggtgattaataagttagggcctaggtactgcggcaacttccaggccgtgcatgtccagggggaggatcttgattccgaggcaacaccctttgtggctgaagagagagtatccttcggcctgcatattgcctcaagcagtattacctcagtagcggatataaggaacgcctataacgaagtagactcgaggctcattgctaaggaaatgaatataagcagccgagataatgccatgcccgtctttctgctgcggaactgtgcagggcacctgtccggctcgttgagaacgatcggggctgtggcagtaggacagctgggcgtacgggtcttccatagctcaccagcggcaagtagtttggatttcattggtggcccagctatccttcttggcctgataagcctggcaacagacgatcacaccatgtacgcggctgttaaggtattgcactcagtgctgacaagcaatgctatgtgcgacttcttaatgcaacacatttgcggctatcaaatcatggccttcctcctgcggaaaaaagctagcctgctgaatcaccgaattttccaattgatcttatcggtagcaggtactgtggaactgggctttagatcttctgcaataaccaatacgggtgtttttcagcatatcctttgtaacttcgagctgtggatgaacacagccgacaaccttgagctgtccctattctctcatcttcttgagattctgcagtctcctcgggagggaccccgaaacgctgaggccgcacaccaggcccagctgatccccaaactgatttttctgtttaatgaaccatccctgattcctagcaagatttcgaccatcataggtatactggcctgccagttacgaggacatttttcaacccaggacctactcaggatcggactgttcgtggtttacacactgaaaccatcaagtgtcaatgagaggcagatctgcatggatggcgcactcgatccctccctacccgctgggtcacagacaagcggcaaaacaatctggctcagaaatcagctgctggagatgctgctttcggtcattagttcgccacagctgcatctatcatccgaatccaaagaagagatgttcttgaaactcggcccagattggttcctgctgctgctgcaggggcatttgcacgcgtcaacaaccgtgctcgctctcaagctgcttctctacttcctcgcaagccccagccttcgcacccgcttcagagatggcctgtgcgccggaagctgggtggaacgtagtaccgaaggagtcgatattgtaatggataatctgaagagccaaagccccctgccggaacaaagtccctgcctgctgcccggatttagagttttgaacgattttctggctcatcacgtgcacatcccagaggtgtacttaattgtgagcacattctttctacagactcccctaaccgagctcatggatggtccgaaggattctctggacgccatgttgcaatggctccttcagcgccaccaccaggaggaagtccttcaggcagggctctgcacagagggcgcattgctcttacttgaaatgctgaaagccacaatgtcccagcctctggctggatctgaggacggggcatgggcccagacctttccagcctctgttctgcaatttctgtcactcgtgcatcgcacctatccgcaggatcctgcctggagggcacctgaattcttgcagaccttggccatcgccgcattcccactgggggctcagaaaggtgtaggcgcagagtccacacgtaataccagtagcccagaagctgcggcagaaggggacagcaccgtggaggggctgcaggcgcctacaaaggcacatcccgctcggaggaagctacgtgagtttacccagctgctgcttagggaactgttgctaggagccagttcacccaagcaatggctacctctcgaagtgcttctggaagcgtcacctgaccatgccacctcccaacagaaaagggattttcagagcgaggtactcttgtctgcaatggaacttttccacatgaccagcgggggagatgctgccatgtttagggacggcaaagaacctcagcctagcgccgaggctgctgcagctccatctttagctaacatcagctgtttcacacagaagctggtggaaaagctctacagtggcatgtttagtgctgacccacgtcacatcctgttgtttatactcgaacatatcatggttgtgatcgaaaccgccagttcccagagagacacagtgctgagtaccctttattcttctttgaataaagtgatcctatattgcttgagcaagccccaacagtcgctaagcgagtgtctggggctactttccatcctgggctttttgcaagagcactgggacgtagttttcgccacatacaatagcaatatctccttcctgttatgcttaatgcactgtcttttgctgctcaatgagaggagctatcccgaaggattcggcctcgagccaaagcccagaatgagcacctatcatcaagtgtttctctccccaaatgaggacgtgaaggagaagagagaagatctaccctccctgtccgatgtgcagcacaacattcagaaaaccgttcagacactatggcagcagctcgtggcccaaagacagcaaacccttgaagacgcttttaaaatcgacctaagcgtgaagcccggagaaagggaggtcaaaatcgaggaggtgactcccctttgggaggagactatgctgaaagcttggcagcactatctagctagcgagaaaaagagcttagcctctaggtcgaacgttgcacatcattcaaaggtgactctctggtctggatcattaagttccgcgatgaaactcatgccaggccgacaagctaaggatcccgagtgtaaaactgaggactttgtgtcttgcatcgagaattacaggcggagaggccaggaactgtatgcttcactgtacaaagaccacgtgcagagacgtaaatgtggcaacattaaagctgccaatgcatgggcacgcatacaggaacagctgttcggagaactaggattatggagccagggagaagaaacaaagccttgttcaccttgggagctggattggcgggagggacccgcaagaatgcgcaaacgtattaaaagactgtcaccactggaggccctgtcctccgggaggcataaggagagtcaggataaaaacgaccacatctcacagactaacgcagagaaccaggatgagctgacattaagggaggccgagggagaaccagacgaggtcggcgtagattgcacacagctcactttctttccagcccttcatgagagcctgcactctgaagactttttggagctgtgtcgagagaggcaggtaatcttgcaagaactccttgataaagagaaagtgacacaaaagttctccttggtgattgtccagggccacctggtgtccgagggtgtgttgctgttcgggcatcagcacttctatatttgcgaaaacttcactctctccccaacaggcgacgtgtactgcacacgtcattgtctgagtaacatctccgacccctttatctttaacctgtgttctaaggacaggagcaccgaccattacagctgtcagtgccacagttatgctgacatgagagagctgcgccaggctcgattcctgctccaggacatagctttagagattttttttcataatgggtattccaaattcctcgtgttttataataatgacaggtccaaggcattcaagtctttttgttcgttccagcccagcctgaagggcaaagcaactagcgaagacacactgagtcttcgtaggtacccaggctctgatcggattatgctccagaagtggcagaaaagagacatttctaactttgaatacctcatgtacttgaatacagccgctggtcggacctgtaatgattacatgcagtatcccgtatttccatgggtgctagctgattatactagcgaaactttaaacctggccaatcccaagatcttccgcgatctctctaaacctatgggcgctcaaacaaaggaacgcaaattaaagtttatccagcggtttaaggaagtcgagaaaaccgaaggggatatgaccgtgcagtgtcactactatactcattattccagtgctattatcgtggccagctacttggttcgtatgcccccattcacccaggccttttgcgctttgcagggcggatctttcgatgttgcagatcgcatgtttcactcggtcaagtccacatgggaatctgccagccgcgagaacatgagtgacgttcgtgaattgacgcctgagttcttttatcttccagagttccttaccaactgcaacggggtggagttcggatgtatgcaggacggcacagtgttaggtgacgtgcagttgccaccttgggcagatggtgaccccaggaagtttatcagtttgcaccgaaaagcactcgagtccgattttgtgagcgctaatcttcaccactggatcgatttaatctttggctacaaacagcagggcccagcagccgttgatgccgtgaatattttccatccatatttttacggggatagaatggacctgtctagtatcaccgaccctctcattaagtcaacgatactcggatttgtaagcaattttggccaagtgccgaagcagctgtttacaaaacctcaccccgcacgcacggccgctggtaaacctctgcccggaaaagatgtgtcaacaccagtatcccttcctggccaccctcagccattcttctactccctgcagtcgctacggccaagccaagtcactgtgaaggacatgtatctcttttccttgggctcggaaagtccgaaaggagccatcggtcacatcgtgtctaccgaaaagaccatcctcgcagtggagagaaacaaagtgttgcttcccccattgtggaacagaacattctcctggggattcgacgacttcagttgttgtcttggctcatatggaagcgacaaggtgctgatgacattcgaaaaccttgcagcctgggggaggtgtctctgtgcggtttgcccctctccaacaacaatcgtgactagtggcacttccaccgtggtttgtgtatgggaactgtccatgaccaagggaaggcccaggggtctccgccttcggcaggccctttatggccacacacaagcggtcacttgtttagccgcaagcgtgacgttctccctattggtgtcgggttctcaggactgtacatgtatattatgggacctcgaccacctgactcatgtcaccaggctgccagcccaccgcgaaggaatctctgctattacgattagcgatgtgagcggtaccatcgtctcctgcgcaggcgctcacctgtcgctctggaatgtgaatgggcaacccctcgcatccattacaactgcctggggaccggaaggcgctataacatgttgttgcttgatggaaggacccgcttgggacacctcgcagattattataacgggctcccaagatgggatggtgagggtttggaagacagaggatgtcaagatgtcagtgccagggctgcagatgggccgtaagcgagaagccgcagaagccttagcacaacagtgtcaagccgagggaggcaggggagattgggggttgagctctgcttatcggaggaatccccaagggctcctgccccatagtagccaggggagggcaagcggaaatcactcatcagcggctcagccttctccttggcctatgggtctgctgtaa

SEQ ID NO: 246846 - DNA, 9554 bp, Artificial Sequence
  Description of Artificial Sequence: Synthetic coding sequence
atggaagccgaggatcttagcaaggcggaggatcggaatgaagatccaggaagtaaaaatgaagggcagctggcggctgtgcagcctgacgtgccccacgggggacagagctccagcccaaccgccctctgggatatgctggagaggaagtttctggaatatcaacagctcacccataaatcacccattgaaaggcagaagagtttactgtccctcttaccattgtttctgaaagcctgggagcacagcgtgggcataatttgcttcccatccctccagaggttggcggaagacgtgtccgaccagctagcgcagcagctgcagaaggcactagtgggcaaacccgcagaacaggcgaggctggcggctgggcagctcctttggtggaagggggatgtggaccaggacggttacctgctcctcaaaagcgtttatgtgctaactggaactgattcagagactctcggacgggtggccgaaagtggactcccagccctcctattgcagtgcctgtacctgttcttcgtcttcccccttgataaggacgaactgttggaatcagacctgcaggttcagaagatgttcgtgcagatgctgcttaacatttgtagcgatagccaggggctcgaaggactgctttccggtagcgagctccagtccttgcttattgcgaccacatgtttacgcgaacacagttgctgtttctggaaagagcctacattctgtgttctccgtgctattagtaaggctcaaaacttgtcaattatccaatatcttcaggctaccgactgtgtgagactgtctcttcagaacctatcgcgactcacggataccctgccggctcccgaggtatcggaggcagttagccttatcttaggattcgtcaaggactcctacccagtgagcagtgccctattcttggagtttgagaactcagaagggtatcccctcttattgaaggtgctactgcgatacgacggcctgacccagtcagaggtcgaccctcatcttgaggaacttttggggcttgtcgtttggttaactacctgcggccgttctgagctgaaggtgtttgacagcatcacgtatcctcagctcgagggctttaagtttcaccatgaagcaagtggggtgaccgtgaaaaacttacaggctttccaggtgctccaaaatgtatttcacaaggcctccgattcagtcctgtgtattcaagtgcttagtgtgattaggaccatgtgggcctggaacgccaggaacttcttcttgctggagtggacactccagccgatctcacagttcgttgagattatgccccttaagccagcacccgtccaagagcactttttccagttgctggaggccctggtgttcgaactacattacgttccacacgagattctgaggaaggtgcagcacctgattaaagagtcccccggaccttcgtgtaccttaatggccctccagagcatactttctatcgcgggaggagacccgctgtttactgacatctttcgggactccggcttactgggactacttctcgcccagctaaggaagcaggccaaaattatgcgtaaatctggaaataaggtatctacccccggagtccaggatccggagagggagctgacttgcgttatgctgcggattgtggtgaccctccttaagggtagtgttcgcaacgcggtggtgttaaaggatcacggaatggtccccttcattaagatcttcttggacgacgaatgttacagggaagcctcgttatcaattttggaacagctgagcgcaatcaatgcagaggaatatatgagtattattgtgggggcactctgctcctcgactcagggagaactgcaactgaaattggacctcctcaaaagccttctaaggattctggtcacccctaagggaagagccgcattccgcgtttcctccgggttcaatggactattgtcactgttgtctgatctagaaggatcccttcaagagcctccactgcaagcatggggcgcagtctctccccgtcagactcttgaactcgtgctgtataccctgtgtgcagtgagcgctgctctccattgggaccccgtgaacggatactttttcaggagaaacggactgttcgaaaagctcgccgaggacctgtgtcttttgggctgctttggcgctttagaggaggaaggcaaccttctgcgctcttgggtagacaccaaggcaaggcctttcgcggaccttttagggacagcattttcttcctccggaagtctgcctcccaggattcagagctgcctgcaaatcctggggttccttgactcaatggcctccggcaccttacatttgagaggggacctgaaagaatcattgagaactaaacaggggccagtggtggacgtccaaaaaggggagaccggctctgacccacaaaggaacttcaagcagtggccagatctggaagagcgtatggacgagggtgacgccgctatcatgcacccaggggtggtgtgtatcatggtgcggttgctgccacggctgtatcacgaggaccacccacaactgtctgaggaaatacagtgctctttggcctcacacatccagtctttggttaagtccgaaaaaaatcgccaggtgatgtgtgaggcaggacttctgggaacgctgatggcttcttgtcatcgcgctctcgtgacaagtgggagtcccctgcatagccgcctgatccgaatttttgagaaattagccagccaggccattgaaccagacgtcctgaggcaatttctgggtttgggcatcccatctagcctttccgccacaaccaagattctggattccagccatacacataggggcaaccccggatgtagcgggtcacagacagcccagggcttggcagaagggccttggcctgcagctcccgacgcagggctgcaccccggtgtgacgcaagcacctcagcccctaggcgagagccaggattctactacagccctgcagacagctctctctctgatctctatgactagcccccgtaatttgcaaccgcagcgggctgccctggcaccatcgttcgtggagtttgacatgagtgttgagggatacggttgcctgttcatcccaaccctgtccactgtgatggggacatctactgagtacagcgtgagtggcggaatagggactggtgccacaagacccttccccccaccgggtggtctgactttctcgtgctggttcctaatctcccgccacggtgcagcaaccgagggtcaccctctgcggttcctgacgctcgtacggcacttggctaggacagaacagccattcgtgtgctttagcgtttccttgtgtcctgacgacctaagcctggtcgtgtctacggaggagaaggagttccagccgctcgatgttatggagccagaggacgatagcgagccctccgctggatgtcagctacaagtccggtgcgggcagctgcttgcatgtggccaatggcatcacttagccgtcgtcgtgacaaaggagatgaaaagacactgtaccgtctcaacctgccttgatggacaggtcattggctcagcaaagatgctctatatacaggccttaccaggtcctttcctctcgatggacccatctgcatttgtagacgtgtatggttacattgccactcctcgcgtctggaagcagaagtccagtctgatttggcgccttgggcctacgtacctgtttgaggaggccatcagcatggagaccctggaagtgatcaacaaattgggcccaaggtactgcggaaattttcaggcagtacacgtgcaaggggaagatttggattctgaggcaactccttttgtcgctgaggaacgagtgtccttcggcctgcacattgcgagctcgtcaataacaagtgtggccgatatcagaaatgcatataacgaggtggactcacgcctgattgccaaggagatgaacataagctcccgtgataacgccatgccagttttcctcctccggaactgtgccggtcacttaagcggatctctccggaccattggtgcagtggcagtcggccaacttggcgtccgggtcttccacagttctcctgcggcttcatcgctggattttatcggtgggccagcgattttgcttggtctgatctctttagccactgatgaccacaccatgtacgctgcagtgaaggtgctgcatagtgtgctgaccagtaacgccatgtgcgactttctcatgcagcatatctgcggttatcagattatggcgtttctgctgcgcaagaaagcaagtctgctgaaccaccgcatctttcaattaatattgtctgtcgccggaactgtggaactgggttttaggagtagcgccatcaccaacaccggtgtattccagcacatcctgtgtaattttgagctttggatgaataccgcagataacttggaattaagtctgttctctcatttattggagatactgcaatccccgcgagaagggccaaggaatgccgaagctgcccaccaagcccaattgattcccaaactcattttccttttcaatgagccaagcctcatcccatcaaaaatatccactatcattggcattctggcttgtcagctgagagggcatttttcaacccaagatctactgcggatcggacttttcgtggtgtatacactgaaaccatcctcggtgaacgaacggcagatctgcatggatggcgcattggatccctctctgccagccggatctcaaacttctggaaaaacaatttggttacgtaaccagctcctggagatgctgctgtctgtaatttcgagcccccagctgcacctgtcgtctgaaagcaaagaggaaatgtttctcaaactaggccctgactggttcttgttgctcctccaggggcatctacacgcatccactacagtgctggccctcaagctcctcctttatttcctggcgtctcctagcttgcgaacccggttcagagacgggctgtgcgccggatcctgggtagaacgatcaacagagggggtcgacatcgtaatggataacttaaagagtcagagtcccctgcctgaacagtctccatgtcttttacctggattcagagtcctgaacgacttccttgcacaccacgtgcacatccccgaggtctatcttatcgtgagcacctttttcttgcagactcctttgactgagctgatggacggcccaaaggacagcctggatgctatgctgcaatggcttctccagaggcatcaccaggaagaggttttgcaggccggactctgcacagagggcgcattgctgcttctcgaaatgctcaaagctacaatgtcacagccgctcgcaggaagcgaggatggtgcatgggcgcaaacttttcccgcaagcgtgctgcagtttctctcactggtccacagaacatatcctcaggaccccgcatggagagctccagagtttctgcagacattagcgatcgccgctttccctctcggagctcagaaaggggtgggggcagaatccacgaggaatacctctagcccagaggctgcagccgagggagactctaccgtggagggcctgcaagctccaacaaaagctcatccagctcgcaggaaattaagggagttcacccagctgctccttcgggagctgctgctgggggcttccagccctaagcagtggctgcccctggaagtattactggaagccagccctgatcacgcaactagccagcagaagcgcgattttcagtccgaagtactgcttagcgccatggagctgtttcatatgactagtgggggagatgcggctatgttccgagacggcaaagaaccccagcctagtgcagaggcggctgccgctccctccctggctaacataagttgcttcacgcagaaattggtcgaaaagctatacagcggaatgttcagcgcggatcctagacacattttgctgtttattctcgaacacatcatggtggtgattgagacagcgtccagccagcgggacacagtccttagcaccctatattcttccctcaataaggtcatcctgtactgtctttccaaacctcaacagtccctgtccgagtgcctaggtctgctgtccattctagggtttctgcaggagcactgggatgtggtttttgctacctacaacagcaacatctcattcttgctctgtctgatgcactgtctgctgcttctaaacgagagaagctatcctgagggctttggtctggaacctaaacctaggatgagtacctaccaccaggtattcctcagccctaatgaggatgtgaaagagaagcgcgaggatctcccaagtctgagtgacgttcagcataatattcaaaagaccgtgcaaactctttggcagcagcttgttgcccagaggcagcaaacactcgaggacgcattcaaaatcgaccttagtgtgaagcccggagaaagggaggttaaaatcgaggaagttactcccttgtgggaagagacaatgctgaaagcctggcagcactacctcgcaagtgagaagaagtctctcgccagccggtccaatgtcgcgcaccactcaaaggtaaccctgtggtccgggtctcttagtagcgctatgaagctcatgcccggacgtcaagcaaaggatcctgaatgtaagaccgaggactttgtgtcctgcattgaaaactaccgtcgtcgagggcaagaattatacgcaagtttatacaaggatcacgtgcagagacgcaagtgtggaaacatcaaagcagccaacgcatgggcacggatccaggagcaattattcggagagctgggcctttggagccagggtgaggaaacgaagccatgctccccttgggagctcgattggcgcgaggggccagccagaatgcggaaacgaattaaacggctgagtcctttggaagcattgtcttctggcaggcacaaggaatcccaggataagaatgatcacatttcgcagaccaatgccgagaaccaggacgaactcacccttagggaagctgaaggggagcccgacgaggtcggagttgactgtacacagctcacattcttccccgcactacatgagtctctccactccgaggatttccttgaactctgcagagagcgccaggtgatccttcaggaactgctggacaaggaaaaggtaacccagaagttctcactcgtgatcgtccagggacacttggttagcgaaggcgtgttgctgtttggtcaccagcacttctatatttgcgagaattttactctcagtccaactggcgacgtgtattgtacgcgtcattgcttgtcaaacatttcggaccccttcatcttcaacttatgcagtaaagacagaagtaccgaccactactcatgccaatgtcacagctatgccgacatgcgggagctgcgacaggctcgttttctcctccaggacatcgctctggaaattttctttcacaatggctacagtaagttcctggtcttttacaataacgataggtccaaagcgtttaagagcttctgctctttccagccctcccttaagggtaaggcaacaagcgaagacaccctaagcctgcgtcgctatccaggctctgataggatcatgctgcaaaagtggcagaaaagggatatttcaaactttgaatatcttatgtacctaaataccgccgctggtagaacctgcaatgattacatgcagtatcccgtttttccttgggtcctggctgattacacctctgagacacttaatctcgccaatcctaagatctttcgcgacctgagcaaaccaatgggggcacagacaaaagagcgaaagttaaagttcatacaaagattcaaagaagtagaaaagacggaaggtgatatgactgtgcagtgccactactatacccactactccagcgccatcatcgtcgcatcatacctggtgaggatgcctccttttactcaggctttttgcgctctccagggaggctccttcgatgtagcagatagaatgttccattcagtcaagtccacttgggaaagtgccagcagggagaatatgtctgatgtgcgcgaactgacccccgagttcttctatctcccagagttcctcactaattgcaatggggtggagtttgggtgcatgcaggacggaaccgttctgggcgacgttcagctcccaccatgggccgatggagacccacggaaatttatctctcttcatcgcaaagcgctggaatctgactttgtatccgcgaatctccatcactggatcgacctcatttttggctataagcagcaagggccagcagcagtcgatgcagtgaacatatttcatccatatttctacggggatcgcatggatctatcatcaataacagatcccctgatcaaatctaccatcttaggctttgtgagcaacttcgggcaggtgcccaagcaattattcaccaagccacacccagcacgcaccgccgctggcaaacctctgcctggaaaagatgttagcactccggtgagtctccctgggcatccccagccatttttctactccctccaatctctgcgcccatctcaggttaccgtgaaggacatgtaccttttctccctcggatctgagtcgcccaaaggcgcaatcggacatattgtgagcaccgaaaaaacgatcttggcggtggagcgcaacaaggtgctgttacctcccctgtggaaccgaacattcagctggggatttgatgacttctcctgttgtcttggcagctacggttccgacaaagtgcttatgacgtttgagaacctggccgcttggggcagatgcctgtgcgccgtgtgcccgtcacctaccacgatcgttacctccggtactagcacagttgtgtgtgtgtgggaattgtcaatgaccaaaggtcgcccaagaggccttcggctcaggcaggccctctatggccacacgcaagcagtgacttgtctggccgcatcggttacttttagcttattggtctctggtagccaggattgcacttgtatcctgtgggatctagaccatcttactcacgtgacgcgcctaccagctcatcgcgaagggattagtgccataaccattagcgatgtgtcagggaccatcgtttcctgcgcaggtgcccacttaagtctttggaatgtgaacggacagccactggcttccattacaaccgcttggggcccagaaggcgcaatcacttgctgttgtctaatggagggacccgcttgggacacgagtcagatcatcatcactggctcccaggatggaatggtgcgagtatggaagacggaggacgttaaaatgtcagtgccgggacggccagccggagaggagccccctgctcagcccccaagtccacggggacataagtgggaaaaaaacctcgctctttcccgcgagcttgacgtgtctattgccctgacaggaaagccgagcaagacttctcccgctgtcactgccctggcagtaagccggaatcacacgaaattgctcgttggggatgagaggggccgaattttttgttggagcgcagacggcta

SEQ ID NO: 246847 - DNA, 1965 bp, Artificial Sequence
  Description of Artificial Sequence: Synthetic coding sequence
atggaagccgaggacttatcaaaggcagaagatcggaacgaagatccaggttccaaaaacgagggccagctggccgcagtccaacctgacgtgccccacggcggtcagagcagcagtccaaccgcactatgggatatgcttgagcgcaagtttctcgaatatcagcagctcacccacaagagcccgatagagagacaaaagagcttgctgtctttgcttcctctgttcttgaaggcatgggagcactctgtgggtattatctgcttcccgagtttacagaggctcgctgaggacgtaagcgaccagctggctcaacagttgcagaaagccttggtcggaaagcctgcagaacaggcacgcctcgctgcgggtcagctcctgtggtggaagggcgacgtggaccaggacggctatctcctgctgaagtctgtatacgtgctgacaggcaccgattcggaaacactgggccgagtggccgagagtggccttcccgctctcttgctgcaatgcctatacctatttttcgtgttccctctggataaggatgagctcttggaatcagatcttcaagtacagaagatgttcgtgcagatgctcctcaacatctgctcagattcacagggattagaaggccttctgagtggatctgaacttcagtcccttctcatcgctaccacttgcctgcgtgagcatagttgctgtttctggaaggagcccacattctgtgtcttgcgggctatttctaaggcccagaatctgtccatcatccagtacctgcaagctactgactgcgtgaggctgagcctccaaaacctctccaggttaaccgatacccttcccgcacccgaggtcagtgaagccgtatctctgattctggggtttgtgaaagactcttatcccgtatcttctgcactattcttagagtttgagaattccgaaggttaccccctgctcctcaaggtgctgttgcgctacgacggcctgacccagagtgaagtggaccctcatctcgaggagcttctcgggttggtggtgtggctcacgacatgcgggcgaagcgaattgaaagtctttgattctatcacatatccccagctggaaggctttaaattccaccacgaagccagtggggttactgtgaagaatctccaagcttttcaagtcctgcagaacgtgttccataaagctagcgactctgtgttatgcattcaggtgctgtccgtcatccggacaatgtgggcatggaacgcccgtaacttctttctccttgagtggacgctccaacctatttcccagttcgttgaaattatgcctctgaaaccagccccagtccaggaacactttttccagcttctcgaggctctggtgttcgagttgcactatgtgcctcatgaaattctaaggaaagtgcagcaccttatcaaggagagtcccggtccatcttgcacactgatggccctacagagcattttgtccatcgcgggaggcgacccgctcttcactgacatcttccgagactccgggctcctcggattgttgttagctcagctgcggaaacaggcaaaaattatgcgtaagagtggaaataaggtaagcacgccaggagtccaggaccctgagcgcgagctgacatgtgtgatgctgagaatcgtagttacgttactgaaagggtcagtccggaatgccgtggtactcaaggaccacgggatggtgccatttatcaagattttcttagacgacgagtgctaccgagaggccagtctttccatcttagaacagctctccgcaataaacgctgaagaatacatgagcataatcgtcggagcactgtgtagtagcacccagggagaacttcagttgaagcttgacttgctgaaggtaatatcttctcccccattgcggcttgcttctctgtggatttgcacgaagagatccacttttgctcaagcctttgtcttcatgtag

SEQ ID NO: 246848 - DNA, 1659 bp, Artificial Sequence
  Description of Artificial Sequence: Synthetic coding sequence
taagacgacacggtagtgtgggcagaggagtgcgtggcgtgtgctaactggctgtggatgaacacagccgacaatctggagctgagtctcttttctcatctcctggagatactgcagagcccccgtgagggtcccagaaatgccgaggccgcacatcaggcacagctcattccaaagctaatattcttgttcaacgaacccagcctaattccgagtaagatctctactattatcgggatactggcttgccagctgcgaggccacttttcaacccaggatttattacggatcggcttgtttgttgtgtacactctgaaaccttcctcagttaacgagaggcagatttgcatggacggcgctctagacccaagtctgccagcaggcagccagactagcggaaaaacaatttggttgagaaatcaacttctggaaatgctgctgtcagtgataagtagtccacagctccacctcagcagtgagagcaaagaagagatgtttttaaaactggggccagattggtttcttctgctcctgcagggacacctacatgcttcaactaccgttctagccttgaagctgctgctctatttcctcgcatccccttctctgcgaacacgcttccgggatggactctgcgcgggttcctgggttgagagatctaccgagggggtggatatagtcatggataacctgaaaagccagtccccgctccctgaacagtccccttgtctgctgccgggattccgagttcttaatgattttctggcccaccatgtgcacattcccgaggtgtatctgattgtcagtacttttttcctacagacccccctgactgaactaatggatggtcccaaagactccttggatgctatgttgcagtggctgctgcagcggcaccatcaggaagaggtgctgcaagcaggattgtgcacggagggagcgcttttgctgttggaaatgctgaaggcgacaatgagccaaccgctggccggtagcgaagacggcgcttgggcacagacctttcccgctagtgttcttcagttcctgtccctggtccacagaacctacccccaggatccagcttggagagcacccgaattcttacaaaccctggctatcgctgcctttcctctaggagctcaaaagggtgtgggcgctgaatccacacggaatacgtcctcccccgaggctgccgctgaaggcgattccactgtcgagggcctccaggccccaactaaggctcacccagcacggcgtaagctacgggagtttacccaattgctgttgcgtgagctcttgctgggcgcatcctccccaaaacagtggcttccgcttgaggtgcttttagaggccagcccagaccatgcaactagccagcagaaacgggacttccagtccgaagtgcttctgagcgcgatggaattgtttcatatgacttctggcggtgatgcagccatgtttcgcgatggcaaggagccgcagccatcagcagaagcagctgctgctcctagtcttgccaacatctcttgcttcactcagaaactcgtcgagaaattgtatagcggcatgttttcagcggatccccgacacatcctgctgttcattttggaacacatcatggtaatttccgccccactgcaggctcgggacttcagctag

SEQ ID NO: 246849 - DNA, 3129 bp, Artificial Sequence
  Description of Artificial Sequence: Synthetic coding sequence
atggaggctgaagatcttagtaaagcagaagaccgaaatgaagacccgggatcgaaaaatgagggacaattagccgctgtgcagcctgacgtcccacacggcggacaatccagtagcccaaccgcactgtgggatatgctggaaaggaagttcctggaatatcagcagctcactcacaagagcccgatcgagcggcagaaaagcctcctgtctctcttgcctctgttcctgaaagcatgggagcattctgtgggcattatttgttttccctccttgcaacgccttgcggaggacgtctccgaccagttagctcagcagctgcagaaagctctggtaggaaaacccgctgaacaggccagattagctgctgggcagctcctgtggtggaagggggatgtggatcaggatggttatctgcttctcaaatctgtttacgtgcttacaggtacagattccgagacacttgggagggtggcagaatcagggctccccgctctcctactccagtgtctgtatctgttcttcgtgtttcccctcgacaaagatgagctgctggaatccgatctccaggtccaaaagatgtttgttcaaatgctccttaacatctgcagtgactcccaaggattagaggggctgctctccggttctgaactgcagagcctcctgattgccaccacctgcctaagagagcacagctgttgcttctggaaagagccaactttctgcgtcctgagggcaattagtaaagcccagaacctctcaattatacagtacctccaggctacagactgcgtgaggctgagcctacagaatctatcacgcttgacagacaccctgccagcacctgaggtgtctgaagcagtgagtttaattctgggattcgttaaggactcttatccagttagctctgccctttttctcgagtttgaaaactccgaaggttacccactgctcttaaaggtactgttacgctacgacgggctcactcagtccgaggtggatccccatctggaggaactattaggactggtagtctggctgacgacttgcgggaggtctgaactcaaagtcttcgatagcataacatacccccagttggaggggttcaagtttcaccatgaggccagtggggtcactgttaaaaacctacaagcatttcaggttctacagaatgtatttcacaaggcatcagactccgtgctgtgtattcaggtgttgtctgtcattcgaacgatgtgggcctggaatgccagaaattttttcttacttgagtggactcttcagccgatttcacagttcgtcgagattatgcctttaaagcccgcaccagtccaggagcacttttttcaactcctggaagctctcgtatttgaattgcactatgtgccgcatgagattctcagaaaggtccagcatttgatcaaggaatctcccggtcccagctgtactctgatggccctgcagagtattctttctatagcgggtggtgatccactattcacagatatctttagggattcgggcctgctgggcctcttgctggctcagctccgcaagcaggccaaaataatgcggaaaagcgggaacaaagtgtccacgcccggagtgcaagatcccgagagggagctgacctgtgttatgctgcgtatcgtggtaacactcttgaagggctctgttcggaacgctgtcgtcctcaaagaccatgggatggtcccattcattaaaattttcttggacgatgaatgttatagggaggctagtcttagcattttggagcaactgtcggctataaatgcagaggaatacatgagtatcattgtcggtgcgctctgcagctccacccaaggggaacttcagttaaaactggacctgctgaaaagcctgctcaggattctggtgacccccaaaggtagagctgcttttagagtgtcctcaggattcaacggactgctgagtctcttgtccgacctggagggcagccttcaagaaccgccactgcaggcctggggggcagtttcaccacggcagactctggagcttgttctgtataccctctgcgcggtgtccgcagctctgcattgggaccctgtcaacggatacttctttcggagaaatggcctcttcgaaaaacttgcagaagatctgtgcctgctcggctgctttggagctctggaggaggaaggaaatctgctgaggagctgggtggatacgaaggccaggcctttcgccgacttacttggaaccgcattttcaagctctgggagcctaccaccaagaatacagagttgtctgcagatactgggcttcctggacagcatggcgagcgggactctgcacctccggggagatctgaaagaatctctgcgaacaaagcagggcccagtcgtggacgtacagaagggggaaacggggagcgacccccagcgcaacttcaagcagtggcccgacctggaggagaggatggatgaaggagatgcagccattatgcatccgggtgttgtctgtatcatggtaagactcctcccacggctgtaccacgaggaccacccacagctctctgaggagattcagtgttcccttgcgagccatattcagtcactcgtgaagtcggaaaaaaaccgacaggtaatgtgtgaggccggactacttggaacactcatggccagttgccacagggcacttgtgacgtcaggtagccccctgcacagtagattaattcgtattttcgaaaagctggcctcgcaggctatcgaaccagatgtgctgagacagtttctggggctcggcataccatcgtccctgtctgctaccactaaaatattggacagctcgcatacacataggggtaacccgggttgttccggcagccaaacagcccagggcctagccgaagggccttggcccgctgcccctgatgctggcctccaccccggagtcacgcaggcaccccagcctctgggggagtctcaggattccacaacagctctccagaccgctttgtcgcttatttccatgacttccccgcacatttggaagcccaacatctggaaagataacctcgcacagaagcctgtggcgggtgatgctgctcagtgcaacattttccctcccgcttcgagtgttctctag

SEQ ID NO: 246850 - DNA, 9530 bp, Artificial Sequence
  Description of Artificial Sequence: Synthetic coding sequence
atggaagcagaggacctgtccaaagccgaagatagaaatgaggatcccggttcaaaaaacgaaggccaactggctgccgtccaaccagatgtgccccacggtgggcagagctcttcccccactgcgctctgggacatgctcgaaagaaaatttctggaataccaacaactgacacataagagtcccatcgagaggcagaagagtcttctaagcctactgcctctctttctcaaggcttgggaacactccgtcgggattatctgcttcccaagcttgcagagactagcagaggatgtgtcggatcagcttgcacagcagctgcagaaggccttagtgggtaaacctgcagagcaggccaggttggccgcaggccagttgctgtggtggaagggagatgtagatcaggacggctacctactgctgaagtcggtttacgtgttaacgggaacagattcagaaactctgggacgcgtggcggagagcggcttacccgcattgctgctccagtgtctatacctgttttttgtatttccgctggacaaggacgagctattggagtccgacctacaggtgcagaagatgtttgtgcagatgcttctcaacatttgctcagactcccagggcctggaagggctgctgtccggcagcgagctgcaatctttgttaattgcaaccacgtgcttgcgcgagcatagctgttgcttctggaaagaacccaccttttgtgtcttacgagctatatcaaaagcgcagaatctgtccattatccaatatcttcaagctactgactgcgttcgcctctctctacagaacctgagtaggctgacagacacactgcccgctccagaggtgtcagaagcagtgtccttgattctcggctttgtgaaggacagctatccagtcagtagtgcactctttttagaattcgaaaatagtgagggctatccattgttgttgaaagttcttttgagatatgacggcctgacccagagcgaggtggaccctcacctggaagagctgctgggccttgtggtgtggctaaccacatgcggcagatctgaattaaaagtgtttgacagcatcacctaccctcaactggagggcttcaagttccaccatgaggcatctggtgtgactgtaaagaatctgcaagcatttcaagtcctacagaatgtcttccacaaagccagtgactccgtgttatgtattcaggtcctgtcggtcattagaactatgtgggcgtggaatgccaggaatttctttttactcgagtggactctgcagcccatctcccagtttgttgagatcatgcccctcaaaccggctccagtgcaggagcactttttccagttgcttgaggcattggtgttcgagctgcattacgtacctcacgaaattctccgtaaagtccagcatctcataaaagaaagccccggaccgtcatgcacccttatggcactacagtctatcctgtccattgcgggaggcgatcccctgttcacggatatcttccgggacagcggattgctcggactactactggcacagttgagaaagcaggccaagataatgagaaaatctggcaacaaagtgtctacaccaggagtacaggaccccgagcgcgagttaacctgtgtgatgctgaggatcgtcgtcactctgcttaaagggagcgtccggaacgcagtcgtgttgaaagaccatggcatggtcccttttataaaaatattcctggacgacgagtgttaccgtgaagcctcactctccatccttgagcagttgagcgcaatcaatgccgaggaatatatgagcatcattgtcggagccctgtgttctagtactcaaggagagctgcagctgaagctcgatttgttgaagtcattgctgaggattctggtgaccccgaagggcagagccgctttccgagtgtcatcaggctttaacgggctgctgtccctgctgtccgacctagaagggagcctacaagagccgccattacaggcttggggagcagtttctcccagacagacactggagcttgtcctttacacgctgtgcgctgtatccgccgcacttcattgggatcctgttaacgggtacttctttcgccgaaacggtcttttcgaaaaactcgctgaagacctctgtttactcgggtgtttcggtgctctggaggaagaaggcaatttgctgcggagctgggtggatacaaaggcgcgaccgttcgccgatttgctgggtacagcttttagctcttccggctcacttcctccacgcattcagagctgtctccagatactgggattcttagattcaatggcttccgggactttgcacttacgaggggatcttaaggagagcttgcgtactaagcaaggacccgtggtcgacgtgcaaaaaggtgagaccggtagtgacccacagcggaacttcaagcagtggcccgacctggaagaaagaatggatgagggtgatgctgctatcatgcaccctggtgtggtttgcataatggttagattactgccaagactctatcacgaggaccatccccaactctcagaggagattcagtgtagcctggcctctcacatccaaagtctcgttaagagcgagaagaacagacaagtgatgtgcgaggccggattactggggacccttatggcctcttgccaccgtgccctcgtgacctctggcagtcctcttcactcccgactcattcgtattttcgaaaagcttgcctcccaagctatcgagcctgatgtgttacggcagttcttaggccttggcatacccagttcgttgtctgccactactaagatccttgattccagccacacccatcggggaaaccccggatgtagcggctcacagaccgcccagggactggctgagggcccatggccagcggcacctgacgccggactgcacccgggtgtcacccaggcccctcagcccctgggagagagccaggattcaacgacagccctgcagaccgcccttagtcttattagcatgacaagccctcgtaacctgcagccccaaagggctgcactggcaccatcatttgtggaattcgacatgagcgtggagggctatggatgcctgttcatacctactctctctacggtaatgggcacatccactgaatactcagtgtctggtgggattggcaccggtgctaccagacctttccctccgccagggggattgactttttcgtgttggttcctcatttccaggcacggcgcagcaactgagggacatccgctgcgatttctcaccctggtgcgccacctcgcgaggacagaacagccatttgtgtgcttctccgtgtccctctgccccgacgatctctccctcgtagtgtccaccgaagaaaaggagtttcaacccctcgatgtgatggaaccagaggacgattccgagccgagcgccggatgtcagctgcaggtgagatgcgggcaactgttggcctgcggacaatggcatcatctggccgtggtcgttaccaaagagatgaagagacattgcaccgtgtccacttgcctcgacggacaggtgataggcagcgcgaagatgctgtatatccaggcattaccaggcccatttctgtcaatggatccatccgctttcgtcgatgtctacggctatatcgcaactcccagagtttggaaacagaagagtagcctgatttggcgcctgggccctacctacctgttcgaggaggccatctcaatggagaccctggaggtcatcaataaactgggacccaggtactgtggcaattttcaggctgtccacgtacaaggtgaggaccttgattccgaggccaccccatttgtcgcagaagagagagtgtcatttggccttcacattgcatctagcagcataacaagcgtggcggatatccggaatgcctataatgaagtggactccagacttattgcaaaggagatgaacatcagtagccgggataatgcgatgccagtctttctcctaagaaactgcgcaggacatttatctggatccttaagaacaatcggcgctgtcgcggtcgggcaactgggcgtgcgcgtttttcatagctcacctgccgcaagcagcctggattttattggcggaccagccatcctgctcggactgatctctctagctactgatgaccacactatgtatgccgctgtgaaagtgctacacagtgtgctcacctcgaacgctatgtgcgactttctcatgcagcatatttgcgggtaccagataatggccttcctgttgcgcaagaaagctagtctgctgaatcacagaatatttcagttgatcttgagtgtcgctggcacagtcgagctcggattccgttcaagcgcaataaccaacacaggtgtctttcagcatattttgtgtaacttcgaactctggatgaataccgcagacaaccttgagctgtctttgttctcacacctgctggagatactgcagagtccacgagaggggccacggaatgctgaagcagcacaccaggcccagctgattcctaagctgatctttctgtttaacgaaccttccttgatccccagcaaaattagtaccataataggcatattagcctgtcagctgcgtggtcatttttcgacccaagaccttctacggattggcctatttgttgtgtacacacttaaaccatcaagcgttaacgagagacagatctgtatggatggtgccctcgatccaagcctgccagcaggctctcaaacatccggaaagacaatttggctaaggaaccagcttctcgaaatgctgttgagcgtgatctctagtccacagctgcacctgagcagcgagagcaaggaagagatgtttctcaagctgggcccagattggttcttgctgctattgcagggacaccttcatgcctcaacgacagtgttagctctcaagctgcttttgtatttcctggcttcaccttctctgcggacccgctttagagacgggctgtgcgccggttcttgggttgaacggtcgacggagggtgtggacatagtgatggacaatcttaagagccagagtccacttccagaacagagcccatgcttgctgcctgggttcagggtcctgaacgattttctggcccatcacgtccatataccagaggtttatcttatcgtttctacttttttcctgcaaacacctttaaccgagcttatggacgggcctaaagattccctggatgccatgctgcagtggctgttacagagacaccatcaagaagaggtgcttcaagctggcctgtgtacagagggagccctattgctcctggaaatgttgaaagcaactatgtcacaaccgctcgcaggatccgaggatggcgcatgggctcaaacattcccagcatccgtgcttcagttcctgtccttggtgcatcgaacctacccccaggaccccgcatggcgcgctccagaattcctgcaaaccctcgcaattgcagcctttcccctgggagcccagaagggagttggcgcagagtctacccgtaacaccagctcacctgaagccgcagcagagggagatagcaccgttgaaggcctacaagctccaactaaggcccaccctgcccgtaggaaacttcgcgagtttacccagttgctgcttagagagctgctgttgggtgcctcaagccctaaacagtggctgcctctcgaagtgctgttggaggcgagccccgatcatgcaacctcacaacagaagcgggactttcagtctgaggtgctcctttccgctatggagttatttcatatgacgtctggtggagacgcagccatgtttagggacggcaaggaaccccaaccttcggctgaagctgcagccgctccttcactggcgaacatttcttgcttcacccagaaactggtggagaagttgtactctggtatgttttccgccgatcctcgtcacattttgttgtttattcttgagcatataatggtggtcatcgagacagcgtcctcgcagagagatactgtgctgtctaccctctacagttccttaaataaggtgatcctttactgtctaagcaagcctcagcaaagcctctcagaatgcctgggcctgctgtccatccttggttttctccaggaacactgggatgtggtcttcgcgacctataatagtaatattagcttcctcctttgtttgatgcactgcctgcttttgctaaatgaacggtcttaccctgagggttttggcctcgagcccaagcccaggatgtcaacataccatcaggtcttcctgtccccaaacgaggacgtgaaggagaagagagaggacctcccgagcctgtctgatgtccagcacaacatccagaaaacggtgcagacgctttggcagcagcttgtggctcagcgacagcagaccctggaggacgccttcaaaatcgacttaagcgtgaagcccggtgagagagaggtgaaaatagaggaggtaacaccactgtgggaagaaactatgctaaaagcgtggcaacactacctcgctagcgagaagaagagtctggcttcccgtagcaatgtggcccaccatagtaaagttactttgtggagcggaagtctctcatctgcgatgaaactcatgcccggtagacaggccaaggatccagaatgcaaaacagaagatttcgtctcttgtattgaaaattacagacgcagagggcaggagctgtatgcaagcttgtataaggaccacgtacagagaaggaagtgcggaaacatcaaagctgccaatgcgtgggcaagaatccaggagcaactctttggggagctaggcctctggagccagggcgaagagactaagccctgttcaccatgggagctggattggagggaggggcctgcacgcatgaggaagcgcatcaagagactttcacctcttgaagcgctctcatcaggacgccacaaagagagccaggataagaacgaccacataagccagaccaacgccgaaaaccaggacgaactgaccctgagggaagctgaaggagagccagatgaggttggcgtggattgcacacagcttacattctttcctgcacttcatgagtccctgcactcggaagacttcctggaactttgtcgcgagcggcaggtgattctccaagagctgctggacaaggaaaaagtgacacagaaatttagcctggtgattgtacagggccacctcgtgtcagaaggcgttctgctgtttggacaccaacacttttatatctgcgagaatttcacgctgagccccactggagatgtatactgcactcgacactgcctcagtaatatatccgacccatttatctttaatctgtgctccaaggacagatccaccgatcattactcgtgccagtgccacagctacgccgatatgagagaactgcggcaggcacggtttctgctgcaggacatcgcgcttgagatattctttcacaacgggtactccaaattcctggtattctacaacaatgaccggagcaaggcatttaaatcattttgctccttccagcccagcctcaaaggcaaggctacctcggaagacaccctttcccttagacggtaccccggatccgatcgcatcatgctccagaagtggcagaagcgcgatatctcgaattttgagtatttgatgtatctgaacacagctgccggtaggacttgtaacgattatatgcagtaccccgtatttccatgggtgctggcagattacacgagcgagaccctgaacctggctaaccccaagatcttcagggacctgagcaaacctatgggggctcagaccaaagaacgtaaactgaagttcatccagagatttaaggaagtggagaagacagaaggagatatgaccgtgcagtgtcattactacacacactatagttccgccattattgtggcctcttacctcgtgcggatgccaccattcacccaggctttttgcgccctgcagggcggttccttcgacgttgcggataggatgtttcacagtgtgaaatccacctgggagtccgcttccagggagaacatgtcggatgtgagggaattgactcccgagttcttttacctgccggagttcctgaccaattgcaacggggtagagttcgggtgcatgcaagatggtaccgtattaggcgacgtgcagctacccccatgggcagatggcgatccaaggaagtttatctctcttcacagaaaagctctggagagtgacttcgtgagcgctaatttgcatcactggattgacctgatttttgggtataaacagcagggcccagccgctgttgatgcggttaacatttttcacccctacttttacggtgacaggatggatctcagttccatcaccgacccactcataaaaagcacaatactcggcttcgtatccaacttcggacaggtgcctaaacagctgttcacgaaaccccatccagccaggaccgcagctggaaagcccctcccaggcaaagacgtgtcaactccagtaagcctgccagggcaccctcagccatttttctactctttgcagagtctcagacccagtcaggtgaccgtcaaagatatgtatctttttagtctaggctccgaatcccctaagggtgcaatcggtcatatagtcagtaccgagaaaactatactggcagtggagaggaataaagttttgctcccccctttatggaaccggactttctcatggggttttgacgacttcagttgttgtcttggttcctatgggagcgataaggtcctcatgacgtttgagaatttggcggcatggggcagatgcctgtgcgccgtctgtccctcccctaccacaattgtgacgagcggaacctcaactgtggtgtgcgtttgggagctttccatgactaaagggagacctcgcggactgcggcttcgtcaggctctgtatggccatacacaggctgtgacgtgcttggctgccagcgtgacctttagcctgcttgtgtcaggctcccaggactgtacttgcatcctatgggatctggatcacctcacccatgtgacacgactcccagcacatcgcgaaggcattagcgcaattaccatctcagatgtatccggaactattgtgagctgcgcgggagctcacttgagcctgtggaacgtgaacggtcaaccactggctagcatcacgactgcctggggcccagagggagcgatcacctgctgttgtctgatggaagggcctgcttgggacactagtcagataattatcaccggtagccaggacggaatggttagagtctggaagaccgaagacgttaagatgagtgttcccggactgcaaatgggaaggaagcgagaagccgcagaagctctggcgcagcagtgccaggcagagggcggtcgcggtgactggggtttgtccagtgcctatcgaagaaatccacagggtctgctaccacactcatcccagggaagagctagtgggaaccatagctctgccgctcaacctagcccttggccgatgggactgctgta

SEQ ID NO: 246851 - DNA, 3159 bp, Artificial Sequence
  Description of Artificial Sequence: Synthetic coding sequence
ttgaactccgaccttctgtgccacggtatggaggccgaggatctgagcaaagctgaggaccggaacgaggatcctggatctaagaacgaggggcagctagccgcagttcaacctgatgtcccccatggtggacaatcttccagtcccacagccctgtgggatatgctggaacgcaaattcttagagtaccaacagcttacgcataaaagtccaatagagcggcaaaagagcttactatctctattgccgctcttcctcaaagcttgggaacatagcgtgggcatcatttgtttcccatctcttcagcgcttagccgaagacgtatccgaccagctggcgcagcaactccagaaggcgctggtgggtaaaccagccgagcaagctcgattggcagccggtcagctactgtggtggaagggggacgtggatcaggacgggtacctgctgctcaaaagtgtatatgtgcttactggcaccgactcagaaacccttggtagagttgcggagtccggactgccggctctccttctgcaatgtctatacttattcttcgtcttccccctagataaggacgagctgttggagtctgacctacaggtacaaaaaatgtttgtgcagatgctgctgaatatatgtagcgattcacagggtctcgaaggattattgtccggttccgaactccagagcctgctaatcgcaactacatgcctccgggaacactcatgctgtttttggaaggagccaaccttctgcgtgctgagggcaatttctaaagcccagaatttgagtatcatacagtacctccaggccaccgactgtgtacgcctgtcccttcaaaatctctcccgattgaccgatacgctccccgctcccgaggttagcgaggcagtgtcgttgatactgggattcgttaaagacagctatcctgtgtcctccgctttgttcctcgagttcgaaaatagcgaaggctaccccttgctgctgaaggttctcctacgctatgacggtctaactcagtctgaggttgacccccacttggaagagctgctggggttggtggtgtggcttaccacgtgtggcaggtctgaactcaaggtatttgattcaatcacctatcctcagcttgaggggttcaaattccaccacgaggcttccggcgtaactgttaaaaatctgcaggccttccaggtgctgcagaacgtgtttcataaagcgtccgatagtgtcttgtgcattcaagtgttgtccgtgattcggacaatgtgggcatggaatgctaggaatttttttttactcgaatggacgctgcaacctatcagccaatttgttgagatcatgccactgaagccagccccagtacaagaacattttttccagctgctggaagctttggtgtttgaactgcattatgtccctcacgagatactcaggaaggtccagcacctgatcaaggaatcaccgggtccgtcatgcacgttgatggctctgcagtccatcctgtccatcgctggaggggacccgctgtttacagacattttccgggattcaggactactgggcctcctactggcacagctgagaaaacaagcgaagattatgagaaaaagcggaaacaaagtgagtacacctggcgtgcaggaccctgagagggagctcacctgtgtgatgctcaggattgtggtcacgttgttgaagggttccgtgaggaatgcagtggtgctcaaagatcacggcatggtgccttttatcaagattttcctagacgatgaatgttaccgggaggctagccttagcattctggaacagttgtccgccattaacgctgaagagtatatgtcgattatcgttggcgcactgtgcagtagcacacaaggggagcttcagctgaagttggatctgctcaaatcgctgctgagaatcctcgtgaccccgaaaggacgggctgcatttagggtgtctagcggctttaatggactcctctccttgctgagtgacctcgaaggatccctccaggaaccacccctacaggcatggggcgcagtgtctccccgacagaccttggaactagtgctgtacactctttgtgctgtaagcgcagctctgcattgggatcccgtgaacggctactttttcagaagaaacggcttgtttgaaaagctcgcagaagatctgtgtcttctcgggtgttttggggctcttgaagaagagggcaacctcctgcgttcctgggtagacacaaaggcaaggccgtttgctgacttgctgggcaccgctttctcttcttctgggtctcttcctcctcgaatccagtcctgtctccaaatccttgggttccttgacagcatggcgtctggtaccctccatctgagaggagacctcaaggagtctttgcgcaccaaacaagggccagtcgtcgatgtccaaaaaggcgaaaccggttcggacccgcagcgcaatttcaaacagtggcctgacctagaggaacgcatggatgagggcgatgccgctattatgcaccccggagtggtctgcattatggttcggctgctgccccgactgtaccatgaagatcacccccaacttagcgaggaaattcagtgcagtctggcaagccacatccagagtctcgtcaaatccgaaaagaaccgccaggtcatgtgtgaggccggtctgcttggaaccctgatggccagttgccaccgagcactcgttaccagtggcagcccgctccattctcgccttatcaggatcttcgaaaaattagcatcccaggccatcgaacctgacgtgttgaggcagttcctggggctggggattccgtcatcccttagcgctactaccaaaatactggatagctcccatacccatcgtggcaatccaggttgtagcggaagccagacggctcagggtctagctgaggggccttggccagcagccccagacgcgggactgcatcccggtgtaacgcaagcccctcagcccttgggcgaaagccaggatagcaccacagcgttgcaaacggctctgtccctcatctccatgacttcccccgtggctggtagtcaaacctcaggcaagaccatctggctccgtaaccaactactggagatgctcctgtccgtaattagcagcccgcaactgcatctgtcatctgaatag

SEQ ID NO: 246852 - DNA, 1875 bp, Artificial Sequence
  Description of Artificial Sequence: Synthetic coding sequence
atgctgcagaagtggcagaaacgggacatttccaatttcgagtatcttatgtacttgaatacagcagccggacgaacatgtaacgactatatgcagtatcctgtctttccatgggtgctagctgattacacaagcgaaacacttaacctggccaaccccaaaatcttcagagacttgagtaagcccatgggggctcagaccaaggagcgcaagttaaaatttattcagaggttcaaggaagtggaaaagacagagggggatatgactgtgcagtgtcattactacacacattactcttcagcaattattgttgcctcctatcttgtgcgcatgccgcctttcacccaagcattttgcgcccttcaagggggatccttcgacgttgctgacaggatgtttcatagtgtgaagtccacctgggagtccgcgtcccgggagaatatgagtgatgttcgcgagcttactcccgagttcttttacctaccagagttcttgaccaattgcaatggcgtagaattcggatgcatgcaggatgggactgtattgggcgacgtccaattgcccccatgggcagacggcgatccccgtaagtttatctcactgcaccgtaaagccttggagtcagatttcgtgtccgccaatttgcaccactggatcgacttgatttttggatacaaacagcagggccctgccgctgtcgatgctgtgaatatctttcacccatatttctacggtgatcgaatggacctttcttccattaccgaccctctgatcaaaagtactattctggggttcgtgtccaattttggacaggtgccaaagcagctatttacgaagccacaccccgcaagaactgccgcagggaagcccttacctggcaaagacgtctccacacctgtctctctgcctggacatccgcaaccatttttttacagcctgcaaagcctgcgaccctcacaggtgacggtcaaagacatgtacttgttttctcttgggagcgagagtcctaagggtgccattggacacatcgtgtctacagaaaagaccatattggccgtggagcggaataaagtgttgctgccaccactgtggaaccgaacttttagttggggtttcgatgacttttcatgttgcctcgggtcttacgggtcagataaagtcctgatgacatttgaaaacctggccgcatggggtagatgcctttgtgccgtgtgcccgagtccaaccaccattgtgacatcaggaacatccaccgttgtgtgcgtttgggagcttagtatgacaaagggcagaccccgtggattgagactgcgtcaagcactgtatggacatacccaggccgtgacatgtctggccgctagcgtgacattttcactcttggtgtccggtagccaggactgcacctgcattctgtgggacctggatcacctcactcatgtgacacggctgccagcccatagggaagggatctctgcgattacgattagtgacgtgagtggcacaatcgtatcttgtgctggagctcacctgtctttgtggaacgtaaacggccagcccctagccagcataacaactgcttgggggccagagggtgcgataacctgttgctgcctcatggaagggccagcatgggacactagccaaatcattattaccggctcccaggatggcatggtgcgggtttggaagactgaagatgtcaagatgagtgtacccggtcgccctgcgggtgaggaacctcctgctcaaccgccaaccctctccatggctgacgggacttccatgaaaagaatgagcacgcataccagacgggcagagcagcacgcagggaactgcgacctggtgatgccttcctgtacgcggaattacacctag

SEQ ID NO: 246853 - DNA, 1704 bp, Artificial Sequence
  Description of Artificial Sequence: Synthetic coding sequence
atggatgataaagatatagacaaagagttacgtcaaaagctgaattttagctactgcgaagaaaccgaaatcgaggggcagaaaaaagtcgaagagtctagagaggcctcatctcagacacctgagaaaggagaggtccaggactccgaagcgaaaggaacgccaccgtggacgcctctctcgaatgtccacgagctggacacgtctagtgagaaagacaaagagagccccgatcagatccttagaacccctgtatcccaccccctgaagtgtcccgagactcccgcacaacctgattctcggagtaaacttctgccctccgacagcccttctacaccgaagaccatgctgagcagactggtgatctctccaaccgggaaactcccctcccggggaccaaagcacttgaagctgaccccagcgcctctgaaagacgaaatgacttcactcgcgctggtgaatatcaatccatttacccctgaatcctacaaaaaactgtttctgcagagtggcggaaaaaggaagatccgaggcgacctggaggaagctggaccagaggagggtaaaggtgggcttcccgcaaagaggtgcgttcttcgggagacaaatatggcgagccgctatgaaaaagagtttctggaggtggagaagatcggggtcggagaattcgggaccgtatataagtgtatcaaaaggcttgacgggtgcgtgtacgccataaagcgttcaatgaaaacattcacggagcttagtaacgaaaattctgctctgcacgaggtctatgcgcatgccgttctgggtcaccacccgcatgtggtgcgctactatagctcctgggctgaggacgaccacatgattattcagaatgaatactgcaacggagggagcctccaggcagccatttcagaaaacacgaagtctggaaaccacttcgaagaacccaaactgaaggacatcctacttcagatctccctaggcctcaactatatccacaattcgtccatggtacatctggatattaaaccctctaacatcttcatctgtcataagatgcagagcgaatcctccggggtcattgaggaagtcgaaaacgaggcagattggttcttgagcgccaacgtgatgtataaaatcggtgatctaggccatgccactagcattaacaagcccaaggtggaggaaggcgactcccgttttctcgcaaatgaaattctgcaagaagattatagacatctgccaaaggctgacatctttgcattaggcctgaccatcgcagttgcagccggagccgaatctctccccactaacggcgctgcctggcatcacatcagaaaggggaacttccctgacgtgcctcaggaactgagcgagagttttagctcgcttctaaagaatatgatccaacccgacgccgagcagcgtccctctgctgcagccctcgctcgtaacaccgtcctgagacctagcctcgggaagactgaagagttgcagcagcaacttaatcttgaaaaatttaaaacagccacactggaacgcgaattacgcgaggcccagcaagctcaatcaccacaggggtacacccaccacggcgacacaggggtgtcggggacccacaccggttctaggtctaccaagaggctcgtgggaggcaaatctgcgaggtctagctcttttacatccggcgaacgcgaacccctccattag

SEQ ID NO: 246854 - DNA, 846 bp, Artificial Sequence
  Description of Artificial Sequence: Synthetic coding sequence
atggtcacaattctgatgagagcgataaactctctaggaattcacgtcctagattccagccggcctacagacccgctgagccatagttctaatagtagttctgaaccggcaatgttcatcgaagacaaagcagtggacactctcgcgtacttatctgatggtgacgccagggccggtctgaatggcctgcagctggctgtgctggctcggctgagcagcaggaagatgttctgtaagaagtctgggcagtcctacagtccatctagggtgttgattacagagaacgacgtcaaagagggactacagagatcacacatactctatgacagggccggtgaggagcattacaattgcatctcagccctgcacaaatccatgcgtgggagtgatcaaaacgccagcctttactggctggctcggatgctggagggtggcgaagaccccttgtacgtcgccaggagactggtcagatttgcctccgaagacataggattagccgacccatccgccctgactcaggcggtggcagcatatcagggctgtcatttcatcggcatgcctgagtgcgaggtcctcttggcacagtgcgtcgtctatttcgctcgcgctccaaaatccatcgaggtgtactcagcttacaataacgtcaaagcctgtctacgtaaccatcagggcccacttccccctgtgccactccacctcaggaacgcacccacaaggttgatgaaagatttgggttatggtaaagggtacaagtataatccaatgtacagtgagcctgtggatcaggagtacctgcccgaagaactgcggggagtggatttttttaagcagcggaggtgttag

SEQ ID NO: 246855 - DNA, 1338 bp, Artificial Sequence
  Description of Artificial Sequence: Synthetic coding sequence
atgctgcagggtaagccattggcagatacaatgagacctgacactctgcaggactacttcgggcagtctaaggctgtaggacaagacacccttctcaggtctctgctcgagacaaatgagattccttcactgattctttggggccctcctgggtgtgggaagactactctcgcacacattatcgctagtaactccaagaagcattctatccgctttgtgacattgagcgccaccaatgccaaaactaacgacgttagggacgtgataaagcaggctcagaacgaaaagtctttcttcaagcgcaaaaccatccttttcattgacgaaattcatcggttcaataagtcccaacaggatacgtttcttccacacgttgagtgtggcaccattacactgatcggggctaccaccgaaaacccttctttccaggttaacgcagccctgctctctcgctgccgtgtgatcgttctggaaaaactgccagtggaggccatggtgactattctgatgcgcgctataaacagtctcgggatccacgttctggatagctctcggcctactgacccgctcagccactcgagtaactctagctctgagcccgctatgtttatcgaggacaaagcagtggatacgctcgcttatctttccgatggggatgctcgagcaggcctcaacggactccagcttgcggtgctggccagactgagctccagaaaaatgttttgcaagaaaagtggtcagagttattctcctagccgcgttcttattaccgagaatgacgtaaaagagggactgcagcgaagtcatatcctgtatgacagggcaggtgaggaacactacaactgtattagcgctcttcacaaatctatgaggggttcagatcagaacgcaagtctttattggctggccagaatgcttgaggggggagaagatcccctttatgtggcacgaaggcttgtgcgattcgcctccgaggatatcgggctcgctgacccaagcgcgctgacacaagcagtagctgcctaccagggatgccactttatcggtatgccagagtgcgaggtacttctagcccagtgtgtggtgtactttgcacgcgctccgaagtctatcgaagtctactcggcttacaacaacgtgaaggcttgtttgcgcaatcaccaaggcccacttcctccggtgccactgcacctgagaaacgccccaactcgactgatgaaagacctgggatatggaaaggggtacaaatacaacccaatgtactccgaacctgttgatcaggaatatctgccggaggaacttaggggggtggatttctttaaacagagacggtgttag

SEQ ID NO: 246856 - DNA, 1923 bp, Artificial Sequence
  Description of Artificial Sequence: Synthetic coding sequence
atggaggtctccggaccagaggacgacccttttctgtctcagctccaccaagtgcagtgtccagtatgccaacagatgatgcccgctgcgcacatcaacagtcacctggaccgctgcttactgctgcaccctgccggacacgcagaacccgcagcgggatctcatagggctggggaaagggccaagggcccttcgcccccaggggcaaagcggcgtaggctgtctgagtctagtgccctgaagcagccagccactcctacagctgccgagtcctctgaaggagaaggagaagaaggtgacgacggaggtgaaaccgaatcccgggagagttacgacgcaccccctacacccagcggagcaaggcttatccctgactttccagtggctcgatcctcgtcccccggaaggaaaggaagcggcaaacgcccagcagccgcagccgcagctggctctgctagcccacgatcctgggacgaagcagaggcgcaggaagaggaagaggctgtgggcgacggcgatggagatggtgacgcagatgccgacggggaggatgatcccggacactgggacgcggacgctgctgaagccgcaaccgcctttggggcaagcgggggagggagaccccatcctagagcgctggctgccgaggaaatccgccagatgctgcaaggtaagcctttggctgacaccatgcgcccagacacattgcaggactacttcggacagtccaaggcagtaggccaagatacactgctgagaagccttctcgaaactaacgaaataccatctctgatcctgtggggcccaccaggatgcgggaaaacaacactcgcgcatattatcgcctctaactccaagaagcactccattcgtttcgtcacattaagcgctacaaatgccaaaacaaacgacgtccgcgatgtgatcaaacaggcacagaatgaaaagagcttttttaaacgtaaaactatactttttatagacgaaattcaccgctttaataagagtcagcaggtaaatgctgcattgctaagccgttgccgcgtgatcgtcctagagaaacttccagtggaagcgatggtgaccattctgatgagggctattaactcactaggcattcacgtccttgacagtagtcgaccgactgaccctctcagccactcatccaattcctcatcagaaccagcgatgttcatcgaggacaaggccgttgacacgctggcatacctttcggacggggacgctcgtgccggactcaacgggctccaactcgctgtcctggcacgtctctcctctaggaagatgttttgcaaaaagtccgggcagagctattcaccttccagagtgcttataacagaaaacgatgtgaaggaggggctccaacgctcgcacatcctttatgatcgagcaggggaggaacattacaactgtatttcggcactgcataaatcaatgagaggtagcgatcagaacgcaagtctgtactggttagccaggatgctggaaggcggagaagaccccctgtacgtcgctcgcagactggtcagattcgcgagtgaagatatcggtctcgctgatccttctgctctgacacaagctgtggccgcataccagggatgtcacttcattggtatgcccgagtgtgaggttctgctggcccagtgtgttgtctacttcgctagggcacccaagtccatcgaagtatactcggcttacaataacgtcaaggcctgtctcagaaatcaccagggtccactgccccctgtccctttacatctgagaaacgcccctacacggttaatgaaagatttgggctacggaaagggctacaagtataaccccatgtactccgagccagtggaccaggagtaccttcccgaggagctccgcggtgttgatttcttcaaacagcgacggtgttag

SEQ ID NO: 246857 - DNA, 1998 bp, Artificial Sequence
  Description of Artificial Sequence: Synthetic coding sequence
atggaagtctctggcccagaggatgacccgtttctcagccagctacaccaggtacagtgcccagtgtgccagcagatgatgccagcagcacatattaactcgcacctcgaccgatgcctgcttctccatccggcaggacatgctgagcctgctgccggaagccatcgtgccggagaaagagcaaagggcccaagcccccctggagccaaacgcagaaggctgagcgagtcaagtgcactgaagcaaccggctacaccaaccgctgcagagagctcagagggggaaggggaagaaggtgatgatgggggagagacagaaagcagagaatcttacgatgcacccccaactcccagtggcgcacgactgatacccgacttcccagtcgcacgctcttcctctcccggtcggaagggcagcgggaagcgcccagccgctgccgctgccgctggcagtgcatcccctaggagctgggacgaagctgaggcgcaggaggaggaagaggccgttggagatggggatggtgatggggacgcggatgccgatggggaggacgaccctgggcactgggatgccgacgctgctgaggctgctaccgccttcggagcaagcggagggggtagaccccatcctagggcccttgccgctgaggaaatcagacaaatgttgcagggtaaacctctcgctgataccatgcgcccagataccctgcaggactactttgggcagtccaaggcggtcggacaggatactttgctcaggtcgctcttggagaccaacgaaatcccgagtttgatactctggggccctccagggtgcggaaaaacaaccttggctcatataatcgcatccaacagcaagaaacacagtatccgtttcgtcacactgagtgcaactaatgcaaaaactaatgatgtgagagacgtcattaagcaggctcaaaatgaaaagtccttcttcaagcgcaagactattttatttattgacgagatacatcggttcaataagtcacagcaggatacatttctgcctcatgtcgagtgtgggacaattactttaataggcgctacgacggaaaatccttctttccaagtgaacgcggcactactatcacgatgccgtgtgatagttctggaaaaacttcctgtggaggccatggtgaccatcctgatgagagctatcaattccctcggcatccacgtgctagattcatcacgcccaacagaccccctaagccacagctccaacagtagctccgagccagcaatgttcattgaagacaaagcagttgatactcttgcgtatctgtccgatggcgacgccagggccggtttaaacggcctccagctcgccgttctagccagattaagctcccggaaaatgttctgcaaaaagtccgggcaaagttactctccttccagagtccttattactgagaatgacgtcaaagaagggttgcagagatcacacattctgtacgacagagctggagaggaacattacaattgcataagcgccctccacaagtctatgcgaggctcagatcaaaacgctagcctctattggctggccagaatgctggagggtggcgaagaccctctttacgtggctcgcaggcttgttcggtttgctagtgaagacattggattggctgatccctccgccctgacacaggcggtagccgcataccagggttgtcatttcattgggatgcctgagtgtgaggtcctgttagcccaatgtgtcgtgtatttcgcgagagcccctaagagcatagaagtgtattcagcttacaacaatgtgaaagcttgcttgcgtaatcaccagggacccctacctcccgtcccattgcaccttcggaacgcccctactaggctcatgaaggacctgggatacggtaaggggtacaagtacaaccccatgtattccgagccagttgaccaagaatatcttcctgaggagctccgcggagtggacttctttaaacagagacgatgctag

SEQ ID NO: 246858 - DNA, 4299 bp, Artificial Sequence
  Description of Artificial Sequence: Synthetic coding sequence
atgtccgaaaaaaagttagagaccactgcacagcagaggaagtgtcctgaatggatgaacgttcagaataaacggtgtgccgttgaagaacgcaaggcatgtgtgcggaagagtgtgtttgaggatgatctaccttttctcgaattcacaggttctatcgtttactcatatgacgcgagtgactgctcatttctgagcgaggatattagtatgtccctgtctgatggagatgttgtcggctttgatatggagtggcctcccctgtataaccggggaaagctcggcaaagtcgcactgattcagttatgcgtctccgagtcaaagtgctacctgtttcacgtctcctctatgtctgtgtttcctcaaggcctgaagatgctgcttgaaaacaaagctgtgaagaaagctggagtcggtatcgaaggtgatcagtggaaattgctgcgagactttgacatcaagcttaagaacttcgtcgagttgacggatgtggctaataagaaacttaagtgcacggaaacgtggtcgctgaacagtctggtgaaacacttactaggcaagcaattgcttaaagataagagtatccgttgcagtaattggtcaaagttccccctcacagaagaccagaaactttacgcagcgacagacgcatacgcgggtttcattatctataggaacttggagatactcgatgataccgtgcagcgcttcgccatcaacaaggaggaggagatcctgttatcagacatgaataaacagcttacttccatttcagaggaagtgatggacctggccaaacatctcccccacgctttcagcaagctcgaaaatccacgccgtgtgtcaatcctgctcaaggacatttcagagaatctatatagcttgaggcgcatgattatcgggtccacaaacatcgaaacagagcttagacccagtaataacttgaatcttctcagctttgaggatagtactaccggtggagtacaacagaagcagattagagagcacgaggtacttatccacgtggaagatgagacatgggaccctaccttggatcacctggccaagcacgacggtgaggatgtgctcggcaacaaggtcgaaaggaaagaggacggctttgaggacggcgttgaagataacaagctgaaagagaatatggagagggcctgcctgatgagccttgatatcactgaacatgaactgcagatccttgagcagcaaagccaggaggaatacctgtccgacattgcatataaaagcactgagcacctctcgcccaatgacaacgagaatgatacatcgtacgtgatcgagtccgatgaggacctggagatggaaatgctgaagcacttgtctcccaacgataacgagaatgatacgtcctacgtcattgaatccgacgaagatctggaaatggagatgttaaagagtctcgaaaatttaaattccggtacagtagaaccgacccatagtaagtgcctcaaaatggagcggaacttgggactaccaaccaaagaggaagaagaagacgatgagaacgaggcaaatgagggcgaggaggacgacgacaaggacttcctctggccagccccaaatgaggagcaggtcacctgtctgaagatgtatttcgggcattccagtttcaagccagtccagtggaaagttattcattccgtgctggaggaaaggagagacaatgtagccgtgatggcgactggttacggcaaatcactgtgcttccagtaccccccagtctatgttggcaagattggcctggttatctcccctttgatctctctgatggaggaccaggtacttcagctcaagatgtctaatattcccgcatgtttcctgggcagtgctcagtcggagaacgtgctgaccgacataaagctcggcaagtatcgcatagtttacgtgacgccggagtattgctccgggaacatgggtctccttcagcagttagaagcagatatcgggattactctcatagccgttgacgaggcccactgtatatccgagtgggggcatgactttcgagactcgttcaggaagctaggctccctgaagacagcactgccaatggtccctatcgtagccctgactgcaaccgctagcagctccatcagagaagacattgtccgctgtcttaacctcagaaatcctcaaataacttgcactgggttcgacaggcccaatctttacttagaagtgagacgaaaaaccggtaacatcctgcaagacttgcagccttttcttgttaaaacgagttctcattgggaatttgaagggccaactatcatctattgtccctccagaaaaatgacacaacaagtaacaggagaactgcgcaagctaaatttgagttgtggaacttaccacgcagggatgtccttcagtactagaaaagacatccaccatagatttgtgcgcgatgaaatccagtgtgtgatagcaacaatcgctttcggcatgggcatcaacaaggccgacatccgccaagtcatccactacggtgcccctaaagatatggagtcctactaccaggagatcggccgtgctggcagagacggactccaatcctcgtgccacgttctatgggctccagccgacattaatttaaatagacatcttttaaccgaaattcgtaacgagaagttcagactgtataagctgaaaatgatggccaagatggagaaatacctgcattctagccggtgcaggcgacagataatcttgagccatttcgaagacaaacaggtgcagaaagccagcttgggcatcatgggtactgagaaatgctgcgacaattgtaggtcaagactcgaccattgctatagcatggacgattcagaggatacgtcttgggacttcgggccacaagcgtttaagcttttatcagcggtcgacatcttgggcgagaagttcgggatcggccttccaatcctatttcttaggggcagcaactcccagaggctggctgatcaatatagacggcatagcttgttcggaaccggcaaagaccaaactgagtcctggtggaaagccttctccaggcagctaattacggaaggatttcttgtggaggtttccagatacaacaagtttatgaagatttgtgcactgaccaagaagggccgaaactggctgcataaagcgaacaccgagtcccagtcactaatcttgcaggcgaatgaagaactttgtccaaagaaactcctcctgccctcttctaagaccgtcagtagtggcaccaaggagcattgctacaaccaggtgcctgtcgagctgtccaccgagaagaagagcaacctggagaagctctacagctataaaccatgtgacaaaatcagtagtggctcgaacataagcaagaagtctatcatggttcaatcacccgagaaagcatacagcagttcccaaccggtaatttcagctcaggaacaagaaactcagatcgttctgtatggcaagttagttgaagctaggcaaaaacatgccaacaagatggatgtgcctcccgctattttggccacgaacaaaatcctggttgacatggctaagatgcggccaactacagtcgaaaatgtgaaacgtatcgacggggtatcagagggtaaagctgccatgctcgccccacttctggaggtcatcaaacacttttgtcagacaaatagcgtgcagactgacttattcagctctacgaaaccacaagaggagcagaagaccagtctggtggctaagaataaaatctgcaccctctctcagtctatggcaatcacatatagccttttccaggagaaaaagatgcccctgaaaagcatcgcagaaagcagaattctgccccttatgacaatcggcatgcacctgtcacaggcagttaaggccggttgccctctcgacttagagcgggcagggcttacacctgaggtccaaaagattattgcggatgtcattagaaaccccccagtaaatagtgacatgagtaagatttcacttattagaatgttggtgcctgagaacatagacacatatctgattcacatggccatagagatattgaagcacgggcctgattcgggtcttcagcctagctgcgacgttaataagcgtaggtgcttccccggatcggaggagatttgcagcagctcgaagaggtctaaggaagaggtcggcatcaacacagagacttctagtgccgaaaggaagagaagactccccgtgtggttcgccaaaggatctgatacttccaagaaactgatggataagaccaagcgtggagggttatttagctag

SEQ ID NO: 246859 - DNA, 738 bp, Artificial Sequence
  Description of Artificial Sequence: Synthetic coding sequence
atggctcaggaggaaggtgggtcccttccagaagtcagggccagagtgcgcgcagctcacgggattcccgacctggcccaaaagctgcacttttacgatcgatgggctccagattacgatcaggacgtcgccaccctcttatatcgcgcaccacgtctagctgtcgattgtctcacccaggccctgcctggtcccccacacagtgccctgattcttgatgtagcgtgtggcactgggttggtggccgctgagttacgcgctccaggcttcctgcagctgcacggagtagatggttccccaggcatgctcgaacaggcccaagcgcctggactttatcagcggctctctctgtgcaccctggggcaagagccactacctagtcctgagggcacgtttgatgcagtccttatcgtgggcgcactgtcagacggccaggttccttgcaacgcaatccctgaattacatgtcacgaaacccggtggcttagtctgcttgacaacccggaccaattctagtaatctgcaatataaagaggccttggaagcgactctggataggttagaacaggcgggtatgtgggaaggacttgtagcctggccggtcgacaggctgtggacagcaggttcctggttgccgccatcgtggaggtggtaccccgcttcactgccacggatggcctctagccccgctctgtccacatgtactgagagcggtaggcggccacggctgcgcaagtag

SEQ ID NO: 246860 - DNA, 798 bp, Artificial Sequence
  Description of Artificial Sequence: Synthetic coding sequence
atggaggcattacccccagttagatcgtctctcctgggaattctcctgcaggtcactcgcctttccgtcctgcttgtgcagaaccgcgaccatttgtacaattttctgctattgaagatcaatctgttcaatcattgggtgagcggcctggcacaggaagcaaggggctcgtgtaactggcaggcccatctgcccttaggcgcagccgcatgccctcttgggcaggccctgtgggctgggctcgccctgattcaagtccctgtgtggctggtgttgcaggggcctcgccttatgtgggccggaatgtggggaagcaccaaaggcctcggcttggcccttctgtctgcgtgggagcagctgggtctgtctgtagctatctggacagaccttttcctcagctgcctccatgggctgatgctagtcgccctgctgctcgtcgttgtgacctggagggtctgtcagaaatctcactgctttaggctgggcagacagctcagcaaagctcttcaagtgaattgcgtggtcaggaagttacttgtgcagcttcgaaggctatattggtgggtggagaccatgacagcgctaactagctggcacctagcctatctcatcacatggacaacttgcctggccagccaccttctgcaggccgcatttgaacacaccacccaactggccgaggcgcaggaggtggagcctcaggaggtgtctggctcgtccttactgcctagcctgagtgctagctcagatagtgaaagtggcactgtgctgccagagcaggaaacacctagagagtag

SEQ ID NO: 246861 - DNA, 456 bp, Artificial Sequence
  Description of Artificial Sequence: Synthetic coding sequence
atgacaaacgaggagccgctgcccaagaaggtcagactttctgaaaccgacttcaaagttatggccagagacgagctgattctccggtggaaacagtacgaagcctacgtccaggccttggagggcaaatacaccgatctcaactccaatgacgtgactggactcagggaatctgaagaaaaactgaagcagcaacagcaggaaagcgccaggagagaaaacattctggttatgcgccttgcaacaaaggagcaggagatgcaggaatgtacaacacagatacagtatctgaagcaggttcagcagccatcagtagctcagctgagatctaccatggtagaccccgctattaatttgtttttcctgaagatgaaaggagagctggaacagaccaaggataagctggagcaggcccagaatgagctatcagcatggaaatttactcccgatcgctag

SEQ ID NO: 246862 - DNA, 1191 bp, Artificial Sequence
  Description of Artificial Sequence: Synthetic coding sequence
atgacgaatgaggaacccttgcctaaaaaggtccggctgtccgagacagacttcaaggtcatggcccgtgacgagctaatccttagatggaagcagtacgaggcttacgtgcaagctctcgagggcaagtacaccgatctcaactccaacgatgtcacaggtttgagggaaagcgaggagaaactgaagcagcagcaacaggaaagtgccaggcgggaaaacatcctcgtgatgaggttggccaccaaggagcaggagatgcaggagtgcaccactcagattcagtatcttaaacaggttcagcagcctagtgtggcccagttgcggtcaacaatggtggatcccgctataaatcttttctttctgaaaatgaagggagaactcgagcaaacgaaagacaagttagaacaagcccagaacgaattatcagcatggaaatttacgccagacagccagactggtaagaaattgatggcgaagtgccgcatgctcatacaggagaaccaggagctgggcagacagttgagccaaggtcgcatagcccagctcgaagccgaattagctctgcaaaaaaagtacagcgaagaacttaaaagcagccaagacgaactgaatgactttattattcagcttgatgaagaggtggaaggtatgcagagcacgattctggttctccaacaacagttgaaggaaactaggcagcaactcgcacagtaccagcagcagcagagccaggcaagcgccccttcgacgagcaggactaccgctagtgagcccgtggagcagtccgaagctacttctaaggactgttcccggttgacaaacggcccatcaaatggctcctcctctaggcagagaacgtcaggtagcggattccatagggaggggaatacaactgaagacgattttccctcatcacctgggaacggcaacaagtcttctaattcctccgaggagcgaacagggagaggaggcagcggatatgtcaaccagctctccgcgggatatgagtcagttgattcacctacagggtctgagaactccttaacccaccagtccaacgatacggactctagtcacgacccccaagaggaaaaagcagtgagcggcaagggtaatcgtacagtagggagccgccatgtgcagaacgggttagattctagtgttaacgtgcaggggtctgtgctatag

SEQ ID NO: 246863 - DNA, 1083 bp, Artificial Sequence
  Description of Artificial Sequence: Synthetic coding sequence
atgaacgctcctctgggcggtatttggctgtggctccctcttctgctgacttggctcaccccagaagtcaactcctcatggtggtatatgagagcaactggaggctcatcgcgggtaatgtgtgataatgttcccggactggtgagttcgcagcggcaactgtgccataggcacccagacgtcatgagagccatcagtcagggagtagctgagtggacagccgagtgccagcatcagtttcggcagcaccggtggaattgcaacaccctggatcgcgaccattcgctgtttgggagggttctgctgcgctcctcgagggagagtgccttcgtgtatgcgatttcctctgccggtgtcgtgtttgccatcacaagggcatgttcacagggcgaggtgaaaagctgcagctgtgaccccaaaaaaatgggctccgctaaggattcgaaagggatctttgattggggcggttgcagtgataacatagactatgggattaaattcgcccgtgcatttgtggatgccaaagagcgcaaaggtaaggatgcccgtgccctgatgaaccttcacaataatagagccggacggaaagccgtgaaacggtttctgaagcaagaatgtaagtgccacggcgtctcaggcagttgcactttgcgaacatgttggctggccatggcagattttaggaagacaggggactacctttggcggaagtataacggggcaattcaggttgtaatgaatcaggacggcaccggctttacggtcgctaacgagaggtttaagaagcccacaaagaatgacctcgtttactttgaaaatagccctgactattgtattagggatagagaggctggtagtttgggaaccgccggtagggtgtgcaaccttacctcacgaggcatggacagttgcgaggtgatgtgctgtggcagagggtacgatacgtcccacgtcacccgcatgactaaatgtggatgcaagttccactggtgctgtgcagttagatgccaggattgcctggaggctcttgatgtccacacatgcaaggcacccaagaacgccgattggaccacagcaacgtag

SEQ ID NO: 246864 - DNA, 1113 bp, Artificial Sequence
  Description of Artificial Sequence: Synthetic coding sequence
atgggactttgggctctgctgccgggttgggtttctgctactctactcctggcattggcagccctgcctgctgctttagccgctaattcaagcggcagatggtggggcatcgtcaacgtggcttcttccacaaacctactgactgactcaaaaagcctgcagttagtactcgagcccagtcttcagttgctatcacggaaacagcgtaggctgataaggcagaaccctggcatccttcacagcgtatctgggggattgcagtctgctgtgagggaatgtaagtggcagtttcgtaatagaaggtggaactgtcccaccgcgcctggaccgcatctcttcgggaagatcgtgaataggggttgtcgcgagactgcgttcatatttgccatcacaagcgccggagtgacacacagcgtcgcgagaagctgcagtgagggcagcattgagagctgtacttgtgactaccgccgtagggggcctggcggacctgactggcattggggcggatgcagcgacaacatcgactttggtagactcttcggcagagaatttgtcgattcaggagagaagggcagggatctgaggtttttgatgaacctgcataataatgaggcgggacgcaccacagtattttccgagatgcggcaagagtgcaagtgccacggtatgtctggcagctgcacagtgcgaacctgctggatgcggcttcctacgctgcgtgcagtaggagatgtcctgcgggacaggttcgacggggcttcaagagtgctgtacgggaaccggggttccaaccgagcatcccgagctgaactgctgcggttggagcccgaagatcccgcacataagcccccatcccctcacgaccttgtgtatttcgagaagagtccgaacttctgcacttactccggacgccttggtacagccggtactgctggcagagcctgtaatagcagctcccccgcacttgatggttgcgaattgctatgctgtggacgcggacaccgcaccaggacgcaacgcgtgactgagcggtgcaactgcactttccattggtgctgccacgtgtcctgtagaaactgtacacatacccgcgtgctccacgagtgcttatag

SEQ ID NO: 246865 - DNA, 588 bp, Artificial Sequence
  Description of Artificial Sequence: Synthetic coding sequence
tggcattggggaggatgttcagataatattgattttggtagactgttcggcagggaatttgttgattctggcgagaaaggacgcgatctgcgcttcctcatgaatttgcataacaatgaagctgggcgaacaacagtgttctctgaaatgaggcaagagtgcaaatgtcacggcatgtccggcagttgcactgtgaggacctgctggatgcgattgccaactttacgggctgtaggcgacgtgctgcgggatcgatttgacggggcttccagagtcctatacggcaacagggggtcaaaccgtgcaagccgtgccgagctgctgcggctggagcctgacctggtttacttcgaaaagagcccgaacttctgtacgtactccggcaggctgggaaccgcagggaccgcagggagggcctgtaactcttcttctcccgcactggacggatgcgaacttctctgttgcggcagggggcaccggactagaactcagcgtgtcactgagcgctgcaactgcaccttccactggtgctgtcacgtgagttgtaggaattgtacacatacacgggtgctccatgaatgtctttag

SEQ ID NO: 246866 - DNA, 1254 bp, Artificial Sequence
  Description of Artificial Sequence: Synthetic coding sequence
atgggctcggcgcacccgcgtccatggctgcgattgagaccccagcctcagcccagaccagccctttgggtgttgttattttttctcctcctcctggctgccgcaatgcctcggtccgcccctaacgacattctcgatctcagactcccacccgagccagtgctaaatgctaatacagtgtgcctgacattacccggtctgtcccgcagacagatggaagtgtgtgttcgtcatccagacgtggcggcttccgctatccaagggatccagattgccatacacgagtgtcagcatcagtttcgcgatcagcgctggaattgttcctctctcgagacacgcaacaagataccatacgagagcccaatcttcagcaggggtttccgagagtccgcatttgcctacgccattgctgccgcaggcgtcgtccacgctgtgtccaatgcctgcgctcttggcaagctgaaggcatgcggatgcgatgcttctcgacgcggagacgaggaagcttttcgacgcaagctgcacagactccagctggatgcacttcagaggggcaaggggctgagccacggggtccccgaacaccctgccctccctacagcgtctccaggcctccaagattcgtgggagtggggaggatgctcacccgatatgggctttggagagagattttcaaaagacttcctggatagtcgcgagcctcaccgtgacattcacgcacggatgcggctgcacaacaaccgggtgggcaggcaagccgtgatggagaacatgcggaggaaatgcaaatgccacgggacatccggctcctgccagcttaaaacatgttggcaggtgacccccgaatttcggactgtgggcgcactcctgcgcagtcgatttcaccgagctaccttgatccgccctcacaacaggaatgggggtcagctggagcctggtccggctggcgctccgtcaccagccccaggtgcgcctgggcctcgaagaagagccagccctgccgacctagtctactttgaaaagagtcccgacttctgcgaacgtgaaccacggctcgattcagcaggtacagttggtagactgtgtaacaagtcttcagcaggtagtgacggatgtggctcaatgtgttgcggcagaggacacaacatccttagacagacaagatcagaaagatgtcactgccgattccactggtgctgctttgttgtatgcgaagagtgccgtattactgaatgggtgtccgtctgcaagtag

SEQ ID NO: 246867 - DNA, 1170 bp, Artificial Sequence
  Description of Artificial Sequence: Synthetic coding sequence
atgctggaagaacctcgaccacgcccacccccttcagggctcgcgggtttgctctttctagcactgtgttctcgggctctctccaatgagattttgggtctcaagcttccaggggaacctccccttaccgccaacactgtgtgcctgacactcagtggtctgtccaagcgccagctggggctttgcttaaggaatcccgatgtgacggcttccgccctgcagggactgcacattgccgtccacgaatgtcaacatcaactgagggatcagagatggaactgtagtgccctcgaaggcggaggtcgtctgcctcatcacagcgccattttaaagagaggcttcagagaatctgctttttccttttcgatgctggccgctggggtgatgcacgcggttgccacagcgtgcagcttgggcaaattggtgagctgtggctgcgggtggaaaggctctggagaacaagacaggctccgcgcaaagcttctacagttgcaagctctgagtagggggaaaagcttcccccattccctaccgtcaccgggacctggtagcagcccctcaccagggccacaggacacctgggagtggggtggatgtaatcacgacatggactttggagagaaattctcaagggactttcttgacagtagagaggcccctcgggatattcaagctaggatgcgcattcacaacaatcgagtgggcagacaggtcgtaaccgagaacttaaaaagaaaatgtaaatgtcacggcacctctggcagttgccagtttaagacgtgttggcgtgccgctcctgaatttagggctgtgggagcagcactcagagagcggctgggtcgtgctattttcatcgacacgcacaaccgaaacagcggggctttccaacccaggttgcgaccgagaaggctgtctggagagttagtctatttcgagaaaagtcccgacttctgtgaaagggaccctactatgggaagtcccggtactaggggcagggcatgtaacaaaacatccagactgctggatggatgcggttctttgtgctgtggaaggggccacaatgtgctgagacaaaccagggtggaacggtgtcactgtagatttcactggtgttgctacgtcctctgtgatgagtgcaaagttacggagtgggtcaatgtgtgtaagtag

SEQ ID NO: 246868 - DNA, 576 bp, Artificial Sequence
  Description of Artificial Sequence: Synthetic coding sequence
atgctcgaagagcctcgcccacgcccaccacctagcggcttggcaggactgctgtttttggccctctgttctcgcgctctgtctaatgagatcctcggactcaagctgcctggcgagccaccactgacagctaacacggtgtgtctgacactgtccggcctcagtaaaagacagctcggtctctgtctccgaaaccccgatgtcaccgccagcgcactccaagggctgcatatagctgtacacgagtgccagcaccagctgcgggatcagcgctggaattgcagcgcattggaagggggaggaaggcttcctcaccattccgcaatcctcaagcgtggatttcgcgaatcagccttttccttttctatgttggccgctggtgtgatgcacgctgtggccaccgcatgtagcttgggaaaacttgtttcttgcgggtgcggctggaaaggaagcggcgaacaagataggctgcgggctaaactgctgcaattacaagctttaagtcggggaaaactgccgggtaccagcagacacgagtgtgagtcaaccacgactggttggggcgctaggtggtag

SEQ ID NO: 246869 - DNA, 309 bp, Artificial Sequence
  Description of Artificial Sequence: Synthetic coding sequence
atgctcgaggaacctcgccctagacctcccccaagcggactcgcaggcctcctgtttctggcgctttgtagtcgagcgctgtctaatgagatacttggtctgaaactgcccggagaaccacccctaaccgcaaatactgtgtgtctcactttgtccggcctgtccaaaaggcagttaggtctgtgtctaaggaacccagacgtcactgccagcgcgcttcagggactccatatcgccgtccacgaatgtcagcaccagctgcgcgaccagcgctggaactgtagcgccctggagggaggcggtcgctag

SEQ ID NO: 246870 - DNA, 354 bp, Artificial Sequence
  Description of Artificial Sequence: Synthetic coding sequence
atggccttggagactgtccctaaagacttacgtcatctgcgtgcatgcctgctctgctccctggttaaaacgatcgaccagttcgaatatgacggctgcgataattgcgacgcttatctgcagatgaaggggaatcgcgagatggtctatgattgtactagcagtagttttgatggtatcatcgctatgatgtcacctgaggactcttgggtctccaaatggcagagggtttctaactttaaaccgggagtctatgcagttagcgtgaccggcagattgccccaggggatagtgagggaactgaagtcacgcggtgtagcatataaaagccgcgacacagctatcaagacctag

SEQ ID NO: 246871 - DNA, 1059 bp, Artificial Sequence
  Description of Artificial Sequence: Synthetic coding sequence
atggctcctctcgggtatttcctcctgctatgcagtctcaaacaggctctgggcagttaccccatatggtggagtctcgccgtgggtccacagtactcctccctggggagccagccaattctgtgcgctagtatcccaggcctggtccccaagcagctgcgtttctgtaggaattacgtggaaatcatgccatctgtcgccgaaggcatcaaaatcggaatccaggagtgtcagcaccagtttaggggcaggagatggaactgcacaactgttcacgactcgctggctatattcggaccagtgctcgacaaggccacgcgggaatccgcatttgtacatgcaatagcatcagccggtgttgcattcgccgtcacaaggtcctgcgctgaagggactgccgctatctgcggctgcagcagccgccaccagggatcaccaggaaaaggctggaaatggggcggatgctcagaggacatagagttcggaggcatggtgtcccgagaattcgcagatgccagggaaaatcgccctgacgctcgttccgccatgaatcgtcacaataacgaggccggacggcaggcaatcgcctcacacatgcacctgaaatgcaagtgtcatgggttatccggatcttgcgaagtaaaaacttgctggtggtctcaaccagacttcagggctattggagattttctcaaggacaaatacgattctgcaagcgaaatggtggtcgaaaagcacagggagtcccgtggctgggtggaaacattacggccacggtatacatatttcaaagtgccaacagaacgagacttggtctattatgaggctagtccaaatttctgtgagccgaatcctgaaacagggtcattcggaaccagggaccggacctgcaatgttagtagccatgggatcgacggatgcgacttactgtgctgtggcagagggcacaacgccagggccgaaaggagacgtgagaaatgcaggtgcgtttttcactggtgctgttacgtgagctgtcaggagtgtacgagggtctatgatgtgcacacctgtaagtag

SEQ ID NO: 246872 - DNA, 1158 bp, Artificial Sequence
  Description of Artificial Sequence: Synthetic coding sequence
atggccccattgggctactttttactgttgtgctcattgaagcaggcactcgggtcttaccctatttggtggagtctggccgtgggccctcaatactcatcgctggggtcccagccgatactgtgcgcttctatcccagggctggttcccaagcagcttcggttttgtagaaattatgtggagatcatgccttctgtggctgagggcatcaagattggaattcaagagtgtcagcaccagttcagaggccgtaggtggaattgcactacagtgcacgacagcctcgcgatcttcggtcctgtgctagataaggccacccgggaatcagctttcgttcatgctatcgcatccgccggtgttgcctttgccgtcacccggtcctgcgccgagggcaccgccgcaatatgtggttgctcatcccgtcatcaggggagcccaggcaaaggctggaagtggggaggctgtagcgaagacatagagttcggtggaatggttagtcgtgagttcgccgacgccagggagaaccgtcccgacgctagaagcgccatgaataggcacaacaatgaggcagggagacaggctatagcctcacatatgcacctcaagtgtaagtgccatggtctctcgggctcttgtgaagtaaagacttgctggtggtcccagccagatttccgagctataggtgattttttaaaagacaaatatgattcagcgagcgaaatggtagtcgagaaacacagagagtccagaggatgggtcgaaacgctgaggccgcgatacacctattttaaagtgcccaccgaaagggacctcgtgtactacgaagcaagccccaatttttgcgagccgaacccggaaactggaagtttcggaacacgggaccggacctgcaacgtttctagccatggaatagacggatgcgatcttctctgctgcggccgaggccataatgctcgtgctgaaaggaggcgcgagaagtgccggtgtgtgttccactggtgttgttacgtaagctgccaggagtgtaccagagtgtatgatgtgcacacctgcaaaaacccagggagccgcgcaggaaactccgcacaccaacctccccatccacagcctcccgtcagattccatccccctctgaggagggccggaaaggtcccttag

SEQ ID NO: 246873 - DNA, 1056 bp, Artificial Sequence
  Description of Artificial Sequence: Synthetic coding sequence
atgtcccccaggtcatgcttaaggtccttacgcttgctggtttttgccgttttctccgctgctgcctccaactggctgtatctggccaagctctcatcagtgggttccatcagtgaggaggagacctgcgagaagctgaagggactgatccagcggcaggttcagatgtgcaaacggaatctcgaggtgatggattcagtgcggagaggcgctcagctggccatcgaggagtgccagtaccagttccgcaatcgtaggtggaattgctctacactggattcccttcccgtgttcggcaaggtcgttacacaggggacgagagaggcggcatttgtctacgctatttcttctgctggcgtggcctttgcagtgactcgtgcttgttcctcaggtgagctcgaaaagtgcggatgcgataggaccgtacatggcgtatcaccacaaggctttcaatggtccggttgcagtgacaacatcgcttatggggttgccttctctcaaagtttcgtagatgtccgagaacgctctaagggcgcttcctccagccgcgcattaatgaatttgcacaataacgaagctgggagaaaagctatattgacacacatgcgcgttgaatgtaaatgccacggtgtatcggggtcctgtgaagtgaaaacatgctggagagctgtcccgcctttccggcaagtaggtcatgcgctcaaggaaaagttcgatggagctacagaggtggaacccaggcgcgtcggctcgtcacgggctttggtgcccagaaacgcccaattcaagccccacaccgacgaagacctggtatatttggaaccatcccccgatttctgcgagcaggacatgcgtagcggcgtgctcggaaccagaggaaggacatgcaacaaaacctctaaggctattgacggctgtgaacttctgtgctgtggcagaggctttcacacggcccaggttgagttagctgaacgctgcagttgtaagtttcattggtgctgttttgtcaaatgcaggcagtgtcagaggctggtcgagttgcacacctgtagatag

SEQ ID NO: 246874 - DNA, 528 bp, Artificial Sequence
  Description of Artificial Sequence: Synthetic coding sequence
atgtcaccaaggtcatgcctcagatccctcagactgctggtatttgcagtgtttagtgctgccgcatccaattggctatacctggcaaagcttagttctgtgggtagtatttcggaggaggaaacctgtgagaagctaaaggggctgatccaaaggcaggtccagatgtgtaagcgaaatctggaagtgatggactcagtgagaaggggggctcaactcgctatagaggagtgtcaatatcagttccggaaccgcagatggaactgctctacattagacagcttgcccgtgttcgggaaggtggtgacacaaggtggcaaggcctggcacgggggagactccgggtgccatttgctgactgaatcccggtcgggggagcggacccagagaagaaaggagggcggaagcctcggccaatgctggcccgaggccatcgtgggcactcaggatccaatgaggagccctccgtatctctggggacgaaaccaaggcggtacacacaccgggagtgcgagcgaaggccactag

SEQ ID NO: 246875 - DNA, 453 bp, Artificial Sequence
  Description of Artificial Sequence: Synthetic coding sequence
tgatacctggcgaaattgagcagcgtggggagcatttccgaggaagagacatgcgagaagctcaaggggctcattcagcgacaggtacagatgtgtaaaagaaacttagaggttatggacagcgtgcggagaggcgcacagttagccatagaagaatgccagtatcaatttcgcaatcgcagatggaactgcagcactcttgactctctaccggtgttcggaaaggtcgtcacccaagggggtaaagcttggcatggcggtgactccggatgccacttactgaccgaatccagaagtggcgaacgcacccaaaggcgaaaggaagggggaagtttaggccagtgttggccagaggccatcgttggcacccaggatccgatgcggtcgccaccatacctatggggcagaaatcaagggggtacgcacacgggatccgccagtgaggggcattag

SEQ ID NO: 246876 - DNA, 159 bp, Artificial Sequence
  Description of Artificial Sequence: Synthetic coding sequence
atgtgcaagaggaacctggaggtgatggattctgtccgtagaggcgctcagctggctatcgaggaatgccagtaccagttccgaaacaggaggtggaactgctccacactcgactcccttcccgtcttcgggaaagtggtgacacaggggggaaagtag

SEQ ID NO: 246877 - DNA, 891 bp, Artificial Sequence
  Description of Artificial Sequence: Synthetic coding sequence
atgtgtaagagaaacttagaagtcatggactcagtgcgccgaggcgcacagttggctatcgaggaatgccagtatcaatttcgtaaccgtagatggaattgttctaccttagattcactgccagtcttcggcaaggtcgtgacgcagggaacacgggaagctgcgtttgtttacgctatttcttccgcaggcgtggcgttcgctgtcacacgcgcatgttcttctggcgaactagaaaaatgcggatgcgatcgaactgtacacggcgtgtctccacagggattccagtggtctggctgcagcgataatatagcgtacggcgttgccttctctcaatcctttgtggatgtgagagagcgttctaaaggtgctagttctagcagggccctaatgaatctccataacaacgaggccggacgaaaagctatcttaacccacatgcgagtcgagtgcaagtgccatggcgtctctggaagctgcgaggtcaaaacttgctggcgggctgtcccccctttcaggcaggtggggcacgctctcaaggaaaagttcgatggtgcaacagaagtcgagccgcgaagagtgggaagttcccgagccctggtgcccaggaacgctcagttcaagcctcatactgacgaagacctcgtctacctggagccgtccccagatttctgtgagcaggacatgcgcagcggagtccttggcaccagaggtagaacatgcaacaagacgtccaaggcaattgacggctgtgaactgctgtgctgcggtagagggtttcatacagcccaggtggagctcgcagagcggtgctcttgcaagtttcattggtgctgctttgttaagtgcagacagtgccagcgcctggtggagcttcacacctgtcgctag

SEQ ID NO: 246878 - DNA, 1710 bp, Artificial Sequence
  Description of Artificial Sequence: Synthetic coding sequence
atgaaagtgcttctacgcctaatctgcttcattgctctgttgatctctagcctggaggctgacaagtgcaaagagagggaggagaagattatcctggtttcgtcggccaatgagatcgatgtgcgcccttgcccacttaatcccaacgagcataaagggaccataacctggtacaaggatgattctaaaacacccgtgtcgacagagcaggcgagcaggattcatcagcacaaagagaagctctggtttgtacccgctaaagtggaagatagtggccactactactgtgtggtgcggaacagctcatactgtttacggattaaaatcagcgccaagtttgtcgaaaacgaacccaatctgtgctataatgcgcaagctatcttcaaacagaagctcccagtggccggagatggcggactggtctgtccgtatatggaattctttaaaaacgagaacaatgaattgcctaagctacagtggtataaggactgcaagcccttactccttgacaacatccatttcagtggggttaaggatcggctgatcgtcatgaatgtcgccgaaaaacacagaggaaactatacttgtcacgcttcctacacataccttgggaaacagtatcccatcacccgggtaatcgagttcataaccctggaagagaacaaacctacgcggcctgttatcgtctcgccagcgaacgaaaccatggaagtggatcttggctcccagatccagctgatttgcaacgtgacaggtcagctctctgatatcgcctactggaaatggaatggcagcgtgatcgacgaggacgacccggtgctgggagaggattattattccgtcgaaaacccagccaataaacgcaggtcaacactgattactgttctgaacatctccgagatcgaatcccggttctacaagcatcccttcacctgttttgccaagaatacgcacgggatcgacgccgcttatattcaattaatttatcctgtgacaaatttccagaagcacatgatcggcatttgtgtcactctcacagtaatcattgtctgctctgtctttatttacaaaatcttcaagatcgatatcgtgctgtggtatcgagactcatgctacgatttccttccaatcaaggcttccgacggtaaaacttacgacgcatatatcttgtaccctaaaacagtgggggaggggtccaccagtgactgtgatatcttcgtctttaaagtgcttccagaggtgctcgagaagcagtgcgggtataaactgttcatatatgggagggatgactacgtgggcgaggatatagtggaggtcattaacgagaatgtaaagaagagccgtagattaataatcatcctggtccgggagacctcaggattctcctggctgggcggttcctccgaggagcaaatcgccatgtacaatgcactcgtccaggacggtattaaggtggtccttctggagctagagaaaatccaggattacgagaagatgccggagtccataaagtttatcaagcaaaaacacggcgcaatcagatggagcggtgacttcacccaggggcctcagtctgccaagactaggttttggaaaaacgtgaggtatcatatgcccgtacagcgaaggtccccttctagtaaacatcagctgctgtcccctgccacaaaggagaaactgcagcgggaggcccacgttcccctgggatag

SEQ ID NO: 246879 - DNA, 1050 bp, Artificial Sequence
  Description of Artificial Sequence: Synthetic coding sequence
atgaaccgaaaagcccgtcgctgtctgggccatttatttctgagcttggggatggtttacctgcgtattgggggattctcaagcgtcgtggcattgggtgctagcattatttgcaataagatccccggtctggcgcctagacaacgcgctatctgccaatcccggccagatgccataattgtaattggagagggatcacagatgggcctggacgagtgtcagtttcagttccggaacggaagatggaactgtagcgcccttggcgaacggacagtgttcggcaaagagctgaaggtcggcagccgggaggctgcttttacatatgccattatcgccgcaggcgtggcccacgctattacagcggcttgcactcagggaaacctcagtgactgcgggtgtgacaaagaaaagcagggccaataccacagagacgaagggtggaagtggggcggatgcagcgccgatattagatacggaataggctttgccaaagtgttcgtcgacgcacgcgaaatcaagcagaacgctcgaactttaatgaatcttcacaataacgaggctgggcgaaagatcctggaggaaaatatgaaattggaatgcaagtgccacggggtgagtggtagctgtacaactaagacatgctggacaaccctaccacagttccgcgaactggggtatgtgctgaaagacaagtacaacgaggccgtgcacgtggagcccgtgcgcgcttcgcgaaataagaggcctacatttctcaagataaagaaacctctgtcttaccgcaaacctatggatacggacctcgtttatatcgagaaatccccaaactactgtgaggaagacccagtaaccggtagtgtgggaacacagggacgcgcatgcaacaagactgcccctcaggcaagtggttgtgacctgatgtgttgtgggaggggctataatacacaccagtatgctagggtctggcagtgcaattgtaaatttcattggtgctgctatgtgaagtgcaatacttgctcagagcggactgagatgtacacgtgcaaatag

SEQ ID NO: 246880 - DNA, 1050 bp, Artificial Sequence
  Description of Artificial Sequence: Synthetic coding sequence
atgcacagaaattttcgcaagtggatcttttatgtgttcttgtgttttggagtcctatatgtgaagctcggggctctctcatctgttgtcgctctgggggcaaacatcatatgcaataaaattcccggtcttgcaccaagacagcgcgctatctgtcagagtagacccgacgccatcatagtgattggagagggagcacaaatgggaataaatgaatgtcagtatcagttccgctttggtcgttggaactgttccgctctaggggagaagaccgtgttcggccaggaattacgcgtgggaagtcgtgaagctgcgtttacttatgccataacggcagccggagtagcccacgctgtgactgctgcttgtagccagggcaatctatccaattgtggatgcgacagggaaaagcagggatattacaatcaggccgagggctggaagtggggagggtgttctgccgacgtgaggtacgggatcgacttttcacgtcggttcgtggacgccagagaaataaagaagaacgccagacggcttatgaatttgcacaataacgaagctgggaggaaggtgttagaagacaggatgcagcttgagtgtaagtgtcacggcgtgtccggttcatgcacgacaaagacttgctggaccacactgccgaagttccgcgaagtgggccatctcctgaaggagaagtacaacgctgcagtccaggtggaagtcgtgcgagccagccgactaaggcagcccacgtttctacgaattaagcagctccgcagctaccagaagcccatggaaactgacttggtgtatatcgaaaaatcacccaattactgcgaggaagacgctgccaccggaagcgttggtactcagggccgactatgcaatcgcaccagccccggtgcggatggatgcgataccatgtgttgcggtagagggtacaatacccaccagtacacaaaggtttggcagtgtaactgcaaattccactggtgttgtttcgttaagtgcaatacatgctcagaacggactgaggtctttacatgtaagtag

SEQ ID NO: 246881 - DNA, 1062 bp, Artificial Sequence
  Description of Artificial Sequence: Synthetic coding sequence
atgcttctacttagtcctaggtccgcattggtgtctgtttactgcccccagatattcctgcttctgtctagcgggagttacttggctctgagtagtgtggtcgctctgggtgccaacattatttgcaataagattccaggcctggctcctcggcagcgggctatttgtcaatcccgcccagacgccatcatcgtcattggcgaaggcgcacagatgggcatcaatgaatgtcaataccagttccgttttggcagatggaactgcagcgcgctcggcgagaagacagttttcggccaggaactgcgggtgggcagtcgtgaagctgccttcacctacgccattaccgcagccggtgtggcacatgccgttactgctgcttgcagccagggaaatctcagcaactgcggctgcgaccgggagaagcagggatactacaatcaggcggaaggctggaagtgggggggatgctcagccgatgtgcgatacggaatcgactttagcaggaggtttgtggatgccagggagatcaaaaaaaatgcacgcagactgatgaacttgcataataatgaggccggaagaaaagtgttagaggacaggatgcaactggagtgcaaatgccacggcgtgtcaggaagctgcacaactaaaacctgttggactacactgccgaagtttagggaagtgggccatctgctcaaggaaaagtacaacgcggcagtgcaagtggaagtggtgcgggcaagtcgcctgcggcagcctaccttcctgcggatcaagcagctgcgcagctaccagaaacctatggagacagatctggtgtatatcgagaagtcacccaactattgtgaagaagacgctgcaacaggatccgtgggtacccaaggacgcctctgcaaccggactagccctggagctgacggatgcgacacaatgtgttgcgggaggggatacaacacacatcagtatactaaagtttggcagtgcaattgtaaatttcattggtgctgcttcgtgaaatgtaacacctgcagtgaacgcaccgaggttttcacttgtaagtag

SEQ ID NO: 246882 - DNA, 618 bp, Artificial Sequence
  Description of Artificial Sequence: Synthetic coding sequence
atgcatagaaatttcaggaagtggattttttacgtgtttctctgttttggggttctgtacgtgaagctcggggctctgagtagcgtggtggcactcggggctaacatcatctgcaacaagatcccaggtctggcccctcgccagagggccatttgtcaatcccgacctgatgcaatcattgttataggagagggcgctcagatgggtatcaacgaatgccagtaccagtttcgctttggcaggtggaactgcagtgcgctgggggaaaaaacggtgttcgggcaggagctcagggttggatcccgcgaggccgcattcacatacgcaataaccgccgctggggtggcccatgccgtgactgcagcttgcagccagggaaacctctccaactgtggctgcgacagagagaagcagggatactacaatcaggcagaaggctggaaatggggaggctgctccgctgacgtgagatatggcattgactttagtcgaagatttgtggatgctcgcgagatcaaaaaaaacgctcgtagactgatgaaccttcacaataatgaggcgggacggaagggtctgctcgggcagccaagagtcaccagcagtcccttgttcccctag

SEQ ID NO: 246883 - DNA, 1002 bp, Artificial Sequence
  Description of Artificial Sequence: Synthetic coding sequence
atgtcggcccctcctttttatcgggctctgtcctctgttgtggctcttggcgcaaacatcatctgtaataaaattcctggcctggccccaagacagagggccatctgccagtcacggcctgacgccataatagtaataggggagggggctcagatgggaattaatgagtgtcaataccagttccgtttcgggagatggaactgctcggcccttggggagaaaactgtgttcggccaggagctgcgtgtcggatccagggaggccgcttttacctacgctatcacagccgcaggggtcgcccacgcagttaccgccgcttgtagccagggcaacctctctaattgtggatgtgatagggagaaacagggatactataaccaggctgaggggtggaagtggggcggatgcagcgcggatgttagatatggcatcgatttttcccgtcgatttgtcgatgcccgagagattaaaaagaacgctaggagactgatgaatctgcacaacaatgaggctggcaggaaggtcttggaggatcggatgcagttagagtgcaagtgtcacggcgtatccggatcatgcacgacgaagacctgctggactaccctgccaaagttccgagaagtagggcacttgttaaaggaaaagtataacgccgctgtgcaggtcgaggtcgtgcgcgcttcacggcttagacagccgacattcctccgcattaagcagctgcggtcctatcagaagcccatggaaacggatctggtgtatatcgagaagagtcctaattactgcgaggaagatgcggctacaggcagcgttggcacccagggtcgcttgtgcaatagaacctcccccggtgccgacggctgtgataccatgtgctgtggtcggggttacaacacccatcagtacactaaggtctggcaatgcaattgcaaatttcattggtgctgcttcgtcaaatgtaatacgtgcagtgagaggacggaagtgtttacctgtaaatag

SEQ ID NO: 246884 - DNA, 174 bp, Artificial Sequence
  Description of Artificial Sequence: Synthetic coding sequence
atggggatcaatgagtgccaatatcaatttcggttcggcagatggaactgcagcgcacttggagagaagaccgttttcggtcaggagctcagggtcggctccagagaggccgcttttacatatgccatcacagccgctggcgtggcgcatgctgttaccgccgcatgttcatag

SEQ ID NO: 246885 - DNA, 1056 bp, Artificial Sequence
  Description of Artificial Sequence: Synthetic coding sequence
atgtttctgtccaagccaagtgtgtatatatgtctgttcacttgcgtcctgcagttatctcacagctggtccgtgaataatttcctcatgacaggacccaaggcttatttgatttattcttccagcgtggccgctggcgcacagagtggcatcgaagagtgcaaatatcaatttgcatgggataggtggaattgtcccgaacgggcactccagctgtcttctcatggcggactaaggtcagctaacagagagaccgcttttgtacatgcaatctctagcgctggagttatgtacaccctgacccgcaattgttcactcggggacttcgacaactgtgggtgcgacgactcacgcaacggccagctgggagggcagggctggctctgggggggatgcagcgacaacgtgggcttcggggaggctattagcaagcaattcgtagatgcccttgaaacaggacaggacgcaagagcagctatgaatctccataataatgaagccggtcgaaaggccgtgaaaggaaccatgaagcgcacctgcaagtgtcatggggtgagcggatcatgcaccacccagacctgttggttacagctacccgaatttcgtgaggtgggtgcacatctcaaagagaaataccacgctgcattaaaagttgatttgctgcaaggtgcagggaatagcgcggctggtagaggcgctattgctgatactttccggtccatttctacccgggagctggtgcacctggaggattctccggactactgtctcgaaaataagacactgggcctcctggggacggaaggcagagaatgtctgaggagagggagggctctgggaagatgggagaggcggtcatgtcggagactgtgcggagactgtgggctggcggttgaggaacgccgagccgagactgttagttcctgtaattgtaaattccactggtgttgcgccgtgcggtgcgaacagtgccgcaggagggttacaaagtatttttgctccagggccgagcggccaagagggggtgcagcccacaagccagggcgtaagccatag

SEQ ID NO: 246886 - DNA, 1209 bp, Artificial Sequence
  Description of Artificial Sequence: Synthetic coding sequence
atggatctcgaccgggcatctttggacctgatgatcagactgttggagctggaacaggacgcttcatccgcaaagcttttaaacgaaaaggacatgaacaaaattaaggagaagattaggagactttgtgaaaccgtgcacaataaacatctggaccttgaaaacattactacagggcatctcgccatggagaccttgctctctctgacatccaagagagcaggtgattggtttaaagaggaattacgattgctggggggactcgaccacattgtggacaaagttaaggagtgcgtggatcacctgagccgggacgaagatgaagagaaactagttgcttccctttggggggcagaaaggtgcttgagagtgctcgagtcagtgactgtgcacaatccggaaaaccagtcatacctcatagcctacaaggatagtcagttgatcgtttcctctgccaaggccctgcagcactgcgaagagctaatccagcagtataacagggctgaggattcaatttgccttgctgatagtaaacctctgccccaccagaacgtcaccaatcatgtcggcaaagccgtggaagattgtatgagagcaattatcggcgtcttacttaacctgactaatgacaacgaatggggatctacaaagacaggagaacaggacggattaatcgggaccgctctgaactgtgtgctccaggtgcctaaatatttgcctcaggaacagcggttcgacatcagggttctactgtttctggagagagaacgcgcagctcaattggccgaaagcaagacggacgagctaatcaaagatgctccaaccacacagcacgataaatcgggggagtggcaggaaacgtcgggagagattcaatgggtgagtactgaaaagacggatgggactgaagagaagcacaaaaaggaggaggaagacgaggaattggacctgaacaaagcactacagcatgccggtaagcatatggaagattgcattgtggcttcctatactgccttgctccttggctgtctatgccaggagagccctataaacgtcaccaccgtaagagagtacctaccggagggcgattttagtattatgactgagatgctcaaaaagttcctctctttcatgaatctcacatgtgctgtcgggacaacaggccagaagagcatttcgagggtaatcgaatatctggaacactgctag

SEQ ID NO: 246887 - DNA, 3573 bp, Artificial Sequence
  Description of Artificial Sequence: Synthetic coding sequence
atgacctcgcggttcgggaagacttactcccgaaagggcggaaatggctctagcaaatttgatgaagtctttagtaataaacggaccacactctctactaagtggggagagacaacattcatggccaagctcggccagaagcgcccaaattttaaacctgatatccaggaaatcccaaaaaagcccaaggtggaggaggaaagcaccggtgacccatttggcttcgactccgacgatgagagcctgcctgtgagcagcaaaaacctcgcgcaagtcaaatgtagttcctacagtgagtcctccgaagcagcccaactcgaggaagtgacctcggtccttgaagcaaactccaagattagccacgtggtggttgaggataccgtagtctctgacaagtgcttcccgctggaggacactttactcggcaaagaaaagagcactaatcggattgtggaagacgatgcctccattagcagctgtaacaagctgatcacctccgacaaagtggagaatttccacgaagaacacgaaaagaattctcaccacattcataaaaatgctgatgactcaacaaagaaacccaacgccgagacaaccgttgccagcgaaatcaaagagaccaacgatacgtggaacagccagtttggcaaaaggcctgaatcaccttctgagatctcacccatcaagggctcagtcagaacaggcctcttcgagtgggacaacgattttgaggacattaggtccgaagattgcatcctgagcttagactcagacccccttttggaaatgaaagatgatgacttcaagaacaggttagaaaatttgaacgaggcaatcgaggaagatattgtccagtccgtcctccgccctacaaattgtcggacttattgccgcgctaacaagacaaagtcctcacagggcgcaagtaattttgacaagctgatggacgggacttcacaggctctggcaaaggccaacagcgagagcagtaaggacggcctgaaccaggctaagaaggggggtgtctcttgcggaacaagtttccgtgggactgtgggaagaacgagagattacaccgtactgcaccccagctgcctgagcgtgtgtaacgtgacaattcaagacaccatggagagatctatggatgaattcacagcttcaaccccggcagatctaggggaggcgggacgcctgagaaaaaaagctgacatcgctacaagtaagacaacgaccaggtttagacctagcaatacaaagtctaaaaaggacgttaagctggagtttttcggcttcgaggaccacgaaaccggaggagatgaaggagggagcgggtccagtaattacaagatcaagtactttggcttcgacgatttatccgaatcagaggacgacgaggatgacgattgccaggtagagcggaaaaccagcaagaaacggacaaaaactgctccgagcccatctcttcagcctcctcctgagagtaatgacaattcacaggatagccaaagcggaaccaacaatgcagaaaacttggattttacggaggacttacctggggtgcccgaaagtgtcaaaaagccaatcaataagcagggcgataaatctaaagaaaacaccaggaaaatctttagcgggcctaagcgctctcccaccaaagcggtatataacgcgagacactggaaccacccagatagcgaggagttgcctggaccgccagtggtaaagcctcagagtgtcaccgtgcgactgtcatccaaagagcccaaccagaaagatgatggggtgttcaaggcgcctgcaccacccagtaaagttatcaaaactgttaccattccaacacagccctaccaggatattgttaccgccttgaaatgcaggcgtgaagacaaggaactctataccgttgtccagcacgtgaagcactttaatgatgttgttgagttcggtgagaatcaggaatttaccgacgacatagaatacctactgtcaggcctcaaatccacacagcccctgaatactcgctgtctctctgtcatcagcctggctacaaagtgcgccatgccctcgttcagaatgcacctgagagctcacgggatggtggctatggtctttaaaacccttgacgactctcagcaccaccagaacctaagtctctgcacggcggcactgatgtatattctgagtcgagaccgcctgaatatggacttggatagggcatctctggacctcatgatccgactactggagttggaacaagatgcttccagcgctaagctactgaacgaaaaggacatgaataaaatcaaggagaagatacgtcgtctttgcgagaccgttcacaataagcatttagatctcgaaaacattaccaccggccacctggcaatggaaactctactgtcgctgaccagtaaaagagccggtgattggtttaaggaggagctgcggctcctgggcggactggatcatattgtcgataaggttaaggagtgcgtggatcatctcagcagggacgaggacgaggagaagctggtggcatcattgtggggcgcagaacgctgtctcagggtgttggagtctgtgacggtgcataatcctgagaaccagagctacctgatcgcatataaggacagtcagttgatcgtgagttctgccaaggctctccagcattgcgaagagctgattcagcagtacaaccgtgcagaggattctatatgtttggctgattctaagcccttgccgcaccagaacgtgacaaatcatgtaggtaaggctgtggaagactgcatgcgcgcaatcattggagtgctgttaaacctgactaacgacaacgaatgggggtccaccaaaactggcgagcaggatggtcttatcggaaccgccctcaattgtgtcctgcaagtccccaagtatctgccgcaggagcagcggttcgacattcgggtactgggcctagggttgctgattaatcttgttgagtactcagcacgcaatcggcactgtttagtgaacatggaaacaagctgttcctttgactcatccatctgtagtggcgaaggggacgactcgctacgtatcggcggacaagtccacgcagtgcaagcgcttgtgcagctgttcttagagcgagaacgcgctgcgcaactggctgaaagtaaaaccgacgaactgataaaggatgcccctacgactcagcacgacaaatctggcgagtggcaggagacatcgggagagattcagtgggtgagtactgaaaagactgacgggactgaggaaaaacacaaaaaagaggaggaagacgaagaactggacttgaataaggcactgcagcacgcgggtaagcacatggaggactgcatcgtagctagctacaccgctttgctgctgggctgcctgtgtcaggagtctcccatcaatgttaccactgtcagagagtacttgcctgagggcgatttctcaatcatgacagagatgctcaagaaattcctgtcctttatgaacctgacatgtgctgtaggcacaactggccagaagtccatatctcgcgtcatcgagtacctggagcattgttag

SEQ ID NO: 246888 - DNA, 3828 bp, Artificial Sequence
  Description of Artificial Sequence: Synthetic coding sequence
atggtccagggccctgttcagacccccgctctgactatccaccgtcggaagcggcgaaggagttgcccacctaatagagcctcatatctccccaaagccgagagcctggcctcgttgggctcccacttacccgctttgctgtctagggccagagtgccccgtcctccagccggtcgtcgggaaagagaaagaagaaggagacctgtggctaaggccccagctagactccgcggagagtacgagacaggggtgaaaatgacaagcaggttcggtaaaacctattcaaggaaaggaggcaatggatcgtctaagttcgatgaagtattttcgaataagagaaccaccctgtcaactaaatggggggagaccacatttatggccaagttgggacaaaaacggccaaactttaagcccgatatccaagagattcctaaaaagcccaaagtggaggaagagtccaccggagaccccttcggcttcgattctgacgacgagtcactgccagttagttccaaaaacctggcccaggtcaagtgctcctcttatagcgaatcctcagaagcagcccagctggaagaggtcacgtcagtgttggaggcaaacagcaaaatttcgcatgtcgtggtcgaggacaccgtcgtctccgacaaatgctttccccttgaagatacactgctaggaaaggagaaaagcacgaatcgaatcgtagaggacgacgcaagcatctcttcctgtaacaagctgattaccagcgacaaagtggagaactttcatgaagaacacgagaagaatagccaccacattcataagaacgcagacgattcaacaaaaaagcctaatgcagagacaacagtggcctccgagatcaaggagaccaacgatacatggaacagccagttcggcaagcgacctgaatcacccagcgagatctcccccatcaaggggtcggtgcgcacaggactcttcgaatgggataacgatttcgaggacattcggtccgaagattgcattctcagcctggattccgaccccctgttggagatgaaagatgacgatttcaaaaaccgtttggaaaacctgaatgaggctattgaggaagatatagtgcagagtgtattgaggcctaccaattgccgtacttactgcagggctaacaagacaaagagctcacaaggagcttcgaattttgacaagctgatggacggcacgagtcaagctttggctaaggcaaatagcgaaagcagtaaggacggcctgaatcaggcaaagaaaggcggtgtcagttgcggcaccagctttcgtgggactgtcggaagaaccagggactataccgtcttacacccgtcgtgtctatccgtgtgcaacgtgaccatccaagacactatggagagaagtatggacgagttcacggcttcaacgcccgctgacctcggggaagctggcagactgcgtaagaaagctgatattgccactagcaaaacgaccacaaggtttaggccctccaacacaaagagtaaaaaggatgtgaaactggagtttttcggtttcgaggatcacgagacgggaggcgatgagggtggcagtggctctagcaactacaaaataaaatactttggctttgatgacctttctgaaagcgaggatgatgaggacgatgattgtcaggttgaaaggaaaacttcgaagaagcggactaagactgctccttcaccgtcgctgcagcctcccccagagagcaacgacaactcacaggacagccagagcggaacaaataacgcagagaacctggattttactgaagatctccctggagtgcctgagtctgtaaagaagccgattaataagcagggtgacaagagcaaagaaaacactaggaagatattctctggcccaaaaagaagtcctacaaaggccgtgtataatgccagacactggaaccaccccgactctgaagagcttcccggtcctcctgtggtgaagccccagagtgtgactgtgcgcctgagctctaaagagcccaatcaaaaagatgacggagttttcaaagcacctgccccaccgagtaaggtgattaagactgtgactatccccacccagccctatcaggacattgtgactgccctgaaatgccgcagagaggacaaggagttgtatacagtcgtccagcacgtgaagcatttcaacgatgtggttgagttcggcgagaaccaggaatttaccgatgacatagagtacttgctctccggactgaagtccacacagcccctcaacacacgctgcctgagcgtgatcagcctggccaccaaatgtgctatgccatccttccgaatgcaccttcgagcacacggcatggtggccatggtctttaagacgttggatgactcacagcaccaccagaatctgtctctatgcaccgctgctttgatgtatatcctcagcagagaccgactgaacatggacctggatagagctagtttagacctcatgatccgcctcctcgagctagaacaggatgcatcctccgcaaagttactgaacgagaaagatatgaacaagattaaagagaagattcggcgactctgtgagaccgtccataacaaacacttagacttggagaatatcacaaccggccatctcgctatggaaacactgttgtctttgacatcaaagcgtgctggcgattggtttaaggaggagcttcgattgctgggagggttggatcacatagtcgacaaggtgaaagaatgtgttgaccatttgagccgcgatgaggatgaggagaaactggtggcttctctgtggggagctgagaggtgtctccgggtgctggagtcagtcactgtgcacaatcccgagaatcagtcttatctgatcgcttacaaggactcccagttgattgtctcctcagccaaagcacttcagcactgcgaggaactgatccaacaatacaaccgagctgaagactcgatctgtttagccgacagtaaacctctcccacaccagaacgtgaccaaccacgtggggaaggccgtagaggactgtatgagggcaatcatcggcgtacttttgaacctcactaatgacaacgaatggggctccacaaagactggcgaacaggacgggctaattggaacggctctgaattgtgtacttcaggtccccaagtacctccctcaggaacagcgcttcgacatacgggtgctgggtctcggcctgctcattaacctcgtagagtatagcgccagaaacaggcattgtcttgtcaacatggagacatcttgtagttttgactcatcgatctgttccggggagggcgatgactcactgcgcattgggggacaggttcacgccgtccaggccctggtgcagttgttcctcgagagagaaagagctgcacagctggctgaatctaagactgacgaattgatcaaggatgcaccaaccacccagcacgacaaatctggggaatggcaggaaacctccggagaaattcagtgggtatctacggaaaaaacggacggtaccgaagagaagcacaagaaggaggaggaggatgaggagctagatttgaataaagccctgcagcacgccggtaagcacatggaggactgcatcgtggccagctatacggcccttctactggggtgcttatgccaggagagccctattaatgtaactacagtcagggaataccttccagaaggcgatttttcaattatgactgagatgcttaagaagttcttatcctttatgaacctcacctgcgcagtcggcacgacgggccagaaatccatatctagagtcatagagtatctggagcactgctag

SEQ ID NO: 246889 - DNA, 1209 bp, Artificial Sequence
  Description of Artificial Sequence: Synthetic coding sequence
atggatctggacagagcatcactggatttaatgattagactgctggaattggaacaggatgcttcttccgccaaactgctaaacgaaaaggacatgaacaaaatcaaggagaaaatccgccgactgtgtgaaacagttcacaataagcatctggacctggaaaatatcactaccggacacctcgctatggagacacttctaagcctcactagtaaaagagctggcgattggttcaaggaggagctccgtttgctgggcggattggaccatattgtggataaagttaaggagtgcgtggaccacctgagcagagacgaagatgaggagaagttggtggcaagcctatggggcgctgaacggtgtctgcgcgtgctggaatcggtgaccgtgcataaccccgagaaccagtcctatctcatagcttataaggactcccaactcattgtaagcagcgcaaaagcactgcagcactgcgaagaattgatccagcaatacaacagagcagaggatagtatctgcctggcagactccaaaccactacctcatcaaaacgtcactaaccacgtcgggaaagccgtagaggattgcatgagagcaatcataggtgttctcctgaatctgacaaacgataacgagtggggcagtactaaaaccggcgagcaagacgggctgataggaactgccttgaattgcgtgctgcaggttccaaagtatttgcctcaggaacaacggttcgatatcagagtcttgctgtttctagagcgagagagggctgctcagctggcagagagtaagacagatgaactgatcaaagatgcaccgaccacacagcacgataaaagcggtgaatggcaggagacatccggagagatccagtgggtgtccacagagaagaccgatggtacagaggagaaacacaaaaaggaagaagaggacgaggagcttgaccttaacaaggctctgcagcatgcgggaaaacatatggaagactgtatcgtggctagctacaccgccttgttactgggttgcttgtgtcaggaaagccccataaacgtgacgacagtaagagagtacttgcctgaaggcgatttcagtatcatgacggaaatgctaaaaaagttcctctcttttatgaacctcacctgcgccgtgggcacaaccggtcagaaatctatctcgagggttattgagtatttagaacattgttag

SEQ ID NO: 246890 - DNA, 3828 bp, Artificial Sequence
  Description of Artificial Sequence: Synthetic coding sequence
atggttcagggacccgtccagacccctgctctgacaatccacaggcgaaaacgtaggcgctcatgccctcccaacagagctagctatctccccaaggcagagtcactagctagcttggggagccacctacccgctctgctcagcagggccagggtgcctcgccctccagccggtcggcgagaacgcgaaaggcggaggaggcctgtcgccaaggcgcctgcccgtctgaggggtgagtacgagacaggcgtgaagatgacttcacggttcggaaagacatactcaagaaaaggcggaaacggcagttccaagtttgacgaagttttctctaacaaacgtacaacacttagcactaaatggggggaaacgacattcatggctaaactgggccagaaacgaccaaacttcaagcccgatattcaggagatccccaaaaaacccaaggttgaagaagaatctactggagatccctttggattcgattctgatgacgagtctcttcccgtgtcaagtaagaacctggcccaggtgaagtgtagttcttactccgagtctagcgaggccgcacagctggaagaagttacctccgtgctggaagcaaattctaagataagccacgtagttgtagaggacacggtggtatcagataagtgttttcctcttgaggataccctactggggaaggagaagtctacaaaccgaattgtggaggatgatgccagcatctcctcctgtaacaagctgattacgagcgataaggttgaaaatttccacgaggagcatgaaaagaacagccatcacatacataagaatgccgacgacagtacgaaaaagcctaatgccgagaccaccgtggcaagcgaaattaaggagacgaatgatacttggaactcccagtttggaaagcggccagaaagcccatctgaaatctcccccattaaaggaagcgtgcgcaccgggctgttcgaatgggataacgatttcgaggacattaggagcgaggattgtatcctaagtcttgattctgaccccctcctcgaaatgaaagacgacgatttcaagaatcgtttagagaacctgaacgaagccatcgaggaagacatagtgcagtctgtacttcggcctactaattgccgcacatattgcagagctaacaaaaccaagagctcccagggcgcatccaacttcgataagctaatggacggtacttcacaggccctcgccaaagcaaacagcgaatcctcaaaggatggtctcaatcaagccaagaaagggggagtctcatgcggcacatcattccggggaacagttggcaggacccgcgattacacagtactacacccttcctgcctgtcagtgtgcaacgttaccattcaggacaccatggaaaggagcatggacgagtttacggcatctacgcccgctgatcttggggaagccggtcgattgcgaaaaaaagcggatatcgccaccagtaagacaacgacaaggttcagacccagcaatacgaagtctaaaaaagacgtgaagctggaattttttggattcgaggatcacgagaccggcggagacgaaggcggaagtggaagttctaattacaaaattaagtactttggcttcgacgacctgtccgagtcggaagacgacgaggatgatgactgtcaggtggagagaaaaacgtctaagaagcggaccaaaaccgccccaagcccctccctgcaacctccacccgagtccaatgataactctcaggatagccagtcgggcacaaacaatgcagagaatctcgacttcactgaagatctgcccggagtgcctgaaagtgtgaagaagccaatcaacaagcagggtgataagtccaaggagaataccaggaagatcttttcagggcctaagagatccccaacaaaagcagtttataacgctagacactggaaccatcctgacagcgaggagctgcccggtcctcctgtcgtgaagcctcagtctgttaccgtgcgattatcctctaaagagccaaatcaaaaagacgatggcgtattcaaagccccagccccaccttccaaagtaattaagacggttactatccccacgcagccctaccaagatatcgtgacggccttaaaatgccgtcgagaagacaaagagctctacactgtagttcaacatgtcaagcactttaacgacgtggttgaattcggcgaaaaccaggagtttacagatgacatagagtacttactgtcaggcctaaagtctacacagccacttaacactagatgtctcagtgttattagcctggctaccaaatgcgctatgccctccttccgcatgcatctgagggctcacggtatggtcgcaatggtcttcaaaaccctagatgactctcagcatcatcagaacttgtccctgtgtacagctgctttaatgtatattttgtcgcgtgaccggttgaacatggatctagatagagcatccctggacctcatgatcaggttgcttgagctggaacaagatgcaagttcggcaaaactgctaaatgagaaagatatgaataagattaaagaaaaaatccgtcgcttgtgtgagacggtgcataacaaacacctcgatctcgaaaatatcactacaggccatttagcgatggaaactctgctgtccctcacgagtaaaagggctggcgactggttcaaggaggaattaagacttctagggggactggaccacatcgttgataaagttaaagaatgtgtggatcatctgagccgggacgaggatgaagaaaagttggtggctagtctttggggtgctgagcgttgtctcagagtcttggaatcagtcaccgtacacaaccctgagaatcagagctacctaatcgcgtacaaggactcacaactgattgtctctagtgctaaagccctacagcactgtgaagaacttattcagcagtacaacagggccgaggactccatctgcctagccgattccaagcctctcccacaccagaacgtgaccaaccatgtcgggaaagctgtcgaggactgcatgcgcgcaatcattggcgtcttactaaatctgacgaacgacaatgagtggggctctaccaagactggcgaacaagatgggctaattggaaccgcgctgaactgcgtcctgcaggttcctaagtacctcccgcaggagcagcgcttcgatatccgtgtgctgggcttgggccttctaatcaacctggtagagtactccgctcgcaaccggcattgtctcgtgaacatggagacttcttgttccttcgatagcagcatatgctctggcgaaggcgacgattccctgagaatcggtggacaggtccacgcagtccaggctctggtgcagctattccttgagagggagcgggcagcccagttggccgagagtaagacagatgaactcattaaggacgcccctacgacccagcacgataaatccggtgagtggcaagagacaagcggcgagattcaatgggtgagcaccgagaagacagacggcaccgaagagaagcacaagaaagaggaggaggacgaggaactggacctgaataaggctctccagcacgccggtaaacacatggaagactgcatcgtcgctagttatacagccctcttgctgggctgtctctgccaggagtctccaatcaacgtgacaacagtcagggagtacctccctgagggcgatttctccattatgactgagatgctcaagaagtttctctccttcatgaacctgacgtgcgctgtggggacaactggacaaaagagtattagccgggtcatagaatatcttgagcactgctag

SEQ ID NO: 246891 - DNA, 1509 bp, Artificial Sequence
  Description of Artificial Sequence: Synthetic coding sequence
atgtcgggaggccctatgggtgggcgaccaggaggtagaggcgctccagcagtgcagcagaacatacccagcacactcttacaggaccatgagaatcagaggctctttgagatgctaggcaggaagtgcttaaccctcgccaccgccgtggttcagctttatctggcacttcctcctggcgcagaacactggactaaggagcattgcggggcagtgtgcttcgtaaaggacaatccacagaaatcttactttattcgcctgtacgggctgcaggccggacgcctgctctgggagcaggagctgtattcccaactagtctattcgactcccacccctttcttccacacttttgcaggggacgactgtcaggctggtctgaactttgccgatgaagatgaagctcaagcatttcgcgcactggtgcaagaaaagatccagaaacgaaatcagcgtcaatcaggggaccggagacagcttccgcctccacctactccggctaatgaggagcgcagaggaggcttaccgcctctgcctctgcatccagggggtgatcaaggaggaccaccggttggacctttgagcctgggacttgcaactgtagacatccagaaccccgacataacttcttcacgctatcggggactgcctgctccagggccaagtccagctgataagaaacgatccggaaagaagaaaatatctaaagcggatattggggcaccctcaggctttaagcatgtctcccacgttggatgggaccctcagaacggatttgatgtgaataatctggaccctgatctgagatcactttttagccgggctgggatcagtgaggcccaactcactgacgcagagacaagcaagctgatttacgactttatcgaggatcagggcggtctcgaggccgtgcgacaagagatgagaaggcaagaaccactaccacctcctccacctccttcgcgcggtggcaatcagcttcccagacccccaatcgtcggcggaaacaaagggagatcagggcctcttcccccagtgccgctgggaatagctcctcctcctccgacaccacgaggaccccctccaccgggaagaggcggtcctccacctccccctccacccgctaccggcagaagtggccctcttccccctccccctcctggtgctggtggccctcccatgcccccaccaccaccccctccaccaccgcctccctctagcggaaatggcccagcacctccgccactccccccagctctcgtgccagcgggaggattggctcctggagggggtcgtggcgcactgctggaccagattagacagggaattcagctgaataaaacccccggagcacctgagtcttcagctctgcagcctccaccccagtctagcgagggcctagttggggctctcatgcatgtgatgcagaagagaagccgtgcaattcattccagcgatgagggagaggaccaggcaggcgacgaagatgaggacgacgaatgggatgactag

SEQ ID NO: 246892 - DNA, 654 bp, Artificial Sequence
  Description of Artificial Sequence: Synthetic coding sequence
atgagcggtggtccgatgggaggtagaccaggcggtcgcggagctccagctgtgcagcaaaatattccaagtactctcttacaggatcacgaaaaccagagactcttcgaaatgttaggaagaaaatgcctgaccttggccaccgcagtggtgcaactctacctggcgctgccccctggcgctgaacactggacaaaagaacattgtggtgcagtgtgcttcgtgaaagataatccccagaaaagttacttcattcggctgtacggcctgcaagctgggagactactttgggaacaggaactgtacagtcagcttgtgtacagcaccccgacacctttctttcacactttcgcaggagacgattgtcaggccggactgaatttcgcagacgaggacgaagctcaggcctttagagcattggtgcaggaaaagattcagaagcggaaccaacggcaatcaggcgataggagacagctccctccccctcctacaccagcaaacgaggagcgacggggaggtctgcctcctttgcctctccaccccggaggtgaccaggggggtccgcctgtgggtcccctgtccctgggcttggccaccgtcgacattcagaaccccgatattacttcatcgcgatacagggggttgcctgcgtag

SEQ ID NO: 246893 - DNA, 4668 bp, Artificial Sequence
  Description of Artificial Sequence: Synthetic coding sequence
atggcaaaagctattaaggacagggtctcactgattaagagaaaaagggagcagcggcagttagtgagggaggaacaagagaaaaagaagcaggaggaatctagtctcaaacagcaggtggaacagtccagtgcctcccaaaccgggataaaacagctgcccagcgcttccaccggcatcccaaccgcctccaccacaagcgcctccgtgtccacacaggttgaaccagaggagcctgaggctgaccaacatcaacagctccagtaccaacagccatctatttcggtgctgtccgatggcactgtggacagtggccagggaagttctgttttcactgagagtcgtgtctcttctcagcagacagttagctatggcagtcaacatgaacaggctcacagtactggcaccgtcccaggacacatccccagtacagttcaagcacagtcccaaccacatggagtgtacccaccctcctctgtacagcagggcatccaacagacagcccctccccagcagacagtccagtattccctctctcagacctccacaagcagtgaggcaaccactgcccagcctgtctctcagccacaggcaccccaggtgctgcctcaggtctcagctggtaaacagtctacacagggcgtgtcccaggtcgccccagccgagcccgttgctgttgctcaaacacaggccacacaacccactaccttggcttcatctgtggactcagcccactccgatgtcgcaagcggtatgagcgatggcaacgaaaacgtcccttccagcagtggtcgacatgagggaagaaccactaaacgacactacagaaagagcgtgaggtccaggtcccgccacgagaagaccagcaggccgaagctgagaatactgaatgtttccaataagggtgatagagtggtggagtgccagctggagacacataataggaaaatggtgacgttcaagtttgatctcgatggcgataatcctgaggagatagctaccattatggtcaacaatgattttatcctggccattgagcgagagagctttgtggaccaggtccgcgagatcattgaaaaagctgatgagatgctttcagaggatgtgtctgtggagcctgagggcgaccagggactggaatcccttcaggggaaagatgactatgggttcagtggttcacaaaagctcgaaggcgaatttaagcagcccattcccgctagtagtatgccccagcagataggaataccaacttccagtctgactcaagtggtgcattcagccggacggaggttcatcgtttctcccgttccagagtccaggctccgggaatctaaagtcttcccaagcgagataaccgataccgtcgccgcatctaccgctcagagccccggaatgaacctgagtcactcagcatcaagtctatccctgcagcaggcattttccgagctgcggcgtgcacagatgacagagggccctaatacagccccacccaatttttcccacaccggaccaactttccccgtcgtacctccattcctgtccagtattgctggtgtgcctacaacagccgcagcaacagcgccagtgcccgctactagtagccccccaaacgatatttcaaccagcgtaatccagtctgaggtgacagttccaaccgaggaggggattgctggcgtggcaacaagcactggcgttgtcaccagcggcggtctccccattccacccgtctccgaatcacccgtactgtctagcgtcgtcagtagcatcactattcccgcagtggtctctataagtacaacctcaccctcacttcaagttccaacgtcaaccagcgagattgttgtgtcctccacagcgctgtaccctagtgtgaccgtgagtgcaaccagcgcttcagcaggcggtagtaccgccactcctggcccaaaaccgcctgcagttgtgagccagcaggctgctgggtctaccacggtgggagccactctgacctccgtgtccacgaccacctcctttccgtcaacagctagccaactttgcattcagctcagcagctctactagcacgccaacactggcagagactgtggtcgtgagcgctcactccttagacaagacctcacatagctccaccacaggattagcattctctctgtcagcgccttcatcctcctcttctccaggtgctggagtctcgtcttacataagccagcctggcggtctccatccactcgttatcccctcagtgatcgcttctacaccaatcttgcctcaggcagcaggaccgacctccacccccctgttaccacaagtgccctctatccccccactggtccagccagtcgctaacgtgccggctgtgcaacagactctaatacactctcagcctcagccggctctcctgcccaaccagccacacactcactgccctgaggttgacagtgacacacagcctaaggcgcctggcattgatgacattaagactctcgaggagaagctcaggagcctgttctctgagcattcctcatctggcgcacagcacgcatccgtgagtctcgagacaagcctagtcattgagagtaccgtgactcccggtatccccacaacggccgtggctccatcaaaattgctcacaagtacaacatcaacatgcttaccacccacaaatctcccactcggaacggtcgcccttcccgtgactcccgtggttacaccaggacaggtcagtacaccagtgagtacaactaccagcggtgtgaaacccggtacagccccatcaaaaccccctctgacaaaggccccagtgttgccagtcggaactgagcttccggctggcactctgcccagcgagcagctacctccatttcccggaccatccctaacgcagtcgcagcagcccctcgaagatttagatgcccagctgaggaggactctgtcaccagaaatgattaccgtcacatcagctgtcggaccagtaagcatggcagcacctacagccatcaccgaggctggtacgcagccacagaagggagttagccaggtgaaagagggacctgtattagccaccagctccggcgctggagtattcaaaatgggaaggtttcaagtctcggttgcagcggatggcgctcagaaggaagggaagaacaaatctgaggacgcgaagtctgtccattttgagtcctccaccagtgagtccagcgtcctgtctagtagtagccctgaatcaacattggtgaagcctgaaccaaacggtatcactatcccaggaatttcatcagacgtgccagagagtgcccataaaactactgcatccgaggctaagagtgacaccgggcaacccaccaaagtggggaggttccaggtaactactacagcgaacaaggtagggcgattttcagtgagcaagacggaagacaagataacagataccaagaaggaaggcccagtggcctctccacccttcatggatctggaacaagccgtgctgcctgcagtaatccctaagaaagagaagcccgaattatctgagccgtcccacctgaacggcccttctagcgaccctgaggctgccttcttgtcacgcgacgtagatgacggatcaggaagcccccatagcccccaccagctgagcagtaaaagcttgccttcccagaacttgtcacagagtttgagtaactccttcaactcttcctatatgtcgtcagacaacgagtctgatattgaggatgaggacttgaaattagagctgcgcaggcttcgtgacaagcatttgaaggaaattcaggatcttcagtctcgacaaaaacatgagatcgaatctctttacaccaagctcggcaaggtgccacccgctgtcatcatccccccagctgcacctctgagtggaaggcgaagaaggcctacaaagtctaagggctccaagagttccagaagttcctctctaggcaataaatcacctcagctaagcggcaatttgagtggtcagtccgcggcatctgtgctgcacccccagcagaccttgcacccacctgggaacatccctgagtctggccagaaccagctcttacaaccactcaagcccagccctagttccgataacctgtacagcgccttcacctctgatggagcaatcagcgtccctagcttatccgcccctggccaagggactagtagtacaaatacagtcggcgcaacagtgaatagccaagccgcacaggctcagcccccagccatgacgtcctccagaaaagggactttcactgatgacctgcacaaattggttgataactgggctagagatgccatgaacctgtccgggagacgtgggagcaaggggcacatgaactatgaagggcctgggatggcgaggaagttttcggccccagggcaactgtgcatttcgatgacctctaatctgggcggatcagcacccatcagtgcagcctccgccacatcccttggccacttcaccaaatcgatgtgtcctccccagcagtatgggttccccgctacgccatttggggctcagtggtcggggacaggaggaccggctccccaacccttggggcagttccagcctgtgggaaccgccagtctccaaaacttcaatatcagcaatctccagaaaagtatctcaaacccaccaggatccaatctgcgaacaacatat

SEQ ID NO: 246894 - DNA, 7148 bp, Artificial Sequence
  Description of Artificial Sequence: Synthetic coding sequence
atgtccgggggagccgcagagaaacagtcgagcactcctggatcgttatttctgagtcctccagcccctgctccaaagaacggaagtagctctgatagttcagtgggggaaaagctcggagccgcagccgctgacgcagttacagggagaaccgaggaatacagacgccgtcggcatacgatggacaaggacagccgaggagcagcagccaccactacaaccaccgaacatagattttttaggaggtcggtcatttgtgacagtaatgccaccgctctagagctgccaggcttacctctttctctcccacagccttctattcctgccgcagtgccccaaagcgccccaccagagcctcaccgggaggaaaccgtgacagccacggctaccagtcaggtggcccagcagcccccagccgctgccgcacccggagaacaggccgtggccggtccagctccaagcacagtgcctagctccacctccaaggaccgtcccgtatcacaacctagcctcgttggaagtaaggaggagccacccccagctcgcagtggctctggagggggatccgctaaggaaccacaggaagagcggtcccaacagcaggatgacatcgaggaactcgagacgaaagcggtgggcatgtctaacgatggacgctttctgaagttcgacattgagattggccgagggtccttcaagaccgtatacaagggtctcgacaccgagacaaccgtggaggttgcctggtgtgagctgcaggaccgaaaactgacaaaatccgaaaggcagagattcaaagaggaagccgaaatgcttaaagggctgcagcacccaaatattgtgcggttctatgatagttgggagtctacagttaagggcaaaaaatgcattgtactcgtcacagagctcatgacatccggcaccctgaagacctatctgaagagattcaaagtaatgaaaataaaggttcttcgctcgtggtgcaggcagattctgaagggcctgcagttcctccatacaaggactcctcccataattcatagagacctcaaatgcgataatatttttataacaggtcctacagggtcggtcaaaatcggagatcttggtcttgccaccctcaaaagagcgtcttttgctaaatccgtgataggcacgccagaattcatggccccagagatgtacgaagaaaaatatgacgagagcgtagacgtgtatgcctttggcatgtgtatgctggagatggctacctctgaatacccttactcagaatgtcagaatgctgctcagatctatcgtcgtgttacatcaggtgtaaaacccgcttcattcgacaaagttgccatcccagaagttaaggagataatcgagggttgtatcaggcagaataaggacgaacgatacagcattaaagaccttttaaatcatgctttcttccaagaagaaaccggggtccgggtggagctggctgaggaggatgacggtgaaaagatagccattaagctctggctccgaattgaggatatcaagaagttgaagggaaaatacaaagataatgaggccatcgagttttcattcgatttggaaagagatgtgccggaggacgtggcgcaggaaatggtggaaagcggctacgtctgtgaaggcgaccacaagaccatggccaaagccatcaaagatagggtgagcttgatcaaacgaaagagggagcagaggcagttggtgagagaagaacaggagaagaaaaagcaagaggaatctagcctcaaacaacaggtcgaacagtcttctgcctcccagaccggcatcaagcaactgccctcagcctctactggtatccccacagctagcaccaccagcgcaagcgtttctacacaggtggaaccagaggaacctgaagctgatcagcaccagcaacttcagtaccagcagccgtcgatttctgtcttgagtgacggcaccgtggactctgggcagggatcgtccgtgttcactgaaagccgcgtctctagccagcagactgtgagctatggaagtcagcacgagcaagcgcattctaccggaactgtgcccggtcacatcccttccactgttcaggcacagtctcagccacacggagtatacccaccttcaagtgtggcccaggggcaatcccaggggcagcccagtagctcttccttaaccggcgtgtcgtcctctcagcccatccagcaccctcagcaacagcagggcattcagcagacagccccaccgcagcagaccgtccaatacagcctaagccagacaagcacttcttcggaggcaactactgcgcaaccagtcagccagccccaggccccacaggtgttgcctcaggtttcagccggtaaacagttaccagtgtctcagcccgtgccaacaattcagggagagccacagatccccgtggcaacacagccatccgtagtccctgtccattctggtgcgcacttcttaccagtgggccagccactgccgactcccttgctcccccagtacccagttagccaaatccctattagcacacctcatgtgtctaccgcccagaccggtttcagctcgctgcctattacaatggctgcaggcatcacccagcctctgctgacgctagcttccagtgctaccaccgcagcaataccaggagtctcaactgtcgtgcctagtcagctaccgacactgttgcagcctgtcacccagctgccttcccaggtgcaccctcaacttctgcagcccgctgtgcagtctatgggtattcccgctaatctgggccaagccgctgaggtgccgctgtcctcaggcgatgtcctgtaccaggggtttccacccaggttgccaccgcagtatcctggcgactcaaacattgcaccctcctcaaacgtggcatctgtatgcatccattcaaccgtcctgtcaccccctatgcctacagaggtgcttgccactccaggctacttcccaactgtcgttcagccttacgtagagtccaacctactggttcccatgggtggagtgggtgggcaagtgcaggtgtcacaaccaggaggctccctcgcgcaggcgcctactacttcctctcagcaggctgtgctcgaatctactcagggagtctctcaggtggcgcctgccgaacccgttgccgtagcccaaacacaggccacccagcccacgacacttgccagctctgtcgacagtgcccatagtgatgttgcatctggaatgtccgatggcaacgagaacgtcccaagttcctcagggcgacacgagggaagaaccaccaagcgccactaccggaagtctgtgcggtcccgctcccgccacgagaagaccagccgcccaaagctgcggattcttaatgttagtaacaagggagaccgcgtggtggagtgtcaactggaaacccacaataggaagatggtaacttttaaatttgaccttgatggcgataatccggaggagatcgctaccattatggttaacaatgactttatcttggccatagagcgggagtccttcgtcgatcaggttcgggagatcattgagaaggcagatgagatgctatctgaggacgtaagcgtggagcccgagggcgaccaggggcttgagtcactgcagggcaaggacgattatggcttctccggttcgcagaagctcgagggggaatttaaacagcctatccctgctagctccatgccacagcagatcggtatccctacatcaagtctgacacaggtcgtgcattctgcaggcagaaggttcattgtgtccccggtgcctgagtccaggctgcgcgaatcaaaggtgttcccaagtgaaataactgacacagtcgccgcatcgactgcacaatcacccggtatgaatctaagccattcggcttctagcctgtctttacagcaggctttctctgaactcaggagggcccagatgacagagggcccaaatacggcgcctcccaacttctcccatactggtcccacttttccagttgtgccaccatttctgagttctattgcgggagtgcccaccactgcagccgcaacagcaccagtccccgctacttccagtccacccaacgatataagtacatctgtcatccaatccgaggtcacagtccccactgaggaagggattgccggtgtggccactagcacgggcgtagtgacctccggaggactccccattcctcccgttagtgaatccccagttctctcatcagttgtgtcgtccattacaattcccgcagtggttagcatctccactacatctccatctctccaggtgccaacaagcacgtcagaaatcgtcgtgtcctccacagctctatacccctctgtcacggtgtctgccacctccgcttccgccggaggtagtacagccacacctggacccaagccacccgcagtggtgtctcagcaggctgctggatctactaccgtaggcgctactttgacttccgttagcacaacgacttcctttcccagcaccgcctcccagctctgcatccagctctcatcgtcaacttctacgcctacacttgctgaaaccgttgtcgttagcgcccattctctagataagacttcccactcctcaactacggggttagccttctccctttcggcccctagttcctccagctcacctggagctggggtgtcatcttatatttcccagcctggtgggcttcaccccctggtcattccaagcgtcattgcctctaccccaatcttgccacaagccgcaggacctacatctacccctttgctgccacaggtcccctccattcccccactggtgcagccagtggcaaacgtacctgccgtacagcaaacactgatccacagtcagccacaaccagcattgctgcccaaccagccacacacacactgccccgaagtggactcagacacacagcccaaagctcccggaattgatgatatcaaaaccctggaagagaagctaagaagccttttctccgagcattcgtcctcaggtgctcaacatgcctccgtctctcttgagacttccctagtcattgaatccaccgtaacacccggtatcccaacaaccgctgtggcaccttctaagctgctgacgtcgactactagtacctgcctaccgcctactaatttacctctcggaaccgtcgccctgcccgtcactcccgtggtgacccctggacaggtgtcaacgcccgttagcaccaccacctcaggcgtcaagcctggaaccgcacccagtaagccccctttaacaaaggcaccagtcctcccagtgggaaccgagctccccgctggcactttacctagtgaacagctccctcctttccctgggccaagcttaacccagagtcaacagcctttggaagacctggacgcacagctgcggagaacactatctcctgagatgattacagtcacctccgcagtcggacccgtgtcaatggcagccccaaccgcaatcaccgaagcaggaacacagccccagaaaggcgtttctcaggtcaaagaaggtccagtgctggccacctcctctggggcaggcgtctttaaaatggggcgatttcaggtgagtgttgccgcagatggcgcacagaaagagggaaaaaataaatccgaagatgccaagtccgtgcattttgagtcaagcacttcagaaagctctgtgctaagtagttcctctcctgagtccactctggttaaacctgagcccaacggcattacaatccctggtatcagcagcgacgtgccagaaagcgctcacaaaaccacagcctcggaggcgaaaagcgacactgggcagcccacaaaggtgggccgattccaagtaaccacaacagcaaacaaagtaggaaggttttccgtctcaaagactgaggataagatcacagacactaagaaggaaggacccgtcgccagccccccttttatggatctagaacaagctgtcctgccagctgtaattccgaagaaggagaagccggagctgtctgagcccagccatctgaacgggccaagctccgatccagaagcagcctttctaagcagggacgtggatgacggcagcgggtctccccatagtccacatcagctgagctctaagagtctcccttctcagaatctgtcccaatccctctctaatagtttcaactcgagttacatgtcatccgacaatgaaagtgatatcgaggatgaagacctcaagctggaattaaggcgcctccgcgataagcacctgaaggaaatccaagacctgcagtctaggcagaaacatgaaatagagtccttgtataccaaactgggcaaagtgcccccagctgtgataatcccgccagcagccccactctccggcaggcgaaggaggccaactaaaagcaaagggagcaagagttcccggtcatcatccctcggaaacaaaagtccccagctctcgggcaacctctctgggcagtctgctgcatcagtgctgcacccacagcagactcttcaccctccagggaacatcccagaaagtggacagaaccagctgctacagccgcttaagccttccccatccagcgacaatttatactccgctttcacttctgatggagctatttccgtgccttctttgagtgcccctggtcagggcacctcgagtaccaacactgtcggggctaccgtaaatagtcaggctgcccaggcccagcctcctgctatgacatcgtcgcgtaaaggaacatttactgacgatctgcataagcttgttgataactgggccagggacgcaatgaatctgtctggtaggagaggtagcaaaggccatatgaactacgaagggcctggcatggccaggaaatttagtgcacctggccaactgtgcatctctatgacatccaatctcggtggcagtgctcccatttcagcagcttcagcaacatcactgggccactttaccaaatccatgtgtccccctcagcagtatggatttccagctactccatttggtgcccagtggagtggaactggaggcccagcccctcagcccctgggccagttccagcctgttggtacagctagtctccagaactttaacatctccaaccttcagaaaagcatctctaatccaccaggaagcaatttgaggacgactta

SEQ ID NO: 246895 - DNA, 5927 bp, Artificial Sequence
  Description of Artificial Sequence: Synthetic coding sequence
atggatatcaagaagaaggacttttgcagcgtatttgtgataattaactcccactgttgttgctgcccacagaaagactgcattaacgagggcgtgaaaccagcctcattcgataaggtggccatccctgaggttaaagagatcatagaagggtgcatcaggcagaacaaggacgagcgatactcaatcaaggacctgttaaatcacgccttcttccaggaggagacgggtgtgagagtggaacttgcagaagaggatgacggagagaaaatcgcaattaaactttggctgaggatcgaagacatcaaaaaattaaagggaaaatataaggataatgaggccattgaatttagctttgatctggagagggacgtgcccgaggacgttgcacaggagatggtggagtcaggatacgtgtgcgagggggaccacaagacaatggccaaggctatcaaagaccgagtcagccttatcaagagaaagagagagcagcgacagcttgtgagggaggagcaagagaaaaaaaagcaggaagagtcttcacttaagcaacaggtcgagcagtcttccgcatcacaaacagggatcaagcaacttccctccgcaagtaccgggatccccaccgcctctacaacatcagccagtgtctctactcaggtcgaacccgaagaacctgaggctgatcagcaccagcagctccagtatcagcagcccagcatttcagttctgtctgatggcacagtggactcaggacaagggtcctctgtctttaccgaatctcgggtgtcctcacagcaaacagtgagttatgggtcccagcatgagcaggcgcattctaccggcacagtgccaggccacataccttccacagttcaagcacagagtcagccacatggtgtgtatcccccatctagcgtggcacagggccagagtcagggtcagccatctagctcctcactgaccggggtatcttcttcccagcccatacagcatccccagcaacagcaggggatccagcagacagcccctccgcagcagactgttcagtattcattatctcagacttccacatccagcgaagcgacgacagcacagccggtgtcacagccacaggccccacaagtcttgcctcaggtcagtgcagggaagcaactacccgtctcacagcctgtccctacaatccagggggaaccacagatcccagtggccacccagccatcagtggttcccgtgcactccggcgcacactttctgccagtcggtcagccactcccaacccctctcttgccccagtatccagtgtcccagatcccaatttcgaccccgcatgttagcaccgcccagacaggattttctagtctcccgattaccatggccgctgggattactcagccactgctgacattggccagtagcgccaccaccgctgctattcccggtgtctcaacagttgtgccttcccagctgccgaccctgctgcagccagtgacccagctgcccagccaggtccacccgcagctattgcaacccgctgtgcagtcaatggggatacccgctaatctgggccaggctgcagaagtgcctctctcgtccggtgacgttttataccagggcttcccccctcggctgccaccccagtatccgggagactctaacatcgctccatcctctaatgtagcatccgtctgcattcactctactgtgctttcgcctccgatgcccaccgaggtgctagcaacacccggatactttccaaccgttgtgcagccctacgttgagtccaacctactcgtgccaatgggaggagtgggcggacaggtccaggtctcgcagcctggaggtagtttagcccaggcacccaccacctcctctcagcaggctgttctggagtccacacagggggtcagccaagtagcaccagcggagcctgtcgcggtcgcacagacccaggccacgcagccaacaactcttgcctcatctgtcgactcagcccactccgatgtggcctcgggcatgtctgacgggaatgaaaacgtgccctcatcttcaggtcggcacgagggaaggaccactaaaaggcactatcgcaagtcagtgcgaagcagatcccgccatgaaaagacttctaggccaaaattaaggatcctgaatgtgagcaataagggggaccgggttgtggagtgccagctcgagacacacaatcgtaagatggtgacatttaaattcgacctggatggggataatcccgaagagatcgccaccattatggtgaacaacgattttattctcgccatagagcgagaatcatttgtcgaccaggtgagggaaattatcgaaaaagccgatgaaatgctgtcggaagatgtaagcgtggaaccagagggcgatcagggacttgagtctctccaggggaaggacgactacggattcagtggaagtcagaaactcgagggggagtttaaacaacctattcctgcaagcagcatgccacagcagataggaatccccacaagtagtttaacacaggtggtacatagtgctggcagaaggttcattgtcagccccgtgcctgaaagtaggttgcgcgagtctaaagtgttccccagcgagattaccgatactgtggctgccagtaccgcgcagtcacccggaatgaacctttcccattctgcaagctcgctctctttacaacaagctttctccgagttgaggcgggctcagatgaccgaaggtccgaacaccgctcctccaaatttctcccatacggggcctacgttccccgtagtaccacccttcctgagttccatcgctggagttccaactacagctgccgcaacagcacccgtccctgccactagcagccctccaaatgacatatccacatcagtaattcaatcagaggtgacagtccctacggaggagggcatcgccggtgtggcaactagtacaggtgtcgtgacttctggaggactccccattcccccagtgagtgagtccccagttctgagttcggtggtatcctcaatcacaatccctgcggtcgtgtccatctctacaacatcaccatctctgcaggtgcccacttcaacaagtgagattgtcgtgtctagcaccgctctgtacccttccgttaccgtctccgcaacttccgcaagcgctggagggagcacggcaactccaggcccaaagccgccagcagtcgtcagtcagcaggcagctggatcaactaccgtcggggctaccctcaccagcgtgagtactacaacatcttttccgtccaccgcttcccagctatgcatccagctgagctcctcaacttcaacacccacactggctgagacggttgtggtaagtgctcacagcctggataagacatcccattccagtacgactggattagcctttagtctgtccgccccatccagttctagctcgccgggtgccggagtcagctcttacattagccagcctggcggtctgcacccactggtaatcccaagcgtaatcgcctcaacccctatcttacctcaggcagcaggtcccactagcacacccctgctgccccaggtcccatcaatccccccactagtccagcctgtcgccaatgtgcccgcagtccagcagactctgattcactctcaaccacagcctgcactcctacccaatcagccccatactcattgtcccgaagtagactccgacacacagcccaaagcacccggaattgacgacatcaaaacactggaagagaagctgagaagtctcttttcagagcactcttctagcggagctcaacacgctagcgtgtccctcgaaacatcccttgtgatcgagagtaccgttacaccgggtatccccacgaccgcggtggcccctagtaagttgcttaccagcactacatctacctgtctgccaccaacaaacttacctttaggaacggtggctttgcctgtgactcccgtcgtgacccctgggcaagtctcaaccccagtttcaactaccacaagcggggtaaaacctggcaccgcgccttctaagcctcccttgaccaaggcacctgtgctgccggtcgggacagagttgcccgcaggaacattgccctcggaacagctcccaccatttccaggtccctccttaacccagagccagcaaccgctcgaagacctcgacgcgcagttgaggcggactttatcacccgagatgatcaccgttacttcggccgttggacccgtctctatggctgcacccaccgcgattacagaagccggtacccagccccaaaaaggcgtttcccaggtcaaggagggtccagtgttggcaactagttcgggggctggcgtcttcaaaatgggcaggttccaagtgtctgtggcagctgacggagctcaaaaagagggtaaaaataaatcggaggatgcaaaaagtgtgcatttcgaatctagtacgagcgagtctagcgtgctctcatcgagctcccctgagtctacacttgtgaaacctgaaccaaatggcatcaccataccgggaatttcgagtgacgttccagagtctgcgcataaaacgactgcgtcagaggctaaaagcgacaccgggcagccaactaaagtcggacgttttcaggttacaacaaccgccaacaaagtcgggagattttccgtaagcaagactgaagacaaaatcacagatacaaaaaaggaggggcctgttgcttcaccccctttcatggatctggagcaggctgtgctgccagctgtgatcccaaaaaaggagaaacctgagttaagcgagccctcacatcttaacggaccttcttcagaccccgaggctgcatttctttctagagatgtagacgatggatctggatcccctcattcgccacaccagctcagctccaagtcactgccatcacagaacctgtcccagtccctgtctaactcattcaactcgagctacatgagctccgacaacgagagcgatattgaggacgaggatctgaagctcgaactgcggcgtctgcgggataagcacttaaaggagattcaggaccttcagtcccgtcagaagcatgagatcgaaagtctgtatacgaagctgggcaaggtaccacccgcagttatcatcccgccagctgctcccttaagtggccgacgaaggcgccctaccaaatcaaagggatcaaaatcctcccgtagcagctcgctgggcaacaaatctccacagctgtcggggaatctatcaggacagtccgccgctagcgtgctgcacccccaacaaacactgcatcctcctggaaacatccctgaaagcggacaaaatcaacttctccaacccctgaagccttcgccatcttctgataatctttattccgctttcactagcgatggcgcaatatcggtcccaagcttgagtgcgccagggcaggggacatccagcacgaacaccgtaggagctacggtgaattctcaggcggctcaagcacagccccctgcaatgactagttcaaggaaggggacatttaccgacgatctgcacaaacttgtcgacaactgggcgcgagacgccatgaacctgtcaggcagacgtggttctaaaggccatatgaattatgagggtccaggcatggcaaggaaattctctgcaccaggacaactatgtattagcatgacctctaacctgggaggtagcgcacccatctcggctgcctcagccaccagcctggggcacttcacaaaatcgatgtgcccaccccagcagtacggctttcctgctacacccttcggcgcacagtggtccggcaccgggggacccgcaccacagcccctgggtcaatttcagcccgtggggactgcctcactacagaatttcaacatctctaacctgcagaaaagcatctccaatccgcctgggagtaacctccgtaccaccta

SEQ ID NO: 246896 - DNA, 1182 bp, Artificial Sequence
  Description of Artificial Sequence: Synthetic coding sequence
atgtccggcggtgctgctgagaagcagagcagcacgccaggcagcctcttcttgagccctcccgcacccgctccaaaaaacggttcgtcaagcgatagctctgtgggcgagaagctgggagctgcagccgctgacgccgtgactggtcgaaccgaagagtacagaaggagacggcacaccatggacaaggacagcaggggggcagctgccacaacaaccactaccgaacaccgcttctttaggaggagcgtgatctgcgacagtaatgcaaccgccctggagctcccaggactgccactgagtttaccccagccgtcgatcccggcagcagtgccccagagtgccccaccagagcctcatcgcgaggaaacggtcaccgcaacagccaccagccaggtcgcgcagcagcccccagcagccgctgcaccaggcgagcaggcggtggcagggcctgcacccagcacagttcctagttctacctccaaagataggcctgtgtcgcagccaagtctcgtgggctccaaggaagagccccctcccgcacgtagcgggagtggtggcggaagcgctaaggaaccccaggaagagaggtcacagcagcaggacgacattgaggagctggaaacaaaggctgtgggtatgagcaatgatggaagatttctcaaatttgatattgagatcggacggggaagttttaaaactgtgtacaaggggctggacaccgagactacagttgaggtagcttggtgtgaactgcaggaccgaaagctcactaaaagcgaaaggcaacggtttaaggaggaggctgaaatgcttaagggcctgcagcacccgaatatagttcggttttacgattcgtgggaatccaccgtcaaaggcaagaaatgcattgtgctggtaacagagttgatgacctcaggaacactaaaaacttatctgaagcgatttaaagtgatgaagattaaggtgctgaggtcatggtgtagacagatccttaaggggcttcagttccttcatacgaggaccccgcctattattcacagggatttaaagtgtgataacatcttcatcactggtccaactggatctgtaaaaatcggagatctgggactcgccaccctcaaaagggccagcttcgcaaagagcgtgattggcatgttccaagtgtatctgggggcatag

SEQ ID NO: 246897 - DNA, 8642 bp, Artificial Sequence
  Description of Artificial Sequence: Synthetic coding sequence
atgtccggaggggcagccgaaaagcaatcctccactccaggcagcttgtttttatcacctcccgcacctgctcccaaaaacggcagcagcagcgacagctcagtgggcgagaaattgggggcagctgctgccgatgcagttacagggagaacggaggaatatcggaggcgtcgacacaccatggataaggattctcgcggagctgccgctaccactactacaacagagcaccgattttttagacggtctgtgatctgtgatagcaatgctaccgcgctagagctgccagggctccccctgtctctcccacagccttctatccctgcagccgttccgcaatctgcacctcctgagcctcatagagaggaaactgtgactgccaccgctacgtcacaggtcgcccagcagccccctgccgcagccgcaccaggcgaacaagccgtggctggaccagcaccatcaaccgtcccatcgtcaacctctaaggacaggcccgttagtcagcctagcctggtgggaagcaaagaggagcctccaccagcccgttccggttcaggtggagggtccgctaaggagccccaggaggagagaagtcagcagcaagacgatattgaagagctagagaccaaagctgtgggaatgtctaacgacggcaggttcttgaagttcgacatcgagatcggacggggttcttttaagacggtttacaaaggcttggacactgagactacggtggaggttgcgtggtgtgagttgcaggatcggaagctgaccaagagtgagcggcagcgctttaaggaagaggccgaaatgttgaagggtcttcaacatccaaatatcgtgagattctacgatagttgggagagcacagtgaagggcaaaaaatgtatcgttctcgtcacagagctgatgacctccgggaccctcaagacatatctgaaaaggttcaaagttatgaagataaaggtgctccgcagctggtgcagacaaatattaaaggggctgcaattcctgcatactcggactccacccatcatccaccgagacctgaaatgtgataatatatttattacaggacctactggatcggtgaagattggcgacctgggcctggccactctgaaacgagcttcatttgccaaatcagtgataggcaccccagagttcatggccccagagatgtatgaggaaaaatacgacgagtccgtggatgtgtacgcattcggaatgtgcatgctggagatggccacgagcgaatacccgtactctgaatgtcaaaacgcagcgcagatatatcgccgagtcaccagcggcgtcaaaccagcctcctttgataaggttgccattccagaggtcaaggaaattatagaaggatgtatcagacagaataaggacgagcgatattccattaaggacctgctcaatcacgcttttttccaggaggaaaccggagttcgagtggagctggccgaggaagacgacggcgagaagattgcaatcaagttatggctgaggatcgaggatataaaaaaactgaaaggcaaatataaggacaacgaagctattgagttttcttttgatttagagagagatgtgcctgaagatgtggcgcaggaaatggtcgaatcgggttacgtctgcgaaggagatcacaagactatggccaaagccatcaaggaccgcgtgtctcttatcaagcgaaaacgggagcagcgacagttggtccgagaggagcaagaaaagaagaaacaggaggagtcttccctgaaacagcaggtggagcagtcatctgcaagtcagacaggcatcaaacagctgccttcagcatctactggaattcccactgctagcaccactagtgcctcggtgagtactcaggtcgaacctgaagagcccgaagccgatcaacaccagcagttgcagtatcaacaaccgtcgatatccgtgttgtcagacgggactgtagattccggacagggctcatctgtgtttacagagagtcgtgtttcatcacagcagaccgtttcatacggttcacagcatgaacaggctcactctactgggactgtacccggtcacatcccctctacagtgcaagcacagagtcagccccatggcgtctacccccctagctcagtgccaaggcgtggaaggtccatgtccgtgtgcgtgccaatcttcctgctgctgccgctgtgccccgcaagtctaccggtcctgtttcatcccacagccagcaccgtatgtacctccttctcgtttcccccaccagattgtcccgaagagacttttgcggaaaaactcagcaaagcacttgagtctgttctcccaatgcactccgcctcccagcggaagcaccgccgaagctcactcccaagtctattcgtaagtaccccacaatctatggcccatccctgtggcggaactccaacttacccagagagccagatcttctttccaacaattcacgagcgcccagtctccttttcaccccctccaacctgtcctcctaaggtcgccataagtcagcgtcggaagtctacatcattcctggaagctcagacgcaccattttcagccattgttgagaaccgtggggcagtccctgctgcctccaggtggcagtccaaccaactggacaccagaggccgtggtaatgcttgggactactgcatcccgtgtcaccggggagagttgtgagatccaagtgcacccaatgtttgagccctcgcaggtttactctgactatcggccaggacttgtgctccccgaagaagcacactactttataccacaggaagctgtgtacgtcgccggagtgcactaccaggccagggtagctgagcaatatgagggtataccctacaattcctcagtcctgtcatcgcccatgaagcaaattccggagcagaaacccgtgcagggcggtcccacctcttcttcggtctttgaatttccatctggccaggcattcctagtcggccatctgcaaaacctccgactcgattccggcctagggcctggatccccacttagctccattagcgctccaattagtacggatgccactaggcttaaatttcatccagtatttgtgcctcactctgcacccgcagtgctcactcataacaatgaaagcagaagtaactgtgtcttcgagttccacgttcacaccccaagttccagttctggcgaaggcggaggtatcttgccccagcgggtgtaccgcaatcggcaggtcgccgtcgatctgaaccaagaggagcttcctccccaaagcgtaggtcttcacggttacctccagccagttactgaggagaaacacaattatcatgctccagaattgacggtcagcgtggtcgaacccatcgggcagaattggcctataggatccccggaatactcctccgattcctcccagattacgagtagtgacccctccgattttcagtcacccccaccgactggcggagctgccgcaccatttggcagcgatgtgagtatgcctttcatccaccttcctcagacggtcctgcaggagagcccactcttcttttgcttccctcagggtaccacatcccagcaggtacttaccgccagcttctcttcgggcggatccgcattacatcctcaggcccaggggcagtcacagggccagccctccagcagctcgctcactggcgtctcaagtagccagccaatccaacatccacagcagcaacaggggatccaacagacagcccctccccaacagacagttcagtactcactatcgcaaacctctaccagctccgaggccaccaccgcccagccagtgagtcagccccaagccccacaggtactccctcaggtctcggctggtaagcagctacctgttagtcagcctgtccctactattcagggggaacctcagatccccgtcgcaacacaaccatctgtagtaccagtacattctggagcgcattttctgccagtgggccaaccccttcctactccgttgcttccacagtatcccgtgtcccaaattcccatttcgaccccacacgtaagtaccgcccagaccggcttttccagtctgcccatcaccatggcagccggaatcactcagcccctgttgacgttagcaagcagcgctaccacggcggcaatcccaggggtctcgaccgtggttccaagtcaactgcctactctcctgcagcccgtgacccagctccctagccaggtgcatccacagctacttcagcccgcagtgcagagcatggggatcccagctaatctgggtcaggccgctgaggttcctttatcttcaggtgatgtgttataccaaggcttcccgccacggctccccccacagtatcccggtgattcaaacatcgcaccttcaagtaatgtcgcaagtgtgtgcattcactctacggtgctttctccaccgatgccaacagaggtgctcgccacccctgggtatttcccaaccgtagtccagccctacgttgaatccaacctcctcgtccctatggggggtgtggggggtcaagtgcaggtttcccagcccggtgggagcctggcccaagcacccactacgagctctcagcaagctgtgttggagtctacgcagggtgtgagccaggtggccccagcagagccagtggcagtggcccaaactcaggccactcagcctacaaccctcgccagcagcgttgactctgcccatagcgacgtggctagtgggatgagcgatgggaacgaaaacgtaccatcttcttcgggaaggcatgaaggcaggacgacaaagcggcactatcgcaaaagtgttcgcagcagaagcaggcatgagaagaccagtaggccaaagctgcgcatcctgaacgtgagcaacaagggcgatagggtggtcgagtgccagctggaaacccacaataggaagatggtgacctttaagtttgacttggacggagacaacccagaggagatcgccactataatggtgaacaacgacttcatcctagccatcgagagagagtcattcgtggaccaagtcagggagataatcgagaaagctgatgagatgctatcggaggacgtctcagtcgagccagaaggcgatcagggactggagagtttacaaggtaaagacgactacggcttttcaggctctcagaagctggaaggggagtttaagcagccaattccggcttcctcgatgccccagcaaatcggtattccgacctccagcctcacacaggttgtccacagtgctgggaggcggtttattgtgtccccagtgcccgagtcaaggctcagggagtcaaaggtgtttccctcagaaatcaccgatacagtcgctgcctctacggcccaaagcccaggaatgaacctcagtcactccgcttctagtctctcgctccagcaagcattctcagaattgcgccgagcacagatgactgaggggccaaatactgctccacctaattttagccatactgggccaacgttcccggtagttcccccattcctatcatcaatcgccggagtacctacaaccgctgccgctaccgcacctgtgcccgctacatcttctccaccaaacgatattagcacatccgtgatccaatccgaggttacggttccgacggaggaagggatcgccggtgtcgcaaccagcactggcgtcgtgacttccggcggactgccaataccaccagtctctgagagccctgtactgtctagcgtggttagctcgatcaccatccccgcagtagtatctatttctaccacaagcccctcgctccaggtcccgacttctacctcagaaatcgtcgtgtcctctaccgccctgtacccgagcgttactgtcagtgcgaccagtgcgtctgctgggggtagcaccgcaacccctggtccgaagccacccgcagtggttagccagcaggcagcgggaagcacaaccgtcggggctaccctgacctcagtaagtactactaccagtttcccaagcacggcatctcaactctgtatccaactgagctcttcaaccagtacccctaccctggcagaaacagtagtggtctcagcccacagtctggacaagacatctcacagcagtaccactggcctagctttttcactcagcgcgccatccagtagttcttcccctggggctggggtctcgtcttacatcagtcagccgggaggattacatcccctggtgatcccatcagtgattgctagtacgccaattttacctcaggctgctggacctacctcaacgcctctgctccctcaagtcccatcgatcccgcctctcgtgcagcccgttgcgaatgtgcctgcagtccagcagacccttatacactcacagccccaaccagctctgctgcctaatcagccccacacacattgtcccgaggttgactccgatacacagccaaaggccccagggatcgatgacataaagaccctggaagagaagctgagatcattgttttctgagcatagcagcagcggagcacagcatgcctcggttagtctggaaacaagcctggtcatcgagtccacagtaacgcctggtatccctaccacggccgtggccccatccaaattgctgacctccactacctccacttgcctgccgccaaccaatctgcccctcgggacagttgctctacccgtgactcccgtcgtcactcccggtcaagtctcgacacccgtgagcacaacaacgtccggcgtgaagccaggaaccgcaccttcaaaacctcccctgacgaaggcccctgtcctaccggtgggaaccgagttgcccgctggcacgctgcccagtgaacagcttccaccatttccaggcccttccctgacccaaagtcagcagccactggaagacctggacgctcaactgagacgaaccttatctcctgaaatgattacggtcacttctgcagtcggccctgtgagtatggccgctccgacagccatcactgaggccggtacccagcctcagaaaggtgttagccaggtcaaggaagggcctgtactggcaacctcaagcggcgctggcgtgttcaagatgggtcggttccaagtgagcgtggccgcagacggcgcacagaaggagggcaaaaataagtcagaggatgccaagagcgtgcattttgagtccagcaccagtgaatccagtgttctgagctcttcctcacccgagagcactctcgtcaaacccgagccaaatggcatcactatccccggtatttctagcgacgtgcccgagtctgcgcacaaaacgactgctagtgaagccaaaagcgacacaggccagccgaccaaagtgggacggtttcaggtcacaactactgctaataaagtcggcaggttctctgtatctaagactgaagacaagattaccgacaccaagaaagagggtcccgtagcctccccacccttcatggatctggaacaggcagtgctgcccgcagtcattcccaagaaagagaaaccggaactctcagagccaagtcacctcaatggtccctcctccgaccccgaagcagccttcctgtctcgtgacgtagatgacggctcgggcagcccgcactctccacaccagttgagttccaagagtttaccctcccagaatttaagtcaaagcctgtccaacagcttcaattctagttacatgtccagcgacaatgagtctgatatcgaagatgaagatctcaaactggagcttagaaggctccgggataaacacctcaaagagattcaggacctgcagagcagacagaaacacgaaatcgagtctctctacacaaaattaggcaaggtgcccccagcggtgataatacccccagctgccccattgagtggaaggcgcaggcgacctacaaagtcgaaggggtccaagtcctcccgcagctcctcattgggcaacaagtctccccagctgtctgggaacctaagcggacaatcggcagccagcgttttgcacccgcaacagacattacaccccccaggtaacatccctgagtctggtcagaatcaacttctccagccactgaagccatccccaagcagtgacaacctgtacagtgcattcacgtctgacggcgctattagcgtaccgagcctcagcgcccctggacagggcacctccagtaccaacactgtcggggctaccgtgaactcccaggccgctcaggcacagcctcctgccatgacatcatctagaaaaggtacattcaccgatgacctgcacaaactggtggacaactgggctagggatgctatgaacctgtccggccgacgcggttctaaagggcatatgaattacgagggacccggaatggccagaaagttcagcgcgccagggcaactttgtatcagcatgacgtccaatctgggtggcagcgcccctattagtgcggcatccgccacttcactcggacacttcactaagtccatgtgtccccctcagcagtacggctttccagcgactcccttcggggcacagtggagtggcacggggggtcccgctccccagccccttggacagtttcagcctgtggggaccgcatctctccaaaactttaatatctcgaatctgcagaagtccataagcaacccccctgggtccaatttgaggaccactta

SEQ ID NO: 246898 - DNA, 6404 bp, Artificial Sequence
  Description of Artificial Sequence: Synthetic coding sequence
atgagcggaggagccgctgaaaagcaatccagtacaccaggcagtctgtttctgtcccctcctgcacctgcgcctaaaaatggttccagcagcgacagctccgtgggagaaaagttgggtgccgcagcagccgacgctgtaacaggtagaaccgaagagtatcggagacgacgccatactatggacaaagattcccggggtgctgctgcgactacgacaactacagagcaccgctttttccgaagaagcgtgatctgcgacagcaacgctaccgctcttgaacttcccggactgccactctccctccctcaaccttcaatcccagctgccgtcccccagtcagctcctcccgaaccacacagagaggagacagttaccgccacggccactagtcaggtggctcagcagccaccagccgcagctgccccaggggagcaggccgtcgcagggccagctccctctactgtgcccagctccacctccaaagacaggccagtgagccagccgtccctggtgggctcaaaggaggaacctcccccagcaagatcaggttcaggaggaggcagcgctaaggagccccaggaggagcgcagccagcagcaggacgacatcgaggaactcgagacgaaggccgtcgggatgagcaacgatggaagattcctgaagttcgatatcgagatcgggaggggctctttcaaaaccgtttataagggactcgacactgagaccactgtcgaggtcgcttggtgtgaactgcaagatagaaagctcacgaaaagtgagcgccaaaggttcaaagaagaagctgagatgctgaaaggcctccagcaccctaacatcgttcgcttttatgattcttgggaatccactgtgaagggtaagaaatgtattgtgttggtgaccgagctgatgaccagtggtacattgaagacgtatctaaagaggttcaaggtcatgaagatcaaggtgctgagaagctggtgtcgccaaattttaaaaggtcttcaattcttgcacacgagaactccccctataattcaccgtgatctgaagtgtgataatatatttatcaccgggcctacggggtccgtgaagattggtgacctcggtctggcaactttgaagcgggctagcttcgcgaagtcggttatcggtactccagagttcatggcacccgaaatgtacgaagagaaatatgacgagagcgtggatgtctacgctttcggaatgtgcatgctggaaatggctacttcagaatatccctattcagagtgtcagaatgccgctcagatctaccggcgtgtgactagtggcgtcaaaccagctagctttgacaaggtcgctatccccgaagttaaagagatcatcgaggggtgcatcagacagaataaggatgaacgctactccatcaaggatttgctaaaccacgctttctttcaagaggagaccggcgtgagagtggagctggccgaggaggatgatggtgaaaagatcgcgattaagttatggctccgaattgaggatattaaaaagctcaaaggcaagtataaggataatgaggcaatcgagttctcctttgacttggagagggacgtgccagaggatgtcgcccaggaaatggtggagtccggctatgtgtgtgagggagaccataaaaccatggctaaagccatcaaggatcgcgtcagccttatcaagcggaaaagagagcaacgtcaactggtaagagaagagcaggaaaagaagaagcaggaggaaagcagtctcaagcagcaagtggaacagagttccgcatcccagacaggcattaaacagctgccttccgcaagcactggaattcccacagccagtaccacatccgctagcgtgtcaacccaagttgaacctgaggagcctgaagcagatcagcatcagcagctgcagtatcagcagccgtccatctctgtgctgtcagacggtactgtggattcaggtcagggctcttctgtgttcactgagtcacgcgtctcttcccagcagaccgtgtcatacgggtctcagcacgaacaggcgcattccactggaacagtacctgggcatattcctagcactgtccaggcccaatcacagccacatggagtttatccgccttccagcgtggcacaggggcagagccaggggcagccgtcttcatccagcctcacgggcgttagttctagccagcccatccagcaccctcaacagcagggcatacagcaaaccgcacctcctcaacagaccgtccagtatagcctctcacagactagcaccagcagtgaggcaacgactgcccagcccgtgagtcaaccacaggctcctcaggttctgcctcaagtgtccgccggaaagcagagcacccagggcgtgtctcaagtggccccagccgaaccagtggctgtcgcacagacacaggcgactcaaccgactaccctcgccagcagcgtcgactccgctcacagcgacgtcgcctcgggcatgtcggatggaaatgaaaatgtgccgtcttcaagcggtcgccacgaaggtcgcacgacaaaaagacactacagaaaatccgtgcggtccagaagccgccatgagaagacttctcgacccaaactaagaatcttgaatgtgtcaaataaaggggacagagtggttgaatgccagctcgaaacacacaatcgcaaaatggttacgttcaagttcgacctggatggagataatccggaagaaattgctacgatcatggttaacaatgacttcatcctcgccattgaacgggaatccttcgtcgaccaggttcgcgaaatcattgagaaggccgatgagatgttaagcgaggacgtgtctgtagaacccgagggggaccagggactcgagtctttgcagggcaaagatgactacgggttcagcgggagccagaagttggaaggagagttcaaacagccaattcctgccagttccatgccccaacagattggcattccaaccagctccctcacgcaggttgtccattccgcgggtaggagattcatcgtttcccctgttcccgaaagcagactgagggagagcaaggtattcccttccgaaatcacagacaccgtggccgcaagcacggcccaatcaccaggaatgaatctttcccacagtgcatcctccctgagcctgcaacaggcattctccgaactgcggcgtgcccagatgacagaaggcccaaacaccgctccgccaaacttctctcacacaggacccacctttcccgtcgtgccaccctttctgtcttcaattgccggtgtgcccaccactgctgcagccaccgcccctgtgcccgctacgtccagtcccccaaatgacatctcaacatctgtcatccaaagcgaggtgaccgtccctacggaggaagggattgccggtgtggctacatcgacaggcgtggtaaccagcggcggtctccccatccctcccgtttccgagagtcccgtgctcagctccgttgtctcgtctataaccattccggcagttgtttctataagcaccacctctccgtccctacaggtgccaactagcacctctgaaattgtggtcagtagcactgccctctatcctagtgtcactgtatcagcaactagtgcctctgctggcggatcaacagctaccccgggaccaaagccccctgcagtggtgtcacaacaagctgctggctcaaccaccgtgggagctactctgacctctgtcagcaccaccacttcatttccctctacagctagtcagctctgtattcagttgagctcatcaacttctactcctacactcgctgagaccgtcgtggtgagtgcccattcactcgacaaaacgtctcacagctctacgaccgggcttgccttctctttgtccgctcccagttcctctagctcacctggcgcaggggtgtccagttacatcagccagccaggcggactccatcccctggtcattccttccgtcattgctagtacaccaatcctgcctcaagcagccggacccacatccacacctctactgccacaggtgccgtcaattccacccctagtgcagcccgttgctaacgtgccagcggttcagcaaacactgattcacagccagccacaaccagcgctgctccccaatcagcctcatacgcactgccctgaggtggacagcgacacccagcccaaagctccagggattgacgacatcaaaactttggaggagaaactgagatcactgttctccgaacactcatcatcaggagctcaacatgcgtccgtgagcttagagacaagcctggtgatcgaaagtaccgttactccagggatccccacgactgctgtcgcaccctccaagttgttgacatctacaaccagcacttgccttccacctaccaatctgcctctcggaactgtggccctgccagtcacccccgtggttacccccggtcaagtgtccacacctgtgagcaccacaacctccggcgtgaaacccggaacagccccttctaagccacctttgaccaaagccccagtactgccggttgggactgagctgccagccggtacccttccttctgagcaactgcctccattcccaggaccatctctaacccagagccagcagcctctggaggacctagatgcccagctccgtcggacgctgtcaccagaaatgatcactgtcactagtgcagtgggccctgtgtcgatggctgccccaaccgctattacagaggccggaacccaaccacaaaaggtttcacaggttaaagaaggacccgtgttagcaacatcctccggggctggcgtgttcaagatgggcagattccaggtgtcagtggccgctgacggtgcccagaaagagggcaagaacaagtccgaggatgcgaaatcagtgcactttgagtcttctacatcagagtcatctgtgttatcctctagcagcccagaaagcaccctcgtgaaacccgaaccaaacgggattaccattccagggatctcctctgatgtgcccgagagcgcacataaaactaccgcatctgaagctaagtccgacacaggccaaccaacgaaagtgggccgtttccaggtgaccacaacagcaaataaggttggccgattcagcgtgagcaagacagaggacaagatcactgatacaaagaaagagggccctgtcgctagcccaccattcatggatcttgaacaggctgtgctgcccgcagttatcccaaagaaggaaaagcccgaactcagtgagccgagccatctcaatggacccagttccgaccctgaggccgcatttctgtccagagatgtcgatgacggcagtgggtctccccacagtccccatcagctgtcttcaaagtctctgccgagtcagaatttgagccaatcgctctctaacagctttaacagcagttatatgtcgtcagacaatgaatctgatatagaagatgaagatctgaagttagaactcaggagattacgggacaagcacctgaaggagatccaggatctgcagagcagacaaaagcacgagattgagtcactctacactaaactgggtaaggttcctccagctgtgatcattcctcccgcagctcctctgtctggacggagacgccgacccaccaagtctaagggtagcaagagttcccgaagctcctcactcggcaataagagcccgcagctttctggcaatctgagcggacaatctgccgcttccgtattgcacccacagcagacgctgcaccccccaggtaatatacccgagtcaggtcaaaaccagctgctccagccgttgaagccatctcctagttcagataacttgtattccgctttcaccagcgacggcgcaatttcggtccctagcctctcagcgcctggtcagggcaccagctcaacaaatactgtcggcgctacagttaacagccaggccgctcaggcccagcctccagccatgaccagctccagaaagggcaccttcactgacgatctccacaagctggtcgacaactgggcacgcgacgccatgaatttgtctggaaggagagggagtaaggggcacatgaattacgaaggtcccggtatggccaggaaattcagcgcgcctggtcaactatgtataagcatgacatccaacctaggcggttcggctccgatatctgctgcttccgctacctctttggggcatttcacaaaatctatgtgcccaccccagcagtacggattcccagccactccgttcggcgcacagtggagtggcaccggcggtcccgcaccacagccactggggcaatttcaacctgtcggaacagcatccctgcagaactttaacatctcaaacctgcagaagagcatttcaaaccccccaggttctaacctcaggaccactta

SEQ ID NO: 246899 - DNA, 975 bp, Artificial Sequence
  Description of Artificial Sequence: Synthetic coding sequence
atgtcgagtgacaacgaatccgacattgaggatgaagacctaaaattggaactgcgcaggcttcgggataagcatctgaaagagatccaggacctgcagagccgccaaaagcacgagattgaatctctgtacacgaaactcggcaaggtcccaccagctgtgattattcctcctgctgctcccctctcagggagaagacgacggccaaccaaatcaaagggctcaaaatcctctagaagctcaagcttgggaaataagagtccgcaactctcgggcaatctcagtggacaaagcgcggcaagtgttctgcatcctcagcagacgctgcacccccctggtaatatccccgaatcaggccagaaccagcttctgcaaccactgaagccatcgccatctagcgataacctctactctgcatttacctccgacggcgcaatttccgtgccttccttatccgcaccaggacaagggaccagcagcacaaacacggtaggcgctaccgtcaactcacaagccgctcaagctcagccaccagccatgacatccagtcgtaagggtacattcacagacgatcttcacaaactagtcgacaactgggcgagggacgcgatgaatctgagtggccgtcgtggttcaaaaggccatatgaactatgaaggcccaggaatggcgaggaagtttagcgcaccaggtcagctctgcatcagcatgacatctaacctgggcggaagcgcacccattagcgccgcatcggcgacttctcttggacacttcaccaagtcaatgtgccctcctcagcagtacgggtttccagcaactccctttggagctcagtggtctggaaccggaggtccagcgccacaacccctcggtcagtttcagccagtcgggaccgcttccctccagaatttcaacatcagcaatctgcagaagtcgatctccaaccctccaggaagcaacctcaggaccacatag

SEQ ID NO: 246900 - DNA, 7928 bp, Artificial Sequence
  Description of Artificial Sequence: Synthetic coding sequence
atgagtggaggtgcggcagagaagcaatcttctactcctggatcactttttctgagcccccctgcccctgcaccgaagaacggttcctccagcgattctagcgtgggcgaaaagctgggtgccgctgccgcagacgctgtaaccggccgaaccgaagagtacagaagacgtagacatactatggacaaagattctcgcggtgccgctgcaaccaccacaacgacggagcataggttttttcgtagaagtgtgatctgcgactctaatgccacagccctggagctccccggacttcccctttcgttgcctcaaccgtctattccggcagccgtcccccaatcagccccacctgaaccacacagagaagaaacagttacggcaactgcaactagccaggtggctcaacagccccctgcggcagctgcccctggcgagcaggccgtcgcgggacccgctcccagcacggttcctagttctacatcgaaagatagaccggtgtcacagccctctctggtcggttcgaaggaggagcccccacccgcacggtccggcagcggcggtggatcggccaaagaaccccaagaggaacggtctcagcaacaggatgacattgaagagttagaaactaaggcggttggcatgtcaaatgacggacggtttctgaagtttgatatcgaaataggcaggggcagctttaaaactgtttataagggcctggacaccgaaacgactgtcgaagttgcgtggtgtgagcttcaggaccggaagctgacaaaatccgagaggcagagatttaaagaggaggccgaaatgctcaaaggcttacagcaccctaacatagttcgattttatgacagctgggaatctacagtcaagggcaagaagtgtatcgtgttagttacggaactaatgacatctggcacgctgaagacctacctgaagcggtttaaggtcatgaagatcaaagtgctgcgctcatggtgtcgccaaatcctgaaaggcctacagttcctgcatacaaggaccccgcctatcatacatagggacctgaaatgtgacaacatatttataaccggaccaaccggctccgtgaaaatcggggatttaggtttggctaccttgaaacgtgcaagcttcgctaagtccgtgataggcacacccgaattcatggcacccgagatgtatgaggagaagtacgatgaaagtgtcgacgtgtacgcattcggcatgtgtatgttagagatggccacttccgaatatccgtatagcgagtgccaaaatgcagcgcaaatctacaggagagtgactagcggcgtaaaacccgcttcatttgacaaagtcgccatccccgaggtgaaagagattatagagggatgcattaggcagaacaaggatgaacgctactccatcaaagatctgcttaatcacgcattctttcaagaggagaccggtgtgagggtggagctcgctgaggaagatgacggcgagaaaattgcaataaaactgtggctgaggattgaggacattaaaaagctgaaggggaagtacaaggacaacgaagctattgagttcagcttcgatttggagagagatgtcccggaggacgttgctcaagagatggtggagtctggatatgtctgcgagggagaccacaaaacgatggcaaaagctatcaaggatagagtaagccttataaagcgtaagagggaacagcgtcagctggtaagagaggagcaggaaaaaaaaaagcaagaggagtctagtctgaaacaacaggtcgaacaatcttctgcaagtcaaaccggcattaaacagttaccatcagcttctaccggaattcccaccgccagtaccacctccgcgtctgtttccacccaagtcgagcccgaagaacctgaagcagaccagcatcagcagctgcagtaccagcaacccagtatctccgtgctatccgacggaactgtggattccggacagggttccagcgtgttcacggagtccagagtatcctctcagcaaactgttagttacggctcccagcacgagcaggctcattcaacaggtacggtgccaggccatatcccaagcacagtccaagcccaaagccaacctcacggcgtatatcccccttcaagcgtgcctcagagtatggctcacccttgcggtggaacccctacctaccccgaaagccagattttcttcccaacgattcatgagcggcctgtgtctttctcacctccacccacctgcccaccgaaagtagctatttcccaacggcgaaagagtacaagctttctggaggcccagactcatcactttcagccccttttgaggacagtgggccaaagcctgctgcctccagggggttcacctaccaattggacgccagaagcggtggtgatgcttgggactaccgcctccagagtcacgggcgagagctgtgagattcaggttcatccaatgtttgagcctagccaggtgtactctgattaccgtcccggattagttctccccgaggaagcccattatttcattccccaggaggccgtatacgtcgcaggtgttcattaccaggctagagttgccgagcaatatgaaggcatcccctataacagctcagtgttgtccagccccatgaaacagattccagagcagaagcctgttcaaggcggtcctacgagctcctctgtgttcgagttcccctccggccaagccttcctggtgggccatctgcagaacttaagactggattccgggcttggacccggttcacctctgagctcaatctccgcaccaatcagcactgatgcaacccgtctgaaatttcaccccgtattcgtcccccactccgctcctgcggtcctgacgcataacaacgagtcaagaagtaattgcgtttttgaatttcatgtacatacaccatcatcctcttcaggtgaggggggtggcattctaccacagcgcgtttaccggaatcgtcaggtggcagtggatcttaaccaggaagagctgccgcctcaatccgtgggactgcatggatacctccagcctgtcacagaggaaaagcataactaccacgcccctgagttaaccgtttcagtggttgaaccgatcggccagaattggcccataggttcccctgaatattcatctgattccagtcagatcactagttctgatccttcggacttccagtctcccccacccactgggggtgcagcagcaccctttggatccgatgtatctatgccttttatccatctcccccagactgtactccaggagtcacccctgtttttctgtttcccccaaggtaccacctcacagcaggtcctcaccgctagttttagctctggtggttccgccctgcaccctcaggctcagggtcagtctcaaggccaaccgagcagcagcagcctgaccggtgtgagttcgtcccaacccatacagcacccgcaacaacagcaggggatacagcagaccgccccaccgcagcagacagttcagtatagcctgtcgcagactagcaccagtagcgaggcaacgactgcccagcccgtgtctcagcctcaggcccctcaggttctgcctcaagtgtccgctgggaaacaggggttccccccaaggctccccccacagtatccaggagattccaatatcgccccaagtagtaatgttgcttccgtgtgtatccactcaactgtcctgtcccctccaatgcccacagaggtgctcgccacacccggatatttccccactgtcgtgcagccctacgtagaaagtaatctcctggtccccatggggggtgtagggggtcaggttcaggtgtctcagcctgggggatctctggcccaggcccctactacaagcagtcagcaggcggtgctggagagcacccagggcgtctcccaggtggcaccagctgagcctgtggcagttgcacaaacacaggctacccagcctaccacactggcaagctcagtcgattcagcacacagcgatgttgcttcgggcatgagcgatgggaacgaaaacgtgcccagctcctctgggcgtcatgaaggcaggactaccaagcgacactaccggaagtcggtgagatccagatccagacatgaaaaaacatcaaggcccaagctgcggatcctgaatgtatccaataaaggagatagagtagttgagtgccagctggagacccataaccgcaaaatggtgacattcaaattcgacttggatggggacaatccagaggagatcgccacaattatggtgaacaatgatttcatcttggcaatagaaagggagtctttcgtagatcaggtaagggagatcatagaaaaggctgacgagatgctttctgaggatgttagcgtcgagcccgagggggatcagggactcgaaagtctgcaaggaaaagatgattacggattttctggcagtcagaagttggaaggagaattcaagcaacccattcctgccagctctatgccgcagcagattgggatacccaccagctcactgactcaggtcgtgcattcagccggtagaagattcattgtgtccccggtgcccgaaagcaggctccgagaatcaaaggttttcccctccgagatcacggataccgtcgctgcctcgaccgcacagtctcccggaatgaacctatcccactctgcttcatcactgtccttgcagcaggcctttagcgagctgagacgggcacaaatgacagaaggccctaatacagcaccgccaaatttctcccacacagggccaacatttcctgtagtccccccattcttgtcaagcattgccggtgtgcctaccacggctgctgccaccgcaccagtgccagccacatcgagcccacccaatgatatctctacctctgtgatccagtctgaggtcaccgtgcctaccgaggagggcatagctggagttgctacctctacaggagtcgtcacgtccggagggctgccgatcccgcctgtgtcagaaagtcccgtgctgtcttctgtagtctcatctatcactatccctgccgttgtctcaatctcaacaacttctccaagtctgcaggtcccaacatccacctccgagattgtagtttcttcgacagctctgtatccatcggtgacggtgagcgctacatccgctagtgctgggggttcaaccgccacacccggacccaagcctcctgcagtggtaagccagcaggccgctggcagcaccacagtaggagcgacattgacctccgtctccacaaccacgtcattccctagtactgcctctcaactgtgcatccagctgagctcctccacctccacacctactctcgccgagactgtggtggtcagtgcccacagtcttgacaagactagccacagctccacaacagggttggctttttcgttatctgctccatcatcaagtagctctcctggtgctggtgttagttcttacatctcccagcccggaggactccacccactcgtcatcccatccgtaattgcaagtacacctatcctccctcaggccgctggtcccacgtcaactccactcctccctcaggtgccgtccatcccaccactggttcagccggttgctaacgtgcctgcagtgcagcaaaccttaatccactcccagccacagcccgctctgctccccaaccagccccacacacactgtcccgaagttgattccgacacccaacctaaagcgcctggaattgatgacattaaaacgctggaagaaaagcttagatccctttttagcgagcacagctcgtctggagcccagcatgccagtgtttccctggagaccagtctagtgatcgaatcgactgtgacccccggtatccccacaaccgcagttgccccatcaaagcttctgacatctaccacatcaacttgtcttccaccaaccaacctgccacttgggactgtagccctgcccgtgactccggtggtgacaccaggacaggtgagcaccccagtcagcactacaacttctggcgtcaaaccaggcactgcaccttctaagccccctcttacaaaagccccagtactcccagtaggtaccgaactgcctgcgggaactcttccctccgagcagttgccaccctttccaggcccatccctcacccaatcccaacagcctctggaagatctagatgctcagctccggcgtaccctgagccctgagatgatcacggtgacctcagctgtgggtcctgtcagtatggcagctcccacagcaattaccgaagcaggtacgcagccacagaagggcgtgtcacaggtgaaggagggaccggtcctagcaaccagtagcggcgcaggcgtgtttaagatgggaaggtttcaggtcagtgtggcagccgatggggcacagaaggagggcaaaaataaatcagaggacgccaaatcagttcatttcgaaagttccacctctgaatcttccgttctttcttcctcgtctcctgagtcaactttggtaaagcctgagcccaatgggatcaccatcccaggtatcagctccgacgtcccagagtcggcacacaagacgaccgccagcgaagcaaaatcagatacaggccagcctactaaggtcggtagattccaggtcaccacaaccgccaataaggtgggccgattcagtgtgtcaaaaacagaagataagattacagacacaaaaaaggaaggacccgtggcctccccgccatttatggacctggagcaagccgtgctgccagctgttattccaaaaaaggagaagcctgagctctccgaaccttcccacctgaatgggccatcttctgacccggaggccgcttttttaagccgtgacgtcgacgatggctccggtagtcctcactcccctcaccaattaagttcaaaaagcctgccgtcacagaatctgagccaatcactgagcaattcttttaattcctcttacatgagctcagacaatgagagtgacatcgaagatgaagacctgaaactggaattgcgcaggctgagagataagcacctcaaggaaatacaggatttacagagccgccaaaaacatgagatcgaatctctctataccaagctaggcaaggttccgcctgcagtgatcatccctcctgcagctcctctctctggacggaggagaagacctacaaagagtaagggatccaaatcctcccggagttcatccctgggaaacaagagcccacagctgagcgggaatctgagcggtcagtcagccgcttccgtgctgcacccccaacagactctccacccgcctggcaacatccccgagtctggccagaaccagctgttacagcctctcaagccttcaccctcaagcgacaacctgtattccgcatttacctccgacggagcgatatcagtgcctagtctgtccgctccaggtcagggaacatcctccaccaatactgtaggcgcaactgtgaacagtcaggccgctcaggctcaaccccctgccatgacctctagccggaaggggacctttacggacgatttgcacaagctagtggataactgggctcgagatgcaatgaatctgtctggtcgaaggggcagtaaaggacacatgaattacgagggacccggaatggccaggaaattcagtgcacccggacagttgtgtatttccatgacctctaacctgggcggtagcgctcccatttccgccgctagcgcaacttcactaggacatttcaccaaatccatgtgtcccccacaacagtacggtttccctgctactccgttcggggctcagtggtctgggaccggagggcctgctccccagccactggggcagtttcagcctgtaggaaccgctagcctgcaaaatttcaacataagtaatttgcagaaaagcatttccaatcctccgggtagcaatctccgaactactta

SEQ ID NO: 246901 - DNA, 6894 bp, Artificial Sequence
  Description of Artificial Sequence: Synthetic coding sequence
atggatggtgacggcggaagacgagatgtgccaggaactctgatggagcccggacgaggcgctgggcctgcaggcatggcagagcccagggcaaaggccgctagaccaggaccgcagcgctttctgcgaaggagcgtagtcgaatcggaccaggaggaaccccctggcttagaggctgctgaagcccctggccctcaaccaccgcaacctctgcagcgccgtgtccttttgctgtgcaagactagacgcctgattgctgagcgtgcgagggggagacccgcagctcccgcacccgctgcccttgtggctcagcctggtgctcctggggcaccagcggacgccggtccggagcccgtgggcacccaagagcctggcccagaccccattgccgcagctgtggagacagcacccgctcccgatggcggaccacgtgaagaagcggctgcaacagtcaggaaggaagacgaaggtgcagccgaggccaagccagagcctggaagaactcggagagatgagcccgaagaggaggaggatgatgaggatgaccttaaggccgtcgccaccagcctcgacggccgatttcttaagtttgatatcgagctaggtagaggttcgttcaagaccgtctataaaggcctggatacagagacatgggtcgaggtggcttggtgtgagttacaagataggaaactgaccaaattggaacgacaaaggtttaaagaagaggccgaaatgctgaaaggcctgcagcaccccaatatcgtgcgcttttatgacttttgggagagctccgccaaggggaaaagatgcatagttttggtgacagagctgatgacgtccggcaccttgaaaacatacttgaagaggtttaaggtaatgaagcccaaggtgctgcgctcttggtgccgacaaatcctgaagggcctactgttccttcacaccaggacaccgcctattatccatcgcgacctgaagtgcgataatattttcatcactggcccaaccggatccgtgaagatcggggatcttggactggcgacactcaagagggccagcttcgccaagtcggtgattgggacccccgagtttatggcccctgaaatgtatgaggaacattacgacgagagtgtggatgtgtacgcatttggaatgtgcatgcttgaaatggccaccagcgaatacccctactcggaatgccagaatgcagctcaaatttaccgaaaagttacctgcggtattaaacctgcgagtttcgagaaagtgcatgatcctgagataaaggagattattggagagtgtatttgtaagaacaaggaggaacggtatgaaataaaagatcttttgtcccatgccttttttgccgaggataccggggtgagggtggaactggccgaagaagatcacgggcgaaagtccacaattgccctgcgcctatgggtggaggatcctaagaaactgaaaggtaagccaaaggataatggggcaattgagttcactttcgacttagagaaggagaccccagacgaggtggcacaagaaatgattgaaagcggcttcttccatgagtctgatgtcaagatcgtagccaaaagtatccgagatcgggtcgcactcattcagtggcggagggagagaatctggcccgctttacagcccaaggaacagcaggacgtgggatcacccgacaaagctcgcggtccccctgtcccattacaggttcaagtgacctaccacgcccaggccggtcagcccggaccaccggagcccgaagagcccgaagctgaccagcacctgctgccaccaacactccccactagcgccacgagtctggcttctgatagtacctttgatagtggacagggttccacagtgtacagtgattctcagtcatcccagcagagcgtgatgctcgggtcgcttgccgacgctgctcccagtccagcccagtgtgtgtgctcaccccctgtttccgaaggccctgttctccctcagagtctgccctccctgggcgcttaccaacagcctaccgccgctcctggcctgcctgtcgggtccgtcccagccccagcttgccctccatccctgcaacaacacttcccggatcctgctatgagtttcgcccctgtgctccctcccccttccacccccatgccgactggcccaggtcagccagccccacctggtcaacaaccgccaccattggcacagccgaccccacttccccaggtgctcgcacctcagccggtggtgcctctccagcccgtgcccccacatttaccgccatacctcgctccggcttcacaggtcggcgctcctgcgcaactgaaaccactgcagatgccacaggctccactccagccactcgcccaggttccacctcagatgcccccaatcccagtggtgcctccgattacccctctagcaggtattgacggcctgccgccagcattgcctgatctgcccaccgctactgtgcctccagtgcccccaccacaatacttttcgcctgctgtgattctaccctctttggcagcccctctccctcccgcatcccctgcacttcccttgcaggctgtgaaactaccacatcctcctggggctcccctggcaatgccttgcaggaccatagtcccaaatgctccagccactatcccacttctggcggtggctccgccaggcgtagccgctctttcgatacacagtgcggtagctcagttgcccggacagccagtttacccagccgctttccctcagatggcacccaccgacgtgccaccttctccccaccatactgtccagaacatgcgcgcaacaccccctcagccagctctcccgccacaaccaacattgccgcctcagccagtgctgccaccacagcccaccctgccccctcagccggtgctgccacctcagcctacgcgcccacctcagccagttctgcctccacagcccatgctgccccctcaaccagtcctgccccctcagccagctctccccgtgagaccagaacccttgcaaccacatttacctgagcaagccgcacctgcagccacccccggatcacagattctgctgggacaccctgccccatacgcagtggacgtggctgcccaggtgcctaccgtgcccgttccacccgctgcagtcctctctcctcccctgcccgaggtcttactgcccgcagctcccgaactcctgccgcagtttccatccagcctggcgaccgtcagcgcttccgtccagagtgtacctactcagactgcaactctgctgccacccgctaaccccccactgccagggggaccaggaatagctagcccctgtccaactgtgcagctgactgtggagcctgtacaggaggagcaggcaagtcaggacaaaccacccggtctgccacagagctgcgaatcatatggagggagtgacgtcacaagcggcaaggaactatcagacagttgcgagggggcatttggcggagggcgattggaaggccgtgccgctcgaaagcatcacaggaggagcacaagagctcgcagccggcaagagagggcaagcagacctaggcttactatcctcaatgtatgcaataccggcgacaagatggtagaatgtcagcttgaaacgcataaccacaaaatggtgacatttaagttcgaccttgacggcgacgctcctgacgagatcgccacctatatggtggaacacgatttcatcctacaggccgaacgcgagacgttcattgagcagatgaaggacgtcatggacaaagctgaagatatgctcagtgaggataccgatgccgaccggggttcagaccccggtacttcccctccgcatttatctacatgcggacttggaacgggggaggaatctcggcagtcgcaagccaacgcaccagtttatcagcagaatgttctccataccggaaagaggtggttcattatatgcccggtcgccgagcaccctgcacctgaagcaccggagtcttctcctcccctgccattaagcagcttgcctcccgaagccagtcagggcccttgtaggggccttactctgccatgtttaccttggcgacgagccgcttgtggggcagttttccttagccttttttcggcagagtccgcgcagtcaaaacaaccccctgattcagccccatataaagaccagctcagctctaaggagcaaccctccttcctggcgtcacagcagctgctgagtcaggctggtcctagcaatcctcctggcgctccacccgctcccctcgccccatcttcacccccagtcaccgcattgcctcaagatggcgctgctcctgcaacatcaactatgccagagcctgctagcggcaccgcatcccaggctgggggtccaggcaccccccagggactaacttctgagctggaaacgtcacaaccactcgccgagacgcacgaggctcccttggccgtgcagcctctggtggtcggactggccccttgtacgccggcacccgaggccgcttcaacaagagatgcatcagcccctagggagcctctccctccacccgcacccgagccctccccccacagtggcacgcctcagccagctctgggccagcctgctccgctcctccctgccgctgtgggcgctgtttcacttgctacctctcaactgccaagtccgcctctgggcccaacagtacccccacagcccccatctgccttggagtctgatggcgagggcccacccccaagagtcgggttcgtcgattcgacgatcaaatccctggatgagaagctacgtaccctcctttaccaagaacatgtccccacatcgagtgctagcgcagggactcctgtggaagtgggggatcgcgacttcaccctggagcccctcaggggggatcagccccgttccgaggtatgcgggggagatctggctctgccacccgtaccaaaagaggccgtaagcggacgggtgcagctcccgcaacccctcgtagaaaagtcagagctggctccaacaagaggggcagtgatggaacagggaacgagctctagcatgaccgcagaatctagcccgaggtccatgctggggtatgatcgcgacgggagacaagtggctagcgatagccacgtggtgcctagtgtgcctcaggacgtgcccgcatttgtccgtcctgcccgtgtggaacctacggatagggatgggggagaagccggtgagagctcagccgagccaccacccagtgatatgggaaccgttggcggtcaggcgagccaccctcagaccttgggagcccgagcccttgggtcgcctcggaagagaccggaacagcaggacgtgtccagccccgctaagacagttgggagatttagtgtagtgtcaactcaggacgagtggacattggcatccccacatagtttgcgctattcagctccccctgatgtctacttggacgaggccccttctagccccgatgtgaaactggcagttaggagggctcagacagcgagttccatagaggtgggtgtgggggagcccgtgagctctgatagtggggacgaggggcctcgcgctcggccacctgtccagaagcaagccagtctcccagtgtcagggtctgtggccggtgattttgttaagaaagcaactgcttttctgcagagaccctctcgggcagggagtctgggtcccgaaacaccgtcaagggtggggatgaaagtgcctaccatctcggtgactagttttcacagccagagctcttatatctcaagcgacaacgattccgagctggaggatgctgacatcaagaaggagctacagagccttcgggaaaagcacctgaaggagataagtgagcttcaaagccaacaaaagcaggaaatcgaggccctataccggaggctcggcaagcccctgcctcccaacgtggggttttttcacaccgccccacctacaggcaggagacgcaagaccagcaagagtaagctcaaagcaggcaagctgcttaaccccttggtgcggcagttgaaagtcgtggcttcatccaccgggcacttggcggacagttcccggggaccacctgcaaaagatccagcacaggcaagcgtgggactgactgcggacagtaccggcttaagtggaaaggctgtgcagacccagcagccttgttctgtgcgggcaagcctctcgtccgacatctgtagcggattggccagcgacggagggggtgcacgtggccagggatggaccgtatatcatccaacatcagaacgcgtgacctacaaatcatccagcaaacccagggcacggttcctgtcgggcccagtaagcgtgagcatttggtccgccttgaagcgcctttgcctggggaaggagcactccagccgaagcagcactagttccttggctccgggacccgagccaggcccacagccagccttgcacgttcaagcgcaggtgaacaacagcaacaacaagaaaggtaccttcacagacgatctgcacaaactggtcgacgaatggacttccaaaaccgtgggggctgctcagctaaagcctacgttgaatcagctcaagcagacacaaaagctccaggacatggaagcgcaggctggctgggctgcaccaggcgaggccagggcgatgacagcaccacgggctggggttggaatgccgaggctgcccccagctcctgggccactcagtacaactgtcatcccaggcgctgctcctacgttgagcgtgccgacacccgacggcgcactcggaaccgcgcgaaggaaccaggtttggtttggtctccgcgttcccccaaccgcgtgttgcggccactccactcaacctcgcggtgggcagcgagtgggaagcaagaccgcaagcttcgctgccagcgacccagtaagaagttac

SEQ ID NO: 246902 - DNA, 5600 bp, Artificial Sequence
  Description of Artificial Sequence: Synthetic coding sequence
atggccacctcagaatatccatatagcgagtgccagaacgccgcacagatctacagaaaagttacctgcggaataaagcccgcatcgttcgagaaagtacacgaccccgagatcaaagagattattggagagtgtatctgtaaaaacaaggaagaacgttatgaaattaaagacctcctaagtcatgccttttttgcagaggataccggagtccgggtggagctagctgaggaagaccacggcaggaaatcaacaatagccctgcggctctgggtcgaagatcctaagaagctcaagggcaagcctaaggataacggagcaatcgagttcacattcgatctcgaaaaggagaccccggatgaggttgcccaggaaatgattgagtccggcttctttcatgaatctgacgtcaagattgtggccaaatccattcgagacagagtcgccctgattcaatggagaagagagaggatttggccagccctgcagcctaaagaacagcaagatgtcggatcaccagataaagccaggggcccaccagtccccttacaagtccaggtgacatatcacgcccaggctggtcagccgggtccccctgaacccgaagaacctgaggccgaccagcacctattgccacctacattgcccacttcagcaacatctcttgcaagcgacagtaccttcgactcaggccagggctccactgtttacagcgatagtcagagcagtcagcagagcgttatgctgggatccctggccgacgctgcgccttccccagctcagtgtgtgtgctctcctccggtgtccgaggggcctgtcttgcctcaaagcctgccgtctcttggggcttaccagcagcccactgctgcccctggcctccccgtaggaagcgtgccagcccctgcgtgtcccccatccctgcagcaacactttccggaccccgcaatgtcattcgcaccggttcttccgcctcctagcaccccgatgccaactgggccaggtcagcccgcaccgcctggccagcagccacctcccctggcccaaccaacccccctaccccaagtgctcgcaccccagccggtggtaccactgcaacccgtccctccccatctgccaccttacctcgctcctgcctctcaagtcggagcgcctgctcaacttaaaccgcttcagatgcctcaggcccctctgcaacctctggcccaagtgcctccacagatgccccctattccggtcgtccctcccataacgccactggccggtattgatggcctgccccctgcccttcctgacctcccaacagcaacagtgcctccagtacctccaccccagtacttttcaccagccgtcatactccctagcttggccgcaccccttcctcccgcaagtcccgctttgcccctgcaggcggtcaaacttcctcaccctcctggggctccactggctatgccttgccgcacgatcgttcccaatgcgcctgcaaccattccattactggcagtggcccctccaggcgtggctgctttatctatccactccgctgtggctcaattgcctggacaacctgtgtatccagcagcatttccccagatggcccctacagatgtgccgccttccccacaccacaccgtccaaaacatgagagcaacccctccccagccagccctcccaccacagcccaccctgcctccccaaccagtgctgcctcctcagcccacacttcctcctcagccagttctgccaccccagcctacaaggcccccacagcccgtgcttccccctcagccaatgctcccaccacaaccagttctgcctccacaacccgcacttcccgtgcgccctgagccactgcagcctcatctgcccgaacaggccgctcccgctgctacgccaggatcccagatccttcttggccatcccgctccatatgctgtggatgtcgcagctcaggtacccaccgtccctgtgccccctgctgccgtgttatctcctcccctaccagaggtgttgttaccagccgcacctgaattacttcctcagttccctagctctctcgcaacagtgagtgcctccgtgcaaagcgtaccaacccagactgccacacttctgcctcccgcaaatcccccattgcctgggggacccggtatcgccagcccctgcccaaccgttcaactgactgttgagccagtccaagaggagcaggccagccaggataaaccaccaggacttccgcagtcctgcgaatcttatggtggatccgacgtgacctctgggaaagagctcagtgatagttgcgaaggagcattcgggggaggcagacttgagggcagagcggctcgcaagcatcaccggcgttctactcgagcgcgaagtagacaggaacgggcatcacgaccaagattgacaattctgaacgtctgcaatactggcgacaagatggttgagtgtcagttggagacacacaatcacaagatggtaacgttcaagttcgatttagatggcgacgctcccgatgagatagccacttacatggtggaacacgacttcatcctccaggctgagcgcgagaccttcatagaacagatgaaggatgtgatggacaaggcagaagatatgctgagtgaagacacggatgctgatcgcggatcggatccaggcacatccccaccacacctaagcacttgtggattggggaccggagaggagtcccgtcagagccaggctaatgctccggtgtatcagcagaacgtgcttcacaccggaaagcgttggttcatcatttgtcccgtggccgagcacccagcccctgaggcacctgagtcatcaccacctctgcccttgagctccctgcccccagaagcatcccagggcccatgtcgcggacttaccctgccatgcctcccctggaggcgcgcagcatgcggagccgtgttcctatccctcttctcagccgagagcgctcaatcgaagcagccacctgattcagctccctataaagaccagttgagttccaaagagcagccaagctttctagcttctcagcagctcctctctcaggcaggcccttccaaccccccaggagcccctccagctcctctggcccctagcagtccacccgttactgctctgcctcaggacggggcagcccctgctacatcaacaatgcccgaacccgcatctggtaccgcgagtcaggccggtgggcctggaacaccacaggggctgaccagtgaactggagacctctcagccgctagccgagactcatgaggcgccacttgccgtgcagcctctcgtagtcgggcttgcaccctgcacaccagcaccggaggccgctagtacgagagacgctagcgctccaagagagcctcttcctcctccagccccagagccgtctccgcattctggaacgccccagcctgcccttggccagccagccccattgctaccagccgctgtcggtgccgtctccctcgctacctctcaactgccctctccgcctctgggacccacagtcccgcctcagccaccgtccgccctagagagcgatggcgaaggaccccctcccagagtgggcttcgtggactccacaatcaagagcttagacgaaaagttgcggaccctactctatcaagagcacgtccccacgtcatctgcctctgcagggactccagtcgaggtgggggatcgagacttcacgctggagccactccgaggggaccagcccaggagcgaggtgtgcggcggtgacttggctctaccccctgttcccaaggaggcagtgagtggacgggtacagcttccccaacccttagtcgaaaaatccgaattggcaccgaccaggggtgcagtgatggagcaaggcacaagtagttccatgacagctgagtcttcacctcggtctatgttgggttatgatagggatggacgccaggtggcatccgactcccacgtagtgccatctgtgcctcaagatgtccccgcattcgtccgaccagccagggtggaacctacagaccgagatgggggtgaggcgggagaaagctccgccgagcccccacccagcgacatggggaccgtgggaggtcaggcttcccaccctcagactttgggagcccgagccttaggatctccacggaagaggcctgaacagcaagacgtgtccagcccagctaagaccgttgggaggttttccgttgtatctactcaagacgagtggaccctcgcctccccccacagcctgcggtactcagctccgccagacgtgtacttggatgaggcaccctcgtcgcccgatgtcaaactggcagttcgtagggcacagaccgcctcctctattgaagtgggcgttggagaaccggtctcttcagattcaggagatgaggggccacgtgcaaggcccccagtgcagaagcaagctagcctcccggtctccggctccgtggccggagactttgtgaagaaggccacagcctttctccagcgaccaagccgggctggttctcttggtcctgagacacctagtcgggtgggtatgaaagttccgactatttcggtgacatcatttcattcacagtcatcttacatttcgagcgataatgactcggagctcgaagatgctgacatcaaaaaagaacttcagtctctcagagaaaagcaccttaaggagatctccgaattacagtcccaacaaaagcaggagattgaggccttgtacaggagactgggtaagcctcttcccccaaatgtgggcttctttcacaccgcccctcccacagggaggcgccgtaagacatctaagtctaaactgaaagccggaaagctcctgaaccctcttgtgaggcaacttaaggttgttgccagctccactgggcacttggccgactcttctcgcggaccccctgccaaggacccagctcaggcctctgtgggactaaccgcagattccactgggctgtccggcaaagcggtccaaacccagcaaccatgcagcgtccgagcaagccttagtagcgacatctgctccggattagcatcagacggtggcggagccaggggtcaggggtggaccgtttaccatcctacgtccgagagagtgacctacaaatccagtagtaaaccgagagccaggtttttgtcaggtcccgtcagtgtgagcatctggagtgctctcaaaaggctgtgtctgggtaaggagcattcctcaaggagttctacgtcaagcctggcacctggacctgagcccggtccacagccagctttacacgttcaggcccaggtcaataattccaataataagaagggaacttttaccgatgaccttcacaagttagtggatgagtggacctctaaaaccgtaggggcagcccagctgaaaccgaccctgaaccagctaaaacagacacagaaactccaggacatggaagctcaggccggatgggccgctccaggggaggctcgcgcaatgaccgctccaagggctggtgtgggaatgccacgtcttcctccagcaccgggaccactaagcacgacggtgataccaggcgcagctccgacactgtcagtgcctacaccagacccagagtcagagaaaccagacta

SEQ ID NO: 246903 - DNA, 1092 bp, Artificial Sequence
  Description of Artificial Sequence: Synthetic coding sequence
atggaacaaggtacatcctcgtcaatgaccgaatcatcccctcgatcgatgttaggatatgacagagatggcagacaggtggctagcgactcccatgtcgtcccatcggtgccacaggacgttcccgcttttgtacgccctgccagggtggaaccaacagatcgggatggtggcgaagcaggggagtcctcggctgaaccccctccttccgacatgggcactgtgggaggccaggcctcgcacccacagacactgggagcgagggcactagggtctcctcgcaaacgtcctgaacaacaggatgtgtcatctcccgctaagactgtcggccgattctcagtagtcagtactcaagacgaatggaccctggcctccccacacagcctccggtactctgcgcctcctgacgtctacttggatgaagcacctagttctcccgatgttaagcttgcagtgcggagggcccagaccgcatcctcaattgaggtgggggtcggagaaccggtcagctcagacagcggagacgagggcccaagggcccgacctcccgtccagaagcaggcttcgttacctgtttccgggtctgttgcgggtgactttgttaaaaaagccacgtcgtgtcggggattgctagggccaagcctgggtcctgagactccttcacgggttgggatgaaagtgcccacgatctcggtcacttcattccattctcagtcatcttacataagttctgataacgatagtgaattggaagatgccgacatcaagaaggagctccagagcctacgcgagaaacatctcaaagagattagcgagctgcagtcccagcagaaacaggagattgaggccttgtaccgcaggctcgggaaacccttgccccctaacgtaggtttcttccacactgcgcctcctaccgggagaaggagaaagaccagcaagtcaaaattaaaggccggtaagctgctcaatcccctggtccgccagctgaaggtggtggcctccagtacaggccacctggcagatagtagtcgaggccctccagccaaagatccgaagccggtttggggatcacttcaaacagcacgggcatag

SEQ ID NO: 246904 - DNA, 2340 bp, Artificial Sequence
  Description of Artificial Sequence: Synthetic coding sequence
atggaacccggtcgaggggcagggcctgctggaatggctgaacctcgggcaaaggcagcacggccagggccacaaaggttcctgcggaggtccgtggttgagtcagatcaggaggaaccccctggattggaggccgctgaagcgccaggtccccagcctcctcaaccgctgcagaggagagtgcttctgctgtgcaagaccaggcggctcatcgcagaaagggccaggggaaggccagccgcacccgctcctgcagcgcttgttgcgcaacccggagccccaggcgcacccgcagatgccggtcccgagcccgtgggaactcaagaaccgggtcctgaccctatcgccgctgctgttgagactgcccctgcacccgacggtgggcctagagaagaggccgcagctacggtcaggaaggaggatgagggggcagcggaggctaagcccgagcccggaagaacaaggcgggatgagcccgaggaggaggaggatgatgaggatgatcttaaggccgttgccacaagcctggatggcaggtttctaaaatttgatatagaacttgggcgaggctcttttaaaaccgtgtataagggccttgataccgagacctgggtcgaggtcgcttggtgtgaacttcaggatagaaaactgactaagctggagcgtcagcggtttaaggaagaggcggaaatgctgaaaggactgcagcaccccaatattgtacgcttttatgatttctgggagagttcagcgaagggtaaaaggtgtatcgttctggtgaccgaacttatgacctccggaacgctgaagacatacttaaagcggttcaaggtcatgaaaccaaaagtgttgcgttcttggtgtagacagatcctgaaaggtttgttgttcttacacacccgcactccacctatcatccaccgagatctgaaatgcgataatatctttatcacaggtccgaccgggagcgtcaagataggtgatctgggcttggccacgctaaagcgggctagctttgcgaagtcagtgattggtacccctgagtttatggctcccgagatgtacgaagaacattatgatgaatccgtggacgtgtacgcattcggtatgtgtatgctggagatggctacatctgagtatccttacagcgagtgtcaaaatgccgctcaaatttaccggaaggtgacttgtggcatcaagcctgcgtccttcgaaaaggtgcacgacccagagattaaggagattatcggcgaatgcatctgtaagaacaaagaggaaagatatgaaatcaaggacctgctgagtcatgcattctttgctgaagatacgggcgtacgcgtcgagcttgccgaggaagaccatggtaggaagtccacaatcgcgttacgtctatgggtggaggaccctaagaagctgaaaggcaaacccaaagacaacggggctatcgagttcacctttgacctggagaaggaaacccccgatgaggtggctcaagagatgatcgagtccggtttcttccatgaatccgatgtcaagatcgtggctaaaagtataagggatcgggtggccttaattcagtggcggcgagagcgcatatggccagctctccagcctaaggaacagcaggatgtcggaagtccggacaaagcacgaggccctccagtgccactgcaggtccaggttacctatcacgcccaagcgggacaacccggtccaccagagcccgaagaaccagaagcagatcaacacctgctgccaccaaccttgccaacttctgccacttccctggcctccgactctacttttgattccgggcagggctctactgtctattctgactcccagagcagccagcagtctgttatgctgggtagcctggccgatgctgctccatccccggctcagtgtgtttgttctccacccgtgtctgagggaccagtcctgccccaaagccttccctcgctcggagcttaccagcagcccactgcagctcctccccctcttgctcaaccaacacctctgccccaggtcctggcacctcaacctgtcgtccctctgcaacctgtgcccccacacctgccaccctacctcgcgccagcgagccaggtcggggcaccagcccagctcaagcctcttcaaatgccccaggctccactgcaacctttagcccaagtgcctccacaaatgccacccatcccagttgttcccccaattaccccattggcaggtatcgatggcttgcctcccgctctgcccgacttgccaactgccacagtgccccctgtgccacctcctcaatattttagccccgctgttatcctgccctccctagccgcatag

SEQ ID NO: 246905 - DNA, 6653 bp, Artificial Sequence
  Description of Artificial Sequence: Synthetic coding sequence
atggacggtgacggtgggaggagggacgtcccaggcactctgatggaacccggacgcggtgccggacccgcaggtatggcagagcccagagctaaagccgctcgacctgggcctcagagatttctgcggaggtcggttgtggagagcgatcaagaagaacccccaggcttagaggccgcagaagcacccggtccgcaacctcctcaaccactgcaacgaagggtactgctgctctgtaagacaagaagactgattgcagagcgtgcgaggggaaggccagcggctcctgccccagccgctttggtggctcagccgggtgcgccaggggcaccagctgacgctgggcctgaacctgtgggaacgcaggagcctggtccagatccgatcgccgctgctgtggagactgccccagcgcctgacggtggacccagagaagaagctgcagcgaccgttcggaaggaagatgaaggagcagcggaggctaagcccgagcccggaaggacccgacgagacgaacccgaggaagaggaggacgatgaggatgacctcaaagctgtggcaacctcactcgatgggaggtttcttaaatttgacattgagctcggcagaggctcatttaagacggtttacaaaggactagacacagaaacctgggtggaggtggcctggtgcgagttacaggatcggaaactcaccaagctggaacggcagagattcaaggaagaggcggaaatgctgaagggacttcagcaccctaatatcgtgcgcttttacgatttttgggagtcctctgctaaagggaagcggtgtatagtgctggtcaccgaactgatgacatcaggcacacttaaaacctatctaaaaaggttcaaagtgatgaagcccaaggttttacgcagttggtgtaggcagatcctaaaggggctgctttttcttcatacgagaaccccgcctatcatacacagagatctgaaatgtgacaacatctttattaccggtcccaccgggtcagtgaaaattggcgatctgggcctggccaccttaaagcgagcctcctttgctaaaagcgtgatcgggactccagaatttatggcgcctgagatgtacgaggagcattacgatgaatccgtagacgtctatgcctttgggatgtgcatgctggaaatggccacctccgaatatccatattctgagtgtcagaacgctgctcagatataccgcaaggtgacgtgcggcataaagccagcctcatttgagaaagtacacgaccccgaaatcaaggagatcataggcgagtgtatttgtaaaaacaaagaagaaagatacgagatcaaggatttgctgtcccatgccttctttgctgaagacaccggtgtaagggtcgagctggccgaggaagatcatggcaggaaaagtaccattgccctgcgtctctgggtagaggaccctaagaagctgaagggcaagccaaaagataatggcgctattgagtttacgttcgatcttgaaaaggaaaccccggacgaagttgcacaagagatgatagaatccggcttctttcacgaatctgatgtgaaaattgttgcaaaatccatcagagaccgcgtagccctcatccagtggcggagagagaggatctggcccgcactccagccaaaagagcaacaggatgtgggcagtcccgataaagcaagaggaccccctgttcctttacaagtgcaagttacttaccacgcccaggcaggtcaaccaggtcccccagaacccgaggaacccgaagcagaccaacaccttttaccaccaactctcccaacgtcagccacaagcttagcgtctgactctactttcgactccgggcagggatccaccgtttattcggacagtcaatcctcgcagcaatctgtgatgctgggatctctggctgacgccgctccgtccccagcgcaatgtgtttgctctcctccagtgtcagagggaccagtgcttccacagagcctgccctctcttggagcatatcaacagcccaccgctgcgccaggactgcctgtgggaagcgtaccagcacccgcatgtccgccttccctgcagcagcactttccagatcctgctatgtctttcgcccctgtgctgccccctcctagtactccaatgcccacaggaccgggacagccagccccacccggacaacaaccccctccactggcccagcccaccccactcccccaggtgctggccccacagcctgtggtgccgcttcaaccagtgccgcctcacctccctccctatttggcgcctgcgtcccaggtcggggcaccagcacagctcaaacctctgcagatgcctcaagcccctttgcaaccccttgcgcaagtcccaccgcagatgcctcccatcccagtggtgccacctataactcccttggcgggaatagacggtctgcctcctgctctgccagatctgcctactgcaaccgtgccccctgtgcccccaccccagtatttttccccggcagtgattcttccatctttagctgcccctctgcctccggcatccccagctctacctcttcaggccgttaagctgccccacccgccaggagcacccttggccatgccttgcagaacaattgtacccaacgccccagctaccattcccctgctcgctgtggctccgccaggcgtcgccgctctgtccattcattcagcggtggcacaattgccaggccaacccgtgtaccccgcagcttttccccaaatggccccaaccgacgtgcccccatcacctcaccatacggttcagaacatgcgcgcaacccccccacagcccgctctgccaccgcagccaactctgcctccccagccagtgctgcctccacaacctaccctaccaccgcagccagtgctgccaccccaacctacaagaccaccccagccagtgctgcctccccagcctatgctgccccctcaaccggtgctgcctcctcagccggcactgccagtgcggcctgaaccattacagcctcatctgcccgagcaggccgctccagctgctacacctggctcacagatcttgctaggacacccggctccatatgcagtagacgttgctgcccaggtacccactgtccccgtcccccctgcagcggtgctgtctccaccactgcctgaggtcctcctgcccgctgcccctgagctgctgcctcagtttccatcatctctggccaccgtctctgcatcggtgcagagcgtgccgacccagaccgcaaccttgctgccgcctgcaaacccccctcttcccggtggcccaggaatcgcttccccctgccctacggtacaactgacagttgagcccgtgcaagaagagcaggcctctcaggacaaaccacccggactgccgcagtcctgcgaatcgtacggcggttcggatgtgacttctggcaaggagttatccgattcttgtgaaggggcattcggcggagggaggctggaagggagggctgctcggaagcaccacaggcgctccacccgagcacgctcccgccaggagagagctagcaggcccaggttgaccatcttgaacgtgtgtaacaccggggataaaatggtcgagtgtcaactggagactcacaatcacaaaatggtaaccttcaagtttgatcttgacggggatgcgcctgacgaaatcgcaacttatatggtcgagcacgactttatcctgcaggcagagcgggaaaccttcattgagcagatgaaggatgttatggacaaggctgaggacatgctctcggaagatacagatgccgataggggtagcgatccaggaacctctcctcctcacttgagcacttgcggactgggaacaggggaggaatcgcgtcagagccaggcaaatgcacccgtttatcaacagaacgtcctccatacggggaaacggtggttcatcatatgtcccgtagctgaacatcccgcaccggaggctcccgaatccagcccacctctgcccctgtcttccctgccccctgaagcttcacaggactccgccccatacaaagaccaattatcaagcaaagagcagcccagcttcctggcctcccagcagctgctctctcaggctgggcctagtaacccaccaggggcaccccctgcaccactggccccatctagcccgcctgtcacagcattaccccaggatggggcagcaccagccaccagtaccatgcctgaacctgcatcaggtaccgcgtcacaggctggcggtcctggcacgccccaagggctcacgagtgagcttgaaactagtcagcccctagccgaaacgcatgaagctcctctggccgttcagcccctggtcgtgggtctggccccttgtactccggctcccgaagctgcgagtacacgcgacgctagtgcacctagggaacctctccctcccccagctccagagcctagcccgcatagcggcaccccacaaccggcactggggcagccagcccctctgttacctgctgctgtgggcgcagtcagtctcgcaacctctcagctgccctctccacctctcggcccaactgtacccccacagccccctagcgccctggagtccgatggcgaaggaccacctccacgcgtgggatttgtagattctaccattaaaagtcttgatgagaagctgaggaccctgctataccaggaacatgtccccaccagcagcgcatctgccggaacacccgtggaagttggagaccgggattttactctggagcctttaagaggcgaccagcccagaagtgaggtatgcggaggagaccttgccctgccccctgtgccgaaagaagcagtgtccgggagggtgcagctcccccagccactggttgaaaagtccgagctggccccaaccagaggtgccgtgatggagcaaggtacgtcatcctccatgactgcagagtcatctccaaggtctatgctcggatatgatagagatggcagacaggttgcgagcgattctcatgttgtgccatcggtgccacaagacgtgcccgcatttgtgcggcctgccagagtcgagcccactgaccgtgatggaggggaggccggagaaagcagcgcagagcctcccccttccgacatgggcacagtaggcggacaggcttctcacccccagacattgggtgcgagagccctgggatccccacgcaaacggcctgaacaacaagatgtctccagtcccgcaaaaaccgtgggccgatttagtgtggtgtcaacgcaggatgagtggactttagcaagcccacactctttgcgttattctgccccacctgacgtgtacttggacgaagcccctagttcacccgatgtcaaactggccgtgcggagagcgcaaacagcaagctctattgaagtcggggtgggcgagcccgtgagttccgattccggtgacgaaggccctagagccaggcccccagtgcagaaacaggcatcactgcctgtgagcggatcagttgccggagattttgtgaagaaagcgactgctttcctacaaaggccatcaagggctggtagtctggggccagagacgccatcaagggtcggcatgaaggtgccgaccatcagtgtgacctcatttcatagccagtcgtcttacattagctccgataatgattccgagctggaagacgctgatatcaagaaggaattacagagcttgcgcgaaaagcaccttaaagaaatcagtgagctgcagtcccaacaaaaacaggagatagaggcgctctatcgaaggctgggaaagccacttccaccaaatgttggattctttcacacagcaccaccaactggtaggcgtcggaagacttccaagtccaaactaaaagctgggaagctcctgaatcccctggtgcggcagttgaaagtggtggccagcagcactggacacctggcagactctagtcgcggacctcccgcaaaagatcctgcgcaggcatcagtggggctgaccgccgactcaaccggcctgagcggcaaagccgttcaaacccagcagccatgcagtgtccgcgctagcctgagttcagatatctgcagtggtctcgcttcagatggagggggagcaaggggccagggatggaccgtctatcaccccacatccgaaagggtcacctacaaatcttcttctaagccacgcgctagattcctctctggtcccgttagcgtgtccatctggtccgcgctgaagcggttatgcttaggtaaagagcacagctctagatcatcaacatcttctttggcccctggacctgaacccggaccccagcctgctttgcatgttcaggcccaggttaacaatagcaataacaagaagggaacattcactgacgatctgcacaagcttgttgatgagtggacgagcaagaccgtcggcgcagctcaacttaagccaaccctgaaccagcttaagcagacccagaaactccaggacatggaggcccaagccggttgggcagcccctggtgaggccagagccatgaccgctccacgagcaggggtcggaatgcctcggctcccaccggctcccggaccactttccactactgttattcccggagcagctcccaccctcagtgtgcctacccccgatcctgagagcgagaagccagacta

SEQ ID NO: 246906 - DNA, 5510 bp, Artificial Sequence
  Description of Artificial Sequence: Synthetic coding sequence
atggctacgtcagagtatccctactctgagtgtcagaacgcggctcagatctatcgcaaggtcacctgcggaataaaaccagctagctttgaaaaggttcatgaccctgagattaaggagatcatcggggagtgcatttgcaaaaacaaagaggaaagatacgaaatcaaggacttgctttcccacgcttttttcgcggaagatacaggtgtgagggtagagctggcagaggaggatcacggacggaaatctacgattgcactgagactgtgggtggaggaccctaagaaactgaaagggaagccaaaggataacggagctattgagttcacctttgacttagagaaagagactcccgacgaggtggcccaggagatgattgaatctggattctttcatgaaagtgacgttaagatcgtggccaaatctataagggaccgtgtagcgctgatccagtggcgcagagagaggatatggcctgctcttcagcctaaagaacagcaggacgtgggctcgcccgacaaagccaggggtcctcccgtgcccctgcaagtgcaggtgacctaccatgcacaggcagggcagccaggacctcctgaaccggaagagcccgaggccgaccaacacttgctgccacctacattgccaacgtccgccacctccctcgcctccgatagtacatttgattcgggccaagggagcaccgtttattccgattctcagagctcccagcagagtgtgatgctcgggtccttggccgacgctgcccctagccccgcacagtgtgtttgcagtccaccagtctccgaagggcctgtactgccacagtcgctcccctctctcggggcttatcaacagcctaccgccgctcccggactgccagttgggtcagtccctgcacccgcttgccctccctcactccagcagcattttcctgacccggcaatgagcttcgcacctgtcctcccccctcccagcacccccatgccgaccggccctggccagccagcacctcctggacagcaacccccacctctagcccagcctacccctttacctcaggtcctggctccacagcccgtggtgcccttgcagcccgtgccaccccacctacctccatatctggcacctgcctctcaagtgggcgcaccagcccaactgaaaccacttcagatgccccaagctcccttacagccattagcccaggtgccaccacagatgccgccaataccggtcgttccccctattaccccattagccggaatagacgggctgcccccagctttaccagacttgccgaccgccacagtgcctcccgttcccccaccacagtatttttcgccggctgtgatcttgccgtcattggccgctcccctgccaccagcttccccagccttgcctctacaggccgtcaaactgccgcaccctccgggtgcgccactggccatgccctgccgcaccattgtgcccaatgctcctgccactatcccactgctggctgtcgcccctcctggagtggctgccctgtctatccactccgccgtcgcccagttgcccggacagcccgtgtaccctgcagccttcccacagatggcgcctactgacgtgcctccctccccacatcacacagttcaaaatatgcgcgctacgccccctcagccagctctgccacctcaacctactctaccaccccagcccgtcttacctccccaacccaccctgccacctcaaccagtactaccacctcaacccactcggcctccccagccggtgctgccaccacaacccatgcttccccctcagcccgtgctgcctcctcagcctgcactgcctgtgaggcccgagccccttcagcctcacttgccagagcaggcagccccagccgctactccaggttcccagatcctgctaggccatcctgccccttacgccgttgacgtggccgctcaagtgccaaccgtacccgtgcctcctgctgccgtgctctcccctccccttccggaggtcttgctgccagcagcccctgagctcctgccgcagttcccgtccagtttagcaacagttagcgcctctgtgcaatccgtgccgacccagactgccacactgctgccacctgctaatccaccgttacctggtgggcctgggatcgcgtcgccttgtcccacggttcaactgacggtggagccagttcaagaagaacaagcgtcacaggacaagccacccggtctgccacagagttgtgaatcctatgggggatccgacgtgacctctggtaaggagctcagtgatagctgtgagggggcttttggcggtgggagacttgaggggagggcagcacggaagcatcacaggaggtcaacccgcgcacgttccagacaggagcgagccagcagacctcgactcacgatcctgaatgtgtgcaacaccggagacaagatggtggagtgtcagctcgagacacacaaccacaagatggtgactttcaaatttgatcttgacggagatgctccagatgaaatcgccacttacatggttgaacacgactttatactgcaagcagagcgcgaaactttcatcgagcagatgaaggatgtaatggataaggcagaggacatgttgtctgaggataccgatgctgaccggggatctgatcctggcaccagcccccctcatctgagcacatgtgggctaggcaccggagaggaatcccggcaatcacaggccaacgccccagtgtatcagcaaaatgtgctgcataccggtaagagatggttcataatctgccccgtggcggagcacccggcacccgaggcacccgaatccagtccaccgctgccactctcaagcctccccccagaggcatcacaggactctgccccatacaaagaccagctgtcctccaaggagcagccctcatttcttgcgtcacagcagcttcttagccaggccggaccaagcaatcctcccggtgctccaccagccccactcgctcctagttcacctcctgtcacggccctccctcaggatggtgctgctcctgcgacatcaaccatgccagagcccgcttccggtaccgcaagccaagccggaggccctggcaccccccaaggtctcacgtcggaactcgaaacatcacagcccctggccgagacccatgaagcccctctggcagtccaacccctcgtagtgggtctcgccccttgtacaccagctccagaagccgcaagtactagagatgcctccgctccacgcgaaccactgccacctccagctcctgagccatcaccgcacagtggtactccccagcccgctctggggcagccagccccacttctgcccgcagcagtgggagcggtgagcctagcaacaagtcagctgccttcaccgccactcggaccaacagtgccccctcagcctccatcggcccttgagagtgatggcgagggcccaccccctcgcgtcgggttcgtcgatagcaccatcaaaagtctggatgaaaaactgcgtacattgctgtaccaagagcacgttccgactagctcggcaagcgcaggcacacctgtcgaggtcggggacagggactttaccctagaacctctgcgtggggatcaaccgaggtccgaggtttgtgggggagaccttgctctcccaccggtgcccaaggaggccgtgtctggccgagtccagctgccacagcctttggtggagaaatccgaactagcacctacacgtggtgcagttatggaacaaggcacctcctcttctatgaccgcagaatctagtcctagatcgatgttggggtacgaccgcgacggcaggcaggtggccagcgattcccatgttgtccccagtgttcctcaagatgtaccggctttcgtaaggccagctcgggtagaaccgactgacagggacgggggtgaggccggagaatcaagtgccgaaccccctcccagcgatatggggaccgtgggcggacaggcgagccacccccagaccctgggcgcacgggctctgggatcaccccgaaaaaggcctgagcagcaggacgtatcctccccagccaaaactgtgggaagattctctgtggtatcgacgcaagacgagtggaccctggccagcccccacagcctcagatactcagctccgcctgatgtgtacctcgatgaggccccatctagccctgacgtcaaactggctgtccgcagagctcagaccgccagctcaatagaagtaggtgtcggcgagcctgtgtcttcggacagcggggatgagggaccacgggctagacctcctgttcaaaaacaggcatctctgccagtgtctgggtctgtggctggcgactttgtcaagaaagccaccgcttttcttcagagaccaagtagagcgggatcactaggaccagagactccttcgagggtgggcatgaaggtgcccactatctcagtgacctcatttcattcgcagtcctcttatataagttcagataacgactctgagctcgaagacgctgatatcaaaaaagaattacaaagcttgagagagaagcatttgaaagaaatcagcgagcttcagtcccagcagaaacaggagattgaagccctctaccgcagacttgggaaacccctgcctcctaatgtcggcttcttccacaccgctccacctactggcagacgcagaaaaacctccaagtctaaacttaaagctggtaagctgcttaatccattagttagacagttgaaagtagtcgcttctagcacgggtcatctggctgatagtagccgtggacctcccgctaaggaccctgctcaggcctcagtggggcttaccgctgacagcaccggcctctccgggaaagctgttcagacacagcagccctgtagcgtgcgcgcaagcctcagttcagacatctgctccggcttggcttctgacggcggaggagccagggggcagggatggacagtctatcatccaacaagcgagagggtaacttacaagtcgagcagtaagcctagggctagatttctttcgggccctgtctcagtgagcatttggtccgctttgaaaaggttgtgcctgggcaaggaacattcctctagaagttctacatccagccttgcccctggtccagaaccagggcctcagccagccctccatgtgcaagcccaagtgaacaattccaataataaaaagggtaccttcactgacgatcttcacaagctagttgatgaatggactagtaaaaccgttggagccgcacagttgaagccgacattgaaccagctgaaacagacccagaaacttcaggatatggaagcccaagccggttgggctgcccctggggaggcccgagctatgaccgcccctagagccggagtgggaatgcccagactccctccggctccaggacctttatcaaccaccgtcattcccggtgctgcccctactctgtcagtgcctacacccggaagctgcgggccaagggcagtctccacacccacctcttacaccta

SEQ ID NO: 246907 - DNA, 5402 bp, Artificial Sequence
  Description of Artificial Sequence: Synthetic coding sequence
atggcaacggatagcggcgaccctgcttcaaccgaagactctgagaagcctgacgggataagtttcgagaatcgcgttccccaggttgccgctaccttgaccgttgaagctaggctcaaagagaagaattcgacatttagtgcaagcggcgagacggtggaacggaagcggttcttccgcaaatccgtggagatgacagaagacgacaaagtcgctgaatcttcacctaaggacgagcggattaaggccgcaatgaatatcccacgggtggataaactgcccagcaacgtgcttagaggaggacaagaagtgaagtacgaacaatgctcaaaaagcacctccgaaatcagcaaagattgcttcaaggagaaaaacgaaaaagaaatggaagaggaagccgaaatgaaagccgtcgcaacttccccgtccggcagatttctgaagttcgatattgaactcggcaggggtgcttttaaaacggtgtacaagggactcgacacagaaacctgggtggaagtcgcctggtgtgagcttcaagatcgtaaacttacaaaggctgaacagcagcggttcaaagaggaagctgaaatgttaaagggactccagcatccaaacatcgttagattctacgattcctgggaaagtatattaaaaggaaagaaatgcatcgtgctcgtgacggagctcatgacctccgggaccctcaaaacctatctcaaacgttttaaggttatgaagccaaaagtactgagatcatggtgtcgccaaatactgaagggacttcagtttttgcatacaagaacgcctccaattatccacagggatctgaagtgcgacaatatttttatcaccggcccaaccggcagcgttaaaatcggagatctaggcctggctaccctcatgaggacatcctttgccaagtccgtgatcggaacgcccgaattcatggctccagagatgtatgaagagcactatgatgaatccgtagacgtttatgcgttcggcatgtgcatgcttgagatggcaacttctgaatacccttattctgagtgccagaacgccgctcagatttatcgaaaagtgacttccgggattaagccagcatcatttaataaagtgacagatcccgaagttaaggaaatcattgaggggtgtataaggcaaaacaaaagtgaacgcctgtcgatccgagatctactcaatcacgcctttttcgctgaagataccggcttgagggtcgagttggctgaagaagatgattgttctaactcgtcactcgccttacgactttgggtagaggaccctaagaagctaaaagggaagcataaggacaacgaggcaatcgagttttctttcaaccttgagaccgacacgcccgaggaggtggcgtatgaaatggtcaaaagtggattctttcatgaatcggactccaaggcagtagctaaaagcatacgagacagggtgacgcctataaaaaaaacgcgtgaaaaaaagcccgcaggttgtctagaagagagaagagactctcagtgtaaatctatgggtaatgtctttccccaaccacagaacactaccctgcctctcgcaccagctcagcagacaggggctgaatgcgaggaaacagaagttgatcagcatgtccggcagcagctgctgcagagaaagcctcagcagcactgctcaagcgttaccggcgacaatctttcggaggcaggagctgcatcagtaatccattcagatacaagcagtcagccatccgtggcatattccagcaaccagactatgggctcacagatggtgtccaatattccgcaggcggaagtaaatgtccccggacagatttacagctcacagcagttagtgggccactatcaacaggtgagcggactccagaaacattccaagctgacacagcctcagatcctgcccctggtgcaggggcagagtaccgtcctccccgttcacgtgctgggtccaacagttgtgagccagccacaggtgtctcccctgaccgtgcagaaggtgccacagatcaaaccggtttcccaaccggtcggcgcagagcagcaagccgctttgctgaaacctgacttagtgcgatcactcaatcaggatgttgccactacaaaggaaaatgtgagtagtcctgacaacccctcaggcaatggcaaacaggatcggatcaagcagcggagggctagctgtcccaggcctgagaaaggaacaaagtttcagctgaccgtccttcaggtttccacttccggtgacaatatggtggagtgtcagctggaaacacataataacaaaatggtgaccttcaagtttgacgtggatggcgacgccccagaagatatcgcagactacatggttgaggataattttgttttggagtcagagaaggagaagttcgtggaagaactccgggctatcgttgggcaggctcaggaaattctgcacgttcacttcgctacagagcgtgccactggggtggactctattaccgttgacagcaattcatcacaaaccggcagctccgaacaggtgcagatcaacagtactagtacacagaccagtaatgagtctgctccacaatccagtcccgtgggcaggtggcggttctgcatcaaccagactattaggaaccgcgaaactcagagtcctccaagcctgcagcattccatgagcgctgtgcccggaaggcatcccctgccttctccaaagaataccagcaacaaggaaatttcccgcgataccctgttgaccatcgagaacaacccctgtcacagagccctctttacaagtaaatccgagcacaaagatgtggtagacgggaaaatctcagaatgcgcgagcgtcgaaacaaaacaacctgccattctctaccaagtggaggataatcgtcaaattatggcccctgttacaaattctagtagttattccactaccagcgtgcgggcagtaccagccgaatgcgagggactcacaaagcaggctagcatctttattcccgtttacccgtgtcaccaaacggcctcccaggctgacgcactcatgagccaccctggggagagcactcagacgagtggaaatagcctcacaacactcgcctttgaccagaaaccgcagaccctgagcgtgcagcagccagcgatggacgcagaatttatttcccaggaaggggagaccaccgtcaacactgaggcctcttcaccaaaaacagttatcccaactcagacacccggtcttgaacccacaacgctacagcctactacagttcttgagagcgatggagagagacccccaaaactcgagtttgctgacaatcgaatcaaaactttggacgagaaacttcgaaatctcctataccaggagcactccatttcctcaatataccccgagagtcagaaggacacccagtcgattgactcgcccttctcctccagcgctgaagatacgctgtcgtgccccgtcactgaagttattgctatttcccactgtggcattaaggattcccccgtccagagccccaatttccaacaaaccggcagcaaacttttatcaaatgtggcggcaagccaacccgctaacatttctgtgttcaagcgcgacctcaacgtgatcacaagtgtccccagtgaactgtgccttcacgagatgtcaagtgatgcaagccttccgggtgatcccgaggcctaccccgcagcagtctccagtgggggagcaatccacctccagactggcggtggttatttcggtctttccttcacatgcccctccttgaaaaacccgatcagtaaaaaaagctggactcggaagctgaaaagctgggcctacaggcttcgccagagcactagcttctttaaacgctctaaggtgcgccaggtggagacagaggaaatgaggagtgctatcgctcctgaccccattccacttactagggagagcaccgccgacacacgtgcactgaatagatgtaaggccatgtctgggagctttcagagggggagattccaggtgattaccatcccacaacagcagtctgctaagatgaccagcttcggcatagagcacatctcagtgttttctgagacaaatcattcatctgaggaggcatttatcaagaccgctaagtcacagctggttgaaattgaaccggctacccagaacccaaagaccagcttcagctacgagaagctacaggcacttcaagagacgtgcaaggagaacaagggagtgcccaagcaaggggacaatttcttgagttttagtgctgcctgtgagactgatgtttcctccgtgaccccagaaaaggagtttgaggagacgtccgccaccgggtcatctatgcagagcggctccgagctcctacttaaagagcgggaaatcttaacagcaggaaaacagccttcatccgactctgagtttagcgctagcctagcagggtcggggaagagtgtcgcaaaaactggtcccgaaagcaaccagtgcctaccccatcacgaagagcaggcatatgcccagacccagagttcactcttctactccccatccagcccaatgagttcagacgacgaatcagaaatagaggacgaggacctcaaagtcgagctgcagcgcctgcgcgaaaagcatattcaggaagtggtgaacctccaaacccaacaaaacaaggagctgcaggagctgtacgaacggttaaggtctattaaggacagcaagacgcagagcactgaaattcctctgcctcctgcctctcctcgacgaccaaggagcttcaagagcaagctgaggtcaagaccccagtctcttacccacgtggacaatggtatcgtcgccactggaaaatcttgcctgatcaatgaactggagaatccgctgtgcgtggaaagtaatgctgcgtcatgtcagcagtcccccgcaagtaagaaaggaatgtttaccgacgacttacataagctggtggatgactggactaaggaagcagtgggtaattcgctcatcaagccatccttaaaccaactgaaacagtcccagcacaagctcgaaacagaaaattggaacaaggtctctgaaaataccccgagtaccatgggctacaccagtacctggatcagctccctctcccagatccgtggagcggtccctacaagcttgccccagggtctgagcctgccctcttttccaggacccctctcgtcgtacgggatgccacatgtgtgtcagtacaatgcagtggccggagctgggtacccagtccagtgggttggaatctcaggcacaacgcaacaatccgtagtaattccggctcagagcggcggtcctttccagcctgggatgaatatgcaggctttccccactagttctgtgcagaacccggctacaattccccctggtccgaaata

SEQ ID NO: 246908 - DNA, 5402 bp, Artificial Sequence
  Description of Artificial Sequence: Synthetic coding sequence
atggccaccgactccggcgaccccgcaagcacagaggactccgaaaaacccgacgggatcagcttcgaaaatcgagttccacaggtggccgcaacactcaccgtcgaggctcggctcaaagagaaaaattctacattttccgctagtggggagactgttgaacgcaagcggttcttccgaaaatccgtggagatgacagaggacgacaaagtcgctgaatcctctcccaaagatgagcggattaaggccgctatgaacataccaagagtggataagctaccgtcgaatgtattaagggggggtcaggaagtgaagtatgagcagtgctcaaagtccacaagtgagattagcaaagattgttttaaggaaaaaaacgagaaagaaatggaagaggaggcggagatgaaagctgtggccacgtcgcctagcggacggttcctaaaattcgacattgagttgggtcgcggagctttcaaaactgtgtacaaaggacttgacacagagacttgggtggaggtggcctggtgtgaattacaggatcgaaaattaactaaagcggaacaacagaggttcaaggaagaggccgaaatgctgaaaggcctccaacacccaaacatagttaggttctatgactcttgggagagtatattgaaagggaagaagtgcatcgtgctggtgactgagctcatgacctccggtaccttaaagacatacttgaaacgcttcaaggtgatgaagccaaaagttctgagatcttggtgtaggcagatcctgaaaggactgcagttcctgcacacaaggactccccctattatccatagggacctcaagtgtgataacatttttattaccggccctacagggtccgtgaagattggggacctgggtctggcaacacttatgcgcacatcctttgccaagagcgtgatcggaacccccgagttcatggcacccgaaatgtacgaggagcattatgatgaatctgtggatgtctacgctttcgggatgtgcatgctagagatggctacctccgagtatccctattctgagtgtcagaacgctgcacagatctacaggaaagttaccagtggaatcaaacctgcgtcctttaataaggtgactgatccagaagtgaaggagatcattgagggctgtattcgacaaaacaaaagcgaacgcctaagcattcgggacttgctcaaccatgccttttttgccgaagataccggattaagggttgaattagcggaggaggacgactgtagcaactcctcgttggccttgagactatgggtggaggaccccaagaagctcaagggtaaacataaggataatgaggccatcgagtttagttttaacctcgagacagacactcctgaagaggtggcatatgagatggtcaagagcggctttttccatgagagcgactcaaaggcggttgccaaatcaattagggacagggtaacacccatcaagaaaacccgcgagaagaaacccgctggatgcttagaggagagaagagattcccaatgcaaatccatggggaacgtgttccctcaaccacaaaatactactctgccactcgcaccagcccagcagaccggcgctgagtgtgaagagacagaagtcgaccagcatgtgcgacagcagctccttcaacgtaagccccagcagcattgttccagcgtcaccggagacaatcttagcgaggctggtgccgcaagcgtaatacatagcgacacaagttcgcagccttccgttgcttactcgtccaaccaaacaatgggatcacagatggtgtccaatatccctcaggcagaggtgaatgtgcccggacagatatactccagccagcaactggtaggacattatcagcaggtcagtggcctccagaaacacagcaagttaacccaaccacagattcttccactggtgcaagggcaatctaccgtgctacctgtgcatgtgttggggccaactgtggtgtcacagccccaggtgagcccactcactgttcagaaggtgccgcagatcaaacccgtgagccagcctgtgggcgcagagcagcaggctgctctgctcaagcccgatctggtgaggtcgttgaatcaggatgtggccaccaccaaggaaaatgtctcctcacccgacaacccttctgggaatggaaaacaagatagaattaagcagcggagagcaagctgcccacggcctgagaaggggactaagttccagctgacagtactccaagtgagtacaagtggggacaacatggtggaatgtcagcttgaaacacacaacaacaaaatggtcaccttcaagttcgacgtggatggcgatgcacccgaagatattgctgactacatggtagaggacaacttcgtgctagagagtgagaaggagaagttcgtcgaagaactgcgcgctattgtcgggcaagctcaggagatcctacatgtgcactttgcaactgagcgagcgactggagtggactccatcaccgtggattccaacagtagccagactggctcttcagaacaggtacagatcaattctaccagcacgcagacttctaacgaaagtgccccacagtcttcaccggtgggcagatggcggttttgtattaatcagaccattcggaatagagaaacacagagcccaccttctctgcaacattcaatgtccgcggtaccagggcgacaccccctcccttccccgaagaacacctcgaacaaagagataagccgtgacaccctcttgaccatcgaaaataacccctgccacagagccctgtttacgtcaaagagtgagcacaaggacgtggttgacggcaagataagtgaatgtgccagcgtggagacaaaacagcctgctatcctctatcaagtcgaagataatcgacagattatggccccagttacgaactcaagcagctacagcaccacgtcagtcagggccgttcctgccgagtgtgagggactgaccaagcaggctagcatattcatccctgtgtacccctgtcatcaaacagctagccaggcggacgccctaatgtcccacccgggtgagtcgactcagacgtcaggcaattcactgaccacgctcgctttcgaccagaaaccccagaccctctccgtgcagcagccagccatggacgccgaatttatctcgcaggaaggcgagacgaccgtgaacaccgaggcttctagccccaagacggtgatcccaacacagactccaggcttggaaccgacaacactacagcccaccactgtgttagaatcagacggtgaaagacctcccaagctggagttcgcggacaatcgcatcaagactttggatgaaaagttgcgcaatctgctctaccaggagcacagcatctcctcaatttatccggagagtcagaaagacacccagtccatcgacagcccttttagctcgagcgctgaagacactctttcatgccctgtcactgaggtgatcgcgatcagtcattgtggtatcaaagacagcccggtacagtcaccaaatttccagcagacaggcagcaagttgctcagcaatgtcgccgctagccagcccgcaaatatttctgtgtttaagagggacctgaacgtaatcacatctgtgccctccgagttgtgcttgcatgaaatgtccagcgacgcaagtttgccaggagacccagaagcctatccagcagccgtgtcctcaggtggcgcaatccacttacaaactggtgggggatattttgggctctcgtttacctgcccctccctcaagaaccccatctcaaagaagagctggacacggaagcttaagagttgggcataccgtctccggcagagtacaagcttttttaagcgttctaaagtgaggcaggtggagaccgaagagatgcggtcagccatcgcccctgaccctataccgttaaccagagagtccacagccgacactcgggcactcaaccgctgtaaggcgatgtcaggatcatttcagcggggacggtttcaggtgatcacgatccctcaacagcaatcagcaaagatgacttcatttggtatcgaacacatctctgttttctcagaaaccaatcactcttccgaggaagcttttattaaaacagcaaaatctcagctagtggaaattgaaccggctacccaaaatccaaaaacatccttcagttatgaaaaacttcaagctttgcaggagacgtgcaaagagaacaaaggggtgccgaagcagggcgataactttctgtctttcagcgccgcatgcgagacagacgtcagctctgttaccccggagaaagagttcgaagagacctccgcgacggggagcagcatgcaatcgggctctgagctgcttttaaaagagagggagatcctgactgctggcaagcagcccagctctgattccgaattctcagccagtctggctggatccggtaagtcagtggctaagacaggacctgaatccaatcagtgtttgccccaccatgaggagcaggcctacgctcaaacacagagcagccttttttacagcccttcctcccctatgtcatctgacgacgagagcgagattgaagacgaggacttaaaagtggaactccagaggctgcgagagaagcatatacaagaggttgttaatctgcagacccagcagaacaaagagctccaggaactgtacgagaggctgagaagcataaaggattctaaaacccagtctactgagatacccttaccaccagcaagccctcgcaggcccagatccttcaagagcaaattgaggagcaggcctcagtctctgactcatgtggataacggaattgtcgcaaccggcaaatcttgcctcattaacgaactggaaaaccctctgtgcgtcgagtcaaatgctgcaagttgccagcaaagcccagcctcaaaaaagggtatgtttactgacgaccttcataaactggttgatgactggacaaaagaggccgtgggaaattctctgatcaagccctctttaaaccaactgaagcagtcacaacataagttagaaacagagaactggaacaaggtgtccgaaaacacaccatctactatggggtatacctctacctggatttcatcattatctcaaatccggggtgccgttccaactagccttccccaggggctgagcttgccctcttttcctgggccactgtccagctatggtatgcctcatgtgtgtcagtacaacgcagtagcaggtgcaggctaccccgtccagtgggtaggcatttcggggacaactcaacagtccgtcgtgatcccagcccagtccggaggcccttttcagcctggaatgaacatgcaggcctttccaactagcagcgtccagaatccggctacgattcccccaggccctaagta

SEQ ID NO: 246909 - DNA, 5231 bp, Artificial Sequence
  Description of Artificial Sequence: Synthetic coding sequence
atggccacagacagcggggaccccgcatctactgaggactctgaaaaacctgacggcatctccttcgagaatagagtgccccaagtggccgctacactaacagtcgaggcgcgactgaaagaaaaaaattcaacattctccgctagtggcgaaaccgtggagcgaaagcgattcttccgaaagagcgtggaaatgaccgaggacgacaaggtagcagaaagcagtcccaaagatgagcgtatcaaggccgctatgaatatccccagagtcgataagctgccatcgaacgtgttgcggggaggccaggaggtgaaatatgagcaatgttcgaaaagcacgtccgagatctcaaaggattgctttaaggagaaaaatgagaaagagatggaagaggaggctgagatgaaggccgtggctacgtctccgagtgggagattcctgaagtttgacatcgaactcggcagaggcgcttttaaaaccgtctacaaaggcttggacacagaaacatgggtcgaggtggcatggtgcgagttacaggatcggaagttgactaaggcggaacagcagagatttaaggaagaagctgaaatgctcaaaggactgcaacaccctaatatcgtgcgattttatgattcttgggagagcatactgaagggaaagaagtgcatcgtcctcgtgactgaactgatgacttctggtaccctcaagacctacctaaaacgcttcaaggtgatgaaaccgaaggtcttgagaagttggtgtaggcagatactaaaggggctacagtttcttcacacccgtacccccccaatcattcatcgggacttgaagtgtgacaacatatttattaccggcccaaccggtagtgtcaagattggagacctaggattggccaccctaatgaggacatcattcgccaagagtgtaataggcacacccgaatttatggccccagagatgtatgaggaacattatgacgaatctgttgatgtctatgcctttggcatgtgtatgctagagatggccaccagcgagtatccttactcagaatgccagaatgcggctcaaatttaccgaaaggtaacgtcaggcataaaaccagcttccttcaacaaagtgacagaccctgaagtgaaggagatcatagaaggatgtatccgtcaaaacaagagcgagagactgagcatccgtgatctcttgaatcacgccttttttgccgaagatactggactccgtgtcgagttggctgaggaggacgattgttcaaatagcagtttggcgctgcgcctctgggtggaagaccctaagaagcttaagggcaaacacaaagataacgaggcaatcgaattctctttcaaccttgagaccgacacgccggaagaagtggcctacgaaatggtgaagtctggctttttccatgagagtgattcaaaggctgttgccaaatctattcgcgaccgggttacacctatcaagaaaaccagggaaaagaagccggcaggttgcctcgaagaacggcgtgacagtcagtgcaagagcatgggcaacgtattcccacagccacaaaatactacactccctttagctcctgcccaacagacgggggcagagtgcgaggagaccgaggtcgaccagcacgtgcggcagcagctgctacaacgaaagcctcagcagcactgctccagcgtgacgggcgataacctttccgaagccggagcagcaagtgtcatccactccgacacgtctagccaaccatcagttgcatactcgagcaaccaaaccatgggctcacagatggtgagtaacataccacaggctgaggtaaacgtgccagggcagatttactccagtcagcagctggttgggcactaccagcaggtttccggtctccaaaaacactcaaaactgacacaaccccagatattgccacttgttcaagggcagagcactgttttgccagtgcacgttctcggcccaaccgtggtctctcagccacaagtgtcccccctgacagttcagaaagtgcctcagatcaaaccagtgagtcagccggtgggcgctgagcagcaggcagccctgctgaaaccagatctcgttcgttctctcaatcaggacgtagctacaactaaggaaaacgtgtccagtccagataatccaagtggtaatgggaaacaggaccgtattaaacagagacgggcatcctgtccacgacccgagaaggggaccaaattccagctgacagtcttacaggtgagcacaagtggtgataacatggtggaatgccagctcgagactcacaacaataaaatggtgacatttaaattcgacgtggacggtgatgcccctgaagacattgcagactacatggtggaggataattttgtcctcgagagcgagaaggaaaaatttgtcgaggaacttcgggcaatcgtcggacaggcccaggagatcctgcatgttcacttcgccaccgagcgggctacaggcgtcgactctatcacagtcgattcaaatagcagccagaccgggtccagcgagcaggtccaaattaattccacctcgacccagacctccaacgagagtgccccacagagctcccctgttggcagatggagattctgcattaaccaaacaattcggaaccgggaaacccagtcccccccttccctgcagcacagtatgtccgctgtacctggccgacaccctttaccatcaccaaaaaatacatccaataaggaaatctctagagataccctgctgacgattgagaacaatccctgtcatcgtgctctgttcacgtcaaagagtgagcataaggatgtggtggacgggaaaatcagcgagtgtgcatcagtcgagactaagcagcccgcaattttgtatcaggttgaggataaccgccagatcatggcacccgtgacaaatagtagctcttatagcacaacaagcgtgagggcagttcctgccgagtgtgagggactcacaaagcaagccagtatattcatccccgtgtatccctgtcaccagaccgcctctcaagccgacgccctcatgtcacacccaggcgagagcacacagacctccggcaattccctgaccactctggccttcgatcagaaacctcaaaccctctccgttcagcagccagcgatggacgccgagttcatcagtcaggagggagagaccactgtcaatactgaggcctctagcccaaagactgtgattcccacccagaccccaggacttgaacccaccacccttcagcctactacagtgttggaatctgatggcgagcggccaccaaaactggagttcgccgataataggatcaagacgctggatgaaaaactccggaacctcctgtatcaggagcattctatatcatctatctatcctgaatcacagaaggacactcagtccatcgatagccctttctcaagcagtgccgaggatactctgtcttgtcccgtcacagaggtgattgcaatctctcactgcgggataaaagattcgcccgtccagtccccaaacttccagcagactggctccaaattgttgtccaatgtggctgcctcacagcccgctaacatctccgtcttcaagcgcgatctgaacgtgattacttccgtacccagtgaactctgcctgcatgagatgtcaagtgacgccagccttccaggtgacccagaagcatacccagccgcagtctcatctgggggagcaatccacctgcagacaggcgtcgagacagaagaaatgaggtcagcaatcgctcccgacccaatacctctcaccagagaaagcaccgccgacacgcgcgctctgaatagatgcaaggccatgagcggtagctttcagcggggaagatttcaagttataaccattccccagcagcagagcgcaaaaatgactagcttcgggatcgaacacatttctgtctttagtgagacaaaccattcatccgaggaggcctttatcaagacggccaaatcccaactcgttgaaatcgagcccgcaactcagaatcccaagacatctttctcttacgaaaagcttcaggctttacaggagacttgcaaggagaacaagggggttcccaaacagggggacaacttcctttcattctcagccgcttgcgaaaccgacgtgagcagcgtcacccctgaaaaggaattcgaagagacatctgcaacaggatcctccatgcagtctggcagcgaactgttacttaaagaacgggagatcctgacggcaggaaagcagccatcttccgacagcgaatttagcgcttccttggccggttccggaaagtctgttgctaagacaggcccagaatctaaccagtgcctgccacatcatgaggaacaggcttacgcacaaacccagtcaagcctgttttacagcccatccagtcctatgagctcagatgatgagtctgaaatagaggatgaggatttgaaggtggagctgcagaggttgagagaaaagcacattcaagaagttgtgaaccttcaaacacagcagaataaggagctgcaggagctgtacgaacggctgcgatccatcaaggatagcaagacccagagtacagaaatccccctgcccccagcgtccccacgacgtccaagatcctttaagagcaagctgcgcagcagaccacaatccctgacgcatgtagataacggtatagtcgccaccgaccccctgtgtgtggagtccaacgccgcatcctgtcagcaatccccagcaagtaagaaaggaatgtttacggacgatttgcataaattagtggacgactggactaaggaggcagtgggaaactccctcataaagccgagtctcaatcagctcaagcagagccaacataagctcgagacagagaactggaataaagtcagcgaaaatactcccagcaccatgggctataccagcacctggatctcttcactctcacaaatcagaggcgctgtgcccactagcttaccccagggactgagtcttccttcctttcccggtcccctgagcagctatggcatgccacacgtatgtcagtacaatgccgtggctggagctggttaccctgtgcagtgggtgggaatctcaggtacaacccagcagtctgttgtgatacctgctcagtccggtgggccatttcaacccggtatgaatatgcaagccttccctacgagttccgtgcagaacccagccaccattccgccagggccaaaata

SEQ ID NO: 246910 - DNA, 498 bp, Artificial Sequence
  Description of Artificial Sequence: Synthetic coding sequence
atggctacagacagtggcgacccggcatctacagaggacagcgaaaagcccgatgggatatccttcgaaaaccgagtgccacaggtggccgcaaccttgactgtggaagccagactcaaagagaaaaacagcacgttctctgcaagtggagaaaccgtggagagaaaacgattcttccggaagtccgtggagatgacagaagacgataaggttgcggaaagtagtccgaaagacgaacgcattaaggctgccatgaatatccctagggtcgacaagcttccaagcaacgtgctacgcggtggacaagaagtgaagtatgaacagtgctccaaatctacatctgaaatcagcaaggattgctttaaggagaagaatgagaaagagatggaagaggaggccgagatgaaagccgtggccacgtcaccctctggcaggttcctaaagttcgatatcgaattgggcagaggagccttcaagaccgtgtacaagggcctatag

SEQ ID NO: 246911 - DNA, 3732 bp, Artificial Sequence
  Description of Artificial Sequence: Synthetic coding sequence
atgctcgcgtcccctgccacagagacaacggtcctgatgtcccagaccgaagctgatctggctctacgacctccccctcccttgggaacggccggtcagcctcgtctaggccctcctcccaggcgtgcccgtcggttttctggtaaggccgagcctaggccacgcagttcacgcctgagccggcgatcaagcgttgatctgggactgctttcttcctggtccttgcctgctagtcctgcccctgacccccctgacccacccgactcggcaggcccaggaccggctaggtctcccccaccctcgagcaaggagcccccagaaggaacatggactgagggtgcaccagttaaggcagctgaggactcagctcgccctgaactgccagatagcgccgttggccctggatctcgagagccgcttcgggtgcccgaggcagtggctctcgagaggcggagggagcaggaagagaaggaagatatggaaacacaggctgttgctacatcaccagatggtagatacctgaagtttgatattgagatcggcagggggtccttcaaaacagtgtatcggggactggataccgatactactgtggaggtggcgtggtgcgagctgcaaacacgaaaattaagccgagccgagcggcaaaggttcagcgaagaagtggagatgctcaagggcctgcagcatcctaatatcgtgaggttttatgacagctggaaatctgtgctgaggggacaggtctgcatagtactcgtaactgaactcatgactagcggaacattgaagacatacctccgcaggttcagagagatgaaaccaagggttctacagcgatggtccagacaaatcctcagaggcctccatttcttacactctagagtgcccccaatcctgcaccgtgatctgaagtgtgacaacgtttttataacagggccaaccggttccgtaaagattggcgacctggggctcgctacgctgaagcgggcttcatttgccaaatcagtaatcggtacccctgaattcatggctccagagatgtacgaagagaagtatgatgaagctgtggatgtctacgcatttgggatgtgcatgctggagatggccaccagcgagtacccttactctgagtgccaaaatgcagcacagatctacaggaaagttacctccgggcgaaaacctaattcattccacaaggttaagatccccgaggtaaaagaaattattgaaggctgcatcagaaccgacaagaacgaacgcttcactattcaggatctcctggcacatgcattcttcagggaagaacggggtgttcacgtggaactcgccgaggaagatgacggagagaagccaggccttaagctgtggctccggatggaggacgctagaaggggagggcgtccgagggacaaccaggctattgaatttctcttccagctaggcagggatgcggctgaggaagtggcccaagaaatggttgccctggggctcgtatgcgaagctgactaccagcctgtcgcccgagcagtgcgcgagagagtggccgctattcaacgaaagcgcgagaaactgaggaaggccagagagctggaagccctcccccctgagccgggtccccctccagctaccgtgcccatggccccaggtccacctagcgtattccctccggaacccgaggagcccgaggccgatcagcaccagccctttctgttcagacatgcctcctattctagcaccacctctgattgtgaaaccgatggctatctttcatcatcaggcttcttggatgcgagcgaccctgccctacagccccctggcggtgttccgagttcattggcagaatcccacttgtgtttaccaagcgctttcgctttgtcgataccaagatccgggccaggttcggatttttcacccggtgatagttatgcatctgacgctgcttccgggctgagtgatgtcggagaaggaatgggtcaaatgagacgacctccaggacgtaacctccgacggcgacccaggagccgcctgcgggtaacgtcagtaagtgaccaaaacgaccgtgtcgtcgagtgtcagctccagacccacaattccaagatggtcactttcaggtttgatctcgacggggattcaccagaggagatcgccgctgctatggtctataacgaatttatactgcctagcgagagagacgggttcctgagaaggatccgagaaatcatccagcgggtggagacacttctaaagcgggataccgggccaatggaggctgccgaggacacgctgtccccccaggaggaaccagcgccacttcctgccctccccgtgcctcttccagacccttccaatgaggaactccaatcttctacttctcttgagcacagatcatggaccgcattctcgacatcttcttcatctccgggtaccccccttagtccgggtaaccctttctcacccggaacgcctataagccccggaccaatcttccccattacgtcaccgccatgccatccttctcctagtccgtttagcccaatctcttcacaagttagttctaacccgtctccccatcccacctcttcacctcttcctttcagtagctccaccccggaatttccggtgccacttagccagtgtccttggtcgtccttaccgacgacatcacccccaacattctctccaacttgctcgcaggtgacccttagctctccattctttccgccatgtccctcaacatccagctttccgtcaacgaccgccgcacccctcctgtcgctggcctcagctttttccttggcagttatgactgtagcgcagtctttgctgagtccatcaccaggcctgctgagtcagagtccacctgcccctccctctcctctcccctcgctgccactgccaccgcctgttgctccagggggacaggagagtccctctccacataccgctgaggtggagagcgaggccagtccaccgccagcgagacctttgccaggagaggcccgacttgctcccatttcagaggaaggcaaaccccaactcgtgggcaggtttcaggtcactagcagtaaagagcccgctgaacccctgccacttcagcccacctctccgactctgtctgggtctccaaagccgtctacaccacagttgacttccgagtctagcgatactgaagattccgcagggggtggccctgaaacccgggaggcgctcgccgaaagcgaccgggcagcagaaggcttgggcgcaggggttgaggaggaaggcgatgacggcaaagagccccaggtcggcggaagcccccaacccttgtcccacccatcaccagtttggatgaactacagctatagtagtctgtgtctgtcctcagaagagagcgagtcgagcggagaggatgaggagttctgggccgagctgcagtccctcaggcaaaagcacctcagcgaggtcgaaacactgcagacactgcaaaaaaaagaaatcgaagacctttacagtcggctcggcaaacagccccctccagggatcgtggccccagccgctatgctgtcgagcagacaacggaggctgtccaaaggctcatttccaacatctcgacgaaactctttgcagagaagtgagcccccagggcctggaatcatgagacgcaacagcctgtcaggtagctccactgggagtcaggagcagcgggcatccaagggcgttacctttgcaggagacgtcggacgaatgtag

SEQ ID NO: 246912 - DNA, 1992 bp, Artificial Sequence
  Description of Artificial Sequence: Synthetic coding sequence
atgagacgacgacaacagggcgcagctgggggtaacttccctgtgggaggctcctttcccgaggacgtgtcaccacaccaagattctggttatgctcccagtcctcgatatctcagaagatttcgtgaaatgaagccaagggtgctccagcgctggtctagacagattctgagagggctgcatttcttgcacagtcgagtaccccctatccttcatcgcgatctgaaatgtgacaatgtttttatcaccggcccaaccggcagtgtgaaaatcggcgacttgggcttagccaccttgaagcgtgccagctttgcaaagagcgtcatcggaacaccagagtttatggcgcctgagatgtacgaggaaaagtatgacgaggcagtggacgtctacgccttcggaatgtgtatgctggaaatggctactagcgaatacccctattccgaatgccaaaacgccgctcagatctaccgtaaggtaactagcggacgaaagcctaacagctttcataaggtaaaaattccggaggtcaaagagattatcgaggggtgtatcaggaccgataaaaatgaacgctttacaatacaggacttgctcgctcacgcattttttcgagaggagaggggtgtgcacgtcgagcttgcggaggaggacgatggcgaaaaaccgggtttgaagctgtggctgcgaatggaagacgcccgtcgagggggacgtccaagagacaatcaggctatagagttcttgtttcagcttgggcgagatgcagccgaggaggtcgctcaggaaatggtggctctgggcctcgtctgcgaagcggattaccaacccgtagccagagccgtaagagaacgtgtggcagcaattcagaggaaacgggaaaaattgagaaaagcccgagagctcgaggctctgccccctgagcccggtcctcctcccgctacggtgcccatggccccaggtccacctagcgtattcccaccggaacctgaggaacccgaggccgaccagcaccaaccatttttgttccgacacgcttcatatagctccaccacttccgactgtgagacggatgggtatttatcaagctccgggttcctagacgcatctgatccagccttgcagccccctggtggcgttccctccagcttggcggagtcccatctctgtctcccaagcgccttcgctctctccatcccacgctccggacctggcagtgatttttcccctggggacagctatgcgtctgacgctgcatcaggattgagcgatgttggcgaaggcatgggccagatgagacgaccgcctgggcgtaaccttcggaggcggccaagatccagacttagggtcacatctgtatcggaccagaacgaccgggtagttgagtgccagttacagacccacaacagcaaaatggtcacatttcgattcgacctggatggagactctccagaagagatcgccgctgccatggtgtataatgagttcattttgccctcagagcgcgacggcttcctgagaagaatccgggaaatcattcagcgcgtagagactctcctcaagagagacactggtcctatggaagccgcagaagatactctgagcccccaggaagaacccgctccgctcccggctctgcccgtgcccctgccagacccttccaatgaggaactgcagtcctccacatcacttgagcatcggagttggacagcattttcaacatccagcagctcccccggaacacctctatccccagggaatcccttttcacccggtacccccatatcgcccggaccaatagcgctgcaacgagagtcccggtctttcagtctacaaagggctcaaattcagcgcactgtgttggaagcaggtcagcggccagggaaactctggttaagggccactgtgcagcttagggtctgggggttggagctccgcagaaaggagatgatgggcagaaatcctaaactgggagctgcacctaacccctag

SEQ ID NO: 246913 - DNA, 471 bp, Artificial Sequence
  Description of Artificial Sequence: Synthetic coding sequence
atgggccaaatgagaagacccccaggccgaaatctgcggagacgcccaaggtcccggctgagagtgactagcgtttccgatcagaatgatcgagtcgtggaatgtcagctgcagacacataactccaaaatggtcacctttagatttgatcttgacggagactcgccagaggagatcgccgcagccatggtctataatgaattcattttgccttctgaaagagacgggtttctgcggaggataagagaaataattcagcgtgtcgagaccttgctgaagcgcgacacgggccctatggaggcagcggaggatacactgtctccacaggttcggccactggggggacatttccagggcaagtggaccttgtgctctagggtgtactatagcctaccctccgccgttcctctcgacctgaccccactgcacttgtgggatccaaaaacagtcgccctgttcttctttttctag

SEQ ID NO: 246914 - DNA, 894 bp, Artificial Sequence
  Description of Artificial Sequence: Synthetic coding sequence
atggctaaggtgtcagagctttatgatgtaacatgggaggaaatgagagacaagatgaggaagtggcgggaggagaattcgagaaactcagaacagattgtcgaggtgggggaggagttgattaatgagtacgcctccaagttgggagacgatatttggatcatctacgagcaggttatgatcgctgcactcgattacgggcgtgacgaccttgcactgttttgtctccaggagctgcgcaggcagttccccggttcccacagagtcaagcggctgaccggcatgcgctttgaagcgatggaacggtacgatgatgcgattcagctttatgatcggatcttgcaggaggaccctacaaatactgctgcacgcaaaagaaagatcgcaataagaaaggcacagggtaagaacgttgaggccatcagggagcttaatgaatacctggaacagtttgttggggatcaagaagcttggcacgagctggccgagctctatattaatgaacacgactacgcaaaagctgcattctgtctggaagagcttatgatgaccaatccgcataaccacctgtattgtcagcagtatgcagaggtcaagtatacccagggcggtctggaaaacctcgagctcagcaggaaatactttgctcaggcacttaaactgaacaatagaaatatgagggcactgtttggactgtatatgtctgcttctcatattgcatccaacccaaaagcgagtgcaaagactaagaaagacaacatgaaatatgctagctgggcggcatcacaaatcaatagggcctatcagttcgccggtagaagcaaaaaggagacaaagtactccctcaaagctgtggaggacatgctagaaacattgcagattactcagagctag

SEQ ID NO: 246915 - DNA, 1104 bp, Artificial Sequence
  Description of Artificial Sequence: Synthetic coding sequence
atgcgatggtttctcccctggaccctggctgctgtgacggctgctgccgcttccaccgtcttggctaccgccctgtcccccgctccaactactatggactttacccctgccccactggaggatacttcttcgagacctcagttctgtaaatggccatgcgagtgtcccccatccccaccgagatgtccactgggcgtgtccctgattaccgacggatgtgagtgctgcaaaatgtgtgcccaacagctgggtgacaattgtacggaggctgctatctgcgatccacatagggggctgtactgtgactacagtggggatagacctagatatgccatcggcgtttgtgcacaagtggttggtgttggttgtgtgttggacggcgtgcgatacaacaatggtcagtccttccaaccgaactgtaagtataattgcacctgtatagatggagccgtggggtgcaccccactgtgcctgcgggtacgaccacccaggctctggtgtcctcacccgagaagggtctccattcctggacactgttgtgaacaatgggtgtgtgaagacgatgctaagcgccctcgcaaaacggccccacgtgacactggagcattcgatgcggtgggtgaagtggaggcctggcatcgtaactgcatagcatataccagcccatggtccccgtgcagtacatcgtgtggtcttggggtgagcacaaggattagcaacgttaacgcccaatgctggccggagcaggagagccgcctctgcaacctgaggccctgcgatgtcgacatccatacgttaatcaaagcaggcaagaagtgcctcgcagtttaccaaccggaggcctcgatgaacttcacccttgccggatgcatatctactcggagctatcagccgaagtattgtggagtttgcatggacaatcggtgctgcatcccatacaaatccaagactatcgacgtgtctttccagtgccctgatggcctgggattctccaggcaggtcttatggatcaacgcgtgtttttgtaatttgtcatgtcggaaccccaatgacatctttgcggatctggaatcctaccctgatttcagcgagatcgccaattag

SEQ ID NO: 246916 - DNA, 588 bp, Artificial Sequence
  Description of Artificial Sequence: Synthetic coding sequence
atgcccgtccccctaacgagtagacatgaggtggtgccagcactcgatgctggctcttcagactcctcatcaaggcaacacagaccagggcacgacgcagtgggcgaggtcgaagcatggcacaggaactgcatcgcctatacaagcccatggagcccatgtagcacttcatgcggactgggagtttcaacaagaatctcaaacgttaacgctcagtgctggcccgaacaggaaagtagactgtgtaacctgagaccctgcgacgtggatatccacacactgataaaagctggtaagaaatgtctggctgtgtatcagcccgaggcgtctatgaacttcaccctggccggatgtatttccactcgcagttatcaaccaaagtattgtggagtatgtatggataatagatgctgtatcccctacaaatccaagacaatcgacgtgtccttccagtgtcctgacggattggggttctcacgtcaagtgctctggataaacgcttgcttctgcaacttgagctgtcggaaccctaacgatatattcgcagatttagagagctaccctgattttagtgagatcgccaattag

SEQ ID NO: 246917 - DNA, 468 bp, Artificial Sequence
  Description of Artificial Sequence: Synthetic coding sequence
atgaggtggtttctcccatggacgctggccgctgtaaccgcagccgcagcgagcacggttctggccaccgctctgtctccagctccaaccaccatggacttcactccagcgcctctagaggatacaagtagtcgaccccagttttgcaaatggccatgtgaatgccccccttcgccacctagatgcccgctgggcgtgtccttaatcacagatggatgcgaatgttgcaaaatgtgcgctcagcagctgggagacaactgtaccgaggccgctatctgcgaccctcaccgaggactgtactgcgattactctggcgacaggcctaggtatgcgatcggggtttgcgccaggagagaagaggtgtctggatgtgtgcccgcaagaggcattcacgaactccacacgtgtggactgcaccagcataccctcctgtcaacacaggttctttggtctcttcatggacagtag

SEQ ID NO: 246918 - DNA, 369 bp, Artificial Sequence
  Description of Artificial Sequence: Synthetic coding sequence
atgaggtggttcctaccgtggacacttgctgctgttactgctgcagcggcatcaacagtcctggccaccgcaggaaaaaagtgcttggcagtatatcagccagaagccagcatgaattttactctcgcaggctgcatttcaacaaggtcttaccaaccaaagtactgcggggtttgtatggataatcgctgctgcattccatacaagtccaagacgattgacgtttcatttcaatgtccagacgggctgggattcagtagacaggtactctggatcaatgcctgtttctgtaaccttagctgccgcaacccgaatgatatcttcgccgatcttgaaagctaccccgacttcagcgagattgctaactag

SEQ ID NO: 246919 - DNA, 753 bp, Artificial Sequence
  Description of Artificial Sequence: Synthetic coding sequence
atgcgtggcactcctaagactcatttacttgcctttagcttgctgtgtctgctgagcaaggtgagaacgcaactgtgcccaaccccctgcacttgtccttggccccctcctaggtgtcctctgggggtgcctctcgtgcttgatgggtgtgggtgctgcagagtatgcgcacgcagactgggtgagccctgcgatcaattgcacgtgtgcgacgcttcccagggcctggtctgccaacccggagctggccctggcggacggggagccttatgtctcttggccgaagacgactccagctgtgaggtgaacggcagattatatcgggagggcgaaacattccaaccccattgcagtatcaggtgtcgttgtgaagatggcggattcacttgtgtccccctgtgtagcgaggacgtgaggttgccgagttgggattgtccccatccccgacgggtcgaagtccttggcaagtgctgcccagagtgggtgtgcggccagggaggcggactggggacccagcctctccctgcacaggggccacaattttctggattagtgtcctcactgccccctggggtgccttgccccgagtggtcaactgcctgggggccatgctccactacttgcggactgggtatggctacgcgggtctcaaaccagaacaggttttgcaggctggagacccaacggcgattgtgtttgtctaggccttgtccaccgtcgcgtgggaggtctccacagaactctgccttctag

SEQ ID NO: 246920 - DNA, 657 bp, Artificial Sequence
  Description of Artificial Sequence: Synthetic coding sequence
atgcgtggtacccccaagacacatttgttggcatttagcctgctctgcctgctctccaaggttcgaacccagttatgtcccaccccgtgcacatgcccatggccccctcctaggtgcccccttggtgttcctttagtactggacggatgcggctgttgtcgtgtctgtgcaagaaggttgggggaaccgtgtgatcagctgcacgtctgcgacgcttcccaggggctggtgtgccaacccggagccggtccaggcggtaggggggcattatgcctttgtaagcaagatccttccttcctggccctttcactcccttgtccgttagtgtcccctgcacagaacggcgcacgccctggagatccagcacggcctcccgtgggatgggcttggccccctggctgccccacaagaaccgcctccgccgattggcgcccaagtgcagcttgtgcatgtccagggccagctcacccaccaggggttgctgtgcacaagacagttccttcacgagccggacttgggatgggcactagatgtccacccagtcctgctgggggacccgttccgggaccgtgggctgatggccgatggagcgttcctcgccctctggcagcgggaaatacattggcctgggtgcatcatgctgagcaccagtactag

SEQ ID NO: 246921 - DNA, 753 bp, Artificial Sequence
  Description of Artificial Sequence: Synthetic coding sequence
atgcggggtactccaaagactcacctgctggctttcagcttattgtgcttgctcagcaaggtgagaacacagctttgtccgaccccctgcacttgcccctggcctccgccacgatgtcctctcggagtgcctctcgtacttgacggatgtggatgctgtcgcgtttgcgcaagaaggctgggcgagccctgcgaccagcttcacgtgtgcgacgcaagtcagggtctggtctgtcagccgggagccggtcccggtggcagaggcgctctatgccttcttgcggaggatgacagctcctgtgaagttaacggcagactctatcgcgaaggcgagactttccaaccacattgctctatccgctgccgttgtgaggatggaggtttcacttgcgtacctctgtgctctgaagatgtgcgattgccgtcatgggattgcccgcatcctcgacgcgttgaagtgctcgggaagtgttgccccgagtgggtctgtggccagggcggtgggctgggcacacagccccttcccgctcagggaccacagttcagcgggctggtttcatctctccctccaggcgttccgtgtcctgaatggtctaccgcctggggtccgtgcagcacgacttgcgggctgggcatggcgactagagtttcaaatcagaatcgcttctgtcgtttagagacacagcggagattgtgtctcagccggccttgccctccatccagagggaggtccccacagaactctgccttttag

SEQ ID NO: 246922 - DNA, 2571 bp, Artificial Sequence
  Description of Artificial Sequence: Synthetic coding sequence
atggagagcgaagatttgagcggcagggagctgaccatagattcaatcatgaacaaagtgagggacatcaaaaataagttcaaaaacgaagacctgacagacgaactgtccttaaacaaaatttcagcggacacaaccgacaacagcgggactgtgaaccaaataatgatgatggcgaacaaccccgaggactggctatccctgcttctcaagctcgaaaagaactccgttcccttgtctgacgccttattgaataaacttattggccgatatagtcaggccatcgaagcactgccccctgacaagtatggccagaacgaatccttcgctcgtatacaggttcgcttcgcagaactgaaggccattcaggaacccgacgacgctcgggattactttcagatggcgcgtgctaattgtaagaagttcgccttcgtgcatatatcatttgctcagtttgaactgtcacaggggaacgttaaaaagagcaagcagctactacagaaagcggtcgagcggggtgctgtacctctcgagatgctcgaaatcgccctgaggaacctgaacttacagaagaaacagctgcttagcgaggaggagaaaaaaaacctcagcgccagcacagtgctcaccgctcaggagagtttttcaggttccttgggacatctccagaaccggaacaattcctgtgactcgcggggacaaactaccaaagcacgatttttatatggcgaaaacatgccaccccaagacgctgaaatagggtatcgtaattccctgaggcagacaaacaagacgaagcagtcatgcccctttggcagggtcccggtgaatctgttgaactcacccgattgcgatgtcaagacagacgatagcgtggttccctgttttatgaagcggcagaccagccgcagcgagtgcagggatctggtggtccccggttccaagccctctggaaatgacagctgtgagctccggaacctgaaaagcgtgcaaaacagccacttcaaagagcccctggtctccgatgaaaagtcctccgaactgattataacggatagcataactcttaagaataagacggaaagcagccttctagccaaactagaagagacgaaagaataccaagaacctgaggtacctgagtcaaaccagaaacagtggcaaagcaagagaaaatcggaatgtattaaccaaaaccccgcagccagctcaaaccattggcagatcccagaactggcacgaaaggtcaataccgagaagcatactacgttcgaacaacctgtcttcagtgtcagcaagcagagtccgcctatctccacaagcaagtggtttgaccccaaatccatatgcaaaactccaagttccaatacactcgacgattatatgtcctgttttcgaacgcccgtcgttaagaatgatttccccccagcctgtcagctgtccacaccatatgggcagcccgcttgttttcagcaacagcagcatcagatactcgctacccctctgcagaatctccaggttctagcttcaagtagcgccaacgaatgcatctccgtcaaaggacggatctatagcatcctgaagcagattgggagcgggggatcatctaaggtcttccaggtgcttaatgaaaagaagcaaatttacgcaattaaatacgtgaatctggaggaggcagacaaccagacgctggacagctatcgtaatgaaattgcctacttgaacaaattgcagcagcactccgacaaaattatcagattatacgactacgagatcactgatcagtatatttacatggttatggaatgcggcaacattgacttaaacagttggctgaaaaagaagaagagtatcgacccgtgggaacggaaaagttattggaagaatatgcttgaggccgtccacacgatccaccaacacgggattgtgcactcagatctgaagcccgctaactttcttattgttgatggcatgttgaaactaatcgactttggaatcgctaaccagatgcaacctgatactacgtccgttgtaaaagattcccaggtcgggactgtgaactacatgcctcccgaagctatcaaagacatgtcatctagccgcgagaatggtaagtcgaaatctaaaatctcccctaagagcgatgtgtggtcacttgggtgcattctgtattacatgacatatggaaaaactcctttccaacagatcattaaccagatcagcaaacttcacgcaataatagaccccaaccacgagattgaattccctgatatccctgaaaaggatctccaggatgttttgaagtgttgcctcaagcgagatccaaaacagcggatctcaatcccagaactgctggcacacccttacgttcagattcagacccacccagtgaaccagatggccaagggcactacagaggaaatgaagtatgttctcggccagctcgtgggcctgaattccccaaatagtattctgaaagcggctaaaaccctttatgagcattatagcgggggagaatcacacaactcaagttcctctaaaaccttcgagaagaagcgcggaaaaaagtag

SEQ ID NO: 246923 - DNA, 1119 bp, Artificial Sequence
  Description of Artificial Sequence: Synthetic coding sequence
atgaataagcgtaggctgttatacccgtctggatggctccatgggcctagcgatatgcagggactgctattttcaactctccttctggctgggctcgcccaattctgctgccgcgtgcaaggtacaggacctctggataccacacccgaggggaggccaggcgaggtttctgatgcaccccagcgcaaacagttctgtcattggccatgcaaatgtccccaacagaaaccacggtgcccaccaggcgtgagcctggttcgcgacggttgtggttgttgtaagatctgcgccaaacagccaggcgaaatttgtaatgaagccgacctttgcgacccacacaaggggctgtattgtgattactcggtcgatagacctcgctacgagaccggagtgtgtgcttatcttgttgctgtgggctgcgagttcaatcaggtgcattaccacaatgggcaggtgttccaaccaaaccccctgttttcatgcctctgtgtttcaggagccatcggatgtaccccactctttattcccaagctcgctggctcacactgcagtggcgctaaaggcggaaaaaagagcgatcagtccaactgcagcctggagcctttgctacagcaactgtcaacctcttacaaaacaatgccggcttatcgaaatcttcccctaatctggaagaagaaatgtctggtgcaggccactaaatggactccttgtagtcggacatgtggcatgggcatttccaatagagtgacaaatgaaaacagcaattgtgagatgaggaaagaaaagaggctctgttacatacagccctgcgattccaatatccttaagaccatcaaaatccccaaggggaaaacgtgtcaacccacttttcagcttagcaaggctgagaagtttgttttttccggctgctctagcacccagagttataaacccaccttctgtgggatatgcctggataaaagatgctgtatcccgaacaaaagtaagatgataactatacagttcgactgccccaacgaaggtagctttaagtggaaaatgctgtggatcacaagctgcgtctgtcagaggaactgtagggagcccggagacatcttcagtgaactgaagattttgtag

SEQ ID NO: 246924 - DNA, 996 bp, Artificial Sequence
  Description of Artificial Sequence: Synthetic coding sequence
atgaaaatcagccgcggacgcgtgtgtctggaatctgaaaataaagacgccggagtggcaggccgtaaacagttttgtcattggccttgtaaatgcccccagcaaaaacctagatgtccccctggcgtgagcctggtaagagatggatgcggatgttgtaaaatatgtgccaaacagcccggtgaaatctgtaatgaagctgacctgtgtgatccacacaaggggttgtactgtgattactcagtggaccgcccacgctacgagaccggagtctgtgcttgcaagtccgtgggctgtgaattcaaccaggttcactaccacaacggacaagtgttccagccgaatcctctgttcagctgtctgtgtgtctctggcgcaattggttgtacgccactctttatccccaagctcgcaggttcccactgttctggggcaaaaggcggtaagaaatcagaccagagcaattgctcactggagccgctcctccagcagcttagtactagctacaagacgatgcctgcataccggaatctgccactcatctggaaaaagaaatgcctggtccaagccactaagtggaccccctgtagcaggacctgcggtatgggcattagtaatcgggtgaccaatgagaatagtaactgcgagatgcgaaaggagaagcgtctatgctacatccagccttgtgacagtaacatcctgaagactatcaaaatacccaaggggaagacctgccaacctactttccagctgtctaaagccgaaaagttcgtgttctccggatgcagctcgacccagagctacaagcccacattctgtggcatttgcttagataaacgctgttgtataccaaataagtcaaagatgataacaattcagtttgattgccccaatgaaggatcgttcaaatggaagatgttatggattacctcttgtgtttgccagcgcaactgtagagaaccaggtgatatcttttcggagctgaaaattttatag

SEQ ID NO: 246925 - DNA, 1065 bp, Artificial Sequence
  Description of Artificial Sequence: Synthetic coding sequence
atgcaaggtctcctattctctacgttgctcctcgctggcctcgcacagttctgttgccgcgtgcaggggacaggacctctcgacactacacccgagggacgacccggtgaggtgtcagatgcccctcagaggaagcagttttgccattggccatgcaaatgtccacagcagaaacccagatgtcccccaggcgttagcttggtgagagatggttgcggctgctgtaaaatctgtgccaagcagcccggagaaatctgtaacgaagcggatctgtgtgatccacacaaagggctgtattgcgattattcagtggatcggccaagatacgagaccggtgtgtgcgcctatttggtggccgtggggtgtgagttcaatcaggtgcattaccataatggacaggtcttccagcctaaccctctattctcctgcctgtgtgtctcaggcgcaatcgggtgtacaccactctttatccctaaactggctggctctcattgctccggagcaaagggtggtaaaaagagcgaccagtcaaactgtagcctggaacccctactgcagcagctgtctacctcgtacaagaccatgccagcatatagaaatcttccgctgatctggaaaaaaaagtgcctcgtccaagccaccaaatggacgccctgctcaagaacatgtggtatgggcatctcaaaccgagtgaccaatgaaaacagcaactgtgaaatgcggaaggagaagagattatgttacattcagccctgcgatagtaacatccttaaaacaatcaaaatccctaaaggcaaaacctgtcagcccacctttcagttgtctaaagccgaaaaatttgtgttctcaggatgcagctctacacagagttacaagcccaccttctgcgggatctgcttggataagcgttgttgcatccccaacaagtctaaaatgatcaccattcagttcgattgccccaacgaaggcagctttaagtggaaaatgctgtggattacttcctgtgtgtgtcagcgcaactgtcgcgaaccgggtgacatcttttctgaactgaaaatcttatag

SEQ ID NO: 246926 - DNA, 693 bp, Artificial Sequence
  Description of Artificial Sequence: Synthetic coding sequence
atgcagggtctgctgtttagtacgttgctactcgccggactggcccagttttgttgccgagtccagggcactggcccattggatacaacacccgaagggaggcctggtgaggtgtccgatgcgccacagaggaagcagttctgccattggccatgcaagtgtcctcagcaaaagccccgttgtccccctggtgtaagcctggttagggatggttgcggttgttgtaaaatctgcgccaaacaaccgggtgaaatctgtaatgaggcggatctttgtgatccgcataaggggctgtattgcgattactctgttgacagacctagatacgagactggtgtgtgcgcttatctcgtcgctgttggctgcgaattcaaccaggtgcactatcacaacggccaggtcttccagcccaatccattattcagctgcttgtgtgtgtcaggagccattggatgcacacccttgtttattccgaagctggccggttcacactgtagtggggcaaaggggggaaaaaaatccgatcagtctaattgttcactggagcctttgctgcagcagctgtctacaagttacaagactatgccagcctacagaaatctgccactgatctggaaaaaaaacgtgttgtgtaaacaacagaatggcctgccagctccggaacatgtgggatgggagtacttgaccggctag

SEQ ID NO: 246927 - DNA, 393 bp, Artificial Sequence
  Description of Artificial Sequence: Synthetic coding sequence
atgggaattagcaaccgggtgaccaacgagaacagcaattgtgagatgaggaaagagaagcgcctctgctacatacagccgtgcgactctaatatccttaaaaccattaaaatccccaaaggaaaaacgtgccagcccacctttcaactgagtaaagctgagaagtttgtattctcaggctgcagttctactcaaagctataaaccaaccttctgcggaatctgcctggataaaaggtgctgtatccctaacaagagcaaaatgatcaccattcagttcgattgcccaaacgaagggagtttcaagtggaagatgttatggataacttcttgcgtgtgtcagcgtaactgtcgtgaacccggtgatatcttcagtgaactgaagattctgtag

SEQ ID NO: 246928 - DNA, 1626 bp, Artificial Sequence
  Description of Artificial Sequence: Synthetic coding sequence
atggctggcgcaattattgagaatatgagtactaaaaagttatgcatcgtgggtggcatactgcttgtatttcaaataatcgcattcttagtgggcggtctgatcgcccctggtccgacaacggccgtctcgtatatgtctgttaaatgtgtggatgccagaaagaatcaccacaagactaaatggtttgtgccttggggacctaatcactgtgataagatacgagatattgaggaagctattcctcgggaaattgaggctaacgatatcgtattcagcgtgcatataccactccctcacatggagatgtctccctggtttcagtttatgttgttcattttgcagctcgacattgccttcaaactgaataaccaaatccgcgaaaacgccgaggtgtctatggatgttagcctcgcgtacagggatgatgcgttcgcggagtggacggaaatggctcacgaaagagtcccgaggaagttaaaatgtactttcaccagcccaaaaacacccgaacatgaaggcagatactacgagtgtgacgtgctgccattcatggagattggctctgtggcacataaattctacttgctaaatatcaggctcccggtgaatgagaaaaaaaagattaacgtcggaatcggcgaaattaaggatattcgtcttgtggggatccaccagaatggtgggttcaccaaagtgtggtttgccatgaagaccttcctgactccaagcatattcattatcatggtgtggtactggcggaggattaccatgatgtctagaccccctgtgctgcttgagaaggtgattttcgcactgggaatttccatgaccttcattaacatccccgtcgagtggttcagcattgggttcgactggacctggatgctcctgttcggagacattcggcagggtatcttttatgccatgctcctttctttttggataattttttgtggcgagcatatgatggatcaacacgaaaggaaccacatcgccggatattggaagcaggtaggacccatagctgtcggcagtttctgcctgttcatcttcgatatgtgcgaaagaggagtccagttgacgaatccattctactcaatctggactactgacattggaactgagctggctatggcatttattatcgtggctggtatatgtctgtgcctgtacttcctgttcttgtgcttcatggtgttccaggttttccggaatatctcaggcaaacagagttctcttccagccatgtccaaggtcaggagactacattacgagggtctcatctttcgcttcaagttcctgatgctcattacactcgcttgtgccgcaatgactgtaatattctttatagtcagtcaagtcactgaggggcactggaagtggggcggagtgactgtccaggtgaactccgcattcttcactggcatatatggaatgtggaatctgtatgtgttcgccctaatgtttctgtatgctccttcccacaaaaattatggcgaggaccagtctaacggggatttaggcgtgcacagcggcgaagagctgcagctgacaaccaccattactcacgtagacgggccaaccgaaatttacaaactgactagaaaggaagctcaggagtag

SEQ ID NO: 246929 - DNA, 1632 bp, Artificial Sequence
  Description of Artificial Sequence: Synthetic coding sequence
atggcaggggctattattgaaaacatgagcacaaagaaactgtgcatcgtcggagggatcctgctggtctttcagatcatcgccttcttggtgggcggactgatagggcctactactgccgtgagctacatgagtgtgaaatgcgtggacgctaggaagaaccaccacaagaccaaatggttcgttccttggggcccaaaccattgtgataaaatcagggacatcgaagaggcgattccccgagagatagaggccaacgacattgtattcagcgtgcacatccccctaccccacatggaaatgagcccttggtttcagtttatgctctttatacttcagcttgatatcgcctttaagttaaacaatcagatccgggaaaatgcggaggtatcaatggacgtttctctcgcgtatcgtgacgatgcctttgccgaatggaccgaaatggcccacgagcgagtcccaagaaaactgaagtgcacctttacgtcacctaaaacacctgagcatgagggacggtactacgagtgcgatgtgctacccttcatggagatcggttcagtcgctcataagttttacctgctgaatatccgcctgccggtaaacgaaaaaaaaaaaattaacgtaggtattggagagatcaaggacatccggttagtaggcatccatcagaatggcggtttcaccaaggtgtggttcgccatgaagacatttctcacgccatcaatctttataatcatggtctggtattggcgtcggatcaccatgatgagtcgaccccctgtcctgctggagaaggtcatctttgccttggggatctcaatgacctttattaatatcccagtggagtggttctcgattggttttgattggacatggatgctgcttttcggggacatacggcaggggattttctatgcaatgctcctgagcttttggattatcttctgcggagaacacatgatggaccagcacgagaggaatcatattgccggttactggaagcaagtgggacctatcgcagtcggatccttctgcctttttatcttcgacatgtgcgaacggggagtccagttgaccaaccccttttactctatatggacaaccgatataggaacagagctggcaatggccttcatcattgttgccggaatatgtttgtgtctctattttctcttcctgtgttttatggtattccaggtgtttcgcaatatctccggtaagcaatcatcactccctgccatgtccaaggtcagaagattgcactacgagggcctgatttttagattcaaattcctgatgctgatcactctggcatgcgccgctatgaccgtgatcttctttatcgtctctcaagttactgagggacattggaagtggggcggagtcactgtacaggtgaactccgcattcttcacaggaatttacgggatgtggaatctatatgtctttgcactgatgtttctgtacgcaccctcccacaagaattatggggaggaccagtccaatggtatgcagctgccctgtaaatctcgggaggattgcgctctgtttgtttccgaactttatcaggagctcttctccgcatccaaatatagcttcatcaacgacaatgcggcttccggaatctag

SEQ ID NO: 246930 - DNA, 1353 bp, Artificial Sequence
  Description of Artificial Sequence: Synthetic coding sequence
atggccggagccatcatcgagaatatgagcaccaagaagctttgcattgtgggtggcattttgttggtgtttcagattatagccttcctagttggagggttgattggggaaaacgccgaggtcagtatggacgtgtctcttgcttaccgggacgatgcatttgccgaatggacagagatggcacatgagcgggtgcctagaaagttgaagtgcacattcacttctcccaaaacacccgaacacgaaggcaggtattacgagtgcgacgtactgcccttcatggaaatcgggtccgtggcccataaattttaccttcttaacatccgccttccagtaaatgaaaagaaaaagataaacgtcggcatcggggaaattaaggacattcggctggtgggtatccaccagaatgggggtttcacaaaggtgtggtttgcaatgaaaacgtttctgacaccatccatatttattatcatggtgtggtattggaggcgtattacaatgatgtcacggcctccagtgctgctagagaaagtcatatttgctctgggcatctcaatgacttttataaatatcccagtcgaatggttcagcattggcttcgattggacttggatgctgctcttcggcgatattaggcaggggatcttctacgctatgctcctctctttctggatcatattttgcggtgagcacatgatggaccagcacgagaggaatcatatcgcaggatactggaaacaggttggacctatcgccgtcgggtcattctgtctgtttatcttcgatatgtgcgagcgtggcgtgcaactgaccaatccattctactctatatggacgaccgacatcggcacagaactggcaatggccttcataattgtcgccggaatctgtctttgtctgtattttctcttcctgtgtttcatggtgttccaggtgttccgcaacatcagtggcaaacaatccagtctgcccgctatgtctaaagtgcggcgactgcattacgagggccttatattcaggttcaagttccttatgctgatcacgctagcgtgtgcggctatgaccgttatcttcttcattgtaagtcaggtgaccgaaggacactggaaatggggaggggtaacggtccaggtgaattcagccttcttcaccggcatatatgggatgtggaacctctacgtttttgccttgatgtttctgtatgctcccagccataagaattacggcgaggatcaaagcaatggcgacctcggagtgcatagtggggaagagttacagctcactacgacaatcacacacgtggatgggcctactgaaatctacaagttgacccggaaagaggcccaagaatag

SEQ ID NO: 246931 - DNA, 1638 bp, Artificial Sequence
  Description of Artificial Sequence: Synthetic coding sequence
atggccggagccatcatcgagaatatgtccacgaagaagctttgtatcgtgggcggaatcctcctggtgttccagattattgccttcctcgtgggcggtcttatcgccccaggaccaactacagccgtttcgtacatgtccgtaaagtgcgtcgatgccaggaagaaccaccacaaaaccaagtggtttgtgccttggggccctaatcactgcgacaagatccgggacatcgaggaagcaattccccgagagatagaggcaaacgacatcgtgttctccgtgcacatccctctgccccacatggaaatgagtccatggttccagttcatgctgttcatcctacagctggacattgcctttaagctgaataaccaaattcgggaaaacgctgaggtgtcaatggacgtctcactcgcttacagggacgacgcgttcgccgaatggacagagatggcccacgagcgggtccccagaaaacttaaatgcactttcacttccccaaagaccccagaacacgagggtcgctactacgaatgtgatgtccttccatttatggagatcggttcagttgctcacaaattctacctactgaacatcaggctaccagtgaacgagaaaaagaaaattaatgtgggaattggtgaaattaaagacatacggttggtgggaatccaccaaaacggcggattcaccaaggtgtggttcgcaatgaaaacattcctcactccctcaatcttcataatcatggtttggtattggcgtcgaattactatgatgtccagacccccagtactgctggagaaagtaatctttgctcttggcatttccatgaccttcataaatatcccagtcgaatggttctcaattggcttcgattggacctggatgctcttatttggggacatccgtcaaggaatcttctatgctatgctcctctcattctggataattttttgtggagagcacatgatggaccaacacgaacgcaaccatatcgcgggttactggaagcaggtaggtcccatcgccgtcggatccttttgcctctttattttcgatatgtgcgaacggggtgtgcaattgacaaatccgttctattcaatctggaccacagacattggaacggaacttgcaatggcgtttattattgtggcagggatctgcctgtgcctctacttcttgtttctgtgcttcatggtatttcaagtctttagaaatatcagcggcaagcagagcagtctgccagccatgagcaaagttcgcagactgcactatgaaggcctaatcttcagattcaaatttctgatgttgattactctagcctgtgctgcaatgaccgtcatattcttcatcgtttcccaggtgacagagggacattggaagtgggggggagtgactgtccaggtaaactccgctttctttaccggcatctatgggatgtggaacctttacgtgtttgccctcatgttcctttatgccccttcacacaagaactatggggaagatcaatccaatggcatgcagctaccatgtaagtctcgagaagattgtgcactgttcgtatccgaactgtaccaggaactgttctcagcctcaaagtatagctttattaatgacaacgccgcaagtggaatctag

SEQ ID NO: 246932 - DNA, 2142 bp, Artificial Sequence
  Description of Artificial Sequence: Synthetic coding sequence
atggcagggtccttttgctggcgcatgctgggtctcgtgagcaaggttgggaaccgggcaaggtgtttctcatcaatggcggcatcagaggaggaactgctggatttctctggtagtgaactgcagtttaattcttgttcccttcatcttagccttcatcctttctttaatttcctgttggggatccactcctgcttcgtttgtaaagagagtaagactgatgtaaaacgctgtgtggttacccagtgcggcaaattctatcacgaagcctgtgtgaaaaagtacccgttgacagtgtttgaaagtagggggtttagatgcccactacacagctgcgtgtcctgccacgctagcaacccttccaacccgaggccatcaaagggcaagatgatgaggtgcgtccgctgcccagtggcgtaccattccggagacgcgtgtctggctgctgggtgttctgtgattgcttctaactctatcatctgcaccgcccatttcacggctcggaagggcaagcgccatcatgcacacgtcaatgtttcgtggtgctttgtgtgtagcaaaggtggaagtttactgtgttgcgagagttgccccgctgcctttcaccccgattgcctgaacattgagatgcccgacggttcttggttttgcaatgattgtcgcgctggtaagaaactgcatttccaggacatcatttgggtcaagcttggaaactataggtggtggcccgcagaggtgtgccaccctaagaatgtacccccaaatattcaaaagatgaaacatgagatcggagaatttcctgtcttcttctttggtagcaaggactactactggactcaccaggcaagagtgttcccctacatggagggtgaccgaggtagccggtatcagggtgtacgagggattggcagagtgttcaagaacgcactgcaggaagctgaggccagattccgcgaaatcaaactccagagggaagcaagagagacccaagagagtgagaggaagccccctccatataaacatatcaaagtgaacaaaccatatggcaaggtgcagatttatacagccgacatatcagagattcccaaatgcaactgtaaacctacggatgaaaacccctgtgggttcgacagcgaatgtttgaaccgaatgctcatgttcgagtgccaccctcaagtctgtccagccggagagttttgtcagaatcagtgtttcactaagcgtcagtaccccgagaccaagatcattaagacagatggtaagggctggggactcgtagctaagcgggacatccggaagggcgagttcgtcaacgaatacgttggcgaactgatcgatgaagaagagtgtatggctcgtatcaaacacgcccacgaaaatgacatcactcatttttacatgctgacaattgacaaggataggatcattgatgctggtcctaagggcaactacagtagatttatgaaccatagttgtcagcccaattgtgaaacgctcaagtggactgtgaacggcgacactagggttggtctcttcgctgtttgcgatatacctgcagggacagaacttacattcaactataatcttgactgcctgggcaatgaaaaaaccgtatgcaggtgcggcgcatccaattgcagtggctttctcggagaccgtccaaaaacaagcacaacactcagtagcgaagaaaaaggcaaaaaaaccaaaaagaaaaccaggcgacgacgcgctaaaggtgagggcaagcgccaatccgaggatgagtgtttccgatgcggcgacggaggacagctggtgctgtgcgaccgcaagttctgtacaaaggcctatcatctgagctgtctggggctcgggaagagaccgttcggaaaatgggagtgtccctggcatcactgcgatgtgtgtggcaagcccagtacctctttctgccatctctgtcctaatagtttctgtaaagagcaccaagacggcacagcatttagctgcacacccgacggtaggagttattgctgcgaacatgacctgggagcggcatccgtaagatccacgaagactgagaaaccccctccagaacctggtaagccaaagggaaaacggagaagaaggcgcggatggcggagagtgaccgagggaaagtag

SEQ ID NO: 246933 - DNA, 4098 bp, Artificial Sequence
  Description of Artificial Sequence: Synthetic coding sequence
atggagttcagcattaagcagtctccattgtcagtacagagtgtggtgaagtgcattaagatgaagcaggcccctgaaatcctcggctccgccaatgggaaaaccccgagctgtgaggtgaaccgcgagtgcagtgtatttctgagcaaggcccagctgagctcatccctgcaggagggcgtcatgcagaaattcaacgggcatgatgctctccctttcattcccgcagacaaactgaaggacctaacctcaagagtctttaacggggagccgggagcccacgacgctaagctccggtttgagtctcaagagatgaaaggcatcgggaccccacccaataccactccaataaagaacggatcaccagagatcaaattgaaaatcacgaagacctacatgaacggaaagcctttgttcgagagctccatatgtggagactcagccgcagatgtgtcccagagcgaggagaatgggcagaaaccagagaataaggctcgacggaacaggaaacggagtattaaatacgactcactccttgagcagggcttggtggaagccgctctagttagtaaaatctcctctccgagcgacaaaaaaatcccagccaaaaaggagagctgtcctaatactgggagagacaaagaccacctattaaaatataacgtgggagacctggtgtggagtaaagtctccgggtatccatggtggccttgcatggttagcgcggaccccctcctgcatagctatactaaactgaaggggcaaaagaaatccgcacgccagtaccacgtgcagttcttcggggacgccccagaacgggcttggatcttcgagaaaagtctcgtagccttcgaaggcgaaggtcaattcgaaaaattatgtcaagagagcgccaaacaagctcccacaaaggctgaaaagattaagctgctgaaaccaatctcagggaagttgagagcacagtgggaaatgggcatcgtgcaggctgaggaagctgccagtatgtctgtggaagaaaggaaggccaagtttacatttctgtatgtgggagaccagttgcacctgaatccccaagtcgcaaaagaagctggaatcgctgccgagtccctgggagagatggccgagtctagtggagtatccgaggaggctgcagagaatcctaaaagcgttagagaggaatgtattccaatgaagcgcagacggagggcaaagctgtgttcctcagccgagacccttgaatctcatccagacatcggaaaatcgacgcctcagaagaccgcagaagcagatccgaggaggggtgtggggtctccccctgggagaaaaaaaacaactgtatcaatgcctagatcacgcaagggcgacgcggcaagccagttcttggtgttttgtcagaaacatagagatgaagttgtggcggaacacccggacgccagtggggaagagatcgaggagctgttaaggtcccagtggtctctgctgtctgagaaacagcgggctcgctataacacaaagttcgctttggttgccccagtacaggctgaggaggactcaggcaacgtaaacggtaagaaaagaaatcatacaaagcggattcaggatcctaccgaggacgctgaagcggaggacacaccacggaaacgtctgaggaccgacaaacactcactcagaaaacgagataccatcaccgataagaccgccagaacttcaagctataaggccatggaagccgcttcctctctgaaaagccaagctgcaacgaagaacctgtccgatgcttgcaaacctctgaagaagaggaacagagcttccaccgccgcatctagcgcacttggtttttctaagagcagcagccccagcgctagtctgactgaaaacgaggtttctgattctcccggtgacgagcccagtgaaagcccatatgaatctgctgatgagacccagaccgaggtgagcgtgtcctctaagaaatccgagcgaggtgtgacggcaaaaaaggagtacgtctgtcagctgtgcgagaaacccggaagtcttttattgtgtgaggggccatgttgcggagcatttcaccttgcctgtctggggctctctcgcaggccagagggaaggttcacttgtagtgagtgcgcttcaggaatccacagttgctttgtgtgcaaggagtcgaaaaccgatgttaaaaggtgcgtcgtcacacaatgtggcaagttttatcatgaggcctgtgtgaagaaatatccactcactgtgttcgaaagtagggggtttcggtgccccctgcactcctgcgtctcttgccacgcctcaaacccctcaaaccccaggcctagcaaaggtaagatgatgcggtgcgtgcggtgcccggttgcatatcacagcggtgatgcctgtctcgcagccggatgttccgtgattgcttcaaactcaatcatctgcacagcccactttacagctcggaaggggaagcggcatcacgcacacgttaatgtatcctggtgttttgtctgttctaagggcggttcactgctctgttgtgagtcttgtcctgcagccttccaccccgactgcctcaatattgagatgccagatggctcctggttctgtaacgactgtagagcagggaagaagttgcattttcaggacattatttgggtgaagctgggcaattacaggtggtggcccgcagaggtttgccaccccaaaaatgttccaccgaacatacagaaaatgaaacatgaaatcggcgagttccccgtattcttctttggctcgaaggactattattggacacaccaggccagggtgtttccctacatggagggagaccgtggaagtagataccaaggagttagaggcattggacgagtgtttaagaacgctttgcaggaagctgaagctagatttagggaaattaagcttcagcgcgaggccagggaaacacaggagagcgagagaaaacccccaccttacaaacacataaaggtgaataagccatatggaaaggtgcagatttacacagccgatatctccgaaatcccaaaatgtaactgtaagcccaccgatgagaacccttgcgggttcgactcagaatgtctgaacagaatgctgatgtttgagtgccaccctcaggtgtgcccggcaggggagttttgccaaaatcagtgcttcacaaaaaggcagtaccctgaaacaaaaatcatcaaaactgatggcaaagggtggggcctcgtagccaaaagagatatcagaaagggcgagtttgtgaatgagtacgtcggggagctgatagatgaagaggaatgcatggcacgcatcaagcatgctcacgagaatgacataacgcacttctacatgctgactattgacaaggatagaatcatcgacgccggtcctaagggcaactacagtaggttcatgaaccattcctgccagcctaactgtgaaactctgaaatggaccgttaatggcgatacgagggtagggctttttgctgtatgtgatatcccagctggcacagagctgacattcaattataatctggattgtctgggaaacgaaaagacagtgtgccgctgcggagctagcaactgttccggtttcctgggcgatcgcccaaaaaccagcacaaccctttctagtgaagagaaggggaagaaaactaaaaagaagacccgacgacgtcgagccaaaggggaaggaaaacggcagtctgaggacgagtgctttcgctgcggtgatggcggtcaactggtcctgtgcgaccggaagttttgcactaaggcttaccacctcagctgcctgggactggggaagcgtccattcggcaaatgggagtgcccatggcaccactgcgatgtatgcggcaagccaagcacatctttctgccacctctgtccaaattcattctgtaaggagcatcaggatgggactgcgttcagctgtacccctgatgggcgaagctactgctgtgagcatgatctgggcgctgccagtgtgcggtccactaaaacagaaaaacctccgccagagcctggcaagcccaaaggcaagagacgcagaagacggggttggaggcgcgttaccgagggaaaatag

SEQ ID NO: 246934 - DNA, 4098 bp, Artificial Sequence
  Description of Artificial Sequence: Synthetic coding sequence
atggagttttcaattaaacagtcacccctaagcgtccagagcgtggtgaaatgcattaaaatgaagcaggccccagaaatccttggatccgcaaatggaaaaacccctagttgcgaggtgaatcgcgagtgtagcgtcttcctttccaaagcacagctgtcatctagcctgcaagagggggtcatgcagaaattcaatggccacgacgcactgccatttatacctgctgataaactcaaggatctgacctcacgggttttcaacggcgagcccggtgcccacgatgcgaaactgcgatttgagagccaggagatgaaaggaataggcactccccctaacaccacacctattaagaatggttcccccgagattaagttgaaaataactaaaacttacatgaatggcaaacctctctttgagtctagcatttgcggagatagcgccgctgatgtctcacagtctgaggaaaatgggcagaagccagaaaacaaagctcggcgaaatcgcaagcggtctatcaaatacgattccctgctcgagcagggactggtcgaagctgcccttgtctctaaaataagtagtccttctgataagaaaattccggctaaaaaggaatcttgccccaacaccggtcgcgataaagatcatctgctcaagtacaacgtcggggatttggtgtggtcgaaagtttccggatacccgtggtggccatgtatggtctctgcagatccgctcttacattcttataccaagttgaagggacagaaaaaatcagctaggcaataccatgtacaatttttcggcgacgcccctgagcgcgcttggatcttcgagaaatctctggtcgcttttgaaggagaaggacagtttgaaaagctctgccaggagtccgccaaacaagcccctaccaaagccgaaaaaattaaactcctcaagcccatctccggcaaattgagggcacagtgggagatgggtattgtgcaagccgaagaagccgcttcaatgtcagtggaggagagaaaagccaaatttactttcctctacgtgggcgaccagctccatctaaacccgcaggtcgctaaggaggctggcatcgccgcagaaagcctcggagagatggccgagtcatctggcgtgagcgaggaggccgctgaaaacccgaagagcgtgagagaagaatgtatacctatgaaaagacgcagacgggctaagctgtgcagttcagccgagacgctcgagtctcatccagacatcggcaagtctacccctcagaagactgccgaggccgaccccaggcggggagtcggctccccacccggacgtaagaaaactacagtgtctatgcccagaagcaggaagggggacgctgcatcgcagttcctggtgttttgtcagaaacacagggatgaggttgttgcagaacaccccgatgcctctggggaggaaatcgaggagctgctgagaagccaatggagcctgctaagcgagaagcagcgagcccgttataataccaagttcgcgctcgtggcaccagtgcaagccgaggaggactccggtaatgtcaatggtaagaagcggaaccacactaaacggatccaagacccgacagaagatgctgaggcagaggacaccccaaggaagcggctgagaaccgataagcactccctgagaaaaagagatactattaccgataagactgcaagaacctctagctataaagctatggaggcagcctcctctcttaagagtcaagccgcaaccaagaacttgtctgatgcttgcaagcctcttaaaaagaggaatcgcgctagcacagcggctagtagtgcattggggttcagcaagtcctcaagcccatctgcatctctgacagagaatgaagtgtctgacagccccggagacgagcccagtgagtctccatatgaatccgcagatgaaacccagacggaagtgagcgtctctagcaagaagagcgagaggggtgttacagccaaaaaagagtatgtctgccagctgtgcgaaaagcctggttccttattgctgtgtgagggcccatgctgcggagccttccatctcgcctgtcttggactctcccggagaccggaaggccgattcacatgctcggaatgcgcctccgggatacattcatgcttcgtgtgcaaggagagcaaaacagatgttaagcggtgtgttgtaacccagtgcgggaaattttatcatgaggcttgtgtcaagaaatacccactaaccgtttttgagagtagaggctttagatgtccactgcattcttgcgtgtcttgtcacgcgtcaaaccctagcaaccctcgccctagtaaagggaaaatgatgagatgtgttcggtgcccagttgcctatcactcaggtgatgcatgtttggcagccggatgcagtgttattgcatctaattcgattatatgtacagcccatttcacggctagaaagggcaaaaggcatcacgcacatgtcaacgtttcttggtgcttcgtttgcagcaaaggcggatcactgttgtgttgtgagtcttgccctgccgcatttcatcctgactgtctgaacattgagatgcccgatggatcctggttttgtaacgactgtcgggctgggaagaaacttcactttcaagatatcatctgggtcaagctcggaaactaccgctggtggccagctgaggtttgtcacccaaaaaacgtgccacccaacatacaaaagatgaagcatgagattggtgaatttcccgtgttctttttcggcagtaaagattactactggacacatcaagccagggtgttcccttatatggaaggcgacagaggttcccggtaccaaggcgtgcggggaattggacgtgtcttcaaaaatgccctccaagaggctgaggcccgatttagagagataaaactccagcgggaggccagggagacccaggaaagcgagagaaagccgccaccttataagcatatcaaagtcaacaagccttatggcaaggtccagatttacacagccgacataagcgagataccaaaatgcaactgtaaacccacagatgagaatccttgtggctttgactcagaatgtctcaatcgtatgttgatgtttgagtgccatccccaggtgtgtccggcaggagagttctgccagaaccagtgcttcacaaagcgccaataccctgaaacgaaaattatcaaaacagatggcaaaggatggggtctggtggccaaacgggatattagaaaaggcgaattcgttaacgagtatgtaggcgagctgattgacgaggaggagtgcatggcacgaatcaagcacgctcacgagaacgatatcacccatttctacatgctgactatagataaggatcgcatcatagatgccggacctaaggggaactattcccgtttcatgaaccatagttgccagcctaattgcgaaaccctgaaatggacagtgaatggcgacactcgggttggtttattcgcagtatgtgacattcctgccggaactgagctgaccttcaattataacctcgattgtcttggaaacgaaaagactgtatgcaggtgcggcgcttctaattgtagcgggttcctgggtgacaggcctaagacttctaccactctgtcgagcgaggaaaaggggaagaagacaaaaaagaaaacccgacggaggcgtgcaaagggagaaggtaaaagacagtccgaggacgagtgcttccggtgtggagacggagggcagctggtactctgcgaccggaaattctgcacaaaagcctaccacttgagctgccttggactgggtaaaaggccgtttggaaaatgggagtgtccatggcaccattgtgacgtgtgtggcaaaccaagcacgtccttttgccatttgtgtccaaactctttctgtaaggaacaccaggatggaactgcttttagttgtacacccgatggtagatcatattgctgcgaacacgacctcggggcagccagcgtcagatccaccaagaccgaaaaacctccacccgaacccggaaagcctaaggggaagcgtcgaaggcggagggggtggcggcgagttaccgagggcaagtag

SEQ ID NO: 246935 - DNA, 4098 bp, Artificial Sequence
  Description of Artificial Sequence: Synthetic coding sequence
atggaattcagcatcaagcagagtccactttccgtgcaatctgtggtgaagtgcatcaaaatgaagcaggccccagagatactggggagtgctaatgggaagacgccctcatgtgaggttaatcgagaatgttcagtgttcctgagtaaggcccagctgagcagctctttgcaggagggagtgatgcagaagttcaatggccatgacgcacttccgttcattcctgccgacaagcttaaggacctcactagcagagtgttcaacggagaaccgggtgcacatgatgcaaagttaagattcgagtctcaggagatgaagggaatcggaaccccccctaacaccacacccattaaaaacggctctccggaaatcaaactgaaaatcaccaaaacgtacatgaacggcaaacctcttttcgaaagcagtatctgtggggattcagctgctgacgtgtcccagtccgaggaaaacggccagaagcccgagaacaaggccaggcgtaaccgtaaacgttctatcaagtatgactcacttctggagcaggggcttgttgaggccgctcttgttagcaagataagctccccatccgataaaaaaattccagccaaaaaagaaagttgtcctaacaccggcagagacaaagaccacttacttaaatataatgtgggagatttagtatggtctaaggtcagtggttatccctggtggccttgtatggtgagtgccgatccactgctccatagttacaccaagctcaagggtcagaagaaaagcgctcgtcagtaccatgtccaattcttcggggacgcgccagaacgcgcatggatttttgaaaaaagtctcgtagccttcgagggagaaggccagtttgaaaagctgtgtcaggaatctgcaaaacaggcccctacgaaagccgaaaaaatcaagttgctcaagcccatttcggggaagcttcgagcccagtgggagatgggaattgtgcaggctgaagaggcagcttctatgagtgtggaggaaaggaaagctaaatttacatttttatacgtgggcgatcagttacacctgaacccccaagtcgcgaaggaagccggaatagcagccgagtcactcggggaaatggccgaaagctcaggagtctcagaggaggctgcagagaatcccaagtccgtgagggaagagtgtatcccgatgaaacggcgaaggcgcgcaaaattgtgtagtagcgccgaaaccctggagagtcaccctgatattggtaagtcaactcctcagaagacggcggaagcagatccaaggagaggcgtcggaagtccgccaggcaggaaaaagacgactgtgagtatgccacggtcacgcaagggcgacgccgcttcccaattcctcgtattctgccagaaacacagggacgaagtagttgctgagcaccctgacgcatcgggcgaggagattgaggagctgctgcgaagccagtggtcattactttcagaaaaacagcgggcacgatacaataccaagttcgctctagtggcacctgtccaggccgaggaggacagcggcaacgtgaatggaaaaaagaggaaccacaccaaacggatccaggaccccacagaagacgccgaagccgaagataccccacgaaagcggttgcggacagataagcatagccttcgcaagcgtgatactatcactgataagaccgcacgcaccagctcatataaagctatggaagctgccagtagcctgaaatctcaggccgcaaccaaaaacttatccgacgcatgtaagccgttaaagaagcggaacagagccagcaccgccgctagctcagccttaggattttctaagagctcttctccctcagcttccctgacggaaaatgaagtctctgacagtcccggagacgaaccgtcagagagcccctatgaaagcgccgacgaaacacagaccgaggttagcgtgagcagcaagaagtcagaacgcggagtgacggccaagaaggaatacgtgtgccagctgtgtgagaagccaggttcccttttgctttgtgaggggccatgttgcggagcattccacctggcctgcttgggactaagccgaaggccagagggtaggttcacttgcagtgagtgcgcctcggggatccactcttgtttcgtgtgcaaagagagtaagaccgacgtgaagcggtgcgttgtgacccaatgcggaaaattctatcatgaggcctgtgttaagaagtaccccctcaccgtgttcgagagcagaggtttcagatgcccactgcactcgtgcgttagctgccacgcttccaatcccagcaatcctaggccctcaaaaggaaaaatgatgagatgcgttcgatgtcccgtggcctatcatagtggggacgcctgtttggccgcagggtgttccgttatcgcttctaactccattatctgtacagctcattttactgcccgaaagggcaaacgccatcacgcccacgttaatgtgagctggtgcttcgtgtgttccaagggcggaagtctgctgtgttgcgagtcctgtcccgctgccttccatcccgactgtctcaatatcgagatgcctgatgggtcatggttctgtaacgattgcagagccggaaaaaagctgcattttcaggacataatctgggtcaaattaggcaactatcgttggtggcccgcagaggtgtgccacccaaagaacgtacccccaaacattcagaaaatgaagcatgagataggagaattccccgttttcttcttcggctcaaaagactactactggacccatcaggctcgggtcttcccctacatggagggggatcgtggatccaggtaccagggcgtacgtgggattggtagagtcttcaagaacgctttacaggaggccgaggccaggtttcgcgaaataaagttacagcgcgaagctcgggaaacccaggagtctgagcggaaacctcccccatacaaacatatcaaggtgaacaaaccttacggcaaggtccagatctacacagccgacatttcagagattcctaagtgtaattgcaagccaacagatgaaaatccatgtgggttcgattcggagtgcctcaaccgtatgctgatgttcgaatgccacccccaggtctgcccagcgggtgaattttgtcagaatcaatgcttcacaaaaagacagtacccagagaccaagatcatcaaaaccgatggaaagggttggggacttgtcgcaaagagggacatcaggaaaggcgagtttgtcaacgaatacgtgggggagttgatagacgaggaggagtgcatggcgcgaattaagcatgcccatgaaaacgatatcacccacttttatatgctgacaattgataaggatcggatcatcgatgcaggtccaaaggggaactactcccggttcatgaatcattcgtgccagccgaactgcgaaacactgaagtggactgtgaatggcgacaccagagtgggcctgttcgcagtgtgtgatatccctgctggaaccgaattgacgtttaactataatctagactgtttggggaatgagaagactgtttgccggtgtggcgcttctaattgctccgggtttctgggggataggccgaagacgtctactactctctctagtgaggagaaagggaagaaaaccaaaaagaaaactaggagaaggcgggcaaagggagagggcaaacggcagtctgaagacgagtgttttagatgtggcgacgggggacagcttgtcttatgcgacagaaaattctgtactaaagcctatcatctatcctgcctgggactggggaaaagacctttcgggaaatgggaatgcccgtggcaccactgcgacgtgtgcggaaagccaagtaccagtttctgccatctttgtcctaactcattctgcaaagagcaccaggatgggaccgctttcagctgcacaccggacggtaggtcctactgttgcgagcacgacctcggggcagccagcgtgagatcaaccaagaccgagaaacctccgccagagccgggaaagcccaagggaaagcgtaggcggcgaaggggctggcgtcgagtgacagaaggtaaatag

SEQ ID NO: 246936 - DNA, 1944 bp, Artificial Sequence
  Description of Artificial Sequence: Synthetic coding sequence
atggagttcagcataaaacaatctccactgtccgtgcagtctgtggtcaaatgcatcaagatgaaacaggccccagaaatcttgggtagcgctaatggtaagacacccagctgcgaggtgaaccgggagtgctccgtctttctgtctaaagctcagctgagttcctcccttcaagaaggagttatgcagaaatttaatgggcacgatgcactcccgttcatcccagctgataagctgaaggatctgaccagccgcgtgttcaatggggaaccaggggctcacgatgctaaactgaggttcgagtctcaggagatgaaaggaattgggacaccacccaacacaacgcctatcaagaacggatcacccgagataaagctgaaaatcacaaagacctacatgaatgggaagcccttgtttgagagtagcatatgtggggatagcgcagcggacgtctctcagagcgaggaaaatggccaaaagccagagaataaagctcggcgtaaccggaaacgaagcatcaaatacgacagcttgttggagcagggtctagtagaggctgccctagtctcaaaaatatccagccccagcgataaaaagattcctgccaagaaggagagttgtcctaacacgggcagggacaaagatcatctccttaaatacaacgtcggagatctggtatggagcaaagtctccgggtatccctggtggccttgcatggtttcagcggatccactcctgcacagctatacaaagctgaaaggacagaaaaaatcggccaggcaatatcacgtccagttctttggggatgctcctgagcgagcctggatcttcgagaaaagcctagtggcttttgaaggggagggacagtttgaaaaactgtgccaggaaagcgcgaagcaggcaccaaccaaggccgagaagattaaattgctgaaacctattagcggcaagctgcgggcacaatgggaaatgggtatcgtgcaggcggaggaagcagcttcgatgagcgtggaagaacggaaagcgaaattcacatttctctatgtcggtgatcagctgcacctcaacccgcaggttgcaaaagaggccggaatcgctgctgaatcactcggcgaaatggccgaaagcagcggcgtaagtgaggaggccgctgagaaccctaaatcagtccgagaggagtgtatccccatgaagcggagacgcagggcaaagctttgtagctcagccgagacactagaatcccacccggacataggaaagagcaccccacagaagaccgccgaagcggaccccaggaggggcgttggcagccccccaggtcgaaagaagacaacagtgagcatgcccaggtccaggaaaggcgatgccgcatcacagtttcttgtgttttgccagaaacatcgcgacgaggtcgtcgctgagcaccccgacgcctctggagaggaaatcgaagagctgctgcgcagtcaatggagcctgctgtccgaaaaacagcgcgcacgctataacaccaaatttgcactggttgctcctgtacaggccgaggaggattccggcaatgttaatgggaagaaaaggaatcatacgaaacgaatacaagaccctactgaggatgcagaggcggaggatactccgagaaaacggctgcgcaccgacaaacactcattgcggaagagggatacaattacagacaaaactgcccgaacctccagctacaaggcaatggaggccgcttctagccttaagtcccaagctgctactaagaacctgagcgatgcctgcaagccattaaaaaaaagaaatagagcttctacggccgcttccagcgcattaggctttagtaagagctcctctccctccgcctcccttactgaaaacgaacttctatgggagccgacgccagtgaagctggatctgaaccctgccgctctttactgcacttag

SEQ ID NO: 246937 - DNA, 1890 bp, Artificial Sequence
  Description of Artificial Sequence: Synthetic coding sequence
atggagttctccattaagcagtctccgttatccgtgcagtctgttgttaaatgcataaagatgaagcaggcaccggaaatcctgggcagtgcaaatggaaagacgccatcttgcgaagtgaaccgcgagtgctccgtctttctatctaaggcccagctgtcttcatcactgcaggagggcgtcatgcagaagttcaatgggcacgacgcactgccatttataccggctgacaagcttaaagacctaacatccagggtgttcaacggggagcctggtgcacatgatgctaaattacgattcgaatcacaggaaatgaaaggcatcggaactccacctaacacaacccccattaagaatggttcaccggaaatcaagctcaagataacaaaaacatatatgaatggcaaacctctttttgaatcatctatctgtggcgattccgcagcagatgtgtcacagtcagaagagaatggccaaaagcctgaaaacaaggctaggcgcaatagaaagcgcagcataaagtacgattcattacttgaacagggcttagtagaggctgctttagtgtccaaaatatcctctccgtcagacaagaaaatcccagcaaagaaggaaagctgccccaatacgggccgagacaaggaccatttgctgaaatacaatgtcggagaccttgtatggtctaaggtgtctggatacccatggtggccgtgcatggtttctgccgatccattgcttcactcgtataccaagctgaaggggcagaagaaatcagcgaggcagtaccatgttcagttctttggcgacgcacccgagagggcctggattttcgaaaagtcgctggtggctttcgaaggcgaagggcagttcgagaaactatgtcaggagagcgctaagcaggccccaacgaaggccgagaagataaaattgctgaaacccattagcggcaagctcagggcgcagtgggagatgggaatcgtacaggctgaggaagccgctagcatgtcagtggaggagcgtaaggcaaaatttacttttctgtatgtgggcgatcagttgcaccttaacccacaggtggccaaagaagcagggatagcggctgaaagtcttggagagatggcagagtcatcgggggtgtcagaggaagctgccgaaaatccaaagagtgtccgggaggagtgtatccccatgaagcggaggcggagagccaaactgtgttcatctgctgaaactctggaaagtcatcctgatatcgggaaatcaacgccacaaaaaaccgcagaagctgatccgaggcggggtgttggaagtccaccaggccgtaaaaagacgacggtcagcatgcccaggagcaggaagggagacgcggcttctcagttcttggtgttttgccaaaagcaccgcgacgaggtggtagcagaacatcccgacgcctccggcgaagaaattgaggaacttctgaggtcacagtggagcctgttgtctgaaaagcagagagcccgatacaacactaagttcgccctagttgccccagtgcaggccgaggaggatagtggaaacgtcaacggcaaaaaacggaaccacacgaaacgcatacaagaccctactgaggacgctgaagcggaagacactcctcggaagcgacttcggaccgacaaacacagtctgcgtaaaagggataccatcacagataagactgctaggacgtcatcctataaagccatggaggccgcatcgtctctgaaatcccaggccgcaaccaaaaacctcagtgacgcttgcaagccactcaagaagcggaatagggcaagcaccgcagcttcctccgcattgggcttctccaagagcagctctccctccgcaagtctgactgagaatgaagtcaagtag

SEQ ID NO: 246938 - DNA, 822 bp, Artificial Sequence
  Description of Artificial Sequence: Synthetic coding sequence
atggaattcagcattaaacagtcccctctttcagtgcagtcagtggtgaagtgcataaagatgaaacaggctcccgaaattctgggctctgcaaacggcaaaaccccaagttgtgaggtcaatcgggaatgttccgtattcttgtccaaggcccagctgtctagcagtttgcaggaaggagtgatgcagaaattcaatggccatgacgcgttacccttcatccccgcagataagctgaaagacttgacctcacgagtgttcaacggcgagccaggagcccacgatgccaaactaagatttgagtcacaggaaatgaaaggaatcggaacgccccctaataccacaccaattaagaatggaagcccggaaataaaattgaagatcaccaaaacatacatgaatggaaagccgctgttcgaatctagcatttgcggggatagtgcagctgatgtgtcacagagtgaagaaaatggtcaaaaaccagaaaacaaggcccgacgaaaccgaaaacgctcaattaaatacgactctctgttggagcaggggctcgtcgaggccgctctggtctctaaaatcagttccccgagcgacaagaaaatccccgcaaagaaggaatcctgccccaataccggtagggacaaagatcatctgctgaaatacaacgtcggagatttagtctggtctaaggtctccggatacccgtggtggccctgtatggtgtccgcagaccccttgttgcactcttacactaagctgaaaggtatttttaaaagcaagaaattcgagcatctgaaaacatcccagatcgtgctgaaggactag

SEQ ID NO: 246939 - DNA, 1944 bp, Artificial Sequence
  Description of Artificial Sequence: Synthetic coding sequence
atggagtttagtatcaaacagtcacctctttccgtccagtccgtggtcaaatgtatcaaaatgaagcaggcacctgaaatactggggagcgccaatggaaagacgccttcgtgcgaggttaatcgggaatgctcagtctttcttagtaaggcacagctctcctcatcactgcaggaaggagtcatgcagaaatttaatgggcatgatgctctgccctttattcccgcagataagctaaaagatctgacaagtagagtgtttaatggggaacccggagctcacgacgccaagttaagattcgagagtcaggagatgaagggcattggcacaccaccaaacactactcctattaagaacggcagccccgaaatcaagctgaagataacaaaaacctatatgaacgggaaacccttgtttgaatcatctatctgtggagattcagccgcagatgtcagtcagtcggaagagaatgggcagaagcccgaaaacaaagcccgtcgcaaccgtaagaggtcaattaagtacgactctttgctggagcaaggccttgtcgaagcagcactggtttctaagatctcttccccatccgataaaaagattcccgctaaaaaagagtcatgccctaacacagggagagataaagaccacctgctcaagtacaatgttggagatctggtgtggtcaaaggtatctggttatccatggtggccatgtatggttagtgccgaccctttacttcactcttatacaaagctcaaggggcagaaaaaaagtgcccgacagtatcatgtgcagttcttcggcgatgcgcctgagcgagcctggatctttgaaaagagcttggtggccttcgaaggggaaggtcaatttgaaaagctctgccaggaatctgctaagcaggcacctaccaaggccgagaagattaaactcctgaaacctatttccgggaaactccgagctcagtgggagatgggaatagtacaggctgaggaagccgctagcatgtctgttgaggagcgtaaggctaagttcacatttctctatgtaggcgatcagctccatctgaatccccaagtggcaaaggaggctggaatcgccgctgagtccctaggtgagatggccgagtctagtggagtgagcgaggaggctgcagaaaatcctaaaagtgtgcgggaggaatgcattcccatgaaaaggagacgcagggccaaactatgctcaagcgccgagactctggagtcacatccagacattggcaagtctacacctcagaagaccgccgaagccgatccgagacggggagtgggctctccacccggaaggaaaaagacgacagtatctatgcccaggagcaggaaaggcgacgctgcttcccaatttctggtgttttgccagaagcacagagatgaggtagtcgcagagcatcccgacgcctccggagaagaaattgaagaactcctgaggagccaatggtcgctattgtctgagaagcaacgtgcaagatacaacactaaatttgctttggtcgcgcctgtgcaagccgaagaggactcaggaaatgtgaacggcaagaagagaaaccacacgaaaaggattcaggatccaactgaggacgcagaagccgaggacaccccgagaaaaagactgcgcaccgataagcacagccttcgaaagagggacacgatcactgacaagaccgccaggacgtctagctataaagccatggaagcggcttctagcttaaagtcccaggctgctaccaaaaacctatccgatgcctgcaaaccactcaagaaacgcaatcgcgcaagcactgccgctagtagcgccctgggcttttccaagagcagtagtccatcagctagtctgacggaaaacgagcttctctgggaacctacacccgtgaaactcgatctgaacccggctgcgctgtattgtacatag

SEQ ID NO: 246940 - DNA, 114 bp, Artificial Sequence
  Description of Artificial Sequence: Synthetic coding sequence
atggagttcagtattaagcagtcacccttaagcgttcaatctgttgttaagtgtatcaagatgaaacaggccccagagattttgggctccgccaacggtaaaacccccagctag

SEQ ID NO: 246941 - DNA, 4098 bp, Artificial Sequence
  Description of Artificial Sequence: Synthetic coding sequence
atggaattcagcataaagcagagcccactgtccgtgcagagtgttgtgaaatgcatcaaaatgaaacaggcaccggaaatattgggttcagcaaacggtaaaactccctcttgtgaagtcaaccgtgagtgttcagtcttcctatccaaagctcagttgagcagttcactgcaggaaggagttatgcagaagttcaacggtcacgatgcactgccatttattcctgccgacaagctgaaggacttaactagcagagtgtttaacggcgagcccggagcccatgatgccaaacttagatttgaatctcaggaaatgaagggcattggaacacctccaaacacgacccccattaaaaatggaagtcctgagattaagctcaagatcacaaagacatacatgaatgggaaacctttgtttgagtcgtccatttgcggcgacagtgctgcagacgtttcccagtccgaagagaacggccaaaaacccgaaaataaggctaggaggaatagaaagaggtctattaaatacgactcactgcttgagcagggcctagttgaagctgctctggtgtccaaaatcagctccccttccgataagaaaatccccgcaaagaaggagagctgcccgaacacaggacgcgataaagatcatctattgaagtataatgtcggtgacttggtgtggtctaaagtgtctggctacccatggtggccatgcatggtatctgccgatcccctgctgcattcctatactaagttaaagggccaaaagaaaagtgccagacagtatcacgtgcagttttttggcgatgctcccgaacgagcttggatctttgagaagagcttagtggcgttcgagggagaggggcaattcgaaaaattatgccaggaatcagcgaagcaagccccaaccaaagccgaaaaaatcaagctgctgaaacccatctccggcaagctgcgggctcagtgggaaatggggatcgtgcaggcagaagaggccgcatcaatgagtgtggaggagcgaaaagctaaattcacttttctgtacgtaggggatcagctgcacttaaatccccaggtggccaaagaggctggcattgccgctgaatccctgggggaaatggccgagtctagcggcgtatccgaagaagcagctgagaaccccaagtctgtcagggaggaatgcattccaatgaaacgacggcgtcgtgctaaactatgctcctccgctgagactctcgaaagtcaccccgatatcgggaaatctacaccacagaaaacagcagaagcagatccccgacggggtgtaggcagcccccctggcaggaaaaagacaactgtgtccatgcctcgaagtcggaaaggtgacgccgcatcccaatttcttgtcttttgccaaaaacatagagacgaggtggtagcagaacatcctgatgcgtcaggagaggaaattgaggaactgctgaggtcacagtggtcgctgttgagcgaaaagcagagggccagatacaacactaaatttgcattagttgctcccgtacaggcagaagaggatagtggcaacgtgaacggcaagaagcggaatcatacaaagaggatccaggacccgaccgaggatgccgaagctgaagataccccacgcaagagacttagaaccgacaaacattcccttagaaaacgggatacaattacagacaaaacggctcggaccagcagctataaggcaatggaagcagccagcagtctgaaatcgcaagcggctaccaagaacctgtccgacgcctgtaaaccattgaaaaaacgaaatagggcatccaccgcagcatctagcgccctgggattctccaagtcttcttccccctcagcttccctcaccgaaaacgaagttagcgattctcctggcgatgagcccagcgaaagtccatacgagtccgcggacgagactcagactgaagtaagtgtgagctcaaaaaaaagcgaacgtggagttactgcaaagaaggagtacgtctgtcagctttgtgagaaacctggttctcttctgctctgtgaagggccttgctgcggcgcattccaccttgcctgccttgggctaagccgcagacctgaagggaggttcacctgttcggaatgcgctagcggcattcacagctgtttcgtgtgcaaggaaagcaagactgacgtgaagcgctgcgtcgtgacccagtgcggcaagttttaccacgaagcttgcgtgaaaaaataccccttaacagttttcgagtcaagggggtttcgctgtcccttacatagttgtgtgtcttgtcacgcaagtaaccccagtaacccacgcccatctaagggcaagatgatgcgctgcgtgcgctgccctgtcgcatatcacagcggcgacgcttgtctggcagcaggatgtagcgtgatcgcctcaaacagtatcatatgtactgctcatttcactgctcgcaagggcaagaggcaccatgcacacgtgaatgtcagctggtgtttcgtgtgtagcaaagggggttctctgctgtgttgcgaatcctgtccagctgcgttccacccagactgcctcaacattgaaatgccagacgggtcttggttctgtaacgattgccgcgcaggcaaaaaactgcacttccaggatatcatttgggtcaagttgggaaattataggtggtggcccgctgaagtgtgccaccccaaaaatgtgcctcccaatatccagaagatgaaacatgagataggtgaattccctgtgtttttctttggcagtaaagattactattggacccatcaggcaagggtgtttccatatatggagggggatcggggatcacggtaccagggagtgcggggaatcggacgggtttttaagaatgcccttcaagaagcagaagccaggttccgggagatcaagctgcagagggaagcaagggaaacacaggagagcgagcgcaaacccccaccttataaacatattaaagtgaataaaccatacgggaaagtccagatttacactgctgacatctccgaaattccaaagtgcaattgtaaaccaaccgacgagaacccttgcgggtttgactccgagtgcctgaacaggatgctgatgtttgagtgccatcctcaggtttgtcccgcaggcgagttctgtcagaaccagtgttttaccaaacgtcagtaccccgagaccaagattataaaaacagacggcaaaggctggggcctcgtagctaaaagagatattcgtaaaggcgagttcgtgaatgagtatgtcggggaactgatcgatgaggaggaatgcatggctcgaattaagcacgctcacgagaatgacattacccacttttacatgctgactatagacaaggatcggatcatcgatgctgggcctaagggcaattactcacggttcatgaaccactcttgtcagccaaactgcgagactctgaagtggactgtaaacggcgacaccagggtgggactattcgccgtgtgcgatattcccgcaggtacagaactcacctttaactacaatctcgactgtcttggcaacgagaaaacagtctgccgctgcggcgcaagtaactgctctggcttcctcggagatagacctaagacaagcaccacactctcttctgaagagaaaggtaagaaaacaaagaagaaaacccggagacggagggctaaaggtgagggcaaaaggcagtccgaggacgagtgcttccgatgtggagatgggggacagctcgtgctgtgcgacagaaagttttgcacgaaagcctatcacctgtcatgtctagggctcggcaaaagaccttttggaaagtgggagtgcccatggcaccactgtgatgtctgcggtaaaccttcaacctccttttgtcacctttgtcccaactcattctgcaaggagcatcaggacggcactgccttctcgtgtacgcctgacgggaggtcttactgttgcgaacacgacttgggcgctgcctcagtacggagtactaaaaccgaaaagccccctccagaaccaggcaagccaaaaggcaagcggaggcggaggagaggctggagaagggtgacagaagggaaatag

SEQ ID NO: 246942 - DNA, 1179 bp, Artificial Sequence
  Description of Artificial Sequence: Synthetic coding sequence
atggaattcagcatcaagcagtcccctttgtccgtgcaatccgtagtaaagtgcattaaaatgaagcaagccccagaaatcctgggttctgccaatggcaaaacgccttcatgcgaagtcaatcgcgaatgttctgtcttcctgtcgaaggcccaactgtcctctagcctgcaggaaggggtgatgcagaaattcaatggccatgatgccctgccattcattccagccgacaagctgaaagacctaacgagtcgtgtgttcaacggagagcctggtgcccatgacgcaaagttgcgtttcgagtctcaagaaatgaaaggtatcggcacaccccctaacaccacgccgattaagaacgggagccctgagatcaaactgaagatcactaaaacatacatgaatgggaaacctctgttcgaaagctcaatctgcggcgactcagcggcagacgtgagccaatcagaagaaaatggacagaagccagaaaacaaagcaaggagaaacaggaaaagaagcatcaagtatgacagcttgctagagcaggggctggtggaggctgccctcgtgtccaaaatctcttctccatcagataagaaaattccggcaaagaaggagtcctgtccaaatacaggcagggataaggaccacttgctgaaatacaatgtgggtgacctggtgtggtccaaggtgtcaggctacccttggtggccctgcatggtgagtgcagaccccctgctgcactcgtacactaagctcaaaggccagaagaagtccgcacgccagtatcacgtgcagttttttggagacgctccagagagggcgtggatcttcgaaaagagccttgtggccttcgagggcgagggccaatttgaaaagttgtgccaggagtctgccaagcaggccccaacgaaggcggagaagatcaagttgttgaagccgattagcggaaagttacgcgctcaatgggagatgggtatcgtccaggcggaagaggctgcctcaatgagcgtggaggagaggaaagccaagttcacatttttgtacgtcggcgaccagcttcatctgaacccacaggttgccaaagaagctggaatcgccgctgagtccttaggggagatggccgagtcctcaggggtaagtgaagaagccgctgaaaaccccaaatcagtgcgcgaatag

SEQ ID NO: 246943 - DNA, 1890 bp, Artificial Sequence
  Description of Artificial Sequence: Synthetic coding sequence
atggagttcagcatcaagcaaagccccctcagtgtgcagagcgtagtcaaatgcattaaaatgaaacaagcgcctgaaattctaggtagcgcaaacggcaagactccctcgtgtgaagtaaaccgtgagtgttccgtgttcctgtccaaggctcagttgagttcttccctgcaggagggtgtcatgcagaaatttaacggtcatgacgcactgccattcatccccgcagataagcttaaggacttgaccagcagagtgttcaatggcgagccaggcgctcacgacgcaaagctgcgctttgagtcacaagagatgaaaggcatcggtacaccgcctaacacaactcccattaagaacggcagtccagaaatcaagctgaagatcacaaagacctatatgaacggcaagcccctcttcgagagtagtatctgcggcgacagtgccgctgacgtgagtcaatctgaagagaacggccagaaacctgagaacaaagccagacgcaacagaaagcgtagtataaaatatgattcactgctggagcaggggttggtggaagctgctcttgtgtcaaagatcagcagcccatcagacaagaagattcccgctaaaaaggagagttgtccaaacactggtcgggacaaagaccacctgctgaaatacaacgtcggggatctggtctggtcaaaggtgtctggttacccttggtggccctgtatggtgagcgctgatcctctgcttcacagctacaccaaattaaaaggacaaaaaaaatctgccagacaataccatgtgcaattctttggggacgcaccagaaagggcctggatctttgagaagtcgctggtcgcatttgagggagagggacagttcgagaagctctgtcaggaaagcgctaagcaagctcctactaaagcggagaaaatcaaactgttgaagcccatcagtgggaaactacgggcacagtgggaaatgggtattgttcaggctgaagaagccgcttcgatgtctgtagaagaacgcaaggccaaattcactttcttgtacgttggcgaccaactgcacctcaacccccaggtggccaaagaggctgggatcgccgcagaaagcctgggggagatggctgaatcctccggcgtgagtgaggaagccgctgaaaatccaaaatctgtgagagaggagtgtatccctatgaaaaggcggagacgggctaaactgtgttcttcagcggagacactggaatctcaccctgacatcggaaagagcactccacagaaaacagctgaggctgatccccgacggggagtagggtcacccccagggaggaagaagacaacagtgtctatgcctcgctcccgtaagggtgatgccgcaagccaattcctggtgttctgtcaaaagcacagggatgaagtggttgcggaacatccggacgccagcggcgaggaaatagaggagctgctgagatcacagtggtcactgctgtcagaaaagcagagggccaggtataatacaaagtttgcccttgttgctcccgtccaggccgaggaggattccggtaacgttaacggcaaaaagagaaatcacacaaagcgcattcaggatccaactgaagacgctgaggctgaggacacacccaggaaacgattgcggacagacaaacacagcctgagaaaacgcgataccattaccgataagactgcacgcacctcttcctataaggcaatggaggcggcatccagtcttaagagccaggccgcaaccaaaaatctctcagacgcctgcaaaccactgaagaagagaaatcgcgctagtactgccgcaagttctgccctgggtttttcaaaatcttcgtcaccctcagcctctctcacagaaaatgaggtgaaatag

SEQ ID NO: 246944 - DNA, 600 bp, Artificial Sequence
  Description of Artificial Sequence: Synthetic coding sequence
atggaatttagcattaaacagagccccctgagtgtacagagcgtggtgaagtgcattaaaatgaaacaggcacctgagatccttggctccgccaatggaaaaacacctagctgcgaggtgaaccgagagtgcagcgtctttttgagcaaggcccaactcagttctagcttgcaggagggcgttatgcagaaatttaacggtcatgatgctctcccatttatccccgctgacaagctcaaggatctaacaagcagggttttcaacggcgagcccggagctcacgatgcgaagttacgcttcgagagccaagaaatgaaaggaattggcacccccccaaatacaactcctataaagaacgggtcacccgagatcaagttaaagataaccaagacatacatgaacggcaaacctttgttcgaatcctctatctgcggggactcggccgcagatgtctcacagagtgaagaaaacgggcagaagcctgagaacaaggccaggcgcaacaggaagcgtagcatcaagtatgacagtctgttagaacaagggctcgtcgaagccgcactagtgtccaagatcagttccccaagcgataagaaatag

SEQ ID NO: 246945 - DNA, 1938 bp, Artificial Sequence
  Description of Artificial Sequence: Synthetic coding sequence
atggatttctcgtttagcttcatgcaaggcatcatgggcaataccattcaacagcctccgcagttgatcgacagtgcaaatattcgccaagaagacgcttttgacaacaacagcgacatagcagaggacggaggtcagaccccatacgaagcaacattgcagcaggggtttcaataccctgccaccactgaggatctgccaccactgacgaacggctacccttccagcatctcagtgtatgaaactcagacaaagtatcagtcctataaccagtatcctaacggctctgccaatggcttcggtgccgtgcgcaacttttcgcccacagactactatcacagtgagatcccaaatacgcgcccacacgaaattctcgagaagccaagtcctccacagccccctccgcctccatctgtgccccagaccgtgattcccaaaaagactggttctcccgaaattaagctcaagatcacaaagacaatacaaaacgggagggagttattcgaaagctcactctgcggagacctcttgaatgaagtgcaggccagcgaacacaccaagagcaagcatgagagccggaaggaaaagagaaagaaatccaacaagcacgactcaagccggagcgaagagcgaaaatcacacaaaatccccaagcttgagcctgaggagcagaaccggccaaatgagcgggtggacactgttagcgaaaaacctagggaggagcccgtgctgaaagaagaggcccctgtgcaaccaattctgtccagcgtccctacaaccgaagtgagcaccggggtcaagtttcaggtgggcgatttggtctggagtaaggttggaacttacccatggtggccgtgtatggtttcctccgacccgcaactggaagtgcacactaaaattaatacaaggggggctcgggagtaccatgttcaattctttagcaatcaacccgagagggcgtgggtgcacgagaagcgagtgagggaatacaaaggacacaaacagtatgaagagcttcttgccgaggctacgaaacaggctagtaaccatagtgaaaaacagaagatccgaaaacctcgaccccaacgcgaaagagcacagtgggacatcgggattgctcatgcagaaaaggcactcaagatgactcgcgaggaaaggatcgagcagtacacatttatctacattgataagcaacccgaagaggcactcagccaagccaagaagtccgtcgcctcaaaaaccgaggtgaaaaagacaagacgacctcgttctgttcttaacacccaacccgaacagacaaacgccggtgaggttgctagctctctgagttcaacagagattaggcgccacagccaaaggcgccatacctctgctgaggaggaagaaccgcctccggtaaagatagcctggaagaccgctgctgcgagaaagagtcttcccgcaagtatcaccatgcataaaggatccttggacctgcagaaatgcaatatgtcacccgtggttaagatcgagcaggtctttgccctccagaacgcgacgggagacggtaagttcatcgatcagttcgtctactcaacaaaaggaattggaaacaaaaccgaaatctccgtccgcggtcaagacaggctcatcatttccacccccaatcagcggaatgagaaacccacccagtccgtctcctcccctgaagcaacatccgggtctacagggagtgtcgagaagaaacaacagcggaggagcattcgtactcgcagcgagtccgagaaatccaccgaagttgtgccgaaaaaaaaaatcaaaaaagagcaggtggagaccgttccccaagcaacggtcaaaacgggacttcaaaaaggcagtgccgacaggggagtgcaaggctcggtccggttttctgattcgtccgtgtcagccgctatcgaggagactgtcgactag

SEQ ID NO: 246946 - DNA, 4314 bp, Artificial Sequence
  Description of Artificial Sequence: Synthetic coding sequence
atggacttctcgttcagtttcatgcagggaataatgggcaataccatccagcagccccctcagctaatcgattccgctaacatcagacaagaggacgcatttgacaataatagtgatatcgctgaagacggcggacaaacgccatacgaagctacactgcaacagggcttccaatatccagccaccaccgaggacctgcctccactaactaacgggtaccccagcagcatttctgtgtacgaaacccagacaaaatatcagagctacaaccaataccctaatggctccgcaaatgggtttggcgctgtcaggaatttcagtccaacagattattaccactctgagattccaaatacccgccctcacgaaatcttggagaagccctctccgcctcagccccctccaccccctagcgtgcctcagactgtgattccaaagaaaacaggctccccagagataaagctcaagatcaccaaaaccattcaaaatgggagggaactgtttgagagcagtctgtgtggagacctgctgaacgaggtgcaggcttccgagcacaccaagtccaaacatgaaagtagaaaagaaaaaagaaaaaagtctaataaacatgattcgtcccgtagcgaagaaaggaaatcccacaagatcccaaagcttgaaccagaggagcagaatcgcccaaacgagcgagtggacacagtgagcgagaaacccagggaagagcctgtactgaaagaagaagcccctgtgcagcctatactgtcgagtgtgccgacaactgaagtgtcaacaggagtcaaattccaggtcggtgacctggtttggtcaaaggtgggcacttacccgtggtggccatgtatggtttcctccgacccacagctggaggttcacactaagatcaacaccaggggcgctagagaataccatgtgcaattcttctcaaatcagccagaaagagcttgggtacatgagaagcgcgtaagagaatataaaggacataaacagtacgaagagcttctggcagaggccacaaagcaggcctccaatcactcagagaaacaaaaaatacgaaagccacggcctcagagagagagagcccagtgggatattggaatcgcccacgctgagaaggccctgaagatgacccgcgaagaacgcattgagcagtatacatttatctatattgataaacagcccgaggaagccctgtcgcaggctaagaaatctgtggcctccaaaaccgaagtgaaaaagacacgaaggccgagatcagtgcttaacactcaacccgagcagacaaacgcaggcgaagtggcatcgagcctgtctagcacagaaatccggagacactcccagcggagacatacttctgcagaggaggaggagcccccacctgtcaaaatagcctggaaaaccgccgcagcacggaagagtctgccagcctcaatcaccatgcacaaaggtagtcttgacctgcagaaatgtaacatgagccccgttgtgaaaatcgaacaagtattcgccctgcagaacgcgactggtgatggaaagttcatcgaccaattcgtgtacagtaccaaaggaatcggtaacaagaccgagatctctgtccgcggtcaagatagattgattatctccaccccgaatcagcgtaatgagaaacctacacagtcggtgtcgagccctgaagccacttctggatccacaggctccgttgagaagaaacagcagagacgtagtatccgaacccgaagcgaatccgaaaaaagtacggaggtagtccccaagaaaaagatcaaaaaggagcaagtagaaactgtgcctcaggccacagtcaaaaccggactgcagaagggcgcttccgagattagcgattcctgcaagcctttgaagaagagatctcgggcttccaccgatgttgagatgacatcgtcagcctatagagacacgtccgattccgacagtcgcggtctgagtgatcttcaggtaggttttggcaagcaagtagattcccccagcgcaactgccgacgcagatgtctcagacgtccagtcaatggatagctctctgagccgacggggaacaggaatgtctaaaaaagacaccgtttgccagatctgtgagtcatctggcgactccctcatcccctgcgagggtgagtgctgcaagcatttccatctcgaatgtttgggcttggcctctctgcccgactccaagtttatatgcatggagtgtaagacagggcagcacccttgcttttcctgtaaagtcagtgggaaagatgttaagagatgcagcgtcggagcttgtgggaaattttaccacgaggcatgcgttagaaagttcccaacagcaattttcgaatccaaaggctttcggtgtccccaacattgctgcagcgcatgtagtatggagaaggacatccacaaagcgagcaaaggacgcatgatgagatgtttgcgatgccctgtggcatatcattcgggagacgcctgtatcgcagcgggatctatgctggtttccagctatattcttatctgttctaatcatagtaagcgctcgagtaactcttctgccgtgaacgtcggattctgttttgtgtgtgcaagagggctgatcgtccaggatcactccgatcccatgttcagctcctacgcctacaagtctcactacctgctcaacgagtccaatagggcagaactcatgaagcttcctatgattccttcctcgtcggcgtcaaaaaagaagtgcgagaaagggggtcggttgctgtgttgcgagtcctgtcctgcctcattccacccagaatgcctgtccatcgaaatgcctgagggctgttggaactgtaatgactgcaaagcaggaaagaaactccactataagcagatagtctgggttaaacttggtaactatagatggtggccagcagagatctgtaatccccgtagcgtgcctctgaacattcaagggctgaagcacgatctgggcgatttccccgtgtttttttttggctctcacgattactattgggtccaccaagggagagtgttcccctacgtggagggcgataaatccttcgcagaggggcagaccagcatcaataaaacctttaaaaaggcccttgaggaggcggctaaaagatttcaggaactaaaagcccagagagaatccaaggaggccctggagattgaaaaaaactctcggaagcctcccccatacaagcatatcaaagcaaacaaagtgattggtaaagtgcagattcaagttgccgacctgtctgaaatcccgcgttgtaattgtaagcccgcagacgaaaatccctgtggactggaaagcgaatgtttgaacagaatgctgcaatatgagtgccacccccaggtttgccctgccggagaccgctgtcagaaccaatgctttacaaagcggttgtatcccgacgcagagattatcaagaccgagaggagaggatggggtttgcgaaccaagcggagtattaagaaaggggaattcgtgaacgagtacgtgggcgaactgatagatgaagaagagtgccgcctgagaatcaaacgcgctcacgagaacagtgtcactaacttctatatgctcaccgtgactaaggaccgtataatcgatgccggaccaaagggaaattattctagattcatgaaccacagctgtaatcctaactgcgaaactcagaagtggaccgtcaacggagatgtgcgcgtgggccttttcgcattgtgcgatattcccgctggaatggaactcacttttaactataacctagattgcctgggtaacgggagaacagaatgtcactgtggtgccgataattgctcaggcttcctaggggttcggccaaagtcagcctgtgcctcaacaaatgaagagaaggccaaaaacgctaagctgaaacagaagcgcagaaaaataaaaactgaacccaagcagatgcacgaagactattgtttccagtgtggggacggcggagaactcgttatgtgtgataaaaaagactgtcctaaggcttaccaccttttgtgtctgaacctgactcagcccccttatggaaaatgggagtgtccgtggcatcaatgcgatgaatgcagcagtgccgctgtgtcgttttgtgaattctgtcctcattccttctgcaaggaccatgaaaagggggcactcgtcccgtctgccctggaagggagactctgctgcagtgagcatgaccccatggcaccagtgtctcctgaatattggagcaaaataaagtgtaagtgggaatcacaggatcacggcgaagaagtaaaagagtag

SEQ ID NO: 246947 - DNA, 4167 bp, Artificial Sequence
  Description of Artificial Sequence: Synthetic coding sequence
atggacttttcatttagcttcatgcaaggaattatggggaacaccattcaacagccaccccaactcatcgactccgcgaacatccgccaggaagacgcgttcgacaacaactctgatattgcagaggacggcggtcagactccttacgaggctacactacagcaaggctttcaatacccggctaccacagaggacctgcccccactgacaaatggttacccttcctccataagtgtctatgagactcagactaaatatcagtcatacaaccagtatcccaatggctccgctaacgggtttggcgcagtgcgtaatttcagcccaaccgactactatcactcagaaatacctaatacccgaccacatgagatcctggaaaaaccttctccgcctcagccacctccacctccaagcgtcccgcagaccgtgattcccaaaaagacgggcagccctgagattaaactcaagattacaaagaccattcagaacggcagggaactgttcgaatcatctctgtgtggggatctcctgaacgaagtgcaggcctccgagcacacaaagtcaaagcatgagtcccggaaggaaaagcgaaagaaatctaataaacacgacagcagtcgtagtgaggaacgaaagtcacataaaatcccaaagcttgagcccgaggagcagaatcgtcccaacgagcgcgttgataccgtttctgaaaaacccagagaggagcctgtgctgaaggaagaggcacccgtgcagcctatcctctcctcagttcctaccacagaggtctccaccggcgttaaattccaggtaggtgacctcgtctggtcgaaggtcgggacctacccttggtggccttgcatggtctcttcggacccgcagctcgaggtgcacacaaaaattaatacaaggggagctcgtgaatatcacgtccagttcttctcgaaccaacccgagcgcgcttgggtccacgaaaaacgggtgcgcgagtataaggggcacaaacagtacgaggagcttctcgctgaggcaaccaagcaggctagtaatcactcggagaagcagaagatccgcaagccacgccctcagcgtgagagggcacagtgggacattggcattgcgcacgcagaaaaggccttgaaaatgaccagagaggaacgcattgagcaatacacctttatctacatcgacaagcagcccgaggaagcactcagccaggctaagaagtctgtagccagcaaaacggaagtgaagaagactcgcaggcccaggtctgtgctcaatacccagcctgagcagacgaacgcgggagaagtggcctccagcctgtctagcacagagattaggcgccatagccagcggagacatacctcggctgaagaggaggaaccaccgcctgtaaagatagcctggaagaccgccgctgcgaggaagagcctgcctgcttccatcactatgcataagggttctctcgacctccagaaatgcaatatgtcccccgtcgtcaagattgaacaggtgtttgccttgcagaatgcaaccggggacggcaaattcatcgatcaatttgtgtactccactaaaggaatcgggaataagaccgagatcagcgtgcggggacaggataggctgattattagtacacccaatcagagaaatgaaaagcccacccagtctgttagttctccagaagctaccagtggatcaaccggatccgtagagaagaagcagcaaaggagatccatccggacacgctccgagtctgaaaaatccaccgaggtagtccctaagaaaaaaatcaaaaaggagcaggtggagaccgtcccccaggctaccgtgaaaactggactgcagaaaggggcttctgaaatttccgactcttgtaaaccactgaaaaaaagatctcgggcttccacagatgtggagatgactagcagcgcctacagggatacttctgacagcgactctagaggcctctccgatctccaggtgggatttggcaagcaggtggattcccccagcgccaccgccgacgcagatgtgagcgacgtacagagtatggactcttccctgagtaggcgtggtaccgggatgtccaagaaggacacagtgtgccagatctgtgagagctccggggactcattgataccttgtgagggcgagtgttgcaagcattttcacttggagtgtctcggactggcatccctacccgactccaagttcatatgtatggaatgcaaaacagggcagcacccttgtttttcctgtaaagtcagtggtaaagatgtgaaacgctgcagtgtgggtgcttgtggaaagttttaccatgaggcatgtgtaagaaagtttcccactgcaatttttgagagcaaaggcttccggtgcccccagcattgctgctcagcttgcagtatggagaaagatatccacaaggcctccaagggacggatgatgagatgcctgagatgtcccgtcgcttaccacagcggtgacgcctgtattgctgccggatcaatgcttgtaagcagctacattctcatctgctctaaccattctaagcgttcttccaacagttcagccgtgaacgtaggattttgctttgtgtgcgcaagaggtggcagactgctttgctgtgagtcttgtcccgctagtttccatcctgaatgtttgtctattgagatgccggaggggtgttggaattgtaacgattgtaaggctggaaaaaaactgcactacaaacaaatcgtatgggtcaagctggggaattacaggtggtggcccgctgaaatttgcaaccctcggagtgtgcccttaaacatccagggacttaagcacgatctgggcgattttccggtcttttttttcgggtcacacgattattattgggtgcatcaggggagggtgtttccttatgtggagggggacaaaagtttcgcagagggccagacatctatcaacaagacgttcaagaaggccctcgaagaggccgcaaaacgcttccaagagctcaaggcccaaagggaatcaaaggaagccctcgaaattgagaaaaactctcgcaagccacccccttacaaacatataaaggcaaacaaagtcatcggaaaggtgcagatccaggtcgcagacctcagcgagattccccgatgcaactgcaaacccgctgatgagaacccgtgtggacttgagagtgagtgtttgaatcgcatgctacaatatgaatgccatccccaggtgtgtcctgctggagaccggtgccaaaatcagtgcttcaccaagaggttgtaccctgatgcggagatcattaaaaccgaacggagaggatggggactgcggactaagcggtctataaagaagggggaatttgtgaatgagtatgtgggggagctaatcgacgaggaggagtgtcgccttcggattaagagagcgcacgaaaacagtgtgaccaacttctatatgttgaccgttactaaagataggattatcgacgcgggtccaaagggtaattactctcgtttcatgaaccattcatgcaaccccaattgtgaaactcagaaatggacagtcaacggggatgttcgggtgggtctcttcgccctgtgcgatattccagcaggaatggagctaacctttaattataacctcgactgtctggggaacggcagaacagagtgccactgcggcgcagacaattgcagcggatttctgggcgtgagacctaagagtgcctgtgctagcaccaacgaagaaaaggccaagaacgcaaaactgaagcagaagaggcggaagataaagaccgagccaaaacagatgcacgaagattattgttttcagtgtggcgacggtggcgagctagtcatgtgcgacaaaaaggactgccccaaggcatatcatctcctttgcctcaatctcacccagccaccttatgggaagtgggagtgtccttggcaccaatgtgacgaatgcagctcagctgccgtctccttctgcgaattctgcccacatagcttctgcaaggatcatgaaaaaggcgctcttgttccatctgctctcgagggcaggctgtgttgcagcgaacatgaccccatggccccagtgtctccggagtactggagcaaaataaaatgcaaatgggagtcccaggatcacggggaagaggtgaaagaatag

SEQ ID NO: 246948 - DNA, 4125 bp, Artificial Sequence
  Description of Artificial Sequence: Synthetic coding sequence
atggatttcagctttagctttatgcaaggaattatgggcaataccattcagcagcccccacagcttattgattctgccaatatccggcaggaggatgccttcgataacaactctgatatcgctgaggatgggggacaaactccctatgaggccacactgcagcagggtttccagtatcccgctactactgaagatttaccacccctacctccaccacctccctccgtccctcaaaccgtgatacccaagaaaaccgggtcacccgagataaagcttaagatcactaaaactattcagaacggaagggagctatttgaaagcagcttgtgcggcgatctgctaaatgaggtgcaggcaagcgagcacactaagtccaagcacgaaagcagaaaagaaaaacgcaaaaaatctaataaacatgacagttcaagatctgaggagagaaagtctcataagattcccaagctggaacctgaagaacagaaccgtccgaacgagagggtggatacagttagcgaaaagccaagggaagaacccgtcttgaaagaggaggctcccgttcaacctatcctcagctcagtgcctacgactgaggtgtctacaggtgtgaaattccaggtaggagatctggtttggagtaaggtcgggacctacccctggtggccctgtatggtcagctccgatccacagctggaagtgcatactaagatcaatacaagaggtgcccgtgagtatcatgttcagttcttctccaatcagccagaaagagcctgggtgcacgagaaacgagttagagagtataagggccacaagcagtacgaggagttactagccgaggccacaaaacaagcaagcaaccacagcgagaaacagaaaattcggaagcccaggccccagagagagcgagctcaatgggatattgggatcgcacacgcggaaaaggccctcaagatgacaagagaggagcggatagagcaatacactttcatctacatcgacaagcagccagaagaagctctatctcaggcgaagaagagtgttgcaagcaaaaccgaggtgaaaaagacccgcagaccccgttctgtcttgaacacacagcccgagcagactaacgccggagaggtcgcaagctccttgtctagcacagagatccggcgacactctcagaggcggcacacgtctgccgaagaagaagaaccaccgccagttaagatcgcctggaagaccgcagcagcccgaaagtcccttccggcttctatcacaatgcacaaagggagtctggaccttcaaaaatgtaacatgagccctgtcgtgaagatcgagcaggtgtttgcgttgcagaatgccacgggggatggtaagtttatagatcagtttgtgtactctaccaaggggatagggaataagactgaaatcagtgtacggggacaggaccgcctcattatctctaccccgaaccagcgcaacgagaaacccacccaaagcgtgtcttcgcctgaagccacgagtggatccaccgggagtgtggagaagaaacagcagcgtcgctcaatccgaacacgttcagaatctgaaaaatctactgaggtcgtgccaaaaaagaagatcaaaaaggaacaggtcgagaccgttccgcaggcaactgtaaaaacagggctccagaagggcgcttctgaaattagtgacagctgtaagccgctcaagaaacgtagccgcgcatcaactgacgtcgaaatgacgagtagcgcttacagagacacctctgacagcgactcacgaggattgtccgatcttcaggtgggcttcggaaaacaggtcgatagtcccagtgccacagcagatgctgacgtgagcgatgtccagtccatggacagctctttaagtagaaggggcactggtatgtccaaaaaggacaccgtgtgtcagatttgcgagagctctggggattccctgatcccttgcgagggcgaatgttgcaaacattttcatctggagtgcctcggactcgctagtcttccagattctaaatttatctgcatggaatgcaagacggggcagcatccctgcttttcctgcaaggtctccgggaaggacgtaaaaaggtgctctgtgggcgcatgcgggaaattttatcatgaggcctgtgtgcggaaattcccaacagccattttcgaaagcaaagggttcaggtgtccacagcactgctgctctgcctgctctatggaaaaggacattcataaagcttcgaagggccgaatgatgagatgcttacgttgtcctgtggcttaccactcgggagacgcctgcattgccgctggcagcatgcttgtgtcttcttatattctcatctgttcgaaccactccaagcgctcctctaactcctctgccgtgaatgtaggcttctgcttcgtgtgcgctagaggactgatcgttcaggatcattcggacccaatgttcagttcttatgcatacaagtcccactatctgttaaacgagtcgaaccgcgctgaactgatgaagcttcctatgataccgtcttccagcgcatctaaaaaaaaatgtgagaaaggcggaagactactgtgctgtgaatcatgtccagcgagttttcatcctgagtgcctcagcattgagatgcctgagggctgttggaattgcaatgactgtaaggctgggaagaagctccactacaaacagattgtatgggtgaagcttggcaattaccgctggtggcccgctgagatctgcaaccccagatctgtgcccttgaatattcaaggcctcaaacatgatctgggggactttcccgtgttcttttttggctctcatgactattactgggtccaccaaggacgggtatttccatacgtggagggcgataagagtttcgctgaaggccagacgtccataaacaagacctttaaaaaagcactggaggaagccgctaagcggtttcaggaactcaaagcacagcgcgaatcaaaagaagctcttgagattgaaaaaaatagccggaaaccgcctccatataagcatatcaaagccaataaggttattggaaaggttcagatacaggttgcagatctatctgagatcccacggtgcaattgcaaacccgcagacgagaacccctgcggcctggagagcgagtgcctgaacaggatgctgcaatacgagtgtcacccgcaggtgtgtcccgcaggagatcgctgtcagaatcagtgttttactaagagactgtatcccgatgctgaaatcattaagacggaacgcaggggatggggcctccgtaccaagcgatctataaaaaagggtgaatttgtcaatgaatacgtgggcgagctcatcgatgaggaggagtgtcgcttgcgcataaaaagagcgcacgaaaactctgttacaaacttctatatgctcacagtgacaaaggaccgcatcatcgacgccggacctaaaggcaactattcacgatttatgaaccactcttgtaatcctaactgcgaaacccagaagtggacagttaacggagacgtaagggttggtctgttcgccttgtgcgacatccccgcagggatggagttaacctttaattacaacctggattgtctgggtaacggcaggacggagtgccactgtggggcagacaattgctcagggtttcttggtgtgcgcccaaagagcgcctgtgcctccaccaatgaggagaaggccaaaaatgccaagttgaaacagaaaagaaggaagattaaaacagagcctaagcagatgcatgaagactattgcttccagtgtggcgatggaggcgaactcgtcatgtgcgataagaaagactgtcctaaagcctatcatctcctgtgtctgaatcttacccaacctccatatggaaagtgggaatgcccctggcaccagtgcgatgagtgcagttccgcagccgtgtctttttgcgagttctgtccccacagtttctgcaaagatcacgaaaaaggcgctcttgtaccatctgcactcgagggcaggctgtgttgtagtgaacatgatccaatggcaccggtgtctcccgaatactggtccaaaattaaatgcaagtgggaatctcaggaccacggagaagaggtaaaggagtag

SEQ ID NO: 246949 - DNA, 4281 bp, Artificial Sequence
  Description of Artificial Sequence: Synthetic coding sequence
atggacttctccttttcatttatgcagggcatcatgggcaacacgatacaacaaccaccacagctgattgatagcgctaacatcagacaggaggacgccttcgataataactctgacatcgctgaggatggtggtcagaccccctacgaggctacgttgcagcagggatttcaatatccagccaccacagaggatctgcctccgctgaccaacggctacccgagctctatatccgtttacgaaacacaaacaaagtaccagtcttacaatcagtaccctaatgggtcagccaatgggttcggggctgtcaggaatttctctcctactgattattaccattccgaaataccaaacaccagaccccatgagattctggagaagccgtcacctcctcagcccccaccacccccttcagtcccccagactgtgatccctaagaaaactggttccccagagatcaagttgaaaataaccaagaccatccaaaacggtcgggaattgtttgagagctccttatgcggcgaccttctgaacgaggttcaggcatcggagcacacaaaatccaagcacgagagccggaaggagaagcggaaaaagtccaataaacacgattccagcaggtccgaggaacgaaaaagccacaagattcctaagcttgagccagaagagcagaatcgccctaatgagcgcgtcgataccgtgagcgaaaagcccagggaggaaccagtgctgaaggaggaggcgcctgttcaaccaatcctcagttccgtgcccactaccgaagtatctaccggagtaaagttccaagttggggaccttgtctggtcaaaagtggggacctacccctggtggccctgcatggtgagttctgatcctcagttagaagtccacaccaaaattaacacaaggggggcaagagaatatcatgtccagttcttcagtaaccagccggaacgcgcatgggttcacgagaaacgcgtgagagaatacaaagggcacaaacaatatgaggaactcctggctgaggcaacaaagcaagccagtaaccactcggagaagcaaaagattcggaagcccaggccacagagagagcgggctcagtgggacatagggattgctcatgcagagaaggccctgaagatgacaagagaagagcgaatcgaacagtatacctttatttacattgataagcagccagaggaggccttaagccaggcaaagaagagcgtggctagcaagaccgaggtcaagaaaacacggagacccagaagcgtcttaaatactcagcccgagcagacaaatgcgggagaggtggcttcttcgctaagcagcaccgagattaggaggcactcacagagaaggcacacttcagccgaagaggaagagccacctcccgtcaagattgcatggaaaactgccgcagccagaaaatctcttccagcctccataacaatgcacaagggcagcctcgatcttcagaaatgcaacatgagcccagtcgtgaaaatagaacaggtgtttgctctgcagaacgcaaccggagacgggaaatttattgatcaattcgtgtatagtactaaggggatcgggaacaagaccgaaattagcgtgagaggacaggatcggttaatcatcagtactcctaaccaaagaaacgagaaaccaactcaatccgtgagttcaccagaagcgaccagcgggtccacggggtccgtcgagaagaaacagcagcggaggtccattcgcactcgttccgaaagcgagaaatctacagaggtcgtgccaaagaagaagataaaaaaggaacaggtcgaaaccgtccctcaagcgactgtgaaaactggcctgcagaagggtgcatctgagatttccgactcttgtaaacctttaaaaaagagatcccgagcttccactgatgtggaaatgactagctctgcctatcgagatacaagcgattctgacagccgtggtctctccgatttacaggtgggctttggaaagcaggtggattctccatcagctaccgctgacgcagatgtgtctgatgtgcagtctatggactccagtctgtctcgaagaggcacaggcatgtctaagaaggacacagtctgccagatttgcgagtcctctggggactccttaatcccatgtgagggcgagtgctgtaaacacttccacttagagtgcctgggcctggcatctctccctgactcaaaattcatctgcatggagtgtaaaaccggtcaacatccctgcttttcctgcaaggtgtctggcaaggacgttaaacgctgttctgtgggtgcctgcggcaagttctatcacgaggcctgtgtgcgaaagttcccgacagctattttcgagtctaagggttttagatgcccacagcattgctgttctgcatgtagcatggagaaagatatacacaaggcaagtaagggaagaatgatgcgatgtctcaggtgtcccgtcgcataccactcaggagacgcctgtatcgccgctgggtccatgctggttagctcgtatatcctgatctgttccaatcactctaagcgttccagtaatagtagcgctgtcaacgtgggattctgttttgtgtgcgctaggggcctcatcgtccaggaccacagtgatcctatgtttagctcttacgcttacaaatctcactacctcctcaatgaatccaaccgtgccgagctgatgaagctgccgatgatcccctcaagctcagcgtccaaaaagaagtgcgagaagggcggaagattattatgttgcgaatcgtgccctgccagcttccacccagaatgcctgagcattgagatgcccgaagggtgctggaactgtaatgattgcaaagctggtaaaaaactacactacaaacagattgtctgggtgaagttgggaaattaccgctggtggcccgctgaaatctgtaatcccagatccgtaccgcttaatattcagggtctcaagcatgatctcggcgacttccccgtgtttttctttggcagccatgattactactgggtgcatcagggtagagtattcccctacgtggaaggagataagagcttcgccgaaggccaaacctcaattaacaaaacatttaagaaggcacttgaggaagcagctaagcgctttcaggagctgaaagctcagagggagtcgaaagaggctctggagatcgagaaaaactcgcgaaaaccccctccgtacaaacatatcaaggctaacaaggtgatcggtaaagttcagattcaggttgcagatttgagcgaaattccaagatgcaattgcaagcctgcggacgagaacccttgcggattggagagtgaatgtctcaaccggatgctccagtacgagtgccatccacaggtatgtccagccggagatagatgtcagaatcagtgcttcactaagcgtctttatccggatgccgagatcattaaaacagagagaagggggtggggcctccgtaccaaacgcagcattaaaaagggggaattcgtgaatgagtatgtcggcgaattaatagacgaggaagagtgtcggttgcggatcaaaagagcccatgagaattccgacaggataattgatgccggacccaaaggtaactactccaggttcatgaatcactcttgcaatcccaactgcgagacccagaaatggaccgtgaacggggacgttcgagtaggactctttgcactttgcgacatccctgccggaatggagttaacattcaattataatctggactgcctggggaacggcagaactgagtgtcattgcggggcagacaattgctctgggttccttggtgttagacccaagagtgcctgcgcgtctaccaacgaggaaaaggccaagaacgcgaaactgaagcagaagcggagaaaaattaagactgaacccaagcagatgcacgaggactactgcttccaatgcggggatgggggagaactcgtaatgtgtgacaaaaaggactgtcctaaggcctatcatctcctgtgtctgaatcttacccagcctccatatggcaaatgggaatgtccatggcatcagtgtgatgagtgtagcagcgccgcagttagcttttgtgaattttgtcctcactccttttgcaaggatcatgaaaaaggcgcactcgtgccgagtgcactggaaggaaggttgtgttgttccgaacatgaccccatggcccctgtctctcccgaatactggagtaagatcaaatgcaagtgggagtctcaggatcatggggaggaggtgaaagagtag

SEQ ID NO: 246950 - DNA, 849 bp, Artificial Sequence
  Description of Artificial Sequence: Synthetic coding sequence
atggatttctcatttagctttatgcaaggtataatgggcaataccattcagcagccccctcagctgattgacagcgctaatatcagacaagaagatgcattcgataacaattctgacattgcagaagatggcggacagaccccatatgaagcaacactgcaacagggctttcagtatcccgcaaccacagaagatctgccccctctcacaaacgggtacccatcctccattagtgtgtatgagacgcagacaaagtaccagtcctacaaccaatacccaaatggatctgcaaatggcttcggagcagtgcgaaatttcagccccacagactactatcactcagagataccaaacacacgccctcatgagatactggagaaaccgagccctccccaacctccaccccctccctctgttcctcagaccgtgattcccaagaaaacggggtcccccgaaataaagctcaagatcactaaaaccattcagaatggtagagagttgtttgaatcatcgttatgcggggatctcctgaatgaagtccaagccagcgagcacactaaatctaagcacgagtccaggaaggaaaagcgtaaaaaatcaaacaaacatgactcatccaggtctgaagagcgaaaaagtcacaagatcccaaagttggagccagaagagcaaaatagaccgaacgagagggtcgacaccgtgtccgagaagcctagagaagaacccgtgctgaaagaggaagcccctgtccagcctatcttgagcagcgtgccaaccactgaggtgagtaccggtgtgaagttccaagtgggagacttggtgtggtctaaagtcgggacatatccctag

SEQ ID NO: 246951 - DNA, 78 bp, Artificial Sequence
  Description of Artificial Sequence: Synthetic coding sequence
atggactttagcttcagctttatgcagggcataatgggaaataccattcagcagcccccacagctgatcgactcttag

SEQ ID NO: 246952 - DNA, 48 bp, Artificial Sequence
  Description of Artificial Sequence: Synthetic coding sequence
atggatttcagcttctcgtttatgcagggaattatggggaacacctag

SEQ ID NO: 246953 - DNA, 1620 bp, Artificial Sequence
  Description of Artificial Sequence: Synthetic coding sequence
atgccgggacagaggagagcactgtcaccaaaaatggcttctatgcgagagagcgacactgggctgtggctgcataacaaattgggggcaaccgatgagctgtgggccccaccttccatcgcgtcactccttaccgccgctgtgatcgataatattaggctgtgctttcacggtctgtcctcggccgtcaaattaaagctgctgctaggaaccctccatctgccacgtcggactgtggacgaaatgaaaggtgccctcatggagattattcaactggcatccctagattcagatccatgggtgctgatggtggccgacatcctgaaaagcttcccagacacaggctctctgaacctcgagctggaggaacagaacccgaacgtccaagacattctcggtgagctacgagagaaggtcggagagtgtgaggcctcagcaatgctgccactggagtgtcagtacttaaataaaaacgctctgacgacactggctggtccgttaacccctccggtgaagcacttccagttgaaacggaaacctaagagtgccacacttcgggcagaactgctccagaagtctactgaaactgcccagcagcttaaaaggagcgcaggcgttccatttcatgcaaaggggcgaggcctactgagaaaaatggataccaccactcctctcaaggggattcccaagcaggccccttttagatcccccacagccccatctgtttttagtcctaccggtaaccgcacacctatacctccttctagaacgctgctccgcaaagaaaggggggtgaaactcctcgatattagcgagctagacatggtgggggctgggagagaagccaagcgacgcaggaagactctcgacgctgaagttgttgagaagccagccaaggaggagactgtggtggagaacgccacacccgattatgcagcaggtctcgtcagtacacagaagcttggatccctgaataatgagccggctctgccaagtacgtcttatctccccagcacgcccagcgtagttcccgcaagttcctatatccctagttcagagactcccccagcccctagctcacgcgaagcttcacgccctccagaggaacccagcgcacctagccctacactgcccgctcagttcaaacagcgggcacctatgtacaactcggggctttctcccgcaactccaacccctgctgctccaaccagtcctctgacccctacaacgccccctgccgtcgctcctactacccagaccccacctgtcgcaatggttgcccctcagacccaggctcctgcgcaacagcagcccaaaaaaaacctctcattgacgagagagcaaatgttcgcagcccaggaaatgtttaagaccgcgaataaagtcactcgccctgagaaagcactgatacttgggtttatggccggttcacgggaaaatccttgccaagagcagggtgatgtcattcagattaagctgagcgagcatacagaggacctccccaaggcagacggacagggcagtacaactatgctggttgacacagtgttcgagatgaattacgccaccgggcagtggaccaggttcaagaagtacaagcccatgacgaacgtgtcttag

SEQ ID NO: 246954 - DNA, 1587 bp, Artificial Sequence
  Description of Artificial Sequence: Synthetic coding sequence
atggcctctatgagagagagtgatactggcttgtggcttcacaataagctgggagccacagatgaactctgggcgccaccgagtatagccagtttgctgaccgccgctgtcatcgataacattcggctctgcttccatggattgtccagcgcagtcaaactgaaacttcttctcggcaccctgcatctgcctcgcagaaccgtggacgagatgaaaggagcgttgatggagataattcaacttgcatccctggactccgatccatgggtgctcatggtggcggacatcctgaaatcctttcccgataccggctccctgaacctcgaacttgaggaacagaacccgaacgtccaggacattcttggcgagttgcgggagaaggtcggagagtgcgaggcttccgcgatgctgccactagagtgccaatatctcaataagaacgcgctaaccactctcgccggacccctcacaccccctgttaagcacttccagctgaagcgcaaaccgaagagtgccacactgcgcgcagaattgctgcagaagagcaccgagactgcccagcagttgaagcgctccgccggtgtcccctttcacgccaaagggagaggactcctgcgcaagatggatactacaacaccactcaaaggcataccgaagcaagctccctttaggagtcctacggctcccagtgttttctccccaacaggaaatagaacaccgatcccccctagcagaacgttactaagaaaggagcgcggagtgaagttgctggatatttctgagctcgatatggtgggcgcaggcagggaagctaagcggagacgaaaaacattagacgctgaggttgttgaaaaacctgccaaagaggagactgttgtggagaatgccactcccgactatgccgctgggctagtctcaacacagaaactcggctctttaaataacgagccggctttgccctctacgtcctatctgccaagcacccccagcgtagtgcctgcttcttcatacatcccgtcaagcgagacacccccagccccttcttctcgggaggcgagtagacctcctgaagaaccttctgcaccttctcctactttgccagctcagttcaagcagcgcgcacctatgtacaactcaggactctcaccagcaacccctactcccgcagcccctacctcacccttaaccccaactacaccgcctgctgtggccccaacaacccagacccctcctgtagcgatggtggcacctcagactcaggctcctgcccagcaacagcccaaaaaaaatctgagccttacgcgcgagcagatgttcgccgcacaggagatgttcaagacggctaataaggttacaaggccagagaaagcccttatcctgggctttatggcagggtccagagagaacccttgccaggagcaaggcgatgttattcagatcaagctcagcgaacacacggaggatctccccaaagctgatgggcaggggagcactaccatgctggtcgacactgtgtttgaaatgaattatgctaccggccagtggacaagattcaagaaatacaagcccatgacaaacgtcagttag

SEQ ID NO: 246955 - DNA, 1182 bp, Artificial Sequence
  Description of Artificial Sequence: Synthetic coding sequence
atgctccccctagagtgtcagtacttaaacaagaacgcacttactaccctggcgggtccactcacgccccctgtcaaacattttcagctcaagaggaaacctaaatcagccaccttgagggccgagctgctgcaaaaaagcaccgaaactgcccagcaattgaagcggagcgctggggttcccttccacgccaagggcaggggcctcctgaggaagatggatacaacgaccccacttaaggggattcctaagcaggccccttttaggagccctaccgctccttccgtcttttcacccaccgggaaccggacgcctatcccaccctccagaaccttactcaggaaggaaaggggtgtgaagctactcgatattagcgagctggacatggtgggagccggaagagaggccaaaaggaggagaaaaacactcgacgctgaggtggtggaaaaacccgcaaaagaagaaactgtcgttgagaatgcgacccccgattacgcagctgggcttgtctcaacccagaagctgggctcactaaacaacgagcctgcactgcctagcaccagctacctccccagcactccctcagtagttcctgcgtcctcgtatatcccctcaagcgaaacccccccagccccttcatcccgcgaggcatcacggcctcccgaggaaccgtcagcaccatctcctacactgccagcacagtttaagcagcgcgctccgatgtataacagtggcctttctccagccacccccactccggctgcacccacctctcccctgaccccgaccacaccacccgctgtcgcccctaccacccagacaccaccagttgctatggtggcaccacagacgcaagctcccgcacagcaacagcccaagaagaacctttctctgacaagagaacagatgtttgctgcacaggaaatgttcaaaacagccaataaagttacacgcccagagaaggcactgatcctgggatttatggcgggatcacgtgagaacccctgtcaggaacagggcgacgtgatacaaatcaaactctctgagcatacagaggatttacccaaggccgacggccaaggcagtaccacaatgttggtggacacagtgttcgagatgaactacgccactggacagtggacgagattcaagaagtataaacctatgacaaatgtatcatag

SEQ ID NO: 246956 - DNA, 462 bp, Artificial Sequence
  Description of Artificial Sequence: Synthetic coding sequence
atgtatagaatgcaacttctatcatgcatcgccctatctttggcactggtaacaaattccgctcccacctcgtcctctactaaaaagacccaacttcagcttgagcacctcctgctggatcttcagatgatcctcaatggaatcaacaactacaagaatcctaaattaacgaggatgttaacgtttaaattctacatgccaaagaaagccaccgagctgaaacatctacaatgtcttgaagaagaactgaagccactggaagaagtgttaaacctggctcagtctaagaacttccatttgaggccgagggatttgattagcaatataaatgttatcgtgctggagcttaaggggagtgagaccacattcatgtgcgagtatgcagacgaaactgcgactatagtggaattcctgaacaggtggataactttttgtcagagcatcatctccaccttgacttag

SEQ ID NO: 246957 - DNA, 2673 bp, Artificial Sequence
  Description of Artificial Sequence: Synthetic coding sequence
atggatagcaataccgctccacttgggccaagctgcccccagcctcctccagcccctcaaccacaggctaggtctagactaaacgctacggccagtcttgaacaggagaggagtgagcggcctcgggcacccggtcctcaggcgggacctggccctggggtgagggacgccgcagctccagcggagccacaggcacaacacactcgctcgagggaaagggcagacggaaccggacccaccaaaggcgacatggagatccccttcgaggaagtactagaaagggcaaaggcaggggatcccaaagcccagacagaggtaggaaagcactacctgcagctagcgggagatactgacgaggaactgaatagttgtacggctgtggactggctggtgctggcagcaaagcagggcagaagagaagcggtgaagctactgagacggtgtctggctgaccggcgtggtattacctctgaaaatgagagggaggtgcgccagctgtctagcgagacagaccttgagcgggctgtaaggaaagctgcactcgttatgtactggaagctgaaccccaagaaaaaaaaacaagtggccgtagccgagcttttggaaaatgttggccaagtgaacgagcatgacggcggagctcagccaggccctgtgccaaagtccctccagaaacagaggcgtatgctagagaggttagtgtcgtcagagtcaaagaattacattgcgctcgatgatttcgtggaaattacaaaaaagtatgccaagggggtcataccatcatctctcttcctgcaggacgacgaggacgatgacgaattggcagggaagagccccgaggacctgcccctccggctcaaagtagtaaaatacccgctgcacgccatcatggaaattaaggaatacctgatcgacatggcttccagggccggaatgcactggctgtcaaccataattccaacccaccacataaacgcactaatttttttctttatagtgtcaaatttgactattgacttttttgccttttttatacctcttgtgatcttttatctgtctttcatctctatggtgatatgtaccctgaaggtgtttcaggactcaaaggcctgggaaaactttcggacccttaccgacctcctccttagatttgaacctaacttagacgtcgaacaggcggaggttaacttcggttggaaccatctggaaccttacgctcacttccttttgtctgtcttctttgtgatattttcgtttccgattgcctccaaggactgtataccttgctcagagttggccgtgatcactggctttttcaccgtgacctcctatctgagcctatccacccacgccgaaccctacacaaggagggcattagccacagaggtcaccgcagggttactctccctcctgcccagtatgccactgaattggccgtacctgaaagtgctggggcagaccttcattacggttccagtcggacacctagtggtacttaacgtctccgtgccttgtctgctgtatgtctaccttctgtacttgttcttccgcatggcacaattgcgcaacttcaaaggaacttactgctatctggttccatatctcgtatgctttatgtggtgcgaactgtctgtggtaattcttttagaatccactggacttggcttgctgagggcctccataggctatttcctatttctgtttgccttgcccatactggtcgctgggctcgcgctcgtgggagtcttacagttcgctcgatggttcacctccctggagctaactaagattgctgtgacagtagcagtttgttctgtgcccctgcttctccggtggtggactaaagcatcattctcagttgtcggtatggtgaagtcccttactcggtcaagcatggtcaaactcatcctcgtctggctgacggcaatcgtcctgttttgttggttttatgtgtacagaagtgaaggcatgaaggtgtacaactctacacttacttggcaacagtatggggctctctgcgggcctcgagcgtggaaagaaactaacatggccaggactcagatcctgtgctcccatcttgaaggtcacagggtgacatggacaggaaggtttaagtacgtccgagtcacagacatcgacaattcagcggaatcggccattaacatgcttccattctttatcggagattggatgcgctgtctgtatggtgaggcctatcccgcatgctcacctggaaacacgtccaccgccgaagaggagctttgccgactcaaattgctggccaaacatccgtgtcacatcaaaaaatttgaccgctacaaattcgaaattacggttggaatgccgttcagctccggcgctgatggctcaagaagccgggaagaagacgacgttaccaaagacatcgtattgcgggctagttctgaattcaaaagcgtgctgctttccctgcgacaggggagtctcatagagttcagcaccatcttagagggcagacttggcagtaaatggcctgtgtttgagttaaaggctatttcctgtctgaactgtatggcccagttgagtcccaccagaaggcatgtcaagatcgaacacgactggcggagcaccgttcacggggctgttaaatttgctttcgacttcttcttctttccatttttgtctgcagcatag

SEQ ID NO: 246958 - DNA, 807 bp, Artificial Sequence
  Description of Artificial Sequence: Synthetic coding sequence
atggttaaatccttaacccgctcctccatggtcaaattgattcttgtatggttgactgctattgtgttgttctgttggttctacgtctaccggtcggaaggcatgaaagtctataattcaacccttacatggcagcaatacggggctctctgcggcccaagggcttggaaagagactaacatggcaagaacgcagatcctttgctcacacctcgaagggcatcgggtaacctggaccggcagattcaaatatgtccgcgtgactgacatcgacaactccgccgaatcagcaatcaacatgttaccattttttatcggggactggatgaggtgcctttatggcgaagcatatcctgcttgctctccaggaaacacatcgaccgccgaagaagagctgtgccgcctgaagttattagccaagcatccctgccacataaaaaagttcgatcgttataagtttgagattacagtgggtatgccattcagctcaggagccgatggtagcagatcaagagaagaggatgatgtcactaaggatatagtgctccgggcatcatcagaattcaaatccgtgttactctcacttaggcaggggtctttgattgaattctccaccattctagagggaagactggggtcaaaatggcccgtgtttgagctgaaggcgataagctgcctgaattgcatggctcaactcagccccactcggagacacgtgaaaattgagcacgattggcggtcaaccgtgcatggcgctgtcaagtttgcatttgacttcttcttcttcccattcctgtccgccgcttag

SEQ ID NO: 246959 - DNA, 3342 bp, Artificial Sequence
  Description of Artificial Sequence: Synthetic coding sequence
atgcctagaccagagctccccttgcctgagggctgggaggaggcacgggatttcgatggcaaggtttattatattgaccacacgaatcgcaccacatcctggattgatcccagggatcgatataccaaaccactcacattcgctgactgtatttccgacgaattaccgctgggatgggaagaagcatacgatccacaggtcggggattacttcattgatcacaacactaagaccacacagattgaggaccccagggtccagtggcgacgggagcaggaacatatgttaaaggattatttggttgtcgcccaagaggccctgtctgcccagaaggaaatctatcaggtcaaacaacagaggcttgagctcgctcagcaggagtaccagcaactacacgccgtgtgggagcataagctgggaagccaggtgtccttggtatcagggtcctcatcaagtagcaagtacgaccccgaaattttgaaggccgaaattgccacagccaagagtcgcgtcaacaagcttaagagagaaatggtccacctgcagcacgagcttcagtttaaagagcgcggtttccagactttaaagaagattgacaaaaagatgagcgacgcacaggggtcctataagttggacgaagcccaggccgtgctgagggaaaccaaggcaatcaagaaagccatcacctgtggcgagaaagaaaagcaggatttgattaagagcctggccatgctgaaggatggctttagaaccgatcgcggtagccacagcgacctgtggtcctcaagcagcagcctggaatcctcctcatttcccctgcccaagcagtacttggacgttagctcccagactgatataagcggctcgtttggcatcaatagcaataatcagttagccgagaaggttagactccggctccggtatgaagaagcaaaaaggagaatcgccaacctcaagattcagctggctaagctggatagtgaggcttggcctggagttctggactccgaacgagaccgactgatccttatcaacgagaaagaagagctgctcaaagagatgcgattcatatctccaaggaaatggactcagggagaagtggagcagctagagatggccagaaaacgactcgagaaagaccttcaagcggctagagacactcagtcaaaagccctgaccgagagattaaagttgaattccaaaaggaatcaattggtccgtgaacttgaagaggcgaccaggcaggtggcgacactccattcacaattgaagtccctctcctctagtatgcagagcctcagcagcggaagcagcccaggatccctgacaagtagtcgcggttcgctggtggctagttccctggatagctccactagcgcttcatttaccgatctctattacgacccgtttgagcagctggatagtgagctccagtccaaagtcgaattcctccttctagaaggggctactgggtttcgtccgagcggctgcatcactacaattcacgaggatgaggtcgccaaaacacagaaagccgagggcggaggacggctgcaggctcttagaagcttatccggtacaccaaaaagcatgaccagtctgagcccacgctctagcttaagttctccatcacctccctgcagtcctctaatggcagaccctctgttggctggcgacgcttttttgaactctttggagtttgaagaccctgaattgtccgccactctttgtgagctgagcctggggaactctgcgcaggagcggtatcgtctggaagaaccgggtaccgaaggaaaacagctagggcaggcagtgaacacggcacagggctgcggacttaaagtggcctgtgtctctgccgctgtgtcagatgagtccgtggcaggcgattcaggagtgtatgaagcctccgtacagaggctcggtgcttcagaggcagcagcctttgactccgatgagtctgaagctgtgggcgctactcggatacagattgctttgaaatacgatgagaaaaacaaacaatttgcaattctgataattcagctgtccaacctatcggcgttactgcaacagcaagatcagaaagtcaacattagagttgcggtcctgccttgttccgagagcaccacttgtctgtttcggacacgccctcttgacgcatctgacaccctcgtgttcaacgaggtgttctgggttagtatgtcctaccccgctctgcaccagaagaccctgcgtgtggacgtatgtaccaccgacaggtcacacctggaggaatgtctcggaggagcccagatttcccttgccgaagtatgccggagcggtgaacgatccacccgctggtacaacctactttcatataagtatctcaaaaaacagagtcgagagctgaaacctgttggagttatggcaccggctagcgggccagcgtccacggacgctgtctcagccctgttggagcagactgccgtggaactggaaaagcgccaggaaggtagaagctccacccaaaccctagaagattcctggagatatgaagagacctccgagaatgaagcagtggcggaggaagaggaggaggaagtggaggaagaggaaggggaagaggacgtcttcactgaaaaggctagtccggatatggacggctaccctgcccttaaagtcgacaaggaaaccaacactgaaactccagccccatctccaactgtagtcagacctaaagacagacgcgtggggaccccatcccagggtccttttctacgcggaagtacaattatcaggagcaaaacttttagccccggtcctcagagtcagtacgtgtgtagacttaacaggagtgatagcgactcctccaccctgagtaagaaaccgccatttgtgaggaactctctggagcgccgatcagtgaggatgaaacgcccatcaagtgtgaaatccctgcgctccgaacggctgatcaggacatccctcgacctggaattggatttacaggcaaccagaacatggcactcccagctcacccaagaaatctcagttttgaaggaactgaaagagcagctggagcaggccaagagccatggcgaaaaggagctgcctcagtggctcagagaggatgaaaggttccgcctgctcctgaggatgctggagaaaagacagatggacagggccgagcataaaggcgagctccaaactgataagatgatgagagcagccgctaaggatgttcaccgcctccgcggtcagagttgtaaggagcctcctgaagtgcagtcatttcgagagaaaatggcattcttcactcgccctcgaatgaacatacccgcattaagcgccgacgacgtgtag

SEQ ID NO: 246960 - DNA, 3360 bp, Artificial Sequence
  Description of Artificial Sequence: Synthetic coding sequence
atgccacgccctgagctgcctcttccagaagggtgggaagaggctcgagatttcgacggcaaggtctactacattgaccacaccaaccgcactacttcttggattgacccaagagaccggtacactaagcccttgaccttcgctgactgcatatctgacgagctgccgctgggctgggaagaagcttatgatcctcaggtgggagattacttcattgatcataacaccaagactacccaaatcgaggaccccagggtgcagtggcgaagggagcaggaacatatgctcaaggactacttagtggtcgcgcaggaagccttgtcagcacaaaaggagatatatcaagttaaacagcaaagactggagctcgctcagcaggaatatcagcagctgcacgcagtgtgggaacataaactggggagtcaggtgagcttggtgtccggcagttcatcttcgagcaaatacgaccccgaaatcctgaaagctgagatcgccactgctaaaagcagagtgaacaagctcaagagagaaatggtgcaccttcagcatgaactccagtttaaggaaagaggctttcaaaccttaaagaagattgacaaaaagatgtccgacgcccaggggtcatataagctggacgaggcacaggcggtgctgagggaaactaaggcgattaaaaaagccattacatgtggggagaaggagaaacaagacttgatcaagtcgctagctatgttaaaggatggctttcggactgatagagggtcacattcggacttgtggagcagtagtagttcattggagagctcttcatttcccctgcccaaacagtacctggatgtttcaagccagaccgacattagcgggagtttcggaataaactcaaacaaccagctagcagaaaaggttagactgagattgcggtatgaggaggccaaaaggcgcattgccaacctgaagatccagcttgcaaagttagatagtgaggcctggccgggagttctcgactctgagcgagacaggcttatcctgattaacgagaaggaagaattgcttaaggaaatgcggttcattagtcccaggaaatggacgcagggagaggtggaacaattggagatggcccgaaaaaggttagagaaggatctccaggccgctagggatactcaatctaaggcgctgaccgagcgcttaaagttgaacagcaaacgcaaccagttggtgcgcgaactggaagaagcgactaggcaggttgctacgttgcacagccagctcaaaagcctatcttccagcatgcaaagtctgagcagtggaagcagcccgggatcactcaccagctcaagaggtagcttggtcgcgtccagcctcgactcaagcaccagtgccagtttcactgatctttactacgacccattcgagcaactggattccgaactgcagtctaaagtggaattcctcctcctagaaggcgctaccgggtttcgacccagtggctgcattacaacgatccatgaagacgaggtcgccaagacacagaaggcggaggggggtggtcgtctccaggctctcagatctcttagcggcacccctaaaagcatgactagccttagcccccgttcgagcctatcatcaccatctcctccctgctcacctctcatggccgacccattgctggccggagatgcattcctaaactctctcgaatttgaagaccctgagttgtccgctactctttgtgagttgtccctgggtaatagcgcccaggaacgatatcgtctggaggaacccggaacggagggtaagcagctcggccaggcagtgaatacagcccagggatgtggcttaaaggtggcctgtgtgtctgccgctgtaagcgacgagtcagtggccggtgactctggggtttacgaagcctcagtgcagcgcctcggtgccagcgaggccgctgccttcgactcagatgagagcgaggccgtgggggctaccaggattcaaattgccctcaagtatgacgaaaaaaacaagcagtttgcaattttgattatacagctttcaaatctgagcgctctgcttcagcagcaagatcagaaggtaaacatccgggtagcggtgctgccatgtagtgagagtacaacttgcctctttcgcactagacccctagatgccagtgacaccttagtgtttaacgaggtgttttgggtgtccatgtcctaccctgcccttcaccagaagaccctgagagtggatgtgtgtaccacagatcgaagccatctagaagagtgcctaggtggtgcgcagatcagcttggctgaagtgtgtagaagcggcgaaaggagcacccgctggtacaacctgctgagttacaaatacctgaaaaagcagtcacgcgagttgaaacccgtcggcgtgatggccccagcttccggccctgcctccacggacgccgtgtctgctcttcttgaacaaacggcagtagaactggagaagcgccaggaaggtcgtagttctacgcagacgcttgaagacagctggcgttacgaggagacctctgagaatgaggctgtggccgaggaggaagaagaagaagtcgaagaggaggaaggagaggaggatgtgtttacggaaaaggcctcacctgatatggacggatatcccgcactaaaagttgacaaagaaacaaatacagagacccccgcaccaagccctaccgttgtcaggcctaaggatcgacgcgtaggaaccccaagtcagggcccatttctgaggggttcaacaataatacggtctaaaaccttttcacctgggccacagtctcagtatgtgtgtagactcaatcgctctgactctgactcatctaccttgtctaaaaaaccccctttcgtgcgcaatagtctggagcgtcggtccgttcgtatgaaaaggccctctccacccccacagccctcttcagttaaaagtttgcgttcagaacgcctcatacggacctcccttgatttggaactggacctccaggcaacacgaacatggcattcacaactcacgcaggagatctccgtcctgaaagaattgaaggagcagcttgaacaggccaaaagccacggtgaaaaggagcttcctcagtggctccgggaagatgaacgttttaggctcttgcttcggatgctcgagaagcgccagatggacagagccgaacacaagggtgagctacagaccgacaagatgatgagagctgctgccaaagatgtgcatcgcctccgtggacagtcctgtaaggagcccccagaggtccaatctttccgggaaaaaatggctttctttacaagaccaagaatgaatatcccagcgttgtctgccgatgatgtttag

SEQ ID NO: 246961 - DNA, 438 bp, Artificial Sequence
  Description of Artificial Sequence: Synthetic coding sequence
atggcagaagtagagcagaaaaagaagagaacatttcgcaagttcacttatcggggtgtggacctggatcaactactggacatgagctatgagcagttgatgcaactctatagtgctcggcagcggaggagactgaataggggccttaggaggaagcaacactcccttttgaagaggctacgcaaagccaaaaaggaagctcctcccatggagaaacccgaggtcgtgaagacacatcttcgcgacatgatcattctgcctgagatggtcggaagcatggttggggtgtataacggaaaaacatttaaccaggttgaaattaagcccgaaatgattggccactacctgggagaattctcgattacatataaacccgttaagcacgggagacctgggatcggagccacccatagcagccgttttattcccctgaagtag

SEQ ID NO: 246962 - DNA, 786 bp, Artificial Sequence
  Description of Artificial Sequence: Synthetic coding sequence
atggcactgaacaaaaatcattcggaaggcggaggcgttatagtgaacaacactgagtctatcctgatgagttacgaccacgtagagctcacatttaacgatatgaaaaacgtgccagaggccttcaaggggacaaagaaaggaaccgtctacctcacgccatatcgcgttatcttcttgagtaagggaaaggacgccatgcaatcctttatgatgccattctacttaatgaaggattgtgagattaaacagcctgtgttcggagctaattatatcaaaggcacagttaaagcagaggccggaggaggctgggaggggagtgcttcttacaaactgacattcacagcagggggtgccattgagtttggccagcgaatgctgcaggtcgcctcacaggcgagtagaggagaggttcctagcggcgcatatggatacagctatatgccgtctggggcatacgtgtatcccccacccgtggccaacggcatgtatccttgtcctccaggatacccttaccccccacctcccccagagttctaccccggaccaccgatgatggacggagctatgggatacgtccagccaccaccccctccctatcctggacccatggagccaccagtctctggaccagacgtgccttcaaccccggcagccgaggccaaggctgcggaagctgctgccagcgcctattataaccccggaaacccacataacgtgtacatgcctacgtctcagccccctccacctccgtactatcctcctgaggacaaaaagactcagtag

SEQ ID NO: 246963 - DNA, 720 bp, Artificial Sequence
  Description of Artificial Sequence: Synthetic coding sequence
atgagttatgatcacgtggagctgactttcaacgacatgaagaatgtgcccgaggcatttaagggaacgaaaaaaggtaccgtttacctgactccctaccgggttatcttcctgagcaaaggaaaggatgccatgcagtcctttatgatgcctttctacttaatgaaggactgtgagattaagcagccagttttcggggctaactacataaaggggactgtgaaggccgaagcaggcggtggttgggagggatctgctagctacaagctgacctttacagctgggggtgctattgagtttggtcagagaatgctgcaagtcgcatcccaggcctcccggggtgaagtgccaagtggagcctatggttactcctatatgcctagcggggcttacgtgtatccaccccctgttgctaacgggatgtacccatgtccacctggttacccgtacccaccgcctccacccgagttctatcccggtcccccaatgatggacggtgccatgggatatgtgcaaccaccgcctcccccttatccgggacctatggagccacccgtgtccgggccagacgttccgagtacccctgctgccgaagccaaggctgcggaggctgccgcatccgcctactacaaccctggaaacccccacaatgtgtacatgcccacaagtcaacctccaccgcctccctattacccacctgaggataaaaagacgcagtag

SEQ ID NO: 246964 - DNA, 654 bp, Artificial Sequence
  Description of Artificial Sequence: Synthetic coding sequence
atggctctgaacaaaaaccacagtgaagggggtggtgttattgtcaacaatacagagtctattctaatgtcatatgaccatgtggagctgacgttcaacgatatgaaaaacgtgccggaagcctttaagggtactaaaaaaggtactgtgtacctgaccccctaccgcgtgatcttcctgagcaaggggaaggatgcgatgcagtccttcatgatgcctttctacctgatgaaggactgtgaaatcaagcagcctgtgtttggagcgaactacattaaaggtaccgtgaaagctgaagccggtgcctcacggggagaagtaccctcaggtgcctatggctattcatatatgcccagcggagcttatgtgtacccccctcccgtggcaaacggcatgtacccatgccctccgggatatccatacccaccccctccacctgaattctaccctggccctcccatgatggacggcgctatgggctatgttcagccgcctcctccaccctacccagggccaatggagcctcctgtgtccggtccggacgtacctagcacccctgcaggtgaggggccttgggtgctggcggctctgcgggaccagccatcacccccacggtgccgtactgagtcactgcggatggcaagggattgctag

SEQ ID NO: 246965 - DNA, 630 bp, Artificial Sequence
  Description of Artificial Sequence: Synthetic coding sequence
atggctctgaataagaatcattctgaaggaggcggagtcattgtcaacaacacagaatccatactcatgtcttacgaccacgtggaactcacatttaacgacatgaagaatgtgcccgaggccttcaaaggtactaagaaaggtactgtgtacttgaccccatacagagtgatcttcctgtcgaagggcaaggatgctatgcaatcatttatgatgcccttttacttgatgaaagactgtgaaattaaacaacctgtatttggggctaactacataaaaggaaccgtgaaagccgaagccggtgggggatgggaaggcagcgcatcatataaactcactttcacagctccaatgtcgcctcctttgctgcagcccaaaccacggccacagaaacagccacccgcacctataacaacccaggccatcgcctccagacgacacctccccactacccaccgcaagattgaggatccagttggtcccccagcatctctcccgccaacactgattagtttgccgtatccaagtcatcgtggatgcgccggtgcctggggcggagagggcgcaccctgctctccctcgcgctctgatcataagcaactgccaggaacaagcatcgtggggcattag

SEQ ID NO: 246966 - DNA, 651 bp, Artificial Sequence
  Description of Artificial Sequence: Synthetic coding sequence
atggcactgaacaagaaccactctgagggtggaggggtcatcgtaaacaataccgagtccatcctgatgagctacgatcatgttgagctcacatttaacgacatgaagaatgttcctgaagcgttcaaggggaccaaaaagggaacagtttacctgacgccgtatcgtgtcatcttcctttccaagggaaaagatgcaatgcagagttttatgatgccattctatctgatgaaagactgcgagatcaaacagcccgtgtttggagccaactacatcaagggaaccgttaaggccgaggcaggtggagggtgggaggggagcgctagctacaaactgacctttacggccggtggggcaatcgagtttggtcaaagaatgctgcaggtagcaagccaggaattctaccccggaccccctatgatggacggcgctatgggctacgtgcagccacccccaccaccctatcctggacctatggaaccgccagtatccgggccagacgtgcccagtacaccagcagctgaagcaaaggccgctgaagcagccgcatccgcatactataaccccggtaatcctcataacgtatatatgcccacaagccagcccccacctccaccatattatcccccagaggataagaagactcaatag

SEQ ID NO: 246967 - DNA, 2769 bp, Artificial Sequence
  Description of Artificial Sequence: Synthetic coding sequence
atggctaccgcctccccacgatccgataccagcaacaatcatagcggcaggttgcagctgcaggtaacggtgtctagtgccaagctcaaacgcaagaaaaattggttcggaaccgccatctatactgaggtcgtcgtggacggggaaatcacaaaaactgcaaagtcttcctccagtagcaacccaaaatgggatgaacagctcacagtcaatgtaacaccacagactaccctggagtttcaggtgtggtctcatagaacactgaaggcagacgctcttctgggcaaggcaacgattgacctgaaacaggcactgttgattcataatcgcaaactggagagggtgaaggagcagctaaagttgtcattagagaataagaacggtattgcccaaactggcgaactaactgtcgttctggatgggttggtgatcgaacaggagaatatcactaattgttcttcctcgcctactatcgagatccaggaaaatggcgacgccctacacgagaacggagagccaagtgcaagaactacagccaggctcgccgtagagggcaccaatggtatcgataaccacgtacctaccagtaccctggtccaaaattcttgttgcagttatgtcgttaatggagataatacaccaagtagcccttcccaagtggcggcacgtcccaagaacacccccgctccgaaaccattagcatctgaacccgctgatgacacagtgaacggggagtcttcatcatttgccccaactgataatgcctccgtaaccggaactcccgtcgtgagtgaagaaaatgcactgtctcccaattgtactagcaccacggttgaagaccctcctgtccaagaaatccttacatcttcggagaataacgagtgtattccctccacaagcgccgagctggaatccgaagctcggtcaattcttgagcctgatacctccaattctagatcatccagtgctttcgaggctgccaagtcaagacagccagacgggtgtatggaccctgtcagacagcagtcaggtaacgccaatacagagaccttgccttcaggatgggaacagcgaaaggacccgcacggacggacatattacgttgatcacaatactcgaaccaccacttgggagcggccacaacctctcccacccggatgggagagacgcgtggacgatcgtaggagggtatactatgttgatcacaacacaaggaccacaacctggcagcgtccaactatggaaagtgtccggaacttcgaacagtggcaatctcaaagaaaccagctccagggcgcaatgcagcagtttaatcagaggtatctctattctgccagtatgctggccgctgaaaatgacccatatggcccactgccgcctggatgggaaaaacgcgtggacagtactgatcgagtctatttcgttaaccacaatacgaagacaacacaatgggaggaccctagaactcagggattgcagaacgaggagccactgcctgaggggtgggagatacgatatactagggaaggagtaagatacttcgtggaccacaatactagaaccactaccttcaaggaccctcggaacgggaagtccagcgtcacaaaggggggacctcaaatcgcctatgagcggggtttcagatggaagttggcccacttccgctatctgtgtcagtctaacgccttgccatcccacgttaaaatcaacgtctctagacagacgctgttcgaggattctttccagcagattatggctctgaagccctacgatttaagaaggcgcctttacgttatttttcggggagaggaaggcctcgattatggcggtctggcaagagagtggttcttccttctcagccatgaagtgctaaatccaatgtattgtctttttgagtatgccggaaagaacaactattgcctccagattaatcctgctagtacgatcaatcctgatcacctgagttacttttgtttcattggcagatttatcgcgatggccctcttccacggcaagtttatagatactgggttctctctgccattctataagcggatgctgtctaagaagttgaccatcaaggacctcgagagtatcgacacagaattctataatagcctgatttggattagggacaacaacattgaggagtgcgggctggagatgtattttagtgtcgatatggagatcctcgggaaagtgacttcccacgatctcaaactagggggtagcaacatcctggtgacagaagaaaataaagacgaatacattggcctgatgaccgagtggaggttttctagaggggttcaggaacagacgaaggcattcttagacggcttcaacgaggtggttccactacagtggcttcagtattttgatgagaaggagctggaggtgatgctgtgcggtatgcaggaggtggaccttgcagattggcagcgaaataccgtgtaccggcactatacacggaattctaagcagattatatggttctggcaattcgtcaaggagaccgataacgaagtgcgcatgaggttgttgcagttcgtaaccggaacttgccggctccctctggggggatttgctgaattaatgggctccaatggtccccaaaaattttgtattgaaaaggtgggaaaagacacatggctgcctcgatctcacacctgctttaacaggctggatttaccaccgtacaaatcgtacgaacagctcaaggaaaaacttctattcgccatcgaggagacagaaggcttcgggcaggagtag

SEQ ID NO: 246968 - DNA, 2379 bp, Artificial Sequence
  Description of Artificial Sequence: Synthetic coding sequence
atggcaaccgcatctccccgaagcgatacatctaacaaccactctgggaggctccagcttcaggtgactgtgtcttccgccaaacttaagagaaagaaaaattggtttggaacagcaatctacactgaagttgtcgtcgatggagagataactaagaccgccaagagtagcagtagcagcaatcctaagtgggacgaacagttgactgtaaacgtcactcctcagaccaccttggaatttcaggtgtggtcccatcgaaccttgaaggctgatgccctgctgggcaaggctactatcgatctcaaacaggccctcttgattcacaaccgcaagtttaacggagagtcatccagcttcgcccctaccgacaatgcctctgtgacaggcacgcccgtggtgagcgaggagaacgccttgtcgcctaattgcacgtccaccacggttgaggatcctccagtccaggaaatcttgacctcttcagagaataatgagtgcatcccatcaactagcgcggaactagagtcagaagccaggtctatcttggagcctgatacttccaatagtcgaagttcatccgcttttgaagccgcaaagagccggcagcctgatggatgcatggaccctgtaagacagcagtcgggaaatgccaacacagagactttgccctctggttgggagcagaggaaggacccccacgggaggacgtattacgtggatcataacacgcgtaccacgacatgggaacgcccacagccattgcctcccggatgggagagacgtgtcgacgaccgccgacgtgtgtactatgtagatcacaatacccgtacgactacctggcagagacccacaatggagagcgttcggaattttgaacagtggcagtcccagcggaatcagctgcaaggagcaatgcaacagtttaaccaaaggtatctgtatagtgcaagtatgcttgccgctgagaatgatccctatggccctctcccgccaggatgggagaagcgggtggatagcacggatagagtgtacttcgtcaaccataacacaaagacaacacagtgggaggaccccaggactcaggggttacagaacgaggagcccctgcctgagggctgggaaatcagatacacaagggaaggtgtgcgctattttgtggatcacaatactagaacaactacattcaaagacccaagaaacggaaagagcagtgttacaaagggcggaccccagattgcgtacgagcggggatttcggtggaagctcgctcattttcgttatttgtgccagtctaacgccctgccatcccatgtgaagatcaatgtctcaagacagaccctattcgaagacagttttcagcagattatggccttgaagccctacgacctgagacgtagactctacgtaatctttcgcggagaggaaggtttggactacgggggattggcaagggaatggtttttcctgctctctcacgaggtcctaaatccgatgtactgtctgtttgagtacgctgggaagaacaactattgcctgcaaatcaatcccgcttcaacaatcaaccccgaccacctcagctatttctgctttatcgggaggtttatcgccatggccttattccatggaaaattcattgatacaggtttctcacttcctttctacaaacggatgttatcaaaaaaacttaccattaaggacctcgagagcatcgacactgagttctacaacagtctcatttggatcagagacaacaacatagaagaatgcggtttagagatgtatttttccgtggacatggagatcctgggaaaggtcacatcccatgatcttaagttgggcggatccaatatcctggtaacagaagagaataaagatgagtacatcggccttatgacagaatggagattcagccgaggagtccaggaacagacaaaagctttcctcgacggcttcaacgaggtagtgcctctgcagtggcttcagtatttcgatgaaaaagagctggaagtcatgctctgtggaatgcaagaggtggacctcgccgactggcagagaaacactgtctatcgccactatactcggaactctaagcaaatcatatggttttggcagttcgtgaaagagaccgacaacgaggtcaggatgcgcctcttacagtttgtgaccggaacatgcaggctccccttgggtggattcgccgagctgatggggtctaacgggccacagaagttctgtatagagaaggtcgggaaggatacatggcttccccgttcacatacctgttttaaccggctcgatcttccaccatacaagtcttacgagcagctcaaggagaagctgctattcgcaatcgaggagacggaggggtttggtcaggaatag

SEQ ID NO: 246969 - DNA, 2115 bp, Artificial Sequence
  Description of Artificial Sequence: Synthetic coding sequence
atggccacggctagcccacgtagcgacacctctaataaccattccggacggttgcagctacaggtgacagtgaacggcgaatctagctctttcgcacccactgataatgcatctgttactggaacccccgtggtgtccgaagagaacgccttgtccccaaattgcacctcaaccactgtggaggatccacctgtccaagagatcttgacatcaagcgagaataatgaatgcatccctagcactagcgctgaactggaatcagaggctagaagtattttagaacccgacacatccaactcccggagttctagcgcgtttgaagccgctaaaagcagacagcccgacggctgcatggatcctgtgcgtcaacaatccgggaatgcgaataccgagactttgccctccggttgggagcagcggaaggatccacacggtcgcacatactatgtcgaccacaacactcggacaacaacttgggagcgccctcaaccgctgcctccgggatgggagagacgtgtggacgaccgcaggagagtatattatgttgaccacaacactcggactaccacttggcagagacctactatggagagcgtgagaaattttgagcagtggcagtcacagaggaatcagctgcagggagctatgcagcagtttaatcagcgatacctgtattctgcctccatgctcgctgccgaaaacgacccctacgggcctctcccgcctggctgggaaaagagggtggactcaacagaccgcgtatacttcgtgaatcataacacaaagaccacgcagtgggaagatccccgtacacaaggactgcagaatgaagaacctctacccgagggatgggagatcagatatactcgagagggagtgcgctactttgtcgaccacaacacgaggacgaccacattcaaggacccgcgaaatgggaaaagctctgtaacaaaagggggtccacaaatagcctacgagcgaggcttccgctggaaactcgctcacttccggtacctatgtcagtccaacgcactgccctcacatgtcaaaataaatgtgtctaggcagacgctgtttgaagacagcttccaacaaatcatggccctgaagccctacgacctgagacgccgtctgtacgtcattttccgcggtgaggaagggctggactatgggggacttgcacgggagtggtttttcctcctcagtcacgaagtgctcaacccaatgtactgcctctttgagtacgctggcaagaataattattgtttacagataaatcccgctagtacaatcaaccctgaccacctgtcctatttttgcttcattggtagattcatagccatggccctgtttcacggcaaattcatcgacaccggattttcattgcccttctataaacggatgctctctaagaagctaacgataaaagatctagaatccattgacacggaattctacaattcgcttatctggattagagacaataacattgaggagtgtggtttggagatgtatttttcagtcgacatggaaatactcggcaaggttacgagtcacgaccttaaactgggcggtagcaatatactcgtgaccgaggagaacaaggatgaatacatcgggttaatgactgagtggcggttctccagaggagttcaggagcagacaaaggcattcctcgatgggtttaacgaggtcgtgccactgcagtggttgcaatattttgatgagaaagagttagaggtaatgctgtgcggcatgcaggaagtcgatttagctgattggcaacgtaataccgtgtacaggcattacactagaaattctaaacagattatctggttctggcagtttgtcaaggaaacagataatgaggtgcgtatgcgactcctgcagtttgtgactggtacatgcaggctcccgctaggaggcttcgctgaactgatgggctcgaacgggccacagaagttctgcattgaaaaggtgggaaaagatacttggctcccacggagccatacctgctttaatcggctggacctgcctccatacaaatcctatgaacaacttaaagagaaattgctatttgccattgaagagaccgagggctttggccaggaatag

SEQ ID NO: 246970 - DNA, 336 bp, Artificial Sequence
  Description of Artificial Sequence: Synthetic coding sequence
atggcgacggccagcccaagaagtgatacatcaaacaaccactccggcagactgcagctgcaggtgacagtctcttccgccaaacttaaaaggaaaaaaaactggtttggcaccgcaatttatacagaagtggtggtcgacggggagataacgaagacagccaagagttccagctcgtccaaccccaaatgggatgagcagctcaccgtcaatgttacgccacagaccaccttggagttccaggtctggagccacaggactttgaaagctgacgccctgctgggcaaggcaaccattgaccttaaacaagccctacttattcataataggaagtag

SEQ ID NO: 246971 - DNA, 2769 bp, Artificial Sequence
  Description of Artificial Sequence: Synthetic coding sequence
atggccaccgccagtcccaggtctgacacgtctaacaaccattctgggagactccagttgcaagtgaccgtttcaagtgccaaactcaaaaggaagaagaactggttcgggaccgcaatctataccgaggtagtggtcgatggtgaaattactaaaactgccaaatcatccagctcttccaacccgaaatgggatgaacagctgactgtcaacgtgacccctcagaccacactggaattccaagtgtggagccatagaactctgaaggccgacgcactgctggggaaggcaactatcgacctgaaacaggcattattaatccacaacaggaagctggagagggtgaaagaacagttaaagttgtcgctggagaacaagaatgggatcgcccagaccggagaactgaccgtcgtgctcgatggactggtgatagaacaggaaaatatcaccaactgctccagctcccctactattgagattcaggagaacggcgacgcactgcatgaaaacggggagccgagtgcaagaacgactgctcgccttgctgtggaaggaaccaacgggattgacaaccacgtccccactagtacactggttcagaacagttgctgttcatacgtagtgaacggcgacaatactccttcttcccccagccaggtggcggcaaggcccaagaacactcctgcccctaaacctcttgcttcagaacctgccgatgacacagttaacggcgaatcatcatccttcgcgcctaccgataatgcttccgtcactggcacacctgtcgtttccgaggaaaacgcacttagtcctaactgcaccagcaccaccgtagaggatccaccagtgcaggaaattctaacgtcctcagagaacaatgaatgtattccaagtacctcagcggaactggaatcagaagccagaagtattctggagccagatacgtctaattcacgatcgagctctgcatttgaggcggctaaaagtaggcagcctgatggatgcatggatcccgtgaggcagcagtctggaaatgcgaatacagagaccctgccctccggctgggaacagagaaaggacccacacggccgtacctattacgttgatcacaacactagaactactacttgggaaagaccacaaccactgcctccgggatgggaacggagggtggatgatcgcagacgcgtgtactacgtggatcacaacaccagaaccactacgtggcagcggcctaccatggaaagcgttaggaacttcgaacagtggcagtctcaacgcaatcagttgcagggggctatgcagcagttcaatcaacggtacctgtactctgcttctatgctggctgcagagaacgatccatatggtcccctgcccccaggatgggagaagcgagtggacagtacggatcgcgtttattttgttaaccacaacacaaaaaccactcagtgggaggacccaaggacccaaggtttacagaacgaagaacctcttcccgagggatgggaaatccgatatacacgcgagggggttagatatttcgtggatcacaatacgagaactactacgtttaaggatcctagaaatggcaagagctccgtcaccaaggggggaccccaaatcgcctacgaacggggtttcagatggaaattagcccactttcgatacctgtgccagagcaacgctctgccatcacacgtcaaaattaacgtctcccgccagacactcttcgaggattcctttcagcagattatggcgttgaagccatatgatctccggagaaggctgtatgtgatttttcgcggagaggaaggtctcgattacggcggactcgcgagggaatggttcttcttgctctcacatgaggttttaaaccctatgtactgcttgtttgaatacgccggaaagaacaattactgcttacagattaatcccgcttccacgatcaaccccgatcatttgtcatacttttgtttcattggacgctttattgctatggccctatttcatggcaaatttatcgacaccggcttttctctccccttttataaacgtatgctcagtaagaaactgactataaaggatctcgagtccatcgatactgaattttacaactccctcatctggataagagataataatatcgaggagtgtggcttggaaatgtacttctccgtagacatggaaatcctgggcaaggttacgtctcacgacctgaaactggggggatcaaatatcctggtgactgaagaaaacaaggacgaatatattggtctgatgaccgaatggcgcttttctcggggagttcaagagcaaacaaaagcatttctggatggtttcaacgaagtggttcccctccagtggctgcagtactttgatgaaaaggagctcgaggtgatgctttgtggaatgcaagaagttgacttggcagactggcagagaaacacagtgtaccggcactatacgaggaactcaaagcagattatctggttctggcagtttgttaaggaaactgacaatgaagtgcggatgaggttgcttcagtttgttacaggaacgtgcaggctccccctggggggattcgccgaactaatgggctccaatggccctcagaagttctgtattgaaaaagtcggtaaggacacttggctgcctcgcagtcacacatgcttcaataggctggatctgcctccctataaatcctacgagcagttaaaggagaagctgctgttcgcaattgaagagactgagggtttcggtcaggagtag

SEQ ID NO: 246972 - DNA, 2613 bp, Artificial Sequence
  Description of Artificial Sequence: Synthetic coding sequence
atggcctccgcatcttctagtcgagccggtgttgctctgcccttcgaaaagtctcagctgaccttgaaggtcgtgtcagctaagccaaaggttcacaacaggcagcctcgcatcaattcttacgtggaggtggccgtcgatggattgcctagtgaaacaaaaaaaactggaaagaggattggtagcagtgaactcttgtggaatgagattattatcctgaatgttactgctcagtctcacctggacctgaaagtatggagttgccacaccctgaggaatgaacttctgggcactgccagcgtgaatctgagtaatgtcctcaaaaataatggaggcaaaatggagaacatgcaactgacactgaatctgcagaccgagaacaagggctctgtggtctccggcggtgagctcactatttttctggacggccctacagttgacttagggaatgttcccaatggaagtgctctcacagacggttctcagctgccctcacgagattcatcgggtacagctgtggcacctgagaatcggcaccaaccaccctctaccaactgctttggagggagatccaggacgcacaggcactctggcgctagcgcacgtaccacacctgcaaccggtgagcaatccccgggagcccgatccagacaccggcaacccgtgaaaaacagtggtcactccggactcgctaatggcactgtgaatgatgagccgacgactgctaccgatccagaggaacccagtgtggtaggggtgacctcaccaccagcagcgcctttgtcggtcacgccaaaccccaatacaacgtcactgccagctcctgccaccccggcagaaggcgaggagccatctacctctgggacgcaacagctcccggcagccgctcaagcccctgatgccttgccagcaggctgggagcagcgagagctgcccaatggcagggtatactacgtggaccataacactaagaccacaacatgggaacgtccactgccaccagggtgggagaagaggactgaccctagaggcagattctactatgtggatcataataccaggacaaccacttggcaacgcccaacggctgagtatgtgagaaattacgaacagtggcaatcgcaaaggaatcaactacagggagctatgcagcatttcagccaacgatttctgtaccagtcttcatctgcctccaccgatcacgatccgctgggaccgctcccacctggttgggagaagcgacaggataacggacgcgtctattatgttaatcacaacacgagaaccactcagtgggaagatcctcggactcagggcatgatccaggagcccgcattgcctccgggatgggagatgaagtacacatcggaaggtgttagatacttcgttgatcacaatacaagaactaccacctttaaggatcctcgcccagggtttgaatcaggcacaaaacaaggctcgccaggcgcttacgatcgctcatttcggtggaaatatcaccaatttagattcctatgccacagcaacgccctgccatcccatgtgaagatatccgtgagtcgacagactctattcgaagattctttccagcaaattatgaacatgaagccttacgatctgaggcggaggctctatattatcatgaggggggaggaggggctggattacggaggaatcgccagggaatggttcttcctgctcagccacgaggtgttgaatccaatgtactgtctgttcgaatacgccggaaagaacaactattgcttacagattaaccctgcctccagcatcaaccccgaccacctcacatatttccggttcataggtagatttatcgctatggccctgtaccacgggaagttcattgacaccggtttcaccctgccgttttacaagcggatgctgaacaaacgcccaaccctgaaagatttagagtcgatcgatcccgagttttataactcgattgtgtggatcaaggaaaataacctcgaggagtgcggcttggagttatatttcatccaggatatggaaattctggggaaagtcacaacacatgaattgaaggaaggaggggagtcaatacgcgtgacagaagaaaacaaggaagagtacatcatgttgcttacagattggcggtttactaggggcgttgaggagcaaacgaaggccttcctggacggctttaacgaggtggcgcctctggagtggctccgatacttcgacgaaaaggagctcgagctgatgctttgtggtatgcaggaaatcgacatgtccgactggcagaaatccacaatctaccgtcactacactaaaaatagcaaacagattcagtggttttggcaagtggtaaaggagatggataacgaaaagcgcattagactgctgcagttcgtaactggcacctgtaggctgcccgtggggggattcgccgagctgattggaagtaacgggccacagaagttctgcattgacaaagtgggaaaggaaacatggctccccagatcacatacctgtttcaaccgcctcgaccttcccccatacaagtcatatgagcaactgcgcgagaaactcctctatgccattgaggaaacagagggattcggccaggagtag

SEQ ID NO: 246973 - DNA, 2613 bp, Artificial Sequence
  Description of Artificial Sequence: Synthetic coding sequence
atggctagcgcgtcttcgagtcgagccggtgtggccctcccattcgaaaagtctcagctgactttgaaagtggtgagtgcaaaacctaaggttcataaccgacaaccacgcatcaatagttatgtcgaggtggccgtggacggcttgccaagtgagactaagaagactggcaagcggatcggaagctcagaactgttatggaacgagatcatcattttgaacgtaacagctcagtctcacctggatctcaaggtgtggtcttgtcacaccttacgcaacgagctgctgggcaccgcatccgtgaacctgtccaatgtgcttaagaacaatgggggtaagatggaaaacatgcagctcactttgaatctgcagactgagaataaagggtctgttgtgagcgggggtgaattaactatctttcttgacggccctaccgtcgacttaggtaacgtgcccaacggctccgcccttacagatggctcccagttaccctctagagactcgtcgggaacagcagtcgcccctgagaatcgccatcagccccctagcacaaactgcttcggcggtcgttccaggactcatcgccactcgggagccagcgctcgaactactcctgccactggggagcagtctccaggcgcaagatccagacacaggcagccggttaaaaactctggacattctgggctcgcgaatggaacagtgaatgacgagcccaccactgctacagaccctgaagaaccctccgtggtaggtgtgacgagcccacccgctgcccctctcagcgtgactcccaaccccaacaccacaagcctaccagcaccagccacccccgcagaaggggaggaaccctctacctcggggactcagcagctgcctgccgcagcgcaagcaccggatgctctaccagctgggtgggagcagagggagctgccaaacggtagggtctactatgtggatcacaataccaaaacaacgacgtgggaaaggcctttgccacccggttgggagaagaggacagatcccagagggcgtttttattatgtcgaccacaacacaagaaccacaacctggcagcgtcctacagccgagtacgtgcgaaactatgagcagtggcagtctcagcgaaaccagctgcagggtgccatgcaacacttctcacaacgcttcctctatcagtctagcagtgccagcacagaccacgaccccctaggacccttgccacctggttgggaaaagcgacaggataatgggagggtttactatgtgaatcataatacacgcacaacccaatgggaggacccacgtacccagggcatgatccaggagcctgccctgccaccaggctgggagatgaagtatacttctgagggggtgcggtactttgtggaccataacacccgcaccacaactttcaaagaccctagaccaggatttgagagtggtacgaagcaggggtctcctggtgcatatgatcgctcgtttcgctggaaatatcaccagttcaggttcctgtgccactccaatgccctgccatcacacgtgaagattagcgtctctaggcagacactgttcgaggactctttccagcagatcatgaatatgaaaccttatgatctccggagaaggttatacattatcatgcggggagaagagggcctggattacggaggcattgccagggagtggttcttccttctctcacacgaggtgctgaacccaatgtactgtctctttgaatacgctggaaaaaacaactattgtctccagataaatcccgcatcttctattaatcccgaccacctgacctacttccggttcatcggacggtttattgcgatggccttgtaccacggaaagttcattgacaccgggttcacattgcctttttacaaaaggatgctgaacaagcgtcctacacttaaagaccttgagagtatagatcccgagttttacaatagcattgtgtggatcaaggagaataatttggaagaatgcggactggaactgtattttattcaggatatggagatccttgggaaggtgaccactcacgagctgaaagagggaggtgagagcattagagttacagaggaaaataaagaagagtacattatgctcctgaccgactggagatttacacggggagtcgaagaacagacaaaagcctttctagatggcttcaatgaggtagcaccactggaatggttgcgctatttcgatgaaaaggagttagaactcatgctttgcgggatgcaggaaattgatatgtccgactggcagaaatctacgatctacaggcattatactaagaactccaaacaaattcaatggttttggcaggtggtgaaagagatggacaatgaaaagcgcatcagactgctgcagtttgttacaggaacctgtcgactcccggtgggagggtttgccgagttgatcggatcaaatggtcctcagaagttttgtatcgataaagtgggcaaggaaacttggttaccccgttctcacacttgctttaataggctcgatctgccaccgtacaaaagctatgagcaattgcgcgaaaagttgctatatgcaatcgaagagactgaaggtttcggacaagagtag

SEQ ID NO: 246974 - DNA, 2613 bp, Artificial Sequence
  Description of Artificial Sequence: Synthetic coding sequence
atggcttctgctagctcctctcgcgctggagtggccctgcctttcgagaagtcccaattaaccctaaaggtagtgtcagctaaaccaaaagtgcataacagacagccacgcattaattcatacgtggaggtggctgtggatggacttcctagtgaaactaaaaagacgggaaagaggatcggcagctccgaactactctggaatgagataatcattctgaatgttacggcccagagccatctggatttgaaagtctggtcatgccatacccttcgcaacgagctgctaggcactgccagcgtgaacctaagcaacgtcctcaaaaataacggagggaaaatggagaatatgcaactgacactgaatctgcagactgagaacaaaggctcggtagtgagtggaggcgaattgaccatcttcctcgatggtccgacagtcgacctgggaaacgtgcctaacggatccgccctgactgacggtagtcagctgccatcacgagactcctccggcacagccgttgcaccagagaacagacatcagccgccttcaaccaactgcttcggcggacgctctaggacccacagacactcaggagcaagcgccagaacaacgcctgccactggcgagcagtcacctggggcaaggtcaaggcaccgtcagcctgtgaagaatagcgggcactccggcctggccaacggtactgtcaacgacgaaccaactactgccacagaccctgaagaaccatctgtcgtcggagtcactagccctcctgcagctcccctgtcagtgactcccaatcctaatacaactagcctgccggcaccagcgactccagccgaaggagaggagcctagcaccagcggaacgcaacagttacccgcagccgctcaggccccagatgccctccccgcagggtgggagcagcgggagttgcccaacggccgtgtgtattatgtggaccacaatacaaaaaccactacttgggagcgacccctgcccccaggatgggaaaaaagaactgaccccagaggacgattttattatgtggatcataacactcggactacaacatggcagcgacctaccgccgagtatgtgcgtaattatgagcagtggcagtcacagaggaaccagctccaaggggcaatgcaacatttttcacagcgatttttatatcaaagttcgtccgcgtcaactgatcatgatccattaggccctcttccgcctgggtgggagaaaagacaggacaatggcagggtttactatgtgaatcataacacaagaaccacacagtgggaggacccaagaacccagggtatgattcaggagccagctctgcccccaggatgggagatgaagtatacctccgagggggttcgctacttcgtggatcacaatacaagaactaccacatttaaggaccccagaccaggattcgagtctgggaccaaacaggggagccccggagcgtatgatagaagcttccgttggaagtatcatcagttccgctttctctgccattccaacgccttgccatctcatgtcaagatctcggtctcacgccagacgctgtttgaagatagtttccagcagatcatgaacatgaagccgtacgacttgcgtagaaggttatacatcataatgagaggcgaggagggcctcgattacggcggaattgctagggagtggttttttctgctaagtcacgaagtgctcaaccccatgtattgcctgtttgaatatgctgggaaaaataactattgtctacaaatcaaccctgccagcagtattaatcccgaccatctgacttactttagatttattgggaggttcatcgctatggctttgtaccacgggaaattcatcgatacaggatttaccctgcctttctacaagcggatgctcaataaaagacccacgctgaaggacctggagtccattgaccccgaattttacaactcgatcgtttggataaaggagaacaatctggaggagtgtggcctggaactgtatttcatccaagacatggagattttgggaaaggttaccacacacgaactcaaagaaggcggtgagagcattcgggttacagaagagaacaaagaagaatatataatgcttcttacggactggcgcttcacaaggggcgtggaagagcaaaccaaggcttttctggatggtttcaatgaagttgccccattggagtggctgcgttacttcgacgagaaggaactggagctgatgctctgtggaatgcaggagatagacatgtcagactggcagaagtctactatctacaggcactatactaagaacagtaaacaaatccagtggttctggcaggtcgtaaaggagatggacaacgaaaaacggatcaggcttcttcagttcgtcaccggaacctgccgcctgcctgtgggcggatttgccgagctaatagggtcaaatggaccccaaaagttctgcatcgataaagtggggaaagagacatggcttcctcggagccatacctgcttcaataggctcgaccttcccccatataagtcctacgaacagcttcgagagaaattgctgtatgcgattgaggaaaccgagggttttggtcaggaatag

SEQ ID NO: 246975 - DNA, 2265 bp, Artificial Sequence
  Description of Artificial Sequence: Synthetic coding sequence
atgcagttgactctgaatctgcagacagaaaacaaaggcagcgttgtcagcggaggagaactgaccatcttcctcgacggtccaactgtggacctcggcaacgtgcctaatgggagcgccctcactgatggctcccagctgccttcaagggactccagtggaactgccgtcgcccctgaaaatagacatcagcctcccagcacaaactgttttggcggaagaagtagaacccatcggcatagcggtgcctccgcccgtaccactcctgcgaccggcgaacaaagccccggagccaggtcgagacacaggcagccggtgaaaaattctgggcattccggcctggctaacggtacggtgaatgatgaacctactactgcgacagatcccgaagagccatccgtcgtgggagtaacctccccgccagccgcaccgctgtctgtcaccccaaaccctaataccacgtcccttccggctcccgcaactccagctgagggcgaggagccttctacatctggaacacagcaactgccagcagcggctcaggcccctgacgccctgccagctggctgggaacagagggagctgccgaacggcagagtatattatgtcgaccataacactaagacaaccacctgggaacggccacttcccccaggatgggagaaaaggactgatccacgaggacgattttactacgtggaccacaataccagaacaacaacttggcaacgtccgacagccgagtacgtgcggaattacgagcagtggcagtcacaaagaaatcagctgcagggggctatgcagcacttttctcagagatttctgtatcagagctcgtcagcctcaacagaccatgatcctctgggccctctgcctccagggtgggagaagagacaggacaatggtcgggtctattacgtaaatcataataccagaaccacacagtgggaggatcccaggacccaaggcatgatacaggagccggctctacctcccggatgggaaatgaagtatacaagtgagggcgtgaggtactttgtcgaccataatacacggaccacaacctttaaagacccgaggcctggttttgagtcaggcactaagcagggtagcccaggagcatacgaccgttcatttagatggaagtaccaccagttcagattcctgtgccatagtaatgcactacccagccatgtcaaaatcagcgttagccgtcagacactgttcgaggactcctttcaacagataatgaatatgaaaccttatgatctgcgcaggagattatatataattatgcggggtgaagagggcctagattatggcggtatagcacgcgaatggttcttcttgctcagtcatgaggttttgaaccctatgtattgcctgttcgagtatgctgggaagaacaattactgcctccagatcaatcctgctagctcgatcaatcccgatcatctgacctattttagattcatcggtcggttcattgcaatggctctgtatcacggtaaattcattgataccggttttactcttccattttacaagagaatgctgaataagcgcccaaccctgaaagatctggaatctattgatccagagttctacaactctatagtgtggatcaaggaaaacaacctggaggaatgtggattagagctgtattttattcaggacatggaaatcctcgggaaagtgacaacacacgagctgaaagaggggggagaaagtattcgtgtgacggaagagaataaggaggagtacattatgctgctaaccgactggcgtttcacaagaggtgttgaggagcagactaaggcatttctggatgggtttaacgaagtagcacccctcgagtggctccgatattttgacgagaaggagctagagctcatgctatgcggaatgcaggagatagatatgtctgactggcagaaaagcaccatctaccgtcactataccaaaaattctaagcagatccagtggttttggcaggtggtgaaggaaatggataatgaaaagagaataagacttcttcagtttgtcaccggcacgtgtaggttgcccgttggcggattcgccgaattaatcgggagtaatgggccacaaaaattttgcattgataaggttggtaaagagacatggcttcctcgcagccatacctgtttcaacagactcgacctccccccatacaaatcttatgaacaactgcgggaaaagctactctatgccatcgaggaaacggaagggttcgggcaggaatag

SEQ ID NO: 246976 - DNA, 2274 bp, Artificial Sequence
  Description of Artificial Sequence: Synthetic coding sequence
atggagaacatgcaactgacactgaacctgcaaaccgagaataaggggtcagtggtttccggtggtgaacttaccatctttttggacgggcctacggtggacctcggcaacgtgcccaatgggagcgctttgacggatgggtctcagttgcccagcagagattcctctggaacagcggtggcaccagagaataggcaccagccaccatcaaccaattgcttcgggggacgtagcaggacccaccgccactccggagcttctgctcgtactactcccgctactggggagcagtcacccggagcacggtcaaggcatagacagcccgtgaaaaacagcggacattctggcctcgccaatggtacagtgaacgatgaacccaccacagccaccgatcctgaagagccctccgtcgtaggagtcacatctcctccagcggcaccattaagcgtgaccccaaaccccaataccacctctctacccgcaccagctactcccgcagaaggggaggaaccttctacatccggaacacaacaactccccgcagctgcccaggcaccagatgctctccctgcgggatgggagcagagagagctgcccaacggcagggtctactacgtggatcacaacactaaaactactacatgggaaaggccgctgcctccaggatgggaaaagagaacagacccgagggggcgattctactacgtcgatcacaacactaggaccaccacttggcagcgacctactgcggagtatgtacgcaattacgaacagtggcagtctcagcgcaatcagctgcagggcgctatgcagcatttctctcagaggtttctgtatcagtcaagttcagcctccacagaccatgatccacttggcccattaccccctggttgggagaagcgccaggataacgggcgtgtgtattacgtaaatcataatacccgcactacacagtgggaagaccccagaacccagggaatgatccaagagcctgcactgccgcctggctgggaaatgaaatacacctcagaaggggttcgttatttcgtcgatcacaacactagaactaccacatttaaggatcctagacctgggtttgagagcggaacgaagcagggctcgcctggggcatacgatcgctctttcagatggaagtaccaccaatttcggtttctctgccacagcaatgccctaccaagccatgtgaaaatatccgtttccagacaaacactctttgaagactccttccagcagatcatgaacatgaaaccttatgacctccggagaagattgtatatcattatgaggggagaggaaggcctggattatggcggtatcgccagggaatggtttttcctgcttagccacgaggtcctcaaccccatgtactgtctgtttgaatatgccggaaagaataactactgtttacagatcaaccctgcctcatcaatcaatcccgaccaccttacctattttcgtttcattggcagatttatcgccatggctctttatcacggcaagtttattgatacagggtttacattgcccttttataagcggatgctcaacaaacgcccaactctgaaggatctagagtccatcgaccctgagttctacaactccatagtatggatcaaggaaaacaatctcgaagagtgcggcctggaactgtattttatacaagatatggaaattctaggcaaagtgactacccatgagctcaaggaaggcggagagtcaatcagggtaaccgaagaaaataaggaagaatacataatgctgcttacagattggaggtttactcggggagtcgaggagcagacaaaagcttttcttgatggttttaatgaagtggcacctttggagtggctcaggtacttcgatgagaaggaactggagctgatgttatgcggcatgcaggaaattgacatgtccgactggcagaagtccactatctataggcactacactaaaaactccaaacagatccaatggttctggcaggtggtcaaagaaatggacaacgagaagagaattagactccttcagtttgtaactggcacttgtcgcttacctgtgggcggttttgcagagctcatcggatccaatggacctcagaagttttgtattgacaaggtgggcaaagagacctggttgccaaggagtcatacatgctttaacaggttagacctccctccatataaaagctacgagcagctgagggaaaagctcttatacgcgatcgaagaaactgaaggctttggacaagaatag

SEQ ID NO: 246977 - DNA, 1029 bp, Artificial Sequence
  Description of Artificial Sequence: Synthetic coding sequence
atgatccaggagcccgcactcccacccggatgggaaatgaaatatacatctgagggagtaagatactttgtggaccacaacacccgcactacaacttttaaagacccgcgtccaggattcgaatctggtaccaaacagggaagccctggggcatacgatagaagcttcaggtggaaataccaccagtttcggtttctgtgtcattccaatgcactgccctcccatgtgaagatcagcgtctctcgccagaccctgttcgaggattcctttcaacagatcatgaacatgaagccatatgacctgaggcgcaggctgtacattattatgagaggggaagaaggcctcgattacggcggaatcgctcgagagtggttttttctgctgagccatgaagttctaaaccccatgtactgcttgttcgagtatgcaggtaagaataattattgtctgcaaattaaccccgcatccagcatcaacccagatcacctgacatacttcagatttatcggtaggttcattgcaatggcattataccacggcaagttcattgataccggctttacactccctttttacaagcgcatgctcaataaacgccctacactgaaggatttggaatccatagaccccgagttctataacagcattgtgtggattaaggagaataatctagaagagtgtggcctcgagctatacttcattcaagatatggagatcctgggaaaagtcacaacccatgagctgaaggagggcggtgaaagtatcagagtgaccgaggaaaacaaggaggagtatatcatgttgttgaccgactggcggtttacgcggggagttgaagagcagaccaaggcattcctggatggcttcaacgaagtcgcacctctcgaatggctgaggtatttcgatgagaaagagctggagttgatgctgtgcggtatgcaggaaattgatgctactggccgtcgggcacccagcaccgggaccacgcccaggacagcctcgcgaagcagcgggagcggtcggtggtag

SEQ ID NO: 246978 - DNA, 1296 bp, Artificial Sequence
  Description of Artificial Sequence: Synthetic coding sequence
atgatccaggagccagccttaccacctggctgggaaatgaagtacacatctgaaggagtgagatatttcgttgaccacaacactaggactaccacctttaaagatccacgcccaggctttgagtctggcaccaaacaagggagtcctggggcatatgatcggagcttccgatggaagtatcaccaatttcggtttctttgccattctaacgctttgcccagccacgtcaagatatctgtcagtaggcagacccttttcgaggattccttccaacagatcatgaatatgaaaccctatgacttacgcaggcggctgtacattataatgcgcggagaagaggggctagactatggcggaatcgcgagggagtggttttttctactgagtcacgaggttctgaatcccatgtattgtctgttcgagtacgctggaaagaataactactgcctacaaatcaatcctgcgtcatccattaatccagatcaccttacctactttcgcttcatagggagattcatcgctatggctctctaccacggaaagtttatcgatacaggattcaccctgcccttctataaaagaatgctcaataagagaccgacactgaaagatctcgagtcaatcgacccagaattttataactctatcgtttggataaaggaaaacaacctggaagagtgcggactggaattgtatttcatccaggacatggaaattctcggtaaggttaccacccacgaactcaaggaaggcggtgagagtattcgcgtcacagaggaaaataaagaagaatacatcatgctgctgacagactggagattcactcgcggagttgaggaacagacgaaggccttcctggacggatttaatgaggttgccccacttgaatggttgagatatttcgatgagaaagaattggaactgatgctgtgcgggatgcaggagattgatatgtccgactggcaaaagtctacgatctatcggcactatactaaaaacagtaagcagatccagtggttctggcaggtggttaaggagatggacaacgagaagagaatacgcttgctccagtttgtgacgggtacatgtcgattgccagtcgggggattcgccgagttgattggctctaacggtccccagaaattttgtatcgataaagtcggcaaggaaacgtggctccctcggagtcatacttgctttaacagacttgatttgccaccatataaatcctacgaacagctgcgggagaagctactgtacgccatcgaagagaccgaagggtttggccaggagtag

SEQ ID NO: 246979 - DNA, 1008 bp, Artificial Sequence
  Description of Artificial Sequence: Synthetic coding sequence
atggcgagcgccagcagcagtcgcgcaggggtggccctgccctttgagaaatctcagctgacgctaaaggttgtttccgccaaacctaaggttcacaaccggcagcccagaattaacagttacgtcgaggtggcggtagatggattaccgagtgagaccaagaaaacaggcaaacggatcgggtcgagcgagttgctgtggaacgaaatcataatcttgaatgtcacagcccagtcgcatctggaccttaaggtttggtcctgccatactctccggaacgagctgcttgggactgcctccgtgaacctgagtaatgtacttaaaaacaacgggggaaagatggagaacatgcagctaacactgaacctccagactgaaaataaaggtagcgttgtctccggtggcgagcttaccatttttctggatggaccaaccgtcgatctagggaatgttccaaacgggtccgcattgacagacggatcccaattaccttctcgcgatagcagcggcacagccgttgcccctgaaaatcggcatcagccaccctcgaccaactgctttggcggtagatcgcgcacgcacaggcatagcggggcatctgcgaggaccacacctgccactggcgagcagagtccgggagcacggtctcggcacagacaacccgttaagaactccggccactctggcctggccaacggcaccgtgaacgatgagcccacaaccgcgactgatcccgaggaaccttccgttgttggagtcacctctcctcccgcagccccactgtccgtcacgcccaaccctaatacaaccagcctgcctgcccctgctacgcccgcagaaggtgaagagcctagcacatctggtacccagcagttaccagcagccgcacaggctcctgatgcactgcccgctggatgggagcagagggagcttcctaacggaagggtctactatgtggatcataacacaaaaaccacaacctgggagcggcctctaccccctggctag

SEQ ID NO: 246980 - DNA, 210 bp, Artificial Sequence
  Description of Artificial Sequence: Synthetic coding sequence
atggagtcccctaaaaaaaagaaccagcagctgaaggtgggcatcttgcatctggggtcaaggcaaaaaaagatccgaatccagctgcgcagtcaggtgctgggacgggaaatgcgggacatggaaggcgatctccaagagttgcaccagagtaatactggggacaaatccggatttgggtttcgacgccagggtgaagataatacctag

SEQ ID NO: 246981 - DNA, 246 bp, Artificial Sequence
  Description of Artificial Sequence: Synthetic coding sequence
atggagtctcctaagaagaaaaaccagcagctgaaagtcgggatcttgcacttaggttcccgtcagaagaaaatccggatccagttgagaagtcagtgcgccacttggaaggtcatttgtaagagctgtattagccagacgccgggaattaatttggatttgggcagcggagtaaaggtcaagatcattccgaaagaagagcactgcaaaatgccggaggctggggaagaacagcctcaggtgtag

SEQ ID NO: 246982 - DNA, 441 bp, Artificial Sequence
  Description of Artificial Sequence: Synthetic coding sequence
atgttactatggtgtccaccgcagtgtgcctgctcccttggcgtttttcctagtgcccctagtccagtttggggaacccgcagaagttgtgagcctgccaccagggtgcctgaggtgtggattctgtccccactgcttaggcacgggggacacacccagacccagaaccacacggccagtcctagatcccctgtcatggagagcccaaagaaaaaaaaccagcagctcaaagtgggcattctacatctggggtcacgacagaaaaagatccgcatccagctaaggagccagtgtgcgacttggaaagtgatctgcaagtcatgcatctctcagaccccaggcatcaacctggatctgggttcaggcgtcaaagtgaagatcataccaaaggaggagcattgcaagatgccagaagcgggagaagagcaaccccaagtctag

SEQ ID NO: 246983 - DNA, 210 bp, Artificial Sequence
  Description of Artificial Sequence: Synthetic coding sequence
atggagagcccgaagaagaagaaccaacagctgaaggtgggcatcctgcatttaggcagtcggcaaaaaaagatccgaattcaattgcgtagccaagtcttaggcagagaaatgcgcgatatggaaggagatctccaagagctgcaccaatccaacaccggggataaatccgggtttgggttcaggcgtcagggagaggacaatacatag

SEQ ID NO: 246984 - DNA, 210 bp, Artificial Sequence
  Description of Artificial Sequence: Synthetic coding sequence
atggagagccccaaaaagaagaaccagcagctcaaagtgggaatcctgcacctgggctcaagacaaaaaaagatccgcattcagcttagaagtcaagtcctcggccgtgagatgcgagacatggaaggcgatctgcaggaactccaccagtcaaatacgggcgacaagagcgggttcggcttcagacgtcagggcgaagataacacttag

SEQ ID NO: 246985 - DNA, 246 bp, Artificial Sequence
  Description of Artificial Sequence: Synthetic coding sequence
atggagtcaccaaagaagaagaatcagcagctcaaggtgggcatcttgcatctgggatcccggcaaaagaagattagaattcagttgcgcagtcaatgcgcgacctggaaggtgatatgtaaaagttgtatcagtcagacccctggcattaatctggatcttggatccggggtgaaggttaaaattatcccaaaagaagaacattgcaaaatgccagaagcgggtgaagaacaaccccaggtgtag

SEQ ID NO: 246986 - DNA, 210 bp, Artificial Sequence
  Description of Artificial Sequence: Synthetic coding sequence
atggagagtcccaaaaagaagaatcagcagctgaaggtagggatattacacttggggagccgacagaagaagatccgcattcagctccgctctcaggtcttaggaagagagatgcgggacatggagggcgatctccaggaattgcaccagagcaatacgggagataagagtggtttcgggttccgcaggcaaggcgaggacaatacatag

SEQ ID NO: 246987 - DNA, 441 bp, Artificial Sequence
  Description of Artificial Sequence: Synthetic coding sequence
atgctgctgtggtgccctcctcagtgcgcctgcagcttgggtgttttcccatcagcgccaagcccagtgtggggcactcggaggtcatgcgagcccgcaaccagagtgccggaggtctggattctctcccccctgctccgacatggtggccatacccaaactcagaatcacacagcgtctccaagatccccagtcatggaaagccccaaaaagaaaaatcagcagctgaaagtgggcatcttgcatctcgggagcagacagaaaaagattcgcattcagttaagaagccagtgcgcaacatggaaagtgatatgtaagagctgcatttcccagacacctggaatcaatttggacctcggtagtggggtgaaagtgaaaataattccaaaggaagaacattgcaagatgccggaagcaggagaagagcaaccgcaggtgtag

SEQ ID NO: 246988 - DNA, 246 bp, Artificial Sequence
  Description of Artificial Sequence: Synthetic coding sequence
atggaatctcccaaaaaaaagaaccagcagctgaaggtcggcattcttcacctcggcagtaggcagaagaaaattagaatccaacttagaagtcaatgtgctacctggaaagtcatatgcaaatcctgcatcagtcagacacccggaattaatcttgatctggggagcggcgtcaaagtcaagattataccaaaagaggaacactgcaagatgcctgaagcaggtgaggagcagccacaggtttag

SEQ ID NO: 246989 - DNA, 210 bp, Artificial Sequence
  Description of Artificial Sequence: Synthetic coding sequence
atggagtcccccaaaaagaagaatcagcagttgaaagttggcattctacacttaggaagtcgccagaaaaagatcaggatccagttaaggagtcaagttcttggacgggaaatgcgcgacatggagggggacttacaagagctccatcagtcaaatacaggggataagagcggcttcgggttccgtcgtcagggggaggataatacatag

SEQ ID NO: 246990 - DNA, 246 bp, Artificial Sequence
  Description of Artificial Sequence: Synthetic coding sequence
atggaaagccccaagaagaagaatcagcagttgaaggtcggcatattgcacctcggctcgcggcagaagaaaatacggatacagctgcggagtcagtgcgctacatggaaggtcatctgtaaatcgtgtatctctcagactcctggaatcaatctggacttgggatcaggtgtcaaggttaaaatcatacctaaagaagaacattgcaaaatgccggaagccggagaggagcaacctcaggtctag

SEQ ID NO: 246991 - DNA, 441 bp, Artificial Sequence
  Description of Artificial Sequence: Synthetic coding sequence
atgctgctgtggtgccccccacaatgtgcctgcagcttgggcgtattccccagtgcacctagccccgtatggggcactcggaggagctgtgaacccgctacacgcgttcccgaggtgtggatcctaagtccccttttgcggcatgggggacacacacagacgcaaaatcataccgcgagcccaaggagtccagtgatggaatcaccaaagaagaagaaccagcagctaaaggtggggatcctgcatctgggctctcgtcagaaaaagataagaattcagctgagaagtcagtgtgcaacttggaaggtgatttgcaagtcctgtatttcccaaacaccgggaatcaatctggacctgggttctggagtgaaagtcaagattattccaaaagaggagcactgcaaaatgccagaggcaggagaagaacagcctcaagtctag

SEQ ID NO: 246992 - DNA, 210 bp, Artificial Sequence
  Description of Artificial Sequence: Synthetic coding sequence
atggagtctcctaagaagaaaaatcagcagctgaaagttggcatactccacctaggaagtaggcaaaaaaagattaggattcagctgcgcagtcaggtcctgggcagagaaatgagggacatggaaggagacctgcaggagctgcaccagtcaaacactggggataaaagcgggtttggcttccggcgacaaggtgaagataatacatag

SEQ ID NO: 246993 - DNA, 210 bp, Artificial Sequence
  Description of Artificial Sequence: Synthetic coding sequence
atggaaagccccaaaaagaagaaccaacaacttaaggtggggatcctacatctaggatctcgccagaaaaaaattcgcatccaactgagaagtcaagtactggggcgagaaatgagggatatggagggtgacctacaagagcttcaccaaagtaatacaggcgacaagtcgggtttcggtttccgcagacagggagaggacaatacctag

SEQ ID NO: 246994 - DNA, 246 bp, Artificial Sequence
  Description of Artificial Sequence: Synthetic coding sequence
atggaatccccgaaaaagaaaaatcagcagctcaaggtgggtatacttcaccttggcagcagacaaaagaagattcgaatccagttgcggagccagtgcgctacctggaaggtgatctgtaagtcctgcatctctcaaacccctggcattaatctagacctcggctcaggtgttaaagtgaaaatcatccccaaagaagaacattgtaaaatgcctgaggccggtgaggagcagccacaggtctag

SEQ ID NO: 246995 - DNA, 441 bp, Artificial Sequence
  Description of Artificial Sequence: Synthetic coding sequence
atgctgctctggtgtccacctcagtgcgcttgctctctgggggtgtttcccagcgccccatcccccgtgtggggaacccggcgaagttgtgagcctgctacacgggtgccagaagtgtggatactgtcccccctgttacgacacggcggacacacacagacgcaaaaccatacagcctctccaaggagcccagtgatggagtccccaaagaagaaaaatcaacaactgaaggtcgggatactgcacttgggtagccggcagaagaaaattcgcatccagttgagatctcagtgtgcaacgtggaaagtcatctgtaagtcctgcatttctcaaacccctggcatcaacctcgatcttggttctggggtcaaagtgaaaattatcccgaaggaggagcactgcaaaatgccggaggccggtgaagagcagcctcaggtgtag

SEQ ID NO: 246996 - DNA, 336 bp, Artificial Sequence
  Description of Artificial Sequence: Synthetic coding sequence
atgatctggagaggcaggtcaacttatcggccacggcctaggcgctctgtcccaccaccagagctgatcggtcccatgttagaaccaggggacgaagaacctcagcaggaggaacctcccaccgaatcccgcgacccggcaccaggccaggaacgcgaggaggaccagggggctgccgaaacccaggtgccagacctggaagcggatctccaggagctttcccaatccaaaacagggggtgaatgcggcaatggacctgacgatcaggggaagatcctgccaaagtccgaacagtttaaaatgcccgaaggcggagatcggcagcctcaggtttag

SEQ ID NO: 246997 - DNA, 336 bp, Artificial Sequence
  Description of Artificial Sequence: Synthetic coding sequence
atgatctggcgtggtcgttcaacctatagaccacggccaaggcgtagcgtacctcctccagaacttattgggcctatgcttgagcccggagacgaagaaccacagcaggaagagcctccaacggaaagcagggatcccgctcccggtcaagaaagggaagaggaccaaggggctgccgagacacaggtacctgatctcgaagccgaccttcaagaattatctcaatccaaaaccgggggagagtgcgggaacggccctgacgatcaaggcaagatccttcccaaaagcgaacagtttaaaatgcccgaggggggagataggcagcctcaggtatag

SEQ ID NO: 246998 - DNA, 4002 bp, Artificial Sequence
  Description of Artificial Sequence: Synthetic coding sequence
atgactgcagataaactagtgttcttcgtgaatggcagaaaggtggtggaaaagaatgccgaccccgagacaacactgttggcctaccttcgcagaaagctcggcttgtccgggaccaaactggggtgcggggaggggggttgtggcgcatgcactgtgatgcttagtaagtacgatcggttgcagaacaagatcgtacacttctccgcgaacgcctgtctcgccccaatctgctctctgcaccatgtggccgtgaccacggtggaaggaataggcagcacaaagaccaggcttcaccctgtccaggaaaggattgcgaagtcccacggcagccagtgcgggttttgcaccccaggtatagttatgtccatgtacacactgctgcggaatcaacccgagccaaccatggaagaaattgagaatgcttttcaaggcaacctgtgtagatgcaccggatatagaccgattctacaaggctttagaacattcgcccgagatggtgggtgctgcggcggtgacgggaataaccctaactgctgcatgaatcagaagaaggatcactccgtctccttaagtccgtccctgttcaagcccgaggagttcacgccccttgatcccacccaggagccaatcttcccgccagagcttcttcgactgaaggacacgcccagaaagcagctgcgcttcgagggggagagggttacctggattcaggcctccactctcaaggagttactagacctcaaggcccaacacccggacgcaaagctcgttgttggaaatactgagatcggcattgaaatgaaatttaagaacatgttgtttccgatgatcgtttgccctgcttggattcccgagctcaattctgtggagcatggccctgacggtatctcattcggtgccgcttgtccgctttctattgttgagaagactttagtggacgcggtcgccaaactgcctgcccagaagacagaagtttttcgcggagtgctcgaacagttgcgctggtttgcaggtaaacaggtcaagagtgtggcatcagtcggcggtaatatcatcaccgcaagcccaattagtgatcttaaccccgtgttcatggcatccggcgcaaaacttacgctggttagtcggggaactagacgtaccgtgcagatggaccataccttcttccctggttaccggaagacgctgctgagcccagaggagatattgctcagtatcgagattccctactctagagagggcgaatatttttcagcctttaagcaggctagtagaagagaggatgatatcgccaaggtgaccagcggaatgagagtgctgttcaaaccaggaaccaccgaggttcaagaactggcactttgttacgggggtatggccaatagaacaatctccgctctgaaaacgactcagcgacaactctcaaagttgtggaaagaagaactgcttcaggacgtatgtgcaggtcttgccgaggaactccacttgccaccagacgcaccgggtggcatggtggatttcaggtgtacacttacccttagcttctttttcaagttctacctcacagtgctacagaaactggggcaggaaaacctggaggacaagtgcgggaagctagatcctacctttgcgtctgcaaccctgttattccagaaggacccccctgcggacgtgcagcttttccaggaagtcccaaaaggacagtcagaagaggatatggtgggtcgtccactgccacacctcgcagcagacatgcaggcatccggcgaggctgtgtactgcgatgatatacccaggtacgagaacgaactttccctaagactggttaccagcacacgagcacacgccaaaatcaaaagcatagatacaagcgaagccaagaaggtgccaggttttgtttgtttcatcagtgccgatgatgtgccgggttccaatatcacaggcatctgcaatgacgaaacggtcttcgctaaagacaaggtgacatgtgtcggccacatcatcggcgctgttgtggcagacacccctgaacatacccaacgagcggcacagggggtaaagattacttacgaggagcttcctgccataattacaattgaggacgccattaagaacaattcattctacggacccgagctgaaaatagagaagggggatctcaagaaaggattctccgaggctgacaatgttgtgagcggggagatctacatcgggggacaggaacacttctatctagagacccactgtactatcgccgtgcctaagggggaggcaggggagatggaattgtttgtctcaactcagaacacaatgaaaacacaatcttttgtcgccaagatgttaggcgtcccagctaatagaattgtagtccgcgtaaaaaggatgggtggcggtttcgggggtaaggagacgcgttcaaccgtggtgtcaaccgccgttgcattagctgcatacaaaacgggaagacctgtcagatgtatgctggaccgagatgaagatatgcttattactggcggaagacatcctttcctggctagatacaaggtaggttttatgaagactggtacagtggtcgctctagaagttgatcatttctctaatgtgggcaacacacaggacctgtcacagtccattatggaaagagctttgtttcatatggacaattgttataagattccgaacatcagggggaccggacgcctctgcaagacgaacttgccttcaaacactgctttcagaggcttcggcggacctcaggggatgctgattgccgaatgctggatgagcgaggtcgccgtcacctgcgggatgccagcagaggaagtgcggcgaaaaaatttgtacaaggagggagacttgactcattttaatcagaagctggagggatttaccctccccagatgctgggaggaatgtttggcttcgtcccagtatcatgcccgtaaatctgaagttgacaaattcaataaagagaactgctggaagaagcgcggtctttgcatcatccctacgaagtttgggatatcatttaccgtgccatttctgaaccaagcaggagccttgctgcatgtgtatacagatgggtctgtcctcctgactcacggtggtaccgagatgggccaaggtctgcacacaaagatggtgcaggtggcctctagggcccttaaaattcctacaagcaagatatacattagtgagacctctacaaatacggtccctaatacatctcctacagcagcttcagtgagcgctgacttgaacgggcaggctgtctacgccgcttgtcaaacaatcctgaagcgccttgaaccgtataaaaaaaaaaacccatccggatcctgggaggattgggtgacagcagcctacatggacaccgtatccctaagtgccaccggcttttacaggacaccaaacctgggttattctttcgaaacgaacagcggcaacccgttccattacttttcctacggggtggcctgtagcgaggtagaaatcgattgtctaaccggtgatcacaagaatttgcggaccgacattgttatggacgtgggctcctccctgaatccagccattgatattggtcaggtggagggagcttttgtgcagggcctcgggcttttcactcttgaggagttgcactactcaccagagggctcacttcacacacggggaccatccacgtataagatccctgcattcggcagtattcccatagagttccgcgtctccctccttcgggactgtccaaataaaaaagcaatctacgcctccaaggccgtgggcgagcctcccctatttcttgctgcatccatttttttcgccatcaaggatgctatccgtgcggcacgcgctcaacacactggcaataatgtaaaggaattgtttcggctggactcaccggctactccagagaagatacggaacgcttgcgtggacaagttcactactctgtgcgttaccggcgtgcccgagaactgcaaaccatggtcagtgagagtgtag

SEQ ID NO: 246999 - DNA, 1896 bp, Artificial Sequence
  Description of Artificial Sequence: Synthetic coding sequence
atgaagttcgccgagcacctgagtgcccacataaccccagagtggcggaaacagtatatacagtacgaggcctttaaggacatgctgtactcagctcaggaccaggcaccttctgtggaagtcaccgacgaggatactgtaaagcgttacttcgccaaatttgaggaaaagttctttcagacatgtgagaaagaattggctaaaatcaatacgttttactcagagaagcttgctgaggcccagcggaggttcgccaccctccagaatgagttgcagtcatcactggacgcacagaaagaatctacaggagttacgaccctgcgtcagaggagaaagcccgtttttcacctatcgcatgaagagcgggtgcaacatcgcaatataaaggatctgaaacttgccttctctgagttttatctgagtttgattctgctgcaaaactatcagaatcttaactttaccgggttccgaaagattctgaaaaaacatgataagatcttagaaacaagcaggggcgctgactggcgggtggcccatgtcgaggttgctcctttctacacttgtaaaaaaataaaccagctgattagtgagacagaggctgtggtgactaacgaacttgaagacggggatcggcagaaggcaatgaaacgattaagggtcccgccactgggggcagcccagcctgcccctgcttggactacttttagagtcgggctgttttgcgggatctttatcgttctcaacattacgctggtcctggccgcagtctttaaactcgagactgatagatcaatttggcctttgataagaatctatagaggtggcttcttgctgatcgaatttttgtttctactgggcataaatacatatgggtggagacaggccggagtaaaccatgttctgatcttcgagttgaaccccaggtccaatctgagtcaccagcatctgtttgagatagctggctttcttgggattctgtggtgtctttctctcctggcctgctttttcgcccctataagcgtgatccccacttacgtgtaccctctggccctgtatgggttcatggtcttcttcttaatcaatccaacgaaaactttctattacaagagtcggttctggttacttaagttgctgttcagggtatttacagccccttttcataaggtcggattcgcagacttttggctggccgaccagttgaactctctgagtgtaatcctgatggaccttgagtacatgatttgcttctactccctcgaactaaaatgggacgagagtaagggacttctccccaataacagtgaagaaagagggcactctgacaccatggtgttcttctatctatggatagtcttctacattatcagctcctgttatacacttatttgggaccttaagatggactggggactgtttgacaagaacgccggtgagaacacttttctaagagaggaaatagtttaccctcagaaggcgtactattactgcgcaatcatcgaggacgtcatcctgcggtttgcttggaccatccagattagcattacaagtactacactgctgccccattccggcgatatcatagccaccgtttttgcccctcttgaggtgtttaggaggtttgtgtggaactttttccgcctggagaacgagcacttgaataattgcggggagttccgggctgtaagggatataagcgtcgccccactgaacgccgacgatcagacattactcgaacagatgatggatcaggatgatggtgtcaggaatagacagaaaaataggtcgtggaaatacaaccaatccatctctctccggagaccaaggctcgcctcccagtcgaaagctagggataccaaggtgttgatagaggacaccgacgatgaagccaatacatag

SEQ ID NO: 247000 - DNA, 2091 bp, Artificial Sequence
  Description of Artificial Sequence: Synthetic coding sequence
atgaagtttgctgagcacctttctgcccatattacacccgagtggaggaaacagtatattcagtatgaggctttcaaggatatgctgtattctgcgcaggaccaggcccctagtgtcgaagtcacagacgaggacacggtcaagcgatattttgccaagtttgaggagaagttcttccagacctgcgagaaagaactggccaagatcaataccttttattccgaaaagctagctgaagcccagaggcgctttgctaccttacagaatgaactgcagtcaagcctcgacgcacaaaaggagtctacaggagtcacaacactcaggcagaggagaaagccggtgtttcatttgtctcatgaggagcgcgtgcaacaccggaacataaaagatctcaaacttgctttcagcgaattttacctatcactcatattactccagaattatcagaacctgaactttaccggattccgcaaaatcttgaagaagcacgacaaaatcctggagacgtcacggggagccgactggagggtggctcacgtagaggtagccccattttacacgtgtaaaaaaatcaaccagctgatatcagaaacagaagcagttgtcaccaatgagctggaagatggcgaccgacagaaggcaatgaagagattacgggtcccgcctcttggagccgctcaaccggctcccgcttggaccacatttagggtcgggttattttgcggaatttttatcgtcctgaacatcaccttagtgctggctgcagtttttaaacttgagaccgatcgaagtatctggccactgattcggatctatagagggggattcctgctgatcgagttcttattcctgttagggatcaatacctatggttggagacaagcaggagtaaaccatgtgttgatcttcgaactgaatcctcgctccaatctgtcacaccagcacctatttgaaatcgctggttttctggggatcctgtggtgtctttccctgctggcgtgcttttttgctcccatttccgtgatccctacctacgtgtatcccctggcgctgtacggttttatggtgttttttttgattaaccccacaaaaaccttttattataaatctagattttggctgttaaagctgctttttcgtgttttcactgccccttttcataaagttgggtttgcagatttctggctggctgaccagctgaactcacttagcgtgatccttatggacctggaatacatgatctgtttctattctctggaactgaagtgggacgaatccaagggcctattaccgaataacagtgaggaatctggcatttgccacaaatatacctatggagtgcgggcaattgtacagtgtatcccagcctggttgagatttattcaatgtctccgccgataccgcgataccaaaagagcctttccacatcttgttaatgctggtaagtattctactaccttctttatggtgacgttcgccgctttgtattccacgcacaaagagaggggtcactccgatacaatggtgtttttttatttgtggattgtgttttacataatttcctcctgctacacactgatctgggatctgaaaatggactggggcttgttcgataagaacgccggagagaatacatttctgcgcgaagagatcgtatatccccagaaagcttactattactgtgcaatcatcgaggacgtgattttgcggttcgcctggactattcagatctccattacctccaccacgctgttgccgcactctggcgacattatagccaccgtctttgccccattagaggtcttcaggcggttcgtgtggaacttctttagactggagaatgaacacctcaacaactgcggagagtttcgggcagtgagagatatcagcgtagcccctctcaacgcggacgatcagacacttctggagcagatgatggatcaggatgatggcgtcaggaataggcagaaaaaccggtcatggaaatataaccaatcaatttcgctgagaagacccagactggcttcgcagagtaaggcccgtgataccaaggtgctgatagaagatacagatgatgaagcaaacacctag

SEQ ID NO: 247001 - DNA, 543 bp, Artificial Sequence
  Description of Artificial Sequence: Synthetic coding sequence
atggagtcctggtgggggttgccatgtctcgcctttttgtgttttctgatgcacgccaggggccaaagagatttcgacttagctgacgccctggatgaccccgagcctactaagaaaccaaatagcgatatttatcctaagcctaagccaccctactacccgcagccagaaaacccggactcaggcggtaatatctacccaaggcccaagcccagaccccagccccagcctgggaatagcggaaactcgggaggatactttaacgatgtcgatcgggatgacggcagataccctcctcgaccaagaccgaggccacctgctggcggagggggaggaggctattcctcatatgggaatagtgacaacacgcacggcggagaccaccacagtacttacgggaacccggagggcaatatggttgcaaagattgtgagccccattgtgtccgtcgtagtcgttacactgcttggcgcagccgcttcttacttcaagctgaataatcggaggaattgctttcgcactcatgaaccagaaaatgtgtag

SEQ ID NO: 247002 - DNA, 588 bp, Artificial Sequence
  Description of Artificial Sequence: Synthetic coding sequence
atggagtcatggtggggccttccttgcctcgccttcctctgcttcttgatgcatgccagaggtcagagagatttcgatctcgcagatgctctggatgaccctgagccaactaagaagcccaacagcgatatttatcctaagcccaagcccccttattatcctcagcccgaaaaccccgactctggcggtaacatctaccctagacctaaaccaaggccacagcctcaacctggaaacagcggcaactcaggcggatacttcaacgacgtggatcgcgatgatggcaggtatccccctcgccctaggcccaggcccccagccggtggcggagggggtggttacagttcctacggaaactcagataacacccacggcagaggtggatatcgcctgaatagtcggtacggtaacacttatggaggtgatcaccactctacctatggaaatcccgaaggcaacatggtggcgaaaatagtctccccaatcgtgagtgtcgtggtcgtaaccttactgggcgcagcagctagttattttaagttgaacaatcggaggaattgcttcaggacccacgaaccagagaatgtttag

SEQ ID NO: 247003 - DNA, 546 bp, Artificial Sequence
  Description of Artificial Sequence: Synthetic coding sequence
atggagtcctggtggggtttaccctgtctggccttcctgtgttttttgatgcacgctcggggtcagcgggactttgaccttgctgatgcgctggatgaccctgaaccaactaagaaacctaactctgacatctacccgaaacccaagcctccttactacccccagccggaaaatccagatagtggcggaaacatctatcctcgcccaaagccccgaccacagccccagccaggcaacagcgggaatagcggaggctcttatttcaacgatgtcgatcgtgatgacggaaggtatccacctcggcctcggcctcgtccccctgccggaggtgggggaggtgggtacagctcttatgggaattctgataatacccatggtggggatcaccattccacgtacggaaaccccgagggcaacatggtcgccaaaatagtgtcccccatcgtcagtgtcgtggtggtgacgctgctgggggcagccgcttcttactttaagctcaacaaccgcaggaattgttttcgtacacacgagcctgaaaacgtgtag

SEQ ID NO: 247004 - DNA, 129 bp, Artificial Sequence
  Description of Artificial Sequence: Synthetic coding sequence
atggttgctaagatcgtttctcccattgtctccgtcgttgttgtgaccctccttggggcagccgcatcttattttaagctgaataacaggaggaactgcttcagaactcacgagccagaaaacgtttag

SEQ ID NO: 247005 - DNA, 10650 bp, Artificial Sequence
  Description of Artificial Sequence: Synthetic coding sequence
atgtttccaatgcagaaagggagtctgaatctcctacgacagaagtgggagtcctgcgactaccagcgctcggagtgtcatcccagggactctcattgtactatattccagcctcaggagtccaagctcttggcccctgagggtgaggtagtttccgctcctcagagcctggatcctacctccctgccttatagtaccggagaagagatgtggagttcaaagcccgaagagaaggactccgttgacaagtctaacaacactcgtgaatacgggcgacccgaagttctgaaagaggacagtctgagctcacgtcgcaggatcgagagatttagcattgctctcgacgagctgagaagtgtttttgaagctcctaagtccgggaataaacccgctgagtatgggggtaaagaggttgaaatcgagcgtagtctgtgctcacctgcctttaagtctcaccccggttctcagctggaagattcagtcaaagatagcgataagaagggaaaggaaacctctttcgataagatgtcacccgaaagcgggcattcccgcattttcgaagctacagcaggaccaaacaagcccgagtctggctttgctgaggattctgcagctaggggcgaaggtgtcagcgacctccacgaggtggtgtctctgaaggaacgtatggctcgttaccaggccgcagtgtctagaggcgattgcagatccttttccgctaacatgatggaagaatcagagatgtgtgcggtgccgggagggctcgcaaaggtgaagaagcagtttgaagacgaaattaccagttcgagaaacacgtttgcacagtatcaatatcagcatcagaataggtcagagcaggaggctatccatagctctcaagtagggacctctaggtcaagccaggagatggcacgcaacgaacaagaagggtccaaagtccagaaaatcgacgttcacgggacggaaatggtgtcacatctagagaagcacactgaagaggttaaccaggcatctcagtttcaccagtacgtgcaggagactgttatcgacactccagaagacgaggaaattcccaaggtgtccacaaagctcctgaaggaacaatttgaaaaatctgcacaggaaaagatcttgtatagtgataaggagatgaccactccagccaagcagattaagacagaatccgagtatgaggagacttttaaaccctcgtccgtggtgagtacatcatcaacttcttgcgtgtcgaccagccagcgaaaggaaacgagcacaactaggtattctgatcacagcgtgactagctccactctggcacagatcaacgctacctcgtctggtatgacagaagagtttccaccaccaccacctgacgtattgcagacgtccgtcgatgtgacagctttcagccaatcgccggaactcccctcacctccccgacggctgccagtgccgaaggatgtgtactcaaaacaacgcaatctgtatgagctgaataggctctacaagcatattcatcctgagctgcgaaagaacctggagaaggattatattagcgaagtgtccgagattgttagcagtcagatgaatagtgggagcagcgtcagcgccgatgttcagcaggccagatatgtctttgaaaataccaacgattcatcccaaaaagatctcaattctgagagggagtacttggagtgggatgaaattctgaagggtgaagtgcagagcataaggtggatattcgagaaccagccacttgacagtattaacaatggctcccccgatgagggcgatatctctcggggtatcgcggaccaagagatcattgccggaggggacgtgaagtatactacatggatgtttgagacccagcccattgacactctgggcgcatattcttccgacacggtggaaaatgcggagaagattcccgagctggccagaggcgatgtgtgtactgccagatggatgttcgaaaccaggcccctggactctatgaacaagatgcatcagagccaggaggaatccgcggttacgatcagcaaagatataacgggcggagacgtcaagactgtgaggtatatgtttgagacgcagcacctggatcaactggggcagttgcactccgtcgacgaggttcacctccttcagctgcgatctgagctgaaagagatcaaaggcaacgtgaagagaagcatcaaatgtttcgaaacgcagcctctttatgttatccgggacgggtcaggacagatgctcgagataaaaactgtgcatagggaggacgtggagaaaggagatgtcagaacggcacgctggatgttcgagacacaacctttggacacaatcaacaaggatattaccgaaatcaaggtggtccggggaatatccatggaagagaatgtaaaagggggtgtatctaaggctaagtggttgtttgaaacccagcccctcgagaaaattaaggaatccgaagaggtgattatcgagaaggagaaaattatcggtaccgacgtgtctagaaaatgctggatgtttgaaactcaaccgctagatattttgaaggaagtccccgatgccgactctctgcagcgggaggagatcataggaggagacgtacagacaaccaaacacctcttcgagactcttccgatcgaagccttaaaggattcacctgacattggcaagcttcagaagatcacggcttccgaagaggagaaaggggacgtgagacatcagaagtggatctttgagacacaacctctcgaagatattagaaaagacaagaaggaatacaccagaacagtgaaactcgaagaagtcgatagaggggacgttaagaattatacacacatatttgaaagcaataatcttattaagttcgacgcttcccacaagatagaggtggaaggagtaacacgaggcgctgtcgagctaaataagtcattgttcgagactacgcctctttacgcaatccaggaccccctaggcaagtatcaccaggtgaagacggtacagcaggaggagatcgttcgaggtgacgtgcgtagctgcagatggctgtttgagacccgcccaattgatcagttcgatgagtcaattcacaaattccagataattcggggaatctcagcccaagaaatccagactgggaacgtcaagagcgccaaatggcttttcgagacacagcccttagattcaatcaaatacttcagcgatgtggaagagaccgaaagcaaaacagagcaaactcgagacattgtaaaaggagatgtgaagacgtgcaagtggctgtttgagacccagcctatggaaagtctgtacgagaaggttagcctgatgaccagctcagaggaaatccacaagggtgacgtgaagacctgcacctggttgttcgagacccagcccctggacacgatcaaggacgactcggaaacggcggtcaagctccagactgtgaagcaggaggaaattcaaggaggtgacgtccggacagcttgtttcctattcgagaccgaaaacctggactcgattcagggggaagaggtgaaagagattaagccagtggagatggatatccaggcaggggacgtaagtagtatgcgctacaagtttgaaaaccaatctttggactcgatctcatccagctcagaggaggttctgaagaagatcaaaacacttaaaaccgaggacatccagaaagggaatgtcctgaattgtaggtggctctttgaaaaccagcctatcgacaagatcaaggaatctcaggagggcgatgagtgcgtcaaaaccgtgacagatatccaaggtggtgacgttagaaaaggatgctttatctttgagactttttcactcgacgagatcaaggaggagagcgattacatcagcaccaaaaagaccataactgaggaggtgatccaaggggatgtgaaaagctatagaatgctgttcgagacccagcccctgtacgcgatccaagacagagagggaagctaccatgaggttaccaccgttaagaaggaggaagtgattcacggagatgtaaggggtacacggtggctcttcgaaactaagcccctggatagtattaataaatccgagacagtgtatgtaatcaaaagtgtgacacaggaggatatccagaagggcgacgtgtcctccgttagatataggtttgaaacacagcccctggatcagatcagcgaagaatcacacaacatcatgccttctattgatcacatacagggcggaaacgtcaaaacctcgcgccagttctttgaatccgaaaattttgataagaacaattacatcaggacggtgtcagtgaacgagattcaaaagggcaatgtgaaaaccagtacgtggcttttcgagacccacacaatggatgaactacgaggagagggcctcgaatacgaaaacatcaagaccgtgactcaagaggatgttcagaaaggcgatgtcaaacaggcagtgtggctgttcgagaaccgaacctttgactccattatggaggcacataaagggataactaaaatgacaaaggaggagattcccccatcagatgttaaaaccacgacttggctgttcgagactacgcccctgcacgaattcaacgaaactcgggtggaaaaaatcgaaattatcgggaagagtataaaggaaacacttgaagacctgtactctcagaaggtcatccaagcccctgggatcatcattgaggccgacgaaataggtgatgtgcgaatggccaagtacaagctcatgaatcaggcgtctcccgagattcagaaggaggagatcattcgagctgacttgcgaaatattatggtgaacctattgagcaagcgggactgtaccgagcgcgagatacttatctctgaagaagagaagggcaacgtgaacttaacaaagactcagcttttgaatcgatcaaccgagttccatgccgagaaggaggagattgtgaaaggagacgtacagcaggcaattaagaatctgtttagcgaagaaagatccgtcaagaaggggatcctgatccaagaggacgagaaaggtgacattaatatgacaatctactgcttgctccacgagaatgacggcgacacgatagaaagggaggaagtgattggtggcgacgtcaaacggacgatccataatctcctctcaagtacatccaataacaaaatcagcgaacgggcaaagattgatgcttcggagcgagggaatgtgcagttcttcacaacgtgcatagaggcaggggcactggattacttgaagcagttgcacacagaaagcaatgagactttaaccgccaagaagcaagaaggcgagaaagagattatagggggagacgtggagggtactaaactcctgttgaagaaacggcagtcattagtggagaggaccgtgtccgaaacagatattattcccggtgacgttcacaacactgtcaaagtgttcatgaccgagccacaatcgacatttggcaaaattccaaaagaggagattattaaaggcgacctcacatccacactgaactcactaagccaggcggtgaatcagaagacagttaccaaaacggaagaaataattaaaggaaatatgctggcaacattaaaatcactgaaagaatcatctcataggtggaaagaatcaaagcaacccgatgcaataccaggggatatagaaaaagctattgaatgtcttgaaaaagcgacaaacacaaagacagaaatcctgaagaaggaacttctgaaggacgacctcgaaaccagcctgaggagtctcaaggaggcccaaagatcatttaaggaggtccataaggagggtgtgattaagaaagatgctaaggctgtgatggccggttcctcaggtgagcaaaaaaccgatattcatcaggtggctgttcagaggaacaagaactccctgctgcagccgaagcccggtcctttcgaacccgctgccaagtggcagggcggtgcagatacacttagccagactatgggaaagagctgtcatgggaatctagtggaggaacgcacagaagtcaaccttcctaaagcgcctaaaggcaccgtaaagatcgtgattgacagggaacagaacaacgacgccctggagaagtcactacggcgactatccaacagtcaccacaagtctaacgtgctcgagtctggtgataagaccggagtttggacggacaccacaggtgaacagcatttacgcgacgagtatatgtccagacagctgacctccaccgtgtctgtcaagaataacctcactaccaaggagtcagatagagcagtgcgtgagcttaagaaagatgatgtgttcaactccatacaatcggcaggaaaaaccgttgggaaacagcaaacgtatgaactgagaaacgaccaccaaaagatggaaggcttccacattaaaagcccaaaaaaaactaagaacattaagatccttacagacacccagtcatcgaagcctagcccaacccagcatccagtctcaatgccagtgggaggcacttacgacctgtcgggagatttccaaaagcagacactgttaaagcaagagacgaagtattccaacaaggatatcaagaagaaaaatataaatcttcagccaatgtggcaattactccccgtcgaacaggatacctcgaatgtgacagaaatgaaagtgagcgagaaatctcataacacctttaaagccacgaataagaagcgagagactgatgtgcatctgaagagtcaggattttcttatgaagaccaacacaagcaccggactgaagatggccatggagagaagcttgaatcctatcaactttaatcccgagaataatgttaaggagagtgaatgtcctctgccaccaccctcccctccccctcctcctccatccaatgccagctccgagattgaatttccattacctcctcctccccctttaatgatgttccctgaaaagaatggcttcctcccttctctgagcactgaaaagataaaagccgaatttgagtcatttccaggtttacctctgccccctcctccggtagacgaaaagtcggagagggagagctcttcaatgtttctgccacctccgcctcccccaacgccatctcagaaacctgcacatctcctcagtagctccgcaccagagaagcatagtggtgattttatgcagcagtatagtcagaaggaggcaagcaattctcagaattcccaagcgaagatcattactgggaaaaccggagtgctgcctccgccaacattgcccaaaccgaagctgccaaaacatattaaagacaacaaaaacgacttcagtcctaaagtggaactagcaactagcctgtccgacatggagtgtaaaatcaccacatccaaggatcaaaagaaagtcatggtgatgacaagcagtgaacacactgaaacaaagcagaatgtcatctccaagtcactcgatgaacgaaagcagttgtccatcgacagtgctaattgcctatcacacaccgttcctggaacctctgccccacgcaagaagcagatcgctccccttattaagagccatagtttccccgagagcagtggccagcagaaccccaaaccttatatgcgcaagtttaagaccccactgatgattgccgaggaaaaatatcggcagcagaaggaggaaatcgaaaagcaaaaacaggaaagctcgtattataatatcgtaaagacccaaagtcaaaaccagcacattaccgaggtggaaaaagaaatgccactccagaaaaccaacgaagaagtgtcgctgagtggcatcgatagcgagtgcacggtagtgcaaccatctccgggaagccagtccaacgctagaattctgggcgtttgctctgacaatcagctaagtacaacgtcacctgaaacggttgctgcaaagagactacatcacgtgcttgctgcctctgaagacaaagataaaatgaaaaaggaggtgttacagtccagtcgagacatcatgcaatcaaagagcgcttgtgagattaagcagtcccatcaggagtgtagtactcagcaaactcaacagaagaagtacctcgaacaattacacttaccccaatctaagccaatttcacctaatttcaaagtgaaaactatcaagctgcctacactggatcataccctcaacgagactgaccactcgtatgaaagtcataagcagcagtccgaaatagacgtgcagactttcaccaaaaagcagtacctgaaaacgaagaagaccgaagctagcacagaatgttcccataagcagtctctcgccgagagacactaccagctgccaaagaaagaaaagcgagtgactgtccagttaccgacagaaagcattcagaaaaaccaggaggacaagttgaaaatggtgccgagaaaacaaagggaattcagcggcagtgacaggggtaagttgcctggaagcgaagagaagaaccagggcccttccatgatcggcagaaaggaagaaaggttgattaccgaacggaagcatgaacatcttaagaacaagtctgccccaaaggttgtgaaacaaaaggttattgacgctcacctggactctcagacacaaaacttccagcagacgcagattcagacagctgagtctaaagccgagcataagaaactaccccagccctataactctctgcaagaggaaaagtgtctggaggtgaaaggaatccaagaaaaacaagtgttttccaacactaaggatagcaagcaggagataacacaaaacaagtcctttttcagttctgtcaaagagagccaacgcgacgacggcaagggagctttaaacatcgttgagtttctgcgcaagcgggaagagctccagcaaatactgagcagagttaagcagttcgaggctgagcccaacaagtccggactgaaaacctttcaaactctcctgaacactatccctggttggctgatttctgaagacaagcgcgaatacgccgtgcatatcgcaatggagaataatctggaaaaggtcaaggaggagataacacacattaaaactcaggcagaggacatgcttgtgtcatacgaaaatattattcagactgcgatgatgagcagtaagaccggtaaaccgggaaacaaaccaaccagcctcgatgaaacgtcctctaaagtatcaaacgttcacgtttcaaataacaaaaactctgagcagaaagagaataagatcgctaaagagaagactgttcagcatcaagttgcagcccaccacgaagctacagttcgttcccacgtgaaaacacatcaggagatcaagctagatgattccaacattccccctccttctctgaagacacgccctcctagccccaccttcatcactatagagtccacagccaggcggacagagaatcccactaaaaacgaattaagccaaagcccaaaaaaggattcctatgtggaaccaccacctcgaagaccaatgtcccagaaatcagagatccaccgggcaaacaccagcccttccccacccaggagccggtctgaacagttggtgcgcttgaaagacacaactgcaaagctgtccaagggagccatcccctgtcccgcagctacccccgtccccatagtggagaaaaggtcagagatcattatgagcccagccaccctaaggaggcagatcaaaatcgagactcggggacgcgatagtcctcccaccatcactatacctgtaaatattaaccacgctgcgagcgggtctttccgtgaaagcgtggacgcgcaagaggaaatccggaaagtggaaaaaagggcaacatatgtccataaggatggattgaattccacggaccacatggtccctgatacagaatcctacgatgctgtggagatcatcagaaaggtcgctgtccctccaaggctcagtgagcacacgcagcggtacgaggcagctaatcgcacggtgcagatggctgaaaacttcgtgaatgacccagagaacgagattaataggtggttcagagaatttgagcacggtcccgtttccgaagccaagagcaaccgcagggtctatgcaaagggtgaaacaaaccacaacatccagcaggagagcaggactttttgtaaggaagagttcgggctgactagtttaggcaatacctcctttaccgatttttcctgtaaacatccacgcgagcttcgagagaaaatccctgtaaaacagcccaggatctgttcagaaacccggtccctgtctgaacatttcagcggtatggacgcctttgaaagtcagatagtggaaagcaagatgaagacatcatcaagccactcatccgaagcaggcaaatcaggatgcgatttcaaacacgctcctccaacttatgaagacgtaattgctggacatatacttgatatctcagatagccctaaggaggtgcgcaaaaacttccaaaagacatggcaggagtcaggcagagtattcaaaggccttgggtatgccacagccgatgcttccgcaacggaaatgcggacaacatttcaggaggagtctgcctttattagtgaagctgctgcccctagacaggggaacatgtacacgctctccaaagatagcctttccaacggggtgcccagtggaaggcaggccgaattcagctag

SEQ ID NO: 247006 - DNA, 2817 bp, Artificial Sequence
  Description of Artificial Sequence: Synthetic coding sequence
atgttccctatgcagaagggatctctgaacttgctgagacagaagtgggagtcttgcgactatcagcgctctgagtgtcaccctagggactctcattgcactattttccagccccaggagtcaaagctcttagcaccagagggggaagtggtcagcgcaccacagtctctggaccccacatcactaccatacagtaccggagaagagatgtggtcctctaaaccagaagaaaaggatagcgtggataagagcaacaacacccgcgaatatgggagacccgaggtgctaaaagaggactcactgtcatctagacggcgaatcgagaggtttagtatagctctcgatgaacttcgaagcgtatttgaggcccctaaatcagggaataaacctgcagaatacgggggtaaggaagtcgagatagagcgtagcctttgctcccccgcttttaagtcgcaccctggctctcagctagaagattctgtgaaggactcagataaaaaaggtaaagagacatccttcgacaagatgagtccggagagcggtcattcccgcatcttcgaagcaaccgctggccctaataagccagagtctggattcgctgaggactccgcagcgaggggcgaaggtgtgtccgatttgcatgaagtggtgtccctcaaggagcggatggccagatatcaagcggcagtgtccaggggcgattgccgcagcttctccgccaacatgatggaagaatccgagatgtgtgccgtgccagggggtttggccaaggttaagaaacaatttgaggacgaaattacaagctcaagaaatacatttgcgcagtaccagtaccaacaccaaaatcgaagtgaacaagaggctattcactccagccaggttgggacatcaagatcatctcaggagatggctagaaatgagcaagaaggatcaaaagtccagaagatagacgtccatggcacagagatggtgtcccatctcgagaagcatacagaagaagttaaccaggcatcgcagtttcaccaatacgtccaggaaacagtcatcgacacccccgaagatgaggaaattcctaaggtgagcactaagctgctgaaagaacagtttgagaaaagtgcacaggaaaaaattttgtattcagataaagaaatgactacaccggcaaaacagatcaagaaattgctcttacaggacaaagaaatttgtatcctctgtcaaaagactgtttatccaatggaatgtctggtggcagataaacagaacttccataagtcatgctttcgctgccaccactgtaactcaaagttgtctctcggaaattatgccagccttcacggtcagatttactgcaaaccgcactttaagcaactcttcaagtccaagggcaattacgacgagggatttgggcataaacaacataaagatcgctggaactgtaaaaatcagtcccggtcagtagacttcatcccgaatgaagagccaaacatgtgcaaaaatatcgccgagaatactctggtcccaggagaccgaaatgaacatctggatgctggcaatagcgaggggcagcgtaatgacctgaggaagttgggggagagaggtaagctcaaagtgatctggccgcctagtaaggagatccccaaaaaaaccctcccgtttgaagaagagctgaagatgtcaaagcccaaatggcccccagagatgaccacattattatcccccgagttcaaaagtgagtctctgctggaagatgtccgcacccccgagaacaagggccagagacaggaccactttccctttctgcagccatatctccagtcgacccatgtgtgccagaaggaagacgtgatcggtattaaggaaatgaaaatgcctgaaggaagaaaagacgaaaagaaggagggcagaaagaatgtccaggaccggccttctgaagctgaggatacgaaatcgaacaggaaatccgctatggatttgaacgacaacaacaacgttatcgtgcagtctgccgaaaaggagaagaacgaaaaaaccaaccagacaaatggggcagaggtccttcaggtgacaaacacagacgacgagatgatgcctgagaatcataaagaaaacctgaacaaaaataacaacaacaattacgtcgcagttagctatctgaataactgccggcagaaaacaagtatcctagagtttctggacctcctgccactctccagtgaggccaatgacaccgcaaatgagtacgaaattgagaagctggagaataccagccggattagtgagttgctggggatattcgagagcgaaaagacatacagtcgcaatgtcctggctatggcacttaagaaacaaacagatcgcgctgccgctggcagccccgtccaacccgctcccaaaccgtcactaagtagaggcctcatggtcaaaggaggatcatccattatctcccccgataccaaccttctcaacatcaaaggcagccattcaaagagtaaaaacctacacttttttttctcaaatactgttaagattactgcttttagcaagaagaatgagaatatcttcaactgtgatctcatcgactctgttgaccagattaaaaacatgccctgtcttgatctgagagaattcggcaaagatgtgaagccgtggcacgtagagaccacagaagctgccagaaacaatgaaaatacgggctttgacgccttaagtcatgagtgtaccgccaaacctctcttcccaagggtcgaagttcagtccgaacagctcacagttgaggaacagataaagagaaatcggtgttacagcgacactgagtag

SEQ ID NO: 247007 - DNA, 10650 bp, Artificial Sequence
  Description of Artificial Sequence: Synthetic coding sequence
atgtttccaatgcaaaaaggaagcctgaacctgttaaggcagaaatgggaaagctgcgactaccagaggtctgagtgccatcccagggattcacattgcacaatatttcaaccgcaggagagcaagctgctggcgcctgagggcgaagttgtgagcgcacctcagagcctggaccccacctcactcccctacagcaccggagaggaaatgtggtcatccaaacctgaagagaaagattccgttgacaagtctaacaacacccgcgaatatgggagacctgaggtcctgaaggaggacagtctgagcagccgacggagaatagaacgcttctctatcgccctggatgaattgcgcagtgtgtttgaagcacccaaaagcggcaacaaacctgccgaatacggcggaaaagaagtggagattgagagatccttgtgcagtcctgcctttaaatcccaccccggttctcagctggaagattcggtgaaagacagtgacaagaaaggaaaagagacttcttttgataaaatgtcgccagaatcagggcattccaggatcttcgaggctactgcaggtcctaataaacccgagagcggatttgccgaggacagcgctgccagaggggagggggtgagtgaccttcacgaggtggtgtcactgaaggagcggatggccagataccaggcggcagtgtcccgaggcgattgtagatccttctctgccaacatgatggaagagagcgagatgtgtgctgtgccagggggactggcaaaggtcaagaaacagttcgaagacgagatcacgagttcccgcaacacgtttgcccagtatcagtaccagcaccagaaccgctccgagcaggaggcgatacatagttctcaggtgggcacctccaggagcagtcaggaaatggcgagaaacgaacaggagggatctaaagtacagaaaatagacgtacatggaacggagatggtgtcccacctagagaaacacactgaagaggtgaatcaggcatcccagttccaccagtatgtgcaggaaaccgtcattgatacccctgaggatgaggaaatcccaaaagttagcacaaaactgctaaaggagcagtttgagaagtccgcccaggaaaagatactttactctgacaaggaaatgactacacctgctaagcagattaagacagaaagtgagtacgaagaaacctttaagccatcttctgtggttagcacatcatccaccagttgcgtgtccacgtctcaacgcaaggagacttccactacccggtacagcgatcattctgtgacctcctcaaccctggcccagattaatgccacgtcatcaggcatgaccgaagagtttcccccacctcccccagacgtactgcagacttctgtcgatgtgactgccttctcacagtcccccgaactgcctagccccccacggagactaccagtgccaaaagatgtgtattccaagcagaggaacttgtatgagctgaacagactttataagcatatccatccggagttgagaaagaaccttgagaaagactacataagcgaggtcagtgaaattgtctcttcacagatgaactctggcagcagtgtgagcgccgacgtccagcaggcccgttacgtgtttgagaacacaaatgattcaagccagaaggacctaaacagtgagagagaatacctcgaatgggacgagattttaaaaggcgaagttcaatccattagatggatctttgaaaatcaacctctggatagtattaacaatgggagcccggatgagggagacatcagccgagggatagcagaccaggagataattgctgggggagatgttaagtatacaacctggatgtttgagactcagcctatcgacaccctaggcgcatactcgtccgacacagtggaaaacgctgagaagataccagagctggccaggggggacgtgtgtactgcacggtggatgttcgaaacccggcctctcgactcaatgaacaagatgcaccagagtcaagaagaaagcgccgtgaccatatccaaggacataactggcggagacgtgaaaacggtaagatatatgttcgagactcagcaccttgaccagctcggccaattgcactccgtggacgaggtgcacctcctgcagttgcgcagcgagttgaaagaaatcaagggaaacgtcaagaggtccataaaatgctttgagacacagccattatatgtcatccgtgacggatccggacagatgctcgaaattaagacagttcatcgcgaagacgttgagaaaggcgatgtgcgcaccgcgagatggatgttcgagacgcagcccctcgacacaatcaataaagatatcacagagattaaagttgtgagaggcattagtatggaggaaaacgtaaaggggggtgtaagcaaggccaaatggctgtttgaaacccagcccctcgagaagatcaaagaatcagaggaagtcatcattgagaaggagaagattatcggcaccgatgtcagtcgcaagtgctggatgttcgagacgcagccactggatattctcaaagaggtacctgatgcagattcactccagcgcgaggaaatcattggtggagacgttcagactacgaaacacctttttgagaccttgccgattgaggccttgaaagatagcccggacatcggaaaacttcagaaaattaccgcatctgaggaggaaaagggagacgtgcgacaccagaagtggatcttcgaaacacagcctctggaggacatcaggaaggacaaaaaagagtacactcgcacagtcaaacttgaggaggtggataggggagatgttaagaactatacccatattttcgaatccaataatttaattaagtttgacgcttctcataagatcgaggtcgagggggtgacccggggagccgtcgaactgaataagagcctgttcgagacaactccattgtacgccatccaggatccactcggtaagtaccaccaagtgaaaactgtccagcaggaggagattgtgaggggcgacgttcggagttgcagatggcttttcgagacacggccaatcgaccagtttgatgagagtatccacaaattccagattatcagggggatctccgcccaggaaattcagacaggcaacgtcaagtccgccaaatggttgtttgaaacacagcctttagacagtattaaatacttttccgacgtggaagaaaccgagtcaaagactgagcagacacgcgatatcgtgaaaggcgatgtgaaaacttgtaagtggctctttgaaacccagcccatggaatccctgtacgaaaaagtgtcactgatgacttcgagtgaggaaattcacaagggcgacgtgaaaacttgcacatggttgttcgagacacagcccttggatactatcaaagatgattctgagactgctgtgaagctccagactgtaaagcaggaggagatccagggcggagatgtgcggactgcatgtttcctattcgagaccgagaatcttgactccatacagggcgaggaggttaaggagatcaaaccagtggagatggacatccaggccggagacgttagctccatgcggtataaattcgagaaccaaagcctcgactccatttcctcctcttctgaggaagtactcaagaagattaagacccttaaaactgaggacatccagaagggaaatgtgttgaactgtagatggctattcgaaaaccaacccattgacaaaattaaggagtcgcaggagggtgacgaatgcgtcaaaaccgtgactgacattcagggcggtgatgttaggaaaggctgttttatattcgaaaccttttcactggatgagataaaggaggaaagcgattacatctccactaagaagacgattactgaagaggtcattcagggggatgttaagagctaccgtatgctctttgaaacccaaccactttatgccatccaggaccgtgaggggtcctaccatgaggtcacgaccgtgaagaaggaggaggtgatccacggggacgtgagggggaccagatggctgtttgagacaaaacctttagattcaatcaacaagtccgagactgtctacgttattaagagcgttactcaggaggacatccagaagggcgatgtgagctccgtcagatatagattcgagactcaaccattagaccaaattagcgaggaaagccacaatatcatgcccagcattgaccatattcagggtgggaatgtgaagacttcgaggcagtttttcgagtctgagaattttgacaagaacaattatatacgaactgtctccgtgaatgagattcagaagggtaacgtgaagacctctacctggttattcgaaacacacacaatggacgaacttaggggtgagggcctcgagtatgaaaacataaaaactgtcactcaggaggatgtgcagaaaggagacgtgaaacaggccgtgtggttgttcgaaaatcgcacctttgatagtatcatggaagcacacaagggaatcacaaaaatgaccaaggaagagataccccctagcgacgttaagaccacaacatggctgtttgagacaacccctctccacgaatttaacgagacacgcgtcgaaaagatcgaaatcataggcaaatccatcaaggagactctggaggacctttattcccagaaggtcatccaggctccagggataattatcgaggccgacgagattggtgacgtgaggatggcaaaatacaaactcatgaatcaggccagtcctgaaatccagaaggaggaaattatccgggcagatttgcgcaacatcatggtaaatttgctgtctaagcgcgattgcacagagagggaaattcttatctccgaagaggaaaaagggaatgtgaacctcacaaaaacccagctcctgaatcggagcactgaatttcatgccgagaaagaagaaatagtcaaaggcgacgtccagcaggcaatcaaaaacctgttttcggaagaaaggtcagtgaagaaagggattctcattcaggaagacgaaaagggtgacataaacatgaccatctattgcctgttgcacgaaaacgacggtgatactatcgaacgtgaggaagtgataggcggagatgtgaaacggactatccacaatctgttgtcttcaacatcaaataataaaatttccgagagagccaagattgatgccagtgaaaggggcaatgtccagttcttcaccacctgtatagaggcaggcgcacttgactacctcaaacagctgcatactgagagcaatgagactcttactgcgaaaaaacaggaaggcgaaaaagagatcatagggggtgacgtggaggggactaagttattgctcaagaagcggcaaagcctggtggagcgcaccgtaagtgagacagatataattccgggtgacgtacataatacagtcaaggtgtttatgacggaaccacagtcgacgttcggcaagatccccaaagaggagatcatcaaaggagacttaactagtactctgaacagtttgtctcaagctgtgaaccagaaaacggtcacgaaaacagaggagattatcaaagggaacatgttggctacgctcaagagtctcaaggaatctagtcatcggtggaaagagtcaaaacagcccgatgccatccccggtgatattgaaaaagctattgagtgccttgaaaaggcaaccaataccaagacagaaatattgaagaaagagctgttaaaagatgaccttgagacatcacttcggagcctcaaagaggctcaacggtcattcaaggaggttcataaggagggcgttatcaaaaaggatgctaaggccgtgatggccggttcctcaggtgagcagaagacagatattcatcaggtggctgtgcagcgaaataagaactccctcctccagcctaagccgggtccctttgaaccagccgctaagtggcagggtggggcagacactttaagtcaaacaatgggaaagagctgccatggcaacttagtcgaagaaaggaccgaggttaatctcccaaaggcgcctaaggggacagtcaaaattgtgatcgaccgcgagcagaataacgatgccttggaaaagagcctaagacgcctctcaaattcgcaccacaaatccaatgtgctcgaatcgggggataagacaggggtatggaccgataccaccggagaacaacaccttagagatgagtacatgtctaggcagctgacgtcgactgtctccgtcaaaaataatcttactacaaaagaaagtgaccgggctgtgcgtgagctgaaaaaagatgacgtgttcaactctatccagtcagccggaaaaacagtgggtaaacagcagacatatgagctgcggaatgaccatcagaaaatggagggcttccatataaagtccccgaaaaaaaccaagaatatcaaaatcctgacggatactcaatccagcaagccttcaccaacccagcatccggtctccatgcctgtcggcggaacctacgacttatcgggcgattttcagaaacaaaccctgttaaaacaggaaacaaagtacagcaataaagacattaagaaaaagaacatcaatctacaacctatgtggcaacttctcccagtggaacaggatacatctaatgtaaccgaaatgaaggtgagcgagaagtcccataacaccttcaaagcaaccaacaagaagcgcgaaactgacgttcatctgaaaagccaggatttcttaatgaaaaccaacacaagcacggggctaaaaatggcgatggagaggtcactgaaccctattaattttaaccccgagaataacgtaaaagaaagcgagtgcccgctccctcctccctcaccccctccccctccccctagcaatgcttctagcgaaatcgaattcccgcttccccctccacctccactgatgatgttccctgaaaagaatggctttctacccagcctgtctacagagaagataaaggcggagtttgaatccttcccaggcctgccactccctcctcccccagtagacgagaagagtgaacgggaatctagttcaatgtttctaccccctccgcctccacctactccatcccagaagccggctcaccttctcagcagttccgcacctgaaaagcactcaggtgactttatgcaacagtacagccagaaggaggcttcaaatagtcaaaacagccaagcaaagatcattaccggaaaaacaggcgtgctgcctcctcctacgctcccaaaaccaaaactgcctaagcacatcaaagataataagaatgatttcagtcctaaagtggaactcgctacttccctgtccgacatggagtgcaagatcacaactagtaaggaccagaagaaggttatggttatgacctctagcgagcacacagagacaaagcagaatgttatcagcaaaagtctggatgaacgcaaacaattaagcatagactccgctaactgcctgagtcacacagtgcctggcacgagcgccccaagaaagaaacaaatcgcacctcttattaagagccacagttttcctgagagctcaggacaacagaatcccaagccctacatgcgcaagttcaaaacccctttgatgattgcagaagaaaagtatcgccagcagaaggaagagatagaaaagcaaaagcaggaaagcagttattacaacattgttaagactcaatcccagaaccaacatataacagaagtcgagaaagagatgccattgcagaagactaatgaagaagtgagcctatctggcatagactccgagtgcaccgtggtgcaaccatctcccggttctcagtcaaacgcccgaatccttggggtatgttcagacaaccagctgagtaccacatcccccgagacagtcgccgcaaagcggttgcaccatgtcctagcagcctccgaggacaaggacaagatgaagaaggaggtgttgcaatcttcacgggacatcatgcaatcaaagagcgcctgcgagataaagcagagccatcaggagtgctccacccaacaaacacaacagaagaagtacctcgaacagctgcacttgccgcagagtaagcccatcagtccaaactttaaggtcaaaaccattaaactgccgactcttgatcatacactgaacgagaccgatcattcgtacgaaagccacaagcagcagagtgaaatcgatgtccaaactttcacaaagaaacagtatctgaagacgaaaaagacagaagcaagtactgaatgttctcacaagcagagtctggccgaaagacactatcagctgcctaagaaggagaaacgcgtaacagtgcagctcccgaccgagagcatccaaaagaaccaggaagataagttgaagatggtgccacggaagcaaagggagttcagcggaagcgaccgaggaaagctacccggaagcgaggagaaaaaccagggtcccagcatgatcggtcgaaaggaggagcgcctcataaccgagcgtaaacacgagcatctcaagaacaaatcagctcctaaagtggtcaaacagaaagtcatcgacgcccacctggatagccagactcagaacttccaacagacacaaatccagacagcagagagtaaagctgaacataaaaagctgcctcagccctataattcgctgcaggaagagaaatgtctggaggtgaaaggaatccaggagaagcaggtttttagtaatacaaaagactccaaacaggagattacgcagaataagagcttcttcagctctgtgaaagagtcacagcgcgacgatggtaaaggcgctcttaatatcgtggaatttctgcgcaaacgagaagaattgcaacagatcctgtctcgagttaaacagttcgaggccgaaccgaacaaatcggggctgaagacctttcagacacttctaaatacgatccctgggtggctcatctcagaggataaaagagagtacgccgtgcatattgctatggaaaacaatcttgagaaagtgaaagaggaaatcactcatatcaaaactcaggcagaggacatgctggtgagctacgagaatatcatccaaaccgccatgatgtcctctaagacaggaaagccagggaacaagcccacaagcctcgacgagacctcgagcaaagtgagtaacgtgcacgtgagcaacaacaagaacagtgagcagaaggagaacaagattgcgaaagagaaaacagtgcagcatcaggtggccgctcaccacgaagccactgtcagatcgcacgtcaagacccatcaggaaattaagttggacgacagcaatatccccccaccttcactcaagaccaggccaccctctccaacgttcattacaattgaatctactgccagaagaaccgagaaccccaccaagaatgagctgtcccagtccccgaaaaaggactcctatgtggagccaccccctcgaagaccaatgtcgcagaaatccgagatccatcgggctaatactagtccaagccctcctcgatcccgatccgagcagcttgttcggctgaaggacacgacggcaaagctgagcaagggagctataccatgtcccgcagcaacacctgtgccaatcgtagaaaagcgttcggaaatcataatgagccctgctacattgcgcaggcaaatcaaaatagaaacgaggggtcgtgattcacctccaactatcacaatccctgtcaatatcaaccatgcggctagcggttcttttcgtgaaagtgttgacgcacaggaggagattcgtaaggtggaaaagagagcaacatatgtgcacaaggatggccttaatagcacggaccacatggtgcctgataccgagagctacgatgcagttgagatcatccgtaaagttgcggtgcctccccgactgagcgagcacacgcaacgatatgaagccgctaatcggacagtccaaatggctgaaaacttcgtgaacgatccagagaatgaaatcaacaggtggttcagagagtttgaacatggcccagtgtcagaggcgaagtccaatcggcgagtgtacgccaaaggagaaaccaaccataatattcagcaggaatcaaggacgttctgcaaggaagagttcgggctgacaagtttaggtaacacaagcttcaccgattttagctgcaagcaccctagggaattacgcgaaaaaattccagtcaagcagccaaggatctgtagcgagacccggtctctgagcgagcattttagtggcatggatgccttcgaaagccagatcgtggagtccaaaatgaaaactagtagctcacacagcagcgaggcgggaaagtcaggttgtgatttcaaacatgcacctcccacgtatgaggacgttattgcgggacatatcctggacatctccgatagcccaaaagaggtgaggaaaaactttcagaagacatggcaggaaagcggaagggtgttcaagggactggggtacgcaacggcagatgcaagcgccaccgaaatgcgaaccaccttccaagaagagtccgcttttatttctgaggccgcagccccaaggcagggaaacatgtacactttatccaaagattccctctcaaatggcgtgccttccggtcggcaagcagagttctcttaa

SEQ ID NO: 247008 - DNA, 9984 bp, Artificial Sequence
  Description of Artificial Sequence: Synthetic coding sequence
atggcacggtaccaggccgctgtctctcggggagattgcaggtccttcagcgcaaacatgatggaagagtccgagatgtgcgccgtgcccggaggtttagccaaggtgaagaagcaattcgaagatgagatcacatcctctcggaatacctttgctcaatatcaatatcagcatcagaaccgatctgaacaagaggccattcattcttcacaagtgggaacctcaagaagttcccaggagatggccaggaatgaacaggaagggtccaaagtgcagaaaattgatgtccatggcacagaaatggtgagccaccttgagaaacacacagaggaagtgaaccaggcgtcccaatttcaccagtacgtccaagagaccgttatcgatacccccgaggatgaggagatacctaaggtgagcaccaaactgctgaaggaacaatttgagaaaagtgcccaggagaaaatcctctacagcgacaaagagatgactactcccgcaaagcagattaagactgagagcgagtatgaagagacgttcaagcctagttctgtggtctcaacctcttctacgtcctgtgtgtcaacatcacaacgtaaggagacatccaccacacggtacagtgaccattcagtgacttcgagcacacttgcccaaatcaacgcgacatctagcggaatgaccgaggagttcccaccaccccctcccgacgtgctccagacatctgtagacgtgacagccttttcacagagcccagaactcccatcaccccctagacgtcttccagtacccaaagatgtatacagcaagcagaggaacctgtatgagttaaacaggctttacaagcacatccaccctgagttgaggaagaatctcgagaaagattatatttctgaggtgagcgagatcgtgagcagccagatgaatagcggatcttctgtttccgccgacgttcaacaggctcgatatgtttttgagaacaccaacgactcctcacaaaaggatctaaactcagagcgggaataccttgaatgggacgaaatccttaagggcgaggttcaatcgataagatggatatttgaaaatcagcccctggatagtataaacaatggcagcccagacgaaggagacatttcaagaggcatcgccgatcaggagattatagctggaggggatgtcaaatacacgacgtggatgtttgagacccagcccatcgacacgcttggtgcctattcgagtgatacagtcgaaaatgcagagaaaattcccgagctggccaggggggatgtttgcactgctcggtggatgtttgaaacgcgacccttagactcaatgaataagatgcatcagagtcaggaagaatcagccgttaccatcagtaaggacattaccggtggcgatgttaaaacagtccggtacatgttcgaaactcagcacctcgaccagcttggccagctgcatagcgtggacgaagtgcatctgctgcaactgagatcagaactcaaagagatcaaaggcaacgtgaaaaggagtattaagtgcttcgagacacagcccctgtacgtgatacgggacggatcaggacagatgctagagatcaagaccgtgcaccgggaagacgttgagaagggagatgtcagaacagcacgctggatgttcgaaacccagcccctagacacaatcaacaaggatatcacggaaatcaaggtggtgcggggaattagcatggaagagaatgtgaaggggggagtgtcgaaagccaaatggctctttgagactcagcctctggagaagatcaaggagtctgaagaagtgattattgagaaggagaagatcattgggactgacgtctctcgcaagtgctggatgtttgaaacacagcccttggacattcttaaggaagttcctgacgccgactcccttcagcgtgaggagattatcgggggagatgtccaaacgacaaaacatctttttgaaactctgcctatcgaagcgctaaaggattcaccggacatcggaaaacttcagaaaatcacagcctctgaggaggagaaaggggacgtccggcaccagaaatggatatttgagacccagcccctcgaagacattcgtaaagataaaaaggaatatacccggaccgtcaaactcgaagaggtagatcgcggagacgtcaagaactacacacacattttcgagtctaataatctgatcaagttcgatgccagccataagatcgaggtggaaggcgtgaccaggggagcggtggaactgaacaaaagtcttttcgagactacgcctctgtatgctatccaagatcctctggggaagtatcaccaggttaagacggtccagcaggaagaaattgtccgaggggacgtgcgatcttgtagatggttgttcgagacgcggcctatcgaccagttcgatgagtctattcataaattccagatcataaggggcatcagcgcacaggaaattcaaaccggcaacgtgaaatctgcaaagtggctgttcgagacacagccacttgattcaattaagtatttttctgacgtcgaggaaaccgagagtaaaacagaacagacacgcgacattgtaaagggtgacgtgaaaacttgtaagtggctttttgaaacacagccaatggaatctctctatgagaaagtgagccttatgaccagcagcgaagagatacataaaggagacgtaaaaacttgcacttggctattcgagactcaacctctggacacgattaaagacgactctgaaactgcagtcaaactccaaacagtgaagcaagaggaaatccagggaggagacgtgcggaccgcctgctttctgttcgaaaccgaaaatttggacagcattcagggggaggaagtgaaggaaatcaagcccgtagaaatggatatccaggcaggggacgtgagttccatgcggtataaattcgagaaccagtccctcgacagtataagcagtagttcagaagaagtactgaaaaaaatcaagaccctgaaaaccgaagatatccagaaaggcaatgtgctcaactgtcgatggctgttcgagaatcagccgatcgacaaaatcaaggaatcccaagaaggtgacgagtgcgtgaagacagtgaccgacattcaaggaggcgacgtccgtaaaggatgcttcatctttgagaccttctctttggacgaaattaaagaggagtctgactatatctcaacaaagaagacaatcacagaggaagtgatccaaggagacgttaagtcttaccgcatgcttttcgaaacccagcccctgtacgcaattcaggatagggaggggagctatcatgaagttaccactgtgaagaaggaggaagttatccatggtgacgtgcgcggaactcgttggttgttcgagacaaagcctctggattctatcaacaaatcggagaccgtatacgttattaaatcagtaactcaggaagatattcagaagggtgacgtgagcagcgtgcggtaccgtttcgagacacagcccctggatcaaatcagtgaagaatcccataatatcatgccctcgatagatcacattcaggggggaaatgtaaagacctctcggcagttctttgagtcagagaacttcgataaaaacaattatataagaacagtgagtgtgaacgagattcagaaaggcaacgtgaagacttcgacctggctcttcgagactcacacaatggacgaattgcgaggcgaggggcttgagtatgagaacattaagactgtgacccaagaagatgttcagaagggggatgtgaagcaagcagtgtggctctttgaaaaccgaacctttgactcaataatggaagcccacaaggggatcaccaagatgacaaaggaagagattccaccctctgacgtaaagactacgacatggctctttgaaactacacctcttcacgaattcaatgagaccagggtggagaaaatcgagatcatcggtaaaagtattaaggagacactggaggacctgtattcccaaaaggtcatccaagcccctggaattatcatcgaagccgacgaaataggggatgtaagaatggctaaatacaaactgatgaatcaggcctcacccgaaatacagaaagaggaaattatccgtgcggacctgcgcaacattatggtgaacttgctctccaaacgggattgtacagaaagggagatactcatttccgaggaagagaaggggaacgtgaatcttaccaagactcagctgttgaaccgctctactgaattccacgcggagaaggaggagatagtgaaaggagacgtgcagcaggccatcaagaacctgttcagtgaggagaggagtgtgaaaaagggtattctgatccaagaggacgagaagggcgacattaacatgactatttactgcctcttgcacgaaaacgatggggatacaatagagagggaggaagttatagggggagacgtgaagcggactattcataacctgctctcctcaacctccaataacaagatatctgagcgagccaaaattgacgctagtgagcgagggaacgtgcagtttttcaccacttgtattgaagccggtgccctggactaccttaagcagctgcacaccgagagtaacgaaaccctgactgcaaagaagcaggagggcgagaaggaaattatcgggggtgatgtcgaaggcacaaagctgttgctgaagaaacggcaatctttggtagaaaggacagtctctgagacagatataattcctggagatgtgcataacactgtaaaagtcttcatgacagaaccacagtccacctttggcaagatcccaaaggaagaaattatcaagggggacctgacaagcaccttaaactcactgagtcaggccgtgaaccagaaaacggtaactaaaactgaggaaataataaaaggaaatatgctggcaacactgaaaagcctgaaagagtcctcacatagatggaaagagtcaaagcaaccggatgctattccaggtgatattgaaaaggccatcgagtgcctggagaaggctactaataccaaaaccgagatcctaaaaaaagaactcctgaaggacgacttagagacctccctgcgcagtctgaaggaagctcaacggagctttaaggaggtgcataaggagggagtgataaaaaaagatgcgaaggccgtgatggcaggatctagtggggaacagaagaccgatattcaccaggtggcagtacagcggaataagaacagtctcttgcagcccaagcccggaccatttgagccagcagcaaagtggcaggggggtgctgataccttgagtcaaactatgggaaaaagctgtcacggcaaccttgtagaagaaagaacggaggtgaacctgcccaaagccccaaagggaacagtcaagatcgtgattgatcgcgagcagaacaatgacgccctggaaaagagtctgcggagactgtctaattctcaccataagtctaacgtcctggaaagtggagacaaaactggtgtatggactgacacaaccggggaacagcacctccgcgacgagtacatgtccaggcagctgactagcactgtctcagtgaagaacaacctcacaaccaaggagtccgaccgggcagttcgggagttaaaaaaggatgatgtttttaacagtattcaatctgctggcaagactgtggggaaacagcagacctatgagctgagaaacgaccaccagaaaatggagggattccacatcaagtcccccaagaaaactaaaaatataaaaatcttaactgacacgcagtctagtaaaccaagtcctacacagcaccccgtatccatgcctgttggcggtacatatgacttgagcggggacttccagaagcagacactgcttaaacaggagactaaatacagtaacaaagatatcaagaaaaaaaatattaacctacaaccaatgtggcagcttctcccagttgagcaagataccagtaatgttacagagatgaaagtgtccgagaaaagtcataatacctttaaggctactaataagaagcgagagacagacgtgcacctaaagtctcaggactttttaatgaagaccaatacaagcacaggtctgaaaatggccatggagagatccctcaatccgattaactttaacccagaaaacaatgttaaagagtcggaatgcccgctgccccctccttccccaccacctcccccaccctctaatgcatcaagtgaaatcgagtttccgcttcccccaccacctcctcttatgatgttcccggagaagaatgggtttctgcccagtctgtcaaccgaaaaaatcaaagctgagttcgaaagcttcccaggcctgccactgcctcctcctcctgtggacgagaaatctgagagagaaagcagtagtatgtttttgccacctccccctccgcctactccttcccagaaaccagcacaccttcttagctcatctgcacccgagaagcacagcggcgactttatgcagcagtactctcagaaagaggcgagcaactcccaaaactcccaagccaaaattatcaccggcaagacaggggtgcttccccctccaacattgccaaagcccaagctgccgaagcacattaaagacaataaaaacgacttcagcccaaaagtagaactggccacctcattgtcagacatggagtgtaaaattaccacctcaaaggaccaaaagaaagtgatggtcatgactagctctgaacataccgagacaaaacagaacgtcattagcaagtctctggatgaacggaaacagctatccatcgacagtgccaactgcttgagccacaccgtccccggaacgagcgcaccccgtaagaaacagattgcccctctgattaagtcccactcctttcccgagagctcggggcaacagaatcccaagccttacatgcgtaagttcaagactcctctaatgatagcagaagaaaagtatcgccagcagaaggaggagattgagaaacagaaacaggaatctagctattacaacatcgtcaagacacagtctcaaaatcagcacatcaccgaggtagaaaaggagatgccccttcagaaaacgaacgaggaggtgtctctctccggtatcgactcggaatgtactgtggtacagccatctccgggtagtcaatccaacgccagaatccttggggtttgttccgataatcagctctccactacttctcctgagacggtcgccgctaaacgcctccaccatgtgttagctgctagcgaggacaaagataagatgaaaaaggaggttttgcagagcagtcgagacattatgcagagcaagtctgcgtgcgaaatcaaacagtctcatcaagagtgcagcacgcaacagacacaacagaagaaatatcttgaacaactgcatctaccacagtctaaacccatttctcccaatttcaaagtgaagacaattaagttaccaactctcgaccatacccttaatgaaactgaccatagctatgaaagccataaacaacaatctgagatcgacgttcagaccttcacgaaaaaacagtatctgaaaacaaaaaaaactgaggctagcactgaatgctcacacaagcagagcttggccgagaggcattatcaattgcctaaaaaggagaagagggtgaccgtgcagctccccaccgagagtatacaaaaaaatcaggaggacaagctgaaaatggtcccgcgaaagcaacgggaatttagcggtagcgatcggggaaaactccccggatctgaggagaagaatcagggccctagcatgatagggaggaaggaagagcgactgatcaccgaaaggaagcatgagcatctgaagaataaatcagctcccaaggttgtgaagcagaaggtgatagacgcccatcttgactcccagacccagaatttccagcaaacccaaatccagaccgccgaaagcaaagctgagcataagaagcttccacaaccttacaactcgctccaggaggaaaagtgtctggaagttaaaggtattcaggagaagcaggtgtttagtaacaccaaggacagcaagcaagaaatcacccagaacaaatcgttcttcagtagtgtaaaggagtcacagagggacgatgggaaaggagctctgaatatcgttgagttcctgcggaaaagagaggagttgcaacaaatactgtccagagtaaaacagttcgaggccgaaccgaacaagtccggacttaaaacttttcaaaccctacttaacaccattcccggatggctcattagtgaagacaaaagggaatacgcagtgcacatcgctatggagaataacctggaaaaggtaaaggaagagatcactcatataaagacacaggctgaggatatgctggtgtcatacgaaaacattattcagacagcgatgatgagttccaagacaggaaaacccggaaataagcctacctctctggatgaaacttcttcaaaggtgagtaatgtgcacgtgtcaaacaacaaaaactccgagcagaaggaaaacaaaattgctaaggagaagacagttcagcatcaggtagcagcacaccacgaggccacagttagatcccatgtcaagacacaccaagagatcaagctggacgactctaacataccgccaccttctctcaagacaagaccgccatccccaacgttcattactatcgagagcaccgcgagacgcaccgaaaatcctaccaagaacgaactatcacaatcccctaaaaaggattcatacgtcgaaccccctccacggagaccaatgagtcagaagtccgagatacaccgggctaacacatcgccgtcaccccctcgctcccgcagcgaacagctggtacgcctgaaggatacaaccgcgaagctgtccaagggcgcaataccctgtccagccgcaacccctgtcccaatcgtggagaagcggagtgaaattattatgtcgcctgctaccctccgccgtcagatcaagatagaaactaggggtcgcgactcccctcctacaatcactattcctgtgaatatcaatcacgctgcgagtggctctttcagagagtcggtggatgcccaagaggagattagaaaggtggagaaacgagctacctatgtacacaaagatggcctgaatagcaccgaccacatggtgcccgatacagaatcatacgacgcagtggagattattcggaaggtggcagtgccacccaggttatcagaacatacccagaggtacgaggccgcaaaccgtacggtacagatggctgaaaattttgtcaatgaccccgagaatgagatcaacagatggtttcgagagttcgaacacggcccagtgagcgaggcgaagtccaacaggcgtgtgtacgctaagggcgagactaatcacaacatccagcaggaatcgcggacattctgtaaagaggagttcggattaacctccctcggtaacacaagcttcaccgatttcagctgtaagcaccctcgagagttgcgcgaaaaaattccggtgaagcaaccgagaatttgtagcgaaacccgctcgcttagcgaacatttctccgggatggatgcgttcgaatcacagattgtggagtcaaagatgaaaacctcatccagccattcttccgaggcgggtaaatccgggtgtgacttcaagcatgctccaccaacctacgaagacgttattgctggacacattcttgatatatcagattctccaaaagaggttcgcaaaaactttcagaaaacctggcaggaaagcgggcgagtgtttaagggactcggatacgctacggctgatgcatccgctacagaaatgcgtacgacatttcaggaagagtctgcttttataagcgaagcggctgctcctcgacaggggaatatgtacaccctttcaaaagatagcctcagtaatggcgttccttctgggagacaggctgaattctcttac

SEQ ID NO: 247009 - DNA, 2151 bp, Artificial Sequence
  Description of Artificial Sequence: Synthetic coding sequence
atggcgcgataccaggcggcagtctcacgaggtgactgcaggtcattttccgcaaacatgatggaagaatccgagatgtgtgctgtgccaggcggtctcgctaaggtaaagaagcagttcgaagacgaaatcaccagcagcagaaacacgttcgcacagtaccaataccagcatcaaaacagaagtgaacaggaagcaattcactcttcacaagtggggacatcccgttcctctcaggaaatggctcggaatgagcaggaaggctcaaaagttcagaagatagatgttcatgggacagagatggtctcccacctcgagaagcatacggaagaggtgaatcaggcctctcaatttcaccagtatgttcaagaaactgtgattgacacacccgaggatgaagaaatccctaaggtctctacgaagcttcttaaagagcaattcgagaagagcgcacaggagaagatcttgtactccgataaggagatgaccactccagccaaacaaataaagaaactcctgctgcaagataaggagatctgtatcttatgccagaaaactgtatacccaatggagtgtctggtcgcagacaagcagaacttccacaagagttgttttagatgccaccactgtaacagcaagctgtctctcgggaactacgcctctctgcacggtcagatctactgtaagccccacttcaagcaactctttaaatctaaaggaaactatgatgaggggtttggtcataagcagcacaaggaccgctggaactgcaagaatcagtctcgatctgtcgactttatcccaaatgaggagcctaatatgtgtaaaaacatagccgaaaacaccctcgttcccggtgaccggaacgagcacctggacgcagggaattccgaaggccagaggaacgatttacgcaaactcggtgagcgaggaaagctgaaggtgatttggcctccgtctaaggaaatcccaaagaagacgttgcctttcgaagaagagttgaaaatgtcaaagcctaagtggccccctgaaatgacgacgctgctgtcacctgaattcaagtccgaaagcttactagaggatgtcaggactcccgagaataagggccagcgccaggatcactttccctttctgcagccatacttgcagtccacacacgtctgtcaaaaagaagatgttatcgggatcaaggaaatgaagatgcctgaaggacgtaaagatgagaagaaggaaggtcgcaaaaatgtccaggatcgccctagcgaggccgaggacaccaagtctaatcgaaagagcgccatggatttgaacgacaacaataacgtcatcgtccaaagcgcagagaaagaaaagaacgaaaagacaaaccagacgaatggcgcagaggttctgcaggtgacgaataccgatgacgaaatgatgccggaaaatcacaaagagaatctcaataagaacaacaataataactatgtggctgtcagttacctcaacaactgccgccagaaaacctccatcctggagttcctcgacctactgcccctctcttcagaggccaatgatacagccaacgaatatgagattgagaagctggagaatacttctaggatttctgaactgctcggaatctttgagtctgaaaagacctatagcaggaacgtcttggccatggccctgaaaaagcaaactgatcgcgctgccgctggatcgccagtccaacctgcccctaaaccgtctctctctagggggttaatggttaaaggaggtagctccataatcagccccgatactaacctgctcaacattaaaggctcacactcaaaaagcaaaaatttacatttctttttttctaacacagttaaaattactgcgttttctaaaaagaatgagaacatcttcaactgcgacctgattgactctgtggatcagatcaagaacatgccctgtctggaccttcgcgaatttggcaaggacgtaaagccttggcatgtggagactacagaagcagctagaaataacgagaataccggctttgacgcgcttagccatgagtgtacagcaaagcccttattccctcgcgttgaggtccagtccgaacagctgacagtggaggagcagataaagcggaacaggtgctactccgatactgaatag

SEQ ID NO: 247010 - DNA, 2817 bp, Artificial Sequence
  Description of Artificial Sequence: Synthetic coding sequence
atgtttcctatgcagaaggggagccttaatcttctgaggcagaaatgggagagctgcgactaccagagaagtgaatgtcaccctagggactcacactgcacaattttccagccgcaggagagtaaattgctggccccagagggtgaagtggtgtccgcgccacaatcactggatcccacctctctgccctacagtacaggagaagaaatgtggtccagtaagcccgaggagaaggattctgtcgataaatcaaacaatacaagagaatatgggaggccggaggtgttaaaagaagacagcttatccagcaggcgtaggatcgagcgattttcaattgccctggatgagttacgcagtgtgtttgaagcccctaaatcgggaaacaagcccgctgagtacggaggcaaagaggttgagattgagaggtccctgtgctctccagcttttaagtcccaccctggttcacagcttgaggactccgtgaaagacagcgataaaaaagggaaggagacctcattcgacaaaatgagtccagaatccggtcatagccggatcttcgaagctacagctggtcccaacaaacctgaatcaggtttcgcagaagacagtgcagccagaggtgaaggcgtctctgatctccacgaagttgtcagcctcaaagagagaatggccagataccaggctgcagtgtcccgcggtgactgtcggagctttagcgcgaacatgatggaggagagtgagatgtgcgcagtaccagggggactggccaaggttaagaagcaattcgaggatgaaattaccagctcacgaaacacatttgctcagtaccagtatcagcatcagaatagatcggagcaagaggctatccacagttcccaggtgggcactagtagatcctctcaagaaatggccaggaacgaacaggaaggatccaaagttcagaagattgacgtgcacggtacagagatggtgagccacttagagaaacacaccgaggaggttaaccaggcttcacagtttcatcagtacgtgcaagagactgtcatcgacacgccagaggacgaagagatccccaaggtttcaaccaagctcctcaaggagcaatttgagaagtctgcccaagagaaaatactatattccgacaaagagatgaccaccccggcaaagcagattaagaaactgctgctgcaggataaggagatttgtattctttgccagaaaaccgtttaccccatggagtgcttagtcgcggacaagcaaaattttcataaatcttgttttcggtgtcatcactgcaatagtaaactttcactagggaactacgcctccctgcacggccagatttactgtaaacctcactttaagcagctcttcaaaagcaagggcaattatgacgaaggttttggacataaacagcacaaagaccggtggaactgtaaaaatcagagccggagcgttgactttattcccaatgaggagcctaacatgtgtaagaacatcgctgagaatactctcgttccaggggaccgaaatgaacacctcgacgcagggaacagtgaggggcagcgcaacgacctgcggaaactgggcgagcggggtaaattaaaggttatatggcccccttctaaggagattccaaaaaagaccctcccttttgaggaagagttgaaaatgagcaagcctaagtggccccctgaaatgacaacactgctctctcccgaattcaagtccgaatctctccttgaagacgtgcggacgcctgaaaacaaagggcaaaggcaggaccatttccccttccttcaaccctaccttcagtctacacacgtgtgtcagaaagaggacgtcattggcattaaggagatgaagatgccggagggacgcaaagatgaaaagaaggaaggcaggaagaatgtgcaggacagaccttccgaggcagaggatacgaaaagcaatcgcaaatccgcaatggacctgaacgataacaacaacgtcattgttcagtccgctgagaaagagaaaaacgaaaaaactaaccagacgaatggcgcagaggtgctccaagttacgaacacagatgatgagatgatgcctgagaatcacaaggagaatctcaacaaaaacaacaataataattacgtggcagtttcttatctgaataactgcagacagaagacatccatactggagttcctggacttactgccattaagctcagaggccaatgacacagctaacgaatacgaaatcgagaagctggagaatacaagccgaatttctgaattactcggcatttttgagagcgagaaaacgtattcccgcaacgtgttagcaatggcactgaaaaagcagaccgatcgggcagcagccggatctcccgtgcagcccgcaccgaagccaagcctatctcggggtctgatggtcaagggcggttcctccatcattagccccgacactaacctgctcaacatcaaggggagccactctaagtccaaaaacctgcactttttcttcagtaacactgttaagatcaccgccttcagtaagaagaacgaaaatatcttcaactgcgaccttattgattctgtggaccagatcaagaacatgccgtgcttggatctccgtgaattcgggaaggatgtaaaaccatggcatgtcgagactacagaggccgctaggaataatgaaaacaccgggttcgacgcgctgagtcacgagtgcacagccaagcctctttttccaagggtggaggtgcagagcgagcagctgaccgtggaagagcaaattaaaaggaataggtgttactccgatacagagtag

SEQ ID NO: 247011 - DNA, 2892 bp, Artificial Sequence
  Description of Artificial Sequence: Synthetic coding sequence
atgcctcttcagaaaacaaacgaggaggtctccctcagtgggatagacagcgagtgcaccgtagtccagccaagcccaggaagtcagtccaatgccaggatcctcggagtgtgctcagacaaccaactcagcactactagcccggagactgttgcagcaaagcgccttcatcacgtgctcgctgcgtcagaggacaaggacaagatgaaaaaggaggtgctccaaagctctcgggacatcatgcagtcgaagtctgcatgcgagataaaacagtcgcatcaagaatgcagtacacaacagacacagcagaagaagtatttggagcaactccacctgccgcagtctaagcctatctcacccaacttcaaagttaaaaccattaagcttccaacactggatcacactctaaacgaaacagatcacagctacgagagtcacaaacagcagagtgagatcgatgtgcagacttttactaaaaagcaatacttgaaaactaagaagaccgaggcttccaccgaatgctcacacaaacagtctttggccgagcggcattaccaattacccaagaaggaaaagcgagtaacagtccagttaccgacagagtcgatccaaaagaaccaagaggataagttaaagatggtcccccgtaaacagcgtgagttcagcggtagtgatcgaggcaagctccccggatccgaggaaaagaaccaggggccaagcatgattggcaggaaggaggaacggttgatcaccgagcgtaagcacgaacacctgaagaataagtctgcaccaaaggtggttaagcagaaggtcatcgatgcccacttagattcccagacccaaaatttccagcagactcagatccagactgcagagtctaaagccgaacataagaagttacctcagccttacaatagtctgcaggaagaaaagtgtcttgaggtaaagggtattcaggagaaacaggtcttctcaaatactaaggattcgaagcaggagattactcagaacaagagtttcttttcttccgtgaaagaaagccaaagggacgatggaaagggagctctgaacatcgttgaattcctcagaaagcgcgaggagttacaacagatcctgtctcgcgtgaaacagttcgaggctgaaccaaacaaaagcgggttgaagacattccagactctgctgaataccattcccggatggctcatctctgaagacaaaagggaatacgcagtccatatcgccatggagaacaatctggaaaaggttaaagaagagataactcatataaaaacgcaagcggaagacatgcttgtgagttatgaaaatattattcagactgccatgatgtcatctaagaccgggaagccaggcaataaacctacgtctctagatgagacaagttcaaaagtgtctaacgtacacgtttcaaacaacaaaaattcagaacagaaagagaataagatcgcaaaggaaaagactgttcagcaccaggtggccgcacaccatgaggcgaccgtgcgctctcacgtcaagacacatcaggagattaagttagacgactctaatatcccaccccctagccttaaaacccgccctccatccccaacctttatcactatagagtccacagccagaaggacggagaatcctactaaaaatgaactctcacagtcacccaaaaaggactcttatgttgaaccccctccgcgacggcctatgagccagaagagtgagatccaccgcgcaaacacaagtccctccccacccagaagccgtagcgaacagctcgtgcgcctgaaagatactaccgcaaagttgtcaaagggcgctataccttgtcccgcagccacaccagtgccgattgtggagaagcggagcgagatcattatgtctcccgctacattacggaggcaaatcaaaattgagactagaggcagggattccccgccaaccatcactatcccagtgaatatcaatcacgcagcatctggttctttccgggaatcagtggatgcccaagaggaaatcagaaaagttgaaaaaagggcaacctacgtgcacaaggacggactgaatagtactgaccacatggtgccagacactgaatcatatgatgcagttgagattatacgcaaagtggccgtgccaccccgtctttctgaacacactcagcggtacgaagcggctaatcggaccgtgcaaatggccgagaacttcgtgaatgaccctgagaacgaaatcaataggtggttccgagagttcgagcacgggcctgtgagtgaagcaaaatctaatagaagagtctatgctaagggcgagacgaaccacaatattcagcaggaatcccggaccttctgtaaggaggaatttgggttgactagcctggggaacacctccttcacagatttttcctgcaaacatcctcgggaactcagagagaaaattcctgttaaacagcccagaatctgcagcgaaaccagatccctgagcgagcactttagcggaatggatgctttcgagtcccagatcgttgaatctaagatgaagaccagcagctcacattcgtctgaagcgggaaagtcagggtgcgactttaagcacgcacctccaacctacgaggatgtaatagcgggtcacatcttggatatttcagacagccccaaggaagtgcggaaaaactttcagaagacctggcaggagagcggacgcgtgttcaagggtctgggctatgcaacagccgatgcttccgcaaccgaaatgagaacaacttttcaggaagaaagtgctttcattagtgaggcagctgcccctcgtcagggtaacatgtatacactctctaaggactcattgtcaaacggggttccaagcggcaggcaggcggaattcagttag

SEQ ID NO: 247012 - DNA, 2916 bp, Artificial Sequence
  Description of Artificial Sequence: Synthetic coding sequence
atgtttcccatgcaaaagggcagcttgaatctgctgaggcagaagtgggaaagttgtgactaccagaggtctgagtgtcacccccgagattcacattgtacaatttttcagccacaggaaagcaagctgttggctccagaaggtgaagtcgttagcgcgcctcagtccctggaccccacatctctgccatatagtaccggcgaggagatgtggtcaagcaagcccgaagagaaggattctgtggataagtcaaataacactagggagtacggacgacctgaggtgctgaaggaagactccctgagcagtagacgcaggatcgaacgttttagtattgccctggacgagctcaggtctgtcttcgaggctcccaagtctgggaataagccggctgaatacggaggaaaggaggtggagatagagagatccctctgctctcctgccttcaaatctcaccccggttcccagcttgaagatagcgtaaaagattctgacaaaaagggtaaggagaccagcttcgataagatgtcccccgaatccggacactcgcgcatttttgaggccgtgttcagcaccgaccaggcacagatccttaggcttcatttgcaccccaagctgacgaagacaccgaagaactcacttaagagcagcacatatatcagcaccgccggtcctaacaaacccgagtccgggttcgctgaggactctgcagcccgaggcgagggcgtttccgacttgcacgaagtggtttcgctcaaggaaaggatggctcgctatcaggccgctgtatcaagaggcgactgcaggagcttctctgccaatatgatggaggaatcggaaatgtgtgcggttcctggtgggctggcaaaggtgaagaagcagttcgaagatgagattacttcgtcaaggaatacctttgcacagtaccagtatcagcaccaaaatcgttccgagcaggaagccatacattcaagccaagtcggtaccagcagatcttcccaggaaatggccaggaacgagcaggagggcagcaaagtacagaaaatagatgtccatggcaccgaaatggtgagtcatctcgagaaacacaccgaagaagtgaaccaagctagccaattccatcagtacgttcaagaaaccgtgatagacacaccagaggatgaagaaatccctaaggtttccaccaaactcctgaaggagcagttcgagaagagtgcgcaggaaaagattttatacagcgataaggaaatgactacacctgcaaaacagattaaaaagctgttactccaagataaagagatctgcatcctgtgtcagaaaaccgtttatcccatggagtgcctggtcgctgataagcagaacttccacaaatcctgctttcggtgtcaccactgtaacagtaagctcagcctgggcaactatgcctctttgcacgggcagatttactgcaagcctcattttaaacaactctttaagtccaagggcaattatgacgaaggattcggccataaacagcataaagacaggtggaactgcaagaaccaatcccggtcagtcgactttatcccaaacgaggagccaaacatgtgcaaaaatatcgcggagaataccctggttcccggagaccgcaacgagcatctcgacgctggaaactctgaggggcagagaaacgacctgcgaaagctgggagagagaggcaagctgaaggtcatttggccccctagtaaagaaattcctaagaaaacccttcctttcgaagaggagctgaaaatgagtaagcccaagtggcccccagaaatgactaccctgctgagccccgagtttaaatcagaaagcctactggaggatgttaggactcctgaaaacaagggacaacgacaggaccactttccatttttgcagccgtacctccagtcgacccacgtatgtcagaaggaggacgtcatcggcatcaaagagatgaagatgcccgaagggagaaaggacgagaaaaaagagggtaggaaaaacgtgcaggatcggccatctgaggctgaagataccaagagcaacaggaagtctgccatggatctcaatgacaacaataatgttatcgtgcaatctgcagagaaggagaagaatgagaaaaccaatcaaaccaatggggcagaggtgctgcaagttaccaacaccgatgatgagatgatgcccgagaatcataaggagaacttgaacaagaacaacaataataactatgtggctgtgtcctacctgaacaattgccgtcagaagactagtattcttgagtttctggatcttctcccactgagctccgaggcaaatgacacagcaaatgagtatgaaatcgagaagcttgaaaatacttcgcggatctctgaactattaggtattttcgagagtgaaaaaacatactctaggaacgtgctggccatggccctcaaaaaacagacagatcgagcggcagctgggtcccctgtgcagcccgcaccaaagccctccctctccaggggcctgatggtaaagggaggatcttcgattatatctccagataccaacttacttaatattaagggttctcacagcaagagtaaaaatttgcatttcttcttctctaacactgtcaagattactgcctttagcaaaaagaacgaaaacatctttaattgtgatctcatagattcagtcgatcagatcaaaaacatgccttgtctagatttgagggaatttggaaaggatgtgaaaccgtggcacgtggagaccacagaagctgcaagaaacaacgagaatacaggatttgatgctctttcgcatgagtgcacggcaaagccacttttccctcgtgtggaagtgcagtctgaacagctcactgtggaggagcagatcaagagaaaccggtgctacagtgatacagaatag

SEQ ID NO: 247013 - DNA, 2916 bp, Artificial Sequence
  Description of Artificial Sequence: Synthetic coding sequence
atgttcccgatgcagaagggaagcctaaatcttcttcgccagaagtgggagtcatgtgactaccagcgcagcgaatgccacccgcgtgatagccattgcactattttccaaccacaagagtccaaactccttgcacccgagggggaggtcgtgtcagctccacagagcctcgatcccactagtcttccctactcgacaggcgaagaaatgtggtctagcaagccggaagagaaggattctgtagacaaatctaacaatacgagggagtacgggcgaccagaggttctgaaagaggactccctctccagcaggcgcagaatcgagcgtttctcgattgctctggatgaactgcgatcagtatttgaggcgccaaagagtgggaataaacctgcggagtacggcggtaaagaggtggagatcgagagatctctctgctcacccgctttcaagtcacatccaggatcacagctcgaagactcagtgaaggattctgataagaaaggtaaagaaaccagctttgacaagatgtctccggagagtggtcactccaggatcttcgaggctgtgttctcaactgaccaggctcagatcttgcgcctgcatctgcaccctaagctgacaaagactcccaaaaattcactgaagtcttccacatatatttctaccgctggccctaacaagcccgaatccggcttcgccgaggactccgctgctcggggagagggtgtgtcagacctgcacgaggttgtctcgctgaaagagaggatggctcggtaccaagccgctgtatcgaggggagactgtaggtcattttccgccaatatgatggaggagtctgaaatgtgcgcggtgcctggaggattggcaaaggtgaaaaaacagttcgaagatgagattactagctccaggaatacgtttgctcaataccagtatcagcaccagaacagatccgagcaggaggctattcattctagccaggtgggtaccagtagatcttcacaggaaatggccagaaacgagcaggaagggtcgaaagtgcagaagatcgatgtgcacggcacagaaatggtgtctcatctggagaagcatactgaggaggttaaccaggcttctcagttccaccagtatgttcaggaaactgttatcgatacccctgaggacgaggaaattccaaaggttagtactaagctgctgaaagagcagtttgagaagtcggcacaggagaaaatactttattccgacaaagagatgacgacccccgctaagcagataaagaagcttctcctgcaagataaggaaatctgcatactttgccagaagacggtctacccgatggaatgtctcgtggccgacaaacaaaactttcataagtcatgctttagatgccatcactgcaatagtaaattatccctagggaattacgcatcgctccatggccagatctattgcaaaccacatttcaaacagctgtttaagtccaaagggaattacgatgagggcttcggccacaagcaacacaaagatagatggaattgcaagaaccagtccagaagcgtggacttcattcccaacgaggagccaaacatgtgcaaaaatatcgccgagaataccctggtgccaggcgaccgcaacgagcatcttgacgctggcaacagtgagggacaaagaaatgatttgcgtaagcttggcgagcgcggaaagctcaaggttatttggcctccgtctaaggagataccaaagaaaaccctacctttcgaggaggagttaaaaatgtctaagccaaaatggccacctgagatgacgactctgctgtccccggagtttaaatctgagtcactgctggaggatgtgcgaactccagagaataaaggtcagagacaggaccacttcccatttttgcagccctacctacaaagcacgcacgtgtgtcagaaagaagatgtgattggtatcaaggagatgaagatgcccgagggcaggaaagatgagaagaaagagggtcgcaaaaacgtgcaggataggccatccgaggcggaggacaccaaaagtaacaggaagtcagccatggatctcaacgacaacaacaacgtcatcgtacaatcagcagagaaggaaaagaacgaaaaaacgaatcagacgaacggagccgaggtcctgcaggtaactaacacagacgatgagatgatgcccgagaaccacaaggaaaatcttaataagaacaataacaacaactacgttgcagttagctatctcaacaattgtcggcagaagacgagcattctggaatttctcgatctcctgccactgtcctctgaagcaaacgatacagccaatgagtacgagatcgagaagctcgagaatactagtagaatttccgaattgctgggaatattcgagagtgaaaagacctattcaaggaatgttctggccatggctctgaaaaaacagaccgatcgcgcagccgctggttcgcctgtacaaccagctccaaagccttccctttcccgcggactcatggtgaagggcggatcctccatcattagccccgatacaaaccttctgaacataaagggctcccactcaaaaagcaaaaacctccatttctttttctccaacaccgtgaaaataaccgctttttccaaaaaaaacgagaacatattcaactgtgatttaatagactccgtggaccaaatcaaaaatatgccttgcctcgatctccgcgaattcggcaaggatgttaagccttggcacgttgagacaacggaagcagctcggaataacgagaataccggattcgatgccctcagccatgagtgcactgctaagccgctgtttccaagggtcgaggtccagtccgagcagctaacagtcgaagagcagataaaacggaaccgctgctacagcgataccgaatag

SEQ ID NO: 247014 - DNA, 1380 bp, Artificial Sequence
  Description of Artificial Sequence: Synthetic coding sequence
atggaaactgttttcgaggagatggatgaagaatcaaccggcggtgtgagcagctccaaggaggaaatcgtgcttggtcaaagactgcacctgagctttcctttttccattattttttctaccgttctttattgcggggaggtggcgtttggtctctacatgttcgagatataccgcaaagctaatgacactttttggatgagctttacaatctcgttcattatcgtgggagctattctggaccagattatccttatgtttttcaacaaagacctccggaggaataaggccgcattgctgttctggcacattctgctccttgggcctatcgtgaggtgtctgcacacaatcaggaactaccataaatggctcaaaaatttgaagcaagagaaagaagagactcaggtatctattacaaaacgcaatacgatgctggagagggagatcgcatttagtattcgagataacttcatgcagcaaaaggccttcaaatacatgtctgtgatccaagcgttcctaggaagcgttccacagctaatcctgcaaatgtacatctccttaaccattagggaatggccactgaacagagcactcttgatgactttctcgctgctgtccgtgacatatggtgctattagatgcaacatcctcgcaatacaaatcagcaatgacgatacaactattaaattacctcccattgaattcttttgcgtggtgatgtggagatttctggaggttatctcccgtgtagttacccttgctttttttattgcgtcattgaagctgaaaagcctcccagtgctcctgattatctactttgtgtccttgctcgcgccttggttggagttctggaaatccggagcccaccttcccggaaacaaggagaacaattccaatatggtagggaccgtgctgatgctgtttttgatcacactgctgtacgctgcaatcaacttctcgtgctggtctgctgtgaaacttcagctcagcgatgataagatcatcgacggccgtcagcgctggggacatcgaatcttacactatagtttccagtttctcgaaaatgtgatcatgatcttggtgtttcggttctttgggggaaaaaccctcctgaactgctgcgacagcctgatcgcagtccagctgataatttcttacctgctagccactggcttcatgctgcttttttaccaatacctgtatccatggcagagcgggaaagtactgcccggtcgcactgaaaatcagcctgaagcaccctactattacgtcaatattgaaaagacagagaaaaataaaaacaagcaactcagaaactactgccactcatgtaacagggtaggatacttcagcattaggaaaagcatgacctgtagctag

SEQ ID NO: 247015 - DNA, 1389 bp, Artificial Sequence
  Description of Artificial Sequence: Synthetic coding sequence
atgaacactcggccacaacacagcgagcggacatccacgatggaccgcgtgtatgagatacccgaggagcccaacgtagatccagttagctcactggaggaggacgtcatccggggagctaacccacgtttcacgttccccttcagcatcctcttctccacctttttgtactgtggcgaggcggcttcagctctgtatatggtgcgtatctatagaaagaatagcgagacctattggatgacatatacttttagtttcttcatgttcagcagcatcatggttcagttgacattgatcttcgtgcatagagacctcgccaaggacaagccattatctctgtttatgcacttaatcctactcggtcctgtaataaggtgcctggaagcaatgatcaaatacctgactctgtggaagaaagaagagcaggaagagccgtacgtaagcctcacacgcaagaagatgctcatcgacggggaagaggtgctgattgaatgggaggttggccacagcattaggaccctggccatgcaccggaatgcctacaagcggatgtcccagatccaggctttcctcggttcagtaccccaactcacatatcagttatacgtgtcgcttatctccgcagaagtgcccctgggaagagtcgtgctgatggtctttagcctcgtgtcagtcacctatggagcaacactttgtaatatgcttgcaattcaaattaagtacgacgactacaaaatccggttgggccctctggaggtcctttgcatcaccatctggcgcaccctggagataacctctaggctgttgatactggtcctgtttagcgcgactctcaaacttaaggctgttcccttcttagttctgaatttcctcatcatcctatttgagccctggataaagttctggaggtctggggctcagatgcctaataacatcgagaagaacttttcgcgtgtggggaccctggtggtgctgattagtgtgactatcctgtacgctggaataaatttttcttgctggtctgcattgcagctcaggttggccgatcgggacctagtcgataaagggcagaactggggtcatatgggtttgcattattctgttaggttagtggaaaacgtcataatggtgctagtgtttaaattctttggtgtaaaagtattgctcaactactgccacagcctcatagccctgcaattgatcatcgcttacctgatttccatcgggttcatgctcttgtttttccagtatcttcacccgcttaggagcctgtttacccacaacgtggtagattacctgcactgcgtgtgctgtcaccagcacccgcgtactcgtgtggagaactccgaaccccctttcgagacggaggccagacagtccgtcgtttag

SEQ ID NO: 247016 - DNA, 1350 bp, Artificial Sequence
  Description of Artificial Sequence: Synthetic coding sequence
atggatcgagtgtatgagatacccgaagagcccaatgttgatcctgtgtctagtctcgaagaggatgtgattaggggcgcaaacccaaggttcacatttccattttccatattgttctcaacctttctgtactgcggcgaggccgcttctgcactctatatggtccgaatctatcgtaagaactccgagacctactggatgacctataccttctccttcttcatgttctcttccattatggtgcagctcacgctgatctttgtgcaccgggatttggcgaaggataagccgctcagtctgttcatgcatctgatattactgggacccgtcatcagatgcttggaggcaatgataaaatatttaaccctgtggaaaaaggaggaacaagaggaaccctatgtctctttaacacgcaagaagatgctgatcgacggagaagaggttctcatcgagtgggaagtcggccacagtatccgaacactcgcaatgcaccggaacgcctataaaaggatgagccagattcaagcgtttctgggaagcgttcctcagttgacttaccagctgtatgtgagcctcatctctgctgaggtgcccctgggtagggtcgtcttaatggtattcagtttggtctctgttacttatggggctaccctgtgtaacatgctagccatccaaattaagtacgatgactacaagattcgacttggcccactggaggtgctctgtataaccatctggcgcaccctggaaattaccagccgactcttaattctggtcttgtttagcgcaaccctgaagctgaaggcggtgccttttctggtgttaaatttcttgatcatactctttgaaccctggatcaaattttggcgctcgggcgcacaaatgcctaataacattgaaaagaatttctctcgtgttgggactctagtcgtcctcatctcagtgaccattttatacgccggtatcaatttttcgtgctggtccgctctgcagctgagattagcagaccgggatctggtggataaaggccaaaattggggtcacatgggcctgcattattctgtgagattggtagagaatgtgattatggtgctggtgttcaagttcttcggagtgaaggtgctcctgaattactgtcattccctgattgcgcttcaactgattatagcataccttatttccatcggcttcatgttactgttcttccagtacctgcaccctctgcggtcactgttcacgcacaatgtggtggattacctccactgcgtgtgctgtcaccagcatccaagaaccagagtcgaaaatagcgaaccaccttttgagacagaggctcgacagtcggttgtctag

SEQ ID NO: 247017 - DNA, 1335 bp, Artificial Sequence
  Description of Artificial Sequence: Synthetic coding sequence
atgaagtttcctgcttcagttctggctagtgtcttcttgttcgttgctgaaacgacagccgctctctccctgagctcgacttatcgtagtggtggagatcgtatgtggcaggctctgacactactgttctctctgttgccttgcgccctcgtgcaactgactctgcttttcgtgcatagagatctatcccgcgatcgacccttagtactcctgctgcaccttctgcaactgggacctctgttcaggtgcttcgaagtgttttgtatatactttcagtctggcaataacgaagaaccatatgtgtccatcacgaagaaacgccagatgccaaagaatgggctgagcgaggagatcgagaaagaggttggacaggcggaagggaaattgatcacccaccgctcagccttctcccgtgcttccgtgatccaggcctttctcgggagcgctccccagttaacactgcagctctacatctcagtgatgcagcaggacgtcaccgtgggcagaagccttctgatgacgataagcctcctgagcatcgtgtatggcgcacttcgctgcaatatcctagccattaagatcaagtacgatgaatacgaagtgaaggtgaaacccctcgcttatgtgtgtattttcctgtggcggtcgttcgaaattgcaactcgcgtcgtggtgctggtgctttttacgtccgtgctgaagacctgggttgtggtcattatactgatcaattttttctcttttttcctgtatccctggattctgttttggtgcagtggaagcccatttcccgagaacatcgaaaaggctctttctagggtggggaccaccatagtactctgcttcctgactctgttgtacactggcataaacatgttctgctggtccgcggtccagctgaaaattgattcaccagatctgatctcaaagagccataattggtaccaactattggtgtattacatgattcggtttattgagaatgccattctactcttactttggtacttgtttaaaactgatatttacatgtatgtgtgcgcacctctgttagtcctccagctcctgatagggtattgtactgctatcctgttcatgttagtcttttaccaattttttcatccatgcaaaaaactgttcagctcttcagtgagcgaagggttccaacgctggttaaggtgcttctgctgggcctgtcgtcagcagaagccctgcgaacccataggaaaagaggacctgcagtctagccgcgaccgggatgagacaccatcatcttcgaaaacctcccctgaacctgggcagttcttgaatgccgaggacctgtgttctgcctag

SEQ ID NO: 247018 - DNA, 1929 bp, Artificial Sequence
  Description of Artificial Sequence: Synthetic coding sequence
atggccgcaagccgcaagccaccacgggtacgggtcaaccaccaggacttccagttacgcaacctgagaatcatcgagccgaacgaggtgactcactccggagacactggtgtagaaacagatggaagaatgcctccaaaagtaactagtgagcttctacgtcagctgagacaggctatgagaaacagcgaatatgttaccgagcccatacaggcctatatcattccatccggagacgctcaccagtcggagtatattgccccatgtgactgtcgacgtgccttcgtgagcggctttgacggttcagctggcacagccattattacagaggaacatgcggctatgtggacagatggacgctatttcctgcaggctgccaagcaaatggattccaactggaccctcatgaagatgggactcaaggataccccgacacaggaggattggctggtgtctgtactgccagaaggtagcagagtgggggtggatccccttatcattccaaccgattattggaaaaaaatggccaaagttcttcgttctgcaggtcaccacctcataccggtaaaggagaatctggtagacaaaatctggaccgacagacctgaaaggccctgtaaaccgttgcttactctgggcctcgattataccggaatttcttggaaagacaaggtggcagatttaagactcaagatggccgagcgaaatgtgatgtggtttgtggtcaccgccctggatgagatcgcttggctctttaatctccgcggatctgacgtggagcacaaccccgtgtttttcagctacgcaatcatagggctcgagacaattatgcttttcatcgatggcgacaggatcgatgctccttctgtgaaggaacacttgctgctggacctcgggctggaggcagagtaccggatacaagtacatccctacaagagtatcttgtctgaactcaaggcactgtgcgccgatttgagccctcgggagaaagtttgggttagcgataaagcctcctacgcagtgtccgagacgatccctaaagaccaccggtgctgcatgccctacaccccaatttgcatcgctaaagccgttaagaactccgccgagtcagaagggatgagacgggctcacattaaggatgccgtggccctttgcgaacttttcaactggcttgaaaaggaagtgcccaaagggggagtcacagagatctcagccgcagataaagccgaagagtttcggaggcaacaggctgatttcgtagatctatccttccctaccatttcttccacaggccctaacggagctatcattcattatgctgatgggacgacggatgtgacccgcacaatgcattttggaacacccaccgcttatgagaaggagtgctttacctatgtgctgaaggggcacatcgccgtctcagctgcagtgttccccacgggaaccaagggacatctgctagatagcttcgccagatcagctctctgggatagcggtcttgattatctccacgggactggacatggggttggttctttcctcaacgtgcatgagggcccttgcggaattagctacaagacgttctctgacgagccgctggaagctggaatgatcgtgaccgacgagcccggatactacgaggacggggcttttggcattagaattgaaaatgttgtcctggtagtgcctgtgaagactaaatacaacttcaataacagaggatccctgacctttgaacccctcacacttgtgcctatccagacaaaaatgatagacgtagactctcttacagataaggaatgcgattggcttaataactatcacctgacctgccgggatgttatcggcaaagaattacagaaacagggtaggcaggaagcgttagagtggctaatacgcgaaacccagcctatatccaaacagcattag

SEQ ID NO: 247019 - DNA, 1872 bp, Artificial Sequence
  Description of Artificial Sequence: Synthetic coding sequence
atgcccccaaaggtgacttccgagcttctgaggcagctgcgccaggcaatgcggaactcagagtatgtaactgaaccaatccaggcttatatcataccctcaggcgatgctcaccagagcgagtacattgctccctgtgactgtcgtagagcttttgtttcaggtttcgatggcagcgcgggtactgccatcatcacagaggagcatgctgcaatgtggactgacggtagatacttcctgcaggctgctaagcagatggatagcaattggaccctaatgaagatgggactcaaggacacccctacccaggaggactggcttgtgagtgttttacccgaaggatcaagggtgggcgtcgatccactcatcataccgacggattattggaagaagatggccaaagtcctgcggagtgccggacaccacctgatccccgtgaaggaaaacctggtcgataagatttggactgaccggcctgaacgcccttgcaagccactgctcacactcggcctggactataccgggatatcatggaaagataaggttgccgaccttcggctgaaaatggcagagaggaacgtgatgtggttcgttgtcactgcactggatgagattgcctggctgttcaatctgcggggatctgacgtcgagcacaaccctgtgttcttttcttacgccattattggcctcgagacaatcatgctatttatcgacggcgataggatcgatgcacctagcgtcaaagaacatctcttgctggatctgggattagaggccgaatacaggattcaggtgcatccgtataagtctatcctttctgagttgaaggccctctgtgcggacctatccccacgtgaaaaggtgtgggtaagtgacaaagcgagttacgcggtaagcgaaacaattcccaaagatcataggtgctgcatgccatatacacccatctgtatcgcaaaagccgtgaagaactctgctgaatctgaagggatgcggcgagctcacattaaggacgctgtggccctgtgtgagttgttcaactggctggagaaggaggtacctaagggaggggtgacagaaatatccgcggcagacaaggctgaagagtttcgccgacaacaagcagacttcgtggacctgagctttcccacaatcagtagcacaggaccaaacggcgctataattcactacgccccagtgcctgagacaaaccgcacactgagtttggacgaagtctatctgattgactctggcgcacagtacaaggacgggacgacagacgtcacacggacgatgcacttcggtacgcccacggcctatgagaaggaatgcttcacctatgtgctgaaaggccatatcgccgtctcggccgctgtgtttccaacagggacgaagggtcatctgctagacagttttgcaaggtctgccctctgggattccggactcgattatctccatgggacagggcatggtgttggaagctttctgaatgtgcacgagggaccgtgtggtattagctacaaaaccttctctgacgagcctttggaggctggtatgatcgtgactgatgaaccgggatattacgaggatggagcatttgggattcggatagagaacgtggtgctggtcgtacctgtgaaaactaagtataattttaacaacagaggctctttaactttcgagccgttgaccttagtgccgatccagactaagatgatcgatgtagactctcttacggacaaagaatgtgactggctcaataactatcacttaacatgccgggatgtaatcggcaaggagctacaaaagcaagggcgtcaagaagctttggagtggctgatccgggaaacgcaaccaatctccaagcagcactag

SEQ ID NO: 247020 - DNA, 1659 bp, Artificial Sequence
  Description of Artificial Sequence: Synthetic coding sequence
atgtggaccgacggtcgctattttttgcaggctgcaaagcaaatggattcaaattggacactgatgaagatgggactgaaggacacccccacacaggaggactggctggtttcagttctcccggagggcagtagggtaggagtcgatccactcatcattccgacagactactggaaaaagatggccaaggtgctacgcagcgccggacatcacctgattccagtgaaggagaatctggtggataagatctggacagacagacctgaacgcccatgtaagcccctgttaaccctgggactcgattatactgggatcagctggaaagataaagtggcagacctgaggctgaagatggctgagagaaacgttatgtggtttgtggtgacggcactagacgaaattgcgtggctgtttaatctaaggggtagtgatgtcgagcataacccagtattcttcagctacgccattatcggcctggaaactattatgctgttcatagacggtgataggatcgatgctccatccgttaaggagcacctattgttggatctcggcctggaggccgaatatcggattcaagtccatccttataagtcaattctttcggagttgaaggccctgtgtgccgatttatcccctagggagaaggtatgggtaagtgacaaagcctcgtatgcagtctccgaaactattccgaaagaccacagatgctgtatgccttacacccctatttgcattgctaaggccgtgaagaattccgctgaaagcgagggaatgaggcgcgcacatataaaagacgctgtcgccctgtgtgaactatttaactggctggagaaagaagtgcctaaagggggagtgacagaaatctcagctgcggataaagcggaagagttcagaaggcagcaggctgactttgtggacctctccttccccacaatcagctccaccgggcctaacggggctatcatccactacgcgccagttcctgaaaccaataggactcttagtctggatgaagtatatcttatagacagcggtgcccagtataaggatgggactacggatgttacgcggacaatgcacttcggcacgcccaccgcctacgagaaggagtgcttcacttatgtgcttaaaggacatatcgctgtctctgccgctgtgtttcctaccgggacgaaagggcatttactggattcttttgcccgatccgccttgtgggacagtgggctggattacttgcacggcactggtcacggcgtgggctcttttcttaacgtgcacgagggtccatgcggaatttcttacaagacattttctgacgaacccctggaagcagggatgattgtgacagatgaacccggttactacgaagatggagcattcggcattcggattgaaaatgtagtcttggtggtccctgtcaaaacaaagtacaacttcaataatcgaggcagtttgacgttcgaacccctgacactggtgccaatccaaactaagatgatcgatgttgatagcctgaccgacaaagagtgcgattggcttaacaactatcacctgacctgtcgggacgtaatcggtaaggagctgcagaaacaagggcgtcaggaggccctcgagtggctaatccgtgagacccagccaatcagtaagcagcactag

SEQ ID NO: 247021 - DNA, 912 bp, Artificial Sequence
  Description of Artificial Sequence: Synthetic coding sequence
atgccccctaaagtcacatctgaactgctgaggcagctgaggcaggccatgaggaactcagagtatgtcaccgagccaatccaggcttacatcatcccctccggcgacgcccatcagtcagagtatatcgcaccatgtgattgccgcagggctttcgtgagcggctttgatgggagcgccggaacagctattatcactgaggaacatgccgctatgtggactgatggcaggtattttctacaagcagctaaacagatggatagcaattggactcttatgaagatggggttaaaagacactccgactcaggaggactggttagtatcagtgcttccagaaggatctagagtgggcgtcgatccactgatcattcccacggactattggaagaagatggccaaggtcctgcggagcgcagggcaccatctaataccggtgaaggagaacctggtggacaaaatctggaccgacagacctgaacgaccctgtaaacctcttttgaccctggggcttgactacaccggaatctcctggaaagataaagtggctgacctccgactaaagatggctgagcgcaatgtgatgtggttcgtagtcacggctctcgatgagattgcatggctattcaatctaaggggaagtgacgtcgaacacaacccggtctttttttcatacgcaataatcggactggagacaatcatgctcttcattgatggcgatcgcatcgacgctcccagcgtcaaagaacacctgctgttagacttgggactggaggccgagtatcggattcaagtccacccatacaagtctattctcagcgagctgaaagcactgtgcgccgatctttcaccacgcgagaaagtttgggtgtcggataaggcgtcctacgcggtgtccgaaactatcccttag

SEQ ID NO: 247022 - DNA, 2001 bp, Artificial Sequence
  Description of Artificial Sequence: Synthetic coding sequence
atggcagctagccggaagccacctagagtccgggtcaaccatcaggattttcagctaagaaatctgcggataatagaacctaacgaggtcacccacagtggcgatactggcgtggagaccgatgggagaatgcctcccaaagtgactagcgagttactgagacagcttcgccaggcaatgcggaattctgagtacgtgaccgaacccatccaggcctatatcatcccttccggtgatgcacaccaatctgaatacatcgccccttgtgactgtagacgcgcttttgtcagcgggtttgacggatcggcagggacagccattattactgaggaacacgccgcaatgtggacagatggcagatacttcctgcaggctgccaagcagatggatagtaactggacactcatgaagatgggtctcaaagatactcccacccaggaggactggctggttagtgtactgcccgaggggagccgcgtgggggtggaccctctgatcatacccaccgactactggaaaaagatggctaaagtcctgcgaagcgctggccaccacctgatcccggtgaaggaaaatctggtggacaaaatctggaccgatcggccagagaggccttgtaaaccattattaactcttggactggactacaccggcatcagttggaaggacaaagtggctgacttgagactgaagatggctgagcgcaatgtgatgtggttcgtagtaacagccctggacgaaatagcgtggctgtttaacctgcgtgggtcagatgtggaacacaaccccgtgtttttttcctacgccatcattggactcgaaacaataatgcttttcatagatggcgacaggatcgatgccccatccgtgaaggagcacttgctgttagacttgggtttggaggccgagtatagaatacaggtgcatccatataaatccatcctatctgagttgaaagcactgtgtgcggacctgtccccacgggagaaggtgtgggtgtctgacaaggcttcttacgcagtcagcgaaactattccgaaggaccacaggtgctgcatgccgtacactcccatttgcattgcaaaggccgtgaagaactctgccgagtctgaggggatgcgccgtgcacatataaaagacgctgtggccttatgtgagctgttcaactggcttgagaaagaagtgcccaaagggggtgtaactgagatttcagctgccgacaaggccgaggagttccggagacagcaggctgacttcgttgatctgtcatttcccaccatcagttccaccggaccgaacggcgctattatccactacgcacctgtgccagagactaacaggactctgagtctggacgaagtataccttattgattctggcgcacagtacaaggacggcacaaccgatgtgacaagaacaatgcattttggcacccccaccgcctacgagaaggaatgttttacctacgtgctgaaagggcacatagcagtgtcagccgcagtctttcctaccggaaccaaaggacacctcctggattctttcgcaagatcggccctgtgggatagtggcctggattatctccacggaaccgggcacggggtgggctcctttttgaacgttcacgagggcccttgcggtatctcatataaaacgttttccgacgagcctctggaagccggaatgattgttaccgacgagcctggctattatgaagatggtgctttcggaattcggattgaaaacgtagtcttagtggtgccagtgaagaccaagtacaatttcaacaatagaggatccctcacctttgaaccacttactttagtgccgatccaaaccaaaatgattgacgtggacagcctgaccgacaaagagtgtgattggctcaacaattaccatctgacctgccgggatgtgattggcaaagaactgcaaaagcagggacgccaggaagcgctcgagtggctcattagagaaacccaacctatatcaaagcagcattag

SEQ ID NO: 247023 - DNA, 552 bp, Artificial Sequence
  Description of Artificial Sequence: Synthetic coding sequence
atggcacgtgcacattggggctgctgtccttggcttgttctcttgtgtgcctgcgcctggggtcacacgaaaccggtcgacctaggtggccaggatgtcagaaattgctctaccaacccaccttatctgccagttacagtcgtgaacacaaccatgtctctgactgcgctgagacagcaaatgcagacccaaaatctctcagcttatattattcccggtactgatgctcacatgaatgaatatattggtcagcatgatgagcgcagggcgtggattacagggttcactggaagtgccggaaccgctgtggttacaatgaagaaggccgctgtgtggaccgattccaggtactggactcaagctgagagacagatggactgcaactgggagctgcacaaggaggtaggaaccaccccaatcgttacctggctgcttactgagatccctgctggcggtagggttgggttcgatcctttcttattaagtatcggaatgttatttctacagagtttgaacctttctatgctaacaagggtgacccagctaccctag

SEQ ID NO: 247024 - DNA, 2025 bp, Artificial Sequence
  Description of Artificial Sequence: Synthetic coding sequence
atggccagggcccactgggggtgttgtccctggctggtgcttctgtgcgcttgtgcctggggccacaccaagccagtagacctcggtgggcaggacgtgcgaaactgctctaccaatcccccttacctgccggtaactgtggtgaataccacaatgtccctgacggccctgcgccagcagatgcagacacaaaatctcagcgcctatattatccctggcacagacgcacacatgaatgaatatataggtcagcacgacgaaagacgagcctggatcaccggtttcacagggtccgctggcacagcagttgtgaccatgaaaaaggctgcagtgtggaccgacagtcgctactggactcaggctgagcgccagatggactgtaactgggagcttcataaggaagtgggcaccactcctattgtcacctggttattgacagagattccggcaggcggacgggtaggattcgaccctttcctactctctatcgacacctgggaatcttatgatttagccttgcaggggtcaaatcgccaactggtgagcatcacaaccaacctggtggatctcgtttggggtagtgaacggcctccagtgcccaaccagccaatttacgctttgcaggaggcttttacgggctccacatggcaggaaaaggtctccggggttcgctcacagatgcagaaacaccagaaagtgcctaccgccgtcttactctcagccctggaggaaactgcttggctgtttaacttgcgggcaagcgacatcccctataacccctttttttacagctataccctcctgaccgacagttccatccgcctattcgcgaataaatcacgcttcagctccgagaccctttcataccttaatagctcttgtacagggccaatgtgcgtgcagatcgaggactacagccaggtccgcgattccatccaggcatactccctcggcgacgttaggatatggatcggcacatcctataccatgtatggcatctatgagatgatccccaaggagaagttagttacagatacttatagccccgtgatgatgactaaggctgttaaaaattcaaaggagcaggccctcctgaaagcaagtcacgttagggatgcggttgccgtgattcggtacctagtctggctcgaaaagaacgtgcccaagggaaccgtggatgaattctccggtgctgagattgtggataaattccggggtgaggagcagttcagtagcggtccctccttcgaaaccataagcgctagcgggttgaacgccgcactggcccactattccccgaccaaggagctgaataggaaactgtcttctgatgaaatgtatcttctggattccggcggtcaatattgggacggtaccacagacattacccgtaccgtgcattggggcacgccatcagctttccagaaggaggcctatacaagagtactgattggcaacatagacctctcccggctgatttttccggcagctacctctggcaggatggtggaagcttttgcgaggcgcgcattgtgggacgccggtcttaattacggccacggaacaggtcacggaatcgggaacttcttgtgcgtgcacgagtggcccgtcgggtttcagagcaataatatcgcaatggccaaggggatgttcacctccattgagcctggatattacaaggatggcgaattcggaattcggctggaggatgttgctctggtggtggaagccaaaaccaaatatccgggaagctacctgaccttcgaagtcgttagctttgtcccatacgataggaacttgatcgatgtctctctgttaagtcctgaacacttacaatatctgaatagatactatcagacgataagagagaaggtcggtcctgaattacagcgtcgacagctgctggaagagttcgaatggttgcagcagcacacagaacctctggctgcgcgtgccccagacactgccagttgggcctcggtcctggtggtgtcaacactggccatcctgggttggtccgtatag

SEQ ID NO: 247025 - DNA, 1524 bp, Artificial Sequence
  Description of Artificial Sequence: Synthetic coding sequence
atgccctggcttctgtccgccccaaaactcgtgcccgcagtcgctaatgtgcggggactgtcgggttgcatgctttgctctcagcgcagatattcactccagcctgtccccgaacggaggatccctaataggtacctcggccagcccagtcccttcacccatccccatctgctgagaccgggagaggtgactcccggactgagtcaggtggagtacgctctacggcgtcataaactgatgtccctcatccaaaaagaagctcaggggcagagcgggacggatcaaactgtagttgtgctcagcaaccctacatactatatgtcaaatgacattccctacacctttcatcaggacaataatttcctttacctgtgcgggttccaggagcccgatagcattttggtacttcagtcattaccaggtaagcagctcccaagccataaggcaatcctcttcgtcccaaggcgagacccttccagagaactgtgggacggcccacgctccgggaccgatggagcaattgctctcactggtgtagatgaagcatacacactggaggaatttcagcacttactccctaagatgaaagccgaaacgaatatggtttggtatgactggatgcggcctagccatgcacagcttcactccgactatatgcagccgctgaccgaggccaaggctaaaagtaagaataaggtacggggtgttcagcagctcatccagcgcctccgcctgatcaaaagtcctgcagagatcgagagaatgcagattgcaggcaagctgaccagccaggcttttatagagacaatgtttacctctaaagccccagtagaggaggcttttctgtacgctaaatttgagtttgagtgcagagcacgcggagcagatatcctggcctatccgcctgttgtagccggaggcaacagaagcaacaccctgcactacgtgaagaacaatcagctgattaaggatggagagatggtgctgctggatggcggatgcgagagctcttgctatgtttccgatattacccggacgtggcccgtaaatgggagattcactgcccctcaggcagagttgtatgaagccgtactggaaatacaaagggattgcctagccctgtgcttcccaggcaccagcctcgagaatatctactccatgatgctgacactgattggccagaaactcaaggatctgggtattatgaaaaatatcaaagaaaacaatgcattcaaagcagcccgaaagtattgccctcaccacgtgggacactatttaggcatggacgttcacgatacaccagacatgcctagaagcttgcccctccagcctggaatggttatcacaattgagccaggcatttacattcccgaagatgacaaagatgctcccgaaaaattcagaggcctaggggtgagaatagaggacgatgtggtggtcacccaggactcccctctgatattgagcgctgattgtcctaaggagatgaacgacattgaacagatttgctcccaagcttcttag

SEQ ID NO: 247026 - DNA, 837 bp, Artificial Sequence
  Description of Artificial Sequence: Synthetic coding sequence
atgccctggttgttgtccgcccctaagctggtgcctgcagtggccaatgtgcgcggactgtccggatgtatgctctgctcccagagacgatattccctccaacccgtgccagagaggcggatacccaaccgttatttagggcagccctcacctttcacccatccccacctgctgaggcccggagaggtgacacctggcctatcacaggtggagtacgctctgaggagacacaaactgatgtccctgattcagaaggaggcccagggacaatctgggacagatcagactgtggtggtactctccaatcctacatattatatgtcgaacgacattccatataccttccaccaggacaataactttctgtacctctgcggctttcaggagcccgattccatactggtgctgcagtctctccccggaaaacagctgccctcccataaggccatcttgttcgtgccaagacgggacccctcgcgtgaactgtgggacgggcctagatccggcacggacggtgctatcgctttgactggagtggatgaagcgtatacccttgaggagtttcaacatttgctgccaaaaatgaaagccgagaccaacatggtctggtatgactggatgcgcccaagccacgcacaacttcattccgattacatgcagccactgaccgaggctaaggccaagagcaagaacaaggtgcggggagtgcaacagttgattcaacggctgagacttatcaaaagtccagcagagattgagaggatgcagattgccggaaagctgaccagtcaacgccagggctttagcgtgctttcacggctggtttccaactcctag

SEQ ID NO: 247027 - DNA, 867 bp, Artificial Sequence
  Description of Artificial Sequence: Synthetic coding sequence
atgccatggctgctcagtgctccaaaactggtgcctgctgttgcaaacgtgagagggttgagcggatgtatgctgtgttctcaacggcgttattccctgcaaccagtcccagagagaagaatccccaaccgttaccttggccagccaagccccttcacccacccacatttgctgaggccaggtgaagtgacaccaggcttaagccaggtcgagtatgcactgaggaggcataaactgatgtcgctgatccaaaaagaagcgcaggggcaaagtggtacagatcagactgttgtcgtgctctctaacccaacttattatatgtctaacgatatcccatacacatttcatcaggataacaatttcctgtacctatgtggtttccaggagccagattctatacttgtgcttcagtcactccccggaaagcagctgcccagccacaaggctatcctattcgtgcccaggcgggacccatctcgcgaattatgggatggcccaaggagcggaaccgatggcgctattgctctgaccggagtggatgaggcctacaccctggaggaattccagcatcttctaccaaagatgaaggccgagactaatatggtgtggtacgattggatgaggccaagccatgcacagcttcatagtgactacatgcaacctctgaccgaggccaaggctaagagcaagaacaaggttagaggtgtgcaacaattaatccagcgacttcgcctcatcaagtcacccgcagagatcgaacggatgcagatcgccggtaagctcacgagccagaagtccgttctgttagccagacacgggggttcacgcctctattcgcaccactttgggagacccaggctgagttag

SEQ ID NO: 247028 - DNA, 1455 bp, Artificial Sequence
  Description of Artificial Sequence: Synthetic coding sequence
atgctttgctctcagcgcaggtactccctccagccagtgccagagaggcgaattccaaatcggtacttagggcagccgagcccttttactcaccctcacctgctgcggcctggggaagtcacacctgggcttagccaagtggaatatgcactgcggagacataaactgatgtccctgatccagaaagaggcccaaggacaatctggcacagatcagaccgtcgtggtgctgtcgaatccgacatactacatgagcaacgacatcccatatactttccaccaggataataacttcttgtacctgtgtggcttccaggagcccgacagcatcttggtgctgcagagcctgcccggaaaacagctgccatctcacaaagctatcctcttcgtgcctcgccgagacccttccagggaactgtgggatggcccaaggagtggaaccgatggcgctatcgctctcactggggttgacgaggcttatacgctggaagagttccagcacctgcttcccaaaatgaaagctgaaaccaacatggtttggtacgactggatgcgacctagtcatgcccagctccacagcgattatatgcagcccctcaccgaggcaaaagcgaaaagtaagaacaaggttcgcggtgttcagcagctcatacagcgcctgagattgattaaaagtccagcagaaatcgagcggatgcaaattgcaggcaaactcacctcccaggctttcattgagactatgtttacctctaaggcgcctgtcgaagaggctttcctgtacgctaaatttgagtttgagtgcagagctagaggagccgacattcttgcctacccccctgtcgttgccggtggaaaccggtccaatacattgcattacgtcaaaaataatcaactaatcaaggacggagagatggtgctcctggatgggggttgcgaatctagttgctacgtaagcgacatcacacgaacgtggccagtgaacggccgttttactgccccacaggccgagctctacgaggccgtcctcgagattcaacgggattgtcttgccttgtgctttccaggcacttcccttgaaaacatttactccatgatgctgacccttattggtcagaagctgaaggatctgggaataatgaagaacatcaaggaaaacaacgcattcaaagccgcaagaaaatattgtccgcaccatgttggccattacctgggcatggatgtgcacgataccccagatatgcccagatccctgcctctgcagcctgggatggtcatcaccatagaacctggaatctatatcccggaagacgacaaagacgcgcctgaaaaatttcgtggacttggagtcaggatcgaggacgatgtggtagtcacccaagatagccccctcatcctgtctgcagattgcccaaaagagatgaatgacatcgaacagatctgcagccaagcgtcatag

SEQ ID NO: 247029 - DNA, 2379 bp, Artificial Sequence
  Description of Artificial Sequence: Synthetic coding sequence
atggcctttagcggaatttataaactagacgacggtaagccatacctgaacaactgttttccagctcgtaacctcctgagggtccctgaagagggccaagggcactggcttgtagtccagaaggggaacctgaagaagaaacccaagggcctagtgggagctcaggccgagaggcgggagtcactgaaagccaccagctttgaattcaaaggcaagaaagagtcccgacgggaaaaccaagttgacctgcccggacacatactcgatcaggcctttctactgaagcatcactgtgtgagaaaaccaagcgatctctgcactatcaatgccaaggagaatgatttcaagcatttccactccgttatctacatcaacgcatccgagaacctccttccactggaggcattccatacttttccagctctaaaggaactggacctcgcctttaacgggatcaaaacaatatacgtgaaatacggtgactttaagctattggaatttttagatctgtcattcaacagcctgaccgttgaggcaatctgcgatctggggatcctgccccacctgagggtcctgctgctgacggggaatggcctgacttcattgcctcccaatctggcagtagccgagcaggaagcatccgtgacctcactcactagcaaacgatacatcctgcggttccctgcacttgagacattgatgctggatgacaatcgactctctaacccttcttgctttgctagcctggcaggcctgcggaggctgaagaagctgagtctggacgagaatcgcatcatcaggatcccgtacctgcaacaggtccagctgtacgatgaatctgttgattggaacggcggtcggggttctcctcacaaagagccccagttcatgcttcagtccaaacccagaatgctcgaggactctgacgagcagcttgattatactgtgttgccgatgaagaaggatgttgacaggacagaggtggtcttttcctcgtaccccggtttcagcaccagcgaaaccaccaagatatgcagcctgcctccaatatttgaaattttaccagtcaaaagcctgaaggcacgcaatcaaacgctggccccacctttcccagagctgcgttatctgagcctcgcgtacaacaagatcgcaaaggaggacgccgtgttgcccgtggctctgtttccttccctttgcgaatttgtattccacaataacccactcgtggcccacacacgcggagtccctccactgctgaagtcattcttgcaggaacggctcggcatccatctgattcggaggaagatagtgaagccgaagcaccatgtgttaatgagtcggaaggagagctggaaagtgaagtctgagatccctaaagttccaaagcagcccctagtgctgcatcatccgagaatgactaccacaaagtcgccctctaaagatatgttggaacccgaagcagaacttgccgaggatcttcccactaccaaatccaccagtgtggagagtgaaatgcccaccgaaaatttggagggccactctcctagttgtcgaacattcgtgccactgcctcccatatgctccaattcaaccgttcacagcgaggaaactctttcacatctgtctgataccacagtgaggctgtcccctgaacggcctagcgatgaagatagtaaaagcacggaaagcatttttctgactcaggtatctgagcttccctcatccgttatccacaaagatgatcttgagctaaaagaaaaagaccaaaaaaagccacctaccgctcccagggaggtgaagggaacacgacggaagctgcccactgcatttctgccatcaaaatatcatggctacgaagaactgctcacagccaagccggatcccgcatttatcgaacctaaagggattcagaagaacgcacaggctctgcagcaaatgcttaagcacccgctcttatgtcatagctctaaacccaaacttgacacactccagaaaccctatgtccacaaagaaaaacgggctcaacgcataccaatcccacctccaaaaaagacacgtgctcagttgttggatgacatatttatccgcctcagggaccccagaaatattaccgaggcccctttgggagctgtgctgcaccagtggaccgagagaaggcttgtaaatcacaagcagtatcttgaggcaaaaaggttgctcaaggagtttcaggcgcgataccggcagctggttagcggtagccttcggactgtcttcggcaccactcccttacccatggcttgtcccgctctttccgagtcgcagcctaaattcggccatttcctggaattcatggatgagttctgccaggaacctaccgcctccgatagccagggctag

SEQ ID NO: 247030 - DNA, 2337 bp, Artificial Sequence
  Description of Artificial Sequence: Synthetic coding sequence
atggccttttccggaatctacaaactcgacgacggcaagccataccttaataactgcttcccagcaaggaatttgctcagggtcccagaggaggggcaaggtcactggctcgtggtacagaaaggtaacttgaaaaagaaaccaaagggcctggtgggcgcacaggcggaaaggcgcgaatcactaaaggctactagtttcgagttcaaaggcaaaaaggaaagcagacgagagaaccaagtggacctccccggacacattttggaccaggctttcctcctcaagcaccactgcgttcggaaaccgtcagacctttgtaccattaatgccaaggagaacgattttaaacacttccactctgtaatctacatcaacgctagcgagaaccttctgcctctggaagcattccatactttccctgcattaaaggagctcgatctcgcctttaacggaatcaagaccatctacgttaaatatggggatttcaagctcctggaatttcttgatcttagttttaactcgctgacagttgaggcaatctgcgacctgggaatcctgcctcatctccgagtgctattgttaacagggaatggactgacatcgctccccccaaatttggcggttgcagaacaggaagcatctgtgacctccctgacctccaagcgctacatcctgaggttcccagctctggaaaccctcatgctcgatgacaacagactatctaaccctagttgtttcgcgtcattagccggtctccgtagactgaaaaaactgtccctggatgagaacagaataattcgaattccttaccttcagcaggttcagctgtacgatgagtccgtcgattggaatggcggaaggggaagcccacacaaggagccacagttcatgctgcagtcaaagccgcgtatgctggaggacagcgacgaacagctggactacacagtcttgcccatgaaaaaggatgtagatcgcaccaccactaaaatctgctcactgccgccaatcttcgagattcttccagtgaagagcctgaaggccagaaatcagacattagcccctccatttcccgagctgaggtacctgtcattggcatacaataaaatcgccaaagaagatgccgtccttcccgtggctttgttcccctcattgtgcgagttcgttttccacaacaaccccctggtggcccatacccgcggtgtgccaccactgctgaaatcattcctgcaggaacggcttggcatccacctaatccgaagaaagatagtgaaacctaaacatcatgtgctgatgtctcggaaagaatcatggaaagtgaagagtgaaatccctaaggtgcctaagcagccactggtacttcatcaccctcgaatgacgactacaaaatccccgagtaaagatatgcttgagcctgaggcagagttggcagaggacctgcctaccactaaatctaccagcgtcgaatccgaaatgcccactgaaaatctggaaggacactctccaagctgccgcacgtttgtgcctttaccacctatctgcagtaacagtacagtgcactcagaggaaaccctgtcacacctgtccgacacaacagtgagactgagccccgaacgccctagtgacgaggattctaaaagcacagagagcattttcctaacgcaggtcagtgaactgccaagcagcgttatccataaggacgatctcgagctgaaggagaaagaccagaagaaaccccctacagcacctagagaggtaaaggggacccggaggaaacttccaactgctttcctgccatccaaataccacggttacgaggagctgttgaccgcaaagccagatccagcttttattgagccgaagggtatccagaagaatgctcaagcactccaacaaatgctcaagcaccctcttctatgtcacagcagcaagccaaagctcgacaccctccagaaaccatatgtccacaaagaaaaaagggcccagaggatacctattcctccaccaaagaaaactcgagcgcagttgttggatgatatctttattcgccttagagaccctagaaatataactgaggctcctcttggcgctgttctgcaccagtggacggagcgcagactggtgaaccataagcagtatctagaggctaagcgcctgctaaaggaattccaagcacgatataggcagctggtcagtggctcactccggaccgttttcggaaccacgccactgccgatggcctgtcctgccctgtcagaatctcagcctaagttcgggcactttttggaattcatggatgagttttgtcaggagcctacggcctccgattcccaaggttag

SEQ ID NO: 247031 - DNA, 2211 bp, Artificial Sequence
  Description of Artificial Sequence: Synthetic coding sequence
atggcctttagcggaatctataagttggatgatggcaaaccctatcttaataactgctttcctgcgcgtaatctgttgcgggtgcctgaagaagggcagggtcactggctggtggtgcagaagggcaatttgaaaaagaaacccaaaggcctggtgggcgcacaagccgaacgtcgggagagtctgaaagctacttcgtttgagttcaagggcaagaaagaatcgcgacgggagaaccaagttgatcttccaggccatatattagaccaagctttcttgctgaagcaccattgtgttagaaagccatccgatctgtgcacaattaatgccaaagaaaacgatttcaagcacttccattcagtgatctatataaacgcatccgaaaatcttctgccactagaggccttccacacattcccagccttgaaagagttagaccttgccttcaacggcatcaagactatctatgtgaaatacggggacttcaagctgctagaatttctcgacttgtcttttaacagcttgactgtggaagcgatctgcgatctgggaattttaccccacttaagagtgctcctgttgacggggaatggtcttacctctctaccacctaatcttgccgtcgctgagcaggaagcatctgtcacaagcttaacatcaaaacggtatatccttcgatttcccgcactggaaacattaatgctagatgataaccgtctctccaacccttcttgctttgcttcgctggctggtctcaggcggcttaagaagctttcgctggatgagaatcggataattcgcatcccctatctccaacaggtgcagctctatgatgagtcagtcgattggaacggcggtagggggagtccccacaaggaacctcagttcatgcttcagagcaaaccgagaatgcttgaagacagtgacgaacagctggactatactgtgctcccgatgaagaaggacgtcgatcgaactatcgcaaaagaggacgcggtattgccagttgccctcttccccagcttatgtgagttcgtctttcataataatcccctcgtagctcacaccagaggggttccgcctttgctcaaatcattcctgcaggagaggctggggattcatctgattagacgcaaaatcgtgaaacctaagcaccacgtgctgatgtcccgcaaggaaagttggaaggtgaagtccgagatccccaaggtgcctaaacagcccctcgtgctgcaccaccctaggatgactaccactaaaagccccagcaaggacatgctggagcctgaggcggaacttgccgaggatttacctaccaccaaatccaccagcgtcgaaagcgaaatgccaaccgaaaacctggaaggacacagcccatcatgtcggacattcgttccacttccaccaatttgtagcaacagcacggtgcatagcgaggagacgctgagtcacctgagcgataccactgtccggctgtcaccagaacgccctagcgatgaggacagcaagagtactgaatctatttttctcacccaggtctctgaacttccatcttctgtgatacacaaggatgatctggagctgaaggagaaagaccagaaaaagcccccaaccgcaccgagggaggtcaaggggacacgcagaaagctgccaacagcgtttctgccatcgaaataccacggctatgaggaactcttaacggctaaacctgaccccgcttttatagaacccaaaggcattcagaagaacgctcaggccttacagcagatgctcaagcacccacttctgtgccacagcagcaaaccaaagttggacaccctgcagaaaccgtacgtgcacaaagaaaagagagcacaaaggatccctattcctccccctaaaaagacccgagcgcagttgctcgacgatatctttattcggctgcgcgacccacggaacatcactgaggctccgttgggagcagtgctccaccagtggacggagcggagactcgtcaatcataaacagtatctggaagccaaacggcttcttaaagagttccaggctaggtataggcagcttgtctcagggagtctccgtaccgttttcggaacaaccccattgcctatggcatgccctgcattgtccgaatctcagccgaaatttggccattttctggagtttatggatgagttctgtcaggagcctacagcctctgattcacagggttag

SEQ ID NO: 247032 - DNA, 891 bp, Artificial Sequence
  Description of Artificial Sequence: Synthetic coding sequence
atggcgttttcaggaatctacaaactggatgacggcaagccatatttaaataattgttttcccgctcgaaatctcttgcgtgtgcctgaggagggccagggccactggctggtagtgcaaaaaggaaacctgaagaaaaagcctaagggcctggtaggagcccaggcagagcgacgggaaagcctcaaggcgaccagctttgagttcaaggggaagaaggaatcacggagagagaaccaggtggacctgcctggacatattctcgatcaggcatttctccttaaacaccattgcgtccgaaagccatctgatctctgtaccatcaatgtgtctggccttaaattcagcaaggctaaggaaaacgacttcaagcattttcactcagtgatctatattaatgcatccgagaatttgttaccgctggaggcattccatacttttcctgccctcaaagaacttgatctggcattcaatggaattaagaccatatacgttaagtacggtgactttaagctgctcgagttccttgacctttcctttaacagcctgacggttgaagctatttgcgatttgggtattctccctcatctcagggtcctgctgctgactggaaatggcctgacaagtctcccgccaaaccttgctgttgccgaacaggaagcttcagtcacgtccctgacttccaaaagatacatcttgcggtttcccgctctggagacattaatgctcgacgacaatagactttcaaacccgagttgcttcgcctccctcgccggtttgcgaaggttgaagaaactttctctcgacgagaaccgaatcataagaatcccctacttacagcaggtgcagttatatgatgaatctgtagactggaacggaggtagaggctag

SEQ ID NO: 247033 - DNA, 1797 bp, Artificial Sequence
  Description of Artificial Sequence: Synthetic coding sequence
atggcattttcaggtatctacaaactcgacgacggcaagccttatctgaataactgctttcctgccagaaatctgctgcgtgtgcccgaggaaggacaaggccactggctggttgtgcagaaagggaacttgaaaaagaaacctaaaggcttggtcggagcccaggcagagcgccgagaatcactgaaagccacgtcttttgagttcaaaggcaagaaagagagcaggagggaaaatcaggtggatctgcctggtcatattcttgaccaagcgttcttgttaaagcatcattgcgtgagaaaaccttccgatctgtgtacaatcaacgccaaagagaatgatttcaagcacttccactcagtcatttatataaacgcctccgagaacctgcttcctcttgaagcatttcatacttttcctgccctgaaggaactggatctggcttttaacggcatcaagaccatatacgtgaaatacggggacttcaagctgctcgagttcctcgatctctcgttcaattcccttaccgtggaggccatctgcgatcttggcatactccctcatctacgggtactgctgttgaccggtaacgggctgacaagtctcccccctaatctggctgtcgccgagcaagaagcaagcgtgacctccttgactagcaagaggtacatccttagatttcctgctttagaaacgttgatgctcgatgacaatcgcctgagcaaccccagttgttttgcgtctcttgccggtttgcgaaggctgaagaagctttccctagatgaaaatagaattatccgtatcccttatctgcagcaagtccaactgtatgacgaaagcgtcgactggaacggcggaaggggttcccctcataaagagcctcagttcatgctacaaagcaagccgagaatgctggaggactcggatgagcagctggactacactgtgctgcctatgaagaaggacgttgaccggaccggagtcccaccactcctaaaaagctttctccaagaaaggctgggtatccacctgattagaagaaagatagtgaagcccaagcatcatgttcttatgtcgcgcaaagagtcatggaaagtgaaatctgagatccccaaagtgcctaagcagcccctagtattacatcacccgaggatgacaactaccaagtcaccaagcaaagatatgcttgagcccgaggcggaactggctgaggacctgcctacaacgaagtcaaccagtgttgagtccgaaatgcctacagagaatcttgaggggcattccccgtcctgtcgtacgtttgttccactgccgcctatttgttccaacagtaccgtccacagcgaagaaacgctcagtcatctttccgatactacggtgagactgtctcctgagcgcccaagtgacgaggacagcaaaagcactgagtctatatttctgacacaagtctccgagttaccaagttccgtaattcacaaggacgacctcgaactgaaggagaaagaccaaaaaaaacctccaaccgccccaagggaagtgaaagggaccaggagaaagctgcccactgcattcctgccgtccaaataccacgggtatgaggagcttcttacagcaaagccggatcccgcatttatcgagccaaaggggattcagaaaaatgcacaggctctgcagcagatgttgaagcatcccctcttatgtcactcttcaaagcctaagttggacactttgcaaaaaccttatgtgcataaagaaaagagggtcctgagctgcacttctggacagaacggtggatggtag

SEQ ID NO: 247034 - DNA, 1554 bp, Artificial Sequence
  Description of Artificial Sequence: Synthetic coding sequence
atgctcgatgacaaccgtctttctaaccctagctgctttgcatcgttggcagggcttagacgcttgaagaagctctcattagatgaaaatcgcataatcaggatcccctatctgcagcaagtgcagctgtatgacgaatcagtggactggaatgggggtcgcggtagcccgcataaggagccccagttcatgttacagtctaagccacgcatgttggaggactccgacgaacagctggactatacagtgctccccatgaaaaaggatgtagaccggacagaggtagtattttcgtcataccctgggttctctacgtccgaaatcgctaaggaggatgccgttctgcccgtagcactgttcccctccctgtgcgaatttgttttccacaacaatcccctagtggcccacacaaggggggtccccccactgctgaaaagttttctacaagagcgcctggggattcacctgatccgaagaaagatcgttaagcccaagcaccacgtgctcatgtcccggaaggagtcctggaaggtgaaatcagagatcccaaaggtgccgaaacaacccctggtcctgcatcacccaaggatgactaccactaaatctcctagcaaggacatgcttgaacctgaggctgagctcgcagaagaccttccaacaaccaaatcaacatctgtagagtcggagatgcctaccgagaaccttgagggacacagcccatcttgcaggacattcgtgcccctgcctccaatatgctctaattctaccgtccattcagaggagactctgtcgcatttgtcggatactaccgtgagattaagccccgagcgcccttcagatgaggatagtaaaagcactgagagcatctttctcacacaggtctccgaactgccgagcagcgtgattcataaggacgacttagagctcaaggagaaggaccagaagaagccacccacggcgccaagagaagtgaaggggaccaggcgtaaactgccgacggcgtttttacctagtaaataccacggatatgaggaacttctgaccgcgaaaccggaccccgcttttatcgagccaaagggtatccagaagaacgctcaggcactacagcagatgcttaagcaccctctcctgtgtcatagctcaaagcctaaacttgacacactccagaagccgtatgttcataaggagaaaagggcacaacggattcctatccccccacctaagaaaacacgcgcacagctgctggacgacatcttcattcgactgagagacccgagaaatattaccgaggctccgttgggtgctgtgctgcatcagtggacagagcgccgtctcgtgaatcataagcagtatttagaagctaaaagattacttaaggagttccaggctcgttaccggcagctggtgagcggcagtttgcgtaccgtgttcggcacgactccactacctatggcctgccccgcactgtccgagagccaacctaagttcgggcattttctagaattcatggatgaattttgtcaggagcctactgcatctgattctcagggctag

SEQ ID NO: 247035 - DNA, 984 bp, Artificial Sequence
  Description of Artificial Sequence: Synthetic coding sequence
atgttcccttcacgacgaaaggccgcacagctgccttgggaagatggccgaagcgggctcctctccggtggacttccaagaaaatgcagtgtgtttcatttgttcgtggcctgtctgtctctcgggtttttttccttgctctggctgcagctgagctgtagtggagatgtcgcaagagcagttagaggtcagggacaagaaacatctggcccacccagggcctgtccgccagagccaccgccagagcactgggaagaggatgcctcctgggggcctcatagactcgcggtcttagtcccgtttcgcgagcgtttcgaagagctcctcgtgttcgtgccacatatgcgtcgtttcctgtcacgaaaaaagatcagacatcatatctatgtgttaaatcaagtggaccattttaggtttaatcgcgcagccctgattaacgtgggatttttggagtcttccaattccacggattacatcgcgatgcacgacgttgacctgctgcctctcaacgaggaactagactacggcttccctgaagccggaccctttcatgtcgcctcgcccgagctgcatccactataccactacaagacatacgtgggaggtatcctgttgttgagtaagcagcattacagactctgtaacggaatgtccaaccggttctgggggtgggggcgtgaggacgatgagttttataggagaattaaaggggctgggttacagctgtttagacccagcgggatcaccactggctacaaaacatttcgtcacttacatgatccggcttggaggaaacgtgatcagaaacgaatcgcggctcagaagcaagaacagttcaaggtggacagagaaggaggactcaatacagtgaagtatcacgtggcatccagaactgccctgtcagtggggggagcgccttgcaccgtgcttaatattatgctggactgcgataagactgccacgccatggtgcaccttctcttag

SEQ ID NO: 247036 - DNA, 642 bp, Artificial Sequence
  Description of Artificial Sequence: Synthetic coding sequence
atgcgcagattccttagccggaagaagatacggcatcatatctatgtcctcaaccaggtcgaccacttccggtttaacagggcggctctcataaatgtgggcttcttagagtcgtcaaatagtaccgattatatagctatgcacgacgtggacctgctgcctcttaacgaagagctggactatggctttcccgaggccggtccctttcacgtcgcctctcctgaactgcatcccttgtaccactataaaacgtacgtggggggaattctgctgctgagcaagcagcactaccgcctgtgcaacggaatgtccaaccgtttctggggatggggcagggaggacgacgaattctaccggcgaataaaaggggctggactgcagttgtttagaccgagtggtattacaacgggctataagacctttagacacctgcatgatccagcttggcgcaagcgagatcagaagagaatagcggcacagaagcaggagcaattcaaggtggatagagagggtggtttaaacactgtgaaatatcatgtcgcatcccggacagccctgtctgtgggcggagctccatgtacagtgctgaacatcatgctggactgtgacaaaactgccaccccatggtgtactttctcatag

SEQ ID NO: 247037 - DNA, 2880 bp, Artificial Sequence
  Description of Artificial Sequence: Synthetic coding sequence
atggtcgcagccccttgtgccagacgactggcgcgacgctcacactctgccttactagcggcactcacggtgctcctcctgcagactctagtcgtctggaacttctcatctctcgacagcggcgctggggaaagacgaggcggagcagctgtgggagggggagagcaaccaccgccagccccagcacctcgacgggaaaggcgggacctacctgcagagccggctgccgctcgtggagggggaggaggaggcggaggtggtggaggaggacgcggaccccaggcccgtgctcggggaggaggccctggagaaccaagaggccagcaacctgcctcccggggtgctttgcccgctcgcgctctggatcctcacccgtcaccgctgatcacgctcgaaacccaggacggctatttttcacaccgcccaaaggaaaaagttcgaaccgactccaataatgagaactccgtccctaaggactttgagaacgtcgacaattcaaattttgctccccgtacacagaagcaaaaacaccagcctgaactggctaaaaaaccaccctctcggcagaaagagttactcaagcgtaagctggaacaacaggagaaaggaaaaggccatacattccctggtaaagggccaggtgaggtgctgcccccaggcgacagggctgctgcaaactccagtcacgggaaggacgtctccaggccccctcatgctcgcaagacaggtggaagttctccggagaccaagtacgaccagccgccaaaatgtgacattagcggcaaagaagccatctctgctctgtcaagagctaagagtaagcactgtcggcaggagatcggagagacctattgtaggcacaaactgggactgcttatgcctgaaaaggtcactcgcttttgccctctggagggtaaagctaacaagaatgtccagtgggatgaggactcagttgagtatatgcctgctaatcctgtgcgtatagccttcgttctcgtggtccacggcagggcatcacgccagcttcaaagaatgtttaaagcaatctatcacaaagatcacttttactatatccacgtcgataagcgtagtaattatctgcaccggcaagtgctgcaggtctccaggcagtactccaacgtgcgcgtcaccccttggagaatggcaaccatctggggcggtgcctctctcctctcgacataccttcaatctatgagggacctcttagaaatgaccgactggccctgggacttcttcattaatctcagtgccgcagattaccctatccgcacaaatgatcagctcgttgcctttttgagccggtaccgggacatgaatttccttaagagccacggtcgagacaacgccagattcatcagaaaacaagggctggacagattgtttctggaatgcgacgcccatatgtggcggctgggagaccgcaggattccggaaggaatagcagtggacggcggttctgactggtttctcctcaatagacgctttgtggagtacgtcactttctccaccgacgatctagttaccaaaatgaaacagttttactcctataccctgcttcctgctgagagcttctttcatacagtgctggagaactcacctcattgcgacaccatggtggacaacaatttgcggattaccaattggaaccggaagctgggttgcaagtgccagtataaacacatagttgactggtgtgggtgctccccaaatgacttcaaaccacaggattttcacagatttcagcagacagccagacccacttttttcgcgagaaagttcgaagcggtggtaaaccaagagattattggacaactggattattacctgtacggcaattatccagctggcactccagggctaagatcttattgggagaacgtatatgatgaacctgacggtatccactccctgtccgacgtgaccctaacactgtatcattcttttgccagactcggattgaggagggccgagacatctctccacactgatggggagaacagctgccggtattatccaatggggcacccagccagcgtacatctgtattttctggctgaccgatttcagggctttttgataaaacaccatgccacgaacctggcggtatctaaactcgagacactggaaacatgggttatgccgaaaaaagtgttcaaaatcgcgtctcccccatcagacttcggacgtttgcagtttagcgaagttggaactgattgggacgctaaggaacgattatttcggaattttggtggtctactaggtcccatggatgagcccgtcggaatgcagaaatggggtaaggggcctaacgtgacagttaccgtgatttgggtcgatcctgtaaacgtgattgctgcaacttacgatattctcattgagagcactgctgaattcacccactataagccccctctaaatctccccctgcgaccaggagtatggactgtcaagatcttgcatcactgggtcccagtagccgagaccaagtttctggtggctcctctgaccttttctaaccgccaaccaatcaagcccgaggaagcactgaagctgcacaacggcccacttaggaatgcgtacatggagcagtcgttccagtctttgaatccagtcctttccctgcccatcaaccctgcccaggttgagcaggctagacgtaatgccgcatctactggcactgcgcttgaaggatggctggactcactggttggcggtatgtggaccgctatggacatttgtgccacagggcctactgcctgtccggtaatgcaaacatgctcccagacagcatggagcagtttttctcccgatcccaaatccgaattgggcgcagttaaaccagatgggcgactgcgatag

SEQ ID NO: 247038 - DNA, 2598 bp, Artificial Sequence
  Description of Artificial Sequence: Synthetic coding sequence
atggtggctagcgcaagagtccaaaagctggtgcgccgttacaaactggctatagccaccgcacttgccattctgctactgcagggcctggtcgtctggtccttctcaggcctggaggaggatgaagctggcgagaaagggagacagaggaagccccgaccccttgaccccggtgagggctccaaggatacggacagtagcgcgggacgaaggggtagcacaggccgtcgccacggccgatggagaggcagggccgaaagccctggcgtccctgttgcgaaggtagttcgcgcagtgacctccaggcaacgtgctagcagaagggtccccccagcacctcctcctgaagcccctggacgccagaacctctctggcgcagcagccggagaggcactcgtaggtgcagcgggattcccaccacacggcgacaccgggtctgtggagggcgctccccagcccacagataacgggtttactcccaagtgcgaaatcgttgggaaggatgctctctcagccctggcacgtgcatcaacaaagcagtgtcagcaggagatcgcaaacgttgtgtgtctccaccaagccggaagcttaatgcctaaagccgtgcctcgacactgtcagttgacgggaaagatgtctcctggcatccagtgggacgagtcccaggcacaacagcctatggacggccctcccgtacgaattgcctatatgctcgtggtacatggaagggcgatcagacagctgaaacggctgttgaaagcggtctaccatgagcaacatttcttctacatacacgtggacaagaggtctgactacttgcaccgagaagtggtggagttggctcaaggctacgacaacgtgcgggtgaccccttggagaatggtcaccatctggggaggggcaagcctactgcgcatgtatctccgtagcatgcgagatttacttgaggtgcccggatgggcttgggattttttcataaatctgtcagccaccgactatccgacacggacaaatgaagagctggtcgccttcctatcaaaaaaccgggacaaaaactttctgaagagtcacggacgggataactctcggttcatcaaaaagcagggcttggaccggttatttcacgagtgcgatagtcatatgtggcggctcggcgagagacaaattcctgccggaatcgtcgtggatgggggaagcgattggttcgtactgacccgctccttcgtggagtatgtagtctataccgacgatccattagtggcacagctaagacaattctatacgtatacacttcttccagcggaatctttctttcatactgtcctggaaaatagtctggcctgtgaaacactggttgataataacttgagagttactaattggaatcgaaagttgggctgcaaatgtcagtataagcatatcgtcgactggtgtggatgcagtcccaacgatttcaagccacaggactttcttcgtctgcaacaggtatctcgtcctacattcttcgctaggaaattcgaatctaccgtgaaccaggaggttcttgagatcctggactttcacttatacggtagttaccctcctggaacaccagccctaaaggcctactgggagaatacttatgacgcggctgacggacccagtgggttgtcagatgtgatgctgacagcttacaccgccttcgcgagactcagtctgcatcacgctgccacggccgcaccccctatggggacacccttgtgccggtttgaaccgcgtggactgccgagtagcgtgcatctctatttctacgacgaccacttccagggatacttggttactcaggctgtgcaaccctctgcccaaggacccgctgagactcttgagatgtggctgatgccccaaggcagccttaagcttctgggtcgcagtgatcaagccagccgactgcagtccctcgaggtcggcactgactgggaccccaaggaacgcttgtttcggaactttggagggcttttgggtcctctggacgagccagtggctgtgcaacgttgggccaggggacctaatcttactgccaccgtcgtgtggatagaccccacttacgtggtggccacctcctacgacatcactgtcgacaccgagacggaggtgacccaatataagcctccgctgagtaggccgctgcgccctggcccatggaccgtgagactgctgcagttctgggagcccctcggggagaccaggtttttggtgctacccctgacattcaaccggaaactgccgctgcggaaggacgacgcgagctggcttcacgcagggcctccccataacgaatacatggagcagtcgtttcagggactgtcaagtatactgaatctcccacaaccagaactagcggaggaggctgcacagaggcatactcagctgaccgggcctgccctggaggcctggacagatagagagttgtcttcgttctggtccgttgctggactctgcgccatcgggcctagcccctgtcctagcctcgagccttgtcggctcacaagctggagctcattaagcccagaccccaagtctgagttagggcctgttaaggctgatggcagattaagatag

SEQ ID NO: 247039 - DNA, 2031 bp, Artificial Sequence
  Description of Artificial Sequence: Synthetic coding sequence
atggttgccagcgctagagtccagaaactggtcaggcgatataagttggcaatcgcaacagccctcgcaattttactactgcagggactcgtcgtttggtcgttcagtgggttggaagaggatgaggctggagaaaaggggaggcagcggaaacctaggcctctggatcctggagaaggcagcaaggatacagatagctcagcgggacggcgtgggagcactgggagacggcacggaagatggcggggtagagcagaaagtcccggagttcccgtcgccaaggtggtgagagccgtcaccagtaggcagagggcatcacgcagagttccgccagctccaccccctgaggcccctggtcggcaaaatctgtcaggcgcagccgctggggaagctctcgtgggcgctgcagggtttccccctcacggggataccgggtccgttgaaggggctccacagccaacagacaacggcttcacacccaaatgcgaaatcgtaggcaaagatgccctctccgcactcgcacgggcatcaactaagcagtgtcagcaagaaatcgccaatgtggtgtgcctgcatcaggcagggagccttatgcccaaagctgtccccaggcactgccagctgactggcaaaatgagccccggaatccagtgggacgaatcccaggctcagcagccgatggatggaccgcctgtgaggatcgcctatatgcttgtggtccacggacgtgctattcgtcaattgaagcgactgttaaaggccgtgtaccatgagcagcactttttttacatccatgttgataaacgcagtgactatcttcatagggaagtcgtggagttggcgcaggggtacgacaatgttcgggtcaccccttggaggatggttaccatctggggaggcgcttccttactgaggatgtatctgcgcagcatgagagacctgttagaggttccgggatgggcatgggatttttttatcaacttgagtgccacggactaccccactcgcaccaacgaagagttagtggccttcctttcaaagaacagagataagaactttctgaagtcccacggtagggacaactcgagatttatcaagaagcagggtctagaccgcctctttcacgagtgcgattctcacatgtggagattaggcgaacggcagatccctgccggaattgtagtggacggaggatccgactggttcgttctcaccaggtcatttgtcgagtacgtagtttacacggacgatcccctcgtcgcccaactgcgccagttctatacctacactttgctgccagccgaaagtttcttccacactgtgttggagaactccctggcgtgcgagacgttggtcgacaataacctccgggtgacaaattggaatcgtaagcttggttgtaaatgccagtacaagcacattgttgactggtgtggctgctccccgaacgatttcaagcctcaggactttctgcgactccagcaagtcagcaggcccacttttttcgctcgcaagtttgaaagtacagtcaaccaggaggtgttggagatacttgactttcatctttatggatcatacccgccaggtacccctgccctgaaggcttactgggagaatacctatgatgctgcagatggcccatccggcctcagtgatgtcatgctaaccgcttacactgcatttgctcgactgtctcttcaccacgctgccaccgcggctcctccaatggggacacccctttgtcgcttcgagccacggggtctgccgagtagcgtgcacctttatttctacgacgatcactttcaggggtaccttgtcactcaggccgtccaacccagcgcacagggcccagctgagactctggaaatgtggctcatgccacaaggaagtctaaagttgctaggcaggagcgatcaggcctcacgcttgcagagcctggagaaccgtgggctctcaatgctaccgaggctcgtctctaacagttggccacaggccgtcctcccgctccagcccccaaaggctctgggctag

SEQ ID NO: 247040 - DNA, 1503 bp, Artificial Sequence
  Description of Artificial Sequence: Synthetic coding sequence
atgatcattagtcactttccaaagtgtgtggcggtgttcgcgctgctcgcactctcagttggggctctcgacacatttatcgctgccgtctatgagcatgccgtgatcctccctaataggactgaaacacccgtgtcgaaagaggaggcactgctacttatgaataagaatatcgatgtgctcgagaaagcagtaaagcttgcagctaagcagggcgcacatataattgttactcctgaggacgggatctatggctggatctttacgcgggagtccatatacccgtacctcgaggatatccctgatcccggagttaactggatcccttgccgggacccctggcggtttggcaacactcctgttcagcagcgattaagctgcctagcaaaggataacagtatctacgtggtcgcgaatataggcgacaagaagccctgcaatgcctccgattcacaatgccccccagacggtcggtatcaatacaacacggacgtggtgttcgacagtcaggggaagctccttgcgagataccacaaatacaacctgtttgccccagaaatccagttcgattttcccaaggactcggaactggtcacattcgacaccccttttgggaagtttgggatctttacttgcttcgatatattctcccatgatcctgcggtcgtggtagtggatgaatctatcgactctattctttatccaactgcatggtataataccctcccccttctttctgcggttccattccattcagcgtgggctaaggctatgggggtgaacctgctcgccgcaaatacgcataacacgtccatgcatatgacgggctcggggatctatgctcctgaggctgtcaaggtttaccattatgatatggaaacagagtcagggcagctgctcctctccgagcttaaatccagaccaaggagagagccgacgtaccctgcggctgtcgactggcacgcctatgcctcatccgtaaagcctttttcaagcgagcaatctgactttctggggatgatttattttgacgagttcacgtttaccaaactaaagcgtaacactgggaattatacagcatgtcagaaagacctctgctgccacctgacctataaaatgtcagagaaaagaacagacgagatctacgctcttggggcattcgatggcctgcacaccgtggaggggcagtactatctgcagatttgcgcgctactcaagtgtcagaccactgacttagaaacgtgcggagaacctgtggggagcgcctttaccaaattcgaagacttcagcctgtccggaaccttcggcacacgatacgtcttcccgcaaattattctgtctggttctcagttagcgcctgagagacactatgagatcagccgcgatggcagacttagaagtagatctggtgctccactccctgtcctcgtgatggccctatatggaagagtattcgagaaagatccacccagactcggacaggggagtgggaaattccagtag

SEQ ID NO: 247041 - DNA, 1200 bp, Artificial Sequence
  Description of Artificial Sequence: Synthetic coding sequence
atggacagttcaactactgcacagtgcagacaactggaggctgccgtcggaggggctcaagctctctcttgtctgaccgggagtcgcgcttatgaacggttcacaggaaaccaaatcgccaagatttatcaacagaatccagaggcctacagtcacactgaacggatctctctggtgagtagttttgccgcatctttatttcttggctcttacagccctattgattatagcgacgggtccgggatgaacctgctgcagatccaggacaaggtctggtcccaagcctgcctgggagcctgcgccccacatctagaagaaaaactctcaccgcctgtccctagttgctccgtggtgggggcaatttctagctactacgtgcagagatatggctttccccctgggtgtaaagtggttgcattcaccggagacaatccagcgagtctggccggtatgaggttggaggaaggggatatcgctgtttctcttggtacctccgataccctgttcctgtggctgcaagagccgatgcccgcactggaaggacatattttttgcaatccagtggactcccaacattacatggcactgctatgcttcaagaatggcagcctcatgcgcgagaaaattaggaacgaaagcgttagtcgttcgtggagcgactttagcaaggccctgcagtcaacagagatggggaatggagggaatctaggcttctatttcgatgtgatggagattacaccagagattatcggccgtcacaggttcaacaccgaaaatcataaggtcgcagcctttcctggggatgtggaggtccgcgcactgatcgaggggcagtttatggctaaacgtattcacgcagaaggactgggataccgcgttatgtcaaagaccaagattttggccacaggcggagcttcccacaacagggagatcttgcaggtgctagcagatgtgttcgatgcaccagtgtacgtgattgatacggcgaattccgcttgtgtgggcagtgcatatcgcgcatttcatggactggccggaggaacagatgtgcccttctctgaggtcgtgaagctggcgcctaacccgcgattggccgcaacaccttcgccaggggcttctcaagtatatgaggcgcttctgcctcagtacgcgaagctcgagcagaggatattgagccaaactcggggacctccagaatag

SEQ ID NO: 247042 - DNA, 4269 bp, Artificial Sequence
  Description of Artificial Sequence: Synthetic coding sequence
atgtcagggataaagaggaccattaaggagacagacccggactacgaggacgtctctgtggccctgcccaataagcgacataaggccatcgagaatagtgcacgagacgcggcagttcaaaaaatcgaaacaatcattaaggagcagtttgccctggagatgaagaataaggaacacgagattgaggtaatcgaccagagactgatagaagcacggcgaatgatggacaagctgcgagcttgtattgtggctaattattatgccagtgccggattgctgaaggtctctgagggaagcaagacttgtgatactatggtcttcaatcatccggctatcaagaaatttctagagagcccttcccggtcctcttcgccagctaaccagcgggcagagacgccctcggcaaaccacagtgaatcagatagcctaagtcagcacaatgacttcctgtcggacaaggataataactctaacatggatatcgaggaacgactctcaaataacatggaacaacggcctagccgaaacacagggcgtgatacatctcggattacgggatctcacaagacagagcagcgaaacgccgacctgacagacgagacctctcggctcttcgtgaagaaaactatcgtggtgggaaacgtgtctaagtacatccctccggacaagcgcgaagaaaacgaccagtcgacccataagtggatggtgtatgtgagagggtctcgacgcgagcccagcatcaatcatttcgtcaagaaagtttggttcttcctgcatccatcctacaagcctaacgacctggtcgaggtaagggaaccgcctttccacctgacccgcagagggtggggcgaattccccgtgagggtacaggtgcacttcaaggactctcagaacaagaggattgacattattcataacttaaaactcgacagaacctacacgggcttacagaccctcggggcagaaactgtagtggatgtggagctacatcgccactcacttggggaggattgcatttaccctcagtcatcagagtctgacattagtgatgctccaccctcactgcccttaaccatcccagctcctgtgaaggcatcttctcccattaagcagtctcacgaacctgtccctgacacctccgtggagaagggattccccgctagcaccgaggcggaacgccacaccccattttatgccctcccatcttctctggaacggacgccaacgaagatgacaacatctcaaaaagtgacgttttgcagccacggaaacagtgcattccagcccatcgcaagctcttgtaaaattgtgccccaaagccaggtgcccaatccagaatcccctggcaaaagttttcagccaatcaccatgtcctgtaaaatcgtttctggaagcccaatctctactccatctccgtctcctttgccacgaacaccaaccagtacacctgtccatgtcaagcagggtaccgcgggtagcgtgatcaacaacccgtacgtcattatggacaaacagcccggtcaagttatcggtgctacaacaccttcgaccggaagccccacgaataaaatctctaccgccagccaagtatcacaagggaccggatctcctgttcccaagattcatggctcaagcttcgtgacttctaccgtgaagcaggaagacagtctatttgcatctatgccaccgctctgtcccataggctcccacccaaaagtccaatctccaaaaccaatcacagggggactaggggcattcaccaaggtgatcattaaacaagagcctggagaggctccgcacgttcctgccacaggggctgcaagccagagcccactgcctcaatacgtgaccgttaaagggggacatatgatcgctgtctcgcctcagaaacaggtcattacaccaggggaagggattgcccagtctgcaaaagtgcagccttccaaggtcgtaggcgtgccagtgggatccgcccttccttccaccgtgaaacaggcggtggccatttcggggggacagatactggttgcaaaggcatcgtcaagtgtcagtaaggctgtgggccctaaacaggtggtcacacagggtgtggccaaagcgatagtgtctggcggaggaggcactattgttgctcagcctgtgcagacccttactaaggctcaagtgacagccgctggtccccagaagtctggctcacagggctcagtgatggctacacttcagctgcctgccacaaacctggcgaatctggcgaatctccctccaggtacaaaactgtacctaaccaccaattctaaaaatccaagtgggaagggaaaattgctgttaattcctcaaggagcaatattgcgagccacaaataatgcaaatctccagagtgggagcgccgcttccggcggtagcggggctggaggaggaggcggaggtggtggtggaggaggaagtggatctggtggcggagggtccactggcggtgggggaggtacagccggagggggaacgcagtcaaccgccggtccaggtggtatctcccagcatctcacatatacctcttacatccttaagcagacgccgcaggggacatttcttgtaggccaaccctccccccagaccagcggaaagcagctcaccacgggatccgtcgtacagggaaccctcggagtgagcactagcagcgctcaggggcagcagacccttaaggttatctccggccagaaaaccactctgttcacacaggctgcccacggcggacaggcttcgttaatgaagattagtgacagcacactaaagaccgttcccgctacatcccagctgtccaagcccggaactacaatgctgcgggttgccggtggtgtgattaccaccgctacaagcccagccgtggccctctctgcaaacgggcctgcccagcagtccgaaggaatggcaccagtgtcctcgtccaccgtgtcctccgtgaccaagacgtccggacagcagcaggtatgtgttagccaggccacagtgggtacttgcaaagccgctacccctaccgtggtcagtgccactagcctggtgcctacccctaatcccatttctggtaaggccaccgtttctgggctgctgaaaatccacagtagtcagtcctccccacaacaggccgttctgaccatcccatcccaactaaaacctctgtcagtgaataccagcgggggtgtgcagacaattctgatgcccgtgaataaagtcgtccagtctttcagtacatctaaacctcccgcaatcctgcctgtagcagcccctacaccagtagtgccgtcgagcgctcccgctgccgtagccaaggtcaaaaccgaacctgagacaccaggcccaagctgtcttagccaggagggacagacagccgttaaaaccgaagagtcaagcgaactcggtaattacgtgattaagatcgaccacttggagaccatccaacagttgctgacagcagttgtcaaaaaaattccccttatcaccgccaagtccgaggatgctagttgcttctctgctaagtccgtcgagcagtattacggttggaacatcggaaagcgtcgtgctgccgagtggcagcgcgctatgacgatgagaaaagttctgcaggagatcctcgaaaagaatcccaggtttcaccacctgacgccccttaaaacgaagcacatcgcacactggtgcagatgccacggctatacccccccagacccagagtccctgagaaatgacggagactctatcgaagacgtccttacacagatcgacagcgagcctgaatgccctagttcttttagcagtgccgacaatctttgccgtaagctagaagacctgcagcagtttcagaagagagagcccgaaaacgaagaggaagttgacatattgagcctcagcgaaccagtgaaaataaacattaagaaggaacaggaagaaaaacaggaggaagtgaagttttacctcccccctacccctggatccgagtttattggcgatgtcacgcagaaaatcggaatcactttgcagcctgtggccttacatcggaacgtctatgcatccgtcgttgaagatatgatcctcaaggcaaccgaacaactggtaaatgatatcctaagacaagccttggcagtgggataccagacagctagccataatcgcatccccaaggagatcaccgtctccaatatccatcaggccatctgcaacattcccttccttgactttctgaccaacaagcacatgggcatccttaacgaagatcagtag

SEQ ID NO: 247043 - DNA, 4269 bp, Artificial Sequence
  Description of Artificial Sequence: Synthetic coding sequence
atgtccggtattaaacgcaccattaaggagacagatccggattacgaagatgtgagcgtggccctacctaataaacgccacaaggcgatcgagaactccgccagagacgcggctgtacaaaagatagagaccattataaaagagcaattcgccctcgaaatgaagaacaaggagcatgaaattgaggtcattgaccaacgattgattgaggcaagacgcatgatggacaaacttcgagcatgcatcgtagccaactattacgccagcgccggactgctgaaggtgtctgagggcagtaagacctgcgatacaatggtcttcaaccatcctgctattaagaaatttctggagtcaccaagtcgatcctcctcacccgctaaccagagggcagagactccttcggcaaatcatagcgaaagcgattccctgtcccagcacaacgatttccttagcgataaggacaataactcaaatatggatattgaggaaaggctctccaataatatggagcagaggccatcacgtaatacaggaagggacacaagccggatcactggcagccacaagaccgagcaacgaaacgccgacctgacagacgaaacctccagactgttcgtgaaaaaaacaatcgttgtggggaatgtgtcaaagtacattcccccagacaagcgagaagagaatgaccagtccacgcacaagtggatggtctatgtgcgcggaagcagacgggagccatctatcaatcactttgtgaagaaagtgtggttcttcttgcacccaagctataaaccaaacgatctcgtggaggtgcgggagcctccattccaccttacccggcgaggctggggtgagttccctgttcgcgtacaagtacatttcaaagacagtcagaacaaacggattgatattatccacaatctgaagttagataggacctatactggactccagactctcggagccgaaactgtggttgacgttgagttgcacagacattccctgggagaggattgcatttatccacagagctccgaatctgacatttcggacgctcctccctccttgccactgaccatcccagcccctgtaaaagcttccagtccaattaaacagagccacgaaccagtaccagacacttccgtggaaaagggctttccagcctcaaccgaggcagagaggcatactcctttctacgctctcccgtcatcattggaacggactcccacaaagatgaccacatcgcagaaggtcactttctgttcacacggaaacagcgcattccagcccatagccagttcctgtaagatagtccctcagtcgcaggtgcctaatcccgagagccctggcaagtcgtttcagccgatcacaatgagctgtaaaattgtttccggtagtccgatcagcaccccctcgccaagccctctccctagaactccaacgagcaccccagtgcatgtgaagcagggcaccgctggcagcgtgataaacaacccatatgtgatcatggacaaacagccaggtcaggtgattggagctacaaccccgtccacagggtccccaaccaataagatcagcacagctagccaggtgtcccagggcaccggatcacccgtgcccaagatccacggttcctccttcgtgacgagtactgtcaagcaagaggacagcctattcgcgagcatgccccctctttgtcccatcggcagccatcccaaagtgcagagtcccaaaccaatcacagggggattgggtgcgtttacgaaggttatcatcaaacaagaaccaggcgaagcccctcatgtgccagctactggagctgcatcacagtcgcctctcccacagtatgtaacagtcaaaggaggccacatgatagctgtctctccacagaaacaggtgattactccaggcgaggggatcgctcagagcgccaaggtgcagcccagtaaggtggtcggagtgccagtcggatcagcactgccctcaaccgtgaaacaagcagtggccatttcaggcggtcagattctcgtcgccaaggcgagttcttccgtatctaaagccgtgggccctaagcaggttgtaacgcagggcgttgccaaggcgatcgtctccggcggagggggtaccatagtcgcccagcctgttcaaacactcactaaggcccaggttacggctgcaggaccccagaaatccggatcccaaggatcagtgatggccaccttgcagctgccagcaaccaacctcgcgaacttagcgaacctgccccctgggactaaattatacttgactacaaatagtaaaaacccgtccggaaaggggaaactgcttttaattccacagggagctatattaagggcaaccaataacgctaacctgcaaagcgggtcagctgcttccggcggatctggagcaggcggagggggagggggtgggggtggcggtgggagtggctcaggtgggggaggctctaccggcggagggggaggaacggccggaggcggtacgcagtctacggccggtccgggtggcatttctcaacatctcacttacacctcatacattctgaaacagactccacaggggaccttcctggtcgggcagccctccccccagacttcaggcaagcagctgaccactggcagtgtggttcaaggaacactcggggtatctacatcttccgcccaggggcagcagactctcaaggtaatctcaggccagaagacaactctattcacacaggctgcacacggtggccaggctagtcttatgaagatttccgactccaccctgaagacagtccccgctaccagtcagctgagcaaacccggaactaccatgcttagggttgccggaggagtgatcacaactgccacttctccagcagttgccctgtctgcaaacggccctgcccagcagtctgaaggcatggcaccggtgtcatcaagcaccgtgtcatccgtaaccaagacttctggtcagcaacaggtatgcgtaagccaggcgactgtcggtacatgtaaggcagcgacacccacagtagtgtctgctacctctctagtacctacgccaaatcccattagcggcaaggccactgtcagcggcctcctgaagattcacagcagccaaagcagcccgcagcaggctgttcttactatccccagtcagctgaagcccttgtccgttaatacgagcgggggagtgcagacaatcctgatgcccgtcaataaagttgtccagtccttctcgactagtaagcccccagccatcctgccagttgctgcaccaacaccagtcgtgcctagctccgcccctgccgcagtggccaaagtgaagacggaaccagagactcctggcccttcttgtctttctcaagagggtcagaccgctgttaaaactgaagagagcagcgagttaggcaactacgtgattaagatcgaccatctggagaccatacagcagctgctgactgccgtggtgaagaaaatcccactgataactgccaaatctgaagacgcctcttgcttctccgcaaagtcagtcgagcagtactatggttggaacatcggtaaaaggagagcagccgaatggcagagggccatgacgatgcgtaaggttctccaggaaattctggaaaagaatccacgcttccaccacttaacacctctgaagacaaaacacattgcacactggtgcaggtgccacggctatacaccaccggatccagaatcactgcggaatgatggagatagtattgaggacgtgctgacacagatagacagcgagcccgaatgtccaagttcattttcgtccgctgacaacctttgtcgtaagctggaagacctgcagcagttccagaagagggagccagagaatgaagaggaggtggacattctctcgctttcggaacctgtgaagatcaacattaagaaggagcaggaagaaaagcaggaagaagtaaagttctacctacccccaaccccaggctctgagtttatcggcgatgttacacagaagatcggcatcacattgcagcccgtggctctgcacagaaatgtatacgcctctgtagtcgaggacatgattcttaaggcgacagaacagctggtaaacgatatattgcgacaggctctggcagtgggctatcagaccgccagtcacaacagaatcccgaaggaaattacagtgagcaacatccatcaggccatttgcaatatcccttttttggatttcctcaccaacaagcacatgggaatcctcaacgaggatcaatag

SEQ ID NO: 247044 - DNA, 684 bp, Artificial Sequence
  Description of Artificial Sequence: Synthetic coding sequence
atgttcaagcgcatggcggaattcggacctgactctggtggcagggtcaaaggggtaactattgtgaagccaatcgtttacggaaacgttgctcgctatttcggcaagaaaagggaggaggacggccacacacatcagtggaccgtgtacgtaaaaccgtatcggaacgaggacatgtctgcttatgtaaaaaagatccaattcaagttacacgaatcctacggcaacccccttcgtgttgtcactaagcctccgtacgagattacggagaccggatggggagaatttgaaattatcatcaagattttctttatagaccccaatgagagacctgtcaccctataccatctgttgaagttgtttcaaagtgatacgaacgcgatgctgggaaagaagaccgtggtctctgaattttacgacgagatgatctttcaggatccaaccgccatgatgcagcagcttctcactacatcccggcaactgacccttggagcctacaagcacgagaccgaattcgctgaactcgaggtgaaaacacgcgaaaagttagaggcagccaaaaaaaaaacttcatttgaaattgccgagcttaaagaaaggttaaaggccagtagagagacaattaactgcctcaaaaatgaaattcggaaactggaagaggacgatcaagccaaggatatctag

SEQ ID NO: 247045 - DNA, 1053 bp, Artificial Sequence
  Description of Artificial Sequence: Synthetic coding sequence
atggcgactactgcagccccagctggtggtgcccgaaacggtgctggcccagaatggggcggattcgaggagaacatccagggtgggggtagcgctgtcatcgacatggaaaacatggatgacacgtccggatcctcgtttgaggatatgggcgagctccatcagcgtcttcgggaagaggaagtagacgctgacgcagctgatgctgcagctgcagaagaagaagacggggagttcctgggtatgaagggattcaagggacaactgtctcgccaggtggccgatcagatgtggcaagctggaaagcgccaagccagcagagccttcagtctgtatgcaaatattgacattctgcgcccatacttcgacgtcgagcccgctcaagtaaggtcccgcctgcttgagtccatgataccaatcaagatggtgaacttcccacagaaaatcgcaggggagctttacgggcctctgatgcttgtgtttaccctcgtcgcgattcttctgcacggaatgaagacgagcgataccatcataagagagggaactttaatggggaccgccataggcacctgtttcggatattggctcggtgtaagctcttttatctactttctcgcctacctttgtaacgcccagatcaccatgctgcagatgctagcgctgctaggttacgggctctttggacactgcatcgtactgttcattacttacaacatacacctgcatgcattgttctatctgttctggcttctggttggtggactgagtacactgcgtatggttgcggtcttagtgagtcgtactgtaggccctactcagaggctgttgttgtgtggtactcttgcagcgctacatatgctcttcctgttgtatttgcacttcgcttatcataaagttgtggaaggaattctagacacgctggaggggccaaatatcccccctattcagcgagtgccccgagatatccccgctatgttgcccgcagccagattgccaacaaccgtactcaacgctaccgccaaggccgtggcggtaacactgcagtctcactag

SEQ ID NO: 247046 - DNA, 774 bp, Artificial Sequence
  Description of Artificial Sequence: Synthetic coding sequence
atgagtggatttgaaaatttgaacaccgacttttatcagacctcttacagcatagatgatcaatcccagcagagctatgattacgggggatctggcggaccgtactctaagcagtacgcaggatacgattactcacagcagggcaggtttgtgccccctgacatgatgcagcctcagcaaccatatacaggccagatctaccagccaacacaagcctatacccctgcaagtccccagccattctacggtaataacttcgaggacgagcccccattgcttgaagagctaggtattaacttcgatcatatttggcagaaaacgctgaccgtactgcaccccctgaaggttgcggatggcagtataatgaacgagacagatctggcaggacccatggttttttgcctggcattcggggctaccctcctgttggccggaaagattcagttcggttatgtctacggtattagtgcgatcggctgcctggggatgttttgcctgctcaatctcatgagcatgaccggtgtctcctttggatgcgtcgccagcgtcctgggctactgtctgctaccaatgatcttactgagttcctttgccgtcattttctctctgcaagggatggtgggcattatccttaccgctggcattattgggtggtgtagtttctcagcctcaaagatattcattagcgctctggcgatggaagggcaacagcttctcgtagcttatccgtgcgctcttttgtacggcgtcttcgccttaatcagcgtgttttag

SEQ ID NO: 247047 - DNA, 798 bp, Artificial Sequence
  Description of Artificial Sequence: Synthetic coding sequence
atgagcggctttgagaacctgaacaccgacttttatcagactagttactcgatcgatgatcagagtcagcagtcttacgattatggcggttccggcggaccttacagcaaacaatatgctggatacgactactcccagcagggcagatttgtcccccctgacatgatgcagccccagcagccatatacaggccagatctaccagccaacccaagcgtacacacccgcatcacctcaaccattctacggaaacaactttgaagacgagccacccctcctggaggagctgggcatcaacttcgaccacatttggcagaaaacattaactgttctgcatcccctcaaggttgccgacggatcaatcatgaacgagaccgatctcgccggtccaatggtgttctgtctggctttcggcgcaacattgctgctggcaggaaaaatacagttcgggtacgtgtacgggattagtgcaatcggctgccttggaatgttttgcctacttaaccttatgtctatgacaggagtgtcctttggttgtgtggcaagtgtgctgggttactgtctcctcccaatgatcttactctcttcttttgcagtgatcttcagtctacaaggcatggtgggcatcattttgaccgcgggaattataggttggtgtagttttagcgctagtaagatctttataagcgctctcgctatggagggccagcaactactggtggcattgcaaccaaatatcacttacgggagcaactatttcctgttttgctgtctcccctacccccagcagcatttctag

SEQ ID NO: 247048 - DNA, 774 bp, Artificial Sequence
  Description of Artificial Sequence: Synthetic coding sequence
atgtcagggtttgaaaaccttaacacggatttctatcaaacttcatacagcatcgacgaccagtcacagcagagctacgactacggtggatcaggcggtccctatagcaagcagtacgccggatacgattacagccagcagggcagattcgtgcccccagacatgatgcaaccacaacagccctatacgggtcagatttatcagcctacccaggcctacacccccgcatcaccacagcctttttacggcaataacttcgaagacgagccccctctgcttgaggaactgggaataaacttcgatcacatctggcagaagacactcacagtcctccatccccttaaagtggccgacggcagcatcatgaatgaaaccgacttggccggacctatggtattttgcctcgcatttggtgccaccctgctcctggctggcaagattcaattcggatatgtctacgggattagtgccatcggatgtctgggcatgttctgcttgttaaacctcatgtcgatgacaggggtgagcttcggttgcgtggcaagcgtgcttggctactgtctgctgcccatgattctgctatcgtcatttgcggtcattttttctctgcagggcatggttggcataattttgacagcaggaattatcgggtggtgctctttcagtgccagtaagattttcatctctgccctggctatggagggacaacagttactggtggcgtacccctgcgccctcctgtatggcgtttttgctttaatctcagttttttag

SEQ ID NO: 247049 - DNA, 612 bp, Artificial Sequence
  Description of Artificial Sequence: Synthetic coding sequence
atgatgcaaccccagcagccatacactggccagatctaccagccgacacaagcatacacccccgctagcccgcagcctttctacggaaataactttgaggatgagccacccttgctggaggagttaggaattaatttcgatcacatctggcagaaaacgttaaccgttctgcatccactgaaggtggccgacgggtcaatcatgaacgagaccgatctggcgggaccaatggttttttgcttggcttttggcgctacgctcctgctggccggaaagatccagtttggctacgtgtatggcatcagcgccatcggctgcctgggaatgttctgcctgttgaaccttatgtccatgaccggggtgtctttcggctgtgtggcttcagtactgggctattgtctgctacctatgatccttctgagtagctttgctgtaatatttagcctgcaggggatggtagggattatccttaccgcaggtattataggttggtgctcattctctgcttctaagattttcatcagtgcactggctatggaaggacagcaactccttgtggcttatccttgtgccctgctctacggggtcttcgctctcatctcagtcttctag

SEQ ID NO: 247050 - DNA, 534 bp, Artificial Sequence
  Description of Artificial Sequence: Synthetic coding sequence
atgatgcagccccaacaaccctacaccggccagatttatcagcccacacaagcctacacaccggcatcaccacagccgttttacgggaacaatttcgaagacgagcccccactgctcgaagaacttggtatcaatttcgatcatatttggcagaagacactcaccgttctgcaccccttaaaggtggcagacggctccattatgaatgaaaccgacctagctggccctatggtgttctgcctggcattcggcgcaacactgctactcgcgggaaagatccagttcggctacgtttacgggattagtgccattggctgcctaggcatgttttgtttgctgaacctgatgtcaatgaccggtgtgtcttttggctgcgttgcctccgtgctcggatattgcctactgcctatgatcctgcttagcagcttcgcagttatcttttcgctacagggaatggttggaattatccttacagctgggataattggctggtgctccttcagcgccagtaagatcttcatatcagccctctag

SEQ ID NO: 247051 - DNA, 306 bp, Artificial Sequence
  Description of Artificial Sequence: Synthetic coding sequence
atgatgcagcctcagcagccgtacacaggacagatttaccaacccacgcaggcgtatactcccgcatcgccccagcccttttacggcaacaacttcgaagatgaacctcccctgctggaggagcttgggattaacttcgatcatatttggcagaagactttaactgtgctgcatccgctgaaagtcgcagatggctcgatcatgaatgagacagaccttgcgggtcctatggtgttctgtttggctttcggggcaacgctcctgctagccggaaagattcagttcggctacgtctacggtatttag

SEQ ID NO: 247052 - DNA, 429 bp, Artificial Sequence
  Description of Artificial Sequence: Synthetic coding sequence
atgagcggctttgagaatctcaatacagatttttaccagacgagctattctattgacgatcagagccagcagagttacgactacggtggaagtgggggaccatatagtaaacagtatgctggatatgattatagtcagcaggggcgtttcgtgcccccagatatgatgcagccccagcagccatacaccgggcagatttaccaaccaacccaggcctataccccagcatccccccagccgttttacggtaataacttcgaagacgaaccacctctgctggaggagttgggcatcaacttcgatcacatttggcagaaaaccctgaccgtgctccatcccctgaaggtggcggatggctccataatgaacgagaccgacttggcacagtggttctttgccttgctgctcgaaccccactgctattggtag

SEQ ID NO: 247053 - DNA, 882 bp, Artificial Sequence
  Description of Artificial Sequence: Synthetic coding sequence
atggcgtaccatagcggatacggcgctcatggctctaagcaccgggctcgtgctgccccagacccccctcctttgtttgatgacacctccggtgggtattcctcacaacctggagggtaccccgcaacaggcgctgatgtggcgttctccgttaatcacctgctgggagaccccatggcaaatgtagctatggcctacggatcttccattgcatcccacggaaaagatatggtccataaagaactccatcggttcgtgtccgtttctaaacttaaatacttcttcgcagttgatacagcctatgtcgcgaagaagctgggactgcttgtttttccctacacacaccagaactgggaagtgcagtacagtcgagacgccccactgccaccgaggcaagatcttaacgccccagacctgtatattcctaccatggcatttattacctatgtgctactggcgggtatggcactgggcatacagaaaagattctctccagaagtcctggggctgtgcgcatctacagcgttagtctgggtggtgatggaggtgcttgctcttctcctcggcctttacctggcaacagtgagaagcgatctgagcacatttcacctcttggcctatagcgggtataagtacgttggcatgattctcagcgtacttaccggccttcttttcggaagcgatggttattacgtcgcacttgcgtggactagttcggctctgatgtatttcatcgtgagaagcctgagaaccgccgcactcggaccagattcaatggggggtcctgtacctaggcagcgcctgcagctctatctcacattgggggcagctgcttttcagccccttattatttactggctaacatttcatctggtcagatag

SEQ ID NO: 247054 - DNA, 360 bp, Artificial Sequence
  Description of Artificial Sequence: Synthetic coding sequence
atggtgaaaatgaccaagtccaaaaccttccaggcatacctgcccaactgtcaccgtacctacagctgcatccattgccgtgcccacctggctaaccatgatgagctcatttcaaaatcctttcagggatcacagggacgtgcctatctcttcaactctgtcgtgaacgttgggtgtggacctgccgaggaaagagtgctcctgacaggtctgcacgcagttgccgatatctactgtgaaaattgcaagaccacacttggatggaagtatgagcatgccttcgagagtagccagaaatacaaggaagggaagtttataattgaacttgcacacatgatcaaggacaacgggtgggagtag

SEQ ID NO: 247055 - DNA, 360 bp, Artificial Sequence
  Description of Artificial Sequence: Synthetic coding sequence
atggtaaagatgactcggtccaaaaccttccaggcatacctgccttcatgccatcgcacatattcatgcatccattgtcgagcccacctggctaaccacgatgaacttattagtaagtctttccagggtagtcaaggccgagcctatctcttcaactcagtggtcaacgtcggatgcgggcctgccgaagagcgtgtgttgttgactggtctacacgctgttgccgatatctactgcgaaaattgcaaaactaccctaggatggaaatatgaacatgcgttcgaaagttcacaaaagtacaaggaagggaaatatattatcgagctggcgcacatgatcaaggataacggctgggattag

SEQ ID NO: 247056 - DNA, 360 bp, Artificial Sequence
  Description of Artificial Sequence: Synthetic coding sequence
atggtgcgcatcagcaaacccaagacatttcaggcctacctcgacgactgtcaccgccgatattcctgcgcccactgccgcgctcatcttgctaatcacgacgatctcattagcaagtccttccagggttctcagggtcgagcatacctcttcaattctgtggtcaacgtgggctgtggccctgctgaggaacgagtgttactgactggactgcacgccgttgcagatatccactgtgagaactgcaagacaacccttggatggaaatatgaacaggccttcgagagctcccagaagtataaggagggtaaatacattatcgaactgaaccatatgatcaaggataatgggtgggactag

SEQ ID NO: 247057 - DNA, 474 bp, Artificial Sequence
  Description of Artificial Sequence: Synthetic coding sequence
atgtgcgtggcgcaggtcctcacggcccatttgttacctccacgtcaggccctggggtctctgtgctcgccgtgggccgcaccgcgagtgggacctctgccacccgctcctgccatggttagaataagcaaacctaaaacatttcaggcatacctggacgactgccatcgcaggtatagctgtgctcactgccgcgcacacctcgccaatcacgatgacctgatcagcaaatcattccagggaagccagggcagagcctacctcttcaacagtgtcgtgaacgtgggctgcgggccagccgaggagcgggtcctcctgactggactgcacgcggtcgccgacatccactgcgaaaattgcaagactactctgggttggaagtacgagcaggcatttgagtcctctcaaaagtataaagagggaaaatacatcattgaacttaatcacatgataaaggataatggatgggactag

SEQ ID NO: 247058 - DNA, 384 bp, Artificial Sequence
  Description of Artificial Sequence: Synthetic coding sequence
atgccctcctgcgacccaggcccaggccctgcatgcctgcctaccaagacatttcggagttatctgccaagatgccaccggacctactcttgcgtgcactgtcgagcgcatctggccaaacatgatgaattgattagcaaaagtttccaaggcagtcatggcagggcatatctgtttaactcagtggtgaatgtgggctgcggacccgctgaacagcgactccttttgacaggcttgcactccgtggctgacattttctgcgagtcttgtaaaaccacactgggttggaagtatgagcaggcttttgagacttcccagaaatataaagaggggaaatatatcatcgaaatgtctcatatggtgaaggacaatggctgggactag

SEQ ID NO: 247059 - DNA, 384 bp, Artificial Sequence
  Description of Artificial Sequence: Synthetic coding sequence
atgccaagctgcgaccccggacccggtccggcttgcttgcccaccaaaactttccgaagttacctgccgaggtgtcacagaacttacagctgcgtgcattgccgggctcacctggcaaaacacgacgaactcatctccaaaagtttccagggcagtcacggcagggcctatctcttcaattccgttgttaatgtggggtgcggtcctgctgagcaacgtctactgcttaccggactccacagcgttgccgatatcttctgtgaaagctgtaagacgactctcggctggaaatatgagcaggcctttgaaactagccagaagtacaaagagggaaaatacataatcgagatgtcccacatggtgaaagataatgggtgggactag

SEQ ID NO: 247060 - DNA, 384 bp, Artificial Sequence
  Description of Artificial Sequence: Synthetic coding sequence
atgccctcctgcgatccaggccctggcccagcttgtctcccaaccaagacattccgttcttacttaccgagatgccatcgaacctactcatgtgtgcattgtcgagctcacctagccaagcatgacgagctcatcagtaagtcctttcagggtagtcacggaagggcttatctgttcaactctgtggtgaacgtcgggtgtggaccggctgagcaacgactgcttctaaccggtcttcacagcgttgctgatatattctgtgaatcttgtaaaaccactctcggctggaagtatgaacaggcgttcgaaactagccagaaatacaaagagggaaaatacatcattgagatgtcacacatggttaaggacaacggatgggactag

SEQ ID NO: 247061 - DNA, 243 bp, Artificial Sequence
  Description of Artificial Sequence: Synthetic coding sequence
atgcctagctgtgacccgggtcccggacctgcctgcctgcctactaaaaccttcaggagctatctgccccgatgccatcggacatacagctgcgtgcattgccgcgctcacctagctaagcacgatgagttaatttcgaagtctttccagggttcacatggaagagcttacctctttaattcagtggtgaatgtgggctgcgggccagcagaacagcgattgctgctcaccggactgcattag

SEQ ID NO: 247062 - DNA, 384 bp, Artificial Sequence
  Description of Artificial Sequence: Synthetic coding sequence
atgccttcatgtgaccccggtcccggaccggcatgcctgccaaccaagacctttcgctcttatttgccacggtgtcaccgaacatattcatgcgtgcattgccgggctcacctcgccaaacatgacgagctgataagcaagtctttccaggggagtcacggcagggcctatcttttcaatagcgtagttaacgtagggtgcggacctgctgagcagagattgttgctcacaggtctccactccgttgctgacatattttgtgagagctgcaaaactactctcggctggaaatatgaacaggcctttgagacatctcagaagtacaaagagggaaagtatatcatcgagatgtcccacatggttaaagataacggatgggactag

SEQ ID NO: 247063 - DNA, 366 bp, Artificial Sequence
  Description of Artificial Sequence: Synthetic coding sequence
atgggccgtatcttcctggaccacatagggggtacacgtctcttttcgtgtgccaactgcgacactatcctgaccaatagatccgaacttatcagcacccgctttaccggggcaactgggagggccttcctgtttaacaaagtggttaacttgcagtatagtgaggttcaagacagggtgatgttgactggccgacatatggttcgggatgtgagttgtaaaaactgtaactcaaagctgggctggatctacgaattcgcaacagaggattcccagcggtacaaggagggcagagtgatcttagaaagagccctggtaagagagagtgaggggtttgaggaacacgttcctagcgataattcttag

SEQ ID NO: 247064 - DNA, 366 bp, Artificial Sequence
  Description of Artificial Sequence: Synthetic coding sequence
atgggccgtatttttttggatcatatcggaggaacccgtctattcagctgtgccaactgcgacacgattctgactaatcggtctgaattgatcagcactaggtttacgggcgctaccggacgcgcatttctgtttaataaagtggtaaacctccaatactccgaggttcaagaccgtgtcatgctcacgggcagacacatggtacgtgacgtgtcatgcaaaaactgcaattccaagctgggatggatatacgaatttgcaaccgaagattctcagagatacaaggaaggcagggtcatcctggaacgcgcattggtcagggagagtgagggctttgaagaacacgttcccagcgataatagctag

SEQ ID NO: 247065 - DNA, 366 bp, Artificial Sequence
  Description of Artificial Sequence: Synthetic coding sequence
atgggacggatttttctggatcatatcggcggtacccgactgttttcctgtgctaattgtgatacgatactgacgaaccggagcgagctaatatctactcgctttaccggcgctactggacgagcctttctgtttaataaagtcgtgaatcttcagtacagtgaggttcaggatagagtgatgctcaccgggaggcacatggtgcgcgacgtctcctgcaaaaactgtaactctaagctcgggtggatctatgagttcgccaccgaggacagccagcgttataaggagggacgtgttatcttagaaagggccttagtacgggaaagcgaggggtttgaggaacatgttcccagcgacaatagttag

SEQ ID NO: 247066 - DNA, 366 bp, Artificial Sequence
  Description of Artificial Sequence: Synthetic coding sequence
atgggaaggatcttcctggatcatattggcggaactcggctgttcagctgtgcaaattgcgataccatattgactaatcgcagcgagctaatatccacccgtttcaccggggcaaccggcagggctttcctcttcaataaagtcgtgaacctccagtatagcgaagtgcaggacagggttatgcttacaggacgccacatggtgagggacgtaagctgtaaaaactgcaactcaaagttgggttggatctatgagtttgcaacagaggactcacagcgctacaaggagggtcgcgtcatcctggagcgagccctggtccgtgagtccgagggatttgaagaacacgtgcccagcgacaattcttag

SEQ ID NO: 247067 - DNA, 366 bp, Artificial Sequence
  Description of Artificial Sequence: Synthetic coding sequence
atgggcagaatattccttgatcatatcgggggtacacgcctgttctcctgcgccaattgtgacacgattctgactaacagatcagaactgatctccacacgcttcactggcgctactggtcgggcattcctattcaacaaggttgtgaatttgcagtactctgaagtgcaggacagggtgatgctaacaggcaggcatatggtgcgggacgtgagttgtaagaattgcaacagtaagctcgggtggatttacgagtttgcaactgaggactctcagaggtacaaagagggacgggtgatcctagagagagctctggtgagagagtcagaagggttcgaggagcacgtgcccagtgacaatagctag

SEQ ID NO: 247068 - DNA, 2322 bp, Artificial Sequence
  Description of Artificial Sequence: Synthetic coding sequence
atgttctcgctgtccagtaccgtgcagccccaggtgaccgtgcccttgtctcacttgattaacgccttccacacgcctaaaaacacctctgtctcactctcaggtgtcagcgtttctcagaaccaacacagggatgttgttccagagcacgaggcaccttcaagcgagtgcatgttctcggacttcctcacaaaactcaacatcgtatcaattggcaaagggaagatcttcgagggatacaggagcatgtttatggagcctgctaagcgtatgaaaaagtcactggataccactgataattggcacatcaggcctgaaccttttagcttaagcatcccaccaagcctcaatctgcgagatctgggactgtctgagttgaaaataggacagatcgaccagctggtggaaaatttactcccaggattttgtaaggggaagaatatcagttctcactggcacaccagccacgtgagcgcccagtcctttttcgaaaacaaatacggtaacctagacattttctctacactgagaagttcctgtctctatcggcatcattctagggcgctacagtcgatttgctccgacctgcaatactggcccgtttttatacaaagcaggggattcaagacgttgaaatctcggaccaggcgcctccagagcacatccgaaagactggccgaaacacagaatatcgcaccctcattcgttaaaggttttcttttacgtgatcggggatccgacgtagagtccctggataagcttatgaaaacgaaaaatatacctgaagcacatcaggacgctttcaaaacaggcttcgctgagggattccttaaagcccaggccttgacacagaagactaatgactcactgaggcgcacgaggctgatattgttcgttctcctgctcttcgggatttacggattgctaaagaacccctttttgtcggtgcggttcaggaccacaacgggtttggattctgcagttgacccggtacagatgaaaaatgtgacatttgaacacgtgaagggcgtcgaggaagccaaacaggaactgcaagaagtcgtcgagttccttaagaatccccagaagttcacaatcctgggcggaaagttgcctaaaggcattctgcttgtgggcccaccaggtactgggaaaactctactagcgcgagccgtagctggggaagcagatgtgccattctactatgcttcgggcagtgagttcgatgagatgttcgtgggcgtgggggctagcagaatcaggaacttgtttagagaagccaaagccaacgcgccttgtgtgatcttcatcgacgagctggattcggtgggaggaaaacgcatagaatctccgatgcacccctacagccggcagactattaatcagctcctggcagagatggatggattcaagccaaacgagggcgttattatcattggggctacgaattttcccgaagccctcgacaacgccctgatcagaccaggtaggtttgacatgcaagttactgttcccaggcccgacgttaagggccgaaccgagatcttaaagtggtatctaaataaaatcaagttcgaccaatccgtggatcccgagattatcgccagaggaactgtagggttttccggcgcagagctggagaacttggtgaaccaagctgctctcaaggccgctgtcgacggaaaagagatggtcactatgaaggagctggagttctcaaaagacaagatcttgatgggaccagagcgccgtagcgtcgaaattgacaataaaaacaagaccattacagcctaccacgagtccggtcacgccattatcgcctattatacaaaggatgccatgcctattaacaaagccaccattatgcctagaggccctaccctcggtcatgtgtctctcctcccagagaacgaccgttggaatgagactcgggctcagctgttagcccaaatggatgtgtcaatgggaggcagagtcgcagaggagctaatcttcggcacggaccatattactaccggggcttcttccgactttgacaacgctacaaaaatcgccaaacgaatggtaaccaaatttgggatgtcagaaaaacttggggtgatgacctattctgacactggcaagctctctccagagactcagagcgccatcgagcaggagatccgtatcctgttaagggacagttacgagcgcgctaaacatatcttgaagacacacgccaaagagcacaagaatcttgctgaagccctcttaacatacgagactctagatgctaaggaaattcagatcgtgctggagggcaaaaaactggaagttaggtag

SEQ ID NO: 247069 - DNA, 2223 bp, Artificial Sequence
  Description of Artificial Sequence: Synthetic coding sequence
atgttttctctttcatccacagtgcagccgcaagtgacagtgcccctgagccatctgattaacgcgttccacacccccaaaaacacaagtgtcagcttaagtggggtgagcgtatcacagaaccaacaccgtgatgtggtcccggaacatgaagcaccctcatctgaatgcatgttttcagatttcctgaccaaacttaacatcgtatccatcggcaaggggaaaattttcgagggatataggtccatgtttatggaacctgcgaagagaatgaaaaaaagcctcgacacaactgataactggcatataaggccagagccttttagcttgagtattcctcccagccttaacctgagggatttggggctgagtgaattgaaaatagggcagatcgaccaactggttgagaacctgctccctggtttctgtaaagggaagaacatttcgtcgcattggcatactagtcacgtgtcagcacagagcttttttgaaaataaatatggcaacctggatatcttctccaccctgcgcagttcgtgcctgtataggcaccactcaagagccctgcagagtatttgttctgacctacaatactggcctgtgttcattcagtctcggggtttcaagactttaaagtccaggacgcgacgcctgcaatctacgagcgagcggctcgcagaaacccagaacatcgccccaagtttcgttaagggctttctgctgcgagatagggggagcgacgtcgaaagcctagacaaactgatgaaaactaaaaatattcctgaggctcaccaggatgcttttaagacaggtttcgccgagggcttcctgaaagctcaggcactcacgcagaagaccaacgacagtcttagaaggacaaggttgattctctttgtcctcttgctcttcggcatttatgggctactgaaaaaccctttcttgagcgttcgcttccgtactacaactggactcgactctgcagtcgacccagtgcaaatgaaaaacgttacctttgaacatgtcaagggagtggaggaagcaaaacaggaattacaggaagttgtcgagttccttaagaatccccagaaattcacaattttggggggaaagcttcccaagggcatacttctggtcggcccaccaggtaccggcaagaccctgctagctcgtgctgtcgccggtgaagccgatgtcccattttattacgcctcggggtcggagttcgacgaaatgtttgtgggggtcggagctagtcgtattaggaatttgttcagggaagcgaaagctaacgcgccttgcgttatctttatcgatgagctggatagtgttgggggaaagcggatcgaatctccgatgcatccttacagccgtcaaactatcaatcaactattagctgagatggacggattcaaacctaacgagggcgtgataattatcggggctacaaacttcccagaagctcttgacaatgctctgatccgacctggcagatttgatatgcaggtgaccgtccctcgccctgatgtgaagggaagaacagagattctgaagtggtacttaaataagatcaaatttgaccagtctgtagaccctgaaatcatcgcacgtggtactgtgggcttttcaggtgccgaactggaaaaccttgttaaccaagctgccctgaaggccgctgttgacggaaaagagatggttacgatgaaagagctggaattctctaaggacaagatcctcatgggacccgaaagaagaagtgtcgagatagataataagaataaaaccatcactgcgtaccacgagtccgggcatgctataattgcctactatacgaaggatgccatgccaatcaacaaagccacaattatgccaagagggcctacactcggccacgtatcgctccttcctgagaatgaccgctggaatgagacccgagctcagctgttagcacagatggatgtaagcatgggcggtcgggtggcggaggagcttatatttggtacagatcacatcactactggcgcatcttcagactttgacaacgctactaagatcgctaagcggatggtgacaaaatttggcatgagcgagaagcttggagtcatgacatactctgacactggaaaattaagccctgaaacacagagtgctatcgagcaagaaatccgaatacttctccgggacagctatgagagggcaaagcacatcttgaaaacccattcctag

SEQ ID NO: 247070 - DNA, 2052 bp, Artificial Sequence
  Description of Artificial Sequence: Synthetic coding sequence
atgttttcactgtcaagcaccgtgcaacctcaggtaaccgtacctctatcacacctgatcaacgcttttcacacccctaagaacactagtgtttccctgtcgggggtttctgtgtcccagaaccagcatagggatgtagtcccggaacatgaagccccatcctctgagccctcccttaatctgcgcgatctggggctgtcagagttgaagatcggccagatcgaccagctcgtggagaatctgctgccgggtttctgcaaggggaagaacatctcatcacactggcacaccagccacgtgagcgcccagagcttttttgaaaataaatacgtgtttatacagtcccgtggatttaagacactcaagtcccggacacgcaggcttcaatccactagcgagaggctcgctgaaacccaaaatatcgctcctagctttgttaagggtttcctgctccgggatagaggaagcgacgtggagtcacttgataaactcatgaagacaaaaaatataccagaggcccatcaggatgccttcaaaacaggatttgctgagggattcctgaaggctcaagccctcactcagaagacaaatgacagtctgcgcagaaccagactgatcctgtttgtgctgctgctcttcggcatttacggtctgttgaagaacccctttttgtctgtccgtttccgaaccacaacaggcctggactcagctgtggatccagtacagatgaaaaacgtgactttcgaacatgtgaagggggtggaggaggcaaagcaggagctgcaggaggtggtggagtttctcaaaaacccacaaaagttcactatactggggggaaagttgcctaaaggcatcctgcttgtaggcccacctgggaccgggaagacccttcttgccagggctgtggcaggtgaagccgatgtgccattctactatgcttctggctccgagtttgatgagatgttcgtcggcgtgggcgcatcacggatacgcaatttgtttcgagaagccaaggcaaacgcaccttgcgtgattttcatagacgagctcgattccgtggggggaaaacggattgagagccccatgcacccctactcaagacaaacaatcaatcagctgctcgctgagatggacggattcaagccaaacgagggagtgataattatcggcgctacgaattttccagaagccctggataacgccctcattagacccggtagattcgacatgcaggttacagtgcctaggccggacgttaagggtcggactgagatactcaagtggtacctcaacaagatcaaattcgatcaatccgtcgaccctgagatcatagccaggggaactgtcggcttctcaggcgctgagctggaaaacctggtgaaccaagccgctctgaaggcagcggtggatgggaaggaaatggtgactatgaaggaactggaattctctaaggacaagatcctgatgggaccagaacgtcgctccgtggaaatagacaataaaaacaagactataacagcctaccacgagagtgggcacgccataattgcttattacaccaaggatgcaatgccaatcaataaggcaaccattatgccgagaggccctacattggggcacgtctcattactgccggagaatgatcggtggaatgaaacccgcgctcagcttctggcacagatggacgttagtatgggaggccgagtcgctgaagagctcatctttgggacagaccatatcacaacaggagcatcgtcagatttcgataatgctaccaagatcgccaagcggatggttactaagttcggaatgtccgaaaagctgggggtgatgacatactcagataccgggaaactctcaccagaaacccagtctgccatcgaacaggaaatccgaatccttctgcgcgactcctacgaacgtgccaagcatattctcaagacccacgccaaggaacacaagaacctcgccgaggcattgttaacatatgagacgctcgacgcaaaggagatacaaattgtgttggaggggaaaaagctcgaggtacgttag

SEQ ID NO: 247071 - DNA, 2151 bp, Artificial Sequence
  Description of Artificial Sequence: Synthetic coding sequence
atgttctcgctgagcagtactgtacaaccgcaggtgacagtgcccttaagtcacttgatcaacgcgttccatacccccaaaaacacgagtgtgagtttgtctggcgtgtcagtaagtcaaaaccagcaccgtgatgtggtgccagaacacgaagccccaagttctgagcctagtctcaatttgcgcgatttagggctgagcgaacttaaaattggacagattgaccagttggtcgaaaaccttctccccggattctgcaaggggaagaatatctccagccattggcacacatcacacgtatctgcgcagagctttttcgaaaacaagtacggtaacctcgacattttctctactctgaggtcctcctgcctttatcggcatcatagtagggcgttacagagtatctgcagtgacctccagtactggccagttttcattcagagtagaggatttaaaactctgaagtcgagaacacggaggctgcagtccacctcagaacgtcttgcagaaacgcagaacattgctccgtcattcgtcaagggcttcctgctccgggatcgaggcagtgatgtagaatcccttgataagctcatgaaaactaagaacattcctgaggcacaccaggatgctttcaaaacaggttttgcggagggctttctaaaggctcaagctctgacccagaagactaatgacagcctccgacggacccgactgatcctcttcgtcctgctgcttttcggaatttacggtctgcttaagaaccctttcttaagtgtcagatttagaaccacaactggcctggacagcgcagtggaccccgtgcagatgaaaaacgtcacctttgaacacgtcaaaggggtagaggaggctaaacaggagctgcaggaggtggtggagttcctgaaaaatccacaaaaatttacaatcctgggaggcaagctgcctaaaggaattctattggtgggtcccccaggtactggcaagaccctgttagccagggccgtagcaggagaagccgatgtcccattctactacgcatccggctcggaatttgatgaaatgtttgtcggtgtgggagcgtcgagaatacgtaacctcttccgggaagccaaagctaacgctccctgcgttatcttcatcgacgaactggactcagtcggtggtaagaggattgagtctcctatgcatccgtatagcagacagaccatcaaccagctgcttgctgaaatggacgggtttaagccaaatgagggcgtcatcattattggagccactaactttccagaggcgctggacaacgcactcatacgccctggccgattcgacatgcaggttactgtgccaaggccagatgtgaagggacgcacagaaatcttaaaatggtacctcaacaaaattaaatttgaccaatctgtggacccagagatcatagccaggggcaccgtgggctttagcggtgccgaactggaaaacctagtgaaccaggcagccctaaaagctgctgtcgacgggaaggagatggtgaccatgaaagagctcgagttctcgaaggacaaaatcctaatgggccctgaaaggcggagtgtggaaatcgacaataagaacaaaaccataacagcgtatcatgaatctggtcatgcaattattgcatactataccaaagacgccatgcctatcaacaaggcaacaattatgcccagggggcctaccctggggcatgtatctcttctgcctgaaaatgatagatggaacgaaactagagctcaactgttagctcaaatggatgtgagcatgggtggcagagttgcagaggagcttatcttcgggaccgaccatataaccacaggcgcatcttcagactttgacaatgccaccaaaattgccaaaagaatggtgactaaattcggcatgtcagagaagctgggggttatgacctactccgacacaggtaagctgtcccccgagacacagtctgccattgaacaagaaatcagaatcctgcttcgggacagctacgagagggccaaacacatattgaagacccacgctaaggagcacaagaatctcgctgaggcactgctaacatatgaaactctcgacgcaaaagaaattcagattgtgctcgaaggaaagaaacttgaggtaaggtag

SEQ ID NO: 247072 - DNA, 747 bp, Artificial Sequence
  Description of Artificial Sequence: Synthetic coding sequence
atgtaccaggtcacagtacccctgagccacctgattaatgcttttcacactcccaagaatacttcagttagtttatctggagtttccgtctcccagaatcagcatcgcgatgtcgtgcccgagcacgaggccccaagtagcgagccaagcctgaatctgagagacctggggttatccgagctaaagatcgggcaaatagatcaactagttgaaaacctgctgccaggcttctgcaagggtaagaacatttcttcccactggcacactagccatgtcagtgcccagagcttctttgagaataaatacggaaatttggatatcttttcgactcttcgcagtagttgtctgtacagacaccactcccgagctttgcagtccatttgctctgatctgcagtattggccagtgttcatccagagtaggggctttaagacgctaaaatcgcgcacccgcaggttacagtccactagtgagaggctggccgagacacagaatatcgctccttcatttgtcaagggcttcctcctgagggatagggggtccgatgtcgagtcactggacaaattaatgaagacgaaaaatatccccgaagcccatcaggatgcattcaagacagggttcgccgagggcttccttaaggcccaggcattgacacagaaaaccaatgattcactgagaaggacacggctaatcctgttcgtactgctcctgtttggaatatacgggctgctaaaaaatcctttttag

SEQ ID NO: 247073 - DNA, 762 bp, Artificial Sequence
  Description of Artificial Sequence: Synthetic coding sequence
atgtttagcctttcgagcaccgtccagcctcaggtgaccgtgcccctgtcacacttaatcaacgccttccataccccgaaaaatacgtctgtgtcactttccggagtaagtgtatcacaaaatcaacatagagatgtagtgcccgaacacgaagcgccttcttctgaaccatcgttgaacctgagagatttgggactgtccgaattgaaaattgggcaaattgaccagctcgtcgaaaatctgctgccgggtttttgtaagggcaaaaatatttcctctcattggcatacatcacatgttagtgcccagtcgtttttcgaaaataaatacgtgttcattcagtctcggggattcaagacactaaaaagtcggactcggagacttcagtccacaagtgaacggctcgccgagacgcagaacatcgctccgtcatttgtgaaaggcttcctgcttagagatcggggatcagatgtagaaagcctggataaactgatgaaaacgaaaaacatccccgaagcgcaccaggacgcctttaaaactggattcgcagagggattcctgaaggcccaggccctgacacagaaaaccaacgacagcctccgtagaactagactgattctgttcgtgctgctcctgttcggcatctatggcctgctgaaaaatccatttctatctgtgagattcagaacgactaccgggttggattcggccgtagacccggtacaaatgaagaacgttacttttgagcacgtgaaggggtag

SEQ ID NO: 247074 - DNA, 1551 bp, Artificial Sequence
  Description of Artificial Sequence: Synthetic coding sequence
atgaagaccaaaaatattccggaagcccaccaagatgcttttaagaccggcttcgctgagggattcttgaaggcccaggcgctcacacagaagaccaacgattcattgcgtcgtacaaggctgatcctctttgtcctgttgctattcgggatctatgggttgctgaagaacccgttcctctctgtccgcttcaggacaaccacggggcttgacagcgctgtggacccggtgcagatgaaaaacgttacattcgagcatgtgaaaggcgttgaggaagcaaaacaagaactgcaagaggtcgtcgaattcttgaagaatcctcagaaatttactattctgggtgggaagcttcctaaaggtattttgctggtggggcctcccggaactggcaagactctccttgccagagccgtggcaggagaggcagacgtgcctttttactatgcctccggctccgagttcgacgaaatgtttgttggtgtgggagctagccgcatccggaatctgtttcgggaagccaaggctaacgcaccctgtgtcatcttcatcgatgagctagacagcgtcggcggtaagaggatagaatctcccatgcatccgtactctcgccagaccatcaaccagcttctggctgaaatggacggatttaaaccaaatgagggcgttatcatcatcggagcaactaattttcccgaggctttagataatgcacttattcggccagggcgatttgatatgcaggtgacagtgcccaggcctgatgtgaaggggagaaccgagattcttaaatggtacctgaacaaaattaaatttgatcagagtgtagatcccgagatcatcgcgaggggaactgtggggttcagcggtgccgaactcgagaatctcgtaaatcaggccgctcttaaagctgccgtagatgggaaagagatggttaccatgaaggagttggagttctctaaggacaagatactcatgggaccggagaggaggtccgtcgagatcgacaataaaaacaagaccatcacagcatatcacgagtccgggcatgcgatcattgcttactatacaaaagatgctatgcccatcaacaaggccaccattatgcctagaggtccaactctgggccacgtttcactgctccccgagaatgaccgctggaacgaaactcgggctcaactgctcgcccagatggacgtgagcatgggcggaagggtagctgaggaactgatatttggaacggaccacattaccactggagctagctccgacttcgataatgccaccaagatcgctaagaggatggttaccaaattcggcatgagtgagaaattgggggtgatgacctactctgacacaggaaaactaagcccagagacacaatctgcaattgagcaagagatacgcatcctgctgcgcgattcctacgagcgcgcaaaacacattttgaagacgcatgccaaggagcataaaaatctggcggaggcactgctgacatacgagacgatgcccaagagatttaagctgtttttgcgtggcaagtcttggaagtag

SEQ ID NO: 247075 - DNA, 1047 bp, Artificial Sequence
  Description of Artificial Sequence: Synthetic coding sequence
atgttcggccctgctaaaggtcggcatttcggcgtgcatccagccccagggtttccaggaggggtgtcacaacaggccgctggtactaaggccggacccgcaggcgcttggcccgtaggcagcaggacagacaccatgtggcgcctcagatgtaaggccaaggatgggactcatgtgttgcagggtctcagctcacgtacaagggtaagagaactccaaggtcagattgcagccatcactggcatcgcccctggaggacagcgaattctcgtgggctaccccccagaatgtctggatctgagtaacggtgacacaatcctcgaggacctgcccatacagtcaggcgacatgctgattattgaggaggatcagacccggccaaggtcatccccagctttcacaaaaaggggagcatcctcatacgtacgcgagaccctcccagtactcacaagaacagtggtgccagcggacaactcctgtctgtttacttccgtgtattacgtggtcgagggaggcgttctgaatccagcgtgtgcacccgagatgcgccgtctgattgcacagatcgtagccagtgaccccgacttctactctgaagccatcctgggaaagaccaaccaggagtattgcgactggatcaagcgcgacgatacatggggcggagccatcgaaatctctatactgtctaagttctaccagtgcgagatctgtgtggtggatacccagaccgtacggatcgatcggtttggggaggacgctggctataccaagcgagtgctgctgatttatgacggaatccactatgaccccctgcagaggaattttccagatcctgacactccccctctgacgattttctctagtaacgacgatatcgtattggtccaagctctggagctcgctgatgaagcccgaagacggaggcagtttaccgacgtaaacagattcaccctcaggtgtatggtatgtcagaaaggtctgacggggcaggccgaagcaagggagcatgctaaggagacaggccacaccaatttcggagaggtctag

SEQ ID NO: 247076 - DNA, 915 bp, Artificial Sequence
  Description of Artificial Sequence: Synthetic coding sequence
atggagacgcttcatataatctactctgaagccaaaagttttaccgtcgagggcctgtcctcccgtacgagggtcagggaattacagggacagatcgccgctatcacagggatcgctccagggggacagagaattctggtgggctatcctccggagtgcctggacctcagtaacggcgacaccattctggaggacctaccaatacagtctggtgacatgttgattatcgaggaggatcaaacaaggcccaggtcaagtcctgcctttaccaagagaggcgcttcaagttacgtgagggagacattgcctgtgctgactcggaccgttgtcccagccgataatagctgtctcttcaccagcgtttattacgtggtggagggcggagtgctaaaccccgcttgcgccccagagatgcggcgtctcatagcccagatagtggcgtccgacccagacttttactcagaagccatattaggcaagacgaaccaagaatactgcgactggattaagcgcgatgatacatggggaggagccattgagatctcaatactgagtaaattctaccagtgtgaaatatgcgttgtggacactcaaaccgtccgaatagaccggtttggtgaggacgcaggttacactaagagggtattactcatatacgacggaattcattatgatcctctgcaacgcaactttcctgatcccgatactcccccactgaccattttttctagcaatgatgatattgtcttggtgcaggctctggaactggccgacgaggccagaaggaggaggcagttcactgatgtgaatagattcaccttgcgctgcatggtctgccagaaagggctcactggacaggcagaggccagggagcacgccaaagaaacagggcacacgaattttggagaggtctag

SEQ ID NO: 247077 - DNA, 915 bp, Artificial Sequence
  Description of Artificial Sequence: Synthetic coding sequence
atggaaacactgcacattatttatagcgaagctaagagtttcaccgtggaagggctctccagtaggacccgtgtgcgagaactgcaggggcaaattgcagctatcacagggatcgctccgggtgggcagagaatactggttggctatccgcctgagtgtctcgacctgtccaacggcgacacaatactagaagatttgccgattcagtctggcgatatgctcatcatagaagaggatcagactaggcccagaagctctcctgctttcacgaaacgtggtgcatccagctatgtgagagaaacactacccgtcctgactcggacagtggtccccgctgacaatagttgcctgtttacgagcgtctactatgtagtggaggggggagtcttgaatccagcttgtgctccagagatgcgcagactaatcgcgcagatagtcgccagcgatccagacttctattcagaagctatcttgggaaaaactaaccaggagtactgtgactggatcaagcgagacgatacgtggggcggtgccatcgaaatttcaatcctgagcaagttttatcagtgtgagatttgcgtcgttgacacacaaactgttcgaatcgaccgattcggagaagatgctgggtacaccaagcgagtactgctgatctatgacggcatccactacgatccactgcaaagaaatttcccagatccagacaccccacccctgacaatcttttctagtaacgacgatattgtgttggtgcaggcccttgaactggcagacgaagcacggagacgacgccagtttacggatgttaataggttcacgctgcgatgtatggtgtgccaaaaaggactcaccggccaagccgaggctcgagagcatgccaaggaaacaggacataccaattttggagaagtgtag

SEQ ID NO: 247078 - DNA, 840 bp, Artificial Sequence
  Description of Artificial Sequence: Synthetic coding sequence
atgagtcccgcacgccgatgtagaggtatgagagccgcagtcgcagcctctgtgggtctgtcagagggcccagcagggagcagatcagggcgtttgttccgcccaccgtctcctgcacccgctgccccaggcgcaaggctgttgcgtctgcccggatccggggcagttcaggccgcatcccctgaacgcgctggttggacagaagcgttacgcgcagcagttgcagaactgagagcaggcgcagtggtcgctgtgcccacagacaccctctacgggcttgcctgtgcagcctcttgctctgccgcacttagagccgtgtacaggctgaaggggaggtcggaggccaaacctctggccgtttgccttggccgtgtggccgacgtctatcgttattgcagagtaagagttccagaggggttactgaaagatctccttcccggacccgtgaccctggtcatggagaggagcgaagaattgaataaggatctgaacccctttacgccccttgtcgggatccggattccagaccatgcgttcatgcaggacctggcccagatgtttgaggggcctttagcattgacatctgcaaatttatcaagtcaagcctcctccttgaatgttgaggagtttcaggacctttggccacagttaagccttgttattgatggcggtcagattggtgatggacagagtcccgagtgtcgattggggagcaccgttgtggacctgagcgtcccaggcaagttcgggattattagaccaggatgcgctttggagagtacgaccgcgatcttacagcagaagtatggcctgctccctagccacgccagctacctgtag

SEQ ID NO: 247079 - DNA, 1740 bp, Artificial Sequence
  Description of Artificial Sequence: Synthetic coding sequence
atgtctgcctctagtttgttagaacagagacctaaaggccaaggcaataaagttcagaacggctccgttcaccaaaaggacggtttgaacgatgatgatttcgagccttacctgtctccacaggcccgacccaataacgcctacaccgctatgtccgactcctatcttccttcttactatagccccagcatcggctttagctactctttaggcgaagccgcatggtccactggcggagatacagcaatgccctatctgacctcctacggacagctgtctaacggtgagccccatttcctgccagacgccatgttcggccagccaggcgctctgggaagcacaccgtttctcggccagcacggctttaacttttttccgtcagggatagactttagcgcctggggaaataattcttcgcagggacagtctacccagagctcaggctactcatcaaactatgcctacgccccaagcagccttggtggggcaatgattgacggccagtctgcttttgccaacgaaaccctgaacaaagcacccggtatgaataccattgaccaagggatggctgccttaaaactaggttccaccgaggttgcatccaacgtgcccaaagtggtgggaagcgcagtggggagcggtagtatcactagcaatatcgtggcctccaacagtctcccccctgccactattgctccaccaaagccagcgagctgggccgacattgcctctaaacccgctaagcagcagccaaaactcaagacgaagaacggaatagccggatcctcactgccccctcccccaatcaaacacaacatggacataggaacttgggacaacaaaggccctgttgcaaaggcccctagccaggctctggtacagaacattggccagccaacccagggctctccgcagcccgttggtcagcaggcaaacaactctcccccagttgcccaggcctccgtgggacaacagacccagccgctgccccctccccctccccagcccgcacaactgtccgtgcagcagcaggcagctcagcctacccgctgggtagcccctcgaaacagggggtccggctttggtcacaacggggtcgacggcaacggcgtgggtcagtcccaggcaggctctggcagcactccctcggagcctcacccagtgcttgagaaactgcggtccattaacaattacaatcctaaggatttcgactggaatctcaagcacggcagagtatttatcattaagtcatatagtgaggatgacatacaccggtcaataaagtacaacatctggtgttcaaccgagcatggcaacaagcgacttgatgccgcataccggtccatgaatggcaagggcccagtctacttgctgttctctgtcaacggatcaggacacttctgcggcgttgccgaaatgaagtccgctgttgattataacacatgcgcaggagtgtggtcccaggacaagtggaaaggacgattcgacgtccggtggattttcgtcaaggatgtgcccaactcacaattgcggcacatccggctggagaacaatgaaaacaagcccgtcactaactcaagggatacacaagaagtacccctagaaaaggcaaaacaagtgctcaagatcattgcttcttataagcatactacatccatcttcgacgatttctcacattatgaaaaacgacaggaggaagaggagagtgttaaaaaagaaaggcaaggtcgcggaaagtag

SEQ ID NO: 247080 - DNA, 1710 bp, Artificial Sequence
  Description of Artificial Sequence: Synthetic coding sequence
atgtcggcctcctcacttctcgagcagaggccaaaaggtcagggcaacaaggtgcagaatggctcagtccaccagaaggacggcttgaacgatgatgactttgaaccgtacctgtcaccacaggctagaccaaacaacgcttataccgctatgagtgactcttacctgccatcttattattcaccttcaatcggtttctcctattcccttggggaggccgcttggagcaccggcggagacacagccatgccttatctaacgagctacggtcagctgagcaacggtgaaccccactttctgcccgatgccatgtttggccaacctggggctttgggcagcacgccctttctaggacaacacgggtttaatttctttccttcaggaattgatttttccgcctggggaaacaactcttcgcagggccagtccacgcagagctctggctatagctctaattacgcatacgcacctagcagcctcgggggtgccatgatcgacggtcagtccgccttcgctaacgaaacgctgaataaggcacccggtatgaacactatcgatcagggcatggcagccctgaagctcgggtcgacggaggtggcgtcaaacgttcctaaggttgtcggctcggccgtcggaagcggcagtatcacttcaaacatcgtcgctagcaattccctgccaccagccaccatagcaccaccgaagcccgcatcttgggccgacatagcgagtaaacctgcgaagcagcagcccaagcttaagactaagaatgggattgcaggcagcagcctccctcccccacctataaaacataacatggatatcggcacctgggacaacaagggccctgtggccaaggctcctagccaagctctggtacagaatataggacagccaactcagggaagtcctcagcctgtgggccagcaagcgaacaatagccctcccgttgcgcaggcgtctgtcggccagcaaactcagccacttcccccacccccaccacagcccgcacagctgtccgtacagcagcaggctgctcagccaactcgctgggtggcccctaggaaccgtgggtctggattcggacacaatggcgtagacggaaacggtgtcggtcagtctcaggctggctctggcagtactccttccgagcctcacccagtattagagaaactccggtcaataaacaattataaccccaaagattttgactggaacttgaaacacggtcgagtctttatcattaaaagctattcagaagatgatattcacagaagtatcaagtataatatatggtgcagtactgagcacgggaataagcgcttggacgcagcttaccgctcaatgaacggtaaaggacctgtgtacctgttgtttagtgtcaatgggagcgggcacttttgcggcgtggccgagatgaaatccgctgtggattataatacgtgcgctggagtgtggtcccaggataagtggaaaggccgatttgacgtgaggtggattttcgtaaaagacgtgcctaacagccagctgaggcatatcagactggagaacaacgaaaacaaacctgtaaccaattcccgtgatactcaagaagtaccattggagaaggccaaacaggttctgaaaataatcgcctcatacaagcacactacaagcatcttcgacgacttctcccactatgaaaagcggcaggggagacgcaagtgttag

SEQ ID NO: 247081 - DNA, 1590 bp, Artificial Sequence
  Description of Artificial Sequence: Synthetic coding sequence
atgtctgatagctatctgccgtcgtactattctccgagcattgggttcagttattcccttggcgaagccgcttggtcgaccgggggtgatactgccatgccctatttgacttcttatgggcaattatctaacggggaacctcatttccttcctgacgctatgttcggacagcctggcgctctaggcagtacaccttttctcggccagcatggttttaacttcttcccctccggcatcgatttcagcgcttggggtaataactcttcacagggccagtccacccagtcaagcggatattccagcaactatgcgtacgctccttcttcccttggcggagccatgattgacgggcagagtgccttcgctaatgagacacttaataaggcaccgggtatgaacaccattgaccaaggcatggccgcacttaaactcggtagcaccgaagtcgcatcaaatgtgccaaaagtggtggggtctgcagtcggcagcggttccattacatcgaatatcgtggcctctaattcattaccacccgcaaccatagcccctccaaagcccgctagctgggccgacattgcctctaaaccagcgaagcagcaacccaaactgaaaacaaaaaacggcattgcgggtagttctttgcctccacctccaatcaaacacaatatggacattggcacctgggacaacaaggggcctgtagcaaaagccccaagtcaagcattggtacagaatatcggacagcccacacagggtagcccacagcctgtggggcaacaggctaataatagccccccagtggcacaggcttcagtggggcagcagacacaacctctcccaccacccccacctcagcctgcacagctttctgtccagcagcaggcggctcaaccaacacggtgggtggcgcctagaaatagaggctctggcttcggacacaatggcgtcgacggcaacggtgtgggtcagtcccaggcgggatctggttcaacacccagcgaaccacacccagtcctggagaagctgcggtcaattaacaactataaccccaaggacttcgactggaatctcaagcacggacgagtgttcatcatcaagtcctacagcgaagacgatatccataggtccatcaagtacaatatatggtgtagcacggagcatggtaacaaacggctggatgcagcctataggagcatgaatgggaaagggccagtctacctcctgtttagtgtcaacgggtccggtcacttttgtggggtggctgagatgaaaagcgccgtcgactacaatacttgcgctggggtctggagtcaggacaaatggaagggacggttcgacgtcagatggattttcgtcaaagacgtccccaactcccaattaaggcacatccggctggaaaacaatgagaacaagcccgttactaatagcagagacacccaggaagtgcccttggaaaaggctaagcaagtccttaaaattatagcttcttacaagcacacaacgtctatctttgatgacttttcgcattacgagaaaagacaggaggaggaagagtcggtaaagaaagagagacagggcagaggaaaatag

SEQ ID NO: 247082 - DNA, 1740 bp, Artificial Sequence
  Description of Artificial Sequence: Synthetic coding sequence
atgtcagcaagcagcctgctggaacaacgcccaaaaggacagggcaataaagtgcagaacggctctgtgcatcagaaagatggtctgaacgatgatgacttcgaaccatatctctccccacaagccaggccaaataacgcgtacacagccatgagtgacagttacttgcctagttattattcccccagcatcggatttagctattctctcggagaggcagcctggtcaactggtggagatacggctatgccttacctgacaagctatgggcagctttctaatggtgaaccgcacttcctgccagacgccatgtttggacaacccggagctctcggcagcaccccctttcttgggcaacacgggtttaatttttttccttcaggcatcgacttctcagcctggggaaacaatagtagccaggggcaatcaacccagagtagcggttactcttctaactatgcctatgccccatcctccctcggcggagctatgatcgacggacaaagcgcctttgccaacgaaactctgaataaagccccaggcatgaatactatcgatcaaggtatggctgctcttaaacttggatctactgaggtggcctccaacgtgccaaaggtcgtgggctctgctgtcggcagcggttcaattacctccaatattgtggcttcaaactccttgccacctgccactattgcccctccgaagcccgcttcctgggccgatatcgccagtaaacctgctaagcaacagcctaagctgaagactaagaatggaattgccggtagctcactcccccctccaccgatcaagcataacatggacattggcacatgggataacaaagggcctgtggctaaagcaccctcacaggctttggtgcagaatatcggtcagccgacgcagggctcgccacagcccgtggggcagcaagccaataactctcccccagtcgcacaggcgtccgtaggccagcagactcagccgctgccccctcctccccctcaacccgctcaattgtctgtgcaacagcaggctgcccaacctacacggtgggtcgcgcctaggaaccgcggttcgggattcgggcacaatggagtagacgggaatggcgtcggacaaagtcaggcaggctccgggagtactcccagcgagccacatcccgtgttggagaaactgcggagcattaataactataatcccaaagactttgattggaatctgaagcatggcagagtgttcatcatcaagtcatattcagaagatgacatccataggtccattaagtacaacatctggtgctcgaccgagcacggcaacaaacgcttggacgctgcctacaggtccatgaacggtaaaggacccgtctatctccttttcagcgtcaatggatccggtcacttttgcggggtcgctgaaatgaagtcagccgtcgactacaacacatgtgctggcgtttggtctcaagataagtggaagggcaggtttgatgttagatggattttcgttaaggacgttcccaattctcagctgcggcatattaggctggaaaacaacgagaacaaacccgtgactaacagtagagatactcaggaggtgcctctggaaaaagcgaaacaggtcctaaagattatcgccagttacaagcatacaacctctattttcgacgacttctcccactacgagaagcgccaagaagaagaggaaagcgtcaagaaagagcgacagggacggggtaagtag

SEQ ID NO: 247083 - DNA, 1245 bp, Artificial Sequence
  Description of Artificial Sequence: Synthetic coding sequence
atggcaagtggcgatacgttgtatattgcaaccgatggatcagagatgcctgcggaaatcgtcgagctacacgagatagaggtggagacaatccctgtggagaccatcgagacaacagtggtgggcgaggaagaggaagaagatgacgacgatgaggacggtggcggaggggatcacgggggtggaggtggacacgggcacgctggccatcaccatcaccatcatcaccatcaccatcacccccctatgatcgccctgcaacctctagtgacggatgatcccactcaagtgcaccaccatcaagaagtcatactggtgcaaacacgcgaagaggtagtcggtggggacgactcagatgggttacgggctgaagatgggtttgaggatcaaattctgatacctgttcctgcccctgccggtggggatgacgattacatcgagcagactctggtcactgtggctgccgctgggaaatctggcggtggcggaagctcaagctccggagggggacgagtaaagaaaggcggaggcaagaaaagtggcaagaagagctacttgtctggcggtgctggtgcggcagggggaggcggagctgatcccggtaacaagaagtgggagcagaaacaggtgcaaatcaagaccttggagggagagttctcagtgacgatgtggtcgtccgatgaaaaaaaagatattgatcatgaaaccgtggttgaggagcagatcatcggagagaattctcctcctgattatagcgagtatatgactggcaaaaagctgcctcctggcggaattcctggcatcgatctctcggatccaaaacagctggccgaatttgcacggatgaaacccaggaaaattaaagaggatgacgctcctagaacaatcgcatgcccacacaaaggttgcaccaagatgttccgggacaacagcgccatgcggaaacatctacacacccacggcccacgggtgcatgtctgcgcagagtgtggcaaggcattcgtagagtctagcaagcttaagcgccatcaattagttcatactggggagaagccctttcaatgtacctttgagggatgcggaaaaaggttttccctcgactttaacctaagaacccacgttcgtattcacaccggagacaggccctacgtatgtccttttgacggttgcaataaaaagttcgcacagtccacaaacctgaaaagtcatatcctgacccatgctaaagcaaaaaataatcagtag

SEQ ID NO: 247084 - DNA, 105 bp, Artificial Sequence
  Description of Artificial Sequence: Synthetic coding sequence
atggctagcggcgataccctgtacatcgcaacagacgggtccgagatgcccgctgaaatcgtggagcttcacgagatagaggtggaaaccatccctgtggaatag

SEQ ID NO: 247085 - DNA, 1221 bp, Artificial Sequence
  Description of Artificial Sequence: Synthetic coding sequence
atggctcaggcgccagccgacccagggagggaaggacacctcgagcagcggatccttcaggtgcttacagaagcaggaagccctgtgaagctcgctcagcttgtgaaggaatgccaagcccctaaacgggagctaaaccaagtcctgtatagaatgaagaaggagctcaaagtctctttgacctctcccgcaacatggtgtctcgggggaactgatcctgagggggaagggccagccgaactcgccctgagcagtcctgaagaggatatctacagattcctgaaggacaacggcccacaacgagctctcgtgatcgcacaggccctgggaatgagaaccgcgaaggacgtgaatagggacctttatcgcatgaagagtaggcacctgctcgacatggacgagcagtccaaggcttggacaatatacaggccagaggactcagggagaagggcgaagtctgcctcaatcatctatcaacataacccaattaatatgatctgtcaaaatggtcctaattcctggatcagcatcgccaatagtgaggccattcaaattggacacggcaatattatcactaggcagaccgtctctcgggaagacggatccgccggtcctagacatctaccctcgatggctccgggagatagctccacctggggcacccttgtggacccatggggaccccaggatatacatatggaacagtcaattctgagacgggttcagttgggacattctaacgaaatgaggcttcatggtgtcccctctgagggacccgcacacatcccccctggttctccaccggtatctgccaccgccgctgggccagaggcttctttcgaagctagaatcccgagcccaggcacccatcccgaaggtgaggccgctcaacgcatccatatgaaatcatgcttcctggaggatgcaacgattggaaattccaacaaaatgagtatcagtcccggagtcgctggacctggcggagtcgccggaagtggagagggagaaccaggtgaggacgctggcagaaggcctgccgatacccagagccgatcccatttccccagagacatcggccagcctatcacaccgagtcacagcaagctaacgcccaagctggagacaatgacgctcggcaataggagtcataaagctgcagagggctcccattacgtcgatgaggcatcgcacgaaggcagctggtggggcggaggtatttag

SEQ ID NO: 247086 - DNA, 1341 bp, Artificial Sequence
  Description of Artificial Sequence: Synthetic coding sequence
atggctcaggctcccgctgaccccggtagagaaggccatttggagcagcggatactccaggttttgaccgaagccggttctcccgtgaagcttgcccagcttgtgaaagagtgccaggcacccaagagggaacttaaccaggtgctgtaccggatgaagaaagaacttaaggtgagcctaaccagtcccgctacctggtgtttgggcggaacagatccagagggcgaggggccagcagaactggccctaagctcgcctgcagagcggcctcaacagcatgccgctactattcccgagacaccaggacctcagttctctcagcagcgggaggaagacatttataggttcctcaaggacaacggcccacagagagcactggtgattgctcaagcactgggaatgagaactgccaaagatgtgaatagggacctgtacaggatgaaaagccgccacctgctggacatggatgagcaatccaaggcttggaccatctacaggcccgaagactccggcaggagggctaagtccgcttccattatttatcagcataacccgatcaacatgatctgccagaatggtcctaattcttggatttctattgctaactctgaggccatccagataggccatggcaatatcattactcgtcaaaccgtgagcagagaagatgggtctgctggacccagacaccttcctagtatggcgcctggcgactccagcacttgggggacgctggtagatccttggggccctcaggatatccatatggagcaaagcatcctccggagagtccagctgggacacagcaatgaaatgcgtctgcacggcgtcccatccgagggaccagcccacattcccccaggatcccctcctgtgtcagccactgccgcaggccctgaggctagttttgaggcccgtatcccgagtcctggtactcaccctgagggcgaggccgctcagcggattcacatgaaatcatgctttctcgaggacgccacaattggaaattctaataagatgtctatctcacccggagtggccggacctggcggagtcgctggaagcggagaaggagagccaggtgaggatgctgtggctgcctttaccgaagtcctgaaccctagcaagtccttcatgaagttcggtatcaatttctttcagacaccagtgaatgtggatagtttgaccagcagtcacgaatcacagatgtttcttacggcctgtcgccttgtgatcttcagcagacgtttttctacttactttgcgcagatccacctccgtaatcactctgtcctacacctgtgtcctcataagatttacctgctgaaaaacaagaagtag

SEQ ID NO: 247087 - DNA, 1143 bp, Artificial Sequence
  Description of Artificial Sequence: Synthetic coding sequence
atggcccaggcaccagctgaccccggacgggaggggcatttggagcaaaggattctgcaagtactcactgaggcgggatccccagtcaaacttgcgcagctggtaaaggagtgtcaggccccaaagagagaattaaatcaggtgctttatcggatgaaaaaagagcttaaagtgagcttgacatcaccagccacttggtgcctgggcggaaccgaccctgaaggggagggtccagcagagctagccctcagcagccccgcagagcgccctcagcagcatgcagccactattccagaaacccctggccctcagttctcccaacagagagaggaggacatataccgctttttgaaggacaacgggccacagagggccctggtcatcgctcaggctctcgggatgcgcaccgctaaggatgtaaacagagatctgtataggatgaagtcacgtcatctgttggatatggacgagcagtccaaagcctggacaatttatcgacctgaagactctgggaggcgggctaaatctgcatccataatctaccagcataacccaataaacatgatctgccagaatggcccaaattcttggattagtattgcgaattctgaggccatccaaatagggcacggaaacataattacccgccaaacagttagtagagaagatggttccgcaggccctagacacctgccttcaatggctcctggcgactcaagcacttggggaaccctcgtcgacccgtggggcccacaggacatccacatggagcaatctattctgcgcagggtgcagctaggacactcaaacgaaatgagactgcatggggttcctagcgagggaccagctcatatcccccctggaagcccacccgtcagtgctacagcagcaggacccgaggccagcttcgaggcaaggatcccctcacctggtactcaccccgagggcgaagcagcccagcgtatccacatgaaaagctgctttttggaggacgccaccatcggcaactcgaataaaatgtccatctctcctggtgtcgcgggtccgggaggggtggccggatccggagagggagaaccgggtgaggacgcaggaaggagacccgcagacacgcaggccagatcttttgacgggcaggaatag

SEQ ID NO: 247088 - DNA, 1290 bp, Artificial Sequence
  Description of Artificial Sequence: Synthetic coding sequence
atggcacaggctccggctgatcccggacgagagggccatctggaacagcgcatcctgcaggtgctgaccgaggcgggatcaccagtcaaattggctcaactagtgaaggagtgccaagctcccaagcgggaactcaaccaggtcctctataggatgaagaaagagttaaaagtgagtctgacctcgcccgctacgtggtgcctggggggtactgaccccgagggtgaaggacctgccgagctggccctcagctccccggctgagaggccacagcagcatgcggctactatccccgagacacctggaccacagttttcacaacagcgcgaggaggacatctaccggtttctgaaggacaacggaccccaacgggctctggtcattgctcaggctttgggcatgcggacagctaaggacgtcaatagggacctgtataggatgaagtcacgtcacctcttggacatggatgaacaaagcaaagcctggacgatctacaggcccgaagattctggccgacgagcaaaatccgcatctattatctaccagcacaacccaattaatatgatctgccaaaatgggcctaattcttggatcagtatagctaatagcgaagctatccagatagggcatggaaatatcatcacacgacagacagtgagcagagaggacggtagcgctggccctagacacctgcctagtatggccccaggggacagctctacgtggggtactctggtggacccgtggggtccccaggacattcacatggaacagagcatcttgcgcagagtgcagcttggccatagtaacgagatgcgccttcatggtgtgccgagcgagggacccgcacatattccccctggttctccccctgtcagcgccaccgccgcaggccctgaggcctcttttgaggccagaattccatccccaggaacccaccccgagggggaggctgctcagagaatccatatgaaaagctgtttcctggaggacgcaacaattgggaactccaataaaatgtctatttcaccaggcgtggccggaccgggaggcgtggccggttcaggcgagggagagccgggtgaagacgcaggccgaagacctgcggatacacagagccgctcccattttccacgggacattggccaacccatcacaccctctcactctaagttaacaccgaagctggagacgatgacacttggcaatcggtctcataaggccgctgaaggatcccattatgttgacgaagctagccatgagggatcatggtggggagggggtatatag

SEQ ID NO: 247089 - DNA, 747 bp, Artificial Sequence
  Description of Artificial Sequence: Synthetic coding sequence
atggctcaagcacctgccgaccccggacgcgagggccatctggagcagaggatcctgcaggtactaacagaggccggaagccccgtcaagctggcccagctagtgaaagagtgtcaggcacccaaacgcgagctgaatcaggttctataccgcatgaagaaggaactgaaggtctccttgacaagcccggcaacttggtgtctgggcggaacagaccctgagggagagggacctgcagagctcgccctctcttcccccgcagaacgtccacagcagcatgcagctacaattcctgagactcccggtccccagttctcccagcagagggaagaggacatatatcgcttcctgaaagacaacggacctcagcgagccctggtcatcgctcaggctctgggtatgaggactgccaaggatgtgaacagggacctgtatcgcatgaagtcaaggcacttgctggacatggacgagcagtcgaaggcctggactatttatcggcctgaggacagcggcaggcgggctaagtcggcatctatcatctaccaacacaaccctataaacatgatttgtcagaatggcccaaactcttggatttcgatagccaactccgaagccattcaaatcggacacggtaacattattactcgtcaaacagtctcccgggaagatgggaagtctccgaaaagggctcagggtggtgacctcgggggagaacctcccgaccctctgggagggggaaaaggatag

SEQ ID NO: 247090 - DNA, 1065 bp, Artificial Sequence
  Description of Artificial Sequence: Synthetic coding sequence
atggctcaggccccagccgatccgggtcgagaagccgagcggcctcagcaacacgccgcaacaatccccgaaacacccggtccacaattctcccagcagagagaggaagacatttaccgctttctcaaggacaatgggcctcagcgagcactggttatcgcccaagcccttggtatgcgcaccgccaaagatgtgaaccgcgacttgtaccgtatgaaatcacggcacctactagacatggatgagcagtcaaaagcttggacgatctaccggccagaggattcaggccgaagggcaaagtctgcctccatcatttaccagcacaaccccattaacatgatttgtcaaaatggcccaaactcctggatttccatcgcaaattccgaagccatacagattggacatggaaacataatcactaggcagacagtgtctcgagaggatggaagcgccggtccgagacacctgccttccatggctccgggagattcctctacgtgggggaccttagtggacccgtggggacctcaagacatccatatggaacagagtattctccgcagggtgcagctggggcatagtaacgaaatgagactgcacggagtgccgagcgagggccctgcacatatcccccctggctcacccccagtttccgctactgcagccggaccggaggccagcttcgaagctcggatcccaagtccaggcactcatccagagggggaagctgcccagaggatccacatgaaaagctgtttcctcgaggacgctacaatcggcaactccaacaagatgtctatctcgccgggagtggcaggccctggaggcgtggctggctctggagagggtgaaccaggggaggacgctggcaggcgccctgctgacacacagagccggtcccacttcccccgagacatcgggcaaccgatcacacctagtcatagcaagctcacgccaaagctcgagacaatgaccctcgggaatcggtcccacaaggcggctgaaggtagtcactacgtcgatgaagcaagccatgaggggagctggtgggggggtggaatctag

SEQ ID NO: 247091 - DNA, 1860 bp, Artificial Sequence
  Description of Artificial Sequence: Synthetic coding sequence
atgccggatccagcggctcacttgccatttttttatgggtccatatcacgggctgaagccgaggaacacctgaagctggcgggaatggctgatggcttgttcctgctccggcaatgcctgaggagtctgggcggatacgtgttatcgttagtgcacgacgtgcggtttcaccacttccctatcgaacgccaactgaacgggacttatgcaatcgcaggtggaaaagcccactgcggccctgccgagttatgtgaattctactcaagagaccccgatggcctgccatgcaatctccgtaagccgtgcaataggccatcaggactggaacctcagcctggggtgttcgactgtcttcgcgacgcaatggtgagagactacgtgaggcagacatggaaattagagggcgaagctctcgagcaggctataattagtcaagctccccaagtggaaaaactgatcgctacgactgcccatgaaagaatgccatggtatcactcgtctttaacacgggaggaggcagaacgaaagctgtattctggagcacagacagatggaaagttcctcctgcgccctcgcaaagagcagggcacatatgcactgtccctgatttatgggaaaaccgtctatcactatctgatttctcaggataaggccggaaagtactgcatcccagagggcacgaagtttgacaccctttggcagctagttgaatatctcaaactgaaggcggacggactgatctactgtctaaaagaagcttgcccgaacagtagcgcctcaaacgcctctggtgcagctgccccaacgctgcccgcacaccccagcactctgacccacccgcagagaaggattgatactctgaattctgatgggtatacccccgaaccagcgaggatcactagtccagacaagccccgacccatgcccatggacacctcagtgtatgagtccccatacagtgatcctgaggaactgaaagacaaaaagctctttttaaaacgtgacaacctcctcattgctgacattgagttgggatgtgggaattttggatctgttagacagggagtctacagaatgcggaagaaacaaatcgacgtggccattaaagtgttgaagcagggcacagaaaaggcagatacagaagaaatgatgcgtgaagcccagataatgcaccagctagataatccatatatcgtgcggctcattggggtttgccaggctgaagctctgatgctagtgatggaaatggctggcggaggtcctctgcacaaatttctggttggtaagagggaggagattcccgtgtctaacgtggctgagctgctccatcaagtgtccatgggaatgaagtatcttgaagagaaaaacttcgtgcaccgggatttagccgctcgcaatgttttactcgtcaacagacactacgcaaaaatcagcgatttcgggctctcgaaagcacttggagctgacgacagttattacaccgctagaagtgccggaaagtggcctctgaaatggtatgcgccagagtgcatcaatttcagaaaattcagttcccgttctgacgtgtggtcttatggagtcacaatgtgggaggctctcagctacggtcagaaaccctacaaaaaaatgaagggaccagaggtgatggccttcattgagcaaggtaaacggatggagtgccctcccgaatgccccccagagctttatgcgctgatgagtgactgctggatatacaaatgggaagatcggccagacttcctgaccgtggaacagcggatgagggcttgctattactctcttgcatctaaggttgaaggaccacctggttccacccagaaagcagaggctgcctgcgcttag

SEQ ID NO: 247092 - DNA, 1482 bp, Artificial Sequence
  Description of Artificial Sequence: Synthetic coding sequence
atgcggctcggccctcgctggaagggagaagctcttgagcaagctattatcagccaagctccccaggtggagaagctgatcgcaactaccgcccacgagcggatgccatggtatcatagttcactcacgagagaggaggctgaaagaaagctgtattccggagctcagaccgacggaaaattcctgttaaggcccagaaaggagcaagggacgtatgccctgtccctaatttatgggaagacggtataccattatctcatcagtcaggacaaggccggaaagtactgtatccctgaggggactaaatttgataccctgtggcagctggtcgagtaccttaaactaaaggctgatggactgatttattgcctcaaggaagcttgtcccaactcaagcgcaagtaacgccagtggagccgctgcgcctactttacccgctcatccaagtactcttacacaccctcaaagaagaatcgatactctcaacagtgacggctacactccagagccggctagaatcacctcgcccgacaagcccaggccaatgcccatggataccagtgtatatgaatccccatactccgaccctgaagagctcaaggataaaaaattgttcttgaaaagagataacctgctaatcgctgacattgagcttggctgcgggaatttcggttcggtgcgtcagggggtctatcgtatgcggaagaaacagatagacgtagcgatcaaggtgttaaaacagggaaccgaaaaagctgatacggaggaaatgatgcgagaagcccagattatgcaccagctggataatccttacattgtacgcctgatcggagtatgtcaagccgaggcgcttatgttagtgatggagatggcaggaggcggtccactgcataagttccttgtgggaaaacgggaggagatccctgtgtctaacgtggcagaacttctgcaccaggtctcgatgggaatgaagtaccttgaggaaaaaaacttcgttcacagagacttagctgctagaaatgtgctactcgtgaacaggcactatgccaaaatttctgatttcggtcttagcaaggcactcggagctgacgactcctattataccgccagaagcgctggaaaatggccacttaaatggtatgctcccgagtgtattaattttcgaaaattttcctcccggtccgacgtatggagctatggagtaacaatgtgggaagctcttagttatggacagaaaccatacaaaaaaatgaagggtcctgaggtcatggcatttatagagcaaggaaaaagaatggaatgcccccctgaatgtcctccagagctctacgctctcatgtccgactgctggatttacaagtgggaggacaggcctgacttccttaccgtggagcagagaatgagggcctgctattactctctggctagcaaggttgaggggcctcccggaagcacccagaaagcggaggccgcatgtgcctag

SEQ ID NO: 247093 - DNA, 939 bp, Artificial Sequence
  Description of Artificial Sequence: Synthetic coding sequence
atgccaatggacacgagtgtctacgagtcaccttacagtgaccctgaggagctgaaggacaagaagctgttccttaaacgagacaacctgctgattgctgacatcgaattaggctgtggtaatttcggctctgtgcggcaaggcgtataccgaatgaggaagaaacagattgatgtggcaattaaggtgctgaaacaggggactgaaaaggcagacaccgaagagatgatgcgggaagctcagatcatgcaccagctagataacccctacatcgtacgactcatcggtgtgtgccaagcagaagccctaatgcttgtaatggaaatggccggtggtgggccactgcacaaattcttggtgggcaaacgtgaggagatccctgtctctaatgtagcagagcttcttcaccaggtgtctatggggatgaagtatctggaagagaagaattttgtccatcgggatctggccgcacgcaatgtgctgctggttaataggcactatgccaagatatcagacttcggtcttagcaaagctcttggggcagatgactcttattacaccgctcgcagcgctggtaagtggccactcaagtggtacgcgcctgagtgcattaacttcagaaagttcagcagccgctccgatgtctggtcctacggggttaccatgtgggaagccctgtcctatggtcagaagccatataaaaaaatgaagggcccagaggtgatggcctttattgagcagggcaagcgaatggaatgccctcccgagtgtcccccagagctctacgccctcatgtccgactgctggatatacaagtgggaggacaggcctgattttttaacagtggagcagcgaatgagggcttgttactactctttagcaagcaaggtggaaggccctccaggttcaacgcaaaaagctgaggctgcctgcgcatag

SEQ ID NO: 247094 - DNA, 1344 bp, Artificial Sequence
  Description of Artificial Sequence: Synthetic coding sequence
atgcttttggacgcagggcctcagtatcctgcaataggagtcacaacatttggggcttcacgacaccatagtgccggtgacgtggccgaaagggacgtcggactgggcattaaccctttcgccgacgggatgggcgcatttaaactgaacccctcgagccatgaactagcatccgccggacagactgcatttacttcccaagcccctggttatgcagctgccgcagccttgggccaccaccaccatcctgggcatgtgggctcttactctagcgcagcctttaacagcactcgggattttctatttcgaaaccgaggattcggagacgccgcagccgcagcatctgctcaacactctctgttcgctgcctcagctggcggttttggaggtccccacgggcacacggatgcagcgggacacttgctatttcccggactgcacgagcaggccgcagggcacgcctctcctaacgtggtaaacgggcagatgaggttgggcttctcgggagacatgtacccgaggcccgagcagtatgggcaagtcacgtcccctcggtctgaacactacgcagctccacaacttcacgggtacggcccaatgaacgtgaacatggccgctcatcacggagctggggcatttttccgttacatgcggcagccaataaaacaggagctgatatgcaagtggattgagccggagcaactggccaaccctaaaaagtcatgcaataagacattttccaccatgcatgaactagtaacacatgtgacagtagaacatgtaggtgggccagagcagtcaaaccacatatgcttttgggaggagtgtccccgagagggtaaacccttcaaggcaaaatataagctagtcaaccacattcgcgtacacacaggcgagaaacctttcccgtgcccattccctggttgcggaaaggtctttgcccgatccgaaaatctgaagatacacaaaaggacacacaccggcgaaaaacctttcaagtgcgagttcgaaggatgtgaccggcgattcgcaaacagctctgatcgtaaaaagcacatgcacgtgcatacaagtgacaagccctacctgtgtaagatgtgtgacaagtcatatacccaccctagctccctgaggaagcatatgaaggtccatgagtcaagcagtcagggaagtcagccatctccagccgcaagtagcggctatgagtcctctacaccacccactattgtttctcccagcacagataacccaaccacttcttcgttaagtccttcgtcatccgctgttcatcacaccgcaggccatagcgcactcagctccaacttcaacgaatggtatgtgtag

SEQ ID NO: 247095 - DNA, 1599 bp, Artificial Sequence
  Description of Artificial Sequence: Synthetic coding sequence
atgttgctcgacgctggtcctcaatttccggcaatcggcgtggggtccttcgcccgacaccaccatcattccgctgcagccgctgccgcagccgctgcagaaatgcaggatcgagaactgagtctggcagctgcccagaacgggttcgtagatagcgcagctgcacacatgggcgcttttaagctgaatcccggagcccacgaattgagccccggacaaagcagtgcctttactagccaaggcccaggcgcttaccctggtagcgctgctgcagctgctgccgctgctgccctggggcctcacgccgctcacgtgggttcatactcgggaccaccgtttaactcgacgagggacttccttttcagaagcagagggttcggggattccgcacctggagggggtcagcatggactattcggcccaggcgcaggagggctccaccacgcccactccgacgcccagggccacctgctctttccgggtctgcccgaacagcacggcccacacgggtctcagaacgtgcttaatggacagatgagactggggttgccaggcgaggtctttggcagaagcgagcagtatcgtcaggtcgccagtcccagaaccgatccctactctgccgctcaactgcacaaccagtatggcccaatgaatatgaatatgggcatgaatatggccgcagcagcagcccaccaccaccaccatcatcaccaccacccaggagcattctttcgctatatgaggcagcagtgtatcaaacaagaactaatttgcaaatggattgacccagaacagctctcaaaccccaagaagagttgcaataagacattctcaaccatgcatgaactggtcacacacgtttccgtggagcacgtgggcggacctgaacagtcaaaccatgtttgcttttgggaagagtgtcccagagagggcaagccctttaaggctaaatataagctcgttaatcatattcgggtgcataccggcgaaaagccttttccctgtccatttcctggatgtggcaaagtgttcgccaggtccgagaacttgaagatccacaagaggacacataccggagaaaaacctttccagtgtgagttcgaggggtgcgatcgcaggttcgcgaactccagcgacagaaagaagcacatgcatgtgcacacgtctgacaaaccttacctgtgtaagatgtgcgataaatcatatacccacccatcctccctgaggaagcacatgaaagtgcatgaatctagccctcagggctccgagtcatctcctgctgccagtagcggttacgagtcaagcacccctccaggtttggtgagcccatctgctgagccgcagtctagctccaacctgtctcctgccgcagctgcagccgctgccgcagcagcggctgcagctgccgcagtgagtgcggtccaccgaggaggaggctccggctccgggggagctggcggtggatccggaggaggttctggttccggtgggggaggaggcggagccggtgggggtggtggtggcagcagcgggggaggcagcggtaccgctgggggacacagtgggctgagctcaaacttcaatgaatggtacgtgtag

SEQ ID NO: 247096 - DNA, 489 bp, Artificial Sequence
  Description of Artificial Sequence: Synthetic coding sequence
ccccctcccccaccaccccctcccgcacctcctccgccaccccctctaaaccccaagaagtcttgcaataaaacttttagtactatgcatgagttggtgacacatgtcagcgtggagcatgttgggggacccgaacagagcaaccatgtgtgcttttgggaggaatgtccaagagaggggaagcccttcaaggctaaatacaaactcgttaaccatatacgggtccataccggagagaagcccttcccgtgcccattcccaggctgcggaaaggttttcgcccgttctgaaaatctgaaaattcataaaaggacacatacgggagagaaaccgtttcaatgtgaattcgagggctgcgaccggagattcgctaactcctccgatcgaaaaaagcacatgcacgtacacacttctgacaagccctatttgtgtaaaatgtgtgacaagtcttacacacatcccagcagtctcagaaagcacatgaaatag

SEQ ID NO: 247097 - DNA, 783 bp, Artificial Sequence
  Description of Artificial Sequence: Synthetic coding sequence
atgttgctcgatgccggacctcagtttcctgcaatcggcgtgggaagtttcgccaggcatcaccatcacagtgctgcggctgcagctgccgctgctgccgagatgcaggaccgagagctgtcacttgctgccgctcagaacggatttgtggactccgctgctgcacacatgggagcattcaagctgaaccctggagcacacgaactgtctccaggccagtctagtgccttcacaagccaaggcccaggcgcttatccgggatctgccgcagcggcagccgcagccgctgcccttggtcctcatgccgctcacgtgggatcttattcaggaccgcctttcaattccacacgtgactttctgtttcggtcccgcggattcggagactcagcacctggcggaggccagcatggtctcttcggaccaggcgcaggcggactgcaccacgcccacagtgacgcacaggggcacttactgtttcctgggctgcccgaacagcatggccctcacggtagccagaatgtcttgaacgggcagatgcgcttgggacttccaggcgaggttttcgggcgatcagaacagtaccgacaggtagcatcaccaagaaccgacccctattcagcagctcaactgcacaaccagtatggtccaatgaacatgaacatgggaatgaatatggcggctgctgccgcacatcaccaccatcaccatcaccatcccgtaccaagcttgctgaccaattgtgtccatagcggactcctgctgagcccacctcgctggttctag

SEQ ID NO: 247098 - DNA, 1404 bp, Artificial Sequence
  Description of Artificial Sequence: Synthetic coding sequence
atgaccatgctactagatgggggtccccagtttccaggcctcggcgtgggctcctttggcgcaccacgccatcatgagatgccaaacagggagccagctggcatgggactgaacccttttggtgatagcactcatgcagccgctgcagccgctgccgctgcagctttcaaattatccccggctgcggcacacgatttgtcctctgggcagagcagcgcttttactccacagggctctggctatgccaatgctttgggccaccaccatcaccaccaccatcaccaccatcacacctcacaggtgccctcctatgggggtgcagcgtccgccgcatttaatagcacacgcgagtttcttttcagacagcgatcttcggggttatctgaggcagcatcaggtggaggtcagcatggactcttcgctgggagcgccagttccctgcatgcaccagccggtattcccgagccaccaagctacctgctgttccccggactgcatgagcaaggcgcaggtcatccaagccccacaggtcatgttgataacaatcaggtccacttaggactgaggggtgagctgttcggtcgggctgacccttatcgccctgtggcctcacctaggaccgatccttatgccgcaggtgcccagttccccaattatagccctatgaatatgaacatgggagtcaacgtggccgcacatcatgggccaggcgcttttttcaggtatatgaggcagcctatcaaacaagaactgtcatgtaagtggatcgatgaagcccagctcagccgaccaaaaaagtcctgcgataggactttttctaccatgcacgaactggtaactcacgtgacaatggaacatgtgggcggacccgaacaaaataaccatgtttgctattgggaggagtgcccccgagaaggaaaatcgttcaaagctaaatataaactggtgaatcacatccgggttcacactggtgagaaaccattcccatgccctttcccaggatgcggcaaaatttttgccaggtcggagaacttaaagatccacaaacgaacgcacacaggggagaagcccttcaagtgcgagtttgagggatgtgatcggcgattcgctaactcctcagatagaaaaaaacatatgcacgtgcataccagtgacaaaccctacatttgcaaagtgtgtgataaaagctacacccatccatcaagtctgagaaaacacatgaaagttcacgagtcgcaggggagcgattccagccctgcggctagcagtggttatgagtctagcactcccccagccatcgcatctgctaattctaaagacacgacaaagacgccctcagctgtccaaacatctacctcccataatcctgggcttccacccaatttcaatgagtggtatgtctag

SEQ ID NO: 247099 - DNA, 1374 bp, Artificial Sequence
  Description of Artificial Sequence: Synthetic coding sequence
atgaccatgctgcttgacgggggaccacaattcccgggactgggggtaggatccttcggggctcctcgccaccacgagatgcctaatcgagagcccgctggcatgggactgaacccttttggtgacagcacacacgccgctgcagcggctgccgctgccgcagccttcaaactgtctccagctgccgcacatgatctgtcaagcgggcagtcatccgcattcactcctcagggctcagggtatgccaatgcactggggcaccaccaccatcaccatcaccatcaccaccacacctcccaggtgccatcttacgggggtgccgcatctgccgcttttaattccacaagagagtttcttttccgccaacgaagttctggactcagcgaggctgcctctgggggaggccagcatggactgtttgcgggatccgcatcctcactccatgccccagccggaattccagagcctcccagttatttgttgtttcctggcctgcatgagcagggcgctggacacccctcacccaccgggcacgtggacaataaccaggtccatctgggattaagaggggagctgttcggaagggccgacccatataggccagtagcgtctccgagaaccgatccttatgcagccggtgcgcaattcccaaactactcccctatgaacatgaacatgggggttaatgttgccgcacaccatggccctggcgcatttttccggtacatgcgacagcctataaagcaagagttatcatgcaaatggatcgatgaggctcagctaagcaggcctaagaagtcctgtgacagaactttttcaaccatgcacgagctggtgacacacgtgacaatggagcacgtggggggacctgagcaaaataatcacgtctgctactgggaagaatgtccacgggagggcaagtccttcaaagccaagtataagctggtcaatcatatccgcgtacacacgggggagaaaccctttccttgtccattccccggatgtggtaaaatatttgctcggagtgagaacttgaagatccataaacgcacacatacaggcgagaagccctttaaatgcgaatttgagggctgcgatcgccgttttgccaacagttccgataggaagaaacatatgcatgtgcatacatccgataagccatatatctgtaaagtttgtgataagtcctacactcacccttcctccctgcggaaacatatgaagtgctgtcctgcttggtaccccggtcagtcgctaattccagacgaagaacttgacaccgatgtcggcatgcaacagcctgctcttcacaacactacctaccccaaatgtcgggtgaacgcggaacccaccgtgcaagaaatgatctactag

SEQ ID NO: 247100 - DNA, 1005 bp, Artificial Sequence
  Description of Artificial Sequence: Synthetic coding sequence
atgcgttacaaaacctctttggtgatgcgcaagcgactgcgcctgtatcgaaacaccttgaaagagagttcatcaagttccggtcaccatggtcctcaactaacagcagcttcgtcgcctagcgtttttcctggcttgcacgaagagcctccccaggcgtccccctccagacctctgaatggtctcctcagactggggcttcccggtgatatgtacgccaggcctgagcctttcccaccgggtccagcggctcgttccgacgcactggctgcggctgctgcactccacggctacggcggtatgaaccttaccgtgaatctggctgccccacatggccctggtgcatttttcaggtatatgagacaacctatcaagcaggaactcatatgtaagtggcttgctgccgacggtacggcaacaccctcactttgcagcaaaaccttctctacgatgcatgagctggtcacacatgtgactgtggagcacgtcgggggtccggaacaggcaaatcatatctgcttttgggaggagtgcccgaggcaggggaagcctttcaaagcgaaatacaagctcgtgaaccacatacgcgtccacaccggagagaaacccttcccctgccctttccccggttgcggcaaagtgtttgctaggagcgaaaacttaaaaatccacaaaaggactcatacaggcgagaagcctttccgctgtgagttcgaggggtgcgagcgtcgcttcgcaaactcttctgataggaagaagcatagccatgtccacaccagcgataagccttatacctgtaaggtaagaggctgtgataaatgctacacccacccatcttctttgagaaaacatatgaaggtgcacggaagatctccaccaccaagctctggatatgacagtgccactccaagcgcactggtttctccgtcatccgactgcggtcataaatcccaggttgcgagctccgccgctgtcgcagcgcgaacagccgacctcagtgagtag

SEQ ID NO: 247101 - DNA, 1119 bp, Artificial Sequence
  Description of Artificial Sequence: Synthetic coding sequence
atgaacgggccttgtcagtccctgaggaaggctgagggactcttggaaggttgcacatccgcagtcacagtgtttcgcaagctgcctcttgactctaaagcgcaaagccagaaaatgcgatataaaaccagcttggtgatgaggaagaggctacgactgtatagaaacactttaaaagaatctagctcctcctcaggccaccacgggcctcagctgacggctgcgtcaagtccttccgtttttcccggacttcacgaggagcctccacaggcttccccctcaagacccttaaacggcttgctaagattgggcctccctggtgatatgtacgctagacccgagcctttcccccctggacctgctgcacgcagcgacgcgcttgcagcagcagctgcgctccacggctatgggggaatgaacttgaccgtcaatttagcagcccctcacggaccaggagcttttttccggtatatgcggcagccaattaagcaagaactgatttgcaaatggcttgcggctgacgggactgccacaccatccctctgctccaagactttctccaccatgcatgaactcgttacgcacgtgaccgtggagcatgtgggcggacccgaacaggctaatcacatctgtttctgggaggagtgtccgagacaagggaaacctttcaaggccaagtacaaactcgtgaatcacatccgggttcacactggggagaagccatttccctgtccctttcctggctgcgggaaagtcttcgctaggtctgaaaacctgaaaatccataagaggactcacaccggggaaaaacccttccggtgtgagttcgaggggtgtgagaggaggtttgccaactcaagtgacaggaagaaacattcccacgtacacacaagcgataaaccatacacttgtaaagtgagggggtgtgataagtgctacacccaccctagttccctccggaagcacatgaaggtacatggcagatcaccccctccttctagtggctatgattcagccactccgtccgccttggtgtctcccagctcagattgtggacacaagtctcaggtcgcatcgagcgctgcagttgcagccagaactgccgatctgagcgagtag

SEQ ID NO: 247102 - DNA, 690 bp, Artificial Sequence
  Description of Artificial Sequence: Synthetic coding sequence
atgaggtacaagacctctttggtgatgagaaagcggttacggctgtaccggaacacactcaaggagagctcaagctcctccggacaccacggccctcagcttaccgcagcctccagtccatctgtgttccccggactgcacgaagagccaccacaggccagccctagccgtcccctcaatggccttctcaggctgggattaccaggagacatgtacgccaggcctgaaccctttccacccggaccagcggcacggtccgatgccctggccgctgcagcagcacttcatggctacggcggaatgaatctgacggtgaacctggctgccccacatgggccaggggcattctttagatacatgaggcaacccatcaagcaggaattaatttgtaagtggcttgctgccgatggtaccgcgaccccttcactttgttctaaaactttctctaccatgcacgagctggtgacacacgtcacagtggagcatgttgggggacctgaacaggctaatcacatttgtttttgggaggagtgtccacgccagggtaaacccttcaaagctaagtacaagctggtaaatcatatacgcgttcatacgggggaaaagccgtttccctgtccttttccaggctgtggcaaagttttcgcacgttccgaaaatctcaagatccacaaacgtacacacacctag

SEQ ID NO: 247103 - DNA, 207 bp, Artificial Sequence
  Description of Artificial Sequence: Synthetic coding sequence
atgcgatacaaaacttccctggtaatgcgtaaacggctccgtttatatagaaatactctcaaggagagctcttcgtcctcaggccatcacggccctcagcttactgccgctagcagcccctccgtcttccctgggctgcacgaggagcctcctcaggcctctccttctcgcccactgaacggcctcttgcgcttagggctgccgtag

SEQ ID NO: 247104 - DNA, 1005 bp, Artificial Sequence
  Description of Artificial Sequence: Synthetic coding sequence
atgcgatataaaacaagtctcgtaatgcggaagagactgcgcctttatcgcaacacgctgaaagagagctcttcatccagtggccaccatggtccacaactaactgctgccagttctccaagtgtatttcctggcctccacgaggaaccacctcaggctagcccgagccggccactcaacgggctgcttcggttggggcttcccggtgatatgtatgccagacccgagccattcccacctggcccagctgccaggtcagatgccctggctgctgctgctgcactgcatggctatggtgggatgaatctcaccgttaacctggccgctccacacgggcctggcgctttctttcgctacatgcgacagcccatcaagcaggaactgatctgcaaatggctagctgctgatggaaccgcaacaccatcgctctgcagcaagacgttttccaccatgcacgaattggtcacccatgtgactgttgaacacgtgggaggcccagagcaggcgaaccatatctgcttctgggaggagtgtcctaggcagggcaaacctttcaaggctaagtataaactagtcaaccacatcagagtacacacaggggaaaagcctttcccatgcccttttcctgggtgcgggaaggtgttcgctaggtctgaaaacctaaaaatccacaagagaacgcacaccggagagaaaccattccgatgcgagttcgaaggatgtgaaaggcgctttgcaaactctagcgacaggaaaaaacacagccacgtccatacgagcgacaagccctacacctgcaaagtcagaggctgtgataagtgttatacccatccttccagtttgcgaaagcatatgaaagtgcacggcaggagcccgccaccaagttcaggttatgactccgctacgccctcggccttggtgagtcctagtagcgactgtggacacaaatcacaggtggcgtcttcagccgctgtagctgccaggaccgccgatttgagcgaatag

SEQ ID NO: 247105 - DNA, 1005 bp, Artificial Sequence
  Description of Artificial Sequence: Synthetic coding sequence
atgcgatataaaacttccctggtcatgagaaaacggctgcggttgtaccgcaatactctcaaggagtccagtagtagttccggccatcacggaccccagctgacagcagccagcagcccctcggtcttccccggactgcatgaagagcccccacaggctagcccctcccgcccactgaacggcttactccgactggggctgcctggcgacatgtacgcgaggccagagccctttccacctgggccagctgctaggagtgacgccttagcggcagctgcagcacttcacggctacggcggaatgaacttgaccgtgaacctggcagcccctcatggccctggggcattttttcgatatatgcggcagccaattaagcaagagttgatttgcaagtggcttgccgctgacggcacagccacccctagcctgtgcagtaagacttttagtacaatgcatgagctggtcacgcacgttaccgttgagcatgtgggcggtccagaacaggccaaccacatctgtttttgggaagaatgtccaagacaagggaaacccttcaaagctaaatataagctcgtgaaccatataagagtgcacacaggcgagaaaccttttccatgcccattccctggctgtggtaaagtgtttgcacggagcgagaacctgaagatacacaaacggacgcacacgggcgaaaaaccatttcgatgcgagttcgaggggtgcgaacgaagattcgccaacagcagtgatcggaaaaagcactcccatgtccatactagcgataagccctacacatgcaaggtgaggggctgtgacaaatgctatacccatccctcctccctaagaaaacacatgaaggtgcatggacgcagccctcctccctcttcaggatacgactcagcaacaccctctgcacttgtctcaccatcttctgactgcggccacaagtctcaggtcgcatcaagtgccgctgtggccgctaggactgctgatctttcagaatag

SEQ ID NO: 247106 - DNA, 234 bp, Artificial Sequence
  Description of Artificial Sequence: Synthetic coding sequence
atgcgttataagacttctcttgtcatgcgtaaaaggttgcgcctgtaccgcaatacactgaaagagagttcctcatcaagcggtcatcacggccctcagctaacagccgcaagttccccctcagtgttccccggtctgcacgaagaacctccccaagcctcgccatccagacctttaaatggattattgcgcctcggcctgcctggagacatgtatgcccgacccgagccttag

SEQ ID NO: 247107 - DNA, 1155 bp, Artificial Sequence
  Description of Artificial Sequence: Synthetic coding sequence
atgcccccattctgcagaaatgccaagctgggtttgctgtcctttctgatttgcgccggtcggagcctactgcctttgggcaagaacgctttctggttggaaagaatcgaaaacaataatacgctctgggaaaaagctcagtcccagaagatgagatacaaaacaagcctggtgatgcgaaaaaggctacgtctgtatcgcaacaccctgaaagaatcatccagtagcagtggacaccacgggccacagctgacagctgcctcttctcctagcgtgttccctgggctgcacgaagaaccacctcaagcatcacctagtaggccactgaatggcttactgagactaggcttacccggtgacatgtacgccagacctgagccatttccgccaggccctgccgcacgctcagacgccctcgccgcagccgctgcactccatggctatggagggatgaatttgacagtgaatctggccgctcctcacggccctggagcgtttttcagatacatgaggcaacctattaagcaggagttgatttgtaagtggctggctgccgacggcactgctaccccgtcgctatgctccaagacatttagcactatgcacgagcttgtgacccacgtgactgtggagcacgtgggtgggcctgagcaggctaatcacatctgtttctgggaagaatgccctcgtcagggcaaacccttcaaagccaagtataagctggtaaaccacatcagagtgcacaccggcgagaaaccctttccctgtcccttcccaggttgtgggaaagtgttcgcacgctcagagaatttgaaaatccataaacgaacacacacaggtgaaaaacccttcagatgtgaattcgagggatgcgagcgacggtttgcaaatagttctgatcgcaaaaagcatagtcacgtgcatacatcagataagccctacacttgtaaggtgcgtggctgcgacaagtgctacacacacccctcttccctccgtaagcatatgaaagtgcacgggagatccccccctccttcctccggctatgatagtgccacgccaagcgccctggtgtctccaagttctgattgtggccataagtctcaagtcgcctcgtctgccgctgtggccgcacgcacagccgatctgtccgagtag

SEQ ID NO: 247108 - DNA, 684 bp, Artificial Sequence
  Description of Artificial Sequence: Synthetic coding sequence
atgggcggaaaacaaagcactgctgctcgaagccgcggaccctttcctggcgtcagtaccgacgatagcgctgtgcccccacccggtggcgctccccacttcggtcattatcgcaccgggggaggcgctatgggtttgcgaagtagatctgtttccagcgtggccggtatggggatggatccctcgaccgcaggaggcgtgcccttcggcctctatactcctgctagtcgcggaactggggacagcgagagggctcccggaggtggaggctcagcatctgattctacatacgcgcacggaaatggataccaggaaaccggcggtggccaccatcgggatggcatgttatatcttgggtcaagagcctccctggcagacgccctccctttacatattgcgcctcgctggttttcttctcattctggtttcaaatgccccatctgcagcaagtccgtcgcctcagacgagatggagatgcattttattatgtgcctgtcaaaacctcgattaagttataacgatgacgtgctgacaaaagacgccggagagtgcgttatctgtctggaggagttattgcagggcgacacgatcgccagactaccctgcctgtgcatttaccataaatcctgtattgatagctggtttgaagttaacaggtcttgtcccgaacatcctgccgattag

SEQ ID NO: 247109 - DNA, 543 bp, Artificial Sequence
  Description of Artificial Sequence: Synthetic coding sequence
cagcggggtgttcctgcagccggtaccccatcttcgccccgactgcttgttagccgcagcctggggggtgcagtgggatccgttgcctcaggcgctagggccgcacaaagcccattttccatcccaaactcctcctccgggccttacggcagtcaagacagtgtccattccagcccagaggacggcggagggggtagagacaggcctgtaggaggatcccccggaggcccaagacttgtaatcggcagtctaccagcccacttgtcgcctcatatgttcggaggatttaaatgtccagtctgttccaaattcgtgagcagcgacgagatggacctgcacctggtgatgtgcctcacaaaaccaagaattacatacaacgaggacgtgctctcaaaagatgcaggcgagtgcgcgatctgtctggaggagctgcagcagggagatactatcgctcggttaccttgcctgtgtatttaccacaagggttgcattgacgaatggtttgaggtgaaccgctcttgccccgagcacccttcagactag

SEQ ID NO: 247110 - DNA, 729 bp, Artificial Sequence
  Description of Artificial Sequence: Synthetic coding sequence
atgggtgcaaagcagtctgggccagccgctgccaatggacgcacccgcgcatacagtggaagtgatctgccttccagctcaagcggaggagcaaacggcacagcgggaggcggaggaggagctagagctgccgctgccggtcggtttcctgctcaggtcccatctgcccatcaaccttccgcttccggaggcgctgctgcagccgctgctgcccctgccgctccagcagcacccaggtcaagatctctgggtggggctgtcgggtctgtcgcgagcggcgctagggctgcccagagtcctttcagtatccctaatagtagctccggcccttatggctcccaggactctgtgcattcctcacctgaggatggtgggggaggtagagatcggcctgtaggtggctcacccggtgggcctagactagtgatagggtcactgccagcccacttgtcacctcacatgttcgggggtttcaaatgcccagtctgttcaaagttcgtgagctcagatgagatggatctacatcttgtgatgtgcctcactaagccacggataacatataatgaggacgttctttcaaaggatgccggtgagtgcgccatttgcttggaagaactccaacagggcgacactatcgcacgactgccctgcctctgtatctaccacaagggctgtatcgacgagtggtttgaggtgaataggtcttgtcccgagcacccctcagactag

SEQ ID NO: 247111 - DNA, 2511 bp, Artificial Sequence
  Description of Artificial Sequence: Synthetic coding sequence
atgcaccccctcggcctttgcaataacaacgacgaagaggacctctacgaatacggctgggtgggggttgtgaagcttgagcagcctgaattagatccaaaaccatgcctgacagtacttggaaaagctaaacgggcagtccagcgaggagccacggccgtgatcttcgatgtttccgaaaaccctgaagccattgatcagttgaaccagggcagcgaggatcctctgaagagacccgtcgtctacgttaaaggggcagacgccatcaaactcatgaacatcgtgaataagcagaaggtggccagggcacgcattcaacaccggcctccaaggcagccaacagaatacttcgatatgggcatatttctggcattcttcgtagtggtctccctagtctgcctcattttgctggtgaagataaagttgaaacagaggagatcacaaaattccatgaaccggctggctgtgcaggctctggagaagatggagaccagaaaattcaacagtaaatcaaaaggtcgcagggagggctcctgcggcgctcttgatactctgtcctcatccagtacatcagactgcgccatatgcttagaaaagtacatcgacggggaggagctgcgcgtgatcccatgcactcatcgtttccatcgaaagtgcgtcgatccctggctcctccaacatcacacatgcccacactgtcggcataatatcatagagcaaaagggaaatccctctgcagtctgtgtcgagacatctaatctctcccgtggacgccaacagcgggtgaccttgcctgtccactacccgggtcgggttcatcggactaatgcaatccctgcttatccaacgcgtaccagcatggattcccacgggaatccagtgacactgttaactatggatcggcacggcgagcagagcctgtatagcccacagacacctgcctatataaggtcctatccccctttacatctggaccactcactggccgctcaccgatgcggcctggagcatagggcttattctccagctcatccttttagaagacccaaactgtccggaagaagtttcagcaaagccgcttgtttttcacagtacgaaaccatgtaccagcactattactttcaaggtctcagctaccccgaacaggagggccagtcccctccatctctggcaccccgaggaccggctagagcgttccccccatccggatcaggctctctgctgtttccaaccgtcgtgcatgtcgctcccccatctcacttggagtccggctccacaagtagcttttcctgttaccacggacatcgcagcgtctgctctggctacctggctgattgcccaggctctgattccagtagttcatcatcttcaggccagtgccactgcagctcaagcgattccgtagtggattgcactgaagtcagcaaccagggggtctacggtagttgcagcacgtttagaagctcccttagctcagactacgatccatttatttacagatcgaggtccccctgcagagcatcagaagctgggggtagcggctcatctggaaggggcccagcgctgtgttttgaaggcagtccacctcctgaggagctgcccgcagtacattcacatggggcagggaggggcgaaccgtggccagggccagccagcccttcaggcgatcaagtttcaacgtgctccctagagatgaattactcgagcaatagtagcctcgaacaccgcggtccaaattcatctacgtcggaggtgggactggaagcatcgccgggtgccgcacccgacttaagacggacctggaagggagggcacgaacttccatcttgtgcttgttgctgtgagccgcaaccaagtcccgcagggccaagcgccggtgccgcaggcagttcaaccctgtttctcggaccacacctctacgaagggtccgggcctgcaggtggagagccccagagcggctcatcccagggactttatggactccacccagatcatctccccaggaccgatggcgtcaagtacgagggtctgccttgctgcttttatgaggaaaagcaggtggctaggggtggaggaggcggatcgggttgctacacagaggattattccgtgtctgttcagtacactctgacagaagaacctccgccaggctgttatcctggggcaagggacctcagccagaggatccccataattcctgaggatgtcgattgcgacttggggttaccctccgactgccagggtacgcatagcctaggcagttggggtggcacccgcggacccgacaccccgagaccacataggggtcttggggctacgcgtgaggaagaacgtgcgctgtgctgtcaagccagagccttgctcaggcctggatgcccgcctgaggaggcgggagccgtgcgcgcaaactttccaagtgccctgcaggacacccaggaatccagtacaacagctacagaagccgctggacccagatctcactctgctgactcttcgagccctggtgcctag

SEQ ID NO: 247112 - DNA, 2511 bp, Artificial Sequence
  Description of Artificial Sequence: Synthetic coding sequence
atgcacccattaggactttgcaacaataatgacgaagaggacctatacgagtatggttgggtgggagtagtcaagctggaacagcccgagttggatccaaagccctgtctcacggtgctcggaaaggccaagagagctgtgcagaggggagcaactgctgtaatctttgacgtgtctgagaatcccgaggcaatagaccaattgaatcagggtagcgaagacccactaaagaggcctgtggtatacgtcaaaggcgctgacgccataaagctgatgaacatcgtcaacaaacagaaagttgctcgggctagaattcaacaccggccaccacgccagccaaccgagtatttcgacatgggaatcttccttgccttttttgttgtggtctccctggtgtgtctgatcctgctcgtgaaaattaagctgaaacagcgtaggtcacaaaatagcatgaatcgactcgccgtgcaggccttggaaaagatggagacaaggaaattcaacagtaaatctaagggaagaagggaaggctcttgtggtgcactggacactctgtcgtcaagcagcactagcgactgcgctatctgcctcgagaagtatatcgacggggaagagctgagagtaattccctgcacacacaggttccacaggaagtgcgtagacccttggctgctgcagcaccatacttgccctcattgtaggcacaatataatcgagcagaaggggaacccatcggccgtgtgcgttgagaccagtaacctgagtcggggacgacagcagagggttaccctgccggtgcattaccctgggagagtgcaccgcacaaacgcaatcccagcctatcctactaggacaagcatggatagccatggaaatcctgttacgttactgaccatggaccgtcatggtgaacagtctttgtatagtccgcagactcctgcatatatacgatcataccccccattgcatctagaccactcactggccgctcacaggtgcgggttagagcaccgggcttactcccctgcccacccctttcgccgacccaaacttagcggcaggtccttctcgaaggcggcatgtttcagccaatatgaaactatgtatcagcattactattttcagggcctgagctaccccgagcaggaagggcagtctcctccaagcctggctccacgtggcccagctagggcgtttcctcctagcgggagcggttctttgctgttccccacggtggtccacgttgcacccccaagccacctggaatcggggtccacttcgagttttagttgttatcatggtcacagaagcgtctgcagcggatatctggcagattgtcccggaagtgatagttcctcttcaagcagttctggtcagtgccactgctctagttccgatagcgtagtggattgtaccgaagtgtccaaccagggggtctacggctcatgctccactttccgaagcagtttgagttccgactatgacccattcatctatcgatcacgttctccttgcagagcgtccgaggctggcggatccggttcaagcggacggggtcccgctttgtgcttcgagggctcccccccacccgaggagctccccgctgtgcactcacatggcgcaggaagaggggagccctggccgggtcccgcaagcccctctggagaccaggtgtccacctgctctcttgaaatgaattactcctcaaactcttctctcgaacaccgtggacctaattcaagcactagcgaggtgggactcgaagccagccccggtgctgccccagacctgcgtcgtacatggaagggaggacatgaactgccctcatgcgcgtgctgctgcgaacctcaaccctcaccagctgggccttccgcaggcgcagctggatcatcgacgctcttcctagggccacacctctatgagggaagtggacctgccggaggcgagccccaatctggctcttcacaaggattgtatggcctgcacccagaccatctacccaggaccgatggcgtaaagtatgaggggttaccgtgttgtttctacgaggaaaagcaggtggccagaggcggaggaggaggaagcggctgctacaccgaagactacagcgtatcagtgcagtacactctgacagaggaacctccgcctggatgctacccgggagcgcgtgaccttagtcaacgtatccctatcatacccgaggatgttgactgcgacctgggacttcccagtgattgccaaggaacccacagtctgggttcttgggggggtacgagaggacctgataccccacgccctcaccggggactgggtgcaacccgggaagaagagcgcgcactgtgttgccaggctcgggctctgctccgtcctgggtgtcctcctgaggaggccggagcagtgcgagctaatttcccatccgctctccaggatactcaagagagtagcaccaccgctaccgaagccgctggccctagaagccattccgccgactcttcaagtcccggagcatag

SEQ ID NO: 247113 - DNA, 2511 bp, Artificial Sequence
  Description of Artificial Sequence: Synthetic coding sequence
atgcatccactggggctgtgcaataacaacgacgaagaagacttgtatgaatatggctgggtcggtgttgtaaagcttgaacaacctgaactcgaccccaaaccgtgcctaactgtgctcgggaaagcaaaacgggcagtgcagagaggtgctacagctgtcattttcgatgtttctgagaaccctgaggccattgatcagctgaaccagggctcagaagatcctctgaagagacctgttgtgtatgtgaaaggagccgatgccatcaagttaatgaatattgttaacaaacagaaagtcgctagagcacggattcaacacagacctcccaggcaacctacggagtatttcgatatgggaattttcttagccttctttgtcgtagtatccctggtatgtcttatcctactggtgaaaatcaaactcaaacaaaggcgctctcagaatagcatgaaccgcctggcagtacaggcactggagaagatggaaacccggaaatttaatagcaagtctaagggaaggcgagagggtagttgtggcgcactggacaccctctcttcctcctccacctccgattgtgcaatctgcctggaaaaatacattgacggtgaagagcttcgagtgattccatgcacacaccgcttccaccggaaatgtgtggacccctggctactgcagcatcatacctgcccccactgcagacacaatatcatcgaacagaaggggaacccctccgctgtatgcgtagaaacttctaacttgtctagaggacggcagcagcgtgtcacactgcccgtccactatcccggtagggttcacaggaccaacgccatacctgcatacccaacaagaacctctatggacagccacggcaaccctgtgactttgcttaccatggacagacacggtgaacagagcctctacagcccacagacgcctgcctacattcgcagctacccacctctccacctggatcatagccttgcggcacatcgttgcggccttgaacaccgcgcatacagtcctgctcatccttttcggagaccgaaattgtctggaagatcctttagcaaggcagcctgttttagccagtatgagactatgtatcagcattactatttccagggactctcctatccagagcaggaagggcagagtccccctagtctggcccctaggggtcctgctagagcttttccgccatctgggtccgggtccctcctctttccaacagtcgtgcacgtcgcacccccttcccatctagaaagcggctccaccagttcatttagctgctatcacggccaccgtagtgtttgttctggatatctcgcggactgtcccggaagcgactcgtcatccagcagcagtagcggacagtgccactgttctagctcggacagtgtcgtggattgtaccgaggtgtccaatcaaggcgtgtatggctcttgtagcacctttcggtcctcattgagttctgactatgacccctttatctaccgctcacgaagcccgtgtcgcgcatctgaggcaggaggttcaggtagctccggcagaggtcccgctttatgcttcgaaggatcaccccctcccgaggagctcccagcggtgcacagccatggagcaggaaggggcgaaccatggcctgggccagcaagtccatcaggcgatcaggtgtcaacctgtagcctggaaatgaattatagcagcaattcttcgctggagcatcggggtccaaattcctccacttccgaggtggggcttgaagcttccccgggtgcagcccctgaccttaggcgcacatggaaaggcggacacgaactccctagctgcgcatgctgttgtgaaccacagccctcacccgctggcccaagtgcaggcgcagctggaagctcaacgctttttctcggcccacatctgtatgagggctccgggccagctggaggggagcctcagagcggatcgtctcaagggttatatggtttacatccagatcacctgcctaggaccgacggtgtcaagtacgaaggactgccttgttgcttttacgaagaaaaacaagtcgctagaggcggagggggtggctctggttgctacacagaagattatagtgtgtctgtccagtataccctgacagaagaacctccccctggatgctatccgggagcaagagacttatcacagaggataccaatcattcctgaggatgtcgattgcgacttaggattaccaagcgattgtcaggggacacattccctgggttcctggggcggtactcgcggacccgacactcccaggccacaccgcggtctcggggcaacacgggaggaagagagggccctctgttgtcaggctagagctttactgcggccaggatgtccacccgaggaagcgggtgccgtgcgcgctaactttccttcggctctccaagacacacaggaatcatctaccaccgccacagaggcagctgggcctcgaagtcattccgcagattcctctagccctggcgcttag

SEQ ID NO: 247114 - DNA, 1932 bp, Artificial Sequence
  Description of Artificial Sequence: Synthetic coding sequence
gttccctcagtatggaggtctactctgatggaaaggtcatgtggctcttcacccgtcctgacaggctttacaggatctgcttggacgcctctcctgcagcatcatacctgccctcactgcagacacaacattattgagcaaaaaggaaacccttccgctgtatgtgtggagacatccaacctgtctagaggaaggcagcagcgggtgacactccctgtgcactacccgggacgggttcaccggactaacgcgattcctgcttatccgactagaacatctatggacagtcacggtaatcccgtaacgcttctgacgatggatcgacacggcgagcaatctctctattctcctcagacacccgcatatattagaagttatcccccactacatcttgaccactcactagccgctcacaggtgtggcctggaacacagagcctacagcccagctcacccctttcgacgcccaaagttgagtggaaggtctttcagtaaggccgcttgcttctctcagtatgagactatgtaccagcattattacttccaggggttgtcataccccgagcaggagggacagtctcccccaagcctggctcctcggggtccggctcgggcttttccgccttcgggtagtgggagccttttgtttcccactgtcgtgcacgtcgcgcctccgtctcatctagagagtgggtccacctctagttttagctgttatcatgggcaccggagcgtatgttcaggatatcttgccgattgtcctggtagtgactcctcctcaagttctagcagtggacagtgccattgcagttcttctgattccgtggtcgactgcacagaagtgtcaaatcagggggtctacggctcttgtagcacgttccgctcttccctatcatctgattatgaccctttcatctatcgctcccggtccccttgtagagccagcgaggccggtggcagtggatcctccggcaggggtccagctctatgcttcgaggggtctccccctcccgaagaactacctgccgtgcatagtcacggtgccggaaggggcgagccgtggcctggacctgctagtcctagcggcgatcaagtatccacctgtagcctggagatgaactactcttcgaatagctcattagagcaccgtggtccaaactcctccacttccgaagtcgggttggaggctagccctggcgctgccccagatctgaggcggacctggaaagggggacacgaattaccaagctgtgcctgctgttgtgagccacagccctcgcccgcaggaccatccgcaggagccgcagggagcagcacactgtttctggggccacatctgtacgagggcagcgggccagctggaggtgagccccagtcaggctctagtcaaggtctttatgggcttcacccagaccacctgcccaggactgacggagtcaagtatgagggcctgccctgttgtttctatgaggaaaagcaagtcgccaggggcggaggaggtgggtctggttgttacacggaagattacagcgtatccgtgcagtatacacttaccgaggagccacccccaggctgttatccaggagccagagatctgagtcagagaatcccgatcattcccgaagacgtggattgcgatttgggtctgccttctgactgccagggcacgcactcactagggagttgggggggaacaaggggccctgatacacctaggccacacaggggtctaggggctacgcgtgaagaggaacgcgcactgtgctgtcaagctcgagccctccttcggcctggctgtccacctgaggaagctggcgcagttcgcgcaaattttccttccgccctccaggacacacaggagtcgagcactacagcgactgaggccgcaggcccaaggagccactccgccgattccagctctcccggtgcctag

SEQ ID NO: 247115 - DNA, 2811 bp, Artificial Sequence
  Description of Artificial Sequence: Synthetic coding sequence
atgcggccacggagtggaggtagacccggtgccactggtaggcgcaggcggaggctgagaagacggccacgcggactgcgatgctcccgtctgcccccaccgccaccattaccattgctgctaggacttctgctagccgcagctggtccgggtgctgctcgcgctaaggaaaccgcattcgtagaggtcgtgctattcgaaagcagcccctctggcgactacactacctatacgactggcctgactggtaggttctcccgagcaggggctactctgtccgctgagggtgagatagtacagatgcatcctttgggcctgtgtaacaacaatgacgaagaagacctgtacgagtacggctgggtcggagtcgtaaagctcgaacaacctgagctcgacccaaagccctgcctcacagtgctgggtaaagccaagagggctgtccaacgcggtgccaccgccgtaattttcgacgtaagcgagaatccagaagcaatcgaccagctgaaccaaggctctgaggaccctctgaagcgccctgttgtctatgtgaaaggggctgacgccataaagctgatgaatatcgtgaacaaacagaaagtggccagagcccgtatccagcacaggcctccaagacagcccactgaatacttcgacatggggatattcctggcgttctttgtagtcgttagcttggtatgtctgatcctcctggtgaaaattaagttaaagcagcgcaggagccagaactcaatgaaccgactggcggtccaggctctcgagaagatggagacgcgtaagttcaatagcaagtccaagggtcgccgtgagggtagctgcggtgccttggacacgctctcctcgtcatcaacttccgattgcgctatttgcctggagaagtatatcgacggcgaggaattgagagttatcccctgtacccatcgcttccacaggaaatgcgtggacccctggcttcttcagcaccacacatgccctcactgcagacataacattatagagcagaaagggaatccttctgcagtatgcgtagagacttctaacctgagccggggtcgacagcagagggtcacactgcctgtgcattaccctggcagagtacataggaccaacgcgatccctgcgtacccaacgaggactagcatggatagtcatgggaacccagtcaccctcttaacaatggatcggcatggcgagcagtcactctattctccgcagaccccagcctatattcgttcctatccacccctgcacctcgatcactctctggccgcacaccggtgtggcttggaacatagagcctattcaccggcacatccctttagaaggcccaaacttagtggccgaagcttcagcaaagcggcatgtttctctcagtacgaaaccatgtaccagcactactactttcagggtctgtcttaccccgagcaggaagggcagtctcccccttccttggccccacggggtcctgctagagcctttcccccaagtggttccggtagtctcctcttccctacagtggtccatgtcgccccaccctcccacctggaatcagggtctacaagcagcttctcatgctaccatggacaccgctctgtctgtagtggatatctcgcagactgcccaggctccgattcatcttctagttcctcaagcggccagtgtcattgcagctcttccgattcggtcgttgattgcaccgaggtgtcaaaccagggggtgtacgggtcttgctccacgtttaggtcgagcctaagtagcgattacgatccattcatctacaggtcgcgcagtccctgcagagcgagtgaggcgggaggctcaggaagctccggacgtggcccagccctttgttttgaaggaagcccccctccagaggaactccctgccgtccattcgcacggggcagggaggggagagccatggcccggacccgcatcaccatcaggggatcaggtgtcaacctgcagcttagaaatgaattacagtagtaactcaagcctggaacaccgcggaccaaatagctccacttccgaggtgggtcttgaagctagcccaggggctgcaccggacctgagaagaacctggaagggaggccacgagctcccttcctgtgcgtgttgttgcgagccacagccgtcccctgccggaccctccgccggtgcagccggatcttcaactctcttcctgggcccacacctctatgaaggaagtggacctgccggaggtgagccgcagagcggctctagtcaggggctctatgggctccatcccgatcatctgccgaggaccgacggcgtgaaatatgaggggctgccttgttgcttctacgaggaaaagcaggtggcccgtggcggtggaggcggaagcggttgctacactgaggattacagtgtcagtgtgcagtacaccctgacggaggaaccaccaccaggatgctatcccggagccagagatttgagccagcggatccctatcattcccgaggacgtcgactgcgacttaggcctgccgtccgattgccaaggcacgcactctcttggttcttgggggggaacaagaggccctgatactcccaggccccataggggcctgggtgctacgagggaagaggagagggcactctgctgtcaggcccgagcgctgttgagacccggttgcccgccagaagaagcaggcgcagtacgagccaatttcccttcagcactccaagacactcaggaaagttctacaacagccactgaagccgcaggcccaagaagtcacagcgcagacagcagctccccaggcgcttag

SEQ ID NO: 247116 - DNA, 339 bp, Artificial Sequence
  Description of Artificial Sequence: Synthetic coding sequence
atgtcttaccccgttacgtcccagcctcaatgtgcaaccactagttgctaccagacccagctgtccgattggcacacaggcctgacagactgctgcaacgacatgcctgtttgtttgtgcgggacattcgcgcctttatgtctggcatgtcggatctccgacgattttggcgagtgttgttgtgcgccatacctgcccggagggctccatagcattagaactggcatgcgcgagcgctaccatatacagggttctgtgggccacgattgggctgccctgacattctgtctgccatgtgcgttatgtcagatggctcgggagctcaagatccgggaatag

SEQ ID NO: 247117 - DNA, 1440 bp, Artificial Sequence
  Description of Artificial Sequence: Synthetic coding sequence
atggccgcattagaaaagatgacgttccctaaaaagatgacattccccgaaaaacccagccacaagaaatatagagccgctctaaaaaaggagaagagaaaaaaacggcgtcaggaactggcacgtcttagagacagtggactgagccaggaggaagaagaggacacttttattgaagaacagcaactggaagaggagaagttactggagcgggaacgcgaacggctccacgaagagtggctgctccgggagcaaaaggcacaggaggaatttagaatcaaaaaggaaaaggaagaagccgctaaaaagtggttggaggagcaggaacgtaagctcaaagagcagtggaaggagcaacagcgcaaggagcgagaagaggaggaacagaaacaacaggagaagaaagaaaaggaggaggccgtacaaaaaatgctcgaccaggcagagaacgacctggagaactcgactacatggcagaaccctgagcctccggtggatttccgggtaatggagaaggacagagctaattgtcctttttactctaagaccggcgcatgccgctttggcgaccggtgctcccgtaagcataacttcccaactagctcccccacccttttgataaaaagcatgttcaccacgtttgggatggaacagtgcagacgggacgattacgatcccgacgcgtcactagaatattccgaagaggaaacatatcagcagtttcttgatttctacgaggacgtgctgcctgaatttaaaaacgtgggaaaagtcattcaattcaaagtctcctgcaacctggagccgcatcttcggggaaacgtgtacgtccaatatcaatccgaagaagagtgtcaggccgctctctctctgttcaatggtaggtggtacgctggccgtcagctgcagtgcgagttttgccctgtgactcggtggaaaatggcaatttgcggcctgttcgagattcaacagtgccctcgagggaaacactgtaactttctccatgtattcagaaaccccaacaatgagttttgggaggccaacagggatatttacctgtcttccgatcagacaggtagcagctttggaaaaaattcagagcggagagagaaaatgggtcatcacgaccactattattctcgccagcgcggtcgccgtaaccccagccctgatcatacgtacaagcgcaacggcgaatctgaacgtaagaaaagcagccataggggcaaaaagtcgcataagaggacttccaaatccagagaaaggcataattccccttcaagaggccgtaaccgtcaccggtcctgggaccagggacgacgctcgcaatcccggcgtagccatcggagtaggtcgcagtctagctctaggtgtcgatccagggggagaaggaagagcggaaaccgcgaccgaacagtccagagtccacagtcaaagtag

SEQ ID NO: 247118 - DNA, 1449 bp, Artificial Sequence
  Description of Artificial Sequence: Synthetic coding sequence
atggcggctcccgaaaagatgaccttccctgaaaagccatcccacaagaaatatcgagccgctctgaaaaaggagaaaagaaagaagcggcgacaggagctggcccgactgagagatagcggactgtctcagaaggaggaagaggaggatacttttattgaggaacagcaacttgaggaagagaagctgttagagcgcgaacggcagcggttgcatgaagagtggctgctccgcgagcagaaggcccaggaagagtttagaattaagaaggagaaggaggaggccgctaagaaacgacaggaggaacaggagcgaaaactgaaggaacagtgggaagagcagcagagaaaagaacgggaagaagaggagcagaagaggcaggagaagaaagaaaaggaggaggcgttacagaaaatgttggaccaagctgagaacgagctggagaacgggactacctggcaaaaccctgagccccctgtggatttccgcgttatggagaaagacagagccaattgtcctttctactccaaaaccggcgcatgccgcttcggtgacagatgttcacgcaagcataatttcccaacctcttctcctacgctgctgatcaaatcgatgttcactactttcgggatggagcaatgtcgtcgggatgactatgaccctgatgccagtctggagtatagcgaggaggaaacctaccagcaatttttagacttctatgaagacgtcctgccagaatttaagaatgttggcaaagtcattcagttcaaggttagttgtaatctcgaaccacatttgcgtggcaatgtgtacgttcagtaccagtctgaagaggagtgccaggctgcgttgagcctgttcaacggcaggtggtacgccggtaggcaactccaatgtgaattttgccctgttacacgctggaaaatggcaatctgcgggcttttcgagattcagcagtgcccaaggggaaagcattgcaacttcctgcacgtctttcgcaaccctaataacgagttctgggaagcgaatagagacatttacctctcaccagatcgcacgggtagttcctttggcaagaactctgagcgtcgggagcggatgggacatcacgatgattactattcacgactgcgtgggaggcgaaatccttccccggatcactcctacaagaggaacggcgagagcgagagaaaaagttctcgccacagaggtaaaaagagccataaacgtacctcaaagtcccgggaacgccacaatagtagatctcgcggtagaaatcgagaccgatctagagatcgcagtcggggacgcggaagcaggtcccgctctcgcagtagatcgcggaggagcaggcgcagtaggtcccaatcttcgagtcggtcaaggagtagaggccgtcgtcgcagtggaaacagggaccggacagtgcagagccccaaatccaagtag

SEQ ID NO: 247119 - DNA, 444 bp, Artificial Sequence
  Description of Artificial Sequence: Synthetic coding sequence
atggctgcacctgaaaagatgacattcccagagaagccttcccataagaaatacagagctgctctgaagaaagagaagaggaaaaaacgtaggcaggaattggcacgcctcagagactccggcttgagtcagaaagaggaggaagaggacacattcattgaagaacagcagctcgaggaagaaaagttgttagaacgggagagattggaatgttccggcgtgatttccgcccatagaaatctgcaccttccgggatcgcacgatagccctgcatctgcatctagggtagccggaataaccgggacacatagacacactcagctaatctttttctgcacgtttagcagagatggcgtaagtccatgctggcctgggtggtctcggtcgctggatctcatgatatgtccgcctaggccccacaaggtgctgagactgcaggtctag

SEQ ID NO: 247120 - DNA, 3438 bp, Artificial Sequence
  Description of Artificial Sequence: Synthetic coding sequence
atgtgtaagtgttgcaatctgttcagtcccaatcagagtgaactgttgtcacacgtctccgaaaagcacatggaggagggagtgaatgtggatgaaatcattattccgctgcgcccactctcgacacctgagcctcccaatagctctaaaacgggggacgaatttcttgtcatgaagaggaagcggggtcgccctaagggctccacaaagaagtcgagcacggaagaggaactggccgagaatatcgtctcccccactgaggactcgccactggcgccagaagaaggcaactccctgccgccttcctcattggagtgtagcaaatgctgccgaaagttctcaaacactcgacagctccgtaagcatatatgcatcatcgttctcaacctcggagaagaagaaggcgaagcagggaacgagtctgatttggaattggagaagaagtgtaaggaggacgaccgtgagaaggctagcaaacgcccacggagccagaaaacggagaaggtgcagaagatttcaggtaaggaggctagacagcttagcggagccaagaagccgatcatcagcgttgttctcacagcccacgaagccatccccggtgcgacaaagattgtcccagtggaagccggacctcccgaaaccggcgctactaacagcgaaaccaccagtgccgacctggtgcctcgtcgcggttaccaggagtacgccattcagcagacaccgtacgaacagcccatgaaatcttcaagactaggtcccacccagcttaaaatatttacctgcgaatattgcaacaaggtctttaaatttaagcatagcctgcaggcccacttaagaattcataccaacgaaaaaccctataagtgtcctcaatgcagctacgcttcggccattaaagccaatcttaatgtgcacctcaggaagcacacaggagaaaagtttgcatgcgattactgctccttcacatgtcttagcaagggccaccttaaggtgcatatcgaaagggtgcacaaaaagattaagcagcactgcaggttctgtaagaaaaagtattctgatgtcaaaaatctgatcaagcacatcagagatgcccacgacccacaggataaaaaggtgaaagaggccctggatgagctgtgcctgatgacccgcgaaggtaagagacagctcctgtacgactgtcatatatgcgagaggaagttcaagaacgaactcgatagggaccggcacatgcttgtacatggggacaaatggccgtttgcttgcgagctttgtggacacggcgcaacaaaatatcaggccttggagctgcacgtgaggaagcatccttttgtgtacgtctgcgccgtatgcagaaagaaatttgtttcctctatcagactgagaacccacattaaagaggtgcacggtgctgctcaagaagcacttgtcttcacgtcttccattaaccagtcattctgtctcctagagccagggggtgacattcagcaggaggcacttggcgatcaattacagctagtggaagaggagtttgcgctgcaaggggtaaatgccctgaaagaagaggcctgccccggtgacacacaattagaagaaggcagaaaggagccagaagctcccggtgaaatgccggctcccgctgtgcacctggcttccccacaggccgaatccactgccttgcccccttgcgagctggagacgacagtggtctcctcatctgatttacacagccaggaggtggtgtctgacgactttctgctcaagaatgatacctcgagcgccgaagcacatgccgcacctgagaaacctccggacatgcagcaccgctcctcagtccaaacccagggagaagtcatcacgctgctgctctctaaagcccagagcgccggaagcgatcaggagtcccacggcgctcagtcacccctgggcgaaggtcaaaatatggccgtactttctgctggcgatccagatccatcccgctgtctcagaagcaatcctgccgaagcgtctgacctgttgccccctgtggccggagggggtgacaccataacccatcagccagattcatgcaaagccgctccggagcataggtcaggtataacggcctttatgaaagtgctgaattctttacagaagaagcagatgaacacaagtttgtgtgaaagaataagaaaggtgtatggtgacctggaatgtgaatactgcggaaagttgttctggtaccaagtccacttcgacatgcatgtgcgcacccacactagagagcacttgtactattgttcgcaatgtcattacagcagtatcaccaaaaattgtttaaaaaggcatgtaatccagaagcattctaacattttactcaaatgccctaccgatggttgtgactacagcacccctgataaatacaagctgcaggctcacctaaaggtgcacaccgcactggacaaaagaagctattcctgccctgtgtgcgagaaatcattcagcgaagaccggcttatcaagagccatatcaagaccaaccaccctgaagtgtccatgtccacaatatcagaggtgcttggtcgccgagttcagctgaagggactgatcggcaaaagagcaatgaaatgcccatattgtgacttctactttatgaagaacggttccgatttgcagcgccacatctgggcccatgagggggtgaaacctttcaagtgttccctctgtgagtacgcaacaagatccaaaagcaatctgaaggctcatatgaaccgccactctacggaaaaaacacacctttgcgacatgtgcggaaagaagttcaaatcaaagggtacactgaagagccacaagcttcttcatacagcggacggcaagcagttcaaatgcactgtgtgcgactacacagccgctcagaagccccagctccttcggcatatggaacagcacgttagcttcaagccctttcggtgtgcgcattgtcattactcttgcaacatctccggcagtcttaaacgccattacaatcgtaagcaccccaatgaggaatatgcaaacgtgggtaccggagagctggctgcagaggtgctgattcagcagggcggacttaaatgccccgtctgctcgttcgtctacgggacaaaatgggagttcaatcggcatttaaagaacaaacatggcttgaaagtcgtcgagatcgacggcgaccccaagtgggaagttacagaagaggaaccatcatctaatcatacggttatgatccaggagactgtacagcaggctagtgtagaactagcagagcagcatcatctggtggtgagcagtgacgacgtcgagggaattgaaactgttacagtgtatacgcaggggggagaagcgagtgagtttatagtgtacgtgcaagaggctatgcagccggtcgaagaacaggctgtcgaacagcctgcccaggagctgtag

SEQ ID NO: 247121 - DNA, 3546 bp, Artificial Sequence
  Description of Artificial Sequence: Synthetic coding sequence
atggaaactagagctgctgaaaacaccgcaatattcatgtgcaaatgttgcaatctgtttagtcctaatcagagcgaactactgtcacacgtgagtgaaaaacacatggaagagggggtaaacgtagatgagatcatcatcccactccggccactgtccactcccgagccacccaacagctccaaaacaggggacgagttcttagtgatgaaaagaaaaagaggcagaccaaagggaagcaccaaaaaatctagcaccgaagaagaactcgcggagaatatagtctcgcctactgaagattccccattggcccctgaggagggcaactctctgcctccatccagcctggagtgcagtaagtgctgcaggaagttctccaatacacgccagttacgcaaacatatctgcatcattgtgctcaatctgggagaagaggagggcgaagcgggagcaaccaagatcgttccagtggaggccggtccgccagagactggcgctaccaatagcgagaccacatccgcagatcttgtcccacgcagaggataccaggaatatgcgattcagcagaccccatatgagcagcccatgaagagtagtagactgggtcctacccaactcaaaatttttacttgcgagtactgcaacaaagtcttcaagtttaagcatagtctgcaagcacatttgcggatacacactaacgagaagccgtacaaatgtcctcagtgttcctacgcctccgccataaaggccaacctgaatgtccacctgcggaaacatactggcgagaagttcgcatgtgattactgtagtttcacatgcctgtctaagggccatcttaaggtgcacatcgagcgggtccacaagaagataaaacagcactgcaggttctgtaagaagaagtactctgatgtgaaaaatttaattaagcatattcgagacgcgcatgaccctcaagacaagaaggtaaaggaggctctcgatgagttgtgtctaatgactagggaagggaaacgtcagcttctgtatgattgccatatctgcgagaggaagtttaagaatgaactggatcgggatcgtcatatgctcgtgcatggcgataagtggcccttcgcctgtgagctgtgcggacacggggctactaaatatcaggcgctggagcttcacgtgaggaagcacccattcgtgtacgtgtgcgcagtgtgccgcaagaagttcgtgtctagtattaggctgcgtacacacattaaggaggtgcacggggctgctcaggaggcgctggtgtttacatcctccatcaatcagtctttttgtttattagaaccaggaggggacatacagcaagaagccctaggtgaccaactgcagcttgtggaggaagaattcgccctgcagggtgtcaatgcgcttaaggaagaggcttgccctggtgacactcagctggaggaggggagaaaggagccagaagcccctggggaaatgcccgctccagctgttcacctcgcctctccacaggcagaaagtacagctctgccaccctgcgagctggaaactacagtggtaagctcttcagaccttcacagtcaggaggtcgtttccgacgatttcctgctgaaaaacgacactagcagcgccgaggcccatgccgctcccgagaagcctccagatatgcagcatcggtcgtccgtgcaaactcagggggaagttatcacgctgctgctgtcaaaggcccagtctgccggatccgatcaggagtcacatggagcccaatcaccactcggggaaggccagaatatggccgtgctttcggccggagatcccgaccctagccggtgcttgcgcagcaatcccgctgaagcctcagatctcctccccccagtggccggaggcggtgacaccatcactcaccagccagactcatgtaaggctgcacccgaacaccgttccggaattactgcattcatgaaggtcctgaattcactccagaagaaacaaatgaacacctctctctgcgaaagaatcagaaaagtatacggtgacctggagtgtgagtactgtggaaagctcttttggtatcaggtccattttgacatgcacgttcgcactcataccagggaacatctctactattgttcccagtgccattactcatccatcactaaaaactgtctgaagagacacgtgatccagaagcacagtaacattctccttaaatgcccaaccgacggatgtgactatagcacgcccgacaagtacaagctccaagctcacttgaaagtgcacaccgccctcgataagaggagctattcctgccccgtatgcgagaagtctttctccgaggatagactcatcaaatcacacatcaaaactaaccacccggaagtatcgatgtctaccatctcggaggtcctgggtagacgagtccaacttaaagggcttatcgggaagcgggcaatgaaatgcccctactgcgatttttatttcatgaagaatggcagtgatctgcagaggcatatctgggcacacgagggagtaaagccatttaagtgttcactttgcgaatatgccacccgctctaagtctaacctaaaggcacacatgaatcgacatagcactgaaaaaacacatctgtgcgacatgtgtgggaagaagttcaaatctaaaggaactcttaagagccacaaactcctgcacaccgcggacggtaaacagttcaagtgtaccgtgtgcgattatacagcggctcagaagccacagctcctgaggcacatggagcagcatgtctctttcaaaccttttcgttgcgcccattgccattacagctgcaatattagcggaagcctgaaacgccattataatcggaaacaccccaatgaagagtatgccaacgtggggacaggggagctggccgcagaagttctcattcagcaggggggactcaaatgtcccgtgtgtagcttcgtgtacggaactaagtgggagttcaacaggcatctgaaaaacaaacacgggctcaaagttgttgagatcgacggagatcccaaatgggaaacagctacggaggcccctgaagaaccatctacacagtacttgcatatcacagaggccgaggaggatgtgcagggcacccaagccgctgtagccgcacttcaagacttacgctacacaagcgaatcaggcgatcgcctagatcccaccgctgtgaatattctacaacagattatcgagttaggggctgagacccatgacgcgaccgccttggcctccgtggtcgctatggctccgggaaccgtgacagtcgtgaagcaggttacagaggaggaaccatctagcaaccacaccgtaatgatacaggaaacggtacagcaggcttcggtggagctggctgagcagcatcacctagttgtcagctctgatgacgtggagggcattgagacagtcacggtctacacacagggaggggaagcctccgagttcatcgtgtatgtgcaggaagcgatgcagcctgtggaggagcaggccgtcgagcagcccgcacaagagctgtag

SEQ ID NO: 247122 - DNA, 177 bp, Artificial Sequence
  Description of Artificial Sequence: Synthetic coding sequence
atggaaactagggcagccggactcctggagttcgccggaggtcctctccacactctcttcgcctgggtatccccagttgaagctgctgagcagcagcgactactgcccgtccccgcttcaggctccttcgtgcctgaaggccacctaccagacgccagtcagtcatcacccgtctag

SEQ ID NO: 247123 - DNA, 1653 bp, Artificial Sequence
  Description of Artificial Sequence: Synthetic coding sequence
atggatctgaccaagatgggtatgatccagctgcagaacccctctcaccccaccggcctactgtgcaaagccaatcaaatgcgcttagccggtacactgtgtgatgtggtaattatggttgattcccaggagtttcatgcccaccggacagtgctcgcatgcacatccaaaatgtttgagatcctgttccacagaaattctcagcactatactctggatttcctgagcccaaaaaccttccagcagatcctggaatatgcttacacagccaccttgcaggcaaaggccgaagatctggacgacctgttgtacgcagcagagattctggagatcgaatacctggaggagcagtgtttaaaaatgcttgagactatccaagcgtccgacgataatgacacggaagcaactatggccgacggaggcgcagaggaggaagaggaccggaaggctcggtatctgaaaaatattttcattagtaaacactcatcagaagaaagtggctatgcctccgtggccggacagtccctgccaggcccaatggttgaccagtctcctagtgtgtccactagcttcggattgagcgcaatgagccccaccaaggcggctgtggattcattgatgaccatcggacagagcttgctgcagggtacattgcagcccccagcagggccagaggaacccactttggctggtggcggacgacaccctggtgtcgcggaggtgaaaacagaaatgatgcaagttgatgaagtaccctcccaggggtttatccagcgagaactcttcagtaaattgggtgagctggcagtcggaatgaagagcgaatcacgtaccataggggaacagtgttccgtgtgcggcgttgaacttccagataatgaggctgttgagcaacatagaaagctgcattctggaatgaagacctacggctgcgagctctgtggcaagagatttctggactcccttaggctgaggatgcacctgcttgctcactcggccggtgctaaagcattcgtttgtgatcagtgcggagcccaattctctaaagaggatgcgcttgagactcacagacaaacacacactgggacggacatggcagtcttctgcttgctgtgtgggaaacgttttcaagctcaaagcgcactccaacagcatatggaggttcacgcaggggttcggagctacatttgttctgaatgcaacaggacctttccctcccacacggcgttgaaaagacatttgcggtcccacaccggcgaccatccctacgagtgtgagttttgtggtagctgttttcgggatgaatcaactctgaagagccacaaaagaattcacactggcgaaaagccctatgagtgtaacggatgcggcaaaaaattctcactaaaacatcagcttgaaacacattaccgcgtgcacactggggaaaagcccttcgaatgcaaactgtgccatcagcgctccagagattattcagccatgattaagcacctcaggacccataacggagcatccccttatcaatgcactatttgtactgaatactgtccatctctttcgagtatgcagaaacacatgaaaggccacaaaccagaagagattcctcctgactggaggatagagaagacctatctttacctatgttacgtatag

SEQ ID NO: 247124 - DNA, 2022 bp, Artificial Sequence
  Description of Artificial Sequence: Synthetic coding sequence
atggacctcacaaagatggggatgattcagctgcagaacccaagtcaccccaccggcttactatgtaaagcaaaccaaatgagactggccggtacgctctgtgatgttgtgataatggtagattcacaggaattccatgctcaccgtacagtcctggcctgcacctctaagatgtttgagatactcttccaccgtaactctcagcactataccctcgacttcttgtccccaaagacttttcagcaaattctggaatatgcttatacagcaacactgcaggccaaggccgaggatctcgacgaccttctgtatgctgccgaaattctcgaaatcgaatatctcgaggaacagtgcctcaagatgctggagacaattcaagcctccgacgacaacgacacagaagctaccatggctgatggcggtgctgaggaggaggaagatcgtaaggccaggtatctaaagaacatattcattagcaaacactccagtgaggagtcggggtatgcgagtgtagccggacagtccctgccaggacccatggttgatcagagtcccagcgtgagtaccagctttggcttatccgccatgtcccctacaaaagccgctgtcgacagcctcatgaccatcggccagtccctgctgcaggggacgcttcagccacctgccggtccagaagagcccaccctggccggaggtgggcgtcaccccggtgtcgctgaggtgaaaaccgagatgatgcaggtggatgaagttccctcccaggattctcccggtgccgctgaaagcagcatctcgggcggtatgggggataaggtggaggagagggggaaagagggccctggtaccccgacccgaagctctgtcataacttccgcacgggagctgcattatggcagagaagagtccgccgaacaggtcccaccacctgccgaggccggtcaggcacccacgggtcggcctgaacatccagcccctccacctgagaagcatcttgggatctactcagtcctgcctaatcacaaggccgacgccgtgctgtctatgcccagcagcgtgactagtggtcttcacgttcaacccgctctagccgtctcgatggacttttccacatacggtggcctcctgccccaaggattcatccaaagggagctgttttccaaattaggagaactggccgtaggcatgaagtccgaatcgcgcacgattggggaacagtgttccgtgtgcggggttgaattgccagataacgaggcagtagaacagcatcgtaagctacacagcggaatgaaaacttatggatgcgagctgtgcgggaagaggttcctcgattcgctccgattgagaatgcatcttctggctcactcagcgggtgcaaaagccttcgtctgcgaccagtgcggagcccagttcagcaaggaggacgcattggaaacacacagacagacccataccggaacagatatggctgtgttttgcctgttatgtggaaagagatttcaagcccagtccgccctgcaacagcatatggaagtgcacgccggagtccgctcctatatttgtagcgagtgtaaccgcacttttccctcccacactgcgctcaaaagacacttaaggtcccacaccggcgatcacccatatgagtgtgaattttgtggcagttgtttccgcgatgagtcaactctgaaaagccacaaaaggatacatactggcgaaaaaccatatgagtgcaacggctgtggcaagaagttcagtttgaagcatcagctcgagactcattatagagttcatacgggagaaaaaccatttgagtgtaaactttgtcaccaacggtcgagggactactcggctatgattaagcatctccggacgcacaatggggcatcaccttatcagtgtacaatttgcactgaatactgccctagcctctcatcaatgcagaagcatatgaagggacataagcccgaagaaattccgcctgactggcgcattgagaaaacttacctgtacctgtgttatgtgtag

SEQ ID NO: 247125 - DNA, 2022 bp, Artificial Sequence
  Description of Artificial Sequence: Synthetic coding sequence
atggatctgacgaagatgggcatgatccaacttcaaaatcccagtcatccaacaggcctgctatgtaaggctaatcagatgaggcttgctggtacactgtgtgatgtggtgatcatggttgattcgcaggagtttcacgcacaccggaccgtcttagcttgcacgtccaagatgttcgaaattctctttcacaggaactcacaacactacacgcttgattttctctccccgaagacgtttcagcaaattttggaatatgcttacacagctaccctccaagctaaggcagaggatctggatgacctgctgtatgctgccgaaattctggaaattgagtatttagaagagcagtgcctgaagatgttggaaaccatccaggcctcagacgacaatgatactgaggctaccatggccgatggaggcgctgaagaggaagaggatagaaaagctcgatacctcaaaaacatctttataagcaaacattcctccgaggaatctggatatgcaagcgttgcaggtcaatcgctgcctgggccaatggtggatcagagcccgtcagtaagcacctctttcgggctgtctgcaatgagcccgacaaaagccgcagtggatagcctcatgacaattggccagagtctgctgcaggggactctgcagcccccagcagggcctgaagagcccacgcttgccggtgggggtcgacaccctggggtggcagaagtcaaaacagaaatgatgcaggttgacgaagttccttctcaggacagtccaggggctgccgaaagctctatatctggtgggatgggagacaaggtagaggagcgagggaaggaggggccaggaacccccacacgctcatccgtgataacgtcggcaagagagctgcactacggacgtgaagagtcagctgaacaggttccccctcctgctgaagctggacaagcccctacgggccgacctgaacatcctgcacccccaccagagaaacaccttggcatctatagcgtcctgccaaaccataaagctgacgcagtcctgtccatgcctagcagcgtcacctccggattacacgttcaaccagcgttggcagtgtctatggactttagtacgtacggtggtcttctgccccagggctttatccaacgggagctgtttagcaaacttggagaactcgccgtggggatgaagagtgaatctcgtaccatcggggagcagtgcagcgtgtgtggggttgaattgccagacaatgaggcagtggagcagcataggaagttacatagtggtatgaagacctacggctgtgagttatgcggaaagcgtttcctcgacagtctgcgcttacgcatgcatctgctggcccatagcgccggtgccaaagcctttgtgtgcgatcaatgcggagcacagttctccaaagaagatgcccttgagacccataggcagacccacaccgggacagacatggcggtcttctgcctgctttgtggtaagagattccaggcccaatccgccctccaacagcacatggaagtccacgccggagtgcgctcctacatttgcagcgagtgtaacagaaccttcccctctcataccgcgttgaagagacacctgcggtcccacacaggggatcacccatacgaatgcgagttttgtgggtcatgtttccgagatgagtcaacgctcaagtcgcacaagaggattcacacaggggagaagccttatgaatgcaatgggtgcgggaaaaagttttcactgaagcaccaattggagacccattaccgggtccacacaggggagaaacctttcgaatgcaaactgtgtcatcagaggtccagagattatagcgcgatgattaagcacctgagaacacacaatggtgcaagcccctaccagtgcaccatttgtaccgaatactgccccagtctctcctcaatgcagaaacatatgaagggacacaagcccgaggaaatccctcctgactggcggattgagaagacttacctgtatctatgctacgtgtag

SEQ ID NO: 247126 - DNA, 447 bp, Artificial Sequence
  Description of Artificial Sequence: Synthetic coding sequence
atggacctcactaagatgggcatgatacagctgcagaatccatcacacccaaccgggttgctttgtaaggccaatcagatgagacttgctggcaccctgtgtgatgtcgtgataatggtagacagccaggagttccatgcacatagaacagtgctggcctgtaccagcaagatgtttgaaattcttttccaccggaatagccagcattacactttggactttctgtccccaaagacttttcagcagattctcgaatacgcatacacggccacactgcaggcgaaagcagaggaccttgacgacctactttacgccgcagagatcttggagatcgagtacctcgaagaacagtgtctcaagatgcttgaaacaatccaggcctcagacgacaacgacactgaagccacaatggctgacggcggtgccgaggaggaggaggaccgatag

SEQ ID NO: 247127 - DNA, 348 bp, Artificial Sequence
  Description of Artificial Sequence: Synthetic coding sequence
atggacctgacaaagatgggcatgatccaattacaaaatcctagccacccaacgggcctactgtgcaaagccaaccagatgaggctggccggaaccttgtgtgacgtagtgattatggtggatagccaggaatttcacgctcatcgtaccgtgctcgcctgcacatcaaaaatgttcgagatcttatttcaccgtaactcccaacattatactttggattttctgtcacccaaaaccttccagcagatcctggaatatgcctacacagccactcttcaggctaaagcagaagacttggatgaccttctatatgctgcagagatactggagatagaatatctagaatag

SEQ ID NO: 247128 - DNA, 723 bp, Artificial Sequence
  Description of Artificial Sequence: Synthetic coding sequence
gaagccctccccgtccgattactcaggcctctcctgttgaggccacacttccaggacgcccctccgggagacccgcgtcacggccagggcgctcaggtgccaaccctgcgccaggaggttcagccaggaaacctgaagaggcatctgaggatccactccggcgagaagccgtatgtgtgcatccattgtcagcggcagttcgccgaccccggagcgctccagaggcatgtgcgcatacatactggagagaaaccttgccagtgcgttatgtgtggtaaagcattcacccaggcctcttcgctaattgcgcatgtacgccagcacaccggcgagaagccatacgtatgcgaaagatgtgggaagcggttcgtgcaatcttctcaactggccaaccatattagacaccacgataacattcggccacacaagtgttctgtttgcagcaaagccttcgtgaatgtgggcgatctaagtaagcacatcattattcacaccggggagaagccctacctgtgtgacaagtgtggacgtggcttcaaccgagttgacaacctccgtagccatgttaaaactgtgcatcaaggtaaggctggcatcaaaatcctcgaacctgaggagggttccgaggtcagtgttgtgaccgtggacgatatggtgactttagccaccgaagccttggctgcgaccgcagtcactcagctcactgtggtgcccgtcggatag

SEQ ID NO: 247129 - DNA, 2433 bp, Artificial Sequence
  Description of Artificial Sequence: Synthetic coding sequence
atggatttcccccagcactcacagcacgtattggagcaacttaatcagcagcggcagctcggtctgctttgtgactgtactttcgtggtggatggggtgcattttaaggcgcacaaggctgtgctagccgcatgcagcgagtactttaaaatgcttttcgttgaccagaaagacgttgtgcatcttgatatctctaatgccgctgggcttggtcaggtgctagagttcatgtatacagcgaagctgtcattgtcaccagagaatgtggacgacgtgctggccgtcgcaaccttcctgcagatgcaagacataattactgcttgtcatgccttgaaatccctggccgaacctgctacttcacctggtgggaacgctgaggctctggctactgagggaggagataaaagggccaaggaagagaaagttgcaacctccaccctcagtcgacttgagcaggctgggagatcaactcctatcggccctagcagagatttgaaggaagagcgcggtgggcaggcgcagagcgctgcgagcggtgccgagcaaactgaaaaggccgatgcgccacgggaaccaccccctgtcgaactgaaacccgaccctacatccggcatggccgctgccgaagccgaagccgctctgtcagagagttccgagcaggagatggaggtcgaacctgcgagaaagggggaggaagaacagaaagagcaggaggaacaggaggaagaaggggcaggccctgcagaggtgaaggaagagggctcccaactggaaaacggcgaagcacccgaggaaaatgagaacgaggagtccgctggaaccgatagtggccaggaactgggttccgaagcccgaggtctgaggagcggcacatatggcgataggaccgaatcaaaagcctacgggagcgtaatacataaatgtgaagattgtggtaaagagttcacacatactggaaactttaagagacacatcagaatccatacaggtgaaaaacctttctcttgcagggagtgttctaaagccttcagtgaccctgctgcctgtaaagcgcatgaaaagactcatagcccacttaaaccatacggctgtgaggagtgcggaaagtcttatcgcttaatttcacttttgaatctgcacaaaaaacggcacagcggggaggcaaggtacagatgcgaggattgcggcaaactctttaccacatccggcaatttgaaacggcaccagcttgtccactctggagagaaaccttatcaatgtgattattgtggacggtcttttagcgatcccacctctaagatgcgccatcttgagactcacgatacagacaaggagcacaagtgtcctcactgcgacaaaaaatttaatcaggtcggaaatctaaaagctcatctgaagatccacatcgcagatggcccactgaaatgcagggagtgtggcaagcagtttacaacctccggcaacctgaaacgccatctgcggattcacagtggcgagaaaccatacgtgtgtatacactgtcagaggcagtttgctgatcccggagctctgcagaggcacgtcagaatccacacgggagaaaagccgtgtcaatgtgtgatgtgtggcaaggcatttacccaggcctcgagcctgatcgcccacgtaagacaacatacaggtgagaagccatacgtctgcgagcgctgcggcaagaggtttgtccagagctctcagttagcaaatcacatccggcatcatgacaatatcagaccgcataagtgctctgtgtgtagcaaggctttcgtaaacgtgggggatctgtcaaaacatatcatcattcacacaggcgagaagccttatctgtgtgacaagtgtggtagggggtttaaccgcgtcgataaccttaggtcccacgtgaaaacagtccatcaaggaaaagccggaataaaaatactggaaccagaagagggcagtgaggtttcagtagtcacagtggacgacatggttacattggccaccgaggctctcgccgctaccgccgttacccaactgacggggccagccaccctgccggctgtggttccagtgggagctgcagtgaccgccgacgaaaccgaggtgttaaaggcagagattagcaaagctgtgaagcaggtacaggaggaggatccaaacactcacatattgtatgcctgtgattcatgtggtgataaattcttggacgcaaactctctggcccagcacgtacggatccacacggcccaggctctcgtgatgttccagaccgatgccgacttttaccagcagtacggccctgggggaacttggccagcaggacaagttctgcaggcgggagagctggtgttcagacccagggacggagcggagggacagccagcgctggcagaaactagccctacagcgcctgaatgcccaccccctgccgagtag

SEQ ID NO: 247130 - DNA, 2412 bp, Artificial Sequence
  Description of Artificial Sequence: Synthetic coding sequence
atggatttcccacagcactctcagcatgtcctggagcagttaaaccagcaaagacaacttggcctcctttgcgactgtactttcgtggtcgacggcgtgcatttcaaggctcataaggcagttctagctgcttgctcggaatacttcaagatgctttttgtggatcagaaggacgtggtgcacctggacatctccaatgctgccggactcgggcaggttcttgagtttatgtatacagcaaagctctctctgtctccggaaaatgtggatgacgtgctcgccgtcgctacttttctccagatgcaagatataattactgcttgtcacgctctgaaatctttggccgaaccagcaacttcgcctggaggtaatgctgaagctctggccacagagggcggagacaaaagagcgaaggaagaaaaggtagccacgtcaaccctcagtcgcctggaacaggctggcagatccacaccgataggaccctcccgcgacctgaaagaggagcggggagggcaggcacagtcagccgctagcggggcagaacagaccgaaaaagccgatgccccacgagaaccaccacctgtcgagctgaaacccgacccgaccagcggcatggctgcggcagaggcagaagctgccctgagcgagtccagcgaacaagagatggaagttgagccagctcggaagggagaagaggaacaaaaggagcaggaggaacaggaagaggaaggcgctggccctgccgaagtgaaagaggaaggcagccagctcgagaatggcgaggcccctgaggaaaacgaaaatgaggagagtgcaggaacagacagcggtcaagagctcgggtccgaggcacgaggtcttaggagcggaacctatggcgatcgaaccgaatctaaggcatacggttccgtgattcacaagtgtgaggactgcggcaaggaattcacacacactgggaattttaaacgacacatccgcatccatacaggcgagaaacctttcagttgcagagaatgttctaaggccttctcggatcccgcagcttgcaaggcccatgaaaaaactcattcacctctaaagccgtacggctgcgaggaatgtgggaagtcctacaggctgattagcctgttaaacttgcacaagaagaggcacagcggagaggctagataccgctgcgaagactgcggcaagctgttcaccacctccggcaatctgaagcggcatcagctggtgcactccggcgagaaaccttatcagtgtgattactgtggcaggtccttttccgatccaacttccaagatgagacacctggaaactcacgacaccgacaaagaacataagtgcccccactgtgataaaaaatttaatcaggtggggaaccttaaggcccacctaaaaatacacatcgccgacgggcctctgaagtgcagggagtgtggaaagcaattcactacatccgggaacttaaagaggcatttgcgaattcattctggagaaaagccatacgtgtgcattcactgccagcgtcaatttgctgaccccggagcacttcagcgccacgttaggatacatacaggggaaaagccatgccagtgcgtgatgtgtggaaaagccttcacccaggccagttctctgatcgcgcatgtacgccaacacaccggcgagaagccttacgtatgtgaacgttgtggcaagcgcttcgtgcagagctcacagctcgcaaaccacatcaggcaccacgataacattcgaccacacaaatgtagtgtctgttccaaggccttcgtcaatgtgggagatcttagcaagcatattataatacacactggggaaaagccatatctgtgtgacaaatgcggcagagggttcaatagggtggacaatctccgctcccatgtcaaaacagtacaccagggaaaggcgggtatcaagattctcgagccagaggagggatcggaagtgagtgtcgtgacagtggatgacatggtaacactggctacagaggcccttgctgcgaccgctgtgacacagttgactgtcgtccccgtgggcgctgcggtgacggccgacgaaaccgaggtgctaaaagcagaaattagcaaggcagttaaacaagtgcaggaagaagaccctaacacacatatactgtacgcatgtgactcatgcggagacaagttcctcgacgcgaacagcttggcccaacacgtgcgaatacacactgcccaggccttggtgatgttccagacggatgctgatttttaccagcagtatggaccagggggaacatggcccgcaggccaagtcctgcaggcaggcgaattagtgtttcggccaagggacggtgcagaggggcagcctgccctagccgagactagccccacagcccctgagtgtccacctcctgcagagtag

SEQ ID NO: 247131 - DNA, 633 bp, Artificial Sequence
  Description of Artificial Sequence: Synthetic coding sequence
tagtctaagcatatcattattcataccggcgagaagccatacctctgcgataagtgcggaagagggtttaatagggtcgataacctccgatcacatgtgaaaaccgtacaccaggggaaggctggcattaagatcttagaacccgaagagggctccgaagtatcagtggtcaccgtggacgacatggtgacgctggccaccgaggccctggcggctacggccgtcacacagcttaccggcccagctaccttgcccgcagttgtccccgttggcgcagccgtgaccgctgacgagaccgaagtgttgaaagctgaaatatccaaggcagtcaagcaggtccaggaagaggacccaaatacccacatactctatgcttgcgactcatgtggtgacaagtttctcgacgctaactcccttgcccagcacgttcgaatccacactgctcaggccctggtgatgttccagacggatgcagatttttaccagcagtatggccctgggggaacatggccagccggacaggtgttgcaggccggagagttggtgttccggcctagggacggagcggaaggacaacccgctctcgccgagacaagccccactgccccagaatgtccaccccctgccgagtag

SEQ ID NO: 247132 - DNA, 726 bp, Artificial Sequence
  Description of Artificial Sequence: Synthetic coding sequence
taagaggctcttcccgttcggttgctgaggccccttctgctgaggccgcacttccaggacgcacctcccggagacccaaggcatggccagggcgctcaggtgcccaccctaaggcaggaggtgcaacctgggaacctaaaaagacacctacgcattcactccggggagaagccctatgtgtgcatccattgccagagacagttcgccgatcccggagctctccagcggcacgtacgcatccatactggggagaagccgtgccagtgtgtgatgtgcggcaaggcctttacacaggcttcatctctgattgcccacgtgaggcagcataccggcgagaaaccttacgtttgtgagcgctgcggtaaacggttcgtccagagtagtcagctggccaatcacattaggcaccacgacaacattagaccccacaaatgctcagtgtgcagcaaagctttcgttaacgtgggcgacctgtcaaaacacatcattatacacaccggggaaaagccatacctatgtgacaagtgtggaagggggtttaatagagtggataacttgaggagccatgtgaagaccgtgcaccagggcaaagccggaattaagatcctggaacccgaagaggggtccgaagtgtctgtggtaacagtagacgatatggtgactctggctactgaggcactggcggctaccgctgttacacagctgaccgtggttcctgtgggctag

SEQ ID NO: 247133 - DNA, 2169 bp, Artificial Sequence
  Description of Artificial Sequence: Synthetic coding sequence
atggattttccacaacactcccagcacgtgctggaacagctgaaccagcagcgacagttgggactactgtgtgattgcacgtttgtggtggacggagtgcacttcaaagctcacaaggctgtgttggcagcttgttctgaatacttcaaaatgctgttcgttgatcagaaggacgtagtgcacctcgacatctccaacgcagccggactgggacaggttttggagtttatgtatacagctaaactgtctctatcccccgagaacgtggacgatgtccttgccgtcgcaccaggcgctgaacagaccgagaaagccgacgctcccagagaacctcctcccgtagagctgaagcccgatcccactagcggcatggctgctgccgaggcggaggccgctttgagcgagagttccgagcaggagatggaggtggagcctgctagaaaaggtgaggaagaacaaaaggagcaggaagagcaggaagaggaaggcgcaggccctgctgaggtgaaggaggaggggtctcagctcgaaaacggcgaagcgcctgaggagaacgagaatgaagaatctgccggaaccgattctggccaggaactgggttcagaagctcggggactgcgcagcgggacatacggcgaccggactgaaagcaaggcctacgggtctgtcattcacaaatgtgaagattgtggaaaagagttcactcacaccggaaattttaaacgccacatccgcatacatactggagagaagcctttttcttgtcgtgagtgctccaaggccttctccgaccctgcggcatgcaaggcccatgagaagacacattccccacttaagccgtatgggtgtgaggagtgtggcaagagctatagattaattagtctgctcaacctacacaaaaagagacattctggagaggcaaggtaccgttgcgaagactgcggtaagctgtttacaacctcagggaatctgaaaaggcaccagcttgtgcatagcggggaaaagccataccagtgcgactactgcgggagatcatttagcgacccgacctcgaagatgcggcacctcgagacccacgatacagacaaggagcataaatgccctcactgtgacaagaagttcaatcaggtcggtaacctcaaggcacacctcaaaatccatatcgccgatggccctctgaagtgcagggagtgtgggaagcagttcacaactagtggtaacctcaaacgacacctcaggatccatagcggcgaaaaaccctatgtgtgtatccattgccagcggcagtttgccgatccaggtgccttgcagaggcatgtccggatccacactggcgagaaaccatgtcaatgcgtgatgtgcgggaaagcgttcacacaggctagtagcctaatagcacacgtccgtcagcacaccggagagaagccttatgtctgcgagaggtgcggtaagcggttcgttcagagctctcagctggcaaatcacataaggcaccacgataacatacggcctcacaagtgttcggtctgttccaaggcattcgtcaacgtaggagatctgagcaaacatatcatcatccacaccggagagaaaccttacctctgcgataagtgcgggagaggcttcaacagggtggacaacctgaggtctcacgtcaagactgtccatcaagggaaggctggtatcaaaatcctggagcctgaagaggggtctgaggtgagcgttgttacggtcgatgatatggtcacactggcaactgaagcgctcgcagcgacggcggtgacacaacttactgtggtgcccgtgggggcagctgtcaccgccgacgaaactgaagtgcttaaagctgaaatctctaaagcagttaagcaggtgcaggaagaagacccaaacactcacattctctacgcatgcgattcttgcggcgataagttcctcgacgctaacagtttggcccaacatgttcgaatccataccgctcaagctctggtgatgtttcagaccgatgccgacttttaccagcaatatggtcccggaggcacatggcccgctggccaggttctgcaagcgggagaattggtattcagacctagggacggcgctgaaggtcagccagctctggccgaaacttctccaaccgcaccagagtgtcccccacctgccgaatag

SEQ ID NO: 247134 - DNA, 1530 bp, Artificial Sequence
  Description of Artificial Sequence: Synthetic coding sequence
atggacttcccccagcactctcagcatgtcctagaacagctgaatcagcaaaggcagttggggctgctttgtgattgtacgttcgtagttgatggcgtccactttaaagctcacaaagctgtgctggcggcatgctccgaatattttaaaatgttatttgtggaccagaaagatgttgtgcacctcgatataagtaatgccgctggcggtgacaagcgggcaaaggaagaaaaggtagctacatcaaccctttccagactggagcaggcaggcagatccacacccatcggaccctctcgcgatttgaaggaggagagaggaggccaggctcagtctgctgcctccggtgccgagcagacagaaaaagctgacgcccctcgcgaaccgccacccgtggagctgaagcccgacccgacatctggaatggctgcagctgaggccgaagccgctctgagcgagtcgtctgagcaggagatggaggtcgagcctgccagaaagggggaggaggaacaaaaggagcaggaggagcaggaggaggagggtgcaggcccagcagaggtgaaggaagagggctcccagctcgaaaacggcgaagcacccgaagagaatgaaaacgaagaatctgccggtactgattctggccaggaattgggctcggaggcgaggggccttcgctcggggacttacggggaccgcactgaatcaaaggcttacggttcagtgatccataagtgcgaggattgtggaaaggagtttacgcacactggcaattttaaacggcatatcaggatccacacaggtgagaagccattcagctgtcgggagtgctctaaggcttttagcgaccccgctgcttgtaaagcccatgaaaagacccactcccctttgaagccatatggttgcgaagagtgtggcaaatcgtaccgcctgataagcctgctcaatttacacaagaagagacactctggtgaggcgaggtaccgctgcgaagattgtggaaagttattcaccacttctggcaacctcaagcgccaccagctggtgcactcaggtgagaagccataccaatgcgattattgcggtcgcagctttagtgatcccacttctaagatgcgtcacttggaaactcacgatactgacaaagagcataagtgtcctcactgcgataagaagttcaatcaggtctgtggtccgctccccgagccggctcctggctcccggaggtggccccagccgcatgcttgccatgtggtgggcagggctggtagtactgccccagcttctcgatccagtagtgcatgctctccacgtaagcaggctcagagggagcctttgcctagaggttcatcaagattgctgtgcggcggacaggctgactctggtcgcggtctggtccttaagaaatggggcggtgctgcatacctcagtccactgggccctgggacatcccctgacccgggagagatcgaacctttcacggaccccggtaagccagagagccaactatttctgtgtggtagaggtcgatag

SEQ ID NO: 247135 - DNA, 2166 bp, Artificial Sequence
  Description of Artificial Sequence: Synthetic coding sequence
atgatgtgttggccctggccactgtcgtccaaatgtcggactagtagcagacccgcaatgccaagttcacacctactgagtcggctccctgcgctgggcgaaatgcgtcgtccctggccacagaaagtgtgccctgttccttcccctggaggggacaagcgtgccaaggaggagaaagtggccacaagcaccctgagtcgcttagagcaggccggacggagtacgcctattggtcctagccgagacctgaaggaagaacgcggtgggcaagctcaaagcgccgcaagcggagctgaacagacagaaaaggccgatgcgcctagagaaccccctccggtggaactgaaaccagatccaaccagcggaatggccgctgccgaggccgaggccgctctgtctgaatcttccgaacaggagatggaggtagagccggctcgaaagggcgaggaggagcagaaagaacaggaggagcaggaggaggagggggcaggacccgctgaggtgaaggaagagggatcacagcttgagaacggggaagcgcctgaggaaaatgagaacgaggaaagtgcaggcaccgactccgggcaggagctagggtctgaagcccgagggttaagaagcggaacatatggcgatcggactgaaagcaaggcttacgggtctgtgatacacaagtgtgaagactgcggcaaggaatttacacatactggaaacttcaaacggcacatacgtatccacacaggagagaagccgttttcttgtagagagtgctccaaagcttttagcgacccagccgcatgcaaggctcacgagaaaactcactctccactgaaaccctacggatgcgaggaatgtgggaagtcataccgccttatctccctgctcaatctacacaagaaacgacactccggcgaagccagatacaggtgtgaggattgcggaaaacttttcaccaccagtggaaacctgaaaagacatcagctagttcattccggagagaagccataccaatgcgattactgcggtcgaagcttctccgatccgaccagtaagatgcggcacctggagacccacgacaccgataaggagcacaagtgtccccactgcgataagaagttcaatcaggtcggaaacttaaaggctcacctgaagatccacattgccgatggccctctgaagtgcagggagtgcgggaaacaatttacaacctctgggaatctgaaacggcacctccggattcattcaggagaaaaaccttatgtgtgcatccattgtcaacggcagtttgctgacccgggagcattgcaacgccacgtgcgaatccacacaggcgagaaaccatgtcagtgcgtcatgtgcggcaaggcattcacacaggcatctagcctcatcgcgcatgtaaggcaacatactggggagaaaccgtatgtgtgcgaacgatgcggcaaaaggtttgtgcagtcatctcagttagccaaccacattagacaccatgataacattcgcccacacaaatgtagtgtgtgctccaaggcgttcgtgaatgtcggcgatttatccaaacatattatcatccacactggagaaaaaccgtatctctgcgataagtgcggccgaggattcaacagagtagataatctcagatctcatgtcaagacagtccatcagggaaaagctggcataaagatactcgagcccgaggagggatcagaagtatccgtcgttaccgtcgacgacatggtcacactcgctacagaagcactcgcagccactgccgtgactcagctgactgtcgtcccagtcggggcagccgtgaccgccgatgagaccgaggtgttgaaagccgagatttcgaaggcagttaagcaggttcaggaggaagatcctaatacccacattttgtacgcctgtgactcttgcggggacaaattcctggacgcaaattcccttgcacagcacgttaggattcacactgcccaggccctggtgatgttccagacagacgcggatttctatcagcaatacgggcctggtgggacttggccagctggacaagtgctgcaggctggggaattggtcttcaggccacgcgatggggctgagggccagcctgctctagccgagaccagccctaccgcacctgagtgtcctcctccagccgaatag

SEQ ID NO: 247136 - DNA, 2007 bp, Artificial Sequence
  Description of Artificial Sequence: Synthetic coding sequence
atgaccgaaagaattcacagtatcaacctccacaactttagcaattcagttctcgaaactctcaacgaacagaggaacagaggccacttctgtgatgtgaccgtccgtatccacgggtctatgctgcgagcccacagatgtgtgctggcagccggatctccattttttcaggataaactgctcctgggatacagtgacattgaaattccttcagtagtctccgtgcagtctgtgcagaagctgatcgatttcatgtattccggggtgcttagagtctctcaaagtgaagccctgcagattctgacagccgcaagcatcctgcagatcaaaaccgtgatcgatgaatgtacccggatcgtcagccaaaatgtaggcgacgtgttccccggaatccaggatagcgggcaggacacccctcgcggtactcccgagtctggcaccagcgggcaatcgagtgatactgaaagtgggtatctgcagagccatcctcagcatagtgtagatcgcatctacagtgcactgtatgcttgcagcatgcagaacgggagcggtgagcgatctttttactccggtgcagtggtctcccaccacgagactgccctgggcctacctcgagaccaccatatggaggatccgagctggattactcgtatccacgaaaggtcacaacaaatggaacgttatttaagcacaacccctgaaactactcattgccgcaaacaaccaagacccgttcgtattcaaactctcgttggcaacatacacattaagcaggagatggaagacgactatgactactacggacagcagcgggtgcaaatactggagaggaatgaaagtgaagagtgcactgaggacactgatcaggccgaagggactgagtctgagcccaaaggagagagttttgatagcggcgtgagttcttctataggtacagagcccgacagtgtcgagcagcagttcggcccaggcgctgctagggactcacaagcagagcctacacaacctgaacaagctgcagaagctcctgctgaggggggtccccaaacgaaccagcttgagactggggcttccagtccagagaggtccaacgaagtggaaatggattctacggtgataacagtaagcaactcttccgataaatccgtgctccaacagccttccgttaatacctccatcggtcagccactgccgtctacccagctttacctccgacagacagaaacactcacgagtaatttgcggatgcctttgaccctcacctccaacacacaggtgattggcaccgccggtaacacatatctgcctgctcttttcacgacccagcccgcagggtctgggccaaaaccattcctgttttctctgcctcagcctcttgcaggacagcagacccagttcgtgactgtgtcacagcctggactgagtacatttacagcgcagctgccggctcctcagcccctcgcatcctccgccggtcactctactgctagtggacaaggcgaaaagaagccttacgaatgtacactctgtaacaagacattcacagcaaagcaaaactatgtgaaacacatgtttgttcataccggtgagaaacctcaccagtgcagcatctgctggaggagtttctcattaaaagattacctgattaaacatatggtgacccacacgggcgttagggcctaccagtgttctatctgtaataaacgctttactcaaaagagcagtttaaacgtacatatgcgcctgcatagaggtgagaagtcatatgaatgttatatctgcaaaaaaaagttctctcacaagactctccttgagcgtcatgttgcgttgcactccgccagcaacgggacgccccctgccggtacccctcccggagcgagggctggacctccaggggtcgttgcttgtacagaaggcaccacttacgtctgtagcgtctgcccggcaaagtttgaccagatcgagcagtttaacgaccacatgaggatgcatgtgagtgacggatag

SEQ ID NO: 247137 - DNA, 2007 bp, Artificial Sequence
  Description of Artificial Sequence: Synthetic coding sequence
atgacggagagaatccattccatcaatctgcacaattttagcaatagcgtgctggagacactcaatgagcagaggaaccgcggacatttttgcgatgtaacggtgcgtatccacggctcaatgctgcgggctcaccggtgcgtcctggctgctggaagccctttcttccaggataaactcctgttgggctattccgatatcgaaataccctccgtagtcagcgtccagtcagtgcagaagctaatcgacttcatgtactcaggcgtcctgcgcgtgtcacagagtgaagcgctgcaaatccttactgctgcatcaattctccagatcaaaaccgtgattgatgagtgtacccggatagtgtctcagaatgtgggggatgtattccccggtatccaggactccggccaggacactcctaggggcaccccagagagcggtacctccggccagtctagcgataccgaaagcgggtatctgcaatcacacccacagcacagtgtcgatcggatttattctgcactgtacgcttgcagtatgcaaaatggcagcggtgagcgctctttctatagcggcgctgtggtctctcatcatgaaactgctctaggcctgcctagggatcaccacatggaggacccctcctggattacgcgcatccacgagcgctcccaacaaatggagcgataccttagtactaccccggaaacgacgcactgtaggaagcaaccaagacctgttagaatccagacactagtgggaaacatccatatcaaacaggaaatggaagacgactacgattactatggacagcagagagtacagattttggaacgcaatgaatccgaagaatgtactgaagatacagatcaggcggaaggcacggaatcagaacccaaaggggaaagtttcgactcaggagttagctcttccatcggcacagaacccgatagcgtggagcagcagttcggacccggtgcggctcgcgacagtcaggctgagccgacccagccagagcaggcggctgaggcacctgctgaggggggtccccaaactaaccagctagagacgggtgctagtagccctgaacgttccaacgaagtcgaaatggactctacagtgatcaccgtatccaactcttcagacaaaagcgtactgcagcagccctccgtgaacaccagtattggacagccacttccaagtacgcaattatatctgaggcagacagagactctcacctctaacctgcggatgccactgaccctgaccagtaatacccaagttattggaaccgctggcaatacttatcttcctgcactcttcaccactcagccagcgggaagtggcccaaagcctttcctgttttccctaccacaacccctagcagggcagcagacacagttcgtaacagtatcacaaccaggattgtcaacgttcactgcacagttacctgctccccagccattggcctcttcagccggtcacagcaccgccagcgggcagggcgaaaagaagccgtacgaatgtacactctgcaacaagaccttcacagcaaaacaaaactacgtgaaacacatgtttgtccacaccggtgagaagcctcaccagtgttccatttgttggagatccttctccctaaaagactatctcatcaagcacatggtgacccataccggggtgcgggcatatcaatgcagcatttgcaataagcggttcacgcaaaaatctagcctgaatgtccacatgaggctgcacagaggtgaaaaatcttacgagtgttacatttgtaaaaaaaaattcagtcacaaaaccctactcgagaggcatgtcgccctgcatagcgcatccaatggaacacctcccgcaggtactccacccggagcacgggcaggcccacctggcgttgtggcttgcaccgaaggcaccacttatgtgtgttccgtctgtcctgccaagtttgaccagatagagcaattcaatgatcacatgaggatgcatgtctctgatggctag

SEQ ID NO: 247138 - DNA, 2007 bp, Artificial Sequence
  Description of Artificial Sequence: Synthetic coding sequence
atgacagagaggatccactccattaatttgcacaatttctccaactctgtcctggaaaccctgaacgaacagaggaataggggccacttctgcgacgtaaccgttaggatccacggtagcatgttgagagcccataggtgcgtgctggcagcaggcagtcctttttttcaggataaactgctgttgggttactctgacattgaaatcccgtctgtagtttccgtccagagcgtgcagaaactgatcgacttcatgtatagcggcgtgttgagggtgtcccagagtgaggccctccagatccttaccgccgcttccatccttcagattaagacagtaattgatgagtgtacgaggatcgtgtctcagaatgttggcgacgtctttccgggaatccaggactccggacaagacacccctcggggaacccccgaatccggaacaagcgggcaaagcagcgatactgagtctggctacttgcagagccaccctcagcactcagtggaccggatctattcagccctgtatgcctgttctatgcagaacggctctggggaacggtcattctactcaggtgccgtcgtaagtcatcacgaaaccgcgttggggttaccaagagatcatcacatggaagatccaagttggattacgaggatacatgaaagatcccagcagatggagagatatttgtcaacaacaccggagacaacgcattgtcgtaagcagcctagacccgtccgtattcagacactcgtggggaacatccacatcaagcaagaaatggaagatgactatgattattacgggcagcagagggtccaaattctcgaacgtaatgagtcagaagaatgcactgaggatacagatcaggcggaaggcaccgagtccgagccgaagggagaatcctttgactcaggtgtctcctctagcatcgggactgaaccagattctgtcgagcagcagtttggccctggggctgcacgggacagccaggctgaaccaacacagcctgaacaggccgctgaggccccagccgaaggcggaccccagaccaaccagctggagacgggggcttctagtcccgaacgtagcaacgaggtagaaatggattcaaccgtcattacagtctctaacagttcagacaaaagtgtcctgcagcagccgtcggtgaacaccagtattggtcaacccctaccctcaactcaactgtacctgcgtcaaaccgaaaccctgactagtaacttaagaatgcctctcacccttacttccaatacacaggtcatcgggacggctggcaacacgtatctgcccgcactgtttactacacagcccgcaggctcaggacctaaaccctttctgtttagcttacctcagcccctggcgggacaacagacccagtttgtcactgtcagccagccaggcctctccacgtttacagcacagctgccagctcctcaacctctagcttcatcggcaggccattcaactgcctcaggtcaaggagagaaaaaaccttatgagtgcacactatgcaacaagacgtttacggctaagcagaattatgtcaaacacatgtttgttcatacaggcgagaagccccatcagtgctctatctgctggcgatccttctccctgaaagactatcttatcaaacatatggttacccatactggcgtgcgcgcataccagtgctcaatctgtaacaaaaggtttactcaaaagtccagcctcaacgttcatatgcggttacaccgcggtgagaagtcttacgagtgctatatatgcaaaaaaaagttcagtcacaaaaccttgctcgaaagacacgttgctctccactccgcctctaatggaacacctcccgcaggtactcccccaggggctcgcgcaggacccccaggagtggtcgcttgtactgaaggtaccacatacgtgtgtagtgtgtgccctgccaaattcgaccagattgagcaatttaatgaccacatgcgcatgcatgtgagcgacggctag

SEQ ID NO: 247139 - DNA, 2007 bp, Artificial Sequence
  Description of Artificial Sequence: Synthetic coding sequence
atgacggagcgcatccactctataaatctccacaacttctcaaactcagtgctagagacactaaatgaacagaggaaccgtgggcacttttgcgatgtgaccgtaaggatccatggctctatgctgagggcacatagatgcgtgctggctgccggtagcccttttttccaggataagttgctgctggggtattctgatatcgagatcccatctgttgtgtcagttcagtctgtacagaaactgattgatttcatgtactctggggttcttcgtgtctctcagtctgaagcacttcaaatactcacggctgcaagcatactgcagattaaaactgtgattgacgagtgtaccagaatcgtgtctcaaaatgtgggcgacgtatttccgggaattcaggattctggacaggacaccccccgtggtacacccgagtcaggcacttcaggtcagtcttccgacaccgagagcggctatctgcagtcgcatccgcagcactccgtggatcgcatttactccgccttatatgcctgctctatgcagaacgggtcgggcgagagatcgttctactctggagcagtggtcagccaccacgaaacagctcttggcttaccccgtgaccaccacatggaggatccgtcctggattacaaggatccacgaaaggagccagcagatggagcgttacctctcaaccaccccggagaccacacattgccgcaagcaaccgcgaccagtgcgcatccagacactcgtcggaaatatacatattaagcaagagatggaagatgactatgattactatggccagcagcgggttcaaatcctggagcgaaacgagagcgaggagtgtaccgaagatacagaccaggcagaaggcacagagtctgagcccaagggggagagttttgattctggggtgtcatcaagcattgggacagagcccgatagcgtcgagcaacagttcggacctggcgctgccagggactctcaggccgaacccactcagcctgaacaggctgccgaggctcctgctgaaggcggaccccagaccaatcagctcgagactggagccagttcacccgaacggagcaacgaggtcgagatggacagcactgttatcaccgtctcaaactccagtgacaaaagcgtgttgcagcaaccctctgttaatacttccatcggacagcccctgccctccacacagctgtacctacgacagacagagaccctaacgagtaaccttcgtatgcccctcacactgacctctaacactcaggtgattgggacagccggtaacacttatctgccggcattgttcactacacagcctgctggcagtggtcccaaacccttcctcttttccctcccacagcctctagctgggcaacaaacacagtttgtcaccgtaagtcagcccggattgtccaccttcaccgcccagttgcctgctccacagcccctggctagctccgccggacacagcacggcgtcgggccagggagagaagaagccttacgagtgtaccctgtgcaacaaaacattcacagctaaacagaattatgtgaagcatatgtttgtccacacaggtgagaagcctcaccagtgttccatttgctggagatcttttagcctcaaggactatctgattaaacatatggtaacacacactggggtaagagcatatcagtgtagcatttgtaacaaaaggttcacccagaaatctagcttaaatgtgcacatgagactccaccggggagaaaagtcctatgagtgctatatctgcaaaaagaagttttcccacaagactctcctcgaaaggcacgttgcgctccattcagctagtaacggcaccccacccgctggaactcccccaggggctagggccggacctccgggagtggtggcctgcacagaagggactacatacgtgtgcagtgtgtgtcctgctaagtttgaccagatcgaacagtttaacgaccacatgcggatgcacgtgtccgacggatag

SEQ ID NO: 247140 - DNA, 174 bp, Artificial Sequence
  Description of Artificial Sequence: Synthetic coding sequence
atgactgaacggattcattccattaacctacacaacttctctaattccgttttggagactttaaacgaacagcgtaatcgagggcacttctgcgacgtgactgtgagaatccatggctcaatgctgagggctcaccgttgtgtgctcgctgccggttcacctttcttccagtag

SEQ ID NO: 247141 - DNA, 2007 bp, Artificial Sequence
  Description of Artificial Sequence: Synthetic coding sequence
atgactgaaagaatccactcaatcaacctgcataacttcagtaacagcgttttagaaactctcaatgagcagagaaatcgcggacatttttgcgacgtgacagtgcgcattcacgggagcatgcttagagctcatagatgcgtcctcgcagctggcagcccctttttccaggataaactgctgctgggttactcggatattgagataccctcagtggtaagcgtacaaagcgtccagaagctgatcgacttcatgtactcgggggttttgagagtgagccaatctgaagctttgcagatcctcactgcagcgtcaattctacagattaaaacagtgattgacgaatgtacgcgcatcgtgtcccaaaatgtgggcgatgtcttccccggaatccaggacagcggccaggacacaccgagggggacacccgagtctggaacatcaggtcagtcatcagatacggagtcaggctacctccagtcacatcctcaacacagtgtagatcggatttatagcgccctttatgcatgctcgatgcagaatggttccggagaaaggagtttctattccggcgctgtcgtgtcacatcacgaaactgcactaggtctgcctagagaccatcacatggaagatcctagttggattacccgcatccacgagagatctcagcagatggagcggtacttgagtactacgcccgaaacaacccactgcaggaagcagcctaggcccgtcaggatccagaccttggtgggcaacattcacattaagcaggaaatggaggatgactatgattattacgggcaacagcgcgtccagatcctggaacggaatgaatccgaggagtgcacagaggataccgatcaagccgaagggaccgagtccgagcctaagggtgagtcttttgacagcggcgtttcctcatcgatcggcacggaaccggacagcgtggagcagcagtttgggccaggggctgctcgagacagccaagctgaaccgacacagcctgagcaagctgccgaggcccctgccgagggtgggccacaaaccaaccaactggagaccggcgctagtagtcccgagcggtctaacgaggtggagatggattctaccgtaattaccgtaagtaacagttccgacaagtcagtgctgcagcaaccttcagtcaacacaagcataggccagccgctcccctccactcagttgtacctccggcagaccgaaactctgacatcaaacttacgaatgcccctgaccctgactagtaacacacaggtcatcgggacggccggaaacacctacctgcctgcattgtttaccacacagcctgctggctcgggcccaaagccatttctattttctttgccccagccactggccggtcagcaaacccagtttgtgaccgtgagtcagccaggcttatctacattcaccgcacagctgccagcccctcagcctctcgcaagctcagctggacatagtaccgcaagcggacagggggaaaagaaaccatatgagtgtaccctgtgtaacaagactttcacagccaaacagaattatgtaaagcacatgttcgtgcataccggggaaaaaccccatcagtgctccatatgctggcggagtttttctttgaaagactatctgattaaacatatggtgacccatacaggtgtgcgggcttaccagtgttcaatctgtaataaaagatttactcagaagagctccctcaacgttcacatgaggctccatagaggcgaaaagtcctacgaatgttatatctgcaaaaagaaattctcccataaaaccctactggagaggcatgtggccctgcacagcgccagtaatggtacgccacccgcaggaacacctcctggagctcgagccggaccccctggcgtcgtagcctgtacagaagggaccacttacgtctgctccgtatgtcctgccaagttcgatcagattgaacagtttaatgatcacatgcgtatgcatgttagcgatggctag

SEQ ID NO: 247142 - DNA, 2226 bp, Artificial Sequence
  Description of Artificial Sequence: Synthetic coding sequence
atgctcgaaaggaagaaaccaaaaacagcggagaatcaaaaggctagtgaggaaaacgagattacccaacccggtggctcctccgccaaaccaggcctgccctgtctaaactttgaggcagtcttatcacccgaccctgctctgattcactcgacccacagcttgaccaatagtcacgcccatactggcagtagtgattgcgatataagctgcaaggggatgacggagcgcatccattccatcaacctgcataacttctccaacagtgtgttggagacattaaatgagcagcggaacagaggacatttctgcgatgtgacagttaggatacacggttctatgctcagggcccaccgttgtgttctggctgccggttccccattctttcaggacaaacttctgctgggttattccgacatcgagattccatctgtggtgagtgtgcaatctgtgcagaaactgatagacttcatgtacagcggcgtactgcgagtttcacagagcgaggccttgcagattctgaccgcagccagtatcctccagattaaaacagttatcgatgagtgtacaagaattgtgagtcagaatgtgggggacgttttccccggaatccaggattcggggcaggacactcctagaggaacccccgagtctggcaccagcggccagtccagcgatactgagagcggatacctacagtcccatcctcagcatagtgtcgacaggatctattccgctctctacgcttgttccatgcaaaacggcagtggagagcggagtttctatagcggggctgtcgtgtcgcaccatgaaacggccttaggactgcccagagatcaccacatggaagacccaagctggattacacgaatccacgagcggtcacagcagatggaacgctatctgtctacgaccccagaaaccacgcattgtcgcaaacagccaagaccagttagaattcaaactctggttgggaacatccacattaaacaggagatggaggacgattacgactactatggccaacagcgcgtgcagatccttgagcgcaacgagagcgaggagtgtactgaagatacagaccaggcagaaggcaccgagagcgagcctaaaggggagtcctttgactccggagtttcttccagcatcggaacagaacctgatagcgtcgagcagcagtttggccctggggcagctcgagattcacaggccgagccaacccagcctgaacaggccgcagaagccccagcagagggcggaccccaaaccaatcaattagagaccggtgcctctagcccggaacggtccaatgaggttgaaatggactcaaccgttatcacggtgagtaactctagtgacaaatccgtccttcaacagccctccgtgaacacctctatagggcagcccttgcccagcacccagctgtacctacgccaaaccgaaactctcacatccaatctccggatgcccctgacgttaactagtaacacccaagtgataggaactgccggtaacacctatctcccggcacttttcactacccagcctgcgggatccgggccaaaacccttcctgttttccttgcctcagcctttggcaggtcagcagacccagttcgtgacagtttcgcaacccggactatctacatttactgctcagctccccgctcctcagcctcttgcctcgtctgctggacacagcaccgcttcaggtcagggagagaagaaaccttatgaatgtacgctctgtaacaaaacttttacagctaagcaaaattatgttaagcacatgtttgtccacaccggcgagaaacctcaccagtgttccatctgttggcgcagtttttcacttaaggattacctcataaaacatatggtcacgcacacaggcgtgcgcgcttaccagtgcagcatctgcaataagcgatttacgcaaaagtcgtctctgaacgtgcacatgcgactgcacaggggggagaagtcttatgagtgttacatttgcaagaagaaattctctcacaaaaccttactggagagacacgtagccctacactctgcaagtaatggaacccctccagccggaactccccctggagcacgtgcaggaccacccggtgtcgtcgcttgtacggaggggaccacctacgtgtgttccgtttgccctgctaagtttgaccagatcgagcagttcaatgatcatatgaggatgcatgtttcagatggttag

SEQ ID NO: 247143 - DNA, 2007 bp, Artificial Sequence
  Description of Artificial Sequence: Synthetic coding sequence
atgactgaaagaatacattctataaacttgcataactttagtaattccgtgttagaaaccctgaacgagcagagaaacagagggcatttctgcgacgtcaccgtgaggatccacggctcaatgctccgggctcaccgctgcgtgctagcagctgggagccctttcttccaggacaaactcctgttgggttactcagatatagagattccatcggtggtcagcgttcagagcgttcaaaagctcatcgatttcatgtacagtggagtgctccgggtatcgcagtccgaggcactgcagattctcacagccgcatcaattctccaaatcaagactgtgatcgatgaatgcactcgtattgtctcccagaacgtgggagatgtgtttccaggaatccaggacagcgggcaggacacgccaaggggcactccagaatccgggacatccgggcaatcctccgatactgagagcggctatctccagtcacaccctcagcattcagttgaccgaatatatagcgccctgtatgcttgctcgatgcaaaatggcagcggggaacgctccttctatagtggggcagtggtttcccatcatgaaaccgccctggggctacccagagaccaccacatggaagatccctcttggatcactagaattcacgaacgctcacagcagatggaacgttacctgagcacgacccctgaaaccacccactgcagaaaacaacccagaccggtgcgaatccaaacgctggtgggaaacattcacataaagcaggaaatggaggatgactacgactactatggacagcagagggtgcagatcctcgagcgcaacgagtctgaggagtgcaccgaggataccgaccaagccgagggcacagagtctgaacctaagggagagagcttcgacagtggtgtgtctagctcaattggcaccgagccagattcagtagagcagcagttcggtcctggggctgcccgtgattctcaggccgagccgacacagcccgagcaggctgccgaagccccagccgaaggtggcccacaaacgaatcaactggagacaggcgcttcaagccccgaaaggagcaatgaagttgaaatggattccaccgtgatcaccgttagcaactcttcagataaaagtgtactgcaacaaccctccgtgaacacctcaatcgggcagcctctcccaagcacacagctgtatcttcgtcagactgagacccttacgagtaatctgaggatgcccctgacactgacctccaatacacaagtgataggtacagccggaaacacctacttgcctgctctattcacaactcagcccgcaggcagtggcccaaagcctttcctgtttagtctgccacagccgttagcaggccagcagacccagtttgtcacagtgagccaaccaggtctctccaccttcactgcacaactgcctgctccacagccgctggcatcttctgctggccactctacggcttctggccagggcgaaaagaagccctatgaatgtactctttgtaataaaacttttacagccaaacagaactacgtgaaacatatgttcgtccacaccggagagaagccacaccagtgctctatctgttggaggagttttagcctcaaggactacctcatcaaacatatggttacccacacaggagtccgcgcataccagtgctccatttgtaacaagagatttacacagaagtccagtttgaatgtgcatatgaggctccaccgtggggagaaaagctatgagtgctacatctgcaagaagaagttttcacataagactttgttagaacgccacgtggcactccacagcgcgtcaaatggcacccctccggcaggcacccctcccggagcacgggctggaccgccaggggttgttgcatgcaccgaaggtaccacttacgtgtgcagcgtttgtccagccaagttcgaccaaatcgaacagtttaatgaccacatgcggatgcacgtgtctgatgggtag

SEQ ID NO: 247144 - DNA, 60 bp, Artificial Sequence
  Description of Artificial Sequence: Synthetic coding sequence
atgttagagaggaagaagcctaagacagccgaaaaccagaaagcgagtgaggaaaattag

SEQ ID NO: 247145 - DNA, 489 bp, Artificial Sequence
  Description of Artificial Sequence: Synthetic coding sequence
atggctgagacagtggccgacacacgcagactgatcactaagccacagaaccttaacgacgcctatgggcctccttccaactttctggagatcgacgtgtccaacccacagacagttggagtgggcaggggacggtttaccacttacgagatccgggtgaagacaaatttgcctatcttcaaattgaaagagtcaactgtgagacgtcggtactccgactttgagtggctaagatctgagctcgagcgcgagtctaaagtcgtggtcccgcctttgccaggaaaagctttccttaggcagctgcccttccggggtgatgatggcatttttgatgataatttcatcgaggagcgcaagcagggtctagaacagttcattaacaaggtggccggacaccccctggcccagaatgagaggtgcctgcatatgtttctacaggatgagatcatcgacaagagctacaccccgtcgaaaatcagacatgcctag

SEQ ID NO: 247146 - DNA, 1308 bp, Artificial Sequence
  Description of Artificial Sequence: Synthetic coding sequence
atggacactgctagtcacagcctcgttctgctgcagcaactgaatatgcaaagagagtttgggtttctgtgcgattgcaccgtagccattggggatgtgtactttaaggcccatagggctgttttagccgcatttagcaactatttcaaaatgatatttatccaccagacgtccgaatgcatcaaaatacagccaaccgacatccagcccgatatcttttcttacctcctgcatattatgtatactggaaagggcccaaaacagattgtggaccattctaggctagaagaagggatccgcttcctacacgcagattatctgtcgcacatcgcaactgaaatgaaccaggttttcagtcctgagactgtccaatcatccaacttgtatggcatacagatttccaccacgcagaagactgtcgttaagcagggcctcgaagtgaaagaggccccaagttctaacagcggtaatcgagcagctgtacaaggagatcaccctcagctgcaactgagcctagccattggactggacgatggtacagctgatcagcaacgagcttgtcctgcaacacaggctctcgaggagcaccaaaaaccacctgtttcgattaagcaggagcggtgcgaccctgagtccgttataagtcagagtcaccctagcccttcttctgaggtgactgggcctacctttacggagaattctgtaaagatacacctgtgtcactattgtggggaacgctttgattccaggagcaatttgcgccagcatctccacacacacgtgtccggaagtctccccttcggtgtgcctgcgagtattctggagagtaacgacctaggcgaggtccatccccttaacgagaatagcgaagccttggagtgtaggcgcctttcctctttcattgtgaaggaaaacgagcagcagcctgaccacactaacaggggcacaacagagcccctccagatatcgcaggtgtcgctcatttcaaaagataccgaacccgtagagcttaactgtaactttagtttttccaggaagagaaaaatgagttgcactatctgcgggcacaaatttcctagaaagtcccagctgctggagcatatgtacacacacaaggggaagtcttatcgttacaataggtgccagcgtttcgggaatgcacttgcgcagaggttccagccctattgtgactcgtggtcggatgtgtctctgaagagtagcaggctgtcccaagagcacctggatctgccctgtgcgctggagtctgagctgacgcaagagaatgtcgataccattctggtggagtag

SEQ ID NO: 247147 - DNA, 1308 bp, Artificial Sequence
  Description of Artificial Sequence: Synthetic coding sequence
atggacactgcttcacatagtctggtgttattgcaacagctcaacatgcagcgcgagttcggttttctctgcgactgcacagtggctatcggtgatgtatatttcaaagcgcaccgggctgtgttggcggcattctcaaactattttaagatgatttttatccaccagaccagcgagtgtataaaaatacagcctactgatatccagcctgacattttcagctatctgcttcatattatgtatacaggcaagggccctaagcaaattgtggaccactctagacttgaggaaggcattcgatttctgcacgccgattacttatctcacattgccaccgagatgaatcaagttttttctccagaaaccgtacagagcagcaatctttacggcatccagatctccactacccagaagactgtggttaaacagggcttggaggtaaaagaagcacctagcagtaactccggcaacagggcagccgtacagggggaccatcctcagctgcagctgagcctcgcaataggtctcgatgacggtaccgctgatcagcaacgagcttgccccgctactcaagcgctggaggaacaccagaaacctccagtatctatcaaacaggagagatgcgacccagagagcgtaatttcccagagccacccctcccccagctctgaggttactggccctactttcacagagaattcagtgaagatccacctgtgtcactattgtggcgaaagatttgactcgcgcagtaaccttaggcagcaccttcacacacacgtatctggcagtttgccctttggcgtccctgcctctatcttagaatccaatgacttaggtgaagtgcaccctctcaatgaaaactctgaagccctggagtgtcgaaggctcagcagctttatagtgaaagagaacgagcagcagccagaccacactaacagaggcaccacggaaccattacagatcagccaagtttcccttatttcgaaggacaccgagcccgttgagctcaactgtaactttagcttcagtcgcaagaggaaaatgtcctgtacgatatgtgggcacaagttcccaagaaaatcccagctcctggaacacatgtatacccataaaggcaaatcttaccgctacaatcgatgccagaggtttggcaatgcgcttgcacaacggttccagccgtactgtgacagttggtcggacgtaagtctgaaatctagcaggttgagtcaggaacatcttgacctgccatgcgcgctagaatcggagctgacccaggagaacgtcgatactattctggtggagtag

SEQ ID NO: 247148 - DNA, 1464 bp, Artificial Sequence
  Description of Artificial Sequence: Synthetic coding sequence
atgtcgctgcctccaattagactcccctccccatacgggtccgataggctggttcaactggccgcacgattaagacctgctctgtgtgacacattaatcaccgtggggagccaggagtttcccgctcattcgctcgtgcttgcgggagttagccaacagctggggagaagaggccaatgggccttgggagaggggatatcaccctccacgtttgcccagcttttgaattttgtgtacggcgaaagcgtagaactgcagcctggagagctgcgtccccttcaggaggcggcacgtgctctgggcgtccagagcctggaggaagcgtgttggagagcccgtggggatcgcgcaaagaagcccgatcctggtctcaagaagcaccaagaggagcctgaaaaaccttcccggaatcctgaacgggagctgggagatcccggagaaaagcagaagcccgagcaagtgtcacggacgggcggacgagaacaggagatgctgcacaaacactctccacccagaggcaggcctgagatggcaggagccacccaggaagcacagcaggagcagacacggagtaaggaaaaaagacttcaagccccagtcggccaaagaggcgctgacgggaaacacggggtgctcacttggctgcgagagaacccaggtggcagcgaagagagcctccgaaaactgcccggacctctccccccagctgggtcgctccagaccagtgtgaccccaagaccatcttgggccgaagcgccatggctggtggggggtcagcccgctctttggtccatcctgcttatgccacctaggtacggtattcctttttaccactctacacccacaaccggcgcatggcaggaggtatggagggagcagcgcatcccactgtccctgaatgctcctaagggcctgtggtcccagaaccagctcgcaagcagttcccccactccagggagcctgcctcagggtccagcccaattgagccccggagaaatggaggagtcagaccagggacacacgggggctcttgccacatgcgccggtcacgaggacaaggcaggatgtcctcccagaccacatccaccaccagccccacctgcaaggtctagaccttacgcatgttcagtgtgcgggaagagattcagcctgaagcaccaaatggaaacacattaccgggtgcataccggagaaaaacctttttcctgctctctttgtcctcagagaagccgggacttctccgctatgacaaagcatctgcgcacacacggagctgccccatataggtgttccctgtgtggagccggttgtcctagcctcgcctccatgcaagcccacatgagagggcactccccctcgcagctgccccctggctggaccattaggtcaacatttctgtattcatcttcacggccatccagaccctccacaagtccttgttgcccctcctcatctacgacttag

SEQ ID NO: 247149 - DNA, 1464 bp, Artificial Sequence
  Description of Artificial Sequence: Synthetic coding sequence
atgagtctccctcctattcgattgccgagcccttatggttcagaccgcctcgtgcagctggcagccagactccgacccgctctgtgtgataccctcattaccgtgggttcccaggagttcccagcacacagcctcgtcctagctggagtctcgcagcagcttggtcgacgaggacagtgggcactcggagaaggcatcagccctagtacattcgcacagctcctcaatttcgtgtatggggaatctgtagaactgcaaccgggagagctaagacccctgcaggaagcggctcgtgcactgggggtgcagagcctggaggaagcctgctggcgcgctcgcggtgatcgcgctaaaaagcctgacccaggactgaaaaaacatcaggaagaaccagaaaaacctagtagaaaccccgagcgcgagcttggcgatccaggggagaagcagaaacccgaacaggtcagtcgaaccggcggaagagagcaggaaatgttgcataaacatagccctcctaggggcagacctgaaatggctggggctactcaagaggcgcagcaggagcagacacgcagcaaggaaaaacgcctgcaagcaccggtcggtcaacggggtgctgacggaaaacacggcgtcttgacttggctgagagagaaccctggagggtccgaagaatcgctgagaaagctgccagggcctctccccccagctggaagtctacagaccagcgtcactccacggccaagctgggctgaagcaccatggttagttggaggccagccggctctgtggtcaatcttgttaatgccgccacgctatggcatcccattttaccacagcacaccaacaaccggcgcatggcaggaggtgtggagggaacagcgcattcctttgagcctgaacgctcctaaaggactatggtcacagaaccaattggcgagtagctccccaacaccaggttcactcccacagggtccagcgcagctcagtccaggcgagatggaagaatctgaccaaggccacacaggcgcactggctacgtgcgcaggccatgaggacaaagccggatgcccaccgaggcctcaccccccacccgcacctcccgcaagatctcggccttatgcgtgcagcgtgtgtgggaagagattcagcttgaagcaccaaatggagacacactatcgagtccataccggtgagaaacccttttcatgcagcctgtgcccacaacgatctagagatttcagcgccatgactaaacatttaaggacccacggagccgctccttacaggtgctccttatgtggggcaggttgtccaagcctggcaagcatgcaagcacacatgaggggccattctccctcgcaacttccacccggttggacaatccggtccacatttctgtactccagctccaggccatcgagaccttccacctctccatgttgtccaagttcatctacgacatag

SEQ ID NO: 247150 - DNA, 2019 bp, Artificial Sequence
  Description of Artificial Sequence: Synthetic coding sequence
atggagtcaagaaagttgatctctgcaaccgacattcagtacagtgggagcctgctgaatagcctgaacgagcagcgaggacacggcctcttctgcgacgtcactgttattgtcgaggataggaaatttcgagctcacaagaatattctatccgccagcagtacttactttcatcaattgttttcagtcgctggacaggtggtggaactgagtttcatacgcgctgaaattttcgctgaaatcctgaattacatctacagcagtaaaatcgtgagggtgaggtccgacctgcttgatgagctgataaaaagtggtcagctcctaggagtcaagttcattgccgagttaggggtccctctgagccaagtgaaaagtataagcggaaccgcgcaggacgggaataccgagcctctgccgcctgatagcggtgataaaaatttagtgattcagaagtccaaggacgaggctcaggataacggtgctaccatcatgcccatcataactgagagcttttcactctctgcagaggattatgagatgaaaaagatcatcgttaccgatagtgacgatgacgacgacgacgtgattttctgtagcgagatcctcccgactaaagaaactctcccgagtaacaacacggttgcccaggtgcagtccaatccagggcctgttgcgattagcgacgtggctccctccgcttctaacaactctcccccactaaccaatatcaccccaacccagaagctgcccacccccgtaaaccaggctaccctttctcaaacacagggctccgagaaactgctggtctcctccgccccaacccacctaacaccgaacatcatcttgctcaaccagacgcctctgtctaccccccctaacgtgagctcctcactgcctaaccatatgccctcttcaattaatttactggtgcagaatcagcagactccgaattcggcaattctgaccgggaacaaggcgaatgaagaagaagaggaggagattatcgacgacgatgatgatacaatctcctctagcccagattctgctgtgtccaatacaagcctggtgccacaggcagacacctcccaaaacactagcttcgacggatcattaatccagaaaatgcaaattcctaccctcttacaggagcctttgtccaattcgcttaaaatctcagacattatcacccgaaatactaacgacccaggtgttggctctaagcacctgatggagggccagaagattataaccttggacactgcaaccgaaattgaaggactgtctacaggctgtaaggtgtatgcaaatatcggtgaggacacgtatgacattgttatccccgtgaaggacgaccccgacgagggcgaagcacgactggaaaacgaaatcccaaaaacatctggttccgagatggctaacaaaagaatgaaagtaaagcacgatgaccactacgaacttatcgtcgatggccgagtgtattacatctgcatagtgtgtaaacggtcctacgtttgtttgacatccctccgacggcattttaacatccattcatgggaaaagaaatacccatgccggtactgtgagaaggtctttcctctggccgagtacaggacgaaacacgaaattcaccacaccggagagcgtaggtaccaatgcttggcatgcggtaaaagcttcattaactatcagttcatgtccagtcacatcaagtccgtgcacagccaggacccttccggcgattcaaagttgtaccgcctccacccctgtaggagccttcaaatacgccagtacgcatacctgagcgaccggtcatccaccatccccgctatgaaggatgatggaattggttacaaagtggacactggcaaggaaccgcctgttgggacgaccacatccactcagaataagcctatgacatgggaggacatcttcatacagcaagagaacgattccatatttaaacaaaatgtgacggacgggtcaaccgaattcgagtttattattcccgagtcttattag

SEQ ID NO: 247151 - DNA, 2019 bp, Artificial Sequence
  Description of Artificial Sequence: Synthetic coding sequence
atggagtcccgaaaactcatcagcgcaacagatattcaatactccggaagtctgttgaactcactgaacgagcagcgaggtcatggactgttttgcgacgtgacagtgatcgtcgaagatcggaagtttcgcgctcacaagaacatcctcagcgcttctagcacgtatttccatcaattgtttagtgtcgctgggcaggttgtggagttgagtttcattcgggctgagatcttcgccgagatcctcaattatatatacagctccaaaatcgtgcgcgtgaggagtgatctcctggacgaattgattaaaagcgggcagctgctgggtgtcaaattcatcgcagaactcggggtgcctctttcgcaggtgaagagcatttcaggaaccgcccaggacggtaatactgagccactacccccagacagcggagacaagaatctagttatccaaaaatcaaaagatgaggcacaggacaacggggctaccatcatgcctattatcactgaatcattcagtctgagcgctgaagactacgaaatgaagaagatcatcgtgacagactccgacgacgacgatgatgacgtgattttctgttctgagattcttccgaccaaggaaacgttgccctccaacaataccgtggctcaggtacaaagcaatcccggtccagttgccatttcagatgtggctccttcagccagcaacaactccccacctttgacgaacattacacctactcagaaactcccgacccctgtaaaccaagccacactgtcacaaactcagggttcggagaagctcctcgtgtctagtgcccctacccacctgaccccaaatatcatcctcctgaaccagacaccattaagcaccccaccaaacgtgagctcctccctaccgaatcacatgccctcgtctattaacctactggtgcaaaatcagcagactccaaattccgctattctgaccggcaacaaagcaaacgaggaggaggaagaggagattatcgatgacgatgacgataccatcagttcctcccccgatagcgctgtcagtaatacctcactcgtcccgcaggcagacacatcccaaaatacctcttttgatggatcattaattcagaaaatgcagatccctaccctgctgcaggagccactgtccaattcccttaaaatttcagacataatcacgcggaacaccaatgatccaggtgtcgggtccaagcacctcatggaagggcagaagattataacgctcgatacagcaacggagattgaaggcctaagcacaggttgtaaggtgtatgcaaatatcggcgaagatacttacgatatcgttatccctgttaaagacgacccagatgaaggagaagccagactagagaatgagatcccgaagacgtctgggtccgaaatggctaataagcgaatgaaggtgaagcatgatgaccattatgaattgatagtcgacggccgagtttattacatctgcatcgtgtgcaagcgctcatatgtttgtctgacatcgctgagaagacattttaacatacatagctgggagaagaagtatccctgcaggtactgcgagaaagtgtttccgctcgcggaatacaggacaaagcatgagatccatcacacaggcgagagaagatatcagtgtctggcctgtggaaaatctttcattaattatcaattcatgtcaagccacattaagtccgtgcattcgcaggatcccagcggagatagcaagttatatagactgcacccctgccgatccctgcagataaggcagtatgcttatctgagcgatcgtagctctactatccctgccatgaaggacgacggcattgggtataaggtcgatactgggaaagagcccccagtcggaactactacatctacccaaaataaacccatgacatgggaagatatcttcatacaacaggagaacgacagcatcttcaaacagaatgtgactgacgggagtacagagttcgaattcatcatcccagaaagctattag

SEQ ID NO: 247152 - DNA, 2019 bp, Artificial Sequence
  Description of Artificial Sequence: Synthetic coding sequence
atggagagccgtaaactgatttcagccacagacattcagtactcgggcagcctcctaaactctctcaacgagcaacggggtcatgggcttttttgtgacgtgaccgttattgtggaggataggaaattccgcgcacataagaacatactgtctgccagctccacatactttcatcagttattctcagtggccggtcaggtggtcgaattgagctttatccgggcagaaatctttgccgaaattctgaactacatttatagctccaagattgtgagggtgcgatctgatttactggacgaattgatcaaatctggccaattactgggagtgaaatttattgccgagcttggggtaccgctaagccaagtgaaatctatttcagggacagcccaagacggcaacactgagcctttacctcccgacagcggtgataaaaacctggtgattcagaagtcaaaggatgaagcccaggacaacggagccaccatcatgcctattattacagagagtttctctctctctgcggaggactatgaaatgaagaaaattattgtcacagactccgacgatgatgacgatgatgtgatcttctgttccgagatccttcccacaaaagagacattgccatccaataataccgtggcacaggtgcaatcgaatcctggaccagtggccattagcgacgtggccccatccgcctctaataattcccccccactgaccaacataaccccgacccaaaagcttcccacccccgtgaatcaagcaaccctttctcagacccagggaagcgagaagcttctggtcagctcagccccaactcacctcacacctaacatcatcctgctgaatcagacaccgctcagcacccccccaaacgtgtcttcttctttgcccaaccatatgccctcctctattaatctgctggtgcagaatcagcagacccccaattctgcaatcttgaccggaaacaaggcaaacgaggaggaggaggaagagattatagatgatgatgacgatacaatttcctcctcccctgatagtgctgtgtccaatacaagtctcgtccctcaggccgacacttcacaaaatacctcatttgacggctcgcttatacagaaaatgcagatcccgactctactgcaggagcccctgtctaatagcttaaagatttccgacatcataacacggaacacaaacgaccccggagtgggttccaagcacctgatggagggtcagaaaattatcacactcgataccgctactgagattgagggactgtccaccggctgcaaagtttacgcaaacattggtgaagatacatacgatatagttatcccggttaaagatgacccggacgagggagaggcgagactggaaaacgagatacccaagacgagcggctccgagatggcgaacaagcgaatgaaggttaagcacgatgaccattacgagctgattgttgacgggagagtgtactacatttgtatagtgtgcaagcggagctacgtgtgcctcacaagtctccgacgtcattttaacatccacagctgggagaagaaatacccctgcagatactgtgagaaagtgtttcctctggcagagtacagaaccaagcacgaaattcaccatacaggggagcgcaggtatcagtgcctcgcgtgtggtaagtcatttataaactatcagtttatgagtagtcatataaagtccgttcattctcaagatccttccggcgacagcaagctttatcgtttacacccttgtagatctctgcagattaggcagtatgcctatttgtccgacagatccagcaccattccagctatgaaagatgacggaatcggttacaaagtggatactggtaaagagcccccagtgggcaccacaacttccacccaaaataagcccatgacctgggaggatatcttcatccagcaggaaaacgactccattttcaaacagaacgtgaccgacggctcgactgagttcgagtttatcattcctgaatcctactag

SEQ ID NO: 247153 - DNA, 1515 bp, Artificial Sequence
  Description of Artificial Sequence: Synthetic coding sequence
atgagtgttgagatggattcatcatcgttcatccagttcgacgtgccagagtacagctcgactgtgctttctcagctgaacgagctgaggctgcagggtaagttgtgtgacattattgtgcacattcagggtcagccctttcgcgcacacaaggcagtactcgccgcttcttccccctacttcagagaccatagcgcactgtccacgatgtccgggttgtcaatttcggttataaaaaaccccaatgtgttcgagcaattgctgtcgttctgctacaccgggaggatgtctctccagctgaaagatgtggttagttttctcactgccgcatctttcctgcagatgcagtgtgttattgacaagtgcactcagattctggagtccatccactcaaaaatttcagtcggcgacgtagatagtgtgaccgttggtgcagaggagaatccggagtctcgcaacggagtcaaagattcctcgtttttcgccaatcccgtggagatttctcccccatattgctctcaggggcgtcagcccacggcctcttccgatctgaggatggagacgaccccatctaaggctctccgctcccgtcttcaggaggaaggacactccgaccgcggtagtagtggcagtgtaagcgagtatgagattcagatagaaggggatcacgagcagggtgacctgctggtgcgagagagccaaattaccgaggtaaaagttaaaatggaaaagtccgacagaccaagctgcagtgattcctccagcttgggagatgacgggtaccacaccgagatggtggacggggaacaagtggtggctgtgaatgttgggtcctacgggagcgttctccaacacgcttattcatactctcaggcagcgagccagcccactaatgtctccgaggcctttgggtccctctcaaactccagcccatcccgcagcatgctcagttgtttccggggtggcagggctcggcaaaagcgggctctgagtgtacatcttcactccgacctgcaaggactggtgcaggggagcgactccgaagcgatgatgaacaaccctggatatgagagctccccccgtgaaagatccgcacgcggtcactggtacccttacaacgagaggctcatttgtatttactgcggtaagagcttcaatcagaagggctctctagatagacatatgcgtttacatatggggatcacccccttcgtgtgtaaattctgtgggaaaaagtatacgaggaaagaccagctggagtaccatatccggggacatacagatgacaaacctttccgatgcgaaatctgcggaaagtgcttccctttccagggcacgctcaaccaacacttgagaaagaatcaccctggagtagcagaggtccgttcaaggatcgagtccccggaacggactgatgtgtatgtggagcagaaactcgagaatgacgcaagtgcttccgagatggggcttgattccaggatggaaattcataccgtaagcgatgcacctgactag

SEQ ID NO: 247154 - DNA, 1503 bp, Artificial Sequence
  Description of Artificial Sequence: Synthetic coding sequence
atggactcttcctcatttatccagttcgatgtgcccgaatactctagcaccgttttgagtcaacttaatgagctccggcttcaagggaagttatgtgatattattgtccacattcaaggtcagccattcagggcgcacaaggcggtgctggctgccagctcaccctattttcgcgaccacagcgcgctgtcgactatgtctgggctttcgattagcgtcataaagaatccaaatgtgttcgaacagctgctgagtttttgctatacagggaggatgtctctgcaactgaaggatgttgtaagcttcctcaccgccgcttctttcctgcagatgcagtgcgtgatcgacaagtgcacccaaattctggagagtatccactctaaaatctcagtaggagacgtggatagcgtgaccgtcggtgccgaagagaatcctgagtcccgtaacggcgtcaaagacagttctttttttgccaacccagtcgaaatctctccaccatactgcagccagggacgacagcccaccgcctcctcagatcttcggatggagacaacacctagcaaggccttgcggagcaggctgcaggaagaaggacactccgatcgcggtagtagtggctctgtgtcagaatacgagatccagatcgagggcgaccatgagcagggcgatcttctggtgcgagaatcccagattaccgaagttaaggtcaaaatggagaaaagtgatcgtccatcatgctccgacagttctagcctgggagatgatggttatcacaccgagatggtagatggagaacaagttgtggcagtcaacgtgggcagctatggttctgttctgcagcacgcatacagctatagtcaggccgcatctcaaccgaccaacgtctctgaagcatttgggagcctgtctaacagttcccctagtcggagcatgctgagttgttttagaggtggtcgtgcccgacagaaacgcgcactgtctgtacacctccattctgatttgcaaggactggttcagggcagtgacagcgaggctatgatgaataatccgggatacgagtcctcacccagagagcgctctgcacggggacattggtacccttacaacgaaaggctgatttgcatatattgcgggaaatcgttcaaccagaaaggatccctcgaccggcacatgagactccacatgggtattaccccattcgtgtgcaaattttgcggcaagaaatacaccaggaaagatcagctagaataccacatcagaggccacactgacgataagccatttcgctgcgagatatgtgggaagtgcttcccatttcagggaaccctgaatcagcatctacggaaaaaccatcctggcgtggccgaggtcagatcaaggattgagtcacccgaacgcaccgatgtgtacgtggaacagaagcttgagaatgatgcttccgcatctgaaatgggtctggacagtaggatggaaatacatactgtctctgatgcaccggactag

SEQ ID NO: 247155 - DNA, 3591 bp, Artificial Sequence
  Description of Artificial Sequence: Synthetic coding sequence
atgatgacagttatgagtttaagccgggacttaaaggacgactttcacagcgacacagtgctgtcaattttgaatgagcaacgaattcgaggaatcctctgtgatgtgaccattattgtggaagacacaaagtttaaagctcactcaaatgtgctggcggcttcatccctgtacttcaagaatatattctggagccacacaatctgcatctctagccatgtgcttgaattggacgacttgaaagccgaggtatttactgagatcctaaactatatctatagctcaacagtcgtggtaaaacgacaagaaaccgtaacagacctcgcagctgccggtaagaagctcggcattagcttcctcgaggacttgaccgaccgcaatttctccaactctcccggaccatacgttttctgtatcactgagaagggagtcgtcaaggaagaaaaaaacgagaagaggcatgaggagccagccatcacaaatggccctcggatcacgaatgctttttcaataatagagaccgaaaactcaaataatatgttctccccgctggacctgcgcgcttcttttaagaaggtctccgactctatgagaaccgcaagtctctgtctcgagcgcaccgacgtgtgtcacgaggccgaacctgtcagaactctggcggaacatagttatgcagtgagctctgtggctgaggcttaccgcagtcagccggtcagggagcatgacgggagcagtcccggtaataccggtaaagaaaattgtgaagcgcttgccgcaaagcccaagacatgtagaaaacctaaaaccttctccattccccaagactccgactccgctacagaaaatatacctcctccacccgtgagtaacctggaggtgaatcaagagcggtcccctcagcccgctgcggtgcttacaagaagtaaatcacctaataacgaaggagacgtccacttcagccgggaagatgagaaccagagttccgacgttccaggtcctcccgctgctgaagtccctcccctggtctacaattgttcatgttgctcaaaagctttcgattcctcgacactgctatcggctcacatgcaactccataaaccaacccaagagcctctcgtctgcaagtattgcaataagcagtttaccactttgaacagactcgaccgccacgaacaaatttgtatgagatcttcccatatgcctatcccaggtgggaatcagaggttcttggagaattatccaacaattgggcaaaacggaggctcctttaccggtcccgaaccgcttctttcagaaaacaggattggggagtttagctctaccggcagcactttgccagataccgatcacatggtaaaatttgtgaatgggcaaatgctttactcctgtgtggtgtgtaagcgttcctatgtcactcttagcagcctgagaaggcacgccaatgtccatagctggaggcgaacttatccatgccactattgtaataaggtgtttgctctggctgaatatcggactagacatgaaatctggcacaccggggaaagaaggtatcagtgtatcttttgtcttgaaacatttatgacttactatatactgaagaatcaccagaagagcttccatgcaatcgatcacagattatctatatccaagaaaacagccaacggaggactgaagccttcggtgtacccctataagctttaccgcctcctgccaatgaagtgtaaaagggccccttataagagctataggaacagctcctatgaaaacgccagggagaatagccaaatgaatgagagtgcgcctggaacgtacgtggttcagaatcctcatagctctgaactcccaacactgaacttccaagatactgttaacaccttaaccaattcgccagccatcccgctggaaacaagcgcctgtcaagatattcctaccagtgccaatgtccaaaacgccgaggggactaagtggggcgaggaggccttaaagatggacctggataacaatttttatagcactgaggtctccgttagtagtacagagaacgcggtcagctcagacctccgagctggcgatgtacctgtgctcagcctcagcaactctagcgagaacgcggcaagcgttatctcctactcaggatctgccccatccgtgattgtgcattcttcacagttcagctctgtgattatgcacagcaatgccattgctgctatgacttcctccaatcacagggctttttctgatcccgcagtctcccagtctctcaaagatgactcgaagcccgagcccgacaaggtaggacgcttcgcatcaaggccaaaatctataaaagagaagaaaaagaccactagtcacaccaggggcgaaatcccagaagaaagtaattatgtcgctgatcctggcggatccctctccaagactaccaacatcgctgaagagacatctaagatagagacctatatcgccaaacccgctctccctggcacatcaaccaattcaaatgtggcacccttgtgccagatcacggttaagatcggcaatgaggctatcgtgaagaggcacatcttgggaagcaaattgttctacaagaggggtcggaggcctaagtaccagatgcaggaagagcctctgccacaggggaatgaccccgagcccagcggtgatagtccactgggcctttgccaatctgagtgtatggagatgagtgaagtgtttgatgacgctagcgatcaagactccacagataagccctggaggccttattacaattacaagcccaagaagaaaagtagacagctgaagaagatgagaaaagttaactggcgcaaggagcacggcaacaggtctcccagccacaaatgcaaatacccggctgaactggattgtgctgtcggaaaggcaccccaggacaaacccttcgaagaggaggaaacaaaagagatgcctaagcttcagtgtgagctgtgcgacggagacaaagctgtaggcgctgggaaccaaggaaggccacatcgccacctcactagccggccatatgcctgtgaattgtgcgccaaacagtttcagtcccccagcaccctcaagatgcacatgcgttgtcacactggagagaaaccttaccagtgtaaaacctgtggaaggtgcttctccgtccaggggaatttgcagaagcatgagagaatacatctgggactcaaagagttcgtgtgtcaatattgcaataaagccttcacactgaacgaaacattgaagatacacgaaagaattcatacgggagagaaaagataccattgtcagttttgtttccagcgttttctctatctcagcaccaaaagaaatcatgagcagcgccatatccgagagcacaatggcaaggggtatgcttgcttccagtgccccaaaatctgcaagaccgcagctgcgctcgggatgcaccaaaaaaagcacttattcaagagcccaagccagcaggagaagatcggtgacgtttgccacgaaaatagcaatcctctagaaaatcagcacttcattggaagtgaagacaacgatcagaaagacaatatccaaactggggtcgagaatgttgtcctatag

SEQ ID NO: 247156 - DNA, 3588 bp, Artificial Sequence
  Description of Artificial Sequence: Synthetic coding sequence
atgaccgtcatgagtctgtcacgggaccttaaggacgacttccactcagacaccgtgctctctatcctcaacgagcagagaatccgcggaatactgtgcgacgtgaccatcattgtcgaggacacaaagtttaaagcacactctaatgttttagccgcatcttccctatatttcaagaatatattttggtctcacactatctgtatatcaagccacgtcctggagttggatgacctcaaggcagaggtgttcaccgagattctgaattacatttattcctccaccgtcgtggtgaaaaggcaggaaaccgttaccgacctcgccgcagccggtaagaagcttggtatcagcttcctggaggacctcacagatcggaacttctccaactcgccaggaccatatgtattttgtataaccgaaaaaggcgtcgtgaaggaagaaaaaaacgagaagaggcatgaagagccagctataaccaatggacctagaattactaacgcgttctccatcatagagactgaaaacagtaacaacatgttctctccccttgatctgagggcatcttttaaaaaagtgtccgattccatgaggaccgccagcttatgtttggagcggacggacgtgtgccacgaggccgaaccagtgcggacactggctgaacattcgtacgctgtgtcatctgtcgccgaggcatacagatcacagccagtccgggaacatgatgggtctagtcccggtaacactgggaaagaaaattgtgaggccttggccgctaaaccaaagacatgtagaaaaccgaagactttcagcattccgcaggattccgactccgctacagaaaacattccgcctccaccagtgtccaatttagaagttaatcaggaaagatccccccagcccgcagccgtgctgactcggtccaagagtcctaataatgagggagatgtccatttctcccgggaggatgaaaaccagagttcagatgtgcctgggccaccagccgctgaggttccaccactcgtgtacaactgctcctgttgttcgaaagcttttgattcctcaaccctactgtctgctcacatgcagctccacaaacctactcaggaaccactggtgtgcaaatactgtaacaagcaattcacaactttgaaccggcttgaccggcatgagcagatttgcatgaggagctcacatatgcctattccgggaggcaatcagcggtttctcgagaactacccaacaatcgggcagaatggcggatctttcactggccctgagcccctgcttagtgagaataggatcggagagttctcctcaactggcagtaccctgcccgacacagatcatatggtgaagtttgtgaatggccagatgctgtatagttgcgtggtctgcaaaaggtcctatgttaccctgtccagcctccggcgtcatgccaacgtgcacagttggcgccgtacgtatccctgccattactgcaataaagttttcgctctggccgagtatcggacaaggcatgaaatttggcatactggcgagcggagatatcaatgtattttctgtctggagacattcatgacttattacatcctgaagaatcaccagaaaagctttcacgcaattgaccaccgcttgagtatttccaaaaagacggccaatgggggattgaagccctccgtatatccttacaaattgtatcgactgttgccaatgaaatgtaagcgcgcaccatataagagttacagaaattccagctatgagaacgctagagaaaacagccaaatgaacgagagcgccccagggacatatgtggtccagaatccccattccagcgagcttccgactcttaacttccaggacaccgtcaataccctgaccaattcccccgcaatccccttggagacatccgcttgccaggacattcctacgagcgcaaatgtccagaacgccgagggcacaaaatggggtgaggaggccctgaaaatggacctcgataataatttctattccacggaggtgtcagttagttcaactgagaatgcagtgagtagtgatttacgcgcaggcgacgtgcccgtcctcagcttgtcgaacagctccgaaaatgccgcttcggttatctcatactcaggatccgctccctctgttattgtccattcgagtcagttcagttcagtgataatgcactcaaatgctatagcagcgatgacaagttccaatcacagagccttctccgaccctgccgtgtctcagtcactgaaagacgacagcaagcccgagcccgataaggtcggcaggttcgccagtcgccctaagagcatcaaggaaaaaaagaagacgacctcccatacacgcggagaaattcctgaagaatcaaactacgtcgccgacccgggtggctccctgtctaagaccactaatatcgctgaggagacctcaaagattgagacgtatatagccaagccagccctgccagggactagtacaaattccaatgtcgctcctctttgtcaaatcacggtgaaaatcggaaacgaggcaattgtcaagcgccacatcctagggtccaaactcttttataagcggggacgtcgccctaagtaccagatgcaagaggaacctctgcctcaaggcaatgatcccgaaccttctggagattccccactgggcctgtgccagagcgaatgcatggagatgagcgaagtgtttgacgatgcctcagaccaggattcaacagataaaccctggcgtccttattataattacaaaccaaagaagaaatcgagacagcttaagaaaatgcgaaaagtcaattggcggaaggagcacgggaaccggagcccaagccacaagtgtaaataccctgccgaactggattgtgcagtcgggaaagcccctcaggacaagcccttcgaagaagaggaaaccaaggagatgccaaagttgcaatgtgaactgtgcgacggcgacaaggctgtgggcgctggcaaccaggggaggccccacagacaccttacgtcacggccatatgcttgcgaactgtgtgcaaaacaattccagagccctagtactctgaagatgcatatgagatgtcatactggggaaaaaccatatcagtgcaaaacgtgtgggagatgcttctccgtgcagggcaatctgcagaaacatgagcgcatccatctcggccttaaggaattcgtctgtcagtattgcaataaagccttcactctcaacgagactctcaaaatacacgagagaattcacaccggagaaaagcgctaccattgtcaattctgcttccaacgcttcctatacctctcaactaagcgcaatcatgaacagcgccacataagagagcacaacggcaagggatatgcgtgctttcagtgccctaagatctgtaaaacagccgctgccctcgggatgcaccaaaagaagcacctgttcaagagtccatcacagcaagaaaagatcggggacgtgtgccacgagaacagcaatcccctggagaatcagcatttcatcggaagcgaagataatgatcaaaaagacaacattcagaccggcgttgagaatgttgtactgtag

SEQ ID NO: 247157 - DNA, 105 bp, Artificial Sequence
  Description of Artificial Sequence: Synthetic coding sequence
atgaccgtcatgtctctatcacgcgatctcaaggatgatttccatagtgacaccgtcctgtctatcctaaatgagcaacgaatccggggaatcctatgcgattag

SEQ ID NO: 247158 - DNA, 285 bp, Artificial Sequence
  Description of Artificial Sequence: Synthetic coding sequence
atgacggtgatgtccttaagcagggacctgaaggatgactttcacagtgatacggtcctgtcaattcttaacgagcagcggatacgcggaatcctgtgcgacgtaaccatcatcgtcgaggacaccaagttcaaagcgcacagcaatgtcctcgccgcatcctccttgtacttcaagaacatcttctggagtcacactatttgtatctcgagtcacgttctggagctcgacgacttaaaggctgaagtgtttaccgaaatccttaattacatctactcaagctag

SEQ ID NO: 247159 - DNA, 357 bp, Artificial Sequence
  Description of Artificial Sequence: Synthetic coding sequence
atgacagttatgtcactgtcccgcgacctaaaggacgactttcattccgataccgtgctgagcatcctgaacgaacagcgaataaggggaatactgtgtgacgtgaccattatcgttgaggacacaaagttcaaggcacattccaacgtgctggccgcatcctcgttatatttcaaaaacattttttggtcacacacaatctgcatctcctctcacgtccttgaactcgatgacttgaaggctgaggtgttcacggagattctgaattatatttacagctcaacagtggtggtcaagcggcaagaaacagttactgacctcgcagcggcaggtaagaagcttgggatcagcttctag

SEQ ID NO: 247160 - DNA, 336 bp, Artificial Sequence
  Description of Artificial Sequence: Synthetic coding sequence
atgaccgtaatgtctttgtccagagacttgaaagacgattttcactctgacactgtgctctcgatcctcaacgagcagagaatccgcggtatcctgtgcgacgtgaccattatcgtagaagacactaaattcaaggcacactcaaatgttctcgccgcatcttctctttactttaaaaacatcttttggtcgcacaccatctgtataagcagccatgtcctggagctggacgacctgaaggccgaggtattcaccgaaattctgaattacatctattcgagcacagtggttgtaaaaaggcaagagaccgtcactgatttggcggctgctgggtag

SEQ ID NO: 247161 - DNA, 453 bp, Artificial Sequence
  Description of Artificial Sequence: Synthetic coding sequence
atgactgttatgtctctcagtagggatctcaaagacgatttccatagcgataccgtgcttagtatcctcaatgaacagcgtatcaggggcattctgtgcgacgtgacaataatcgtggaagataccaagttcaaagcccacagcaatgttttggctgctagtagcctgtactttaagaatatcttctggtctcacaccatctgcatctcatcacatgtcctcgagctcgacgacttaaaggccgaggtctttaccgaaattcttaactacatctacagctccaccgtcgtggtgaaacgacaggagaccgtgaccgacctcgcagcagccggtaaaaagttgggcatctcttttcttgaagacctgacggatagaaacttttccaacagcccaggcccttatgtgttttgtatcactgaaaagggcgtggtcaaagaggaaaaaaacgaatag

SEQ ID NO: 247162 - DNA, 2316 bp, Artificial Sequence
  Description of Artificial Sequence: Synthetic coding sequence
atgactgtcatgagcctctctcgggacttgaaagacgacttccactcggacacagtgctgtctattctgaatgagcaaagaattagggggatcctgtgtgacgtgacaatcattgtggaagacaccaaattcaaggcacactcaaacgtcctggcagcctcatctctctacttcaagaatatattctggagccacaccatttgcatctcatcccatgtgttggagctggatgacctgaaggctgaggtcttcaccgagatcttgaattatatctactctagcactgtagtagttaagcgccaggagactgtaacagatctcgccgcagccggaaagaaactggggatatcttttctcgaggacctcactgatcgaaactttagcaatagcccaggcccatacgtgttttgcatcaccgagaagggagtggttaaggaagagaaaaatgaaaagaggcacgaggagcccgctatcaccaatgggccaagaatcactaacgccttcagcattatagagacagaaaattctaacaatatgtttagcccgctggacctccgcgcatcttttaaaaaggtgtcagatagtatgcgcacagcttcactttgtctggaacgaactgacgtgtgtcatgaagcagagcccgttcggaccctggccgagcatagctacgccgtgagttcagtagccgaagcatacaggtcccagccagtacgggaacacgatgggagtagtcctggaaataccgggaaggagaactgcgaggccctagccgcaaaaccgaaaacatgccgcaaacccaaaaccttctctatacctcaagattcggactcagccacagagaatatcccccctccacctgtctcgaatctggaggtaaatcaggagagatccccacaaccggcagcagtgcttaccaggagcaagtccccaaataacgagggagatgtccatttcagtcgcgaagatgagaatcagagctcagatgtgccaggcccacctgctgccgaggtccctcctcttgtgtacaattgcagctgctgttcaaaagctttcgatagttcgactctgctatcagcccatatgcagctgcacaaaccgacccaggaacccctagtatgtaagtattgtaacaaacaattcactacactgaaccgtcttgataggcacgaacaaatatgcatgcgatcatcccacatgcccatccccggaggcaatcagaggttcttggaaaactacccaaccatcggacaaaatggcggaagctttacaggacccgaaccactcctctcagagaatagaatcggagaattttcctccacgggtagcacacttccagatacggatcacatggttaaatttgttaacggtcagatgctttatagttgcgtggtttgcaagcgctcctatgttacactcagtagtttaagacgccatgcgaatgtgcactcctggcgacgcacctatccatgccactattgcaataaggtctttgccctggccgagtataggacacgacatgagatctggcataccggagaacgtagatatcagtgcattttttgcctcgaaacctttatgacatattacatactgaagaatcaccagaaaagctttcacgccattgaccaccggctgtcgatttccaaaaagactgcaaatggtggactgaaaccgagcgtatatccgtacaagctgtatagactgttgcccatgaaatgcaagcgcgctccctacaagagctacagaaacagcagttatgaaaatgccagggagaatagccagatgaacgaaagtgccccaggaacctatgtggtgcagaatccccactcatccgaattgcccaccctaaatttccaggatactgtgaatacactcaccaacagcccagctattccgctggagacctcggcttgtcaggatatccctactagcgccaacgttcagaatgctgaaggcaccaaatggggcgaagaagcgttgaagatggacctggataacaatttctattcaactgaggtgtctgtgtcttccactgaaaacgccgtatccagtgatctgcgggcaggggacgtaccagttctgagtttatccaattcatctgagaatgccgctagtgttataagctactctggctccgccccttctgtgatcgtacacagttcgcagttttcctccgtgataatgcacagcaacgcaattgccgctatgacatccagtaaccaccgcgcattctccgaccccgcagtcagccaatcattgaaagacgattctaagcccgagcctgataaggtgggacggtttgcaagcagaccgtag

SEQ ID NO: 247163 - DNA, 441 bp, Artificial Sequence
  Description of Artificial Sequence: Synthetic coding sequence
atgacagtcatgtccctgagtcgcgatcttaaagacgacttccactccgatacagtgctaagcatactgaatgagcagcgtatccgaggtattctgtgcgatgtgactattattgtcgaggataccaagttcaaagctcactcaaacgtgctggcagcttcctcactctacttcaagaacattttctggtcacatacgatctgtatttcgtcacacgtcctggagttggacgatttaaaggccgaggtgtttacagagatcctcaattacatttatagcagcaccgtcgtcgtgaaaaggcaagaaaccgtgacagatctcgcagccgctggaaaaaagctgggcatttctttcctcgaagacctgaccgatcgcaatttctccaatagccctggtccctatgtgttctgcataacggagaagggggtggtgaaggaatag

SEQ ID NO: 247164 - DNA, 633 bp, Artificial Sequence
  Description of Artificial Sequence: Synthetic coding sequence
atgacagtcatgagtctcagcagagatctgaaagatgatttccatagtgacacagtgttaagcatccttaacgagcagcgcataagaggaatcctgtgtgatgttacgatcatagttgaggacacaaaattcaaggctcattctaatgtcctggcagcatcctccttgtattttaagaacattttctggtcacatacgatatgtatcagctcacacgtcctggagttggatgatctcaaagcagaagtgtttacagaaattctaaactacatttatagttccaccgtcgtggtgaagcgacaagagaccgtcactgaccttgcagctgcagggaaaaaacttggaatctcttttttggaagatctgacagaccgaaacttcagcaatagtcccggtccatatgtgttttgtattaccgagaagggggtggtcaaggaggagaagaacgaaaaaaggcacgaggaaccagccataaccaatggaccgaggattacaaacgctttcagcatcattgagaccgaaaattccaataacatgttctcacctttagacctgcgggcttccttcaaaaaagtttctgactctatgagaaccgcaagcctctgcctggaaaggactgatgtgtgtcactag

SEQ ID NO: 247165 - DNA, 327 bp, Artificial Sequence
  Description of Artificial Sequence: Synthetic coding sequence
atgacagtgatgtccctgtccagggatctgaaggatgatttccattctgacacagtgttaagcatcctgaacgagcagagaatccggggaatcttgtgcgatgttacaattatcgtcgaggacaccaagtttaaggcccacagcaacgtcctcgccgcatccagcttatactttaagaatatcttttggtcacatacgatctgtatctcttcacacgtgcttgaactggatgatctgaaggctgaggtctttaccgagatcctgaattatatttactcatccacagtcgtggttaaacggcaggaaacagtgactgatctagcgtag

SEQ ID NO: 247166 - DNA, 213 bp, Artificial Sequence
  Description of Artificial Sequence: Synthetic coding sequence
atgacagtcatgtctctcagccgggacctcaaagatgatttccactccgacaccgtgttgagcattctgaacgagcagcgcatcaggggaatcctgtgcgatgtcacaatcatcgtggaggataccaagttcaaggcacatagtaatgtcttagctgccagctccctgtatttcaagaacatcttctggagtcatactatttgcatttcatag

SEQ ID NO: 247167 - DNA, 3588 bp, Artificial Sequence
  Description of Artificial Sequence: Synthetic coding sequence
atgactgttatgagcctgagtcgcgacctgaaggacgactttcactcagatacggtgctgagtatcctcaacgagcagcgcatccgcggaattctgtgcgatgtgacgatcattgtcgaggataccaagttcaaagcccactcaaacgttctcgccgcatcttcgctctacttcaaaaacattttctggtcccatactatctgcatatcatctcacgtgctggaactggacgatttgaaggccgaggtttttacagagatcttgaattatatctacagcagtactgttgtggtcaagcgtcaagagacagtgaccgacctggccgctgccggtaaaaaactggggatatcatttctcgaggacctgactgaccgcaacttctctaatagcccgggaccatacgtgttctgtatcacagagaagggagtggtgaaagaagaaaaaaacgagaaaagacacgaggagcccgcaatcactaatggcccacgaatcacaaacgcgtttagcattattgaaacagagaattccaataacatgtttagtcctttagatctccgagcttcattcaaaaaggtcagtgacagcatgagaacagccagcttgtgtcttgaaagaacagacgtatgccatgaggctgagcctgtgagaactcttgccgaacactcgtacgccgtgtcttccgtagcagaggcctataggtcacagccagttagggagcacgacggctcctcccccggtaacacgggcaaggaaaactgtgaggctctcgccgctaagccgaaaacctgccggaagccgaagacgttcagcattcctcaggactccgactccgctaccgagaacatcccccctccacccgtctcaaatctcgaggttaaccaggagagaagtccacagcccgcagccgtgctgaccagatccaagtccccaaataatgaaggggacgtccatttctcaagagaagacgagaaccagtcgtcagacgtgcccggacctccagctgcagaggtgccccctcttgtgtataattgttcctgttgctctaaagctttcgatagcagtactctcctgagcgcccacatgcagcttcacaagcctactcaggaacctctcgtctgcaaatactgtaataagcagttcaccacattgaacaggcttgatagacatgaacagatctgtatgcggagcagccatatgcctatcccgggtgggaaccagcgatttctggaaaactaccctacaatcggccaaaacggcggtagcttcactggccctgaaccattactatctgagaatagaatcggagagttttcttctaccgggagcactctcccagatacagaccatatggtaaagtttgtcaacggacagatgttgtactcttgtgtcgtgtgcaagcgatcctatgtgaccctgagtagccttcgacgtcatgccaacgtccattcatggcgaagaacttatccttgtcattactgcaataaagtcttcgccctggcagaatacagaacccgacatgaaatttggcacaccggtgaacgtaggtatcagtgcatattctgtttggagacattcatgacctactacatcctgaagaaccaccagaaatccttccatgctattgatcataggttgtccatatccaaaaagacagccaacggcggtctaaaaccatccgtatatccctataaactctatcggctcctgccgatgaaatgtaagcgggcaccctataaatcttaccgcaattcttcgtatgaaaacgccagagagaatagccaaatgaatgagtccgcaccaggcacatacgttgtacaaaatcctcactcctccgagctcccgaccttgaacttccaagataccgttaatacactgaccaattcacccgcaatcccattggagacttccgcctgtcaggatatccccactagcgcgaatgtgcaaaatgccgaggggactaaatggggggaagaggcccttaagatggatttagacaataacttctactctactgaagtgtccgtgagtagtacggagaacgcagtctcctcggacctgcgagccggagacgtcccagtgctttcattgagcaattctagtgaaaatgcagcatctgttatctcttattctggtagtgccccatctgtgatcgtgcatagctcccagttctcctccgtgataatgcacagtaatgctattgccgcaatgaccagcagtaaccatcgtgctttctccgacccggctgtgagccagagtctgaaagacgattccaagcctgaacccgataaagtggggagattcgctagcaggccaaaatcgattaaggagaaaaaaaagactactagtcatactagaggtgaaatcccagaggagtctaattacgttgctgatccaggcggttccctctcgaagacgactaacatagctgaagaaacctcgaaaattgagacttatattgctaagcctgctctacccggtacctccaccaacagtaatgttgcccctctctgtcagatcactgtaaagattgggaacgaggctatagtaaagaggcatatcctcggatccaagttgttctacaaacgcggtcgacgccctaaataccagatgcaagaagaaccactgccccagggcaacgaccccgaaccttcaggagatagcccactgggactctgtcagtcagaatgtatggaaatgtccgaagtcttcgacgacgcgtccgatcaggatagcacagataaaccttggagaccatactacaattacaaacccaagaagaaatcccgccaactgaaaaaaatgagaaaggtgaattggagaaaggagcatggtaatcgtagtccttctcacaaatgtaagtatcctgccgaattggattgtgccgtaggtaaggcacctcaggacaaaccctttgaggaagaggaaacgaaagaaatgcccaaactgcagtgcgagctatgcgatggagataaggccgtgggggcaggaaaccagggcaggcctcatagacacctcaccagcagaccttacgcctgcgagctgtgtgctaaacagttccaatcaccaagcacactgaagatgcatatgcggtgtcacaccggtgagaaaccttatcagtgcaagacctgtggaaggtgttttagcgtgcagggaaatctccagaagcacgagcgcattcacctcggccttaaggagtttgtgtgtcagtactgtaacaaagcctttacattaaacgagactctgaagattcatgagcgaatccatacaggtgagaaaagataccattgccagttttgtttccaacggtttctttacctaagcacaaagcggaatcatgagcaaagacacattcgggagcacaatggaaagggatatgcctgttttcaatgcccaaagatttgtaagaccgccgctgcattgggcatgcaccagaagaagcacttattcaaatcgccaagccagcaagagaaaattggggatgtctgccatgaaaattccaacccactcgagaatcagcacttcataggctctgaggacaacgatcagaaggataatatccaaacaggggttgaaaatgtggtcctttag

SEQ ID NO: 247168 - DNA, 3042 bp, Artificial Sequence
  Description of Artificial Sequence: Synthetic coding sequence
atgcctcccccagcagaagtgacagacccctctcatgctcccgctgtgctgagacaactcaacgaacagaggctgcggggactgttttgcgacgtcacactgatcgctggagacaccaagtttcctgcacatcgtagtgtactggccgcaagtagtcccttcttccgagaagctctgctcaccagtgcgccactgccacttcccccagctactgggggtgccgctccgaatcccgctacaactacggcagccagttcttctagcagtagctccagttcaagttctagctctagcagctccgcctcttcatcctcatcaagctcatcgtctagcccacctcctgccagtccaccagcaagctctcccccaagggtgctggagctgccaggagtccccgctgctgctttcagcgacgtgttgaatttcatatattctgcacggttggcgttgcccggaggaggcggagatggggctgcggttgctgaaattggagctttaggcaggaggttaggcatttccaggctccaggggttgggagaagggggagacgcatgggtccctcccactcccgcacccatggctacatcgcagccagaggaagactccttcggccctgggcctcggcctgcaggcgaatgggaaggagacagagccgaggcccaggccccagatctgcaatgcagcctcccgagaaggccgttaccatgtccacagtgcggcaagagtttcatccacccgaagcgtcttcagacacacgaggcccaatgtcgcagaggagcctcaactaggggctctacaggactcggcgctggaggggcaggacctggcggtccagctggcgtggatgcgtccgctctgcctccacccgttggattcaggggcggacctgagcatgtagtcaaggtagtgggagggcacgttctgtatgtttgtgccgcatgtgaacgctcttatgttaccttgtctagtcttaaaagacactccaatgtgcatagttggagacgcaaatacccgtgccggtactgcgaaaaggtattcgccctagccgagtaccggactaagcatgaggtgtggcacaccggtgagcgcagatatcaatgcatcttctgttgggaaactttcgtgacatattataatctcaagactcaccaacgggctttccatgggatctctccaggcttgctggcctccgaaaaaacccctaatgggggttataagcctaaattgaatactctcaagctgtatcgacttctccctatgagggccgcaaagaggccctacaagacgtattcccagggagcccctgaggctcctttgtcgcctacccttaacacacccgctcctgtagccatgcccgcttcacctccaccgggtcctccccctgcgccagagcctggacctcccccatccgttattacattcgctcaccctgccccatccgttattgtccacggcggttcaagcagcgggggaggcggtagcggtacagccagcactgggggaagccaggcggcttcagtgattacttacacagctcctccacggcctcctaaaaaaagggagtatccacctcctccacccgaacctgccgcaacccccacatctccagctactgcggtaagtcccgctactgctgccggaccagcgatggcaacaaccacagaggaggccaaaggaagaaatccaagagcgggaaggacgcttacatataccgccaaacccgtaggaggtattggcggaggtggcggacctccaactggggcaggtagaggcccatcacagctgcaagcccctccccctctgtgtcagatcacagtgcgaataggcgaagaagctattgtcaaacggcgaatctcagagactgatcttcgccctggagagctgtctggagaagagatggaagaatcagaagaggacgaggaggaagaggatgaagaggaagaagaagaagatgaggaagagagcaaggccggtggggaggatcagctgtggagaccctactattcctataagccaaaacgaaaagccggtgccgcaggaggtgcttctgtcgggggatcaggtctccctaggggcaggagacctcccaggtggcgccagaaattggaaagacgcagctgggaggagacccctgccgctgaaagtcctgcaggcagagctcggacagagaggagacaccggtgtggggattgtgcgcagactttcaccaccctgcgcaagctccggaagcaccaggaagctcatggaggaggctctcatagctcaagggcaggtcgcagaccaagcaccaggtttacttgccctcactgtgcgaaggtgtgcaagaccgccgcagcactcagtagacacgggcagaggcacgccgcagaacgacccggtggaactcctacccctgttatcgcatatagtaagggttctgccggtacccgtccaggagacgttaaagaggaggctccccaggagatgcaagtaagttcctcctcaggcgaagccggtggtggctctacggctgccgaggaggcaagcgagaccgccagtctgcaagatcctatcatcagcggtggggaggagccccctgttgtcgctagcggcggaagctatgtgtatcctccagtccaggagtttccactcgccctgattgggggagggagggaacctgggggagggagggggaagtctggttccgagggacctgttggagcgggagagggagaccggatggaaggcattggagcggcaaaggtgaccttttatccagagccttaccctctggtgtatgggcctcaacttttggcggcttatccgtacaatttctcaaatttagctgcactgccggtggcacttaatatggtgctcccggatgagaagggcgctggcgctctcccttttctccccggagtatttggctacgccgtgaacccccaagctgccccacctgccccaccaactcccccaccccctactctcccacctcccatacctccaaagggggagggcgagcgagccggtgtggagcggactcagaagggcgatgtgggctag

SEQ ID NO: 247169 - DNA, 3042 bp, Artificial Sequence
  Description of Artificial Sequence: Synthetic coding sequence
atgcccccaccagcagaggttactgatccttctcacgccccagccgtgctccgccaactgaacgaacaacgactgaggggcctgttttgcgatgtgactttgatagctggcgatactaagttccccgctcaccgcagcgtgctcgcagcctctagccctttctttcgggaagctcttctaacatcagcgccactgcccctgcccccagccaccggaggcgcagctcccaatcccgctacaactacggctgctagctcatcctcatcttcatcctcaagttccagtagtagctcctccagtgcgtcttctagttcgtcttccagctcctcttcccctccgccagccagcccccctgcctctagccctccaagggtgctagagctaccaggcgtcccggctgcggctttcagcgacgtccttaatttcatctatagcgcacggctggcactaccaggcggtgggggagatggagccgctgtggccgaaatcggtgcattaggcagaaggctgggcatctccagacttcagggcttaggtgagggaggtgacgcttgggtgcctcccactcccgcacccatggcgacaagtcagccagaagaagactcattcggtcctggtccaagaccagcaggtgaatgggaaggtgatcgcgctgaggctcaagcgccagaccttcagtgtagcctgcctcggagacctcttccctgcccacagtgtgggaaaagtttcatccacccgaagcgattacagacccatgaagcacagtgtcgacggggagctagtacaaggggctcaaccgggcttggggctggaggagccggacctggcggtcctgctggggtcgatgctagtgccctgccacccccagtcggtttccggggtggcccagaacatgtggtcaaggtggtcggaggccacgtgctttatgtctgcgctgcttgcgagcgttcttatgtgactctgtcttctctgaagcggcactctaacgtacattcttggcggagaaaatatccttgccgctactgcgagaaagttttcgctctagcagaatatcgaacaaagcatgaggtgtggcacaccggtgaacgcagatatcagtgtatcttttgctgggagactttcgttacctactacaaccttaagacccatcaaagagcattccatggcatttctccaggtcttttagctagtgagaagacaccaaacggcggatataagccaaaacttaacaccttgaaactttaccggctccttccgatgagagctgccaaaaggccttacaagacttatagtcaaggggcacctgaagctcccttgtctcccaccctgaatacacctgcacctgtggcgatgcccgcaagccccccacccggaccaccaccggctcctgaacctgggccacctccttccgtgataactttcgcgcatccagcacctagcgtcatcgtccatggtgggagctccagcgggggaggcggaagcgggacggcctcaactggtgggtcccaggccgcatccgtgataacatacactgctcctcctcggccacctaagaaacgagagtatcccccacctcctccagaaccagctgctaccccaacctcaccagcgacagccgtatcacctgccactgctgccggtcctgctatggccacaactaccgaggaagccaaagggcgtaaccctcgagcaggcaggacactcacatacacagctaagccagttgggggaattggcggaggaggtgggccacctacgggggcagggcgtgggccttctcaacttcaggcacctccgcctctctgccaaatcacagttcgcatcggagaggaggccatagtcaaaaggaggatatccgaaactgatctgcgtcctggagagttgtctggcgaggagatggaggaatccgaggaagatgaagaggaagaagacgaagaggaagaagaagaagatgaagaagagtcaaaggccggaggcgaagaccagctttggaggccttactactcctacaagccaaagaggaaggccggagcagccggtggcgctagcgtgggcggttccggcctcccccgaggtcgacgtcctcccaggtggcggcagaaactggaacgtcgcagctgggaggaaacccccgcagccgagtcaccagccggtcgagctaggaccgaacgtaggcatcgttgcggagactgcgcccagacgttcacgactttaaggaagctcagaaaacatcaagaggcccacggtggcggatcacatagcagccgcgctggtcggaggccttctaccaggtttacatgcccacactgtgccaaggtgtgcaagaccgcagcggctctttcacgccatggtcaacggcacgcagccgagaggcccggagggaccccgacccctgtgatcgcatactctaaaggtagcgccggaactaggccaggcgacgtgaaagaggaagctccacaagaaatgcaggtctctagttcgtccggggaagctgggggaggcagtactgctgccgaggaggccagcgaaaccgcgagcctgcaggacccgatcatcagcgggggtgaggagcctccagtcgttgcctccggcggttcttacgtttatcctcccgtgcaggagttccctctggctctcattggcggtggacgcgaacccggaggaggacgtggcaaatctggctctgaaggaccagtgggcgctggcgaaggggacagaatggaggggattggcgctgccaaagtgacgttctatcctgagccttatccattggtgtatggacctcagctcctggccgcatacccctacaactttagtaacctggcagccctccctgtggcacttaatatggtgcttccagatgagaagggggctggtgccctcccctttctgcccggagtattcggctacgccgtcaatccccaggcagctccacctgcccctcccacgccccctcctccaacactgccgccacctatcccccctaagggggagggggaacgcgctggggtagagagaacccagaagggagacgtgggttag

SEQ ID NO: 247170 - DNA, 708 bp, Artificial Sequence
  Description of Artificial Sequence: Synthetic coding sequence
atggagctgcccaactactctaggcagcttctacaacagctgtataccctctgtaaggagcaacagttctgtgattgtaccatttctatcggcacgatctacttccgggctcataagctggttttggcagctgccagcctgctctttaagaccctcctggacaataccgacaccatctcaatcgacgcaagtgtcgtctctcccgaggagttcgcgctcctgttggagatgatgtacacgggcaagttgcctgtcggtaaacacaatttttccaaaattatctcactggcggacagcctgcagatgtttgatgtggccgtttcatgtaagaatcttcttacttcccttctagccgcaacacccggtggccctgtaaaggcagagaccgaggaagccgctcatagcgtgtcccaggagatgtcagtgaattcacctaccgcacaggaatcgcaaaggaatgctgagactccagcagagacaccaacaactgccgaagcttgttcgccttcccctgccgtccaaacattcagtgaggccaagaagacctctacggagccaggatgcgagagaaagcattaccaactaaatttcttgttagaaaatgagggcgtgtttagcgatgctctaatggttacccaggacgtcctgaaaaaacttgaaatgtgctccaactgctgcgtgcctgtggaagctgttcctattttttag

SEQ ID NO: 247171 - DNA, 3384 bp, Artificial Sequence
  Description of Artificial Sequence: Synthetic coding sequence
atggagctgcctaattattccagacaactgctccagcaactttacactttatgcaaggaacaacagttctgcgactgcactatcagtattgggaccatctacttcagggctcataaactcgtgctagcggcagctagcttgttgtttaaaacgctgctggataacactgatacgataagtatcgatgcaagcgtcgtgtcccccgaagaatttgctctcctcctcgagatgatgtacacaggaaagctcccagtgggtaaacacaacttcagcaaaattatatcgctggcagatagtctgcagatgttcgacgtcgctgtgtcctgtaagaacctgttgacatccctggtgaattgctcggtccagggccaagtggtccgagatgtgagtgctccctcatccgagacttttcgaaaagaacctgaaaaaccacaggtggaaattctgagctcagaaggagcgggtgaaccccactcttctccagagctcgctgctaccccagggggtcctgttaaagcagagacagaagaagccgctcatagcgtttcccaggaaatgtcagtcaatagccccacagcgcaggagagtcagaggaacgcggagaccccagctgagacaccaactacagccgaagcatgcagcccatctccagctgtgcagacgttttcagaagcaaagaagacttcaacggagcctgggtgcgagagaaagcattatcagctgaacttcctcctggagaatgagggtgtgttcagcgatgcactgatggtaacgcaggacgtactgaaaaagttggaaatgtgctcagagattaagggacctcaaaaggaagtgatcctgaactgttgtgaaggtcgcactcccaaggagacaattgagaatctgcttcacaggatgacagaggagaaaacactgaccgccgagggtctcgttaaattactgcaggccgtaaaaactacattccctaatctggggttgcttctcgagaaactgcagaagtcagctacgctaccctcaacgactgtacaaccatctcccgatgactatggtacggaactcttacgaagatatcacgaaaatctatcggaaatcttcactgacaaccagatcctcctcaaaatgatatcacacatgaccagcctggctcctggggagagagaggttatggagaaactggtgaaacgtgactctgggagtggcggatttaacagcttgatctccgctgtgctggaaaaacagaccttgagcgccaccgcaatctggcagctgcttctggtcgtgcaggaaactaaaacctgcccactggatctgcttatggaagagattcgacgggaacccggtgctgatgcattctttagggctgtgacaacccccgaacatgctacactcgaaactattcttaggcataatcagctgattctagaagccatccagcagaagatcgagtacaaattattcacttctgaagaggaacatctcgcggaaactgtcaaggagattctgtcaatccccagtgagactgccagcccagaagcctctctcagggcagtcctaagccgtgcaatggaaaaatccgtcccagccattgagatctgccacctcttatgtagcgtgcataaatcttttcctggattgcagccagtaatgcaggagctggcatacatcggtgtcttgaccaaggaggacggcgagaaggagacttggaaggtgtcgaacaaattccacctggaggctaacaataaggaggatgaaaaggctgcgaaggaagattcacaacctggcgagcagaacgatcaaggtgaaacaggcagtctgcctggtcagcaggagaaagaggcaagtgcatctcccgaccctgcgaaaaaaagcttcatctgcaaagcatgcgacaagtcttttcacttctactgccgtttgaaggtgcacatgaaacgttgcagggtggcaaaatccaaacaggtgcagtgcaaagagtgttctgagactaaggatagtaaaaaggagctagacaaacatcagctggaggcccacggtgcgggtggggagccagatgcgcctaaaaagaagaaaaaacgcctaccagtgacttgtgacctgtgtggacgggaattcgcgcacgcaagcggcatgcagtatcataagctgaccgagcatttcgacgagaagcctttcagttgcgaggaatgcggggcaaagtttgcagccaacagtactttgaaaaatcacctccgcctccacacgggagatcgcccttttatgtgcaaacattgcttaatgacctttacgcaggcatccgccctggcataccacacgaagaagaagcactcggaaggtaaaatgtacgcatgccagtattgtgatgccgtatttgcgcaaagcattgagctgtccaggcacgttcggacgcataccggggataaaccgtacgtttgtagagactgtggtaaaggctttcggcaggcaaacggtcttagtatacatcttcatacattccacaatatcgaagacccatatgactgtaaaaaatgtagaatgtccttcccgaccctgcaggaccacagaaaacacattcatgaggttcattccaaggaataccatccatgccctacttgcggcaagatcttttcagccccttctatgttggaacgccacgtggtcacgcatgtcggtggcaagccattttcttgtgggatatgtaacaaggcttatcagcagctgtcaggtttatggtatcataatcgcacccaccaccctgatgttttcgcagcgcaaaaccataggtccagtaaattttcaagcttacaatgctcctcctgcgacaagacgtttcctaacactatagagcataagaagcacatcaaggccgagcatgccgacatgaaatttcatgaatgcgaccagtgtaaggagctgtttccaacgcctgcacttctacaggtgcacgtcaagtgccagcactccggctcccaaccatttcgttgcctctactgcgcagctacttttaggttccctggtgctcttcagcaccacgtaaccactgagcacttcaagcagtctgagacgaccttcccatgcgagctttgcggggagttgttcacaagccaagcccaactggatagtcaccttgagagcgagcatcctaaggtcatgagcaccgagacacaggccgctgcctcccagatggcgcaagtaatacagacccctgagcctgtggcgcctacagaacaagtaatcaccctggaagaaacacagctggccggatctcaagtgtttgtgactctgccagactctcaggcctctcaggcatcaagcgaactcgtggctgtgactgtcgaagatctcctcgacggcaccgtcaccctaatctgtggagaagcaaaatag

SEQ ID NO: 247172 - DNA, 3720 bp, Artificial Sequence
  Description of Artificial Sequence: Synthetic coding sequence
atggaactcccaaactattcacgacagttactacaacagctgtataccctttgtaaggagcagcagttttgcgattgtaccatctccatcggcaccatttactttcgggcacataagctcgtactcgccgctgctagcctgctatttaagactctgttggacaacacggataccatcagcattgacgccagcgttgttagcccagaggagttcgccctgctgcttgaaatgatgtataccggcaagctgcccgtgggcaaacataactttagtaagatcattagcctggccgactctctgcaaatgtttgacgtggctgtcagttgcaagaatcttctgaccagtctggtaaactgttcggtccaagggcaggtggtaagggacgtcagcgctccctcctccgagacctttcgcaaggaacccgaaaagccgcaggtcgagattctttcgtccgaaggggctggcgaacctcactcttctcccgagctggccgcaacacctggcggaccagtaaaagccgaaaccgaggaggcagctcacagcgtgtcacaggaaatgtctgtgaattctcctacagcacaggaaagtcagcggaatgccgaaacccccgctgaaacacccacaactgctgaggcctgcagcccgtcacccgctgtccaaacattcagtgaagctaagaaaacgagcacagaacctggctgcgagcgcaaacactatcagctgaacttcctgctggaaaacgaaggcgtattctctgacgccctgatggtaacccaggatgtgctgaagaagctggagatgtgtagtgaaattaagggtccacagaaggagatgatagtgaaatgctttgaaggggaggggggacactccgcttttcaacggatcctcggaaaagtgagggaagagtccttagatgtgcagacagtagtctcccttctaagattataccaatatagcaatccagcagtaaagacggcccttcttgatcgaaagcccgaggatgtggatactgtgcaaccaaagggttccactgaggagggtaagaccttaagcgtgcttctcctcgaacacaaggaagatcttattcagtgcgtgactcaactccgcccaatcatggagtcccttgaaacagccaaagaggagttcctgaccgggaccgagaaacgggtaatccttaattgctgtgaaggccgaacaccaaaggaaacaatagagaatctgctgcaccgaatgaccgaggaaaagaccctgaccgcagagggtctggtgaaactacttcaagctgtgaaaacaacctttcctaaccttggcctcctgcttgaaaaactccagaagtccgctactctgccgtcaacgacggtccagccctcacccgacgactatggaacagagctgctgcgaaggtatcatgaaaatctgagtgaaatctttactgataatcagatccttttaaagatgatttcacacatgacctccctggccccaggtgagcgggaggtgatggagaagctggtcaagcgtgactctggctccggcggtttcaactcacttattagtgccgtgttggaaaagcaaacactgtccgccactgcaatttggcaactcctgctggtggtgcaagaaaccaaaacatgtcctctagatctgctaatggaggagatccgcagggaacctggcgcagacgcctttttccgcgctgtcacaactcccgaacacgccacattggagaccattctgaggcacaatcaacttatccttgaggctatccagcaaaaaattgagtataagctttttactagcgaggaggaacaccttgccgaaactgttaaggagattttgtcaattccttcggagacagcgtctcccgaagccagcctccgcgctgtcctgagcagagccatggagaagtcggtcccagcaattgaaatctgtcatttactctgctctgtgcacaagtctttccccggactgcagcctgtgatgcaagaacttgcttatatcggggttctgactaaagaggatggtgagaaggagacgtggaaggtgtccaacaagttccaccttgaagcgaataataaggaggacgagaaggccgcaaaagaggactctcaacctggtgagcagaatgatcagggcgagaccggatccctgcccggacagcaggagaaagaggcatccgccagccccgaccctgctaagaaatcattcatatgcaaagcctgcgataagagttttcacttttactgtcggctcaaggtgcacatgaaacgctgtcgagtggccaagtcaaaacaggtccagtgtaaagaatgtagcgagacaaaggatagtaagaaagaattggacaaacatcaactggaggcgcacggggcaggaggtgaacctgatgcccctaaaaagaaaaagaagagactgcccgtcacctgtgatctgtgtggacgggaattcgctcacgcgtccgggatgcagtatcataaattgactgagcattttgatgagaaacctttttcttgcgaagagtgtggcgcaaaattcgctgcaaattctaccctgaagaatcacttgagattgcataccggggatcgaccattcatgtgcaaacattgcctgatgacttttactcaggcttccgctctggcttatcacacaaaaaagaaacatagtgaaggtaagatgtacgcctgtcagtattgcgacgcggtgttcgcacaatccatcgagttgagcaggcatgttcgcacccacacgggcgacaagccctatgtctgccgtgattgtggcaagggctttcgccaagccaacggcctatcaattcacctccacacttttcataatattgaggatccctacgactgcaagaaatgccgtatgagtttcccaacactgcaagatcatcgaaaacacatccatgaagtgcacagtaaagagtaccacccctgcccaacttgcgggaagatattcagtgcgcctagcatgctcgaacgtcacgtagttacccatgtgggtggcaaacccttttcctgcggcatatgtaacaaggcgtatcaacaactgagtggcctgtggtaccacaatcggactcaccatccagatgtgtttgcggctcagaatcacagaagctctaagttttcctccctgcagtgcagcagttgtgacaaaacctttccaaataccatagagcataaaaagcatattaaggccgaacatgctgatatgaaatttcacgagtgcgatcagtgtaaagagctctttcctacccccgctctcttacaagtgcatgtcaagtgtcagcattccggcagccaacctttccggtgcctgtactgcgctgcgacattccgctttcccggagccctgcagcaccatgtgactacagaacactttaagcagagcgagacaacgttcccatgtgaactctgcggagaattgttcaccagccaggcgcagttggactctcacctagagagcgaacatcccaaagtaatgtcgacagaaactcaagctgcagcatctcagatggctcaggtcattcaaaccccggagcccgtggcgccaacagagcaagtcataactctggaggagactcaacttgcaggcagccaggtgttcgttactctccctgattcccaagcctcccaggccagctccgaactagtggctgtaactgtcgaggatcttctggacgggacggtgaccctcatttgcggggaagccaaatag

SEQ ID NO: 247173 - DNA, 1362 bp, Artificial Sequence
  Description of Artificial Sequence: Synthetic coding sequence
atggagttgccgaactatagtcgacagctcctgcagcagctgtacaccctgtgcaaagagcagcagttttgtgattgcactatttctatcggaacaatttattttcgggcacataagctggtccttgccgctgcctcattgctatttaagacactgctggataacactgacaccatatcgatcgacgcctccgtggtgagtccagaggagtttgctctgcttctcgagatgatgtacacggggaaactgcctgtcggcaagcataatttttctaaaatcatttcactcgcagattcactccagatgttcgacgtcgcagtgagctgtaagaacctcctgacttctttggttaactgttccgtgcaaggtcaggtcgtgcgcgacgtgtccgctcccagctctgagaccttccgtaaagaaccagagaaaccccaggttgaaatcctgtcatccgaaggagcgggtgaaccgcacagttctccagaactggccgctacaccaggcggtcctgtgaaagccgagaccgaagaggctgcacacagcgtttcacaggagatgagcgtaaattcccccacggcccaggaatcccaaaggaacgccgaaaccccagccgagacccccacgaccgctgaagcttgctctccgtcaccagccgtccaaacgttttcagaagccaaaaagacatccaccgaacctggatgtgagcgaaaacactaccaactgaactttctcctggaaaatgagggggttttttcagacgccttaatggtgacccaggacgtcttgaaaaaactggaaatgtgctcagagatcaaaggccctcaaaaggaaatgatagtgaaatgctttgaaggtgaggggggacactcagcattccagagaatcctgggcaaggtcagggaagagtctcttgatgttcagaccgtcgtgtctctgctgcgactttatcagtactctaaccctgcggtaaagactgctctgctggatcgaaagcctgaagatgtggataccgtgcagcctaagggatccactgaagaagggaagaccttatcagtgctcctcctagagcacaaagaggacttgatccagtgcgtgacccagttaaggccaattatggagtcccttgaaactgcaaaggaggaatttctaacgggaactgagaagagggttattctcaattgttgtgagggacggacacctaaggagacgatcgagaacttactgcaccgtatgaccgaggaaaagactctgactgccgaaggattggtgaaactcctgcaggctgttaaaactacatttcctaatttagggctgttgcttgagaaactccagaaatcagccacactgcctagtaccacgtag

SEQ ID NO: 247174 - DNA, 3720 bp, Artificial Sequence
  Description of Artificial Sequence: Synthetic coding sequence
atggagctcccaaattacagccggcaactgctccagcagttatatacactgtgcaaagagcagcagttttgtgattgcacaatctccatcgggaccatatattttagagcccacaagctcgttctggctgcagcaagtctgctgtttaagacactgctcgataacacagataccataagcatcgacgcgagcgtggtctcacctgaggagttcgctctgttgctggaaatgatgtatactggcaagctgccggtgggtaagcataatttctctaagatcatatcacttgctgacagtttacagatgtttgatgttgccgtcagttgcaaaaacctgcttaccagcttggtgaattgcagtgtacaagggcaggtggtgcgagatgtctccgctccatcatccgaaaccttccggaaagagcctgagaaaccacaggtcgagattctgtcatctgagggcgcaggcgaaccgcacagcagccctgagctcgcggcaacccctggaggacccgttaaggcagagactgaagaagccgctcattctgttagccaagaaatgtcagtgaatagtccaacagcccaggagagccaacgaaacgccgaaacacccgcagaaactccaaccacagctgaggcctgttcccctagtcccgcagtccagaccttttccgaagcaaagaaaactagcaccgagcctggttgcgaaaggaaacactatcaactcaatttcttactcgagaatgagggggtttttagtgatgcgctgatggttactcaggatgtcctcaaaaaactggagatgtgttctgaaatcaagggccctcagaaagagatgattgttaaatgcttcgaaggtgaggggggacactccgcatttcagcgaatcctaggtaaggtgagagaagaatccttagacgttcagacagtagtttccctgcttaggctttatcagtactctaatcccgctgtgaagactgccctgctggatcgcaagccagaggacgtggacactgtgcagcccaaggggtcaactgaagagggtaagaccttgagcgtcttacttctagagcacaaagaggatctcattcaatgcgtcacacagcttcggcctataatggagagcctagagaccgcgaaagaagagtttcttaccggcaccgagaagcgagtgatcctcaattgttgcgagggccgaactcctaaggagactattgaaaacttacttcatcgaatgactgaggaaaaaacattaaccgccgagggcctggtgaagctgttgcaggcggtgaagacaactttcccgaatctggggttactgttagagaagctgcagaagtccgccactctcccctcgaccactgttcagccaagtcctgacgactacggcacagaattattgagaagataccacgagaatctgtctgagatttttacagacaaccaaattctgctgaagatgatatcgcacatgacaagccttgctcctggagagagagaggtcatggagaaattggtcaagcgagatagcgggtcaggcggttttaacagtctgatcagcgcagtcctggagaagcagacactgtcggccacagctatttggcagcttctcctggttgtccaggagacaaagacatgtcctctcgatcttcttatggaggagatccggagagaacctggggcagacgcgttttttcgggctgtgaccacccctgagcacgcaaccctcgaaaccattctgagacacaatcagcttatattagaagccatccagcagaagatcgaatataagctttttacctctgaggaggagcacctcgcagaaacagtgaaggaaattctctctattccatccgaaaccgcctcacctgaggcgtctctgagggccgttctgtcccgtgcaatggagaaatcagtacctgccattgaaatttgtcacctgctatgctcagtgcataaatcattccccggtctccaacctgttatgcaagaactcgcctatatcggagtgctcactaaagaggacggagagaaagaaacttggaaagtctcaaataagtttcatctggaggcgaacaacaaagaagacgaaaaagcagcaaaggaggacagccaaccaggcgagcagaacgaccaaggtgagacggggtcactgcctgggcagcaggagaaggaagcatctgcaagcccagatccagctaagaaatcattcatctgtaaggcctgcgataagagctttcatttctattgtagattgaaggttcacatgaagcggtgtcgcgttgccaaatctaaacaggtccagtgcaaggagtgtagcgagacaaaggactccaagaaagaactcgataagcaccagttagaggcgcacggcgctgggggagagcccgacgcgccaaaaaaaaagaagaagcgcctgcccgtgacctgtgatctgtgcggacgtgagttcgcccatgctagcgggatgcagtatcacaagctgacagagcactttgacgagaagccctttagttgcgaggagtgcggcgcaaagtttgctgccaatagtacgctgaagaaccatttacggctgcatactggtgataggccatttatgtgcaagcactgcctgatgacttttacccaggcatccgcactggcataccacaccaagaagaaacatagtgagggtaagatgtacgcatgtcagtactgcgacgccgtctttgcccagtccatcgaattgtccaggcatgtacgcactcatacgggggacaaaccatatgtctgccgggattgtggcaagggttttcggcaagctaatggcctgtccatccatctgcatacctttcacaacatcgaggacccctacgattgcaagaaatgcagaatgtcctttccaaccttgcaagatcacaggaaacacattcatgaggtgcattctaaggagtaccacccttgtccaacctgtggaaagatcttcagcgcaccgagtatgctcgagaggcatgtggtgacacacgtggggggtaagcctttcagctgcgggatctgcaataaggcctaccagcagttgagcgggctctggtaccataaccgaacacatcatccagacgtatttgccgctcagaatcaccgaagttccaaatttagctcgctccagtgtagctcatgcgataagaccttccccaacacaatcgaacacaaaaagcacataaaagccgagcatgccgatatgaagtttcatgaatgcgatcagtgcaaagaactctttccaaccccagctttactgcaggtgcacgttaaatgccagcactcaggcagccagccatttaggtgtttgtactgcgctgccacattccgcttcccaggtgcccttcagcaccacgtgactaccgagcacttcaagcagtccgaaacaacattcccatgtgagctgtgtggggaactgtttacatctcaggcccagctcgacagtcacctcgagagtgagcatccaaaagtgatgtcaactgagacccaagctgcagcctctcagatggcccaagtcatacagaccccagagcctgtagctcccactgagcaagtcatcactcttgaagaaacccagctggctggctctcaggtctttgtcaccctgccggactcgcaggcatcccaagcctccagtgaactggtcgcagttaccgtagaggatttgctcgatgggacggtgactctcatctgtggagaagcaaaatag

SEQ ID NO: 247175 - DNA, 1269 bp, Artificial Sequence
  Description of Artificial Sequence: Synthetic coding sequence
atggagttccctgaacacgggggaaggcttttgggtcgtctgcggcaacagcgggaactcggatttctgtgtgactgcaccgtgcttgtcggagacgcacgttttcccgcacacagggccgtgcttgcagcttgctcagtctactttcacctgttttacagggacagaccagccggatcacgggatacggtgcgtttgaatggtgacattgtcacagctcctgctttcggtaggcttctcgatttcatgtatgagggacgcttggacctgagaagtcttccagtggaggatgtcctcgccgctgccagctacctccacatgtatgacattgtgaaagtctgcaaagggcgtctgcaagagaaggaccgctctctggacccagggaaccccgctcccggtgcggagcctgcccagccaccttgtccatggcccgtgtggacagccgacctctgccctgcagctcggaaggccaaactgcctccgttcggcgtaaaggcagctctccccccacgagcgtcgggcccacctccctgtcaggtgccagaggagtcggaccaggccctggacctatcgctcaagagtggacccagacaagagagggtgcatccaccctgtgtgctccagacccctctatgctctcagcgacagcccggtgcacagccactcgtcaaggacgagcgggactctctcagtgaacaagaagagagctcatccagtcgcagccctcactcacctccgaagcctccacccgtccccgcagccaaaggactggtggtgggattgcaacccctccctctcagtggggaggggagtagagaactggaactgggcgctggacgtctggcgagtgaagacgagctgggtccaggcggtcctctgtgtatatgtccgctgtgcagtaaactattcccctcaagtcacgttcttcagctgcacctctcggcacattttcgggaacgggactcaacccgcgcaaggttgagtccggacggcgtggcccctacttgtccactgtgcggcaagacattctcttgtacctacactttgaagcgccacgaacgcacacacagcggtgagaaaccgtacacatgcgtacagtgcgggaagtcctttcagtacagtcacaatctgagtcgtcatacagtggtacacactagggagaaaccccatgcttgtcgctggtgtgagaggagattcacccagagcggagatctgtacagacacgtccgcaaattccactgtggacttgtaaaatcattgcttgtttag

SEQ ID NO: 247176 - DNA, 1269 bp, Artificial Sequence
  Description of Artificial Sequence: Synthetic coding sequence
atggaatttcctgagcatggtggcagactgctgggccgtttgcgtcagcagagagagcttggctttctctgtgattgcacggtcctagtcggggacgcaagatttcccgctcatcgcgcagtgctcgcggcttgttcggtgtacttccacctcttttatcgagaccgcccagctggcagtagagataccgttaggcttaacggcgacatcgtgacagctccagcttttggtaggttgttggatttcatgtacgagggtagactcgatctccggagcctgcctgtggaggatgtgctcgcagctgcctcatatctgcatatgtatgacattgtgaaggtgtgtaaagggagactgcaagagaaggatagatctcttgacccagggaaccctgcacctggtgcggaacccgctcagcccccatgcccgtggccagtatggactgcggacctgtgtcccgcagccaggaaagctaaacttcctccctttggagtgaaggcagcactgccaccaagagctagcggccctcctccatgccaggtcccagaggaaagtgatcaggcactggatctctcgttgaagagtggaccgaggcaggaacgcgttcaccctccatgtgtattgcaaacacctctctgttcacagcgccagccaggagctcagcccctggtcaaagatgaaagagactcactcagtgaacaggaagaaagttctagttccagatccccacactccccaccgaagcccccacctgtgcctgccgctaaaggactcgtggtgggccttcaacctttaccactttcaggcgaaggctctagggagctcgaactgggggcagggaggctagctagcgaggatgaactggggcctgggggaccgctctgtatctgtccactctgtagtaaattgttcccctcttcccacgtcctccagctccacttatctgctcactttcgcgagagggatagtacacgcgcaagactttcacctgatggggtggcccctacttgcccgctgtgcggaaagaccttctcatgtacctataccttgaaacgacacgagaggacccacagtggggaaaaaccttatacctgcgtgcagtgcggtaaatcttttcagtattcacacaacctgtcccggcatactgtggtacacacccgggagaaaccacacgcctgccgttggtgtgagcggagatttacacaatcaggtgatttgtaccgccacgtaaggaagttccattgtggtctggtcaagtcactgctggtgtag

SEQ ID NO: 247177 - DNA, 1815 bp, Artificial Sequence
  Description of Artificial Sequence: Synthetic coding sequence
atggccagtacatgggctattcaggcccacatggaccaggatgagcccctggaggtgaaaatcgaggaggaaaagtacacaactcgacaagattgggaccttcggaagaataatacacattcacgtgaggttttccgacagtactttaggcagttttgttatcaagagacctccgggcctagagaagcgttgtctcgcctacgcgagctgtgccaccaatggctgagacctgagacccataccaaggagcagattttggaactgctcgtgttagaacagttccttacgattctgccggaagaactgcaggcctgggtgcaagagcagcaccccgaatcaggggaggaggtggtcactgtactcgaagatctcgagagggagctggatgagcctggcgagcaggtgtctgttcatacaggtgagcaagaaatgtttctgcaggaaacggtgcggttgaggaaagaaggggaaccttccatgagcctgcagtctatgaaagcccagcctaaatacgagagccctgaactggagtcccagcaggagcaggtgttagatgtcgaaaccgggaacgaatatggcaatctgaaacaggaagtttctgaagagatggagccccacggtaagactagttcaaagtttgagaacgacatgtcaaagagcgcaaggtgcggagagacacgtgagccagaggaaatcacagaagagcctagtgcctgctcccgggaggataagcagcccacgtgtgacgaaaacggggtttcccttaccgaaaattccgaccataccgaacaccagcgtatctgccccggtgaggagtcatatgggtgcgatgactgcggcaaggccttttcacagcactcccaccttatcgagcatcaaagaattcataccggagatcgtccttataaatgtgaagagtgcggaaaggcttttagagggcgtaccgtgttaattcgacacaagatcattcatacaggagagaagccctacaaatgtaatgagtgcggaaaggcctttggacggtggagcgccctgaaccagcaccaacgcctgcacaccggggaaaagcattaccactgtaatgactgcggaaaagccttctcccaaaaggctggtctctttcaccacattaagattcacaccagagacaagccctaccagtgtactcagtgtaacaaatcctttagtcgaagatccatactgacgcaacatcagggagtgcacacaggggctaaaccctatgaatgtaatgaatgcggcaaggccttcgtgtacaattcatcacttgtgtcccaccaggaaattcaccacaaggagaagtgttaccagtgtaaggaatgtgggaagtccttttcccagtcaggcctgatccaacaccaaagaatccataccggcgagaagccatacaaatgcgacgtgtgtgaaaaagccttcatacagcgaaccagcctgacagaacaccaacggatacataccggcgagcgaccctataagtgtgataagtgcggaaaagccttcacccagcgatcagttttgactgaacatcaacgaatacacactggggaacgaccttacaagtgtgacgagtgtgggaacgcgtttcgagggataacttcactgatccagcatcagagaatccataccggagagaagccttaccaatgcgacgagtgcggaaaagcatttcggcagcggaaaaagaccagttacaaagagatcctactaaagaatcattccgagccccaggcgggtgtgaacctgctcctgtcgtccctcatcccagaatggcaaagctgtttccgaagagacctgtag

SEQ ID NO: 247178 - DNA, 1815 bp, Artificial Sequence
  Description of Artificial Sequence: Synthetic coding sequence
atggcctccacttgggcgatccaggctcacatggatcaggacgagcccctggaagtgaagatcgaggaagagaaatatactacacgtcaggattgggatctccgcaaaaataacacacattctagggaagtctttcggcagtacttccggcaattttgctatcaggagacgtctgggccaagggaggcattgtcccggctaagggaactatgccatcaatggttaagacccgagacacacacaaaggagcagatcctcgaactcctggtgctggagcagtttttgacaatcttaccggaggagctgcaggcctgggtccaagagcagcatcctgaatcaggagaggaggttgtcactgtgctcgaggaccttgaacgcgagctcgatgagccgggagagcaggttagtgtgcataccggggagcaggagatgttcctgcaggaaacagtgcgccttaggaaagagggcgagccctcaatgagcctccagagcatgaaggctcagcccaaatatgaatctccagaactggagagccagcaagaacaggtcctggatgtagaaaccggaaatgagtatgggaatctcaaacaagaagtctcggaggaaatggaaccacatggtaagacctcatctaaattcgaaaacgacatgtccaaatcggccagatgcggggaaacacgtgagcccgaggagatcacagaagaacccagcgcatgttccagggaagataaacagcccacatgtgatgaaaacggggtatcccttaccgagaactcggaccatactgagcatcaaaggatctgtccgggtgaggagagttatgggtgcgacgattgtggcaaggccttctcccagcattctcacctgatcgaacatcagcgcattcacaccggcgataggccatacaagtgtgaggagtgtgggaaagctttccgcggacggacagtgttaatcaggcataagattatccacaccggggaaaaaccatataaatgcaacgaatgtggaaaggcctttggcagatggtccgcactgaatcaacatcagaggcttcatactggagaaaaacattaccattgcaatgactgtggaaaggccttttcccaaaaggcagggctcttccaccacattaaaattcatacccgcgacaagccctaccaatgtacgcaatgtaacaagtcgttctccaggagatccatcttgacgcagcaccaaggtgtgcataccggggcaaagccatacgaatgcaacgaatgcggtaaagcatttgtgtacaatagttctttggtttcgcatcaggagatccaccacaaggagaaatgctatcagtgcaaagaatgcgggaaaagctttagtcaatcagggctcatccagcaccaaagaatccataccggtgaaaaaccatataagtgtgacgtatgtgagaaggctttcatccagcgtacgagtctaacagagcaccaaaggattcacacgggcgaacgaccttacaaatgtgacaaatgtgggaaggctttcacccagagatcggtactgacagaacaccagagaatccacacaggtgagcgcccttataagtgcgatgagtgcggaaacgcattccgcggtattacatctcttattcagcatcagaggattcatactggcgagaagccataccaatgcgacgagtgtggtaaagctttccggcagaggaagaagacgtcttacaaagagattctccttaagaaccactcggagccgcaagccggagtgaacctgctcctcagcagccttataccagagtggcagtcctgtttccggcgtgatctgtag

SEQ ID NO: 247179 - DNA, 1476 bp, Artificial Sequence
  Description of Artificial Sequence: Synthetic coding sequence
atggccattccaaagcactcactgtcccccgtcccctgggaagaggatagttttctgcaggttaaggtcgaggaagaggaagaggcttcgctatctcagggcggagagtcttcccatgaccacatcgctcacagcgaagcagctcgattgagatttaggcattttaggtacgaggaggcctccggcccacacgaggccctggcccatttgagagctctttgttgtcaatggctgcaacctgaagcgcacagcaaagagcaaatcctggaactcctcgtccttgagcagttcttgggcgcactgcctccagagattcaggcctgggtcggagcccagagtcccaagtctggagaggaggcagctgtgctggtcgaagacctgacccaggtcttggacaagcgtggctgggacccaggcgctgagccgacggaagccagctgcaagcagtcagacctgggagaatccgaaccttccaatgtaaccgagactctgatgggtggcgtgagcctggggccagcatttgtcaaagcatgtgaaccagaaggcagctctgaacgctccggcctgtccggcgaaatctggaccaagagcgtaactcagcagatacacttcaaaaagaccagcggcccttacaaggatgtcccaacagatcaacgcggacgggaaagcggggctagcaggaactcttcatctgcctggcctaatttaactagccaggaaaagccaccttccgaggacaaatttgatctggttgacgcctatggaactgagcccccttacacatacagcggcaagcggagctctaaatgccgggagtgtagaaaaatgttccagagtgctagcgctcttgaggcccatcagaaaactcacagccggaaaaccccctacgcatgcagtgaatgtgggaaggcatttagccgcagcacacacctggctcaacatcaagtcgtccacacaggggctaagccacatgagtgcaaagaatgcggcaaagcgttcagccgggtcactcatctgactcagcaccaacgtatccatacgggagagaagccttacaaatgtggcgaatgcggcaaaactttctcccgttcaacccacctcactcaacaccagagggttcataccggggagaggccctacgaatgtgacgcctgcggcaaggcttttagtcagtccactcacctgacccaacatcagaggattcacacgggcgagaagccctacaaatgtgacgcttgcggcagagccttctcagactgcagcgctctcattaggcaccttaggatacattccggcgaaaagccctaccagtgcaaagtgtgtcccaaggcatttgcccaaagttctagcttgatcgagcaccagagaattcataccggtgaaaagccttacaagtgtagcgactgcggaaaggcattttcccgcagctccgcactgatggtccatctaagaatacacataacggttctacagtag

SEQ ID NO: 247180 - DNA, 1302 bp, Artificial Sequence
  Description of Artificial Sequence: Synthetic coding sequence
atggcgctggatctgcgaacgatattccaatgcgaaccctctgaaaataacctgggaagtgagaattccgcctttcaacagagccagggacccgctgttcagagggaggaggggatcagtgagttttcacggatggtactgaactcattccaggactctaacaattcatacgcccgtcaggaattgcagcggctttatcggatcttccattcttggctgcaaccagaaaagcatagcaaggacgaaataattagcctgctagtgctcgagcagttcatgataggcggtcattgtaacgacaaggcctccgtaaaagaaaaatggaagtcctccggaaaaaacttagaacggttcatcgaggacctgacggacgactcaattaatccacctgctttggttcacgtgcatatgcagggacaagaggcattgtttagcgaagatatgccccttcgtgatgtgatagtgcacctcaccaagcaggtgaacgcccagaccaccagggaggctaacatgggcacgcccagccagacatctcaggatacatccctcgaaacaggacaagggtatgaggacgagcaggacggctggaacagttcttccaagaccactcgggtcaatgaaaacattacgaatcaggggaaccaaatcgtatcccttattataattcaggaggaaaatggccctcggccagaggaaggcggtgtcagtagtgacaacccttataacagtaagagagcggagctggttaccgcccgttcccaagagggatccataaacgggattaccttccagggagtacccatggtgatgggggctggctgcatatcacagccggagcagtctagtccagaatcagccctgacgcaccaaagcaacgaaggcaactccacgtgtgaggtgcatcaaaagggatctcatggggtgcaaaagagttacaaatgtgaggagtgccccaaggtttttaagtatctgtgccacctgctggctcatcagcgcagacaccgaaacgagcgacctttcgtgtgccctgaatgccaaaaagggttcttccagatctccgacttacgagttcaccagattatccacaccgggaagaagcctttcacctgcagcatgtgcaagaagtcattttcccataagacgaaccttcgcagccatgagcgaattcacaccggggaaaaaccctacacctgtccattttgtaagacatcatatcggcagagctccacctaccaccgtcatatgagaacacacgaaaagatcacccttcctagcgtccccagcaccccagaggcctcgtag

SEQ ID NO: 247181 - DNA, 2433 bp, Artificial Sequence
  Description of Artificial Sequence: Synthetic coding sequence
atgcccaaccaaggtgaggattgctatttcttcttctattctacttgcaccaagggcgatagctgtcccttcagacattgtgaggccgctatcggtaacgaaaccgtgtgtacattgtggcaggaaggcagatgctttagacaggtctgtcgatttagacacatggaaattgataagaaacggagcgaaatcccatgttactgggagaatcaacctaccggctgccagaaattgaattgcgcctttcatcacaatcgagggaggtatgtggatggcctcttccttccaccatccaagactgtgctgcccacggtgccagagtcccctgaagaggaggtaaaagctagccagctgtcagttcagcaaaacaagctgtccgtccagtccaacccttccccccagttgaggagtgtaatgaaagtggaaagctccgagaatgtgcccagccctactcacccaccagtagtcatcaatgccgcagacgacgatgaggatgatgatgaccagttcagcgaggagggagacgagaccaagaccccgacattacaaccgactccagaagttcacaatggcctgcgtgtcacaagtgtgagaaagccggctgtgaacattaagcagggagaatgcttgaatttcggtattaagactctggaggagattaagtctaagaaaatgaaagaaaaatctaaaaaacagggcgaggggtcctcgggagtctcgtcccttctactccaccccgaacccgtaccaggccctgaaaaagagaacgtgcggaccgttgtcagaaccgtgactctcagcactaaacagggagaggaacccctcgtccgtctgagcctaactgagcgcctcggtaaacggaaattttctgctggtggtgacagtgacccacccctgaagagaagcctcgcccaacgcctaggtaagaaggtggaagcccctgagaccaatatagataaaactccaaaaaaggcccaggtgagcaagtctctcaaggagcgtctggggatgagcgccgacccagacaacgaagacgccactgacaaggtcaataaggtgggcgaaatccacgtcaagaccctggaagaaatcctgctcgagagggcatcccaaaagaggggagaactccagacaaaactgaagaccgagggacctagtaaaaccgacgactctacctctggtgccaggtctagtagcactattagaattaaaactttctccgaggtgctggcagagaaaaaacataggcaacaagaggcagagcgccaaaaatccaagaaggacactacttgcattaagcttaaaattgacagcgagatcaaaaagaccgtggtattgcccccaatagttgcctcacggggtcagtctgaagagcccgctggtaaaactaagtcaatgcaggaagtccacatcaagactctggaggagatcaaactggagaaggccctgcgggttcaacaaagttccgagtcatctacaagctcaccatcccagcacgaagccacaccaggagctcgacgcctgttacgcataactaagaggaccggcatgaaggaggagaagaatctgcaagaaggaaacgaagtcgattcccagtcaagtatccggactgaggctaaggaggcaagtggcgagacaactggggtcgacattaccaagatccaagtcaagaggtgcgagactatgagagaaaaacacatgcagaaacagcaagagagagaaaaatctgtgctgacgccgctgagaggcgacgtagcctcctgcaatacgcaagtggccgagaaacccgttctgaccgctgtccccggaatcacccgacatctgaccaagagattacccacaaagtcttcacagaaggttgaggtggaaaccagtggaataggggattcactcctgaatgtgaagtgcgccgctcagactttagaaaagcggggaaaagccaagcctaaagtcaacgtgaagccttctgtcgttaaagttgtaagctctcctaagctagcaccgaaacgcaaagccgtggaaatgcatgctgcggtgatcgccgcagtcaagcctttaagctcctctagtgtactccaggaaccgccagccaaaaaggctgcagttgcggtagttccattagtatctgaagacaagtccgtgacagttccggaagcagaaaaccctcgcgactccctggtgctaccacctacccagtcgtcttccgattcaagcccgcctgaggtgtctgggccatcaagtagtcagatgagcatgaaaacaaggcgtttgtcttctgctagcactggaaaaccccctttatcggtcgaggacgatttcgagaagctaatctgggaaattagcgggggaaaactcgaggcagaaatagacttggatccaggcaaagacgaggatgacctcctgctggaactgagtgaaatgatcgattcttag

SEQ ID NO: 247182 - DNA, 2433 bp, Artificial Sequence
  Description of Artificial Sequence: Synthetic coding sequence
atgccaaatcagggggaggactgttattttttcttttattcaacctgtacaaagggtgactcctgcccattcaggcactgtgaggcggcaatcggcaatgaaacggtgtgtacactgtggcaggagggccgttgcttcaggcaagtgtgtcgatttcgccatatggagatcgataaaaagaggtccgaaatcccctgttattgggaaaaccagcccaccggttgccagaagctgaactgtgcattccatcataatagaggacgctacgttgatggactgttcctgcctccctccaaaacggttctgcccacagtccccgaaagcccagaggaagaggttaaggcctctcagctaagcgtacagcaaaacaaactcagcgtacagtctaatcccagccctcagttaagaagtgtaatgaaggtggagagctccgagaacgtccccagccctacccatccccctgtcgttattaacgccgctgatgatgatgaagatgatgacgaccagttcagcgaagagggggacgagacaaagacgcccacactacagccaacacctgaggttcacaatggactgcgggtaaccagcgtcagaaagcctgccgttaatattaagcagggcgaatgtttaaacttcggcataaagactctcgaagaaatcaaaagtaagaagatgaaggaaaagagcaagaaacagggcgaagggtcctcaggcgtctcctcgctgctcctgcaccccgaaccagtgcctggcccagaaaaagaaaatgtccggaccgtcgttaggacggtcaccctttctactaagcaaggagaggagcccttggttcgcctctctctaacggagcgtcttggtaaaaggaagttctcagctggcggagatagcgatccacccctgaagcgcagcctcgcccagcggcttggcaagaaagttgaagctcctgagacgaatatcgataaaacaccaaagaaagcccaggtctcaaagtctctcaaagagcggctcggtatgagcgcagatcccgacaatgaggacgccacagataaggtgaacaaggtcggtgaaattcatgttaagaccctggaagaaattctgcttgagcgagccagtcagaagcggggagagctgcaaaccaaactgaagacagagggaccttctaaaaccgacgattctactagcggagcacgctcatcttccactattcgcataaagaccttttcagaggtgttggccgagaagaaacatcggcagcaggaggcagaacgacagaagagcaagaaagacaccacatgtataaaactgaagattgattcagagatcaagaaaacagtcgttctgccccctatagttgcttcccgtggacaatcagaagagccagctggcaagaccaagtccatgcaggaagttcacatcaaaaccctcgaagaaatcaagctcgagaaggctctgcgggtgcagcagagttctgaaagttccaccagcagtccatcgcagcacgaggcgacaccgggagccagacgactgctccggattacaaaacggacaggcatgaaagaagagaaaaacctgcaagagggcaacgaggttgacagccagtccagtatccgtacagaggcaaaggaggcttctggcgagacaacgggagtagatattactaagattcaggtgaagagatgcgagacgatgagagaaaaacatatgcaaaagcagcaagaacgcgagaaatcagtgctgactccactccggggagacgtcgcaagttgtaatacgcaggtggctgagaaacccgtacttaccgccgttcccggtattacacggcacctcacaaagaggttgccaacaaagtcatcgcaaaaggttgaagtcgaaaccagcgggatcggagacagtctcctgaacgtcaaatgtgctgcacagacactggaaaagagggggaaggccaagccaaaggtgaacgtcaagccttccgtggttaaagtcgtgagtagtcccaagttggctcccaagcgaaaggctgtcgaaatgcatgcggctgtcatcgccgctgtgaagcccctcagcagcagcagtgttttgcaagaaccacccgcaaagaaggcagctgtcgcagtcgtgccactagtgagcgaggacaagtcagtgaccgtccctgaggcggaaaatcccagggactctctggtgttacctcctacccagagctcttctgacagttccccacccgaagtttcagggccatccagctctcaaatgtctatgaaaacccggagactcagcagtgcgtctacgggcaagcctcctctgtctgtcgaggacgatttcgaaaagctgatttgggaaatcagtggtggcaagctcgaggctgagatcgatctggatccagggaaggacgaagacgacctcctgctggagctctcagagatgattgattcctag

SEQ ID NO: 247183 - DNA, 2433 bp, Artificial Sequence
  Description of Artificial Sequence: Synthetic coding sequence
atgcctaatcagggtgaagattgctattttttcttttattcaacttgtactaaaggggattcctgccccttcaggcactgcgaggcggctatcggaaatgaaactgtgtgtacactgtggcaggagggaagatgcttcagacaggtctgtagattccggcacatggagattgacaagaagcgctctgagatcccatgttattgggagaaccagccgaccggctgccagaaactgaactgtgcattccaccataatcggggaaggtatgttgatggcctctttctgcccccatcgaaaacggtgttaccaaccgtgcctgagtctcccgaagaggaggtgaaggctagtcagctgagcgtgcagcaaaacaaattaagtgttcaatcaaatcctagccctcagctccgcagtgtgatgaaggttgagagtagtgaaaacgttccatccccaacgcaccctcctgttgtcattaacgccgcagatgacgacgaagatgatgatgaccagttcagcgaggagggggacgagactaagactccgacgttgcagcccaccccagaggtccataatggtctgcgagtgactagtgtgagaaagcccgcagtgaatatcaaacagggagagtgtctcaattttgggatcaaaacgctggaagagattaagtcgaaaaagatgaaagagaaatctaagaagcagggtgagggttcctcaggggtctcttccctcctgcttcaccctgagccagtccctgggcctgaaaaagaaaacgttcggaccgtcgttcgaaccgtgaccctcagtaccaagcagggagaggagccactcgttaggttgagccttacagaacgccttgggaagagaaagttcagcgcgggaggagactcagatccaccacttaagagatcgttggcccagcgactgggaaaaaaagtggaggcccctgaaacaaatatcgacaaaactcctaagaaagcccaggtctccaaatctctaaaggagaggcttggcatgtctgctgaccccgacaacgaggatgctaccgataaagtcaataaggtgggggagattcatgtgaaaactcttgaggagatcctgctggaacgcgcatcccagaaaagaggcgaactacagactaaacttaagacagaagggccatcaaagaccgatgatagtacctccggtgctaggtcaagtagtaccatacgaataaaaaccttcagtgaggttctcgccgaaaagaagcatcgacagcaggaggccgagaggcagaaaagcaagaaggataccacttgcattaaactgaaaatcgattccgagattaagaagacagtcgtgttgccacccattgtcgctagccggggtcagtccgaagagccagcaggtaagaccaaatctatgcaagaggtccacatcaaaaccctggaggaaataaagttagagaaagccctgcgggtgcaacaaagcagtgagagctccacgtcctccccatctcaacacgaggcaacacctggagcccgtcgccttttgcgcattacgaagcggaccggcatgaaagaagaaaagaatctacaagaaggcaatgaggtcgattcccagtcaagtatcagaactgaggcgaaagaggccagcggcgaaacaactggggtggatatcactaaaattcaagttaagaggtgtgagacaatgcgcgagaagcatatgcagaagcagcaggagcgagagaagagcgttcttacaccactgcggggtgatgttgcatcttgcaacacccaggtggctgagaagcctgtgctcactgcagttcccggaattacgcggcacctgactaagcggctccccacaaaatctagccagaaggtggaagtggaaacctccggcattggagattctctgctgaacgttaagtgtgccgctcagaccctcgaaaaacgcggaaaagccaaacccaaggtaaacgtgaaaccctccgtagtcaaggtggtttcaagccctaagctggcccctaaaagaaaggcggtggaaatgcacgcggcagttatagccgcagtgaaacctctatcctctagttccgtcttacaagagccgcctgccaaaaaggcagccgtggctgtcgtcccactggtttccgaggataaatctgttacggtgccagaggcagagaacccgagagattctctggtgttgcctccaacccagtccagttcagactcatctccacccgaggtcagcgggccatctagctcacagatgagtatgaaaaccagaagactgtcttctgcttctaccggtaagccgccactatctgtggaggatgacttcgaaaagctcatttgggaaatttctgggggaaaacttgaggcagagattgacctggatcctgggaaggatgaggatgatttacttctggaactgtcagaaatgatagattcttag

SEQ ID NO: 247184 - DNA, 2433 bp, Artificial Sequence
  Description of Artificial Sequence: Synthetic coding sequence
atgcccaatcagggcgaggactgttactttttcttctacagtacctgtaccaaaggcgattcttgccccttccggcactgcgaggccgcaatcgggaacgagaccgtgtgcacactctggcaggaagggagatgttttcgccaggtctgtcgattccggcatatggaaattgacaaaaagaggagcgagatcccgtgttactgggaaaatcagcccacagggtgtcagaagttgaattgcgccttccaccataacaggggaaggtacgtggatggcttgtttctgcctcctagcaagaccgtcctcccgacggtcccggagtctcctgaagaggaggtgaaggcaagtcagctgtcagtccagcagaacaagctgtctgtacagagtaacccaagtcctcagcttcgaagcgtcatgaaagtcgagtcaagtgagaacgtcccctctcctacccaccctccagtggtcatcaacgctgctgatgatgacgaggatgacgatgaccagttcagcgaagagggagatgagaccaaaaccccgactctgcaacctaccccagaagttcataacgggttgcgagtgaccagtgtgaggaagcccgcagtcaacattaaacagggcgagtgtttgaattttggcattaaaacactcgaagagattaaaagtaaaaagatgaaagaaaagtcgaagaaacagggggaggggtcctctggtgttagttccctgctgctgcatcctgagccggtccctggccctgaaaaggagaacgtgcgaactgtggtacgcactgtgactctgtctacgaagcagggagaagagcctctggtccgcctgagtctaaccgagcggctgggcaagcgcaaattctccgctggtggagatagcgatcccccactcaagaggtcacttgcacagcgcctgggcaaaaaggtcgaggcccctgagaccaatatcgataaaacccccaaaaaggctcaggtatcgaagagtttgaaggagcgcctggggatgtccgcagaccccgacaacgaggatgcaacagataaggtgaacaaagtaggggagatccacgtgaaaacattggaagagatactgctggagcgggctagtcagaagcggggtgagctacaaacgaagctgaagaccgagggtccatccaagacggatgacagtacgtccggagccaggtcctcaagcaccataagaataaagactttcagtgaagttctcgctgaaaagaaacataggcagcaggaggccgaacgacaaaaatcaaaaaaggacactacctgcattaagctcaagatcgactcggaaatcaagaagaccgtcgttctgccccctattgtagcctccagaggacagtccgaggagccagccggtaagacgaaatccatgcaggaagtgcacatcaaaactctggaagaaatcaaactagagaaggccttacgtgtgcagcagagctccgaaagcagcacttccagtccaagtcagcatgaagcaacacccggtgcgaggcgcctgctcagaattaccaagagaactgggatgaaggaggagaaaaacttgcaggagggcaatgaagtggactcccagtcctccattaggacagaagctaaggaagcgtccggtgaaactactggggtggatataaccaaaattcaggtcaaacgctgcgagactatgcgggagaagcacatgcagaaacagcaggaacgggagaagagcgtactaactccacttcggggagatgttgcctcctgcaacactcaggttgccgagaagcctgttctgacagcggtgccgggaattactcgtcacctaaccaagaggttgccaacaaaaagctcgcaaaaggttgaagttgagacctctggtattggcgatagccttctcaacgtgaagtgcgctgcacagacacttgagaaacggggaaaagccaagcccaaagttaatgtcaagccatcggtggtgaaagtggttagcagtcccaagttggctcccaagcgcaaagccgttgaaatgcatgccgctgtaattgcggcagtgaaacctttgagttcttcctctgtattacaggagcctcctgccaaaaaagctgccgtcgcagttgttccactcgtatcagaagataaaagcgttaccgtcccagaagctgagaatcctcgggattccctcgttttgcctcctactcagtcttcttctgacagcagtccacctgaggtgagcggcccaagttccagtcagatgtctatgaaaacacgcaggctgagcagcgcctccaccgggaagccccctctgagcgtggaagacgattttgaaaagctgatctgggaaataagcggcggaaaacttgaggccgagatcgacctcgacccaggcaaagacgaagacgacctcctgctcgaactatcggaaatgattgactcatag

SEQ ID NO: 247185 - DNA, 153 bp, Artificial Sequence
  Description of Artificial Sequence: Synthetic coding sequence
atgcccaatcagggagaagattgctatttctttttctattctacttgcacaaagggggattcctgtccgttccggcactgtgaagcagcaattggcaatgaaacggtgtgcaccctgtggcaggaaggcaggtgtttccgtcaggtttgttag

SEQ ID NO: 247186 - DNA, 1548 bp, Artificial Sequence
  Description of Artificial Sequence: Synthetic coding sequence
atgccgaaccagggtgaagattgctatttcttcttttatagtacctgtaccaagggggactcctgcccattccggcactgtgaggcagcaattggaaacgagacggtctgtaccctttggcaggaaggaaggtgctttcggcaagtttgccgattccgccacatggaaatcgacaagaagcggtccgaaatcccgtgttactgggagaaccaacccactggatgtcagaagctgaattgtgcgtttcaccacaaccggggaagatacgtcgacggcttgttcctaccgccatctaagaccgtcttacccactgttcccgagtcaccagaagaagaggtcaaagcctcccagctgagcgtccaacagaacaagttatctgtacagtcaaatcctagcccacaactgagatccgtgatgaaagtcgagtccagcgaaaacgttccctcacctacgcacccaccagtggtgattaacgccgcagatgatgacgaggacgatgacgaccaattcagtgaggaaggagacgagaccaagacccccacactccagcctacacctgaagtgcacaatggcttgagagtgactagtgtccggaaacctgctgtgaacattaaacagggggagtgcctgaactttggaatcaaaacactggaggagataaaatccaagaagatgaaggaaaagtcaaagaagcagggtgaagggtcttcaggcgtatccagtctcctcctgcaccctgagcctgtgcctgggccagagaaagagaacgtgcgtaccgtagttcgcaccgtaacactttcaactaaacaaggagaagagccccttgtccgcttgtcgctgaccgaacggctgggtaaacggaaattcagcgccggaggagacagcgacccccctctgaaaaggagcctcgcccaacggctcggaaagaaggtggaggcgccagagacaaatattgataaaaccccaaaaaaggcacaggttagtaagagcctaaaagagagacttggaatgtcagctgaccctgacaacgaagacgcgaccgacaaagtgaacaaggtgggagagatccacgttaaaacactggaggagattttattagaacgcgcaagccagaagcgaggggaactgcaaacgaaactgaagaccgaaggcccatccaagacagacgatagtaccagtggcgctcgctcctccagcactatccggatcaagacatttagcgaggtcctggccgagaaaaagcaccgacagcaggaggccgaaaggcagaagagcaagaaagacacaacttgtatcaaacttaagattgacagcgaaataaagaagaccgttgtcctgccccctattgtagcatcccgcggtcaaagcgaagagccagcgggtaaaaccaaatccatgcaggaagtgcacattaagaccctagaggagatcaagctggagaaagcgttacgggtccagcagagcagtgagtcctccaccagctcaccaagccagcacgaagctactcccggagcacgcagacttctgcgcatcaccaagcgcacgtag

SEQ ID NO: 247187 - DNA, 2271 bp, Artificial Sequence
  Description of Artificial Sequence: Synthetic coding sequence
atggaaatcgataaaaagcggtcagaaatcccctgttactgggagaatcagccaactggttgccagaagcttaactgtgcattccaccacaatcggggtcgctacgtggatgggctgttcctgccccctagcaagaccgtgctccccacagtgccagaaagccccgaagaggaggtaaaagcatcccagttgtcagtgcagcagaataaattaagcgtgcagtcaaacccatcgccccagcttaggagcgtgatgaaggtggaatctagtgagaacgtgccttcgcctacacacccgccagtggtgatcaacgccgcagatgacgacgaggatgatgacgatcagttcagcgaagaaggcgacgaaaccaagacacccaccctgcaaccaacacctgaagttcacaatggccttcgggtcacgagcgtaaggaaacccgcagtcaacattaaacagggtgagtgtctgaatttcggcatcaaaaccctggaagaaatcaaatctaagaaaatgaaagaaaaaagcaagaaacagggagaggggtccagcggggtgtcatcattgctgctgcaccccgagcccgtacccggtccagaaaaggaaaatgttagaacagtagtgaggacagtgaccctgtccactaaacagggtgaggagcccttggttcgtttatccctcacggagagacttgggaaacgaaaatttagcgccggaggggatagtgatcccccattgaaaagatctctcgcacagcgactgggaaagaaggtagaggcccctgaaaccaatatcgacaaaacccccaaaaaggcccaggtgagtaagtctttaaaggagcggctgggtatgtccgctgaccccgacaatgaggatgcgactgacaaggtgaataaggtgggagagattcacgtgaaaactctcgaagaaatactcttagaacgggcatcccagaaaagaggagagttgcagacgaagctgaagacagagggacccagcaagaccgacgattcaacgtccggcgcaaggagctcttccactatccggataaaaacattctctgaggtgttggccgagaaaaagcataggcagcaggaagcagaaaggcaaaagtccaaaaaggatactacatgtatcaagctgaagattgacagtgagataaaaaaaacggtggtgcttccgcctattgtggcttcgaggggccaatccgaagaacctgccggtaagacaaaatctatgcaagaggtgcacatcaagacacttgaggagataaagctggagaaagctcttcgagtacaacaatcttccgagtctagcacatcaagccctagccagcacgaggcaacaccaggagctcgtcggctgctgcggatcacaaagcgaaccgggatgaaagaagagaaaaatttgcaggaaggcaacgaagtggatagtcaatcttcgatccggacagaagctaaagaggcatccggagaaaccacgggagtcgacatcactaagattcaggtcaagcgttgtgaaacaatgagagagaagcacatgcaaaagcagcaggagcgggagaagtcagtcctgactccacttcgcggagacgtcgcatcctgcaacacacaggtagccgaaaaacctgtgctcactgccgttccaggaatcactagacaccttactaagcggctccctacaaaatcctctcagaaggtggaggtggaaacctccggcattggggatagcttgctgaacgtgaaatgtgctgcccagactctggagaaacgcggtaaggctaagcccaaggttaacgttaaaccttccgtggttaaggtggtcagctctccgaagttggcccctaagcggaaggcagtcgagatgcacgctgcagttatagctgccgtcaagccccttagctcttcttctgtcctccaggagcccccagcaaagaaggccgcagtggctgtggtaccactcgtgtccgaggataaatcagtcacggttcccgaagctgagaaccctcgagatagcttagtcctgccacccacccagtcatcctccgatagcagtccgcctgaagtgtccggcccatcttcctcccagatgtcgatgaagacaaggcggctttcctcagcgagcacaggaaagccaccactgagcgtagaggatgacttcgaaaaactgatctgggaaattagtggaggaaaactggaggccgagatcgatctggacccgggaaaggatgaggacgatctcctcttggaattatcagaaatgatcgatagttag

SEQ ID NO: 247188 - DNA, 2433 bp, Artificial Sequence
  Description of Artificial Sequence: Synthetic coding sequence
atgcctaatcagggagaagactgttacttcttcttctattccacgtgcactaagggcgatagctgccccttccgacactgtgaggccgctattggtaacgaaaccgtatgtaccctgtggcaggaaggcagatgttttcggcaggtttgtcgcttcagacacatggagattgataaaaagcggagcgagatcccatgttactgggagaaccagccgaccgggtgtcaaaaactgaattgcgcattccaccataatcgcggtcggtacgtagacggcttgttcctccctcctagcaaaaccgtgctgcccaccgtacccgagtccccagaggaggaagttaaagcatcgcaattatctgtccagcagaacaaactgagcgtgcagtcaaatcctagtccgcagctgcgaagcgtgatgaaagtcgagagcagcgaaaacgttccaagcccaactcatccgccagtggtcatcaatgctgccgatgacgatgaggacgacgatgatcaatttagcgaggagggtgatgaaactaagactcctactctgcagcctacacccgaggtgcataatggtctgagagtgaccagcgtgaggaagccagcggtgaacatcaaacagggtgaatgtctgaacttcgggataaaaaccctggaagagataaagagcaagaaaatgaaggaaaagtcaaagaagcagggagaagggagtagcggtgttagcagcttattacttcatccagaacccgtccccggtcctgagaaagagaacgtcaggaccgtggttaggactgtaacactgagtaccaaacagggggaggagcccctggtgaggctatcactcaccgagcggctaggaaagcgaaaattctcagcagggggtgatagtgatcccccactcaagcggtctctggctcagagactgggaaaaaaggtggaagctccggagacaaacatagacaagactcctaagaaagctcaggtcagcaagtcactcaaagagcggttgggcatgtccgccgatcccgacaacgaggacgctaccgacaaagtgaacaaggtgggggagatccacgtaaagactcttgaggagattctgcttgaacgggcaagtcagaaaaggggtgagttgcagaccaaattaaagacagaaggcccatctaaaaccgatgactctacctccggtgccaggagcagctcgacgattaggatcaagactttcagcgaggtgctagccgaaaagaaacatcggcagcaggaggcggaacggcagaaatccaagaaggacaccacgtgcatcaaactcaagatagattctgaaatcaaaaagaccgtggtgcttccgcctatcgtggcctctagaggacagtccgaagaacctgcgggtaaaactaaaagtatgcaggaagtccacatcaaaacactggaagagattaagttagagaaggccctgagagtgcagcagtcttctgagagctctacgtcctctcccagtcagcatgaggccactccaggcgctcgacggctgcttaggatcactaaaagaaccgggatgaaagaggagaaaaatctgcaggagggcaacgaagtggattcgcagtcctccatcaggacagaggccaaagaggctagcggagagacaacaggtgtcgatattaccaaaattcaggtgaaacggtgcgaaacgatgcgggaaaagcatatgcagaaacagcaggagagagaaaaatccgtattgacgcccttacggggagacgtagcctcatgcaatactcaggtcgccgagaagcctgtactgaccgcggtcccaggcattaccagacacctgactaaaagacttcccaccaaaagttcccagaaagtggaggtggaaacatcaggaataggcgactctttgctaaacgtaaaatgtgctgcacagaccttggagaagcgaggtaaagctaagccaaaggtaaatgtgaaaccttccgtggtgaaggtggtgtcttcaccaaaattggctcctaagcgtaaggccgtcgaaatgcacgcagccgtgattgcagcagtgaagcctttaagctcttcctcagtgcttcaggagcccccagccaagaaggcagctgttgctgttgtgcccctcgtgagtgaggacaaatctgttactgtcccggaagcggagaacccaagggacagcctcgtcctgccgccaactcagtcctcttccgatagctcacctcccgaagtatcaggcccttcctcctctcagatgagtatgaagaccaggagactttcctcagcgagtactggcaagcctccactctctgtagaagatgacttcgagaaactaatatgggagatctcaggtggaaagcttgaagccgaaatcgatcttgaccctggcaaggatgaggatgacctgctgttagagctgtccgaaatgatagattcttag

SEQ ID NO: 247189 - DNA, 1584 bp, Artificial Sequence
  Description of Artificial Sequence: Synthetic coding sequence
atggaacatccaagcaaaatggagtttttccaaaaattgggatatgatcgcgaagacgtgctgcgcgtgttgggcaagcttggcgagggagccttagttaatgacgtgttgcaggagctgatccggacaggtagtcgccctggggctcttgagcaccccgctgccccacgcctggtgccgcgtggctcatgcggagttccagactctgctcagcgaggcccaggtaccgccctggaagaggacttcaggactctggcttcttctttaagacctattgttattgacggcagtaatgtcgcaatgtcccacggaaacaaagaaaccttctcttgcagggggattaaactggccgttgattggtttagagataggggtcatacatacataaaagtattcgtgccctcctggcgcaaggacccaccaagggcagataccccaatccgggagcagcacgtactcgctgagctggagaggcaggcagtgctggtttacactccctctcggaaggtgcatggaaagcgcttagtttgctatgacgataggtacatagtgaaagtggcctacgagcaggacggcgtgatagtctccaatgacaattatcgagatttacaaagtgaaaacccagagtggaagtggttcatcgaacaacgactgctgatgttctcctttgtgaacgatagattcatgccaccggatgatcctctagggcgacacgggccttcactctctaactttctttctagaaagcctaaacccccagaaccaagctggcagcattgtccttatggaaagaagtgcacttacgggattaagtgtaaattctatcaccccgagaggccccaccatgcgcaacttgcagtcgccgacgaattacgagctaagaccggtgcccgaccgggtgcaggggcagaggagcagcgtccacctagagcaccgggtgggtccgcaggggctcgcgcagctcctagggagccttttgctcactctctcccccctgctcgcggatcacctgacctcgccgctctgcggggatccttttcacgacttgctttcagtgacgacttgggacctctcggaccaccattgcctgtccccgcatgtagtctgactccgaggctcggcggacccgattgggtctcagccggtggaagagtgccaggcccattatctctgccctcaccggagagccaattctcacctggggatctgccaccgccaccagggctacagctacagcccagaggcgagcaccggcctagggatctgcacggcgatttactgtccccacgtcgcccacctgacgatccgtgggcaagaccaccgcgaagcgataggttccccggacgcagtgtgtgggcagaacctgcatggggagacggcgcaacgggcggtctgtccgtgtacgcgacggaggacgacgaaggagatgctcgtgcacgggctcggatcgccctgtactcagtcttccccagggaccaagttgacagagtgatggcagctttccccgagctgtctgacctggcacgcctgattctgctggtgcagagatgccagtctgccggagcccctctaggcaagccctag

SEQ ID NO: 247190 - DNA, 1584 bp, Artificial Sequence
  Description of Artificial Sequence: Synthetic coding sequence
atggaacacccatctaagatggagttcttccagaagcttggatatgatcgtgaagatgttctgagggtgcttggtaagctgggagaaggagccttggtgaacgatgtgctgcaagaactgattagaacaggatcccgccctggcgctttggaacatccggctgcaccccgactggtaccgaggggctcctgcggggtcccggacagtgctcagcgagggccaggcactgcactcgaggaggattttcgaaccctggcctccagtctccggcctatagtgattgatggtagtaacgtcgccatgtcgcacggcaacaaggagaccttctcgtgcaggggtatcaagttagccgtcgactggtttcgggataggggacatacctacatcaaggtctttgtgccctcctggagaaaggaccccccacgggctgatactcctataagagaacagcacgtgctagcagagctggagagacaggccgtgctggtgtatacaccaagcaggaaagtgcacggaaagaggctggtgtgctacgacgaccggtatattgttaaagtggcctatgagcaggacggggttatcgtgagcaatgacaactaccgtgacctacagagcgagaaccctgaatggaagtggtttattgagcagcggctcctcatgttttcatttgtcaacgaccggtttatgccccctgatgacccgctggggagacatggtccatctctgtctaattttttgtcacggaaaccaaaacctcccgaaccctcctggcaacactgtccgtacggaaagaaatgtacttatggaatcaagtgcaaattctaccaccccgagcgccctcatcacgctcaactggctgtcgccgatgagctgcgtgctaaaacgggggcaaggccgggagcaggggcagaagagcagaggccaccccgagctcctgggggtagcgctggggcaagagccgcaccacgcgaaccattcgctcattcactgccacccgcaagaggaagcccagatttggctgccctgaggggctccttcagtcgacttgccttcagcgatgacctcggacctttggggcctccattacctgttccagcctgcagtcttacgcctcggctaggcggtcccgattgggtatctgccggaggcagggtacccggacccctatcattgccttctccggagtcacagtttagcccaggggatctacctccaccgccaggtctacaactgcaacccagaggggagcatcgacccagagatctgcacggagacctgctatcccccaggagacctccagatgacccatgggccagaccacctaggagcgataggtttccaggccgatccgtttgggccgagcctgcttggggcgacggagccaccggtggcctctctgtctatgcaactgaggacgatgaaggagatgcacgggcaagagctcgtatcgcgctgtactccgtgtttcctagggaccaggtggaccgggttatggcggcatttcccgagttgagcgacctggctcggctgattctattagtgcaacgttgtcaatccgcaggggcaccgcttggcaaaccctag

SEQ ID NO: 247191 - DNA, 966 bp, Artificial Sequence
  Description of Artificial Sequence: Synthetic coding sequence
atggagcacccctccaagatggagttttttcagaaactggggtacgacagggaagatgtgctccgcgtgctcggcaaactcggagagggagcgctcgtgaacgatgttctgcaagaattaataagaaccggctcgcggcctggtgctctcgagcacccagcagcacctaggttggtcccgagaggaagctgcggcgttcccgacagcgcgcagcgcggaccagggacagccctagaggaagattttcggactctggcttccagcctacggccaatcgtgattgacgggtcaaatgttgctatgtcccatggaaataaagaaaccttcagctgtagaggaatcaagctcgctgtcgactggttccgagataggggacatacctacatcaaagtttttgtcccctcttggaggaaagatcccccacgggctgacacccccatacgtgaacagcatgtgttggccgaactagagcgacaggctgttctcgtgtacaccccgagcagaaaggtgcacggaaagaggcttgtgtgctacgatgacaggtatatagtaaaagtcgcctatgagcaggatggagtgattgtgtcgaatgataactaccgggatctgcagagtgaaaatcctgagtggaagtggttcatagagcagcgactacttatgtttagcttcgtaaatgatcgtttcatgccaccggatgatccactagggaggcacgggcctagcctgagcaactttctctcaaggaagcctaagccacctgagccatcatggcagcactgcccttacggtaagaagtgtacttatggaatcaaatgtaagttctatcaccccgaaagaccccaccatgcccagttggccgtggcagacgagctcagagccaagactggcgctcgcttgggagtccgtggcagacctcccgcatcagcacgcccagctgccccagccgctgggaggactcccccatag

SEQ ID NO: 247192 - DNA, 966 bp, Artificial Sequence
  Description of Artificial Sequence: Synthetic coding sequence
atggagcatccgtccaagatggagttttttcagaagcttgggtatgacagagaggacgtgttgcgcgtcttaggaaaattaggagaaggcgcactggtcaacgacgtcctgcaggagctgatccggactggctctcgtcctggtgcgctggagcatcctgccgcaccccgactggtgccaaggggttcttgtggagtgccggacagcgcacagcgcggacccggaactgccctggaggaagatttccggactctggccagctctctgcgccctattgtcatcgacggctctaacgtggcgatgtcacatggtaataaagaaacatttagctgtcggggaattaaactggcggtggactggtttagagacagagggcatacctacatcaaggtcttcgttccctcctggcgaaaagatcctcctcgagctgacactcccatacgagagcagcatgtgctggcagagttggagcgacaggctgtactcgtgtatacgccatctcgtaaagtccacggaaaaaggctcgtttgttatgatgaccgatatattgtgaaagttgcctatgaacaggatggcgtgatcgtgtccaatgacaattatcgggacctccaatctgaaaatccagaatggaagtggtttattgagcagcggttgcttatgtttagcttcgttaacgaccgctttatgccaccagatgatccactggggcgacatggaccatctctctccaatttcctgtcacggaagcctaagccaccagagccgtcttggcagcactgtccctatggcaagaagtgcacatatgggatcaagtgtaagttctatcatcctgagcgccctcatcacgctcagctagcagtggctgacgaactccgtgccaagactggggctcggcctgtactccccggtcgcccacctgcttcagccagacccgctgcacctgcagctggaaggacacccccatag

SEQ ID NO: 247193 - DNA, 2211 bp, Artificial Sequence
  Description of Artificial Sequence: Synthetic coding sequence
atggagattgggaccgaaatttccaggaaaattagaagtgccattaaagggaagcttcaggagctgggcgcatatgttgacgaggagctgccagactatataatggtgatggtcgcaaataagaagagccaagatcagatgactgaggacctgtccttatttcttgggaataataccatcaggttcactgtatggctgcacggggtccttgataagctgagatctgtgaccacagagccatcgagcctcaaatcaagtgacaccaatatttttgatagcaatgtaccctccaacaaatcaaatttttccagaggagatgaaagacggcatgaggcagctgtacctcctctggctatcccttccgcgagaccagaaaaacgggattcccgggtgagcactagctcacaggaatcgaagacaactaatgtgcggcagacctacgacgacggcgctgcaaccaggcttatgtccaccgtcaaacccctgcgagagcccgctcctagcgaggatgtcattgacatcaagcctgagccggacgacttaattgatgaagatttgaacttcgtgcaggaaaatccactctcgcagaaaaagcccacagttaccttgacatacggaagctctagaccttccatcgagatctatcgtccgccagccagccggaacgccgattccggggtgcacctaaatcgcctgcagttccagcagcagcaaaattcgattcacgcagctaagcaactggatatgcagagtagctgggtctacgagaccggtaggctatgcgaacccgaagtgctgaacagcctggaggagacatattcgcctttttttagaaataattctgaaaagatgtcaatggaggacgagaacttcagaaagcgaaagctgccagtggtcagttccgtggttaaggttaagaaatttaaccatgatggtgaggaggaagaagaagacgatgactacggttcccgcaccggcagcatttcttcttccgtttccgttcctgcaaagcccgaacggagaccctctcttcctccgagcaagcaggccaataagaacctaatacttaaggcaatttctgaggctcaggaaagcgtgactaaaacaactaattacagtacggttccacagaaacagaccttgccggtggcccctagaactagaacctcacaggaggagctgctcgctgaggttgtccaggggcagtcaagaactccgaggatctctccacccatcaaggaagaagagactaagggcgacagcgtagagaagaatcagggcactcagcagagacagctgctctcccgcctgcagatcgatcctgtcatggccgagacactgcagatgtcacaggattattatgatatggagagtatggtccacgcagatacacgctcttttattcttaagaaaccaaagctcagcgaggaggtggtagtggccccaaatcaggaaagtgggatgaaaaccgctgactccctccgggtgttgagtggccacctgatgcagacaagggatctggttcagcctgacaaaccagcctcacctaaatttattgtaacactcgacggcgttccttcaccccctggatatatgtccgatcaggaggaggacatgtgtttcgagggcatgaagcctgtgaatcaaaccgctgcctcgaataaaggactgagagggctgctgcatccccagcaactgcacttgctatcccgccagcttgaagatcctaatgggagtttttctaacgcagagatgagcgagctgagtgtagcccagaaaccagagaaactgctggagcgctgcaagtattggcctgcttgtaagaatggtgatgaatgcgcctaccatcatcctatttcaccttgtaaagcttttcccaattgcaagtttgccgagaagtgcctcttcgtccatcctaactgcaagtacgacgcgaaatgtacaaaacctgactgtcctttcacccatgtcagtagaagaatacctgttctctccccaaaacccgctgtagctcctccagccccaccctccagcagtcagttgtgccgatatttccccgcttgtaaaaagatggagtgcccattttatcatcccaagcattgccggttcaatacccagtgtaccaggccagactgcactttttaccatcctaccatcaatgtgcctccgaggcatgctctgaaatggatccggcctcaaacgtccgagtag

SEQ ID NO: 247194 - DNA, 1740 bp, Artificial Sequence
  Description of Artificial Sequence: Synthetic coding sequence
atggaaatcggcactgagatcagtcgtaagataagaagtgccataaagggtaaattgcaggagctgggggcatatgtggacgaggagctgcctgattatatcatggtgatggtcgctaataagaaaagccaagaccagatgacggaggacttgagtttattcctggggaacaataccatccgcttcaccgtgtggttacatggtgtgctcgacaagctcaggtcagtgaccacggagccatcaagcctcaaatcatctgatacaaatatcttcgactctaatgtcccgtctaataagtcgaactttagtcgcggtgacgagaggagacacgaggccgctgtgccaccgcttgcaatccccagcgccagaccagaaaagagggatagcagagtctccacgagtagccaggagtctaagacgaccaacgtgcgccagacttacgacgatggcgcagccacgagattgatgagtaccgttaaacccctccgagaacctgccccttccgaggatgtgattgatattaaaccggaacctgacgacttgatagatgaagatttaaatttcgtgcaagaaaatcctctgagccaaaaaaagcccaccgtcaccctcacatatggtagctctcgtccaagtatcgagatctacagaccccctgcatccagaaacgctgacagcggagtgcaccttaaccggcttcagtttcagcagcagcagaattccatccatgccgctaagcaactggatatgcagtcttcttgggtttatgagaccgggcgtctgtgcgaaccagaggtgctaaattccctcgaggagacctactcaccattcttcaggaacaacagtgaaaaaatgagcatggaggatgagaatttcaggaaaaggaaattaccagtagttagcagcgttgtgaaggtgaagaagttcaatcatgacggggaagaagaagaagaggacgacgactatggatccagaacaggaagtatcagtagcagtgtctcagttccggctaaacccgagaggcggccaagcctcccaccttccaagcaggccaataagaacctgattttgaaagcgatcagcgaggcccaggaaagcgtgaccaaaaccacaaactattccacagtcccacagaagcagacgctccctgtggcccctagaaccaggacatctcaggaggagctgctcgcggaggtggttcaggggcagtcacggaccccgcgtatctctcctccaatcaaggaggaggagactaagggagattctgtggagaaaaatcaggccgaaatgagcgagctttctgtggcccagaagcctgagaagctgctcgagaggtgcaagtactggccagcctgtaaaaacggagatgagtgtgcttaccaccaccctatttccccatgcaaggcctttcccaactgtaaattcgccgagaaatgcttgtttgttcatccaaactgtaaatacgatgccaaatgcacgaagccagattgtccatttactcatgtgagcagacggatacctgtgctcagtccaaagcccgtagctcccccagccccaccttcctcctcgcagctgtgtcgctatttccccgcttgtaagaagatggaatgtccattctatcacccaaaacattgcaggtttaatacccagtgtactcgccctgattgtaccttctatcacccaacaatcaacgtaccaccaaggcatgccctgaagtggatacggccacagacgtccgaatag

SEQ ID NO: 247195 - DNA, 921 bp, Artificial Sequence
  Description of Artificial Sequence: Synthetic coding sequence
atgcgaatgagcagcaagtttccgagtcccccactccctattttccttcccccagagcccgtcgacctcggctctattacttctagcagttgcagcctgaacgagttggataacattagtcatctgttgcggaaaatatctgctgacattaacgaaatcaaaggaatgaaagctgccatcctcacggtcgaagctaatctcttcgacctgaacgtgagggtcagtaaaaatgaggctaagatctcgtcactggaagtgaaaatgaatgaatactctactacatatgaatgtaaccggcaattcgaagaccaagaggaggacaccgagtctcagtcgcgcaccaccgacgtgaaaatcatcggcttcctgcggaatgtcgaaaagggcacccagcagagacagctgctgtccagattgcaaattgacccagtgatggctgagaccctacagatgtctcaggccgagatgtccgagttatctgtggctcaaaagccggagaagctcctggaacgatgtaaatactggcctgcctgcaagaacggcgatgagtgcgcgtaccatcaccccatctccccgtgcaaggcctttcctaattgtaagttcgcagaaaaatgcttgtttgtgcaccctaactgcaagtatgatgctaaatgcacaaaacctgactgtccattcacacacgtgtcccgtagaatccccgttctgtccccaaagcctgttgcccctccggctccgccatcaagctcgcagctgtgtagatacttcccagcctgtaagaagatggagtgcccattttaccacccaaaacattgcaggttcaatactcagtgtacacgaccagactgcacattttatcacccaactatcaacgtaccccctaggcatgcactgaagtggattaggccacaaacatctgagtag

SEQ ID NO: 247196 - DNA, 1716 bp, Artificial Sequence
  Description of Artificial Sequence: Synthetic coding sequence
atggtcatggtggcaaacaagaaatcacaggaccaaatgactgaggacctgagtctgttcctggggaacaacacgattcgattcacggtgtggctccatggagtgttggacaagctgagatctgttacgaccgagccctcaagtctcaagagtagtgacacaaacatcttcgacagtaacgtgccctcgaacaagtccaacttttctcgcggagacgagcggaggcatgaagcagccgtgcctcctttagccattccctccgccaggccagaaaagcgcgattctcgcgtctccacttcctcacaggagtctaaaaccactaacgttcggcagacttatgacgacggggcagccacaaggctcatgagtaccgtcaaaccccttcgtgagcccgcaccctccgaagacgtcatcgatatcaagcctgagcccgacgaccttatcgatgaggaccttaactttgtgcaggagaatccactgtcccagaaaaaacctacagtaactctgacttacgggtcttccagaccttccattgaaatatataggcccccagccagccggaacgctgatagtggagtgcacctcaataggcttcaattccagcaacagcaaaattctattcacgccgcaaaacagctggatatgcagtcatcttgggtatacgaaactggaaggctgtgcgagcccgaggtcttgaattccctggaggagacctacagcccattctttcgcaacaatagcgagaagatgtcgatggaggatgaaaatttcaggaaaagaaagctcccagtcgtaagctctgtagttaaagtgaagaaattcaaccatgatggagaggaagaagaggaggatgatgactatgggtctcgtacaggaagtatttctagcagcgtatctgtgcccgctaagcccgagcgccgtccctcgctccctccatcaaaacaggccaacaagaatctgatattgaaggcaattagcgaggcacaggagagtgtcactaaaactaccaactattccacagttccacaaaaacagacccttcccgtggccccaaggacaaggacctcgcaggaggagctgctggcagaagtcgtccagggtcagtccaggacacctaggatctccccacccattaaggaggaggaaaccaagggtgacagcgttgaaaaaaatcagggtacacagcaacggcagttactgtcccgacttcagatcgacccagtgatggcagagacactgcagatgagtcaggccgaaatgagcgaactgtcagttgcacagaaacctgagaagttactagagcgctgcaagtactggccagcgtgtaaaaacggtgatgagtgtgcatatcaccaccccatatcaccctgtaaggccttcccgaactgcaaattcgctgaaaagtgcctgttcgttcaccccaattgtaaatacgacgctaaatgcacaaagccggactgccctttcacgcatgtatctcggaggatacctgtcctcagcccaaagcccgctgtagctccacccgctcccccatctagctcacagctttgccgatatttcccagcctgtaagaaaatggagtgccccttctatcatccaaaacattgtcggtttaacacccaatgcacccgaccagattgtactttctaccaccctaccatcaacgtcccaccccgacatgcacttaagtggatcagacctcagacctcagaatag

SEQ ID NO: 247197 - DNA, 2022 bp, Artificial Sequence
  Description of Artificial Sequence: Synthetic coding sequence
atggagattggcaccgagatcagtcgcaagattaggagcgctataaagggaaagttgcaggaactcggcgcatatattgacgaagaacttccggattatataatggtcatggtagccaataagaaaagccaagatcagatgactgaagacctctctttatttctgggcaataatacaatccgtttcacggtgtggctacacggcgtgctggacaaactgagatcggtcactacagaaccgtctagcctgaagtcatctgatactaatatcttcgattcaaacgtccctagtaacaaatccaattttagccgaggtgatgaacggagacacgaagcggctgtgccgcctctggctattccgagcgctagacctgagaagagagactctagggtgagcaccagctcgcaggaatccaagacgactaacgtgaggcaaacatacgacgatggagctgccacaaggctgatgagcacagtcaaaccattaagagagcctgcaccctctgaggatgtgatcgacattaagcctgaacctgatgacctgatcgacgaggaccttaattttgtgcaagaaaatcctcttagtcagaagaagcccaccgtgaccctaacctatggctcaagcagaccttccatcgagatttataggcccccagcatcgcgcaacgccgacagcggagtccacctaaaccgcctgcagttccagcaacaacagaacagtatccacgccgctaagcaactcgacatgcagagtagttgggtctatgaaactggcaggctgtgcgagcccgaggttcttaattcattggaggagacctactcgcctttctttcgaaataatagcgagaaaatgagcatggaggatgaaaacttcaggaaaagaaaactcccagtggtatcgagcgtggtgaaggttaagaaatttaaccatgatggggaagaggaggaggaagatgacgactacggttctagaacagggagcatctctagtagcgtgagtgtgccagccaagcccgaacgtcgcccatccttgccgccttccaaacaggcgaacaagaacttaattcttaaagccatcagcgaggcgcaggagagcgtgacaaagactacaaattattctaccgtcccgcaaaaacagactctccccgtggcccctaggacacggacgtcacaggaggagctgctggccgaggtggtacaaggtcagagtagaacgcccaggatcagtccacccataaaggaagaagagaccaagggcgactccgtggaaaaaaaccagggcacccagcagcggcagctcctcagtcgcttgcagatcgatcctgtgatggctgagacactccagatgagccaggattattatgacatggagtcaatggttcacgccgatactagatcattcatacttaagaagccaaagctgtctgaggaggtggtggtcgctccaaaccaggagtctgggatgaaaacagctgacagccttcgcgtgttgtctgggcatctcatgcagacgcgggatctggtgcaaccggacaagccagcaagtcccaaattcatcgttactttggatggcgtgccttctcctcctggctatatgtccgaccaggaggaagatatgtgtttcgagggcatgaagcccgtaaaccagacagcggcatctaataaggggctcaggggccttctccaccctcaacagctccatctgctcagcagacagcttgaagaccccaactgtaagtacgacgccaaatgcactaagcctgactgtccattcacacatgtgtccagacgcattcccgtcctgtcgccaaaaccagctgtggcgccacccgcacctccatcttcctctcagctctgtagatacttccctgcgtgcaagaagatggagtgtccgttctatcacccaaagcattgtcgctttaacacacagtgcactcgccctgactgtaccttctatcacccgacaattaacgtgcctcctcggcacgctttgaagtggatcagaccccagacctcagagtag

SEQ ID NO: 247198 - DNA, 1716 bp, Artificial Sequence
  Description of Artificial Sequence: Synthetic coding sequence
atggttatggtggccaacaagaaatcccaggatcagatgaccgaggatctgagcctattcctcggcaataatactatccgatttaccgtgtggctccatggggttctcgataagctccggagcgtcaccaccgaaccttcatccctgaagagtagcgataccaacatttttgattcaaatgtgcctagcaataaaagcaacttttcaagaggcgatgagaggagacacgaggccgcagtcccacccctcgccatcccgagcgcacgacccgagaaacgggacagtagagtttccacaagttctcaagagagcaagaccaccaatgtgcgccagacgtacgacgacggagccgctactcggctgatgtccaccgtgaagcctctgcgcgaaccggctccatcagaagatgtgatcgatatcaagcccgagcccgatgacctgattgacgaggacctgaactttgtgcaggagaatcctctgagtcagaagaagcccactgttacgctcacatacggatcatccaggccttcaatcgaaatctataggcctccagcttccaggaatgctgacagcggagtccacctgaacagactgcagtttcagcaacagcaaaacagcatccatgccgcaaaacagctagacatgcagagctcatgggtatacgagacgggccgactgtgtgagcccgaagtgctgaattccttggaggagacatactcacccttctttaggaataactctgagaagatgagcatggaagacgagaacttccgcaagaggaagttgcccgtggtgtcaagcgtggtgaaggtaaaaaaattcaaccatgacggtgaggaagaggaggaagatgatgactatgggtcacgaacaggctctatttccagtagcgtttctgtgccggctaagcctgagcgacggccttccttgccgccaagcaaacaggcgaacaagaacttgattctgaaggctatatcagaagcacaggagtccgtcacgaagacaacaaactacagtacagtgccacagaagcagacattacctgtggcccctcggacaaggacaagtcaggaggagctgctcgccgaagtggttcagggccagagtaggacaccgaggattagtcccccaatcaaggaagaggagactaaaggggactcagttgagaaaaatcagggaacgcagcaaagacagctcctcagccgtcttcagattgaccccgtgatggcggaaactctccagatgtcacaggccgaaatgtccgaactaagcgtggcccagaaacccgagaaactgctcgaacgctgtaagtactggcctgcctgcaagaatggggacgaatgcgcctaccaccaccccatcagtccctgtaaggcgttcccgaactgtaaattcgcggagaaatgtttgtttgtacacccaaattgcaaatatgacgcgaagtgcactaagcctgactgtccatttacgcacgtgtcaaggcgcatccccgtcctgtctccaaaacctgcggtggctcctccggctcctccctctagttcgcagctatgtaggtactttcccgcttgtaaaaaaatggaatgccctttttaccacccaaagcactgcagattcaacactcaatgcacgcggcctgactgtacgttttatcaccccaccatcaatgtgcccccacgccacgcactgaaatggatccggccacagacaagcgagtag

SEQ ID NO: 247199 - DNA, 1758 bp, Artificial Sequence
  Description of Artificial Sequence: Synthetic coding sequence
atggagattgggacagagatttccagaaagattaggagcgccattaaggggaagctgcaggagttaggggcttacgtcgacgaagagttgccggactacattatggtgatggttgctaacaagaagagccaggatcagatgactgaggatctcagcttatttctgggcaacaacaccatacgcttcaccgtttggttacacggtgtgctagataagctccgaagcgtaaccactgaacccagttcactgaaatctagtgacaccaatattttcgactcgaacgtgccccctcttgcaattccgtcggccaggccggaaaagcgcgattcaagggtctccacctcctcacaggagtctaaaacaactaatgtgaggcaaacctatgacgacggcgcagccaccagactaatgagtactgttaaaccattgagggagccggcaccatctgaggacgtcatcgacattaagcccgagccggatgatctgatagatgaagacctcaattttgttcaggaaaatcccctgagtcagaaaaaaccaacggtaacccttacgtatgggtcttctcgcccatccattgaaatttaccgcccaccagcaagccgtaatgctgactctggcgtccacctgaaccgtctgcaattccagcaacagcaaaacagcatccacgcagcaaaacagctcgatatgcagagctcctgggtttatgaaactggaaggctgtgtgaacctgaggtgcttaattccttagaggagacatatagccctttttttaggaacaactctgagaagatgagcatggaagacgagaacttccggaagaggaagctgcccgtggtgagcagcgtggtgaaagtgaaaaaattcaatcatgatggcgaggaggaagaggaagacgacgattatggttcacgtacaggatcaatttcctctagtgtgagcgtgccagctaaacctgagcgacggccttcccttcctccttccaaacaagcgaataaaaatctgatcctgaaagccattagcgaagctcaggagtcagttaccaagaccacaaactacagcacagtacctcaaaagcaaactctgccggtcgctccacgaactaggacaagccaagaggaattactcgcggaagttgtccagggacagagcagaactccacgcatctcgcctcctattaaggaggaggaaacaaaaggagactccgtggagaagaatcagggcacacagcagcggcaactgctcagccgtctgcagatcgacccagtgatggccgaaaccctgcagatgtctcaggccgaaatgtctgaactgtctgtggctcagaaacctgaaaaactgctggaacggtgcaagtactggcctgcttgtaaaaacggtgacgagtgtgcataccatcacccaatttccccatgcaaagcctttcctaactgtaagttcgcggaaaagtgtttgttcgtgcacccgaattgcaagtatgacgcaaaatgtaccaagcccgactgtccttttactcacgtgagtcgcaggatcccagtgctgagccctaaacctgtagcccctcctgccccaccgtccagctctcagctctgcaggtactttcccgcatgcaaaaaaatggagtgtccattttatcaccctaagcattgtaggtttaacactcagtgtacacgccctgactgtaccttctaccatccgacaattaatgtcccccctagacacgccttgaagtggatacgcccacagacaagcgagtag

SEQ ID NO: 247200 - DNA, 2136 bp, Artificial Sequence
  Description of Artificial Sequence: Synthetic coding sequence
atggaaatcggaacagagatatctagaaaaattaggagtgctatcaagggcaagctgcaggagctgggcgcatacgtcgacgaggagctgcctgactatatcatggtgatggtggcaaataagaaaagtcaggaccagatgaccgaggatctgagcctgttcctcgggaacaatacaatccgattcacggtgtggctgcatggcgtccttgataaactgcgcagtgtcacaacggagccttcatccctgaagtcctccgacacaaatattttcgacagcaacgtgccttcgaataagagcaacttcagcagaggagatgagcgccgacatgaggccgcagtgccccctctcgccatccccagcgctcgccctgaaaaaagggactctagagtctctacaagttcacaggagagcaagacaaccaacgtgagacagacgtatgatgacggagccgcaacgagacttatgagcactgtgaagcccctcagagagcctgccccatctgaagacgtgatagacattaaaccggaacccgatgacttgatcgacgaagatctgaatttcgtgcaggaaaatccgctgtcacaaaagaagcctactgtgaccctgacttacgggagcagcaggccaagtatagagatctaccggccaccagcatccaggaatgcagactctggagtgcaccttaatcgccttcaattccagcagcagcagaactctattcacgcggcaaagcagctggacatgcagagctcttgggtctatgaaaccgggagattatgtgaacctgaggtgctgaactctctcgaagaaacgtattccccattcttcagaaataactcagaaaaaatgtccatggaggatgaaaactttagaaaacggaaattgcccgtggtgagttctgtggtgaaagtgaagaaatttaaccatgacggagaagaagaagaggaggacgacgactacggctcccggacaggttcaatcagcagttctgtatccgttcccgctaagcccgaaagaaggcccagcttacctccttcaaagcaagcaaacaagaatctcatcctaaaagctatcagtgaagcccaggaaagtgtcaccaaaacgaccaactattcgacagtcccccaaaagcaaacgctgccggtcgcgcctcggacgcggacttcacaagaagaactgctggctgaggtggtccaggggcagtcaaggactcccaggatctctccgcctatcaaagaggaagagactaaaggggatagcgttgagaaaaaccaggattactatgacatggaaagtatggttcacgctgacactcggtccttcatactgaagaagcccaaattatctgaggaggtggtggttgcccctaaccaagagagcggtatgaaaacagctgactcactcagggtgctgtcgggccacctcatgcagacacgcgacttagtgcaaccggataaaccggcttctcccaagtttatcgtgactctggatggtgttccctctcctccaggatacatgtccgatcaagaggaggatatgtgcttcgaagggatgaagcccgtgaatcagactgctgcatctaacaaaggcttacgaggccttcttcatcctcagcagctccacttgctctccaggcaattggaagaccccaatggttccttctcgaacgctgagatgtctgaactgtctgtggcccagaagccagagaaactgctggagcgttgtaaatattggcccgcatgtaagaacggagatgagtgtgcctatcatcatcccataagcccatgtaaagccttcccaaactgcaaattcgccgagaaatgtctgtttgtccatccaaattgtaaatacgatgctaagtgcacaaaacccgattgcccttttactcatgtgagccggaggatacctgtgctgagccctaagcccgctgtcgcccctccagcccctccaagttcttcacaattgtgccgctatttccctgcctgcaaaaagatggaatgtccattctatcaccctaaacactgccgatttaacacccagtgtactagaccagattgcaccttttaccaccctacaatcaacgttcccccacggcacgccctgaagtggataaggccccaaacaagtgaatag

SEQ ID NO: 247201 - DNA, 2136 bp, Artificial Sequence
  Description of Artificial Sequence: Synthetic coding sequence
atggagatcggcaccgagattagtcgtaagatacgatctgctattaagggaaagctccaggagctgggcgcttacatagatgaggaattgcctgactatattatggttatggtggccaataagaaatcacaggatcaaatgacggaagatttatcactctttctcggtaacaacactatccggttcaccgtctggctccacggagttttggacaaacttcgttctgtgacaaccgagccctcttccttaaaatcgtctgatacgaatatttttgatagcaatgttccttcgaacaagtctaacttcagccggggagatgagcgtagacacgaggctgccgtgccgccacttgccatcccgagcgctcgccctgagaaaagagactctcgtgtgagcacatcatctcaagagtccaaaacaactaacgtgagacagacttacgacgacggtgcagcaacgaggcttatgagtaccgtcaagccactgcgcgaacccgctcctagcgaagacgtaattgacatcaaacctgaaccagatgacttaatcgacgaagacttaaattttgtacaggaaaatcctctatcgcaaaagaagcccactgtgacacttacatacggctcttcccgcccttccattgagatttataggcccccagcctcaaggaacgcggatagtggtgtccacctgaataggctgcaattccagcagcagcagaattcaatccatgctgccaagcaattggacatgcagagcagttgggtgtatgagacagggagactctgcgaacctgaggtgctcaactctctggaggaaacctattcaccttttttcaggaataactccgagaagatgtccatggaggatgagaacttcagaaaacgcaaattacctgtggtgagcagcgtggttaaggtgaagaaatttaatcacgacggggaagaggaagaggaggacgacgactacggctctaggacaggcagcatttcctcaagcgtctctgtgcccgcaaagcctgagaggagacctagtctgccaccgtccaagcaggccaacaagaatctgatactgaaggctatctccgaggcccaggaatctgttacgaagacaacaaactattcaacagtcccccagaaacagactctgcccgttgccccacgcactaggacgtcacaggaggagctcctggcagaagtggtccagggccagtcccggaccccgagaatcagccctcctattaaagaggaggagaccaagggagacagtgttgaaaagaatcaggattattatgacatggaatccatggtgcatgccgacaccagatcgttcatcctcaaaaaaccaaaattaagtgaggaggttgtggttgcaccaaatcaggaatctggtatgaagactgctgatagcttaagggtgctgtctggacatcttatgcagaccagggacctggttcagccagacaagcccgcaagccctaaattcatagttaccctcgatggggtaccctccccacctggctacatgtccgatcaggaagaggacatgtgcttcgagggaatgaagccggtgaatcaaactgccgcaagcaacaaaggtctccgcggactgctgcacccgcagcagctgcatcttttaagtagacagctggaagatccgaacggttccttcagcaacgccgagatgtctgaactgagtgtcgcgcagaagccagagaaactgctcgagcgctgcaagtattggcccgcatgcaagaacggggatgagtgcgcttaccatcaccctatttccccatgcaaggcctttcctaactgtaaattcgcggagaaatgtctctttgtccatcctaactgcaaatacgacgccaagtgtactaaacctgattgcccttttactcacgtaagtaggaggattcctgttctgtcacccaagcccgcagttgctccacctgctccacccagttcgtcccagctctgccgttacttccctgcctgcaagaaaatggaatgtcctttttatcatccaaagcactgcaggttcaacactcaatgcacacgcccagactgtaccttctaccatcctactattaacgtcccaccgaggcacgccttgaaatggatcagaccccagacctctgagtag

SEQ ID NO: 247202 - DNA, 849 bp, Artificial Sequence
  Description of Artificial Sequence: Synthetic coding sequence
atgcgaatgagcagcaaatttccttcaccacccttgccaattttcttacctcccgaaccggttgacctgggatctattacttcttcctcttgctctttaaatgaactcgacaatatttcacacttgcttagaaaaataagcgccgacattaacgaaatcaaggggatgaaggccgcaatcctaacagttgaagctaatctgtttgatcttaatgtcagggtgtcaaaaaatgaggctaaaatcagctcgctggaagtcaaaatgaatgagtatagcactacctatgagtgcaaccgccaattcgaggaccaggaggaggacacagagtctcagtcgcgaacgacagatgtgaaaatcattggctttctgagaaacgtagagaaagccgagatgagtgagctgtccgtggcccagaagcccgagaagttacttgaacgatgcaaatactggcctgcctgcaaaaatggcgacgagtgcgcctatcaccatcctatttccccttgcaaagcatttcccaactgcaagtttgccgagaaatgcctcttcgttcatccaaactgcaagtacgacgctaaatgtacgaaacctgactgcccctttactcacgtctcccgtcggattcctgtgctgtcacccaagcctgctgttgctccccctgcacctccttccagctcacagctatgtcgatatttcccggcttgcaagaagatggaatgcccattctaccacccaaaacactgccggttcaatacacagtgcaccaggccggactgtacattttatcatccgacaatcaacgtgcccccacggcatgctctgaaatggattagaccccaaacaagcgagtag

SEQ ID NO: 247203 - DNA, 219 bp, Artificial Sequence
  Description of Artificial Sequence: Synthetic coding sequence
atggtcatggtggccaacaaaaagtcccaagaccagatgacagaagacctgagcctctttctgggcaacaacactatccgctttacggtatggctgcacggagtgcttgataaactcagaagtgtgacaaccgagccatcttccctgaagagctcggatactaacatatttgactcaaacgtcccaagcaacaaaagcaacttcagccgcggtgactag

SEQ ID NO: 247204 - DNA, 285 bp, Artificial Sequence
  Description of Artificial Sequence: Synthetic coding sequence
atggtaatggtggccaacaagaagtcacaggaccagatgacagaggacctgagcttgtttctcggaaacaacaccattagatttacggtgtggcttcatggcgtgctggacaaactcaggagtgtgaccaccgagccctcatcccttaagtccagcgacacaaacattttcgactctaacgtgccatcaaataaaagcaacttcagcagaggcgacgaacgacgccatgaggccgctgtccctccactggctattccctccgctaggccggagaagagggactag

SEQ ID NO: 247205 - DNA, 648 bp, Artificial Sequence
  Description of Artificial Sequence: Synthetic coding sequence
atggtcatggtcgccaacaaaaaaagtcaagaccagatgaccgaagatctcagcctatttctcggaaataacaccataagatttacagtttggcttcatggagtcctcgataagctgcggtccgttaccaccgaaccctcctcactcaaatcctctgataccaatatttttgattctaacgtaccttctaacaaaagtaacttctcccgtggcgacgagcgcaggcatgaggctgctgttccaccgctggctataccgtctgctaggcccgagaaaagagattctcgggtctcaacatcatcacaagaaagcaagacaactaatgttcgacagacctatgacgacggggcagctactagattaatgtctacagtgaagccactccgggagccagccccaagtgaagacgtgattgatatcaaacctgagcccgacgacctgatcgacgaagatcttaattttgtacaggaaaatccacttagccaaaaaaagcctacggtaactctgacttacggtagcagcagacctagcatcgaaatttatcgccctccagccagccgcaatgccgactccggggttcacctcaacagactgcaatttcagcagcagcaaaatagtatccacgccgctaagcagctcgatatgtag

SEQ ID NO: 247206 - DNA, 1956 bp, Artificial Sequence
  Description of Artificial Sequence: Synthetic coding sequence
tgatcagatactaacatatttgactccaacgtaccttcaaacaagtccaacttttctagaggagatgaaagaaggcatgaagccgcagtgccgccactggccatccccagcgccagaccggagaagagggacagccgggtgtcaacaagctcacaggaatccaagacaaccaatgttcgacagacatatgatgacggtgccgcaacaaggcttatgagtaccgtcaagcccctccgcgagcccgctccctcggaagatgtgatcgatattaaaccagagcctgacgatcttatcgacgaagacttgaactttgtgcaggaaaacccactgagccagaagaaaccaaccgtcactctaacgtatggctcatcacgtccgagtatagaaatctatcgccctcccgcatcgcgaaatgctgattctggcgtgcacctgaatcgtctgcagtttcagcagcagcagaacagcattcatgccgctaagcagctggatatgcagtctagctgggtctacgagactggtcgtttgtgcgaacctgaggtacttaattcattggaagaaacatatagcccattcttccgcaacaatagcgagaaaatgagcatggaggacgagaacttccgcaagcgcaagctgcccgtggtgagtagtgtggtaaaggttaaaaagttcaaccacgatggcgaggaggaggaggaggacgatgattacggctcaagaactgggtccataagttcaagcgtgtctgtgcccgctaagcccgagagacgaccctctctgcccccttctaaacaggcgaataagaaccttatcctgaaagcgattagtgaggcccaagaaagcgtgactaagactacaaattacagcacagtcccccagaagcagacactgccagttgccccacggacacggacttctcaggaggaactcctggctgaggtggtgcaggggcagagtaggacaccaaggatttcaccacctatcaaggaggaggaaaccaaaggggactccgtagagaagaatcagggcactcagcagcggcagctgctgtctagactgcagattgatcccgttatggccgagacgttgcagatgagccaggattactacgatatggaaagcatggtgcacgctgatactagaagctttattctcaagaaaccaaagctgtccgaggaggtagtcgtggcccctaatcaggagtccgggatgaagacggctgatagtcttagggtactctctggtcacctgatgcagactcgggaccttgttcaacccgataagcccgcatcccccaaattcatcgtcacactggatggcgtgcctagccctccgggatacatgtcagatcaggaggaggatatgtgttttgaaggcatgaagccagtgaatcagactgccgcttctaacaaaggactgagagggctgcttcacccccagcagctgcatttactcagcagacagttagaagacccaaacggttccttttcgaacgctgagatgtcggaactgtcggttgctcaaaaacctgaaaagctgcttgaacggtgcaagtattggcccgcatgtaaaaatggggatgagtgtgcctatcaccatccaatctccccatgcaaagccttcccaaactgtaagttcgcagaaaagtgcttgtttgtgcatcccaattgtaagtacgatgcaaagtgcaccaagccagactgcccgtttacacatgtatcaaggcggatccctgtcctgtcaccaaagccggtcgcacctcctgcccctccttcgagctcacagctgtgtcgctacttccctgcctgcaagaaaatggaatgtcccttttaccatccaaagcactgcaggttcaacactcagtgcactcgtcctgattgtactttctaccatcccacaatcaacgtgcccccacgccacgccctaaaatggatacgccctcagacaagcgaatag

SEQ ID NO: 247207 - DNA, 402 bp, Artificial Sequence
  Description of Artificial Sequence: Synthetic coding sequence
atggtgatggtggcaaataaaaaatcgcaagatcaaatgactgaggatctgtctctctttttaggtaacaataccatccgcttcactgtctggttgcacggcgtgctggataagcttagatccgtgaccactgagcccagctccctgaagtcatctgatactaacatcttcgacagtaacgtaccctctaacaaatcaaatttctctagaggggacgagagacgccacgaagccgctgtgcctccactggccattccgtccgcaaggcccgagaaacgagactcccgtgtgtctacttctagtcaggagtcaaagactacaaacgtacgccagacgtacgatgatggcgctgctacgcgattaatgtctactgtgaagcctctccgggagcctgcgccatag

SEQ ID NO: 247208 - DNA, 2193 bp, Artificial Sequence
  Description of Artificial Sequence: Synthetic coding sequence
atggaaatcgggaccgagatctctagaaaaatccgcagcgccattaaaggtaaactgcaagaactgggtgcttacgtagacgaggaattacccgactatatcatggtgatggtggctaacaaaaaatctcaggatcagatgactgaggacctgtcactctttctggggaacaacactattcgttttacggtgtggctgcatggagtgcttgacaaactcagatccgtgaccacagaaccctcaagtttgaagagctccgatacgaacatattcgactcaaacgttccaagcaataagagcaacttttcacgtggcgatgaacgcagacatgaagcggctgtgccccctttagccatcccttcagctaggccagaaaagagagattcacgagtttcaacttcttcccaagaaagtaagacaacaaacgtgaggcagacttatgacgacggcgcagccaccaggctcatgtcaacagtgaaacccctccgggagccggcaccttccgaagacgttatcgacatcaagcccgaacccgacgatctgatcgatgaggacctgaattttgtccaagaaaatccactatcacagaagaaaccaaccgttaccctgacctatggatcaagtaggccatcgatagaaatctatcggccaccggcatcacgaaacgccgattctggtgtgcacctgaatcgcttgcagtttcagcaacagcagaattccattcatgctgccaaacagctcgatatgcagagcagctgggtgtatgagacggggcgactctgtgagcccgaggtcctaaatagcttggaggagacctactcccctttcttcagaaataattctgagaaaatgtccatggaagatgagaacttcagaaagcgtaaactccccgtcgtaagctctgtcgttaaggtgaagaagtttaatcatgacggagaggaagaggaggaggatgacgattatgggtctaggacaggctcaataagcagcagtgtgtccgtgccggcaaagcctgagcgccgaccgtctcttcctccaagtaagcaggctaacaagaaccttatcttgaaagcaatctcggaggctcaggagtcagtcaccaagaccactaactatagcaccgtcccccagaagcagaccctgccagtcgcaccacggaccagaacttctcaagaggagctgctggccgaagtagtccaaggccaatctcgcacccctcggatcagtcctcctataaaagaggaagagacaaaaggggatagcgttgaaaaaaaccaggggacacagcagcggcagcttttatcacgactccagatcgatcctgtgatggcagaaaccctgcagatgagtcaggactattacgacatggaatcaatggtgcatgccgatactagatcattcattctaaaaaagccgaaattgtctgaagaggttgtcgtcgcgcctaaccaggagtcaggtatgaaaactgcggactcacttcgggttcttagcggacacctcatgcagacaagggacctggtgcagcccgacaagcccgcttccccaaagttcatcgtcactttggacggcgtgccatcacctcctggatacatgtctgaccaggaggaggatatgtgtttcgaaggaatgaagcccgtgaatcagaccgccgctagcaataaaggcctgcgcggtctgctccatccccagcagctacatctcctgtcacgccaacttgaggatccgaacgcagagatgagcgagctgagcgtggctcagaagccagagaaactcttagagagatgtaagtactggcccgcatgcaagaatggcgacgagtgcgcctaccaccatcctattagcccttgcaaagcctttcccaactgcaaattcgccgagaagtgtctcttcgtgcatccaaactgtaaatatgatgctaagtgtactaaacctgactgtccttttacccatgtctcacgcagaatccccgtgttaagtcctaaacccgtagctccccctgcccctccatcttcctcccaattgtgccgctattttccggcatgcaagaagatggagtgcccgttctatcaccccaagcactgtcgcttcaacacgcagtgtacaagacctgattgtaccttctaccatccgactataaacgttcctccacgccacgctctgaaatggatacggcctcagaccagcgagtag

SEQ ID NO: 247209 - DNA, 2709 bp, Artificial Sequence
  Description of Artificial Sequence: Synthetic coding sequence
atggccgatccagaggtctgttgtttcataacgaagattttgtgtgcccatggcggacgtatggccttggacgctttgcttcaggagatcgctcttagtgagccacagctgtgtgaggtcctccaggtggcaggccctgatcggtttgttgtgctggagaccgggggtgaagcgggtatcactcgatcagttgtggcaacaacccgtgctagagtttgtaggagaaaatattgccaacgaccatgtgacaacttgcacctgtgcaagctgaatctgctgggcagatgtaattacagtcaaagcgagcggaacctgtgcaagtattcccatgaggtgctcagtgaagagaacttcaaagtccttaagaaccatgagctaagtggcctgaacaaggaggaattggccgttctgctgctccagtcagatcccttttttatgcccgaaatttgtaagagctacaagggtgagggaaggcaacaaatctgtaaccagcagccgccatgctcccggttacacatatgcgaccattttacccggggaaactgtagattccccaactgcttaagatctcacaacctgatggataggaaggtccttgccatcatgagagaacatggccttaatccagatgtggtgcaaaatattcaggatatttgcaacagtaaacatatgcagaaaaacccccctggccctagagcaccaagctcccatcgtcgaaacatggcataccgcgcaaggagtaaatcaagagatcgattcttccaaggctcacaggagtttctggcctccgcctctgcttctgcagagaggagttgcacaccatctcccgaccagatctcccatcgagcatccctggaagatgccccagttgatgatctgacacgtaagttcacatatctcggcagccaggacagggcccgtcctccatcagggtcttccaaagctaccgatctaggcggtacctcacaagccggaacttcacaacggttcctggagaacggaagccaggaagacctgctacacggcaaccctggatcaacttacctggcttcaaatagtacgtccgcccctaactggaagagcctcacatcctggacaaacgatcagggggcaaggcggaagaccgtgttcagccctaccctgccagcagcacggagtagcctgggctctctccagaccccggaggcggtgaccacacggaaaggcaccggtctcctaagcagcgactacaggattataaatgggaagtccggaacccaagatatccagccgggacctctgttcaacaacaatgccgacggggttgccacagacatcacttcgaccagatcccttaattataagagtaccagcagtggtcacagggaaatctcctccccaaggatacaggacgccggtccggctagtcgggacgtacaggctaccggcaggatcgcagacgacgccgacccacgcgtcgccttggtgaacgatagtctttcagatgtgacctcaacaacctcctcacgcgttgatgatcatgattcggaagaaatctgcctggaccacttatgcaaggggtgtcctttgaatggctcatgttcgaaagtacatttccatttgccctacagatggcagatgctaatcgggaaaacctggactgatttcgaacatatggaaacaatcgaaaaaggctactgcaaccctggcatccatctgtgctcagtaggcagctatactattaactttagggtcatgtcatgtgatagcttccccattcgccgtttatctactccctcttcagtgactaagcccgctaactcggtgttcactactaaatggatctggtactggaagaatgagtccggcacatggattcagtatggcgaggaaaaggacaagagaaaaaattctaacgtggattcttcctatctcgagtccctgtatcagagctgccctcgcggagtcgtgccttttcaggccggttcaagaaattatgagctttcatttcagggtatgatccagaccaacatagcctccaagacgcagaaagatgtcattagaagacccacttttgtgccccagtggtacgttcagcagatgaagcgtgggcctgaccatcagccagcaaaaacgtcttccgtaagcctgaccgcaacctttcgcccacaggaggacttctgctttctgtcgtctaagaagtacaagctgtcagaaatccaccacctgcatcccgagtatgtgagagtgagcgaacactttaaagcttctatgaagaactttaagatcgagaagatcaaaaaaatcgagaattccgaactgcttgataagtttacatggaagaagtcccagatgaaagaagagggaaagcttctcttctacgctaccagccgggcatacgtcgagtccatatgcagtaacaactttgactcattcctgcacgagacacacgagaacaaatatggtaagggaatctacttcgccaaggacgccatctattctcacaagaattgtccctacgatgccaagaacgtggtgatgtttgtggctcaagtcctggtaggaaagtttacagaagggaacataacctacacatctccccctccccagtttgatagttgcgtggatacaaggagcaacccgtctgtgttcgttatcttccaaaaggaccaggtctatccccagtatgttatagaatatacagaggataaggcctgcgtaatctcctag

SEQ ID NO: 247210 - DNA, 2100 bp, Artificial Sequence
  Description of Artificial Sequence: Synthetic coding sequence
atggctgacccggaagtatgctgtttcataacaaaaattctctgtgcacacggcggtcgcatggccctggatgcactgctgcaggagattgctctgtcggagccacagttatgcgaagtcctgcaggtggctggaccggataggttcgtggttcttgaaacaggaggagaggccggaattaccaggtccgtagtggctactaccagggcgagagtgtgtagacgcaagtactgccaacgtccttgtgataacctacacctctgcaagttaaacctgctggggcgatgcaactatagccagagtgagagaaacttgtgtaagtactctcacgaggtgctctccgaggagaacttcaaggtcctgaaaaatcatgaactcagcggccttaacaaggaggaactagcagtgctgctgttgcaaagtgacccctttttcatgccagaaatttgcaaaagctataagggcgaaggtcgtcagcagatctgcaatcagcaaccaccatgttccagactacatatctgcgatcacttcaccaggggaaattgtcgcttcccaaactgcctgcggagccacaatctgatggatcgcaaagtgctcgctataatgcgggagcacgggctgaatcccgacgtggtccagaatattcaggatatttgtaattctaaacatatgcagaaaaacccgcctggacctcgggcaccatcttctcacagacgtaatatggcatatcgagccagaagcaaaagtcgcgaccggttctttcagggctcccaagagtttctggccagcgctagcgctagtgcagaaaggtcatgcacccccagccctgaccagatctcccaccgcgcttcccttgaggatgccccagtggacgatcttacgcgcaagttcacatatttaggttcgcaagacagggcgcgtcctcccagcggaagcagtaaagccactgaccttggaggaacaagtcaagcaggcaccagccaaagatttctggaaaatgggagtcaggaggacctccttcacggtaatcctggttctacatatctggcctctaactccacctccgcccctaactggaagtcactgactagctggacgaatgaccagggtgctcggcgaaagactgtgttttctccgactttaccagctgcaaggagctcgctgggctcactacagacccctgaggcggtgaccacacggaaaggaacaggcctactgtcatctgactaccgaatcatcaacggcaagtctggtactcaggatattcagcccggtcctctttttaacaataatgccgatggagtggcaacagatataacgtctacacggtcccttaattacaaaagcacctcctccggacatcgagaaatttcaagccctcggattcaagacgctggcccagcctccagagatgtccaagccacaggcaggattgctgacgacgctgaccctcgcgtcgcactcgtgaacgacagcctgagtgatgtgacttcgacaacaagttctcgggtcgatgatcacgacagcgaggagatctgtcttgatcacctctgtaagggctgcccattgaatggaagctgctccaaggtgcactttcatctgccttacagatggcagatgctaatcgggaagacttggacagattttgagcacatggagacaatcgagaagggctactgtaacccaggcatacacctctgcagcgtcggatcatacaccatcaatttcagggtgatgtcctgcgactcctttcccattaggaggttgagcacgccatccagcgtgaccaaaccagcaaattctgtgtttacaactaagtggatctggtattggaagaatgaaagtggcacctggatccaatacggggaggaaaaagataagagaaagaatagtaatgtagactcctcctacctggaatccctctaccaatcatgtccaaggggagtggtacctttccaggctggctctcggaattacgagctttcatttcaggggatgatacagactaacatcgcttctaagacccagaaagatgtgatccgtaggcctacctttgtgccccaatggtacgtgcaacaaatgaagcgaggacccgaatag

SEQ ID NO: 247211 - DNA, 1521 bp, Artificial Sequence
  Description of Artificial Sequence: Synthetic coding sequence
atggcttacagagcacggagtaagtctcgtgatcgctttttccagggatctcaggaattcctagcttccgcctcggcctctgccgagaggtcctgtactcccagtccggatcagatttcgcatcgagcctcactggaggacgcccctgtggacgacctcacacgaaaattcacatatctgggctcacaggaccgcgctcgtcctcccagcggctctagcaaagctacagacctcggtggcaccagtcaggcgggtacttctcagcgcttcttggagaacgggagccaggaggaccttctccacggaaacccaggttccacctacctcgcctcgaacagtacttccgcccctaattggaagtcccttacgagctggactaatgatcaaggcgctagaagaaaaacagtctttagccctaccctccctgccgctagaagttctctgggatctctgcagaccccggaagccgtcactactcgtaagggcacaggacttctgagctctgactacagaatcatcaacggcaagagtggtacccaggacatccagcccggacccctcttcaataacaacgctgacggagttgccaccgacattacctctaccaggtctttaaactacaagtctacgtcttcaggccaccgtgaaatatcttctcctagaatacaggacgctggtcctgccagtcgggacgttcaagcaaccggacggatagccgatgatgcggatcccagagtggcactcgtgaatgattcattatcagacgtgacctcaactaccagctcacgagttgacgaccatgattctgaagaaatctgcctcgaccacctgtgcaaaggatgcccattgaacgggtcatgtagtaaggtacacttccacctaccctatcggtggcaaatgctcatcgggaaaacgtggaccgacttcgagcacatggagaccattgagaagggttattgcaatccaggcatacacctttgctctgtgggcagctacaccatcaatttccgcgtaatgtcctgtgattccttccccatcaggcgactctctacgccaagctcagtgacgaagcctgctaattccgtattcacaacgaaatggatctggtactggaaaaacgagagcgggacatggatacagtacggcgaggagaaagacaaacgcaagaactcaaatgtggattcctcttacctagaatcgctctaccagtcatgtcctaggggagtggtcccattccaggcaggatcccgcaactatgagctctccttccaagggatgattcagacaaatatcgcaagtaagacacagaaagacgttatcaggcgccctacatttgttccccagtggtacgtacaggaggagcgtgccagagtctctgtgctgaaacagttatttgctgaccgatgcctgagatgctcctgtcccggactgatcaagtccctggttaacctggagcccgtcttcttaaaaagctcttgtttacactactccgctgtcagtatttgtatcattgacgagtag

SEQ ID NO: 247212 - DNA, 654 bp, Artificial Sequence
  Description of Artificial Sequence: Synthetic coding sequence
atgtccgggggattggccccaagcaaaagcacagtctatgtgtctaatttgcccttcagtctgactaataacgatctttaccgtattttctctaagtatggaaaagtggtaaaggtgacgattatgaaggacaaggatacgaggaaatccaagggtgttgcgttcatattgtttttagataaagacagtgcccagaattgcaccagggctattaataataaacagctatttggaagggttattaaagcatccattgcgattgacaacggcagagcagcagagttcatacgtagacgcaattattttgataaatcgaagtgttatgagtgcggagagagcggccatctctcttacgcttgcccaaagaacatgctaggcgagagagaacctccaaagaagaaggagaaaaagaaaaaaaaaaaagctccagagccggaagaggaaatagaagaagtggaagaatcggaggatgaaggagaagaccctgcgctcgatagtctaagtcaggcaatcgctttccagcaagcaaaaattgaagaagagcagaagaagtggaaacccagctcaggcgtcccttcaaccagcgatgattcccgcagaccaaggattaagaaaagcacctacttcagtgatgaggaggagctgtctgactag

SEQ ID NO: 247213 - DNA, 501 bp, Artificial Sequence
  Description of Artificial Sequence: Synthetic coding sequence
atggctatgtctcaggaaagccttactttcaaagatgtgttcgttgacttcaccctggaggagtggcagcagctggattcagcacagaaaaatctctatcgcgatgtcatgttagagaattacagccacctagtttccgtgggttacttagtggctaaacccgatgtgatttttaggctgggtccgggtgaagaaagctggatggcagatggtgggacgccagtgcgcacctgcgcggaggtgtggcaggttgacgagcagatcgaccactacaaagagtcccaggacaaactcccgtggcaggcagcttttatcggaaaagagaccctgaaagacgaatccggacaggaaagtcgcacgtgccggaagtccatttatctatccactgaattcgatagtgtgcggcagagactgccaaagtactatagttgggaaaaagccttcaaaacttctttcaagttgtcctggagcaaatggaagctttgcaaaaaggagagatag

SEQ ID NO: 247214 - DNA, 516 bp, Artificial Sequence
  Description of Artificial Sequence: Synthetic coding sequence
atggccatgagtcaggaatcattgactttcaaggacgtttttgtcgacttcacccttgaagaatggcagcagcttgacagcgcgcagaaaaatctgtacagggacgtgatgctggaaaattattcacaccttgtttccgtgggatatctcgtggccaagcctgacgttatctttaggcttggtcccggagaagaaagttggatggcagacggaggcacccctgtcaggacatgtgctggagaagatcgcccagaagtctggcaggtagatgaacaaattgatcactacaaagagagccaggataaactcccgtggcaggctgctttcatcggaaaggagaccttgaaggacgagagtggacaggagtcccgcacctgcaggaagagcatatacctcagtaccgagttcgacagtgttcgccagagattgcccaaatactatagctgggagaaggcttttaaaaccagctttaaattgtcatggagtaagtggaaactgtgcaaaaaagagcgctag

SEQ ID NO: 247215 - DNA, 297 bp, Artificial Sequence
  Description of Artificial Sequence: Synthetic coding sequence
atggccatgagtcaagagtctctcacttttaaagatgtgttcgtcgattttaccctcgaagagtggcagcagctggactccgcacagaagaacttatatcgggacgtgatgcttgaaaactattcccacctggtgtccgtcggctatcttgttgcaaaacccgacgttatcttccgcctcggaccgggagaggagtcttggatggccgacggtggcacaccagtccggacgtgtgccggtgaagacagacctgacgtaagtatctttgcttcatgtattctgaagtgctgctattag

SEQ ID NO: 247216 - DNA, 297 bp, Artificial Sequence
  Description of Artificial Sequence: Synthetic coding sequence
atggctatgtcccaagagtctcttacattcaaagacgtcttcgttgactttaccttagaagaatggcaacaactagacagcgcgcagaaaaacctctacagggacgtgatgttggaaaattactcacacctggtcagcgtgggttacctggtggcaaagccggacgtcattttccgcctgggaccgggagaggagtcatggatggccgacggtggcaccccagttaggacctgtgctggtgaggaccgtccagacgtgtcgatttttgcttcttgcattctgaagtgttgctactag

SEQ ID NO: 247217 - DNA, 516 bp, Artificial Sequence
  Description of Artificial Sequence: Synthetic coding sequence
gttgccatgagccaggagtctctcacgttcaaagacgtgttcgtcgacttcacactggaggagtggcaacagctcgactccgcgcagaaaaatttataccgggatgttatgctagaaaactattcccatttagtcagcgtgggatatctagtggcaaagcctgacgtgatctttcgtctaggacccggtgaggagagttggatggctgacggaggcacaccagttcgcacttgcgccggagaagatcgaccagaggtttggcaggtggacgagcagattgaccattacaaggagagtcaagacaaactcccttggcaggccgcattcattggcaaggaaaccctgaaagatgagagcgggcaggagtctcgaacatgtaggaagtctatctaccttagcacggaatttgactcagttcgccagcgcctgcccaagtattattcttgggaaaaagcgttcaaaacatctttcaagctgtcgtggagcaagtggaagctgtgcaaaaaagaacggtag

SEQ ID NO: 247218 - DNA, 297 bp, Artificial Sequence
  Description of Artificial Sequence: Synthetic coding sequence
atggccatgtctcaggaatcactcacatttaaagatgtctttgtggacttcactttggaggagtggcagcagctcgactcggcgcaaaagaacttgtatagagacgtgatgctggagaactattcccacctggtcagcgtggggtatttggtggccaagccagatgtgatctttcgtttaggtcctggagaagaaagctggatggctgatggcggtacacccgtgaggacttgcgctggggaagacaggcccgacgtgagcatctttgcaagttgcattctaaaatgctgttactag

SEQ ID NO: 247219 - DNA, 864 bp, Artificial Sequence
  Description of Artificial Sequence: Synthetic coding sequence
atgatgaatcggttccgaaagtggctttataaaccaaagaggagcgatccgcagttgctcgcgaggttctactacgccgatgaagaactcaatcaggttgccgctgagcttgatagtcttgacggaaggaaggacccacagaggtgtacactgctggtgtcccagttccgaagctgtcaggataatgtgctgaatataattaatcaaatcatggacgagtgcatcccccaagatagggccccacgcgacttttgtgtgaagttccctgaggaaatccgacacgacaacttggccggacaactgtggtttggtgcagagtgcctggccgcaggttccattataatgaacagggaactcgagtctatggcaatgcgccctctggcaaaggagctcactcgcagccttgaggacgtcaggggcgcactgcgcgatcaagctctccgagacttaaatacctatacggaaaagatgagagaggccttacggcatttcgacgttctgttcgcagaattcgaactttcgtatgtgtcagccatggtgccagtgaaatcccctagggaatactacgtgcagcaggaggtgatcgtactgttctgtgagaccgtggagcgcgcactggatttcggttacctcactcaagacatgattgatgactacgaaccagccctaatgtttagcatacctcggctggccattgtgtgtcctttgctcccagcgcacccacggactcgagcaggggctaccgcccacgtcgcctgtaggatggtggctggctccagcagcggcgctttgacccatccgccagtgtcaaagcagggcgtcatttccgccctccttcgaccgctgcccgagttgcccccatag

SEQ ID NO: 247220 - DNA, 519 bp, Artificial Sequence
  Description of Artificial Sequence: Synthetic coding sequence
atgatgaatcgctttagaaaatggctgtacaaaccaaaggacaacgtattgaacataatcaaccaaatcatggacgagtgcatcccacaagatagagctccgagagacttttgcgttaagttccctgaagagatacgccacgacaatctggcagggcagctttggtttggtgctgagtgcttagccgcagggtccatcattatgaacagagagttggagtctatggccatgaggcccctcgcaaaggaactgacccgctcccttgaggacgtgcgtggggcactccgtgatcaagctttgcgggacctgaacacctacaccgagaaaatgcgcgaagccctgagacacttcgacgttctctttgcagaatttgaactgagctacgtgtcagcaatggttcctgtcaaatcccctcgcgaatattatgtgcagcaggaggtgattgttctgttttgcgagacggttgaaagaaacggcaagggcgttcttaagtttatgtggaactgcaacggcccttag

SEQ ID NO: 247221 - DNA, 492 bp, Artificial Sequence
  Description of Artificial Sequence: Synthetic coding sequence
atggacgagtgcattcctcaagacagggctccaagggatttctgcgtcaagtttccagaggagatcaggcacgataatcttgcgggtcagctgtggtttggggctgaatgcctagcggctgggtccattatcatgaaccgcgaactggagtctatggccatgagacccctggccaaagaattgacgagatcccttgaggacgttagaggggcactgagagaccaggcgctgagggacctgaatacatacacagaaaaaatgcgcgaagcactccgacattttgatgtgttgtttgccgagttcgaattgtcctatgtgtcagctatggtgcctgtcaagtcaccacgcgagtactatgtccaacaggaggtcatcgtcctgttctgtgagacggtggagcgagcactcgacttcggctacctaacacaggacatgatcgacgattatgagccggctctaatgttcagcattcctcgtcttgcaatagtgtag

SEQ ID NO: 247222 - DNA, 11112 bp, Artificial Sequence
  Description of Artificial Sequence: Synthetic coding sequence
atggagggctgtgatagtcctgtagtgtcaggcaaagataatggttgcggcatcccccagcaccagcagtggacagagctcaacagcacacatctgcccgataaaccctcatcaatggaacagtcaaccggtgagagccacggtcctttggatagcctccgcgcaccatttaatgaacgcctggctgaaagtaccgcttctgctggtcccccttccgagcccgcaagcaaagaagtgacctgtaacgaatgcagtgcctcatttgcctccctgcagacttacatggaacaccattgtcctagtgctcgcccaccccctcccctgcgggaagagagcgcaagtgacacaggagaagagggggacgaagagtcggatgtcgaaaaccttgccggagagattgtttatcagcccgacggctctgcctacatcgtggaatctctgtctcaactgacccagggcggtggggcatgtggatctggctccggctcaggccctctcccatccctcttcctgaactcccttcctggagccggaggcaagcagggcgatccatcttgcgctgcccctgtctacccacaaattattaatactttccatatcgcaagcagcttcgggaaatggttcgaagggccagatcaggccttcccaaacacgtcagccctggcgggactgtctcccgtgctgcactcattcagagtctttgatgttcggcacaagtcaaataaagactatctcaatagcgacggaagtgcaaaatcatcctgcgtgtccaaagacgtgccgaacaatgtcgacttaagcaagtttgatggatttgtcctgtacggaaagaggaaaccaatattaatgtgcttcctatgtaagctcagcttcgggtatgttagaagctttgtgacacacgccgtgcacgatcatcgcatgaccttaagcgaagatgaaaggaaaattctgtccaacaaaaatataagcgctatcatacaggggattggaaaagataaagagcctctggtgtcttttctggagcctaagaataagaactttcagcacccactcgtctccaccgctaatttgatcggccctgggcacagcttttacggaaagttttctggcatcagaatggaaggagaagaggctctgccagcgggatctgccgcagggcctgaacagccccaggcaggactcctcacgccctccacactgctgaatcttggaggcctaacttcatctgttctgaagacccctatcacctcagttccactgggacctctggctagctcccctaccaaatcatcggagggcaaagattctggcgctgccgaaggcgagaaacaagaggtgggagatggtgattgcttttctgagaaggttgagcctgcagaggaagaagctgaagaggaggaagaggaagaggaagcggaggaggaggaggaggaggaagaagaggaagaagaggaagaagaagatgaaggatgtaagggattattcccctcagagttggacgaagagctggaggacaggccccacgaagagcctggtgccgctgcaggatcgtcaagtaaaaaagatctcgctctttctaaccagtccatatcgaacagcccgctcatgccaaatgtcttgcagacactgtcgcgcggtactgctagcaccagttccaattccgcctcgtcctttgtagtgttcgatggcgcaaaccggaggaatcgacttagttttaattctgaaggcgtgcgagctaacgtggccgaggggggtcgccgactggacttcgcggacgagagtgctaacaaagataacgcgactgcaccggagcccaatgagagtacagaaggagatgatggaggttttgtgcctcaccatcagcacgccggaagtctctgcgagttgggcgtgggtgagtgtccctccggatccggcgtggaatgtcccaagtgcgacacagtcctcggctcatctcggagcctcgggggtcacatgactatgatgcactcaagaaacagctgtaagaccttgaaatgtccaaagtgtaactggcactataagtatcagcaaacgttagaggcccacatgaaggagaaacaccctgaaccagggggtagttgtgtgtactgcaaatctggtcagcctcatcccaggctggccagaggagaatcatacacctgcggttataaaccctttagatgcgaagtctgcaactactcaactactactaagggcaacctgagcattcacatgcaatcggataagcaccttaacaacatgcagaacctgcagaacggaggaggcgaacaagtattttcacataccgcaggcgcagccgcagctgcagttgccgctgccgctgctgctgctaacatttctagcagttgcggggcaccttccccaaccaagcccaagactaagcctacttggcgatgtgaggtgtgtgattacgagacgaatgttgcacgaaacctgcgtatccatatgacctcagagaagcatatgcacaatatgatgctcctccagcagaatatgacgcaaattcagcacaatcggcacctcggcctcggatcattgccctcgcccgcagaagcggagctctaccagtactatctggcacagaatatgaatctgccaaacctgaaaatggactctgccgcatccgacgcccaattcatgatgagtggctttcagttggatccagccggacccatggccgctatgacaccagctctggttggtggcgagatcccattggatatgaggctgggcggaggccaactcgtgagcgaggaactgatgaacctcggcgaatcctttattcaaacgaacgacccatctctgaagctgtttcagtgcgcggtttgcaacaagtttaccactgacaacctggatatgctcggcctgcatatgaatgtagaacggagccttagtgaagatgagtggaaggcagtgatgggcgactcttatcaatgcaaactctgccgctacaacacacagttgaaagccaatttccagcttcattgtaaaaccgataagcatgtgcagaagtatcagcttgtcgcccacattaaggaggggggaaaagcaaacgagtggcgcctgaaatgcgtggctattggcaaccccgttcacctcaaatgcaacgcttgtgattactacacaaactctctggagaagctccgcctccataccgtgaatagccggcatgaagcaagtttgaaattgtataaacatctccagcagcacgagagcggcgttgaaggggagtcctgttattaccactgtgtgctctgtaactacagcaccaaggccaaactgaaccttatccagcacgtgagatccatgaagcatcagcggagtgaatcactccgaaagctgcagagactgcaaaaggggctgcccgaggaagatgaagacctcggtcagattttcaccatcagaagatgcccatccaccgatccagaggaggccatcgaggatgtggaaggcccttccgaaaccgccgcagatcccgaagagttggctaaggaccaggagggcggtgcatccagcagccaggcagaaaaagagctgactgacagcccagccaccagcaaacggatttctttcccaggatcaagcgagtctccactttcttcgaagcggcctaaaacagcagaagaaattaaaccggaacaaatgtatcagtgcccctactgcaaatactccaatgcagacgtcaaccgcctacgggttcatgctatgactcagcactccgtccaaccaatgctgcgctgtccactctgtcaggacatgctgaacaataagatccacctgcagctacatctgacacacctgcatagcgtagcccctgactgcgtggagaagttaattatgactgtcacaacaccagaaatggtaatgccatcttctatgttccttccagcagccgtacctgacagagatggcaattccaacttagaggaagccggtaaacaacccgaaactagcgaggatctgggcaagaatatcctgccttctgcctctactgagcagagcggcgatctcaaaccgagcccagccgaccctgggtctgtgcgagaggatagcggattcatctgttggaagaagggatgtaatcaggtgttcaaaacaagcgccgcacttcaaacacatttcaacgaggtccatgcaaaacgcccacagttgcccgtgtcagatcgacacgtgtataagtacagatgcaatcagtgctccctagcttttaagaccatagagaaactgcaacttcacagtcagtatcacgtgatcagggccgcaacaatgtgctgtctttgccaacggtccttccggacctttcaggctctaaaaaagcatctggaaacttctcaccttgagctctccgaagcggacatacagcagctctatgggggtctacttgcaaatggcgacctgctggcaatgggggatccgactctggcagaggaccacaccatcatcgtggaggaggataaggaggaggagtctgatctcgaagataaacagagtccgaccggatcggattcagggagcgtccaggaggatagtgggtcagagcccaagagagccctgccatttcgcaagggccctaactttactatggagaagttccttgatccctcccgaccttataagtgcaccgtgtgtaaggaatcgttcacccagaagaacattctgttggttcactacaactcggtgtcccaccttcacaagctcaagagagctctccaggaatccgccaccggccagcctgaaccaacgagctcacccgacaacaagccttttaagtgcaacacctgtaatgttgcttactctcagtcatccaccttggagatccatatgaggtctgtcctgcatcagaccaaggcccgagcggcaaaactggaggctgcctccgggtccagcaacggaacgggtaacagctctagcattagtctgtccagctcgaccccatcaccggtgagtaccagtgggagcaacacatttactacgtccaatccctctagcgcaggcatcgccccttcctcgaacttactgtcccaagtacccaccgagtccgttgggatgcctcctttaggaaaccctataggcgcaaacatcgcttcaccaagcgaacccaaggaggctaatagaaagaagctcgcagatatgatcgctagccggcaacagcagcaacagcaacagcaacagcaacagcagcaacagcagcagcagcagcaagcccagaccctggctcaggctcaagcgcaggttcaagctcatctgcagcaggagctgcagcagcaggcggctttaatccagagccagcttttcaacccgacactgttacctcactttcccatgaccacagagacactgctgcagctccagcaacagcagcacctgttgtttcccttttatatcccgagtgctgaatttcagctcaaccctgaggtgtccctgcctgtgacctccggcgcacttacgctcaccggtacaggacccggtctccttgaggacctgaaggcacaggtgcaggtaccacagcaaagccaccagcaaattctcccccagcagcagcaaaaccagctaagcatcgcgcagagccattccgccctgttgcagccgagccaacatcccgaaaagaaaaataaacttgttataaaagagaaggagaaagaatctcagagggagagagacagcgcggaaggaggcgaggggaacacgggccctaaggagaccctgcctgatgcgttaaaggcaaaggagaaaaaggagcttgcccctgggggtggtagcgaaccttccatgctgccccctcgcatagcttccgacgcacgtgggaatgctaccaaggctcttctcgagaacttcggattcgaactcgtcatacagtataatgagaataagcaaaaggtgcagaaaaaaaatggcaagacagaccagggcgaaaacctcgagaagctcgaatgcgactcctgtgggaagctttttagtaacattctgattctgaagtcgcaccaagaacacgtacaccaaaactacttcccctttaaacaactggagcgattcgccaaacaatacagggatcactacgacaagctctatcctctccggccacagacccctgagcccccaccaccccctcctccgcctcccccacctcctctgcctgctgctccccctcagcccgcatccactcctgctattcctgctagcgcaccacctattacaagccctaccatcgctcctgctcagccttctgtaccgctgactcagctctctatgccaatggagctgcctatctttagtcccctgatgatgcagacaatgcccctgcaaacactgccagcccagttgccaccccaactgggtccggtagagccgcttcccgctgatctggctcagctgtatcaacatcaacttaacccgaccctgctccagcagcagaacaagcgccctcgcactcgtatcaccgacgaccagttacgggtactcaggcagtattttgacataaataacagcccttcagaggagcagattaaggagatggcggacaaatccgggctcccccagaaagtgataaagcattggttccggaacaccttatttaaagaacggcaacgcaacaaggatagtccttataactttagcaatccgcctatcaccagcctcgaggaactgaagattgatagtagacccccatccccagagccaccgaaacaggaatattggggttccaaacgatcatctaggactagatttacggactaccaactgcgcgtgctgcaagatttctttgacgctaatgcctatcccaaggatgatgagtttgagcagcttagcaacttgttgaacctgccgaccagagtcatcgtggtctggttccagaacgccagacagaaggctcgcaagaattacgaaaatcagggtgagggtaaagatggcgaaagacgcgagctcactaacgatcggtacatcaggacttccaacttgaactaccagtgcaaaaaatgtagcctcgtcttccagagaattttcgatctcatcaaacaccagaagaagctctgctacaaggacgaagatgaggaggggcaggacgattcacagaacgaggatagtatggacgcaatggaaattctcacccctacttccagctcttgcagcaccccaatgccgtcccaggcatactccgctcccgctccaagcgccaataatacagcatccagcgctttcctacaattaactgcggaagccgaagaactcgctacgtttaattctaagacggaagcaggtgacgaaaagcctaaactcgccgaagccccttcagcacaacccaaccagacccaagagaagcaggggcaacccaagccagagctccagcaacaggaacagcccgaacagaagactaatacacctcaacagaaacttccgcagctagtgagcttacctagcctgcctcaaccccctccccaggcgccaccgccacagtgccctctgcctcagagcagccctagtcccagtcagctgagtcatctcccgcttaagcccctccacacatctacgccacagcaactggccaacctccctcctcagttgatcccctaccagtgcgaccagtgcaagcttgcttttcctagctttgagcactggcaggaacatcagcagctgcacttcttatctgctcaaaatcagtttattcacccgcagtttctggatcgctcattggacatgcccttcatgctctttgacccaagcaacccactcttagcatcccagctcctgtctggggctatccctcagattcctgctagctccgccacttccccaagcacacctacatctaccatgaacacacttaagcgcaaactggaggaaaaggcttcagcaagccctggagagaatgattctggcacgggcggtgaagagccccagcgggacaagcggctcaggaccaccattacacccgaacaactggaaatactgtaccagaaatatcttttagactccaatcccacgcggaagatgttggatcatatagctcacgaagtgggcctgaagaagcgcgtggtacaggtctggttccagaatacccgcgcacgggaacggaagggccagtttcgcgctgtagggccagctcaggctcataggcgctgtcctttttgccgagcactgttcaaagcaaaaacagctctggaggcacacatccgcagccgccattggcatgaggccaagagggccggatataatttaactttatctgcgatgctccttgactgtgacggcggtttacaaatgaagggagacatatttgacggaacgagcttctcacatctgccgccatcaagttccgacggccaaggagtgcccctttcacccgtctccaagaccatggaactgtcccctcggaccctgctctccccatcgagtattaaggtagaaggcatcgaagactttgagagcccatctatgtcatccgtgaatctcaacttcgaccagaccaagttggataatgatgattgttcgagtgtaaacaccgccatcaccgatactacaaccggggatgagggtaacgcagacaatgactccgctaccggcatcgctactgagaccaagtcatcttccgccccaaatgagggtctcacaaaggccgctatgatggcgatgagcgagtacgaagacagactgtccagcggccttgtttcgcccgctccgtccttttacagtaaagaatacgataacgagggcactgtcgactattcagaaacatcaagcctcgccgacccatgctcaccttcacctggagcttcggggtccgcaggcaagtctggcgatagtggcgatcgtcccggacagaagaggttccgaacccagatgacgaatctacaactcaaggtgctcaaatcttgcttcaacgattatagaactcccacaatgctagaatgcgaagtgcttggtaacgacatagggctccctaaaagagtcgtgcaggtctggttccagaatgcgagagccaaggagaaaaagtcaaagctgagtatggcgaaacatttcggcataaaccagacgtcctacgaaggccctaagacagagtgcacactttgcggcatcaaatatagtgcacgtctgtctgtgcgggaccatatcttctctcagcagcatatctcaaaggtgaaggacactattggtagtcagcttgataaggaaaaagagtattttgatcctgccacagtgaggcagctgatggctcagcaagagctcgaccgcataaaaaaggccaatgaagtgctcgggctggccgctcagcagcagggaatgttcgacaataccccactccaggcactcaacttgcctaccgcctatcccgctctccaaggtatccctcccgttttgcttcctggattgaacagtcccagtctgccagggtttacccccagtaataccgccttaacttccccaaaaccaaacttaatgggccttccctccactactgtaccatcaccgggattgccaacttccggcttgccaaataagcccagctctgcgagtttaagctccccaacgcctgctcaggccaccatggccatgggaccacagcagccgccacagcagcagcagcagcagcagcagcctcaggtccagcagccacctcctccgcctgcagctcaaccaccccctaccccccagctccctttacagcaacagcaacagcggaaggacaaagatagtgaaaaagtgaaagaaaaggaaaaagcacataagggcaagggcgagcctctaccagtcccaaaaaaggagaagggagaagctccgacagccacagccgctacaatcagcgctcctctccccactatggagtacgccgtagacccagcacaactacaggctctgcaagcggcactgacttcagatccaactgctttgctcacctcccagtttcttccctattttgtgcccggattttcaccttactacgcgcctcagatccctggagccctgcagtcggggtacctccagcctatgtatgggatggaagggttgttcccctactcgcctgccctgagtcaggcactcatgggactaagccctggatcactcctgcagcaataccagcagtaccagcagtcccttcaggaggccatccagcagcaacagcaacggcagctccaacaacagcaacagcagaaggttcagcagcagcaaccaaaagccagccagaccccggtccctccaggtgctccatcacccgacaaagaccccgcaaaggagagtccaaagccggaggaacaaaaaaacactcctcgcgaagttagccctctgttgcctaagcttcctgaagagcccgaggcggaaagcaagagcgctgatagcctgtatgacccattcatcgtgcctaaagtacagtataaacttgtgtgcaggaaatgtcaggctggtttctcggatgaggaggccgcacggagccaccttaaaagtctttgttttttcggacagtccgtggtcaacttacaggaaatggtattacatgtgcctacaggcggaggcggaggtggaagcgggggtggcggtggcggagggggtggtggtggcggtggtggctcctatcattgcctcgcatgtgaaagtgctctgtgtggtgaggaagccctgagccagcatctggagtccgctctgcataaacacaggacaatcacccgcgcagccaggaatgccaaggagcaccccagcctcctcccacactcggcatgctttcccgacccgtctacggcttccacttcccagtctgccgcacacagcaatgattctcctccacctccatctgccgctgcgccttcttctgcaagcccgcatgcttccagaaagagttggcctcaggtggtatctagggcgtctgcggctaagcctccctctttccctcctctgagttcgtctagcactgtgacaagtagctcttgttcaacctccggggtgcagccttcaatgccaacagacgattattccgaagagtccgacacagatcttagtcaaaagtccgacgggcctgcctctccagtggagggtccaaaggatccaagctgtcctaaggactccgggcttactagtgtgggcacagatacatttcgactgtag

SEQ ID NO: 247223 - DNA, 8369 bp, Artificial Sequence
  Description of Artificial Sequence: Synthetic coding sequence
atgaggctgggtggagggcagttagtgagcgaggagctaatgaacctgggagagtcctttattcagacaaacgatccatcactcaaactcttccaatgcgcagtttgcaataagtttactaccgacaacttagacatgttggggctgcacatgaacgtggagaggagcctgagcgaagatgaatggaaagcagtcatgggagattcttaccagtgtaagctgtgcaggtataatacccagctcaaggccaattttcagctgcactgcaaaactgacaagcatgtccaaaagtatcagctggtggctcacattaaggagggaggcaaggcaaacgagtggcgtctgaaatgtgtggccatcggtaaccctgtgcaccttaaatgcaacgcttgcgactattatactaactctctggagaagctgcgcttgcacactgtcaacagccgccacgaggcctccttgaagttgtacaagcacctgcaacagcacgaaagtggcgttgagggcgaaagctgctattatcactgcgtcttgtgcaactatagtacaaaggcaaaactcaacctcattcagcacgtccgctccatgaaacatcagaggagtgagagtctgcgaaagctgcagcgtctccagaaagggctgccggaggaggacgaggacttgggtcagatttttacaattcgtagatgtcctagcacggatcccgaagaagccatagaggacgtggaggggccttctgaaacggctgccgatcccgaggagctggccaaggatcaggaggggggagcatccagctcccaggccgagaaggaactcaccgattctcctgcgacatcaaagagaatatcctttcccggaagttccgagtcccctctctcttcaaagcgccctaagacagcagaggaaatcaaaccagaacagatgtaccagtgcccatactgtaagtacagcaacgctgacgtaaatagactgagggtgcatgctatgactcagcactcagtgcagccaatgctgcggtgccccctctgtcaagacatgctcaacaacaagatccacctgcagttacatctgactcaccttcactcagtagctccagactgcgtggaaaagctgattatgaccgtgaccactcctgaaatggtgatgccttcttccatgttcctaccagccgcagtccctgatagggacggcaacagcaatcttgaggaagccggaaagcagcctgaaacttccgaagacttgggcaagaatatacttccttccgcctccacagagcagtctggcgatctcaagccatcccccgctgaccctggcagcgttcgcgaggatagcggattcatatgctggaagaaaggatgtaaccaggtgttcaaaactagcgccgctcttcaaacccattttaacgaggtacatgcaaagcgtccccaattaccagtctcagaccgccacgtgtataagtacaggtgtaaccagtgcagtctggcctttaaaactatcgagaagctgcagctccactcccagtatcacgttattcgagccgcaactatgtgttgcttatgccaacggagctttcggacattccaggccttaaagaagcacctggaaacaagccacctggagctttcagaagccgatatccagcagttgtatggaggcctgcttgcgaacggcgacctgttagccatgggtgatccaacgctggcagaggaccacaccataattgtggaagaggataaggaagaagaaagtgatctggaggataagcagtctccaaccggttcggattccggctcggtgcaggaagatagcggtagcgagccaaagcgcgcactgcctttccgcaagggtccaaacttcaccatggagaaattcttggacccttctcggccttacaagtgtactgtgtgtaaggaatcattcacccagaagaacattctactggtgcactataatagcgtatcgcacctacataaactgaaaagagccctgcaggaaagcgcaacaggacagccggagcccacaagctccccagacaataagcccttcaaatgtaacacttgcaacgttgcctattcccagtcatcaaccctggagatccacatgcggagtgtcttacaccaaacaaaggcgagagccgctaaacttgaagccgcatcgggctctagcaatggtactgggaacagtagctctatctctctctctagctcaacgccaagtccagtgtccacctccggctctaacacatttacgaccagcaaccctagctcagcaggaatcgccccaagtagcaaccttttgagccaggtcccaaccgaatccgtaggcatgcctccactcggcaaccctattggagctaatattgcttcaccctccgaaccgaaggaggccaacagaaaaaagttagccgatatgattgcctcaaggcagcagcagcaacagcagcagcaacagcagcagcaacaacagcagcaacagcaacaagcgcagaccctggcacaggcccaagcccaggtccaggctcacctgcagcaggagctccagcaacaggctgcactgattcagtcacagctttttaacccaacactgcttccccattttcctatgactacagagaccctgctacaactgcagcagcaacagcatctcttgttccccttctatataccctcggccgagttccagctgaatccggaggtctcgctgcccgtgaccagtggagcactaactctcacaggcaccggtcctggtttacttgaggatttaaaagcccaggtccaagtgccccagcagtcacaccaacaaattcttcctcagcaacaacagaaccagctgtcgattgctcagtcccactcagccctgcttcagccatctcaacacccggagaaaaagaacaagctggtcataaaggagaaagagaaggaaagtcaaagggagcgtgacagcgccgagggcggagagggaaatacgggtcctaaggagacactaccagacgcgctcaaagctaaggaaaagaaggagctggcgccaggaggcggtagtgagccgagtatgctgccccctaggatcgccagtgacgcgagaggtaatgccacaaaggctcttctggaaaacttcggctttgaactcgtcatacagtacaatgagaacaaacagaaagtgcagaagaaaaacggcaagacggaccaaggggaaaatctcgagaaactcgagtgcgactcttgcggcaagttgttctctaatatactcatcctgaagtctcaccaagagcacgtgcaccagaattatttcccattcaaacaacttgaacggttcgctaaacagtaccgggatcattacgataaactgtatcctctgcggcctcagacccctgaaccaccacctccaccaccaccaccacccccaccccctcttccagccgcacccccacagccagcgtctactccggctattcctgcgtcggccccaccaatcacttctcccaccatcgcaccagcgcagccaagcgtccccctgacacagttatcgatgccgatggaactccctatcttctctccactgatgatgcagacaatgcctttgcagaccctgcccgcacaactccctccgcaactagggccagtcgaacctctgccagctgacctggcacagttgtatcaacaccagctgaatcctaccctactccagcaacagaacaagaggcccaggaccaggataacggatgaccagctaagggtgctgaggcagtactttgacataaacaattcccccagcgaagagcagatcaaagaaatggcagacaagagtggcctgcctcaaaaagtaatcaagcattggtttcggaatactttgttcaaggagagacagcggaacaaagattcaccatacaatttctcaaatcctccaattaccagcttagaagagctaaaaatcgattctaggcctccttcccctgagccaccaaaacaagagtattgggggagtaaaaggtcgtctcgtaccaggtttaccgattatcagctaagagtgctccaagatttctttgacgctaatgcttatcctaaggacgatgagtttgagcagctgagcaatttgctcaacctgcccactcgtgtgatcgtggtgtggttccagaacgccaggcagaaggctcgcaagaactacgagaatcaaggggaagggaaggacggggaaaggcgtgagctgacaaacgaccgatacatccggacgagcaacctgaattaccagtgcaagaaatgttcccttgtcttccaacggatcttcgaccttatcaaacaccagaaaaagctctgttataaagacgaggatgaggaaggtcaggacgactctcaaaacgaagacagtatggatgccatggagatcctgacccccacatcctcgagctgctccacccccatgccgtcccaggcctattcagctcccgcacccagcgccaacaataccgcatcttccgccttcctgcagctgactgccgaagccgaggagttagcaacctttaactccaagaccgaggcgggagatgagaagcctaagctggccgaagcaccctctgcacaacccaatcaaacccaagaaaaacagggacagcctaagcccgaactgcagcagcaggaacagcccgaacagaagacaaacaccccgcagcagaaattaccgcagctagttagcctaccaagcctgccccagccgcctccacaagcccctccgccacagtgccctctcccgcagagctccccctcacctagtcagctctcacatctgccactgaagcccctccacactagcacgccacaacaattagcaaacctgcccccacagctgataccctaccaatgtgaccagtgtaaactggctttccctagtttcgaacactggcaggagcatcagcagctccacttcttgtcagcacagaatcagttcatccatccacaatttcttgatcgtagtttggatatgcccttcatgctctttgatccgtctaacccactcctggcttctcaattactgtcaggagccataccccagattcccgcatcatctgccacctccccttcaacccccacctcaaccatgaacacattgaagaggaagcttgaggagaaagcttcagcttccccaggagagaacgacagcgggaccgggggagaggagccccagcgggacaagagactccggacaactatcaccccagaacaactggaaatcttataccagaagtaccttctcgatagtaaccccacccgaaagatgcttgatcatattgcacacgaagtggggctgaaaaaacgtgtcgtacaggtttggttccagaacacccgtgccagggagagaaaaggacagttcagggcggtgggtcccgcacaggcccaccgtaggtgccccttctgccgcgcactatttaaggcaaaaactgccctcgaggctcacattcgaagccgccattggcatgaagctaagcgggcaggatacaacttgacgttgtccgcgatgcttctcgactgcgacggcggattgcaaatgaagggagacatcttcgacggaacatctttttcccatctgcctcccagctcctcagacgggcagggcgtgccactgagcccagtgtctaagaccatggaattgtctcccagaacgcttttgtcgccatcctccatcaaagttgaagggatcgaagactttgaatctccaagcatgtcgtctgtgaacctcaatttcgaccagactaaacttgataacgacgactgtagttcagtcaatacggccattaccgacactaccaccggcgatgagggcaatgcggataacgattccgccacaggcatagccacagaaacaaaatcttcatccgctccaaacgaagggttaaccaaagcagcgatgatggcgatgtccgaatatgaggaccgcctgtcaagcggattagtgagcccagcccctagtttttactctaaggagtacgacaatgaagggacagtagattactctgagacgtcttcactggctgacccgtgtagcccctcacctggagcttccggttcagcagggaaatctggggattctggtgataggccaggccagaagaggttcaggacccagatgaccaaccttcagttaaaggtgctgaagtcgtgtttcaacgattaccgcacacctacgatgctcgaatgtgaagtgctgggaaatgatatcgggttgcccaagcgggtagttcaggtttggtttcagaatgcaagagctaaggagaagaaatccaagctttctatggcaaaacacttcggtataaatcaaacctcctatgagggcccaaagaccgaatgtactctgtgtggcataaaatacagcgcacggctgagtgttagagatcatatcttctcccagcagcacataagtaaagtgaaagacaccatcggcagtcagctggataaggagaaagagtactttgatccggcaaccgtcagacagctgatggctcaacaggagctggatcgaatcaagaaggccaacgaggtgctgggcttggccgctcagcagcaaggaatgttcgataacacccccctacaggctctgaacctgcccacggcctatccggcactgcagggtatcccccctgtgctccttccgggtctcaactcaccctctctcccagggttcacccctagtaacaccgctctgacatccccgaagcccaatctcatgggcttgccgtcaactacagtgccgagtcccggactgccaacatcaggattgcctaacaagccgagttcggcatcgctgtcctcccctactcctgcacaagcgaccatggcaatgggtcctcagcagccccctcagcagcagcagcagcagcagcagccccaagtgcagcaacctcctccccctcctgccgctcagcccccacccactcctcaacttccactccagcagcagcagcagcgcaaagataaggactccgaaaaagtgaaggagaaagagaaagcccacaagggaaagggcgaacccctgccagtgcctaagaaggagaagggagaggcccctactgccacagcagccaccattagtgcacccctgccgaccatggaatacgcagttgacccagcacagctccaggcactccaggccgcattgacgtccgacccaaccgccttgctgacttctcagtttctgccatacttcgtcccagggttcagcccatactacgctcctcagattccaggcgctctccaaagtgggtacctacaaccaatgtatggtatggaagggctattcccttactcaccagctctgagccaagcgttgatggggctttcaccaggatccctcttacaacagtaccaacaatatcagcagtcactccaggaagcgatccagcagcaacaacagcgtcagcttcaacagcagcaacagcaaaaggtccagcaacagcagccaaaggcaagccagactcctgtcccgcctggcgctccctccccggacaaggatccggctaaagagagtcctaaacccgaggagcaaaaaaatactcctcgcgaggtgtcccctcttctgcccaagctcccagaggaaccagaagcagagagtaagagtgcggacagcctttacgaccccttcatcgtaccaaaagtccaatacaagcttgtgtgccgcaagtgtcaggccggatttagcgatgaggaggccgctcggagccatcttaagagcttatgctttttcggacagagtgtggtcaatctgcaagagatggtgctgcacgtccctacgggtggtggtggtggagggagcggaggcggaggcggtggtggtggtggaggtggcggagggggatcatatcactgtcttgcgtgcgaatctgccctttgcggcgaggaagccttgtcccagcacctcgagagcgctttgcataaacatcgtacaattactcgcgcagcccgtaatgccaaggagcacccgagcctgctcccccattccgcgtgcttccccgacccctcaactgcttcaacttcccagagcgcagctcactctaacgattctccccctccgcctagtgctgccgcaccatcttccgcatcaccccatgcctcaaggaagtcttggcctcaggtggtgtctagagcctccgccgctaaacccccaagcttccccccacttagttcgagttccaccgttacctcctcctcttgctccacatcgggtgtgcagccaagcatgccgaccgatgattactctgaagagtctgataccgatctcagtcagaagagcgatgggcctgcctctcctgtcgagggccctaaggacccatcctgtcctaaggatagcgggttgaccagtgttggtactgacacttttcggctgta

SEQ ID NO: 247224 - DNA, 10704 bp, Artificial Sequence
  Description of Artificial Sequence: Synthetic coding sequence
atggaaacctgcgatagcccccctatctctcgacaggaaaacggccagtcgacttcaaagctgtgcgggaccacacagcttgataacgaggtgccggagaaggttgcaggcatggagcctgatagggagaactcttctaccgacgataacttgaagacagatgaacgaaagtcagaagcactgctgggcttttcagtcgaaaatgccgcagcaacccaggttaccagcgccaaggagatcccttgtaatgagtgcgccacatctttcccaagcctgcagaaatacatggagcaccactgccccaacgcacgcctccccgtgttgaaggacgacaatgagtctgaaatcagcgagctggaagattccgacgttgagaatcttactggggagattgtctaccagcctgatgggagtgcttatatcatagaagacagtaaggagagcggacagaatgctcagaccggtgccaactccaaactgttctccacagctatgtttctggactctctagcatccgccggtgaaaaatcagatcagtccgcctctgcccctatgtccttttatccacagattatcaatactttccacatcgccagctcactgggtaagcctttcacagccgatcaagcctttcctaacacttctgctctcgcaggggtggggcctgtgctacacagcttcagagtgtacgatctgagacacaagcgggaaaaggattatctcaccagtgatgggtccgccaaaaactcatgcgtcagcaaggatgtgcccaataatgtagacctttcaaaattcgatggctgcgtgagcgacggtaagcgcaaacctgtgctgatgtgtttcctttgcaagctgtcatttgggtatatccgatcatttgtgactcacgctgtgcacgatcacagaatgactctgaatgatgaagagcagaaattactgagcaataaatgtgttagcgctatcatacagggcatagggaaagacaaagagcctcttatctcattccttgagcctaagaagagcacctctgtgtatccacatttcagcacaaccaacttaataggaccagatcccacattccggggtctttggtcagctttccacgtcgagaacggtgattccctccccgctggattcgcgtttctgaagggctctgcttctactagcagctcagccgagcagcctctcgggattacacaaatgcccaaagctgaagtgaacttggggggactgagtagtttagtggtaaatacaccaattacctctgtctccctaagtcacagctctagcgagtcatccaagatgtccgagtcaaaagaccaggaaaataattgtgagagacctaaggaatccaatgttcttcaccccaacggtgaatgcccagtcaagagcgagcctacagagcctggcgacgaagacgaggaggacgcgtattctaacgaacttgatgacgaagaggtgcttggagaattgactgattctattggcaataaagacttccccctgttgaaccagtcgatctctccactgtccagctccgtgcttaagttcattgaaaagggaacaagcagcagtagtgcaactgtgagtgacgacaccgaaaaaaagaagcaaactgctgcagtgagggcatctggttctgtggccagcaattacgggatatcagggaaagatttcgccgatgcttccgcttccaaggactctgctaccgcggctcacccatccgagatcgccagaggggacgaggactcttccgccacccctcaccagcacggttttacccctagcacccccggaacgccagggccaggaggtgacgggtccccagggagcggcatcgagtgccccaaatgtgatacggtgcttggcagcagtagatctctgggcggtcacatgacgatgatgcacagtagaaatagctgcaaaaccctgaagtgccccaagtgtaactggcactacaaataccagcagactctggaggctcacatgaaggaaaagcatcccgaacctgggggtagctgcgtctactgcaaaaccggacagccccaccctaggctcgccaggggggaaagttacacctgcgggtataagcctttcaggtgcgaggtttgtaactacagtactactacgaagggcaacctcagtatacatatgcagtctgacaaacatctcaataatgtgcagaatctccagaacgggaatggagaacaggtgttcggccatagtgcacctgctccaaacacttctctctcgggttgtgggaccccctcccccagtaagccaaaacagaagcccacctggaggtgcgaagtgtgtgactacgagaccaatgtcgcaagaaacctcagaatccacatgacatccgagaagcacatgcacaacatgatgctcctccaacagaatatgaagcagattcagcataacctgcaccttggccttgccccagcggaggcagaactttaccaatactatctggcccagaatatcggacttactgggatgaagctagagaatccagctgacccccaattgatgatcaacccattccagctcgacccagccactgctgccgcacttgcccctggattgggtgagctgagcccctatatatccgacccagcgctgaagctcttccaatgtgccgtgtgtaataaatttacctccgattcactggaggcattgtctgtgcacgtctccagcgagcgaagcttaccagaggaggaatggcgagcggtgatcggggacatctatcagtgcaagttgtgcaactataacacacagctcaaggcaaactttcagttgcattgcaagaccgataaacacatgcagaagtatcaactggtggcacatattaaagagggcggtaaatcaaacgagtggcgactgaaatgcatcgctatcggaaacccagtacatctgaaatgtaacgcttgtgactactacacaaattccgtagataaactcagactgcacaccactaaccacagacacgaggctgccctgaaactgtacaagcacttgcagaaacaggagggcgctgtgaacccggaatcctgttattattattgcgcggtgtgtgactatacaaccaaggtaaaactgaacctggttcagcatgtgagaagtgtcaagcatcagcagaccgaggggctgagaaagctccagctgcaccagcagggactagcccctgaagaagataacctgtccgagattttcttcgtcaaagactgcccaccgaacgagctcgagactgccagtttgggtgcgcgtacctgtgatgatgatctgactgaacagcatgaggaggctgagggtgcgattaagcccaccgcggtcgcagaggacgatgaaaaagacacgtctgaaagagacaattcagagggtaagaacagcaacaaggacagcgtgtccgtggctgggggtacccagcctctccttttggccaaagaggaagacgtcgcgactaagcggtctaaacctaccgaggataacaaattttgccatgaacaattctaccagtgtccctattgtaactacaactcacgcgaccagtcccgaatccagatgcatgtgctgtcccagcatagtgtgcagccggtgatctgctgccctctctgccaggatgtgcttagtaataagatgcatctgcaattgcatctcacacatctgcattccgtgtcccctgactgcgtggagaaacttcttatgacggtccccgtccctgatgtcatgatgccaaactccatgctgttgcctgcggctgcttcggagaagtctgaacgcgacaccccagccgctgtaactgctgagggatctggcaaatacagcggtgagagtcccatggacgacaaatccatggcgggacttgaagactcaaaagcaaatgtggaggtaaagaatgaggagcagaaacccacaaaagagcctctggaagtaagcgagtggaataagaactccagtaaggatgttaaaatccctgatacattgcaggaccaactaaacgagcagcaaaagcgacaacccctttcggtcagcgatcgacatgtgtataaatacagatgcaatcactgcagtttggccttcaagacaatgcagaagttgcagatccactcccagtatcacgccatccgcgcagctaccatgtgcaacctttgtcagaggtccttccggactttccaggctcttaaaaaacatttagaagccggtcatccagaactgagtgaagcagagctgcaacagctgtacgcctcgttgcctgtgaatggcgagctttgggcagagagcgagacaatgtcccaggatgaccatgggcttgaacaggagatggaaagggagtatgaggtagatcacgaggggaaggcctcccccgttggatctgacagctcctccatccctgacgatatgggatctgaaccgaagcgtacactgccttttagaaaaggcccaaattttaccatggaaaaattcctggatccctctcggccatacaaatgcactgtgtgcaaggagagctttacccagaaaaatattctactcgtgcattataactcggtatcacatctgcacaagttaaagaaggtgctgcaagaggcaagctcacctgtgcctcaagaaacaaatagtaacacagataacaaaccatacaagtgcagcatttgtaacgtcgcttactctcagagctccactctagagatacatatgcgatccgtcttgcaccagaccaaggccagagccgcaaagcttgagccttcgggacacgtggccggtggccattctattgccgctaacgtaaactctcctgggcagggcatgctagatagcatgtcactcgccgcagtgaatagtaaggacacccatctcgatgctaaagaactaaacaaaaaacagacgccagacttaattagtgcacagccagcacatcatcctccacagagtccagcccagattcagatgcagctacagcacgagctgcaacaacaggctgcattctttcagcctcagttcctaaatccagcctttctcccgcacttcccgatgaccccagaagccttgctgcagtttcaacagccccaattcctgttcccattctatatcccaggtacagagttttctctaggacctgacctcggactgccaggatccgcgacattcggaatgcccggaatgacgggcatggctggatcacttctggaggaccttaagcagcagattcagacacagcaccatgttggtcaaacacagctgcagatactgcagcagcaagctcagcagtaccaggctacacagccgcagctgcagcctcagaagcagcagcagcagccaccccctccccagcaacagcagcagcagcaggcctctaagctgctgaagcaggaacagtccaacattgtttcagccgactgccaaattatgaaggacgtaccttcctataaagaagcagaggacatctcagagaagccagagaaacccaaacaggagtttatcagtgagggcgaaggacttaaggaaggcaaagacacaaagaaacagaagagcctggaacctagtatccctcctcctcgtattgcctccggcgctagagggaatgccgctaaagccttactggagaattttgggtttgagctcgtgatacagtacaatgagaatagacagaaggtgcagaaaaagggcaagtccggcgaaggtgaaaatacagacaaactcgaatgtggaacctgtgggaaacttttctctaatgtgctgatcctgaaatcccatcaggaacatgtccatggtcagttcttcccatacgccgcacttgagaaatttgccaggcaatacagagaggcgtacgacaagctgtacccaatctctccctccagtccggagacccctccacccccaccaccacctccccctctaccacctgcacctccacagccatcttctatgggccctgtgaagatccccaacaccgtgagtaccccactacaagcccctcctcctacacccccacctcctcctccgcctcctccccctccgccaccgccacccccaccacctcctccttccgccccaccacaagtgcagttgcctgtgtcactggacctgccactttttcctagtattatgatgcagcctgtgcaacatcccgcactgccgcctcagttagctcttcagctgccacagatggacgccttgagtgccgacctgacgcagttatgccagcagcagctgggacttgaccccaatttcctacgccactcccaattcaagcggcctaggactcggatcaccgacgatcagttaaagattctgcgtgcatatttcgacattaacaactctccctcggaggagcagatccaggaaatggccgaaaaatccgggctttcccaaaaagttatcaagcactggttccgaaataccctgtttaaagaacgccagagaaacaaggacagtccttataacttcagcaacccacccataaccgtgctggaggatataagaatcgacccacaacctacgtccctcgagcattacaaatcagatgcaagcttctctaagcgttcttcgcgcactcgttttacagactaccagctcagggtacttcaagactttttcgacaccaacgcctaccctaaggatgatgagatcgaacagctgagtaccgttctcaacttacccacacgagtgatcgtcgtttggtttcagaatgcccgtcagaaagcacgaaagagctatgagaatcaggcagagacgaaagacaatgagaagcgagaattgacaaacgagcgctatattagaacatctaacatgcagtaccagtgtaaaaaatgtaacgtcgtattcccaaggattttcgacctgattacacaccagaagaagcagtgctataaggacgaagacgacgacgctcaggacgaaagccaaacagaagattcaatggacgccacagaccaggttgtgtataaacactgtacagtcagtggtcagacggatgctgccaaaaacgccgcagctcccgcagctagcagcggctctggaacatctactcccttgatcccctctccaaaacccgaacctgagaagacaagcccaaaaccagagtatccggctgaaaagccaaaacagagtgaccctagccccccttcccagggcaccaagcctgcccttccactggcctctacaagctcagatccccctcaagccagtaccgcccagcctcagcctcagcctcaacctccaaaacagccccaacttatcggcaggcctccttccgctagtcaaacgccagtcccctcctcaccattgcaaatatctatgacatctttgcagaacagcctgccccctcagctcctgcagtaccagtgcgaccagtgtaccgtggcctttcccactctggagctatggcaggaacatcaacacatgcactttctggccgctcagaaccagtttcttcactctcccttcctagagcgacctatggatatgccttacatgattttcgacccgaacaatccgctgatgaccggtcagctgctgggtagctccctgactcagatgccacctcaagcctccagcagtcacaccaccgctcccaccaccgtggccgcaagcctcaaaaggaagctggacgacaaggaagacaacaactgttctgagaaggaaggcggaaacagcggagaagaccagcacagggacaaacgcctgcgaacaactatcactcccgagcagctcgaaatcctttatgaaaaatacctcctggatagcaacccgacacgcaaaatgctggaccacatcgcccgagaagtggggctgaaaaagagagttgtgcaggtgtggttccagaataccagagctcgcgaacgaaaggggcagttccgggctgtgggacccgcacagtcacacaaacgttgtccgttttgcagagcattgtttaaggccaagagcgcactggaaagccacatcagatctagacactggaatgaaggtaagcaggccggatacagcctgccgccaagcccgcttattagcaccgaggacggtggggagtcgcctcagaagtatatctacttcgactatccgtcactccccctcacaaaaatcgacctgagctccgaaaatgagctggcgagcaccgtgagcacaccggtatctaagactgctgagctcagtccaaagaatctgctttcgccatcatccttcaaggccgagtgctccgaagatgttgagaacttgaacgctccgccagcagaggctggatacgatcagaataaaactgatttcgatgaaacctcctccataaacactgcaatttccgatgccaccactggtgacgagggaaacacagagatggagagcacgaccggctcgtccggggacgtcaagccagcgctttccccgaaagagcccaaaacactcgacaccctgcccaaacccgcaacaactccaacaactgaggtgtgcgatgacaagtttctgttttccttaacgtctcccagcattcacttcaacgacaaagacggtgatcacgaccagtcgttttacattacagatgatcccgacgacaacgctgataggtcagagacgtcctctattgccgacccgagctcgccaaatccttttggctcaagtaatccattcaagagtaagagcaatgataggcctggacataaacgcttccgtacccagatgagcaatttacagctgaaagttttaaaggcgtgcttcagcgactatcgaacacccacaatgcaagagtgcgaaatgctggggaacgagataggtcttcctaagagagtcgtgcaggtctggtttcaaaatgcacgtgcgaaggagaaaaaattcaaaattaatataggcaaacctttcatgataaaccagggtggcaccgaaggcaccaaacctgaatgcaccctgtgtggcgtgaagtactctgcacggctgagtatcagggaccacatcttctccaaacagcatatctcaaaggtcagagagactgtaggttcccagttggatagagagaaggactacctggctcctaccacagtcagacagctaatggcacagcaggagttggacaggattaaaaaagcatctgacgtattggggcttaccgtgcagcagccgggaatgatggacagctcatctctccacgggatttccttgccgacagcctacccgggattaccaggcctgccccctgtgctcttaccaggtatgaacgggccttctagcttgcccggttttccgcagaactcgaacatcgcatccgggatgctcggtttccctacctctgcaaccagctccccggctctgtctttgtccagcgccccaactaaaccactgttgcagacaccaccaccgccaccccctcccccacccccaccgccttcatcatccctctctggtcagcaaaccgagcagcagaataaagagtctgagaagaagcagaccaagcccaacaaagtcaagaagatcaaggaagaggaactggaggctaccaaacctgagaagcatccaaagaaggaggaaaagatctcttctgccctctcagttctgggtaaagtcgtgggcgagacccatgtggacccaatacagctgcaggctctccagaatgcaatcgcaggcgacccagcctcctttattggcggtcagttcctcccatatttcatccctggttttgccagttactttacacctcagcttccaggcacagtacaggggggttacttccccccagtatgcggaatggagagcctctttccctatggccctactatgcctcaaacactagcagggctaagcccgggagcgctcctgcagcagtaccagcaataccaacagaatctgcaagaaagcctgcagaagcaacagaaacagcagcaggagcagcaacagaaaccagtgcaagctaagacttcaaaagtagaaagtgaccagccacagaattcgaacgatgcgagtgagacaaaagaagataaatcaacagcaactgagtccactaaagaagaacctcagttggaaagcaagtccgctgacttctcggacacgtatgtagtgccttttgtcaaatacgagttcatttgccggaagtgtcagatgatgttcacagatgaggacgcggctgtcaaccaccaaaagagcttttgttacttcggacagcctctgatagatccccaggaaacagttcttcgtgtacccgtctcaaagtaccagtgcctggcatgcgacgtcgcaataagcggaaatgaggccctgtctcagcacctacagagctctcttcataaagaaaagactatcaagcaagcaatgagaaatgccaaagagcacgtgcgcctccttccgcattccgtgtgctcccccaatccgaacacgacgagtacttcccaatcagccgcttcttctaacaatacttaccctcacctaagttgtttctccatgaaatcatggcctaacattcttttccaagcatcagccaggagagccgcatcccccccttccagcccaccctcactaagcttgccatcaaccgtgacctcctcgctgtgctctacctcgggggtgcagacatcccttcctaccgagtcttgctccgacgaatccgatagtgagctttcacagaaactcgaggatctcgataattcgcttgaggtgaaggcgaaaccagcttcagggctggatggaaattttaattccatacgaatggatatgttctccgtgtag

SEQ ID NO: 247225 - DNA, 10803 bp, Artificial Sequence
  Description of Artificial Sequence: Synthetic coding sequence
atggagacctgtgattctcccccaatcagtcggcaggagaacggccaatcgacaagcaagttgtgcggaacaactcaactcgataatgaagtgccagaaaaagtggcaggcatggagcccgacagggaaaactcatctacagacgataatctgaaaacagacgagcgtaaaagcgaggccctgctcgggttcagcgtggagaatgccgcagctacacaagtcacctctgccaaagaaataccatgtaacgaatgtgccactagtttccctagcctgcagaagtacatggaacatcactgcccgaacgctcggctacctgtattgaaagacgataatgaatccgaaatcagtgagctggaggatagcgatgtggaaaatcttaccggtgagattgtatatcaaccagacggctcagcttatatcattgaagacagtaaagaatccgggcagaacgcccagacaggcgctaattcaaagctgtttagtacagctatgtttttggactcactggccagcgcaggcgagaaaagcgatcagtccgcatctgcccctatgtctttttacccccaaattattaacacctttcatatcgctagctccctcggaaagccatttacagccgaccaggcatttcccaatacctctgccctggcaggggtgggaccggttctgcattccttccgggtctatgacctgagacataaaagagagaaagattacctgacctccgatggcagcgccaagaattcatgtgtttctaaagatgtccctaacaatgtagacctcagtaagttcgatggttgtgtgtccgacggcaagaggaaacctgttttgatgtgttttctgtgtaagcttagctttgggtatataaggtcctttgtgacccacgcagtgcatgatcatcgaatgacgctcaatgacgaggaacagaaactgttaagtaacaaatgcgtgagcgcaattattcagggcatcggtaaggacaaggagccgcttataagttttctcgaaccaaaaaagtccacttctgtataccctcatttcagtacaacgaacctgattggacccgatcccacattccgtggactctggagtgcatttcacgtggagaacggagactcgctgccagccggattcgcttttctgaagggcagtgcttccacctcttcttctgctgaacagcctctgggcatcacacaaatgccaaaagccgaggtgaatctgggaggattatccagtctggtggtgaacactcctatcacttcagtcagcctgagtcactccagctccgaaagctcaaaaatgtctgagtctaaggaccaagaaaacaattgcgagcgcccaaaggagtccaacgttttgcaccccaacggagaatgtcctgtgaagtctgaacccacagagcccggagatgaagacgaagaggacgcttactccaatgagctcgacgacgaagaagtcctgggcgagctaacagacagcatcggaaataaggactttccactcctgaatcagtccatctctcccctgtcttcctctgttctaaaatttatcgagaaagggaccagctcaagcagtgccacagtatccgatgatacagagaaaaagaaacagacagcagccgtaagggctagcggctctgtcgcctcaaactacggaatttccggtaaggactttgcagatgcgagcgcctctaaagactcagccacagccgctcatccctcggaaatcgcccgaggggacgaggactccagtgctaccccacaccaacatggatttactccgagtacacctggcactcccggacctggaggggacggttctccagggagcggaatcgagtgcccaaagtgtgacactgtcttgggtagtagtcgtagcctggggggtcacatgactatgatgcattctcggaatagttgcaaaacgttgaaatgcccaaaatgcaactggcactacaagtaccagcaaaccctggaagcccacatgaaagagaagcaccccgagccaggtgggtcatgcgtgtattgcaaaacggggcaacctcaccctcgccttgccaggggcgagtcttacacttgcgggtataaacctttccgatgcgaggtgtgcaattactccaccaccaccaaggggaatctgtcgattcacatgcagagcgataagcacctaaacaacgtacaaaatctccagaatggcaatggtgagcaagtgttcggacatagcgcaccagcgcctaacaccagtctgagcggttgtgggacaccgtctcctagcaaacccaagcagaaacccacctggaggtgcgaggtgtgcgactacgaaacaaacgtagcacggaaccttcgaatccacatgactagcgagaaacacatgcacaacatgatgctgctgcagcagaatatgaagcagattcagcacaacctgcatctcggcctggctcccgcagaagctgaactgtatcaatactatctggcccagaacattgggctgactggcatgaagctggagaacccagctgaccctcagcttatgatcaatcccttccagcttgaccctgctactgctgcggctctggcacctggccttgtgaacaacgagctgccgcctgaaatcagactcgctagtggccagctcatgggcgatgacctctcccttctgacggcgggtgagctgtccccttatatcagtgacccagcactgaaactgtttcaatgcgcggtatgcaataagtttacgtctgattccctcgaggctctgtcggtgcacgtgtctagcgagaggagcctcccggaggaggagtggagagcagttatcggcgacatctaccagtgtaagctctgtaactataatacccaattaaaagcgaactttcagctgcactgtaagacagataagcacatgcagaaatatcaacttgtcgcccatattaaggagggaggaaagtctaatgagtggcggttaaagtgtatcgctattggaaatcctgtgcatcttaagtgcaacgcatgtgactattatacaaacagtgtagataagttgcgcctgcacacaaccaaccaccggcatgaagccgctcttaaactttacaagcacctccagaagcaagagggtgcggttaaccccgaaagctgttattattactgtgccgtgtgtgattacactacgaaagttaagctgaacctggtccagcatgtgaggagcgtcaagcaccagcagacggagggcctacgcaagctgcaactacaccagcaggggctggcaccggaagaggacaacctgagcgaaatcttcttcgtcaaagactgtccacccaacgagttggagaccgccagccttggcgcaagaacttgcgacgacgatctgacagagcaacagctgaggtcaacctccgaagagcagagcgaggaggccgagggcgctattaaacccacggccgtggccgaagacgatgaaaaggatacgtcagaacgggacaacagtgagggtaaaaactcgaacaaagactccgggatcatcacacctgagaaagagttaaaggttagtgtggccggaggtacccaacctctactgttggcgaaagaagaggacgtggccactaaaagaagcaaacctactgaggacaataaattttgtcacgaacagttttaccaatgtccgtattgtaactacaattcccgagaccagagtcggatccaaatgcacgtcttatcgcagcactccgtacaaccggttatctgctgtccactgtgtcaggacgtgttgagcaataagatgcaccttcagctgcacctcactcatctccactccgtgtctcccgattgcgtggaaaagctgttaatgaccgttcctgtcccggacgtaatgatgccgaatagtatgctcttgccagccgctgccagtgagaaaagcgaacgcgataccccggcagccgtgacagctgaggggagcggaaaatattctggagagagtcccatggatgataagtcaatggccggactggaggatagcaaagccaatgtggaggtgaagaatgaagagcaaaagccaactaaagaacccctcgaggttagtgagtggaacaaaaatagttctaaagacgtgaaaatcccagatacgctccaggaccagctgaatgaacagcaaaagcggcagccccttagcgtgtcggatcggcacgtctataaatatagatgtaatcattgttccctcgcatttaaaaccatgcagaagctccaaattcactcccagtatcatgctataagggcagcgactatgtgtaacttatgtcagcggagttttcgaaccttccaggctcttaaaaagcaccttgaagcaggacaccctgaattgagcgaggctgagctgcagcagttatacgccagcctccccgtcaacggagaactgtgggccgagtccgaaaccatgagtcaggatgaccacggacttgagcaggagatggagcgagaatacgaagtggatcatgagggcaaggctagtcctgtaggcagtgattcatcttccatccccgacgacatggggagcgaacctaagcggactcttcctttccgcaagggacccaattttactatggagaagttccttgatccgagccggccatacaagtgcacagtgtgtaaagagtcctttacacaaaaaaacatccttctggttcattataatagtgtttctcacctccacaaactcaaaaaagtccttcaagaggccagttctccagtgcctcaggagacaaattcaaacaccgacaacaagccctacaagtgcagcatctgtaacgtggcctactcacagtccagcaccctggaaatccatatgcggtccgtgctccaccagactaaggccagggccgctaaacttgagcccagcgggcatgtagctggtggtcattcaatcgccgctaacgtgaattctcccggtcaaggcatgctggacagcatgtctctggcggctgtgaatagcaaagacactcacttggacgctaaggagctgaataaaaagcagaccccggacctgatttcagcccagccggcacatcacccacctcagtcgccagcacagattcagatgcagcttcagcatgagttacagcagcaggcagcattcttccagccacagttcctgaacccagcttttctgccccacttccctatgacccctgaggccctacttcagtttcagcagccacagtttttgtttccattttacattccgggtaccgagttcagtctggggcctgacctgggattgcccggatccgccacgttcgggatgcccggaatgaccggtatggccggaagtctgctcgaagacctgaaacagcagattcagactcagcatcatgttggccagacacagctccagattctgcagcagcaggcccagcagtaccaggcaactcagccgcagctgcagccacagaagcagcagcagcagccaccaccccctcagcagcagcagcagcagcaagcaagcaagctcctcaagcaggaacagagtaatatcgtcagcgccgattgccagataatgaaagacgtaccgtcctacaaagaggcagaggatataagtgagaagcctgaaaagcccaagcaggaattcatcagcgaaggggaaggtttgaaagagggaaaagacaccaagaagcagaagtcactggagccctccattcccccaccccgaatcgccagtggagcccgtggcaatgctgccaaggctcttctcgagaatttcggattcgaacttgtaatccagtataacgagaaccggcaaaaggtgcagaaaaaagggaagagcggtgaaggcgaaaacactgacaagctggagtgtggcacatgcggaaaactattctccaatgtgttgatcctgaagagtcaccaggagcacgtgcacggccagttttttccgtacgccgcattagagaagttcgcaagacagtatcgggaggcatatgacaagctttatcccattagcccctcgtcccctgagactccgcctcctcccccaccccctccgcctctgccacccgctccaccgcaaccctcgagcatgggcccagtcaagattccaaacacagtgagtactccacttcaggccccacctcctaccccgcctccaccgagcgcccctccccaagtgcagctcccggtgagcttggatttaccgttgtttccctctattatgatgcagcctgtacagcacccagctctgcctcctcagctggccctgcagctgccacagatggacgctctttctgccgatcttacccagctgtgccaacagcagcttgggctggacccaaatttcctgcgacacagccaatttaaacgcccaagaaccaggattaccgacgaccaattgaaaatcctcagagcatatttcgacatcaacaatagcccttccgaggagcaaattcaggaaatggccgaaaagtccgggctgagccagaaagtgattaagcattggttcaggaacacactgttcaaggagaggcagaggaacaaagactcaccttacaacttctctaatcctcctattacggtccttgaggacattagaatagatccccagcccaccagtcttgagcactacaagtctgatgcttctttttccaaacggtcctcaagaaccaggtttaccgattatcagctgagggtgctccaggatttctttgacacaaacgcttacccaaaggatgatgagatagagcagctgtccactgtcctgaatttgccaacccgcgtgatcgtcgtttggttccaaaatgctagacaaaaggcacggaagtcttacgagaaccaagccgagactaaggataatgaaaagagggagctgacaaacgagagatacatcaggaccagcaacatgcagtatcagtgcaagaaatgcaacgtcgtttttccaagaatttttgacctcattactcaccagaagaaacagtgctacaaggacgaagacgatgatgcccaggatgaatcccagaccgaagattccatggatgcaaccgatcaagtggtatacaagcactgcacagtttctggacagaccgacgccgctaagaatgccgcagcacccgcagcgtcctcgggcagcggcaccagcacccccctcataccaagccctaagcctgagcctgagaagaccagccccaaacctgagtatccagcagaaaaacccaagcagagcgacccatctccaccatctcaagggactaaacccgcattgcccctagccagcacttcctccgaccctccacaggcaagcacagctcagccacagccccagccacaaccccctaaacagcctcagctgatcggacgccctcccagtgcctctcagacaccagtcccttcatctccgctccaaatatcaatgaccagcttgcagaactccctgccgcctcagttgctccagtaccagtgtgatcagtgcactgtggcctttcctacgcttgagttatggcaggagcatcagcacatgcactttctagccgcacagaatcagttcctccattccccgttccttgagaggccgatggacatgccctacatgatcttcgacccaaataacccattgatgacagggcaactactgggttcttccctgactcagatgccccctcaggcttccagttcgcatactacggctcctactacagtcgcggcatctttaaaacggaaactggacgataaggaggataataactgctccgagaaagagggaggcaatagcggagaggatcagcacagagataagcgcctacggactactatcactcccgagcagctggagatcctgtatgagaaatatctgttggattctaaccccacacgcaaaatgttagaccacatagcgcgtgaagtagggctgaaaaagcgggtggtgcaggtgtggttccagaatactagagcgagggaacggaaagggcagtttagagccgtggggcctgcgcagtcccacaagcgttgtcccttctgtcgagctcttttcaaagccaagtcagccctggagagccatatacgctcaaggcattggaatgagggaaagcaggcagggtactcattgccaccctcccccctgatctccacagaggatgggggagagagtccgcagaagtacatatattttgattatccttctctgccactaactaaaattgacctgagctctgaaaacgaattggctagcacggtctccaccccagtgtctaagaccgccgagctgagccctaaaaatttattgtcaccttccagttttaaagctgagtgtagcgaagatgtggaaaatctgaacgccccacccgctgaggccggttacgatcagaacaaaaccgactttgacgagactagcagtatcaacacagcaatttcggacgctacaaccggcgacgaggggaacaccgagatggagtctaccacagggtctagcggggatgtgaagccagccttgtccccaaaagagccaaagactttggatacactgcctaagcctgccactacccccactacggaagtgtgcgacgacaaatttctgttttccctcacttccccctctatacacttcaacgacaaggacggggatcacgaccagtccttttacatcaccgacgaccccgacgacaacgctgacaggagtgagacatcctcaattgctgatccgtcatctcccaacccctttggcagcagcaatccctttaagtcgaagagcaatgataggcccggtcataaacgttttcgaacgcagatgtccaaccttcagctcaaagtgctgaaggcttgtttctcagactacaggactccgacaatgcaagaatgcgagatgctgggcaacgagataggcctgccaaaaagggtggttcaggtatggtttcagaacgccagagcgaaggaaaagaagtttaagatcaatatcggaaaaccattcatgatcaaccaagggggaactgaggggaccaaacctgagtgcaccctgtgtggggtcaaatactctgcaagactttctataagagaccacatattttctaaacagcatatcagcaaggtgcgcgaaactgtgggatcgcagctcgatcgcgaaaaggactaccttgcacctactacagtgagacaactcatggcacaacaggaactggaccggattaagaaagcgagtgacgtcctaggccttaccgttcagcaaccaggtatgatggactcctctagcctccatggcatcagtctgccaaccgcctatcctggcctcccaggccttccaccggtgctgctgcccggaatgaacggacctagctccctgcctggattcccccagaactctaacaccttaaccccccctggtgctggcatgctaggattcccaacctccgcgacttcctctcctgctttaagcctgagctcagctcctacaaaacctctgcttcagactccgccaccccctcctcctcctccccctccacctccatcctcatcactgtctggacagcagaccgagcagcagaataaggaaagtgaaaagaaacagaccaagccgaacaaggttaaaaaaattaaggaagaggagctcgaagccacaaaaccagagaaacacccaaaaaaggaggaaaagatcagctctgcattgagtgtgctcggcaaggtggtgggcgagactcatgttgatcccatacagttgcaagctctacaaaacgcaatagccggtgatcccgcttcttttataggtgggcagttcttgccctactttatacccggattcgcgtcctacttcaccccgcaactccccggaaccgtgcaggggggttactttccacctgtctgcgggatggaaagcctgtttccttacggaccaacaatgcctcagaccctggccggactgagtcctggagccctcttgcaacagtaccagcagtaccagcagaacctgcaggaatctcttcagaaacagcagaagcagcagcaggaacagcagcaaaagccggtgcaggcgaagacaagcaaagtggagagcgaccagcctcagaattcgaatgatgcttctgagacaaaagaggataagtctaccgcaacagaatcaaccaaagaggaaccacaactggagagcaaatcagccgacttctctgatacttacgtggttccttttgtgaaatacgagttcatttgtcggaagtgtcaaatgatgtttacagatgaggacgccgctgtgaaccaccagaagagcttttgctattttggccagccgctgattgacccccaggagacggtgctgagggtgccagtatccaaataccagtgccttgcctgtgacgtggctatttcaggcaatgaggcgttaagtcagcatctccagtcatccctgcataaagaaaaaaccattaaacaggccatgagaaacgccaaagaacacgtacgactccttccccactcagtctgctctcctaatcctaacacaacctcaacttcccagagcgcagcctcctctaataatacttaccctcacttgagttgctttagtatgaagtcctggccgaatatcctctttcaggcatcagcgcgtagggctgccagtccaccgtcctctcctccatccctcagcctgccctccacagtcacctcaagcttgtgttctaccagcggggtccagacaagccttccgactgagagctgcagcgacgaatcagactccgagctgagccagaaattggaagacctggacaattcattagaggtgaaagcaaaacctgctagcgggttggacggcaatttcaatagcattcgcatggacatgttttcagtttaa

SEQ ID NO: 247226 - DNA, 10716 bp, Artificial Sequence
  Description of Artificial Sequence: Synthetic coding sequence
atggagacatgcgactccccacctataagtagacaagaaaatggccagagtacatccaagttgtgcggcaccacccagctcgataacgaggtgcctgagaaggtggctggtatggaacctgaccgcgagaactccagtactgatgacaacctcaaaactgacgagcggaagtcagaggctctgttaggcttctctgtggaaaatgccgcagctacacaggtcacctccgctaaggagattccatgtaacgaatgtgccacgtcttttcctagccttcaaaaatacatggagcaccattgcccgaatgcaaggctgcccgtcctgaaagacgacaatgagtccgagatatccgagttagaagactcagacgtcgaaaaccttactggcgagattgtttatcagccggacgggtcggcgtatattatcgaggactccaaggaaagtggccagaatgcccagacgggcgctaattcaaagctgttctccaccgccatgtttttagacagtttggcgtcagccggagagaaatccgaccagagcgccagtgccccaatgagtttctacccccaaatcattaatacgtttcacattgccagtagtctcggtaagccatttacagctgatcaggcattcccgaatacctcagcactggccggtgtcggtcctgtgcttcactcctttagggtgtacgatctaaggcataaaagggaaaaagattacctgacatccgatggatcagccaagaatagctgtgtctctaaagatgtgcccaacaatgttgacctgagcaagttcgatggttgtgtctcagatggaaaaaggaagccagtcctgatgtgttttctgtgcaagctgagcttcggttacatccgctcattcgtgacacatgccgtgcacgatcatcggatgactcttaacgacgaagaacagaaactgctgagcaacaagtgtgtctcagcgataattcagggaatagggaaggacaaagaaccgctgatcagctttctggaacctaaaaagtcgacttctgtttaccctcactttagcaccaccaatctgattggcccagatcccacattcagggggctttggtccgcgtttcacgtggaaaatggagactcgctgcctgctggattcgcctttctgaagggatccgcaagtacgtcctccagcgctgagcagccgttgggtatcacccagatgcctaaggccgaagtgaacctgggtgggctaagtagcttggttgtgaacactcccatcacaagcgtcagcctgtcgcattccagcagcgaatccagcaagatgagtgagtctaaagatcaggaaaataactgcgaacgccctaaagaatcaaacgtgctgcatcccaatggcgaatgccctgtgaaatccgagcctacagaaccaggggacgaggatgaagaggatgcctatagcaatgaactcgacgatgaagaggtgctgggggaattgacagactccatcggaaataaggattttcccctgctgaaccagtctatcagcccactcagctcaagcgtccttaaattcatcgaaaaagggactagttcctctagtgccacagtttcagatgataccgagaagaagaagcagacagccgctgtgcgcgcaagtggtagcgtcgcatccaactatggcattagcggtaaagacttcgcagacgctagtgccagcaaagacagcgccaccgccgcacacccctcagaaatcgcaaggggtgatgaagacagttccgccaccccacatcagcacggcttcactcccagtaccccgggtacccccggtcccggaggagacggttcccccggatctggcatcgaatgtccaaaatgcgataccgtgctgggcagtagtcgcagtctggggggacacatgacaatgatgcacagccgaaacagttgcaaaacattgaagtgcccgaaatgcaattggcactacaaataccagcagaccctcgaggcccacatgaaggaaaaacaccctgagcccggtggaagttgtgtgtattgcaagaccgggcaaccgcaccccagactcgccagaggagagtcctacacctgcggatacaaaccttttcgttgtgaggtttgtaattacagtaccactacaaagggtaacctttctatccatatgcagagcgataagcaccttaacaacgttcagaatctgcagaatggcaatggcgaacaggtctttggccacagcgcaccggctccaaacacctcattgagtgggtgtggaacaccaagcccctctaagccgaagcagaagccaacatggagatgtgaagtctgcgattacgagacgaatgtggctcggaacctccgaatccacatgacctcagagaaacatatgcacaatatgatgctgctgcagcaaaatatgaagcagattcaacacaacttgcatctcgggctagcccctgctgaagcagagctttatcagtactacctggctcagaatatcgggctgacaggtatgaagctagaaaatccagcggatccccaactgatgatcaacccattccagcttgatccggcaacagccgctgcgttggccccaggattgggagaactctcgccatatatatcagatcccgctctgaaacttttccagtgcgctgtgtgtaacaaatttacgtcggactctctggaggccttgagcgtccacgtatcaagcgagaggagcctccctgaagaagagtggcgcgctgttatcggggatatctaccaatgtaaactgtgtaactataacacccagctgaaggctaacttccagctgcattgtaaaactgataagcacatgcagaaataccagctcgtggctcacattaaggagggaggtaagtccaatgaatggaggctaaaatgtatcgccattggaaacccagttcacctgaagtgcaacgcctgtgattactacacaaacagcgtcgataaactgcggttgcatactactaatcataggcacgaagccgcattaaagctttataagcacctgcaaaaacaggagggcgcagtgaatccggagtcttgttactattactgcgctgtgtgcgactacactaccaaagttaaactgaatcttgtgcagcacgtcagatcagtaaagcatcagcaaactgaaggcctgcgtaagttgcagcttcaccagcagggtctggccccagaagaagacaatttgtctgaaattttttttgttaaggactgccctcccaacgaactggagacggcatcccttggagcaagaacctgtgacgatgacttaacggagcaacacgaggaggctgaaggggctatcaagcctactgccgtagccgaagatgacgagaaggataccagtgaaagagataactcggagggaaagaactccaataaggatagcgtctccgtcgcagggggaactcagccgctgctcctggcaaaggaagaggacgtggctacaaaacggagtaagcctaccgaggacaataagttttgtcacgagcagttttaccagtgcccctactgcaattataactcccgggaccaaagccggattcagatgcacgtcctgtctcaacatagtgttcagcccgtaatctgttgcccactgtgtcaagacgttctgtctaacaagatgcaccttcaactgcatttgactcacctgcatagcgtgtctcccgactgtgtggagaaactcctgatgaccgtgcctgtcccggacgtgatgatgccaaacagtatgctgttacccgctgccgcttccgagaaaagcgagagagatacaccagccgctgtgacagccgagggctcaggcaaatactctggcgaatcccccatggacgataagtcaatggccggtcttgaagacagtaaggcaaatgtcgaagtcaaaaacgaagaacagaagccgaccaaagagccattggaggtttcagagtggaacaagaacagtagcaaggacgtgaagatcccggacactctgcaggatcagctgaatgaacagcagaagaggcaaccgctatctgtgagcgataggcatgtctataaatatagatgtaaccactgttcattggctttcaaaaccatgcagaaattacagattcactcacagtatcacgccattagagcagctaccatgtgcaacctatgccagcgatcatttaggacatttcaggctctgaagaagcacttggaggcagggcacccagaattaagcgaagccgaactgcagcagctgtatgcgagcctaccagtcaatggagagctctgggcggagagcgagactatgagccaagacgaccacgggttggagcaggagatggaacgggagtacgaggtggaccacgaagggaaagcatcccccgttgggtctgacagcagtagcatcccagatgacatgggcagtgagcccaaaagaacacttcccttcaggaaaggcccaaactttactatggagaaatttttggaccctagccgtccatataaatgtacagtgtgcaaggaatcatttacacagaagaacatccttttagtgcattataactccgtctcacatctgcataagctcaaaaaggtgttgcaggaagcaagctcacccgtgcctcaggagactaactcaaatacggacaacaaaccatacaagtgtagtatttgcaatgtggcatactctcagtcttcgacccttgagatccacatgaggtctgtcctgcatcaaactaaagccagggccgcaaaactcgaaccctccgggcacgttgccggtggccatagcatcgccgcaaacgtgaacagccctgggcagggaatgctggatagcatgtcgttagcagctgtaaattctaaagatactcaccttgacgctaaggagctcaacaagaaacaaacccccgatttgatatcggcccagcccgcacatcaccctccccagtctccggctcagattcagatgcagcttcaacacgagttgcaacagcaagcagcattctttcaacctcagttcctgaaccctgcgttcctgcctcactttcccatgactcccgaagctctcctgcagtttcaacagcctcagttcctgttccccttctatattcccggaactgagtttagcctgggtccagatctgggcctccccggatccgcgaccttcggcatgccaggaatgacagggatggccggaagcctcctggaggacctaaagcagcagattcagactcagcaccatgtgggacagacacaactgcagatactacaacagcaggcccagcagtaccaggctactcagccgcaactgcagccgcagaagcagcagcaacagcctcctcctccacagcagcagcagcaacagcaggcatctaagctgctgaaacaggaacagtctaatatcgtttccgcagactgccaaattatgaaggacgtgcctagctataaggaggcggaagacatcagcgagaagccagaaaaacctaagcaagaatttataagcgagggcgaaggtctgaaggagggcaaggatacaaagaaacagaaatccttggagccctcaatccctcctcctcggatcgcctcaggcgctagaggaaacgctgctaaggccctcctcgaaaacttcggctttgagctggttatacagtataacgagaacagacaaaaggtgcagaaaaagggtaaaagtggcgaaggtgagaacaccgacaaactggagtgtggcacatgtggtaagctgttttccaacgtgctcatcctcaaatcccatcaggaacatgttcatggtcaattcttcccctacgccgctctagaaaaatttgcaaggcagtacagggaagcgtacgacaaactatatccgatttcgccatcttcaccggagactccgcctccaccacccccacccccacccctgcccccagccccaccacaaccatccagcatgggccctgtcaagattccgaacactgtttccactccactgcaagcccctcctcctactcctcccccaccacctccaccacctcccccaccccctccaccccctcccccacccccaccatcagcgccaccccaagtgcagctgccagtgagcctggatctgccgctcttcccgtctatcatgatgcagcccgtccaacatcctgcactacctccgcagctggcgctgcagctccctcagatggacgcactcagtgctgacctgactcagctgtgtcaacagcagttgggtctggaccccaacttcctgcgccactcccaattcaaacgtcccaggacgagaatcaccgatgaccagctgaagatcctccgcgcatacttcgatatcaataatagtccctccgaggaacagattcaggagatggcagagaagtcaggactgtcgcagaaagtaataaaacactggttccggaatacgttgttcaaagagagacagaggaataaggactccccctataatttctcaaatccccctatcacagtactcgaggatatcagaattgatccacaaccaactagtctggaacattacaaatcagatgctagttttagcaaaaggtctagtcgcacccgctttactgattaccagctccgagtcttgcaggacttctttgacactaacgcctatcctaaggacgacgaaatcgagcagctgtctacagtgttgaacttgccgacccgggtcattgtggtgtggtttcagaacgcaagacaaaaggctagaaagagctacgaaaatcaggctgaaactaaagacaacgaaaagagggaactgacaaacgaaagatatatccgaaccagtaacatgcagtatcaatgcaagaagtgcaacgtcgtgtttccgagaattttcgatctgatcactcaccagaagaagcagtgctacaaggacgaggacgatgatgctcaggacgagtcccagactgaggattccatggatgccaccgaccaagtggtctacaaacactgtacagtttctggtcaaaccgatgcagcgaagaacgctgccgcaccggctgcgtccagcggatctgggacctccactcccctgattccgtcgcccaagcccgagcccgagaaaacatccccgaagcctgagtatccagcggagaagccaaaacagtccgacccatcacctccatcacagggtacgaaaccagcacttcccctcgcaagcacaagctcggaccctccccaggcttccactgcccagccgcagccgcagcctcagccccctaagcagccacagttgattggcaggccgccaagcgccagccagacaccagtgccttcatctcccctccagatttctatgacgagtcttcagaactctcttcccccacagttactgcagtatcaatgcgaccagtgcacagtggcttttcccaccctggagttgtggcaagagcaccagcacatgcacttccttgctgcacagaatcagtttctgcacagcccttttctggagaggcctatggacatgccatacatgatcttcgaccctaataacccattaatgactggacagctgttgggatctagcctgacgcagatgcctccacaggcctcttcatcccataccaccgcccctactactgttgcggcatccctcaagcggaaactcgacgataaggaagataacaattgctccgaaaaggagggcggtaactcaggcgaggatcagcaccgggacaaacgcttgcgcacaactataacaccggaacagcttgagatcctgtatgaaaagtatctgctggattccaatcccactcggaaaatgctcgatcacattgcacgggaggttggtttgaaaaagcgggtggtacaagtatggtttcagaacaccagggctcgtgaacggaaaggccagttccgggcagtgggaccagcacaatcccataagaggtgtcccttctgccgtgccttattcaaggcaaaaagtgccctggaaagccacatccgatcccgccactggaacgagggaaaacaggccggatatagtctgcccccaagccccttgattagtactgaggacgggggagaatctccacagaagtatatctacttcgattacccctcactccccctgactaagatagatctgtcatctgagaatgagcttgcgtctacagtgtcaacacccgtatcgaaaaccgccgagctgtcgcctaagaacctgctctctccgtcctccttcaaggccgaatgtagcgaggatgttgaaaatttgaatgctccccctgctgaggctgggtacgatcagaacaagactgacttcgacgaaaccagcagcatcaacaccgcaatatcagacgcgaccacaggagatgaggggaacacggagatggaaagcaccacaggcagctcaggggacgtgaagccagcgctctctcccaaagagcccaagaccctagatactctgcccaagccagctacgaccccaacaaccgaagtctgtgatgacaagttcttgttcagcctcacctcacccagcatacactttaatgacaaagacggagatcacgatcaaagcttctacattacggatgatccagatgacaatgccgaccggagcgaaacgtcgagcatcgctgaccctagcagtccaaacccgttcggctcatcaaacccctttaaaagtaaatctaacgatcgaccaggtcataaaagattccgcactcagatgagcaatctgcaattaaaagtccttaaagcttgcttcagtgactatagaacgccgaccatgcaggagtgcgagatgctcgggaatgaaatcggcttgcccaagcgggtggtgcaggtgtggtttcagaacgcgcgtgctaaggagaaaaagttcaagatcaacattgggaaaccttttatgatcaaccagggtggcaccgagggcaccaagcccgaatgtacactctgtggggtcaaatacagtgctagattatcgattcgcgaccatatcttttccaaacaacacatttcaaaggtccgggaaacggtcggctcacagctggacagggagaaggactatcttgcgcctactacagttcggcaactgatggcccaacaagaattggaccgcataaagaaggcatctgatgtgcttgggctcaccgtccagcagccgggaatgatggactccagcagtcttcatggcatttcactgccaacagcctatcccggtctgcccggactgccaccggtgctccttccaggaatgaatggcccatcatccctgcctggctttccccagaattctaacaccctcacgccaccaggcgcaggaatgctcggctttcctacttctgcgacctcatccccagccctttcactcagctctgcacctacaaagcctttgttacagacacccccacctcccccaccaccacccccaccccctcccagttcctccctgtcaggccagcaaactgagcagcagaacaaagaaagtgaaaagaagcagaccaaacctaacaaggtgaaaaagatcaaggaggaggagcttgaagctaccaagccagaaaagcaccccaaaaaagaggagaaaatctccagtgctctgagcgttcttgggaaagtggtaggagagactcacgtggatcccatacagctacaggctcttcaaaatgccatcgccggagaccctgcttcctttatcgggggacaatttttgccttatttcataccgggatttgccagttattttacgccgcagctgccgggtacagtgcaggggggttactttccacctgtgtgcggaatggagtccctcttcccctatggacccaccatgccacagacattggcaggcctctcccccggtgctttgcttcagcagtaccaacaataccagcagaatctgcaagagtcgctgcagaagcaacagaaacagcagcaggagcaacaacagaaacccgtgcaggcaaagactagcaaagttgaatcagaccagccgcagaattctaacgacgcctcggagaccaaggaggacaagtcaactgccacagagagtacaaaggaagagccacagctcgagagcaagtctgctgactttagcgacacatatgttgtcccctttgtgaagtatgaattcatatgccgtaaatgtcagatgatgtttaccgacgaggatgctgctgttaaccaccagaagagtttctgttactttgggcagcctttgatcgatcctcaggagacagtgctgcgtgttccggtctctaagtatcaatgtctagcatgcgacgttgctatcagcgggaacgaggccctcagccagcacttgcagtcttccttgcataaggaaaaaactattaagcaggcgatgcggaatgctaaggaacacgttcgcctcttaccccacagtgtatgttcccctaaccccaacaccacatcaacctcacagtcagctgccagctcaaataatacatatccacacctgagctgcttttctatgaaaagctggcccaacatcttgttccaggcttctgcgcgacgggcagcctcaccaccctcgtcaccccctagtctctcacttccatctactgtgacttcctctctttgctccacttcaggagtgcagacttctctccccacagagtcatgtagtgatgagtcagactctgagctttctcagaaactcgaggacttggataactctctggaagtcaaagccaagccagcatcgggcctggatggtaatttcaatagcattagaatggatatgttttctgtgtac

SEQ ID NO: 247227 - DNA, 468 bp, Artificial Sequence
  Description of Artificial Sequence: Synthetic coding sequence
atggaaacctgcgatagtcctcctatttcaaggcaggagaatgggcagtccacgtcaaagctgtgcggcacgacacagttagataatgaggtcccagaaaaggtggccggtatggagcccgaccgcgaaaactcctctaccgatgacaaccttaagacggatgagcgcaagtctgaagctttgctggggttttctgtagaaaacgctgctgctactcaggtcactagtgcgaaggaaattccttgcaatgaatgtgccacctcttttccttcactgcagaaatacatggagcatcattgcccgaatgctcggttgcctgtgttgaaagacgacaatgagagtgaaatcagcgagctggaggattccgacgtggagaacctcacaggtgaaatagtctatcagcctgatgggtcagcctatattatcgaggattcaaaagagagcggccagaacgcgcagacagggtag

SEQ ID NO: 247228 - DNA, 10773 bp, Artificial Sequence
  Description of Artificial Sequence: Synthetic coding sequence
atggaaacctgtgactcaccccctatctcacgtcaagagaatgggcagtccacctccaagctgtgcggcaccacccagctcgataacgaagttcctgagaaggtcgccggaatggaaccagatagggaaaattcttccaccgatgataacttgaagaccgatgagcgtaaaagcgaggctctactgggattctccgtggagaatgccgcagccacacaggtgacctccgcaaaggagattccctgtaacgaatgcgcgacctctttcccttctctacagaaatacatggagcatcattgtccgaacgcacgcttaccagtgctgaaggatgataatgaatccgagattagcgaactggaggactctgacgttgaaaacctcacaggtgagattgtgtatcagcctgacggcagtgcctatatcatcgaagacagcaaagaatccggccagaacgcccagacaggagccaacagtaaattgttctccaccgcaatgttcctggacagcttggcctcagcaggggagaagtctgatcagtctgctagcgcccctatgtcattttacccacagattatcaacacatttcacattgcatcatccttggggaagccgtttaccgctgaccaggccttccccaatacctctgcccttgcgggtgttggcccagtactccacagtttccgggtgtatgacctccgccataagcgcgagaaggattatctgacgagtgacggttccgcaaaaaactcctgtgtttcgaaggacgtgccaaacaacgtggatctgtctaagttcgacggatgtgtttcggatggaaagcgcaagcctgtgctgatgtgtttcctgtgtaagctgtcatttggctatattaggtcattcgtaactcacgctgtgcacgatcaccgtatgacacttaacgacgaagaacagaagttgctctccaacaaatgtgtctcagccataatccagggaatcggcaaagacaaagaacccctgatttctttcctcgagccaaagaaatccaccagcgtgtaccctcatttttccacaacaaacctcatcggccctgaccctacctttcgcggattgtggagcgcgttccacgtcgagaatggagattctctacccgctggctttgccttcctgaagggctctgccagcaccagttcatctgccgagcagccactggggatcacccaaatgcccaaagctgaggtcaatctaggaggtctttctagtctcgtcgtcaacactccaattacctctgtgagtctatcacattccagttctgagagcagcaaaatgagcgaatccaaagaccaggagaataattgcgaaagacccaaagaatcaaatgtcctgcaccccaatggagagtgtcctgtcaagtccgagcctacagagccaggtgacgaagacgaggaggacgcatattctaacgagctcgatgatgaggaggtgctcggcgaactcaccgattccatcgggaataaagactttcctttactgaatcagtccatttcaccattgtccagctctgttctcaaatttattgaaaagggaacctcttcatcttcagccactgtgtcagacgacacagaaaagaagaagcaaacagcggcagtgagagctagtggttccgttgcaagcaactacggcatttcaggcaaggacttcgcggatgcaagcgcgtcaaaggactcagctacagccgctcaccctagcgagatagccaggggcgatgaggatagctcagcaacgccacatcagcatggttttacaccatcgacacctggaacccctggacctggcggtgacggaagccccggatccggtattgaatgtcccaaatgtgacacagtgttagggtctagccggtcgctgggaggtcacatgacaatgatgcactcgcgaaactcttgtaaaacactgaagtgtccaaaatgtaattggcattataaatatcagcagacgcttgaggcacacatgaaagagaagcaccccgagcccggaggcagctgtgtgtattgcaagacaggacagccacatccacgtcttgcccgaggagagtcatacacatgcggatacaagcctttcagatgcgaggtgtgtaactactcaacaaccaccaaggggaatctcagcattcatatgcagagtgataagcacctgaacaatgttcagaatttgcagaatggcaatggcgagcaggtgtttgggcatagcgcacccgcaccgaacacctccttatctgggtgcggtacccctagtcctagtaagcctaagcaaaaaccgacatggcggtgtgaggtatgcgattacgagacaaatgtcgccaggaatctgaggatccacatgaccagcgagaaacatatgcacaatatgatgcttttgcagcagaacatgaaacagatacagcataacctgcatttgggtttggctccggcagaagctgaactgtatcaatattacctagctcagaacataggattaaccggcatgaaattagaaaaccctgccgatccgcaattgatgattaacccttttcagctcgacccagcaaccgccgcagccctggctccagggctgggcgagttgagcccctacatttcggatccagcgctcaagttgttccagtgtgcagtctgcaacaaatttacgtctgacagcctagaagctctttcagtccacgtgagttctgagcggtctcttcctgaggaggaatggcgcgcagttatcggggacatctaccagtgcaagctctgtaactataatactcagctgaaagctaatttccagctccactgtaaaaccgataagcacatgcagaagtaccagcttgtagcacatattaaggaaggcggaaagagcaacgaatggcggctcaaatgcatcgctatcgggaatccagtgcacctgaagtgcaatgcatgcgattactatacgaactcggtggataaactgaggcttcacacgacaaatcaccgccatgaagctgctttgaagttgtataaacatctccaaaagcaggagggagccgtgaatccggagagttgctactactactgcgccgtgtgtgactacaccaccaaggtcaagcttaatctggtgcagcatgtccggagtgtgaagcatcaacagacagaaggcttgcggaaattacagctgcaccagcagggcctcgctcctgaagaagacaacctgtccgagatattctttgttaaggactgtccaccaaatgagctggagacggcctcccttggtgccagaacttgcgacgatgatctgaccgagcaacagctccgcagtacctccgaggagcagtctgaagaggctgaaggagcgataaagcctaccgctgttgccgaggacgacgagaaggatactagcgaacgcgataactccgagggtaaaaactcaaacaaagatagcgggataattactcctgagaaggagctgaaggtgagcgtggctgggggtacccaaccgttgttacttgcaaaagaggaggatgttgccactaaaagatcaaaacccaccgaggacaataagttctgccacgagcagttctatcagtgcccatattgcaattacaactcccgggaccaaagccgcatccagatgcacgtgctgtctcagcactctgtgcagcccgtgatatgctgccctttgtgtcaggacgttctcagcaataagatgcacctacagcttcacttgacccaccttcacagtgttagccccgactgtgtggagaaactactcatgaccgtgcctgtccctgacgttatgatgcccaattcgatgctgcttcccgcagccgcatctgagaaatccgaacgcgacactcctgccgctgttactgccgaagggtctggaaagtatagtggagagtcacctatggacgacaaatccatggcagggctggaggattctaaagccaacgtggaagtgaagaacgaggagcaaaagcctacgaaggagcccctagaggtttcggaatggaataagaactcttccaaagatgtaaagatccccgataccttgcaggatcagctgaatgaacagcagaaacgccagcctttaagtgtgtcagaccgacacgtgtataagtatcggtgtaatcattgttccttagccttcaaaaccatgcagaagcttcagattcattctcaataccatgcgatccgagccgcaactatgtgtaatctatgtcaacgttccttccggacttttcaggcgctaaagaaacatctggaagcgggacatcctgagctttctgaggctgagttgcagcaactttatgcctcccttccggtgaacggcgaactgtgggcagaatccgagaccatgtcccaggacgatcacggactcgaacaggaaatggagagggagtatgaagtagaccacgaggggaaggcttcacccgtgggatctgacagctctagtattcctgacgacatgggttctgagcctaaacgcacccttccatttcgcaaaggccctaactttaccatggaaaaattcttggacccttctagaccttataagtgtactgtgtgcaaggaatcatttacccagaagaacattttattagtgcactacaattctgtctctcatctccacaaattaaagaaagtcctccaggaagcctcctcccctgtgccccaggagacgaattctaacactgacaacaagccgtacaagtgttctatttgcaatgttgcctactcccagtcgtccactctggagatccacatgcgctctgtgctgcaccagactaaggctagggcggctaaactcgagccgtcgggacatgtagctggaggccactccatcgcggctaatgtgaattcacctggacaggggatgctggactcaatgtcccttgccgctgtgaactcgaaggacacccacctcgacgctaaggagctgaataagaagcagaccccagatctgatctcagcccagcccgctcaccatccccctcagagccccgctcagatccagatgcaattgcagcacgagctccagcagcaggccgcattctttcagccccagttcctcaatcccgcttttctgccacattttccaatgactcccgaggctcttctgcagttccagcagccacagtttctgttcccattctacatccctggcactgagttcagtctgggccctgacctcggactgccagggtccgcaacttttggtatgcccggaatgaccgggatggccggatctttgctcgaggatttaaagcagcagattcagactcagcatcacgtgggacagactcagctccaaatccttcagcagcaggcgcaacagtatcaggccacacagcctcagcttcaaccacagaaacagcagcagcagcctccaccaccacagcagcaacagcagcagcaggccagcaagctcctaaagcaggaacagtctaatatcgtttctgctgattgtcaaattatgaaagacgtgccctcttacaaggaggctgaggatatctccgagaagccagaaaaacctaaacaggagttcatctccgagggggaggggttgaaagaaggcaaggacaccaagaagcaaaagagcctggaaccatccatccctcctccacgcatcgccagcggcgctcgtggtaatgctgcgaaggccctgctcgagaattttggcttcgagttagtgatccagtacaatgagaatcggcaaaaggttcagaagaagggaaaaagtggtgagggagaaaacactgacaaactcgaatgtggcacctgtgggaagctattctcaaacgttctgatccttaagtcccaccaggaacatgtgcatgggcagtttttcccgtatgccgctctggaaaagttcgcaaggcagtatcgcgaggcttatgataagttgtatcccatttctcccagctcccctgaaactcccccacctccaccccctcctccccctttgccaccggcacccccacagccaagctccatgggtccggtgaagattccgaacaccgtctcaacaccactgcaggcaccaccgcctactcccccacccccaccccctcctcctccaccacccccaccaccccctcctccacctccacctagcgcccctccccaggttcagcttcccgtttcactagacttgccactgttcccaagcattatgatgcagcctgttcagcaccccgctctgcccccacagctggccttgcagctcccccagatggatgctttaagcgccgatctcactcagttatgccagcagcagctgggactggaccctaattttttgcgccactcacagttcaagcgtccgagaacccggattactgatgaccagctgaagatactgcgggcttatttcgatattaataattccccttctgaggagcagatccaagagatggctgagaagtccggcttgtcccagaaagtgattaagcattggtttcgcaacaccctctttaaagagcgccaaaggaacaaagattcaccttataacttttccaatcctccaatcaccgtcctggaagacatcaggattgacccacagcccacttctctggaacactacaagagcgatgcctccttctctaaacggtcgtcaaggacacgattcacagactaccaactgagggtcctgcaggacttttttgatactaatgcgtaccctaaagacgatgagatagagcagcttagcacagtgcttaaccttcccacccgcgtgattgttgtgtggttccagaacgctagacagaaggccaggaagtcatacgagaaccaggccgagacaaaggacaacgagaagcgcgagttgacaaatgaacgctacattcgtacctctaacatgcaatatcagtgcaaaaagtgtaacgtcgtgtttcctcgaatatttgacctgattacacatcagaagaaacagtgttataaggacgaagacgatgacgcacaagatgaatcccaaactgaagattcgatggacgcaaccgatcaggtagtttacaagcattgcactgttagtggccagaccgacgccgctaagaatgccgctgcccctgctgcctcatctggcagcggtacgtcaactcccttgataccctctcccaaacccgagcctgaaaaaacatctcccaagcccgagtacccagccgagaagcctaaacaaagcgacccaagcccaccgtcccaggggacgaagccagcactgcctctggcttccacaagcagcgaccctccgcaggcatccacagcgcagccacagcctcagccgcagccccctaagcagcctcagctcatcggcagaccaccgagtgccagtcagacccccgttccttcctctccactacaaatctccatgactagccttcagaattcattgccccctcagctgctgcagtaccagtgcgaccagtgtacggtcgcattccctactctggagctttggcaggaacaccagcacatgcacttcctggccgctcagaaccagtttctccacagccctttcctggaacggcctatggatatgccctacatgatcttcgacccaaacaatcctttgatgacgggtcaactgctggggtcttcattgacccagatgccaccacaggctagcagtagccacaccaccgctcccacaacagtcgcggcttccttaaaacggaagctggatgataaagaagataacaattgttccgaaaaagaggggggaaactccggcgaagaccagcatcgggataagcgtctgcgcacgactataacgcccgaacaactggagatcctgtacgagaagtatcttttggactcaaatcccacaagaaaaatgcttgatcacatcgcgagggaagttggactgaagaagagagttgtgcaggtgtggtttcagaataccagagcacgtgaacgcaagggccagtttcgagccgtcggaccggcacagtctcacaaacgatgtcctttttgtagagcgttattcaaggctaaatcagcgttggaaagccatatcaggtcacggcactggaacgagggcaaacaggccggatatagtctgccaccttcaccactgatcagcaccgaagacggtggcgaatcgcctcagaagtacatttactttgattacccatccctaccactgacgaaaatcgacctgagctccgagaacgagctcgcgtcgaccgttagtacaccggtgagcaagacagccgagctctctcctaagaatctgctttctccttcttctttcaaggctgagtgttctgaggatgtggaaaatctcaatgcaccacctgccgaagccggatacgatcagaacaaaacagacttcgacgagaccagcagtattaatactgcaatcagcgacgcaactacgggggacgaaggaaacaccgagatggaaagtacgacaggtagctcaggcgacgtgaagcccgcactgtctccaaaagaaccgaaaacactagatactctgccgaaaccagctaccactccaaccaccgaggtttgcgacgacaaatttctgttttcgctgacttcaccctctattcattttaatgataaggatggtgatcacgaccagagcttttatatcacagacgacccagacgacaatgccgatcgcagcgagacttctagcatcgccgacccttcttccccgaaccctttcggatccagcaatccatttaaaagcaagtcaaacgacagaccaggccacaagcgattccgcacacagatgagcaatttacagttgaaagtgctcaaagcatgcttctccgattataggacccccacgatgcaagagtgtgaaatgttgggaaacgaaatagggctgccaaaacgggtggtgcaggtctggttccagaatgcccgagcgaaggaaaagaagttcaagattaacatcggtaaacccttcatgatcaatcagggtggcactgaaggcaccaaaccagaatgtaccctgtgtggagtgaaatactctgccagactcagcatacgcgaccacatcttcagcaagcagcatatttctaaagtaagggaaaccgtcggttcccagcttgatcgcgagaaggattacctggcaccaaccactgtgcggcagcttatggcacagcaagagctggacaggattaagaaggccagtgatgtgctgggactgactgttcagcagcctggcatgatggacagctctagtttacatggcatctctctcccgactgcttatcctggacttcctgggctccctccagttcttctgcccggaatgaacggcccttcttccctgcctggctttccccagaatagtaacactttgacgccaccaggcgctggaatgctaggctttccaacaagtgccacatcatcacctgcgctctccctgtcctctgcgcctacgaaacctctgttgcagacccccccacccccacctcctccccctccgcctccgccttccagcagtttatccggccagcaaactgagcagcagaacaaggagtcggagaagaagcagactaaaccaaacaaagtgaagaagattaaggaggaggagttagaggcgacgaagcccgagaaacatccaaaaaaggaagagaagatttcttccgcactgagcgtgttgggcaaggtcgtgggggaaacgcacgtcgaccctatccaattacaggccttgcaaaacgccattgccggagaccctgccagctttataggcggacagtttctgccctacttcatacctggctttgcatcatatttcaccccccagctccctggcacagtccagggcggttacttccctccagtgtgtggaatggaatctttgtttccatatggccctactatgccgcagacgctagcaggcctgtccccgggagcactcctgcaacagtaccagcagtatcaacagaatctgcaggagtccctgcagaagcagcagaaacagcaacaggaacagcaacagaaacctgtccaggctaagacttctaaagtcgaaagcgatcagccccaaaattccaacgacgcctccgagactaaggaagacaagtctaccgcaacagagagcacgaaggaggagcctcagctcgagtccaaatctgctgacttcagcgacacatacgtcgttccgtttgtgaagtacgagtttatctgccgcaaatgccagatgatgttcaccgatgaggacgcggcagtgaaccaccagaagagcttctgttattttgggcagcccctaatcgatcctcaagaaacagtcctcagggtgccagtgagcaaataccagtgtttagcctgcgacgtagcgatctctggaaacgaagctttgtcccagcatcttcagagttccttacataaggaaaaaacaatcaaacaggccatgaggaatgcaaaggagcacgtgcgtctacttccccacagcgtttgctccccaaacccgaacactacgtcgacttcacagtctgctgcatccagcaataatacttacccacacctctcctgctttagtatgaagagttggcctaacattttattccaggcctcggccagaagggccgcttctcctccctcctctcccccatccctgtccttgccgtcaaccgtcacatctagcctctgctccacaagtggggtacagactagcctgcccaccgagtcatgtagtgacgaaagtgacagcgaattgtcacaaaagctggaagatctggacaattcactagaggtaaaggccaaaccagcatcgggacttgacggcaattttaatagcatcagaatggatatgtttagtgtgtag

SEQ ID NO: 247229 - DNA, 468 bp, Artificial Sequence
  Description of Artificial Sequence: Synthetic coding sequence
atggagacctgtgactccccacccatttcaagacaggagaatggccaaagcacatccaagctctgtggaacaacgcagctagacaacgaggttccagaaaaggtcgccggaatggagcccgatcgagaaaactcctccaccgatgacaatctgaagactgacgagaggaaatctgaagcactgcttggatttagtgtggaaaacgctgcggcaacccaggtgacaagtgctaaggagatcccttgtaatgaatgcgccacatccttcccctccttgcagaagtacatggagcatcattgccccaacgcaaggctgcccgtacttaaggacgacaacgagtccgaaatatcagaactagaagatagtgatgtagagaatctgacaggcgagatcgtgtaccagcccgacggaagcgcatacatcatagaagattcaaaagaaagtggacagaacgctcaaaccggatag

SEQ ID NO: 247230 - DNA, 10851 bp, Artificial Sequence
  Description of Artificial Sequence: Synthetic coding sequence
atggaaacctgtgattctcctcctattagcagacaagagaacggtcaatccacatcaaagctgtgcgggacaacacagctggataatgaagtgcccgaaaaagtagcaggaatggaacccgaccgtgagaactctagtactgacgataatctcaagacggacgagaggaagtccgaggctctgttagggttcagtgtagaaaatgctgcagccactcaggtcacgtctgccaaagagataccttgtaacgaatgtgccacctcctttccttccttacagaaatacatggagcaccactgcccaaacgcacgcttaccagtgttaaaagacgacaatgagtcggaaatctcagagctggaagacagcgacgtcgaaaacttgacgggcgaaatagtgtaccaaccagatggcagtgcatatattatagaagactccaaagagtctggccaaaatgcccaaacgggtgcgaattctaaactgttctctaccgccatgtttctcgactccctggcttccgcaggcgagaaatcggatcagagcgcatccgcccctatgtcattctatccccagatcatcaacacattccacattgcttccagcctaggaaagccgttcactgcagatcaagccttccctaatacatctgctctggcgggagtgggccctgtactccactcgtttcgggtgtatgacctgagacacaagcgagagaaggactatctgactagcgacggcagtgctaagaactcatgtgttagcaaagatgtccccaataatgtcgacctgagcaagtttgacggttgcgtctccgacggtaagaggaaaccggtcctcatgtgcttcctttgtaaacttagcttcggctacatccgctcctttgttactcacgccgtccatgaccaccgtatgacactcaacgacgaagagcagaaactgctcagtaataagtgcgttagcgcaataatacaaggcatcggtaaagacaaagagcccctcatttcgtttctcgagccaaaaaaatccacgagcgtttatccccacttcagcaccacaaacctgattggcccagatcccacctttcgaggcctgtggtccgcttttcacgttgaaaacggggatagtctgcccgcaggctttgcctttctgaagggtagcgcttcaaccagctcttcagctgaacaaccattgggaatcactcagatgcctaaggctgaggtcaatctgggtggactcagcagtctggtggtcaacacccccataaccagcgtttctctcagccactccagtagcgagtcctcaaagatgagtgagtcaaaggatcaagaaaacaattgtgaacgcccaaaggagagcaacgtgctacacccaaatggtgaatgtccggtgaagagcgaaccaaccgaaccaggtgatgaggacgaagaagacgcttattccaatgagctggatgatgaagaggtcctgggtgaactgactgacagcataggtaataaagatttcccccttctgaatcaatctatctccccactgtcatcctcggtgttgaaattcatcgagaaaggtacctcaagcagctcagctaccgtgagtgatgataccgagaagaagaaacagactgccgctgtgcgggcatctggaagcgtggcatctaactacggaatatctggaaaagatttcgctgacgctagcgctagcaaggattctgcaacagcggctcatccctccgagatcgccaggggggatgaagacagttccgccactcctcaccagcacggcttcactccaagtacgccaggcacgcctgggcctggtggcgatggatcaccgggtagtggtatcgagtgtccgaagtgtgacaccgtgctgggcagttctcggagtttaggcggacacatgaccatgatgcactctagaaatagctgcaagaccctgaagtgcccaaagtgtaactggcactacaagtatcaacagacattagaggcccacatgaaagaaaaacatccagaaccaggcggtagctgtgtgtattgcaagacaggacagccacaccccagactggccagaggtgagagttatacctgcggctacaagcctttccgctgcgaggtgtgtaactattcgacgaccactaagggaaacctgagcatccacatgcaaagcgacaagcaccttaacaacgtccagaacctccagaacgggaacggcgagcaggtgttcgggcactctgccccagcccctaacacctctctgagcggttgtggtacacccagcccttctaagccaaagcagaagcccacctggcgctgcgaggtatgtgactatgagactaatgtcgccaggaatcttaggatacatatgacatctgagaagcatatgcataatatgatgctgttgcaacagaatatgaaacagattcaacacaatctgcatctgggactagccccagcagaagccgaattgtatcagtattatcttgcacagaacatcggcctgaccgggatgaaactggagaatcctgccgacccacagctgatgattaacccatttcaactcgacccggctactgcagctgccctggcacccggtctagtcaataatgagcttccccctgagataagactcgccagcgggcagctgatgggagacgacttgtcattactgactgccggagagctgagcccctacataagcgatcctgctctaaaactcttccagtgtgcagtgtgcaacaaattcacgagtgatagcttggaagctctgagtgtgcacgtctcttcagagcgctctttacccgaagaagaatggcgcgctgttatcggagatatctaccagtgcaaactgtgtaactataatacgcaattaaaggcaaatttccagctacattgtaagacagacaaacacatgcagaaatatcaactggtcgctcacataaaggagggcggtaaatccaacgagtggaggctgaagtgcatcgccatcgggaaccccgtacacttaaaatgcaatgcgtgcgattactacaccaacagtgtagataagctgcgcctacacactacaaatcatcggcacgaggccgcattgaagctgtataaacacctccaaaagcaggagggcgctgtcaaccccgagagttgctattattactgcgccgtgtgtgactatactaccaaagtgaaactgaatctggtccaacacgttcgtagcgtgaaacaccagcagaccgagggattgagaaagctacagcttcaccagcagggcttggcacccgaggaggataacctgtctgagatcttctttgttaaggattgtcctccgaatgaattggaaacagcgtccctcggcgctcgaacttgtgacgacgacttgaccgagcagcagctgaggtctacctccgaagagcaatctgaggaagctgagggagccatcaaacctactgccgttgccgaggatgatgaaaaggatacgtcggagagagacaattccgagggaaaaaattcgaataaggattctggcattatcacaccggaaaaggaactgaaggtctccgttgcgggaggcacccaaccgctgctgctcgctaaagaggaagatgtcgccactaagcggtctaagccaactgaagataataaattctgtcacgagcaattctaccagtgcccatactgcaattataactccagagaccagtctaggattcagatgcacgtactgagccagcattctgttcagcccgtaatttgttgcccattgtgtcaggatgtgctgtctaataagatgcatctgcagcttcatctgacacatcttcatagcgtctctccagattgcgtcgaaaaactgctcatgaccgttccggtacccgatgtcatgatgcctaattcaatgttgctgcctgccgctgcgagtgaaaaaagcgagagggatacccccgctgccgtgactgccgaaggctctgggaagtatagcggagaaagtccaatggacgacaagtctatggctggcctcgaggacagcaaggcgaatgtggaggttaaaaatgaggagcagaaaccaacaaaggaaccattggaggtgtctgaatggaacaaaaattctagcaaggacgtgaagataccagacacactacaggatcagctcaacgagcagcagaaacgccagcccttgagtgtctccgacagacatgtttataagtaccgctgtaaccactgctcattggcctttaaaaccatgcaaaagttgcagatccactctcagtatcatgcaatccgggctgccacaatgtgtaatctgtgccagagatcctttaggacgtttcaagctctgaaaaagcatctggaagctgggcatccagaacttagcgaagccgagcttcaacagttatacgcatcactgcccgtgaacggcgagttgtgggctgagagtgaaaccatgagtcaggacgaccacggcttggaacaagagatggagcgagagtatgaggttgatcacgaaggcaaggcatcacctgtcgggagtgactcttcctctattccagatgacatgggcagtgaacctaaacgaactctgcctttcagaaagggccctaacttcacgatggaaaaattccttgacccttctcgtccttataaatgcacagtgtgcaaagaaagctttacccagaagaacatcctgcttgtacattataattccgtttcacatcttcacaagctgaaaaaggtgcttcaagaagcatcttctcccgtgccccaggagactaacagcaacacagataacaaaccctataagtgttcaatctgcaatgtagcttattcgcaatcttcaactctcgagattcacatgcgctcagtcctgcaccaaaccaaggccagagcagctaaattagaaccctccgggcatgtagccggtgggcattccatagccgctaatgtaaactcccctgggcaggggatgctcgacagcatgagcctcgcagccgtgaattcgaaagatacacatttagacgccaaagaactgaacaagaaacaaacacctgacctgatttccgcacagccagcgcaccaccctccccaatcgcccgctcagatccagatgcagctccagcacgagctgcagcagcaggccgctttctttcagcctcagttcctgaatccagccttcctcccccacttccccatgacaccagaggcattgttgcaattccaacagccacaatttctgtttcccttctacatccccggaacagaattcagccttggtcctgacctcgggctccccggatcagcaacatttggcatgccgggaatgacaggaatggctggcagtctgctggaggacctgaaacaacagattcagactcaacatcatgtgggacagacacagttgcaaattctccaacagcaagcacagcagtatcaggcaactcaaccgcagctgcagccccagaagcagcagcaacaaccccctccgcctcaacagcagcagcagcagcaggcgagcaagttactgaagcaagaacagagtaatatcgtgtccgccgattgccaaattatgaaagacgtgccatcgtataaggaggccgaggacatctccgagaaaccggagaagcctaagcaggagtttatatctgaaggagaaggactcaaagagggcaaagacaccaagaagcagaagagtctcgaaccatccattccccctccaagaatagcttccggtgctcgcggaaacgctgccaaggctttactggaaaacttcggtttcgagctggttatacagtataacgagaatcgccaaaaggtgcagaaaaaaggcaaatccggcgagggcgaaaataccgacaagctggaatgcggtacgtgcggcaagctattttctaacgttcttattctcaagtcccaccaagagcacgtccatggtcaattctttccatatgctgctttagagaaattcgccaggcaatatcgggaagcttacgataaactgtaccctattagcccatcttcacctgagaccccacccccaccccctccaccccctccactaccacctgcccctccgcagcccagctctatggggccagtaaagattccgaacactgtgagcacaccgctgcaggcccctccccctacgcccccacctcctcccccaccaccccctccaccgcctccaccaccgccaccacccccaccatctgcgccacctcaggtgcaactgcccgtgtccctcgatttgccactgtttccatcaataatgatgcagccagttcaacacccggctcttccaccccagctggctcttcagttgccccagatggatgctctgtccgctgacctgacccaactgtgtcagcagcagctcggtctggatcccaactttctgcggcattcacagtttaaaagacctcggaccagaattacggatgaccagctgaaaatcctccgggcatactttgatattaataattcacctagtgaagagcagattcaagagatggcggaaaagtccggcctgagccagaaagtcattaagcattggtttcgtaataccttgtttaaggagcgccagagaaacaaggattctccctataatttcagcaatccccctattacagtcctcgaagatattcgtatagatccccagcctacatcacttgagcactacaagtcagacgcatccttctctaaacgcagctcgcggacgcgtttcaccgattaccagttaagagtcttgcaggatttttttgacacaaatgcctaccccaaagatgatgaaattgagcagttatccactgtgctcaacctgccgacccgggtgatcgtggtttggtttcagaacgctcggcaaaaagctcgtaagagctacgagaaccaggcagagactaaggacaacgagaaaagggagctgaccaatgagagatacattcgtaccagcaatatgcagtatcaatgtaagaagtgcaacgttgtcttcccaaggatctttgatctaatcacacaccaaaagaagcagtgttataaggacgaggatgacgatgcccaggacgaatctcagaccgaggactccatggacgccacagaccaggtggtttataaacattgtaccgtgtccggccagacagacgctgctaagaacgcagctgctccagccgcatcgagcgggtctggcacttccactcccttgatcccgtccccaaagcccgagcctgaaaaaacttctccgaagcccgaatatccggcagagaagccgaagcagtctgaccccagtccaccttctcagggaactaagccggctttgccgctggccagcacttcaagcgatccaccgcaggcaagtactgcccagcctcaaccacagccacagccccctaagcaacctcagctaattgggagacccccatcggccagtcaaactcctgttccgagctctccactccaaatctccatgacctccttgcaaaattccctcccaccacagctcttacagtatcaatgcgatcagtgcacggtagctttcccaacgctcgagctttggcaggagcaccaacacatgcactttctggccgctcaaaaccagtttctccatagtccttttttggagagaccgatggacatgccgtatatgatttttgaccccaacaatccacttatgactggccagctgctgggaagtagtctcacccagatgcccccacaggcttcatctagccatacaacggccccaactaccgtggcggcttcgctgaaacggaaacttgacgacaaagaagacaacaactgttccgaaaaggaggggggaaacagcggcgaagatcagcacagggataagaggcttaggactactattactccagagcagctggagattctgtacgaaaagtacctgctggacagcaaccctaccagaaagatgctcgaccacatagcacgggaggtcggtctgaaaaaaagggtggtgcaggtttggtttcagaacacacgcgcaagagaacggaagggacaatttagagcggtcggaccagcccagtctcataaacggtgcccgttttgtcgcgcactgtttaaagctaagtccgcccttgaaagccatatcagaagccgacattggaatgaaggtaaacaggccggatattctctcccaccatcccccctgattagtacggaggatggaggtgaatctccccagaaatacatttacttcgattatcccagccttccacttacaaagatcgatctgagtagtgagaacgaacttgcgtctacggtgagtacacccgtttccaaaaccgctgagctctccccaaagaatctcctcagccctagttctttcaaggccgaatgttctgaggacgtcgagaacctgaacgctccccctgctgaggctggatatgaccaaaataagaccgatttcgacgaaactagctctatcaacaccgctattagcgacgccacaaccggtgatgaaggcaataccgaaatggagagcacaactggaagtagtggggacgtgaaaccagcgctcagccccaaggagccaaaaactttagacacactccccaagccagcaacgactccaacaaccgaggtttgtgatgataaatttctgtttagtctcacaagtccgagtattcattttaatgataaggacggtgaccacgaccaatctttctacatcactgatgacccagatgataacgccgaccggagcgaaacctctagtatcgccgatccaagctccccaaatccctttgggtctagtaaccctttcaagagtaagagtaacgatcggccaggacataaacgctttaggacacagatgtcaaatcttcagttaaaggtgcttaaggcctgcttttccgactatagaactcctaccatgcaagagtgtgaaatgttgggaaatgaaatcgggcttcccaaacgagtggttcaggtttggttccagaacgcgagagccaaggaaaagaaatttaaaattaacattgggaagccatttatgattaaccagggcggtactgagggcacaaaacccgagtgcactctgtgtggcgtcaaatacagcgccagattgagtatcagagatcacatattctctaaacagcacatcagcaaggttcgagagacagtgggaagtcagttggaccgagagaaggactatctggccccaactaccgttaggcagcttatggcgcaacaggaactcgacagaattaagaaggcgtctgacgtactcggtctcacagtgcagcagccaggaatgatggatagctcctccttgcatggtatttctctgcctactgcctatcctggtctacccggactcccacccgtgctccttcccggaatgaatggtccatcatcacttccagggttcccacagaacagtaacacgctgactccaccaggagcagggatgctgggtttcccgacttccgcaacgagttctccagcccttagcctctcatccgctccgaccaagccacttttgcagaccccacccccaccaccacccccacctcctccacctccctcttctagcctgtcagggcagcaaacagaacaacagaacaaggagagcgagaagaagcaaacaaaacccaacaaggtgaaaaaaatcaaagaagaggaactcgaagcgaccaagccagaaaagcatcccaaaaaagaggagaagatctcaagcgctctgtccgtgttaggcaaggttgtgggggagacccatgtagatccgattcaactgcaagcactgcagaatgctatcgccggtgaccccgcatcttttatagggggacagtttctgccctacttcatccctggctttgccagctactttaccccacagctcccaggcaccgtccagggagggtattttcctccagtatgtggtatggaatcgcttttcccatacggaccaaccatgccccagacactggcaggccttagtcccggagcgctgcttcaacaataccagcagtaccagcaaaacctacaggaaagcctacagaagcagcaaaagcagcaacaggaacagcagcaaaaacccgtgcaggccaagacctccaaggtggagtcagaccagccacagaactctaatgatgcctcggagaccaaagaggataagtccactgccacagagtccactaaagaggaaccgcagctggaaagcaaatctgccgatttctcagatacttacgtggtcccatttgtcaaatatgagtttatttgtaggaaatgtcaaatgatgtttacagatgaagacgccgcagtcaaccaccagaagagtttctgttatttcggccagccccttatagatccgcaagaaacggttctgagggtgccagtctctaaataccagtgcctggcttgtgatgtggccatctcaggcaacgaagcgctgtcccagcatctgcagagctccctgcataaagagaagactattaaacaggcaatgcggaatgcaaaggagcacgtaagattgctaccccacagcgtttgcagtcccaatcccaacaccacaagtacgtctcaatccgccgcaagttccaataatacttacccccatctaagctgtttcagcatgaagtcatggccaaatatcctgtttcaggcatctgccaggagagccgcaagtcctccaagttcccctccaagtctgtcattgcccagtacggtcacatccagtctttgctctacatccggggtgcagacatccctgcctaccgaaagctgcagcgatgagagtgactccgaattgtctcagaaactggaggacttggataactcactcgaggtgaaggccaaacccgcaagcggcctcgatgggaatttcaattcaatccggatggacatgttcagcgtgtac

SEQ ID NO: 247231 - DNA, 423 bp, Artificial Sequence
  Description of Artificial Sequence: Synthetic coding sequence
atggagacatgtgattctccacctatctctaggcaagagaatgggcaaagcacatcaaagctctgtgggacaactcaactggacaacgaagtgcccgagaaggtggctggaatggagcctgaccgggagaactcttctaccgacgataatctcaagaccgacgagaggaaaagtgaggcccttctgggctttagtgtggaaaatgccgcagccacccaagtgacttccgcaaaggaaatcccttgtaacgaatgtgccacgtccttccccagcttgcagaagtacatggaacaccattgcccgaacgcccgattgcctgtccttaaagacgacaacgaatctgagatcagtgagctcgaagacagcgacgtggagaacctaacaggagagatcgtgtaccaacctgatgggagcgcctactag

SEQ ID NO: 247232 - DNA, 306 bp, Artificial Sequence
  Description of Artificial Sequence: Synthetic coding sequence
atggaaacctgcgatagtcccccaatttctcgacaggaaaacggacagtcaacctctaaactgtgcggcacgacgcagttggacaacgaagtacccgagaaggtcgcaggcatggaaccagaccgcgagaacagctccacggacgataaccttaaaaccgatgagcggaagtctgaggctcttcttggcttttccgtcgagaatgctgcagccactcaggtcactagcgccaaggagattccatgcaacgagtgtgctacttccttcccctctttgcagaaatacatggagcatcattgcccatag

SEQ ID NO: 247233 - DNA, 2253 bp, Artificial Sequence
  Description of Artificial Sequence: Synthetic coding sequence
atggagtttgtctcgggttacagagatgaatttcttgactttacagccttgctctttggctggttcaggaaattcgtggctgagcgcggagcggtgggcacaagcctggagggacgctgcagacagttagaggcacagatccgaaggctgcctcaggatcctgcgctgtgggtactccacgttcttcccaatcacagcgtaggtatctccctaggacaaggtgcggaacctggacccggtcccggactcggcacagcttggctcctgggtgacaatccgcctttgcacctgcgggacctttcaccttacatcagttttgtgtctctcgaggatggggaagagggggaggaagaggaagaagaggacgaggaggaggagaagcgagaggacggcggagcgggatccaccgagaaggtcgaaccagaggaggaccgagagttagctcccacatctcgggagtctccccaagagaccaatcccccaggggaatctgaggaggccgctagagaggccggtgggggaaaggacggctgtcgtgaggatcgtgtggagaatgaaacgagaccacagaagcggaagggccagagaagcgaggcggcaccgctgcatgtgtcttgtctgctccttgttacagacgagcacggtacaattctcggcatcgacctgctggtagacggtgctcagggaacagcctcttggggatctgggaccaaggacctcgcgccttgggcctatgccctgttgtgtcactctatggcctgccctatgggctcgggcgacccacgaaaacctcggcagctgacagtgggagacgcacggctccaccgggagctggagagcctcgtgccaaggcttggtgtgaaactcgccaaaactccaatgcggacctggggccctagaccaggcttcacttttgcaagtctcagagcacgtacctgtcacgtctgccatcggcattcatttgaggcgaaactgaccccctgtccgcagtgttcggcggtgttgtattgcggagaggcctgtttgagggctgactggcagaggtgtcctgatgatgtttcacacagattttggtgccccagactggccgcattcatggagcgggcaggcgagttggcgaccctgcctttcacctataccgcggaagttactagcgaaacgttcaacaaggaagcttttctcgcgagtcgcggtctcacaaggggttattggactcagctgagcatgctcattccgggacccggatttagccgacaccctagaggtaatactcccagtctctccctgcttagaggcggagatccataccaacttcttcagggcgacggaacggccctgatgcccccagtgcctccccatccaccacggggagtctttggaagctggcaggactactatacatggaggggcctctcactcgatagcccgattgccgtccttctgacctaccctctcaccgtatattatgtcatcacacatttagttccacagtctttccctgaactgaacattcagaacaaacagtccctgaaaatacacgttgttgaagctggaaaagaattcgacctggtgatggtattttgggaactcctggtgctgctgccccatgtggccctggaactgcaatttgtcggcgacggtctgccacctgagagtgacgagcaacacttcaccttgcagcgagactcgctggaggtttcagtccgccctggatcagggatctccgcaagaccatcgagcgggacaaaggagaaaggcggtcggagagaccttcagatcaaagttagcgccagaccctaccacttgtttcaagggccaaagcccgatctcgtgatcgcgtccccttcatctctatcagctggcttcaacagtgggttcgcattgaaagatacttggctccggagcctgcctagactgcagagcctgcgcgtaccggcttttttcaccgagtcctctgagtacagctgtgtgatggacggacaaacaatggccgtggcgaccgggggtggtacctctccgcctcagccaaacccatttagatcccctttcagactaagggcagcggacaactgcatgagctggtattgtaatgccttcatcttccacctggtgtacaaacctgcccagggcagcggggcacgtcccgctcccggaccccctccaccctcacccaccccaagcgcccctcccgctcctacccggaggcggagaggagaaaagaagcctgggaggggcgcacgcagacggaaatag

SEQ ID NO: 247234 - DNA, 2112 bp, Artificial Sequence
  Description of Artificial Sequence: Synthetic coding sequence
atggagttcgtgtctggctatcgggatgaattcctggactttacagccctgctctttgggtggttcaggaagttcgttgccgaacgaggcgctgtcggaacctcccttgagggaaggtgtcggcagctggaggcgcagatcagacggcttccgcaggatccagcgttgtgggtccttcatgtgctcccgaatcacagcgtcggcattagtctgggtcaaggggcagaaccaggcccaggcccaggactcggcactgcttggttgctgggcgacaatccacctctgcatctcagggatttaagcccgtacatttccttcgtcagtctggaggatggcgaggagggagaggaggaggaggaggaggatgaggaagaggaaaaaagagaagacgggggtgccggatctacagaaaaggttgagccagaggaagaccgcgaactggcaccgacctcgagagaatctccacaagagactaatcccccaggagagtccgaggaggccgctcgtgaagccggaggcggaaaagatggctgtagagaggatagggtggagaacgagacgcgccctcaaaagcggaaaggccagcggagcgaagctgcccctctccacgttagctgtctcctcctggtgaccgatgagcatggaacaatactgggcatcgacctcttagtggatggtgcacagggcacggcatcttggggctccggcaccaaagaccttgcgccttgggcctacgctctcctctgccacagtatggcatgccctatgggctcaggggaccccaggaagcctcggcagctgacagttggggacgcgagactccatagagaactggaatcgctggtcccccgattaggagtgaagctggcaaaaacccctatgcggacttggggccctaggccagggttcacattcgcatctcttcgggctcgaacttgccatgtatgtcacaggcattcctttgaagcaaagctgacaccatgccctcagtgcagcgcagttctgtattgcggggaggcctgtcttcgcgcagattggcagagatgccccgacgacgtatctcaccgcttttggtgcccacgcctcgcggcttttatggagcgagcgggagagctcgccactcttcccttcacctacaccgccgaggtaaccagcgagacttttaataaagaagcattcctggcgagccgaggtttgacacgaggctactggacacagctctccatgttgattccaggccctggcttctcccgacacccccgtggtaacactcccagtctgtcactcctccgaggcggagatccttatcaactgctgcagggtgacggcaccgctctcatgcctcccgtccccccacaccctcccagaggcgtttttgtgcccgaattgaacatccagaacaagcagtccttgaagatccacgtagtcgaggctgggaaggaattcgatctcgtgatggtgttctgggagctgttggttttgcttccacacgttgctctcgagctccagttcgtcggggatggactgccccctgaaagtgacgagcagcactttaccctgcagcgggattccctggaggtgtccgtccgccctggaagcggtatctctgccaggcccagtagcggtaccaaagagaaaggcggaagacgggatctccagattaaggttagcgctaggccttaccacctgtttcagggacccaagccggatctcgtgattggctttaactctggcttcgccctcaaggacacatggctgcgttcgctgcctcgcttgcagagtttgcgcgtccctgcgttcttcaccgagtcctcggaatattcgtgtgtgatggatggtcaaaccatggccgttgcaacaggaggtggaacctcacctcctcagcctaacccctttaggtcacccttcagactccgcgcagcggacaattgtatgtcatggtattgtaatgccttcatcttccacctcgtatacaagccggctcaggggtccggagccagacctgctccagggcctccgcctccttcacccactccctcagccccacctgcccctacacggagacggaggggtgagaaaaagcctggtcggggagctcgcaggcggaaatag

SEQ ID NO: 247235 - DNA, 1722 bp, Artificial Sequence
  Description of Artificial Sequence: Synthetic coding sequence
atggacgccaagagccttaccgcttggtctagaacactggtcacatttaaagatgtgtttgttgacttcacccgcgaggaatggaaactacttgatactgcacagcagatcgtttacagaaacgtgatgttggaaaactacaagaaccttgtcagtcttggctaccagctgaccaagcccgacgtgatcctgaggcttgaaaagggagaagaaccatggttggtagagcgggagatacaccaggagacgcaccccgactcagaaacagcatttgaaatcaaatcctccgtgagttccagaagtattttcaaggataagcagtcttgcgacatcaagatggagggcatggccagaaatgacctgtggtatttaagcctggaggaagtatggaaatgccgagatcagctggacaaataccaggaaaacccagagcggcacctgcggcaggtcgcatttactcaaaaaaaggtcctcactcaagagcgggtcagcgaaagcgggaaatacggcggaaattgtctgctaccagcccaactagtcctgcgggaatactttcataagcgggatagccacaccaagagcctgaagcacgaccttgtcttaaacgggcaccaggactcatgcgcatcaaactccaacgaatgtggtcaaacattctgccaaaatattcatttgattcagtttgccagaacacacaccggagataaatcttacaagtgcccggacaatgataacagcctgacccacggaagcagtctggggataagcaaggggattcatcgggaaaagccctatgagtgcaaggagtgcggcaaattcttttcgtggcggagcaacttgacacgccaccagctcattcataccggtgaaaagccatatgagtgtaaagagtgtggcaaatcctttagccgctcatctcatcttataggacatcagaaaacccacactggagaggagccatatgaatgtaaagaatgcggcaaatccttctcctggttctctcacttggtgacccatcagagaactcacaccggagacaagttgtacacgtgcaaccagtgtggcaagagtttcgtgcactcctctagactgatcaggcaccagcgcacccatacaggcgaaaaaccttatgaatgtccagagtgcggcaagtcattccgacagagcacccacctgatcttgcatcagagaactcatgtgcgggtgcgaccctatgagtgcaatgaatgcgggaaaagctactctcagcgcagtcacctggtcgtgcatcaccggatacacacgggcctgaaaccattcgagtgcaaggattgtggaaagtgtttttcacggtccagccacctttattcccaccagcggacccacacaggagaaaaaccctacgagtgtcatgactgcggaaagagttttagccaatccagcgccctgatcgttcaccaacggattcatacaggggaaaagccctacgaatgttgccagtgcgggaaagcttttattcggaaaaacgatttgattaagcaccagcgcattcatgttggtgaggagacatataaatgcaatcaatgcggaatcattttctctcagaattcgccctttattgttcatcagattgcccacacgggcgaacaattcctgacttgtaaccagtgtggcacggccctggtgaatacaagtaatcttattgggtaccagactaatcacataagggaaaacgcctactag

SEQ ID NO: 247236 - DNA, 1722 bp, Artificial Sequence
  Description of Artificial Sequence: Synthetic coding sequence
atggacgctaaatccctaacagcttggagccgcacccttgtgacctttaaagatgtgtttgtcgattttacaagagaagagtggaaactccttgacactgctcaacagattgtgtaccgaaacgttatgttagaaaattataaaaacttggtgtcacttggctatcagctaaccaaacccgatgtaattttgcgccttgagaagggggaagaaccttggctggtagaacgcgaaatccatcaagaaacccatccagatagcgaaacagctttcgagattaagtcttcggtctcatctcgatcgatctttaaagataagcagtcctgtgacattaagatggagggaatggccagaaatgacctttggtatttatctctggaggaggtgtggaagtgtcgggaccaactggacaagtaccaggaaaatccagagcgacacttgagacaggttgctttcactcagaaaaaggtgcttacgcaggaaagggtatccgaatccggaaaatacggcggaaactgtctcttgcccgcacagctggtcctccgggaatattttcacaaaagggatagccacactaagtcactgaagcatgacttggttctcaacgggcatcaggactcctgtgcatctaactctaatgaatgcggccagacgttctgccagaacatccacctgattcaatttgctcgcactcacacaggagataaatcctataagtgtcccgataatgataactctctgacccatggatcatcgcttgggatctctaaaggcatacacagggaaaagccttacgagtgtaaagagtgcggtaaattcttcagctggcgtagtaacttgacacgccatcagttgatccacaccggcgaaaaaccctacgaatgcaaagagtgcggcaagagttttagtcggtctagccacctcattggtcatcagaaaacccacacaggagaggaaccatacgagtgcaaggaatgcggcaagagcttcagctggttttcgcacctagtgacccatcaaaggacgcatacgggggacaagctgtatacttgcaatcagtgtggaaaatctttcgttcacagctccagactcattagacaccagcggactcacaccggcgagaagccttacgaatgtcccgagtgtggcaaaagttttaggcagtcaactcacctcatcttacaccagagaacgcacgtgcgcgttaggccctacgaatgtaacgagtgcggcaaatcctattctcagcgatcacacttggtagtccatcaccgaattcatactggtctgaagccatttgagtgtaaagactgcggtaaatgtttctctagaagctcacacttgtattcccaccagaggacacataccggcgaaaagccttacgaatgtcacgactgcggtaagagcttttctcagtccagtgccttaattgtgcaccagcggatccacacgggcgaaaagccttacgagtgctgccaatgtggtaaggcattcattcgcaaaaatgaccttattaaacaccagcgcatccacgtgggggaagagacatataaatgcaatcaatgcgggattatcttcagccaaaatagccccttcatagtgcatcaaatcgcccacactggtgagcagtttctcacttgcaaccagtgcggcaccgccctggttaacacttccaacttgatcgggtatcagaccaaccacattagggaaaatgcatattag

SEQ ID NO: 247237 - DNA, 219 bp, Artificial Sequence
  Description of Artificial Sequence: Synthetic coding sequence
atggatgcaaaaagcttaactgcctggagcagaacgttggtcacattcaaggatgtgtttgtggacttcacaagggaagagtggaaactccttgacaccgcccagcagattgtctatcggaacgtgatgctggaaaattataagaatctggtctccctggggtatcagttgaccaagccagacgtaatccttcgactcgaaaaaggagaagagccgtag

SEQ ID NO: 247238 - DNA, 132 bp, Artificial Sequence
  Description of Artificial Sequence: Synthetic coding sequence
atggacgccaagagcctgaccgcttggagccgtaccctagtcacctttaaggacgtgtttgtggattttaccagggaagaatggaagctcctcgatacagcgcagcagattgtgtaccggaacgttatgtag

SEQ ID NO: 247239 - DNA, 144 bp, Artificial Sequence
  Description of Artificial Sequence: Synthetic coding sequence
atggacgccaaaagtctaacagcctggtcccgaacccttgtaacattcaaggacgtgttcgtcgacttcacccgggaggagtggaaactcctcgacactgcacagcagatcgtttatagaaatgtgatgctagagaactactag

SEQ ID NO: 247240 - DNA, 1629 bp, Artificial Sequence
  Description of Artificial Sequence: Synthetic coding sequence
atggatgatccgcgatacgggatgtgccctttgaagggcgcaagcggctgcccgggtgctgaacgcagcctcttagttcagtcatatttcgagaagggaccactcacattccgggatgtagccatagagtttagtctcgaagagtggcaatgcctggactcagcccagcagggactgtaccgaaaggttatgttggaaaactacaggaaccttgtgtttctggcgggaatagcactgaccaagccagatctgatcacctgtctggaacagggcaaggagccctggaacatcaaacggcatgaaatggttgctaaaccacctgtgatctgctcccactttccccaggacctgtgggctgaacaggacattaaggacagcttccaggaggccattcttaagaagtacggaaaatatggccacgataacctgcagctgcagaagggatgtaagtcagttgacgagtgtaaagttcacaaggagcacgataataagctaaatcagtgtctgatcaccacacagagcaacatttttcagtgcgacccctctgccaaggtgtttcatacattttccaattccaacagacataaaatccggcatactcggaaaaagccattcaaatgcaagaagtgcgaaaagtcattctgtatgctcctgcatctgacccagcacaagaggttccacatcaccgagaattcctaccagtgtaaagattgtggtaaggcttttaactggtttagcacccttacaacacataggcgcatccacaccggcgaaaagccctacaagtgtgaagaatgtggcaaggcttttaatcgatcttctcacctcactacccacaagatcattcacaccggggaaaagccctacagatgtgaagagtgtgggaaagcctttaacagaagcagtcacttgactacacataagagaatccacacgggggtgaaaccatataagtgcacagaatgtggcaaggccttcaatagatctagccatctgacaacacataggattattcacactggggaaaaaccctataagtgtgaagagtgtggaaaagcattcaaccagtcttccaccctgacaacacataaaattacgcatgctggcgaaaaaccttacaagtgtgaagagtgcgggaaggctttctaccgattctcctacctaactaagcacaaaacaagtcacacaggcgaaaagttctacaagtgtgaggagtgcggcaaaggctttaactggtctagcgcccttacaaagcataagagaatccatacgggggaaaagccgtataagtgtgaagaatgcggaaaggcctttaatgagtcttccaatctcacgacccacaagatgatccatacaggcgaaaagccatataagtgcgatgagtgtggcaaggcctttaaccggagcagccaacttaccgcccataaaatgatccatacaggcgaaaaaccgtacaagtgtgaggaatgcggaaaggcttttaaccgctcttcaaccctgacaaagcacaaaataacacacacaggggagaagagctacaagtgggaagagtgcggcaaagacttcaaccagtcattgagcctgattaagcagaataactcgtactggcgcgagaccctgcagatgtag

SEQ ID NO: 247241 - DNA, 1311 bp, Artificial Sequence
  Description of Artificial Sequence: Synthetic coding sequence
atggactccgtggcctttgaggacgtggcagtgaactttacacaggaggaatgggccttgcttagtccatcacaaaaaaacctctatagagatgtgactctcgaaacctttcgaaacctggcgtctgtgggcatccaatggaaggatcaagacatcgagaatttatatcagaatctggggatcaaactccgctccctggtcgagaggttgtgtggtaggaaagaggggaatgaacatcgtgagacattttctcagattcccgactgccacttgaataaaaagagccagacgggcgtaaaaccatgtaaatgtagtgtgtgtggcaaggtttttctgcggcacagctttctcgaccgtcacatgcgcgcacacgccggacataagcgatccgaatgcgggggagagtggcgggagacgccacggaagcagaagcagcacggcaaggcctcaatctctcctagctccggggcacgccgaaccgttacaccaactcggaagcggccttatgaatgcaaagtctgcggaaaggcattcaattctcctaacctcttccagatccaccagagaacccacactggaaaaaggagctacaagtgtcgcgagatcgtgagggcattcaccgtatcgagctttttccgaaaacacggtaagatgcacacaggggagaagagatacgagtgcaagtactgtggtaagcctattgattatcccagtctctttcagatccacgttcgtacccatactggcgagaagccttacaaatgcaagcagtgtggcaaggcttttatcagtgcagggtatttgcgcacccacgaaattcggtctcatgcattggaaaagagccatcagtgccaagagtgtggaaagaaattgtcctgttcttccagccttcatcggcatgaacggacccactctgggggaaaattatatgaatgccagaagtgtgcgaaggtatttcggtgtcctacttccctccaggctcatgagcgcgcacatactggagagcggccatacgaatgcaacaagtgcgggaaaacattcaattacccatcatgtttcagaaggcataagaagacccacagtggcgagaagccatacgagtgcacacgctgcggtaaggcctttggttggtgcagtagcctgagaaggcacgaaatgactcacacgggcgagaagcccttcgactgtaaacaatgtggtaaagtctttactttctctaattacctgcgcctgcacgagcgtacccacttagcgggacggtcccagtgctttggacgccgtcagggggaccatttgtcccctggcgtctag

SEQ ID NO: 247242 - DNA, 1311 bp, Artificial Sequence
  Description of Artificial Sequence: Synthetic coding sequence
atggactcggtggcttttgaagacgtggccgtcaacttcacacaagaggaatgggccctgctttcaccttctcagaagaatctatacagagacgtcacccttgagacatttcggaatttagccagtgttggtattcaatggaaggaccaggatatcgagaacctgtaccagaatttgggaataaaattgaggagcctggtggaacggctctgcggcagaaaggagggtaatgaacatagggaaacattttctcaaattcctgattgtcatctgaacaagaagtcgcaaacgggcgtgaagccctgtaagtgttctgtttgtggaaaggtgttcttacgtcattccttcctggaccgccatatgagagctcacgcaggtcacaaaaggtctgagtgtgggggagagtggagagaaacgcctagaaagcagaagcagcatggtaaagcttccatctccccatcctcaggagcgagacgcaccgtcactcccaccagaaagaggccgtatgagtgcaaggtttgtgggaaggcgttcaatagccccaatctgttccagatacatcagagaactcataccggaaagcgcagttacaagtgtcgcgaaattgtccgcgcattcactgtatcctccttcttcagaaagcacgggaagatgcacacgggtgaaaagcgctacgagtgtaaatactgtggaaaaccgatcgactacccaagcttattccaaattcatgtacgtacacacaccggagaaaagccttataaatgcaaacagtgcggcaaggcgtttatcagtgcagggtacttgagaactcacgaaatcagaagccatgccctcgagaaatcacaccagtgtcaggagtgtgggaaaaagctgtcctgttcttcatccctgcacagacatgagcgcacccactcgggaggtaagctgtacgaatgccagaaatgcgctaaagtgttccgctgtcccactagtcttcaggcccatgagcgcgctcacacaggtgaacgcccttatgagtgtaataaatgcggcaaaacattcaattaccccagctgctttaggcgccacaagaaaacacattcaggcgaaaagccttacgagtgtacaaggtgcggaaaggccttcgggtggtgttcctcactcaggaggcatgagatgacccacactggtgaaaaacctttcgattgtaagcaatgtggcaaggtatttactttctctaattacctccggttgcacgaaaggacccatcttgccggtcgatcccagtgttttggaaggcgccagggcgaccacctgtcacctggcgtatag

SEQ ID NO: 247243 - DNA, 951 bp, Artificial Sequence
  Description of Artificial Sequence: Synthetic coding sequence
atgcgagcccatgcaggccacaagagaagcgagtgtggaggtgagtggcgcgaaacgccaaggaaacagaagcagcatggcaaggccagcatttcaccttcgagcggtgcccgacggactgttacccctactcggaaacgcccatacgagtgcaaggtgtgcggtaaagccttcaactcacctaacttatttcagattcatcaacggacacataccggcaaacgcagctacaaatgcagagaaattgtgagggccttcacagttagctctttctttagaaaacacgggaaaatgcacaccggagaaaaacggtatgagtgcaaatattgtggtaaacctattgactacccctccctgtttcagatccatgtgcgtacccacactggagaaaagccctataaatgcaaacagtgcggcaaagcgtttatatcagccggttacctccggacacacgagattcgcagccacgccctggagaagtcccatcaatgccaagagtgcggcaaaaagctttcttgctcatcctcactgcatcgtcacgaaagaactcactctgggggaaaactgtatgagtgtcagaagtgtgcaaaggttttcaggtgtccaaccagtcttcaggcccacgaaagagcccacaccggcgagcggccttatgagtgtaacaaatgcggtaagacattcaactacccaagctgtttccgcagacataagaaaacgcattccggcgagaaaccatacgagtgtactcgttgcgggaaagcctttggatggtgtagctccctccggaggcacgaaatgacccacacaggcgaaaagccatttgactgcaaacaatgcgggaaggtgtttaccttttctaattacctgaggctacacgaacggacccaccttgctggcaggagccagtgctttggccgaaggcagggagatcatctgtcaccaggtgtttag

SEQ ID NO: 247244 - DNA, 1311 bp, Artificial Sequence
  Description of Artificial Sequence: Synthetic coding sequence
atggacagcgtggcatttgaagacgtggccgtgaattttactcaggaggagtgggctttgttgagcccaagtcagaagaacttgtaccgcgacgtgactttggagacattcaggaatttagcaagtgtcggaattcagtggaaggaccaggatatcgaaaatctctaccagaacctaggcatcaaactacgatctctcgtggagagattatgtggacgtaaagaagggaacgagcacagagagaccttctcgcaaatcccggactgccatctgaacaaaaaatcccaaaccggggtgaagccttgtaaatgcagcgtgtgcggaaaagtgtttttgcgtcattcttttctagacagacacatgcgtgcacacgccggtcataaaaggtcagagtgtggtggcgaatggcgggagactccgcgaaagcaaaagcaacatgggaaggcgtcaatcagcccatccagcggagctcgacgaactgtgaccccaacacgcaagcggccatacgaatgtaaggtttgtggaaaggccttcaattcaccaaacctgtttcagattcaccagcgaacccatacgggcaagaggtcatataaatgccgagagatcgttcgagcgttcaccgtttcttcattcttccgtaaacatgggaagatgcatacgggagagaagcggtatgaatgtaaatattgcggcaagcccattgattatccaagcttgtttcaaatccatgtgcgcactcatacaggtgaaaaaccatacaagtgcaagcagtgtggaaaagcgttcatcagcgcagggtatctgaggactcacgaaatccgatcccatgctttggagaagtctcaccagtgccaggagtgcggcaaaaaacttagctgtagctcctccctgcataggcacgagcggacccacagcggaggaaagctgtacgagtgccaaaagtgcgccaaggtcttcagatgccccacgtctctgcaggcacacgagagggctcacactggtgagaggccatatgagtgtaacaagtgcggtaagacctttaactatccaagttgtttccggcgtcacaagaagactcactctggcgagaagccctacgaatgtactcggtgtggcaaagcttttggatggtgtagctctttacgaagacatgagatgacccatacaggtgaaaagccttttgactgtaagcagtgcggcaaggtgtttacattcagcaattatcttcgactgcacgagagaacccacctggctggcagatcccagtgcttcggccgaaggcagggcgatcatctgtcccctggtgtgtag

SEQ ID NO: 247245 - DNA, 2352 bp, Artificial Sequence
  Description of Artificial Sequence: Synthetic coding sequence
atggtagctaaacctccagttatgtcatttcatttcgcccaggacctatggccggagcagaacataaaggactcattccagaaggttactctgcggcgttacggaaaatgcgagtatgaaaatctgcagctccggaaaggttgcaaacatgtcgatgagtgcaccggccacaaaggtggccataatacagtgaatcagtgcctgaccgcgaccccatcaaaaatatttcagtgtaataagtatgttaaggtgttcgataagttttccaactctaacagatacaagagaaggcatactgggaataaacacttcaagtgtaaggaatgtagtaagagcttttgtgtcctatcacaactgacccagcaccgcaggatacacaccagagtcaactcatataagtgtgaagaatgtggcaaagccttcaattggttttctaccctcactaaacataagcggattcataccggggagaaaccctacaaatgcgaggaatgtggaaaggctttcaaccaatcttcccagctgaccaggcacaagattatccacaccgaggagaagcctaataaatgtgaggagtgcgggaaggcgttcaagcaggcctcccatcttactatccacaagatcattcacaccggcgaaaagccctataaatacgaagagtgcggtaaagtattcagccagtcatcgcacctgacaacgcaaaaaattttgcacaccggcgaaaatctttacaaatgcaaggagtgcggcaaggcattcaatctgttctctaaccttaccaaccataagaggatccacgccggagaaaagccctacaagtgtaaagaatgtggtagagcttttaatatttcttccaatctcaataagcaagagaaaatccacaccggagggaaactcaacaagtgcgaggagtgcgacaaggctttcaaccgctcccttaaattgacagctcacaaaaagattctgatggaagagaagccatataagtgtgaagagtgcggaaaggtgtttaatcagttctctaccctcacgcgtcacaaaatcatccataccggagaaaaaccatataaatgcaaagagtgcggaaaggctttcaaccagtcctccaatctgaccgagcataagaaaatccacacagccgaaaaatcatacaaatgcgaagagtgcggtaaggcgtttaatcaacacagcaatctgatcaatcacaggaaaatctactccggggagaaaccttacaaatgcgaagagtgcggtaaagcgtttaatcgaagctctacattgaccaggcataagaaaattcacaccggcgaaaagccctacaaatgcgaagaatgtgaccgggctttttcacagagctctaacttaaccgagcacaagaaaatccataccggggagaagccctacaagtgcgaagagtgtggaaaagcatttaaccggttcagcaccttgaccaaacacaagagaatccacaccggagaaaaaccctacaaatgtgaggaatgtggcaaggcctttaatcagtcctatcagctcacccgccacaaaatcgttcatacaaaggaaaagctgaataagtgcgaggagtttggcaaggcattcaagcagtcaagccaccggaccattcataaaattatccacacaggcgaaaaaccttacaagtgcgaagagcatggcaaagtattcaatcaaagcagcaatctaaccacccaaaagatcatacacacaggtgagaacctttataagtttgaggaacacggtaaggcctttaacctgtttagtaatataacaaaccataaaatcatatatactggcgagaagccccacaaatgcgaagagtgtggcaaggcttacaaccggttctcaaaccttacgatccacaaaaggatccataccggggagaaaccctaccaatgtgctgaatgcggtaaggctttcaactgctccagcacactaaatcggcacaaaatcatccacacaggggagaagccttacaagtgtaaagaatgtggaaaggcattcaatctgtcttccacactcactgcacataagaaaattcacacaggcgaaaagccgtacaagtgtgaagaatgcgggaaagcattcaatcaaagtagcaatctcactactcacaaaaagattcatacgagtgagaaaccatataagtgcgaggaatgcgggaaatcttttaatcagttcagctcattgaatatccacaagattatccacacaggggagaaaccctacaagtgtggagattatggtagagctttcaacctatcatccaatttaacaacccacaagaaaatccacacgggcgagaagccctataaatgtgagtatggcaagacgtag

SEQ ID NO: 247246 - DNA, 276 bp, Artificial Sequence
  Description of Artificial Sequence: Synthetic coding sequence
atggtcgctaagccaccagtgatgagtttccacttcgctcaggacctgtggccagagcagaatatcaaagactcattccagaaagtgactctacggaggtatggtaagtgtgaatacgagaacctgcagctgagaaaaggctgcaaacacgtggatgagtgtaccgggcacaaggggggacacaacaccgtaaaccagtgcctgactgccactcccagcaaaatctttcagtgtaacaaatacgtaaaggtgtttgacaagttctcaaacagttag

SEQ ID NO: 247247 - DNA, 2352 bp, Artificial Sequence
  Description of Artificial Sequence: Synthetic coding sequence
atggttgcgaagcctcctgtgatgagctttcacttcgcccaagatctttggcccgaacagaatatcaaagatagttttcaaaaagtcacactccggagatacggaaagtgtgagtatgaaaacctccaactccgtaagggctgcaagcacgttgacgagtgcaccggtcataagggcggacataacaccgtcaaccagtgtcttacagcaactcccagcaaaatcttccagtgtaataagtatgtgaaagttttcgacaagttctcgaactcaaaccggtacaagaggaggcatacgggcaacaagcactttaaatgcaaggagtgctctaagtcattctgtgtgctgagccagctcacccagcatcggaggattcacacccgggtaaattcgtataagtgcgaagagtgtgggaaagccttcaactggtttagcacattaactaagcacaaacggattcataccggggagaagccctataagtgtgaggagtgcggcaaagctttcaaccagtcttctcagctcactaggcataagataatccacaccgaagagaagccaaataagtgcgaagagtgcggaaaggcgtttaaacaggcctcacacctcacaatccataagataattcatactggcgagaagccctataaatacgaggagtgcggaaaggtgttcagccagtcgagtcaccttaccacgcagaagatactccatacgggcgagaacctttacaaatgtaaggaatgcgggaaggccttcaatctattcagcaaccttacaaatcacaaacgaatccacgcgggagaaaagccttataagtgcaaagaatgtggtagagcattcaatatttcctccaacttgaacaagcaagaaaaaattcacactgggggaaaacttaacaagtgtgaagagtgcgataaagcattcaatcggtctcttaaactgactgctcacaagaagatactgatggaagagaaaccgtataaatgtgaggagtgcggcaaggtatttaaccagttctctacccttacacggcacaaaattattcatactggtgagaagccctacaaatgcaaagagtgtggcaaggcgttcaaccagtcttccaatctgacggaacataagaagatacacactgctgagaaatcctacaaatgcgaggagtgcggtaaagcattcaatcagcactcaaatctgattaaccatcggaaaatctattccggagaaaagccttataagtgtgaggaatgtggtaaggcctttaatcgctcaagcacactcactagacacaagaagatacataccggcgagaagccctacaaatgtgaagaatgtgatcgggctttcagtcaaagctccaatctgactgaacataaaaagattcatactggggaaaaaccctacaaatgcgaggaatgtgggaaagcctttaaccgcttcagcacacttacaaagcacaaaaggattcacaccggggaaaaaccgtataaatgtgaggagtgcgggaaagcttttaaccagtcatatcagctaaccaggcacaagatcgtgcacacaaaggagaaactcaacaaatgcgaagagtttgggaaagcattcaaacagagttcccaccgcaccatccacaagattatccacaccggagagaagccatacaaatgtgaggagcatggcaaagtcttcaaccagtcttcaaatctcacaactcaaaagatcatccataccggagagaatctgtacaagttcgaggagcacggaaaagcttttaacctctttagcaacattacaaaccacaagatcatttataccggcgagaagcctcataagtgcgaagaatgtggcaaggcctacaatcgcttttcaaatctgactattcacaagaggatccacacaggagagaagccttatcagtgtgcagaatgtggaaaagcttttaactgctccagcaccttgaacagacataagatcatacatacaggtgaaaaaccctacaaatgtaaggaatgcggaaaagcattcaatctcagtagtactctcacagctcacaagaagatacacaccggggaaaagccttacaaatgtgaagagtgtggcaaagcattcaatcagtcctccaaccttacaacccacaaaaagatccacactagtgaaaaaccctacaagtgcgaagagtgtggcaagtccttcaaccagttttcttcgttgaacatccacaaaattatacacacaggcgaaaagccgtataagtgcggagactatggcagagcctttaacctgagctcaaacttgacaactcacaaaaaaatccataccggggaaaaaccctacaaatgtgaatatggtaagacctag

SEQ ID NO: 247248 - DNA, 2352 bp, Artificial Sequence
  Description of Artificial Sequence: Synthetic coding sequence
atggtcgccaaaccacctgtcatgtcgtttcattttgcccaagacctgtggccggaacagaacattaaggactccttccaaaaggtgacacttcgcaggtacggcaagtgtgagtacgagaacttgcaactcagaaaaggctgcaaacatgtggacgaatgtactgggcacaagggaggacataataccgtgaatcagtgtctgaccgctaccccgtcgaagatctttcagtgcaataagtatgtgaaggtgtttgataagttctcaaattcgaacaggtacaagcgcagacacacaggcaataagcatttcaaatgtaaggagtgcagtaagtccttctgcgtgctgagtcaactgactcagcacagacgtatccacacacgcgtgaatagttacaaatgcgaggaatgcggtaaggcattcaattggttctccacactgaccaagcacaaaaggatccacaccggagaaaaaccatataagtgtgaagagtgcggaaaagcctttaatcagagcagccagctgactcgtcacaagattattcatactgaagaaaagccaaacaaatgcgaagagtgcggtaaagcttttaaacaggccagccatctgactattcataaaatcattcacacaggggaaaagccatacaaatatgaagagtgcggcaaggttttcagccaatcttcgcacttaacaacccaaaaaatccttcacaccggggagaacctgtataagtgcaaggaatgcggaaaagcctttaatctgttctctaacctgactaaccataagcgaatccacgccggtgaaaagccctataaatgtaaggagtgcgggagggcattcaacatttctagcaaccttaataaacaggagaagatacacaccggaggtaaacttaataagtgtgaagagtgtgacaaagccttcaatcgttcactaaagcttacagcccacaaaaaaatactgatggaagagaagccatataagtgcgaggagtgcgggaaggtgtttaaccagtttagcacgctgacacggcataaaattatccacactggtgaaaaaccctataagtgtaaagagtgcgggaaggcgtttaaccaaagttcgaacctgacagagcataaaaaaatccatacggccgagaagagttacaaatgtgaagagtgcggcaaggccttcaaccagcactcaaatcttataaatcataggaagatctattccggagagaagccatacaaatgcgaagagtgcggcaaggcctttaataggtcttcgactttgacacggcataagaagattcacacaggcgagaaaccatacaagtgtgaggagtgcgatcgagcattttcgcagtcttcaaacttgaccgaacacaaaaaaatccatactggcgagaagccctacaagtgtgaggaatgtggtaaagcgttcaatcgtttctccacactgacaaagcataagcgaattcatacgggggaaaagccatacaagtgcgaagaatgtggcaaggcattcaatcaatcttaccagctgaccaggcacaaaatcgttcacacaaaggaaaaattaaataagtgcgaggagttcggaaaggcgttcaagcagtcctctcaccggactattcataaaatcattcataccggcgaaaagccctataaatgtgaagaacacggaaaggtattcaaccagtctagcaaccttactacccagaagatcattcatactggagagaacctgtacaaattcgaggagcacgggaaggcgttcaacctctttagcaatataactaatcataagataatttacaccggcgaaaagccccacaagtgcgaggaatgcggcaaagcctacaataggtttagcaacctcaccatacacaaaagaatccatacgggcgagaagccgtaccagtgtgcggagtgtggtaaagccttcaactgcagctctacactgaacagacacaagatcatccataccggagagaagccatacaagtgtaaagaatgcgggaaggccttcaatctcagttcaacccttaccgcacacaaaaaaattcatacaggagagaagccctataagtgcgaagaatgcggaaaggcttttaaccagagcagcaacctgacaacccacaaaaaaattcacacgagtgagaaaccttataaatgcgaagagtgtggtaaatcttttaatcagttttcttcactcaacatccataaaatcattcataccggcgagaagccgtacaagtgcggtgactatggcagggctttcaacctttcctccaacttgacaacccacaagaagattcataccggggaaaaaccttacaagtgcgagtacgggaagacgtag

SEQ ID NO: 247249 - DNA, 453 bp, Artificial Sequence
  Description of Artificial Sequence: Synthetic coding sequence
atggtggcaaaaccccctgtgatgagttttcatttcgctcaggatttatggccggaacaaaatataaaggacagcttccagaaggtcacattacgccgttacggtaaatgcgagtatgagaatctacagcttcgcaaaggctgtaagcacgtggatgagtgcacaggccataaaggaggtcacaatacggtgaaccagtgcctgacggccactccttctaaaattttccagtgtaataagtacgttaaggtcttcgataagttctcaaactctaaccggtacaagcgacggcacactggcaataagcattttaagtgcaaggaatgttctaaatctttctgtgtcctcagccagcttacacagcaccgcagaatccatacacgtgtgaattcctataagtgcgaggagtgtggaaaagctatcatcatttgttcagacttcacccagcattag

SEQ ID NO: 247250 - DNA, 1254 bp, Artificial Sequence
  Description of Artificial Sequence: Synthetic coding sequence
atgagccaggattctgtaacatttgccgatgtggctgtgaactttacgaaagaggaatggacacttctggatcctgcccagcggaatctgtatagagacgtgatgctggaaaactcccgtaaccttgcatttattgactgggccacgccctgtaaaaccaaggacgcgacaccacagcctgatatcttacccaagcgcacctttccagaggccaaccgggtgtgcttgacctctatttcatcccagcactctactttgcgcgaagactggagatgtccaaagacggaagagccacataggcagggcgtcaacaatgttaagcctccagccgttgcaccagagaaagacgagtccccagtgagcatctgcgaggaccatgagatgagaaaccacagcaagcctacttgcagactcgtaccaagtcaaggggattctatcagacagtgcatactgacgcgagattcgagtatcttcaagtataatccggtcctgaatgatagtcagaaaacgcacgagaacaacgaggatgatggagttctcgggtggaatattcaatgggttccttgcggcagaaagaccgagctgaagtctagcacatggaccggctcacagaacacagttcaccatattagagatgagatcgatactggagcaaaccgacatcagcgaaaccccttcggcaaggcttttcgtgaggatggatccctgcgtgcccacaatactcacggacgtgaaaagatgtatgatttcacgcaatgcgaaaatacatcaaggaacaacagtattcacgcaatgcagatgcagttatacacggcagagacgaacaaaaaagattgtcaaaccggagctaccagcgccaacgcccctaacagtgggtcacacaagtcccactgcactggcgagaagacgcacaagtgtcctgagtgtggccgagccttcttttatcagtcttttctcatgaggcatatgaaaatccacacaggtgagaagccttatgagtgcgggaaatgtggaaaggccttccgctactctttacatttgaataaacacttgagaaaacacgtggtgcagaagaagccttatgagtgtgaagagtgcgggaaagtgattagagaatcatctaagtatacccatattagatcacataccggtgagaaaccatataagtgcaaaacttgtggcaaggactttgccaagtcttctggcctgaaaaagcatcttaagacccacaaagatgagaagccatgcgagtag

SEQ ID NO: 247251 - DNA, 1254 bp, Artificial Sequence
  Description of Artificial Sequence: Synthetic coding sequence
atgtctcaagactccgtaactttcgcagacgttgcggtaaacttcactaaagaggaatggacgcttctagatccagctcagaggaacctgtaccgcgacgtgatgcttgaaaacagtagaaacctggcgttcattgattgggccactccttgcaaaacaaaagatgccaccccccaacccgacatcctgccaaagcgcacctttcccgaggctaatagagtgtgcctgacctccatctcaagccagcacagcaccctacgcgaggactggcgttgccccaaaactgaagaaccccatcgtcagggcgttaataacgtcaagcctcctgcagtagcccctgaaaaagacgaatctcctgtctccatatgtgaggaccacgagatgcggaatcattccaagccaacatgtcggctggtaccctctcagggtgattcaattagacagtgcatcttgacccgggattctagtatcttcaagtacaacccggtattaaacgacagtcagaaaacgcatgagaacaatgaggatgatggcgtgttaggctggaacattcaatgggtaccctgcgggaggaaaacagaactcaaaagttctacctggacggggtcacagaacactgtgcatcacatacgggatgaaatagatactggtgcaaataggcaccagaggaatccttttggtaaagcattccgggaggacgggtctctacgcgcacataatacccacggcagggaaaagatgtatgatttcactcaatgcgagaatacatctcgcaacaacagcatccatgctatgcagatgcagctgtataccgctgaaaccaacaagaaagactgtcagaccggagccacatccgccaacgctcctaattccggttcgcacaagtctcattgtactggcgaaaaaacgcacaaatgccccgagtgtggtcgagcatttttttaccagtcttttttgatgaggcacatgaagattcacaccggagagaagccatacgaatgcggaaaatgcggtaaggccttccggtactctctgcatctgaacaagcacttaaggaaacacgttgtgcaaaagaagccgtatgaatgcgaggagtgtgggaaggttattcgtgagagcagcaagtacacacacatcaggtctcacaccggcgaaaaaccctacaaatgtaaaacatgtggaaaagactttgcaaagtcatctggcctcaagaagcacttgaagactcacaaggacgagaagccttgcgaatag

SEQ ID NO: 247252 - DNA, 1452 bp, Artificial Sequence
  Description of Artificial Sequence: Synthetic coding sequence
atgaaacgacacgagatggtcgccaaacatttagtgatgttctactatttcgcacagcatttgtggccggaacagaatataagggactcgtttcagaaggttacactgagaaggtaccggaagtgtggatatgagaaccttcagctccggaagggctgtaagtccgtcgttgagtgtaagcagcataagggagactatagcggactgaaccagtgtcttaagacgactctgtccaagatttttcagtgcaataagtacgtggaggtatttcacaaaatcagcaatagcaataggcacaagatgaggcacactgagaacaaacattttaagtgtaaagagtgcaggaaaaccttctgcatgctgagccacctgacacagcacaaacgtatccagaccagagtcaatttttacaaatgcgaagcctatggaagagccttcaattggagttccacactcaataaacacaaacggattcacacaggagagaagccatacaagtgcaaagaatgcggaaaagcctttaaccagacaagccacctgatccgtcacaagcgaatacataccgaggaaaaaccatacaagtgcgaggagtgtggcaaagcatttaaccagagttccacactgacaacgcacaacattattcatactggagagatcccctacaaatgtgagaagtgcgttcgagctttcaaccaggctagtaaactgacggaacacaagctgatccacacaggcgaaaaaaggtacgagtgtgaggaatgtggcaaagcgtttaacaggtccagcaagctcaccgaacacaagtacatacatactggtgaaaagctttacaaatgtgaggagtgtggcaaggcctttaaccagtcaagtactctgaccacacacaaacgaatacactctggtgaaaagccctataaatgcgaggaatgcgggaaagccttcaagcaattttccaacctgacagatcataaaaaaattcataccggcgaaaaaccatataaatgcgaggagtgcggcaaagccttcaatcagttgtccaacctcacccgtcataaggtcatccataccggcgagaagccttacaaatgcggggaatgcggcaaggcttttaaccagagctccgccctgaacacccataagataatccatactggggagaaccctcacaaatgcagggaatctgggaaggtctttcatcttagctctaagctaagcacatgcaaaaagatccatacaggggaaaaattgtataagtgcgaggagtgcggcaaggcctttaaccggtcctccacgctgattggccataagcgcatacataccggggaaaagccatataaatgcgaagagtgtggcaaggctttcaaccagtcctccactctgactacacacaaaatcatacatacggaggagaaacagtataagtgtgatgaatgtgggaaagcctcaacctag

SEQ ID NO: 247253 - DNA, 1152 bp, Artificial Sequence
  Description of Artificial Sequence: Synthetic coding sequence
atgaaaaggcacgagatggtggctaagcatctggtcatgttttattatttcgctcaacacctgtggcctgaacagaatatccgcgacagctttcagaaagtgaccctgaggagataccgaaaatgcggctatgagaaccttcaactccgcaagggctgcaagagcgtggtggaatgcaagcaacacaaaggcgactacagtgggcttaatcaatgcctgaagaccacactctcaaagattttccagtgcaataaatacgtcgaggttttccacaagatctctaacagcaatcggcacaagatgcggcacactgaaaacaagcacttcaaatgtaaggaatgccgcaagaccttctgcatgctatcacacctgactcaacataagcggatccagacaagagtcaatttttataagtgtgaagcctacggacgtgcctttaattggtccagcaccttgaacaagcacaaaaggatacatacaggcgaaaagccctacaagtgtaaagaatgcggaaaggcattcaatcagacgagtcacctcattcgccacaagcgcatccacacggaggaaaaaccctacaagtgtgaggaatgtggtaaggccttcaatcagtccagcacgctgacaacgcacaacatcatacataccggtgaaattccatacaagtgtgaaaaatgcgtacgcgcattcaaccaggcctcaaagctcaccgaacacaagctcatccacaccggggagaagaggtatgagtgcgaggagtgcggcaaagccttcaatagaagctcaaaactgacggaacataagtacatccataccggggaaaaattgtataaatgcgaagaatgcggaaaggcctttaaccagagctctaccctcaccacacataagaggatccacagcggagaaaaaccgtacaaatgcgaggagtgcgggaaggcctttaaacagttttccaacctgacagaccataagaagattcataccggggaaaaaccttacaagtgcgaagaatgtgggaaggccttcaatcaactgagcaacttaacacgccacaaggtgatccacactggcgaaaagccctataagtgcggagaatgcggtaaagccaatctcagctccactcttacccctcataaaactatccacatctag

SEQ ID NO: 247254 - DNA, 1368 bp, Artificial Sequence
  Description of Artificial Sequence: Synthetic coding sequence
atgctggaaaactactcaaatctggtcagcgtgggctatcacatcattaagccagacgtgatcagcaagctggagcaaggcgaagagccctggatagtcgaaggagagtttcttctgcagagttaccccgatgaagtgtggcaaacggatgatcttatcgagcgtatccaagaggaagagaacaagccgtcccgccaaaccgtattcatagaaaccctgatcgaggagagggggaacgtgcccggaaaaactttcgacgtcgagacaaatcccgtccctagtcggaagatcgcgtataagaattccctctgcgattcctgcgaaaaatgtctgacaagcgtgagcgaatatatctcttcggatggtagctatgcgagaatgaaggctgatgaatgttcaggttgtggcaagagcctccttcatattaaactcgagaaaacccatcctggagaccaggcatacgaatttaaccaaaatggggagccgtatacactcaacgaggaatctctgtaccagaaaatccgtatcctcgaaaagcccttcgaatacattgagtgtcagaaagcattccaaaaggataccgtgtttgtgaaccacatggaagaaaagccctataagtggaacggcagcgagatcgcgtttttgcaaatgagcgacctgactgtgcatcaaacttcccacatggagatgaagccttacgagtgctcagaatgtggaaagtcattttgcaaaaagtctaagttcatcatccaccagcgcacccacaccggcgagaaaccctacgaatgtaaccagtgcggaaagtcattttgtcagaagggaaccctcactgtacaccagcggacccacacgggagagaagccatatgagtgcaatgagtgtgggaaaaatttttaccagaagctccatttgatacagcatcagaggactcattctggcgaaaaaccttacgagtgttcctattgcggtaaaagtttctgccagaaaacccatctcacacagcatcagaggacgcactcaggcgaaaggccatacgtatgtcatgattgcgggccaagcagaagaagtcagcatcttatgcatcagaaaattcataccggtgtgaaattatataaatgcagcgaatgtgggaagtgtttttgcagaaagtcgaccctaaccacacacctgcgcactcatactggagaaaagccctacgagtgtaacgaatgcggtaagttcttctctagattatcttacctgactgttcactaccggacacatagcggagaaaaaccctatgaatgcaatgagtgcgggaaaaccttttaccttaactctgctcttatgagacaccagagggtgcataccggcgagaagccgtattag

SEQ ID NO: 247255 - DNA, 1980 bp, Artificial Sequence
  Description of Artificial Sequence: Synthetic coding sequence
atgaataaatcgctgggccctgtgagctttaaggatgtggcagtggactttacacaggaagagtggcagcagctggacccggaacaaaagattacgtaccgcgatgtcatgctggagaactatagcaatctggtcagcgtgggttaccacataatcaaaccagatgttatctcgaaactggaacagggtgaggagccatggatcgtagaaggggagttccttctgcagagctatcctgatgaagtgtggcaaactgacgacctgatcgaacgcattcaggaagaggagaacaaacctagtaggcaaactgttttcatcgagaccttaatcgaagaacgggaatacatctcgtccgacgggagctatgctaggatgaaggccgacgagtgttccggttgtggcaagagcctgttacatatcaaattagagaagacccacccaggcgaccaggcctatgagttcaatcagaatggtgagccctacactttgaacgaggagagcctgtaccagaagatccggatcctggagaaacccttcgagtatatagaatgccaaaaagcatttcaaaaggacacagttttcgtcaatcacatggaagagaagccatataagtggaacggctctgaaatagcctttttgcaaatgagtgacctgaccgtgcatcagacttcccatatggaaatgaaaccgtacgagtgtagcgagtgcggaaagtccttttgcaaaaagtctaagtttatcatacaccagcggacccacaccggcgaaaagccttacgaatgtaatcagtgcgggaaatcgttttgtcaaaaagggacactcacagttcatcagcgcactcacaccggcgaaaagccatacgaatgtaacgagtgtggcaaaaatttctatcagaaactgcatctaatccagcaccaacggacgcacagcggggaaaagccatatgaatgttcgtactgcggtaaatctttttgccagaaaacccatctgacccaacatcaaagaacccactctggcgagagaccttacgtctgccatgattgcggaaagacattctcacagaagagcgctctgaacgaccaccaaaagattcacacaggggttaagctgtacaagtgttcagagtgtggtaagtgtttctgccggaagtccaccctcaccacccatctgcggactcatactggagagaaaccatacgagtgcaatgagtgtggcaagttcttctctcggctctcttatctgaccgtgcactaccgaacccactctggcgagaaaccttacgagtgtaatgaatgtgggaaaacgttctacctgaactcagccttaatgaggcatcagcgagtacatacgggcgagaagccttacgagtgtaatgagtgtgggaagctattttctcagttgtcttacctcaccattcaccaccgaactcatagcggcgtgaaaccctatgagtgtagtgaatgtggaaaaacattctaccagaactcagcactgtgccggcacaggcgcatccacaagggcgagaaaccctatgagtgttatatttgcgggaaattcttcagtcagatgtcgtatctgacaatccaccacagaatacacagcggtgaaaaaccttacgaatgcagcgagtgcggaaagactttttgccagaactctgctttaaatagacaccaaaggacccatactggcgagaaggcatacgagtgttacgaatgtggaaagtgtttctcacaaatgtcctacttaactattcatcatcggatccactcgggcgaaaagccattcgaatgcaacgaatgtggcaaggcgttttcaagaatgagctacctgaccgtacattataggacccactctggtgagaaaccctacgagtgcaccgagtgcggcaaaaagttttatcataagagtgcattcaacagccaccaacgaatccacaggaggggtaatatgaacgtgatcgatgttgggcgattgctctag

SEQ ID NO: 247256 - DNA, 2268 bp, Artificial Sequence
  Description of Artificial Sequence: Synthetic coding sequence
atgcgggctactgccctggttcgatggacagggagggatcttgcaagtcggagggcccctgccactgcgatccctcctcggcctgtcggaagcggcggagccgaggccgctgaacctcaagaggacctcccgcctctctcgcagtccagcagatttttccaggagcagcagaagatgaataaaagtctgggaccagtgtcctttaaggacgtggcagtcgattttacccaagaggaatggcaacagctcgaccccgagcagaaaataacctacagggatgtgatgctggagaactactcaaaccttgtgtccgtgggctaccacattataaagccggatgtgataagtaagctggaacagggagaggagccttggatcgtggaaggcgaattcttattgcagtcgtaccccgacgaggtgtggcaaacagatgacctgatcgaacggatccaggaggaagaaaataaaccgtcacgccagaccgtgttcatcgagactctcatcgaggagcggggtaacgtcccaggcaagacgtttgacgtcgagaccaatcctgtgccttcacgcaaaatcgcctataaaaactccctctgcgacagctgtgagaagtgtctgacctcagtgtctgagtacattagtagcgacggcagctatgccagaatgaaggcggacgaatgttccgggtgcggcaaatctctcctccacattaagttagagaaaacacatcccggtgaccaggcttatgaattcaatcagaatggagagccatatacattgaacgaggagagcctgtaccagaaaatacggattttggaaaaaccatttgagtatattgaatgtcagaaggccttccagaaggataccgtgttcgttaaccatatggaagaaaagccctacaagtggaacggaagcgaaattgcattcctccagatgagcgacctgacagtccaccagaccagccacatggaaatgaagccatacgaatgcagcgagtgcggcaagagtttttgcaaaaagagcaagtttatcatacatcagcggacccacacaggtgaaaagccctacgagtgtaaccagtgtggcaagagtttttgccagaaggggaccttaaccgtccaccagagaacccacaccggggagaagccctacgagtgtaatgaatgcgggaaaaacttttatcagaaacttcatctgatacaacatcagcggactcatagcggggaaaagccctacgagtgctcttattgtggtaagtcattttgccagaaaacacatctcacacagcaccagagaactcacagcggggagagaccgtatgtttgccacgactgcggtaaaaccttctcgcaaaagagtgctctcaacgaccaccagaagatacacacaggtgtgaaactctacaagtgctctgagtgcggcaaatgtttctgccggaagtcgactctgactacacacttacggacgcacaccggggaaaagccttacgagtgtaacgaatgcggaaaatttttctcccgattatcatatcttaccgttcattaccggacccattcgggagagaagccttatgaatgtaacgagtgtggtaagacgttttacttaaattccgccctcatgcgacaccagagagttcacaccggtgagaaaccatacgaatgcaacgaatgcggaaaactcttttcgcagctgagctacctgaccatacaccatcggacccactctggggtaaaaccatacgaatgtagtgaatgcggcaaaaccttctaccagaacagcgcgttgtgccggcaccgcaggatccacaaaggagaaaagccgtatgagtgctatatttgtggcaaattcttcagccaaatgtcttatcttacaattcaccaccggattcactccggcgagaaaccctacgagtgtagcgaatgcggtaagacattctgtcagaacagcgccctcaacaggcaccagaggactcatacgggggagaaagcctacgagtgttacgagtgcggtaagtgtttttcacagatgtcttacttgacaatccatcacaggatccactccggcgagaagccatttgagtgcaacgagtgtgggaaagcgttcagtaggatgagttatctgacagtacactatcgcactcattccggcgagaagccctacgaatgcactgaatgtggcaagaagttttaccacaaaagtgcgttcaatagccatcagcgcattcacaggagggggaacatgaacgtgattgatgtgggcaggcttctgtag

SEQ ID NO: 247257 - DNA, 2094 bp, Artificial Sequence
  Description of Artificial Sequence: Synthetic coding sequence
atgaacaagtcactgggcccagtgtcgtttaaggacgtggctgtggatttcacccaggaggaatggcagcagttggatcccgagcagaaaattacctatcgtgatgtaatgctcgagaattatagcaacctggtatcagtcggctaccatatcatcaagcctgatgtgatcagcaaactggagcaaggcgaggaaccttggatagttgagggggagtttttgctccagagctacccagacgaagtgtggcagaccgatgacctgatcgagagaatacaggaggaggagaacaagccctccaggcagacggtctttattgagaccctgatcgaggagcgaggaaacgttcccggtaagactttcgacgtggagaccaaccctgtcccttctcgaaagatcgcttataagaacagcctttgtgactcatgtgaaaagtgcctgacatcagtatcggagtatatctcctcagacggaagctacgctcggatgaaagcggatgagtgttctggctgcggcaaatcattactccacatcaaactcgagaagacccaccccggagatcaggcatacgaatttaatcaaaacggagagccttacacactcaacgaagagtctctctaccagaaaatcagaattctggagaagccttttgaatatattgagtgccagaaggcgttccagaaggacacggtattcgtgaatcacatggaagagaaaccatataagtggaacggatccgagattgctttcctccaaatgtcggatctcaccgttcatcagaccagccacatggagatgaagccctatgagtgctccgaatgcggcaagagtttctgcaagaagtctaaattcatcatccatcaacggactcacaccggggagaaaccttacgagtgcaaccagtgcgggaagtcgttctgtcagaaaggaaccctgaccgtgcaccagagaacacataccggagaaaagccttacgagtgtaacgagtgcggaaaaaacttctaccaaaagcttcatctgatccagcaccagcgaacacattctggggagaaaccatacgagtgcagttattgtgggaagtccttctgccagaagactcacctcacacagcaccagcggacacatagcggggagcgcccatatgtgtgccatgattgtggcaaaacatttagccagaagagtgccctgaatgatcaccagaagattcacactggtgtaaaattgtacaaatgttccgaatgtggaaaatgcttctgtagaaaaagcacactcaccacacatcttagaacccacactggtgagaaaccctacgagtgcaatgaatgtggcaaatttttttctcgattgtcttatcttactgttcactataggacacacagtggggagaagccatacgaatgcaatgagtgcggtaaaacgttctatctaaacagcgccctgatgcggcaccagcgtgttcacaccggtgagaagccctacgaatgtaatgaatgcggcaagctcttttctcagttatcctacctgaccatccaccatagaacacacagcggcgtcaaaccatacgagtgtagcgaatgtggcaagacattctaccaaaattcggctctgtgtaggcatcgtaggatacacaagggcgagaaaccctacgaatgttacatatgcggcaagttcttcagccagatgagctacctgaccattcatcaccggatccactccggggagaagccttacgagtgctctgagtgcggtaagactttttgccaaaacagcgcgttgaacagacaccagaggacccacaccggggaaaaggcatacgagtgctacgaatgcggcaagtgcttttcccagatgtcttatctgaccatacaccaccgaatacattccggagaaaaaccctttgagtgcaacgaatgtggcaaagccttttccaggatgtcctacctgaccgtgcactatcgcacacactccggggagaagccgtacgaatgcacggagtgcggcaagaaattttatcacaaaagtgcattcaatagccaccagcgtatccaccggaggggtaatatgaacgtcatagatgtcgggagattgctgtag

SEQ ID NO: 247258 - DNA, 1173 bp, Artificial Sequence
  Description of Artificial Sequence: Synthetic coding sequence
atggccgagatccataatggtggggagctgtgcgatttcatggagaacggcgagattttcagtgagcactcttgtttgaatgcccacatgggcactgagaatacaggggacacttatgactgcgatgagtacggcgaaaattttcctatgctgcacaattctgccccagctggggagacattaagcgtgctgaatcagtgcagaaaggcattctctctccctccgaacgtgcaccagagaacatggattggagacaaatctttcgagtacagtgactgtgaggaggcatttgttgatcagtcccatctccaagcaaaccgaataacccacaatggagaaaccctttatgagcagaaacagtgtgggcgagcctttacctattcaactagccacgccgtgagcgtgaaaatgcacactgtcgagaagccctacgaatgcaaggagtgcgggaaattttttcgttactcatcctatctgaactctcatatgagaacacacacaggagaaaaaccctacgaatgcaaggaatgtgggaaatgtttcaccgtgtcctcacacctagtcgagcatgtcaggattcacactggggagaagccctatcaatgcaaggagtgtggaagggcttttgctggcagaagcggcctcactaagcacgtccgaattcacaccggcgaaaagccatatgaatgcaacgagtgcggtaaagcttataatagattttatctactaactgagcactttaagacgcacaccgaggagaagccattcgagtgcaaggtgtgtggcaagtctttcaggagctctagctgcctgaagaatcattttcggatccacaccggtatcaagccatataaatgcaaggagtgtgggaaggcctttaccgttagttcgtcccttcacaatcacgtaaagattcatacaggtgaaaaaccctatgagtgcaaagactgcggcaaagcctttgccacctcctcccaactgatcgagcacattaggactcatacgggggagaaaccttacatatgtaaagagtgcggcaagaccttccgggcatccagccacctgcaaaaacatgtgcgaattcacaccggggagaaaccttacatatgcaatgagtgcggaaaagcgtataacagattctacctgctcacgaaacaccttaagacgcactag

SEQ ID NO: 247259 - DNA, 1032 bp, Artificial Sequence
  Description of Artificial Sequence: Synthetic coding sequence
atggccgagatacacaacggcggagagttatgtgattttatggaaaacggcgagatcttctcagagcattcatgcctcaacgcacacatgggaacagagaacaccggggacacctacgactgtgatgagtacggggaaaactttccgatgctccacaattcagcacctgccggtgagactctcagcgtgcttaaccagtgtagaaaggcctttagcctcccccctaatgttcaccaaaggacctggatcggagacaagagcttcgagtacagtgactgtgaggaggcctttgtggaccagtcccatttgcaggccaataggatcactcataatggggagaccctctatgagcaaaagcagtgcggcagagcattcacttattcaacatcccatgcagtgtcagtaaagatgcatactgtcgagaagccttatgaatgtaaagagtgtggcaagttttttagatatagcagttacttaaactcccatatgcgcacacatacgggtgagaagccttatgaatgcaaggagtgcggaaaatgcttcactgtgtcatcacacctggtggagcatgtacgcattcatacaggtgaaaaaccgtatcagtgcaaggagtgcgggagggccttcgccggacggtccggcctaacaaaacatgttcggatacatacaggggaaaaaccctacgagtgtaatgagtgtggcaaagcatataacagattctatctgctgactgaacattttaaaacccacaccgaggaaaaaccgtttgagtgtaaagtgtgtgggaagagtttccgcagctcctcctgcctgaagaatcacttcagaatccacacggggatcaagccgtataagtgcaaggagtgtggaaaggcattcactgtgtccagtagtcttcacaatcatgtcaaaatccatacaggcgaaaagccctacgaatgtaaggactgcgggaaggcattcgccaccagtagtcagttgatcgaacacatccgcacgcatacttgtaatccttcaaccctcagaggctag

SEQ ID NO: 247260 - DNA, 870 bp, Artificial Sequence
  Description of Artificial Sequence: Synthetic coding sequence
atgtcaggccatcccggaagctgggaaatgaacagcgtagcattcgaggacgtggccgtgaacttcacacaagaggagtgggccctgctggatccaagccagaagaacttgtaccgcgatgttatgcaggagacctttaggaatctggcctcgattgggaacaaaggcgaggatcaaagtatagaagaccagtataaaaatagctccaggaacctgagctcttttcagattcaccagagaaaccacacaggagaaaagccctatgaatgcatggaatgcggtaaggccttgggcttctcacgctctttgaatcggcataaacgaatacacacaggagagaagaggtatgagtgtaaacagtgcggaaaggcattctctcgcagctctcatctccgcgaccatgagcggactcatacaggcgagaagccctatgagtgtaagcactgtggaaaggctttcaggtattctaattgcttgcattatcacgaacggactcatactggggagaagccatatgtgtgtatggagtgcgggaaggcattctcctgtctcagcagtcttcaagggcatattaaagcccatgctggagaggagccttacccttgtaaacagtgtggtaaggctttccgctatgcctcttctctacagaaacatgaaaagacccatatagcacagaagccttacgtctgcaataattgtggaaagggattccgttgctctagttcgcttagggaccatgagcgtactcacactggcgagaagccttacgaatgtcagaaatgtgggaaagccttctctcgcgcaagcacactgtggaagcacaagaagacccataccggggagaagccctacaaatgcaaaaagatgtag

SEQ ID NO: 247261 - DNA, 939 bp, Artificial Sequence
  Description of Artificial Sequence: Synthetic coding sequence
atgccaaatttcaacctcaataagaaaatacctgccagggtcaagcctcatgaatgcatcgtctgtgagaagttcttcattcgccatagtagtcttcacagacacattatctctcactccggcaataacccatatggatgtgaggagtgtggcaagaaaccttgtacctgtaagcaatgccagaaaacctcactgtccgtcacaagagtgcacagggacaccgtgatgcataccggcaatggacactacggatgtactatttgcgagaaggtgtttaacatcccctcgtcattccagatccatcaacgcaatcatactggggagaagccgtacgaatgcatggaatgcggaaaagcccttggatttagtaggagcctgaatcgccacaaacgtatacacaccggcgaaaagcgatacgagtgtaagcagtgtgggaaagcatttagtcgatcttcccatctcagggaccacgaacgcacccacaccggagaaaagccgtacgagtgtaagcactgcgggaaagcctttcgttactcaaattgccttcactaccacgagcggacacacacgggagaaaaaccgtacgtgtgtatggaatgcgggaaggcgtttagctgcctctcctccctgcagggtcacattaaggcccatgcgggtgaggagccttacccatgcaagcagtgcggcaaggccttcagatatgcttccagcctgcagaaacacgaaaagacccacattgcccaaaagccttacgtctgcaataattgcggcaaaggatttcggtgctccagcagtctgcgggaccatgagagaacccacaccggtgagaagccctacgagtgccagaagtgcggcaaagctttctccagagcttccacactgtggaagcacaagaaaacacacaccggcgagaagccctataaatgcaagaagatgtag

SEQ ID NO: 247262 - DNA, 468 bp, Artificial Sequence
  Description of Artificial Sequence: Synthetic coding sequence
atgaacgctctctgcgtgaaaaactccagttatcatagttcgttgcacaggcatataatttcacactctgggaataacccctatggctgcgaagagtgcgggaagaagccatgcacctgcaagcaatgccagaagacctcactcagcgttacgcgggtacatcgcgacaccgtcatgcataccggtaacggacactacgggtgtaccatttgtgagaaggtatttaacatccccagtagctttcaaattcatcagagaaaccacaccggggagaagccatatgaatgtatggaatgtggaaaagctcttggattctcacggagcctaaataggcacaaacgcatccacaccggggaaaagcggtacgagtgcaagaaatgtggcaaagccttttcccgcgctagtactttatggaaacacaaaaaaactcacacgggcgagaaaccgtataagtgcaaaaaaatgtag

SEQ ID NO: 247263 - DNA, 888 bp, Artificial Sequence
  Description of Artificial Sequence: Synthetic coding sequence
atgaacgctctgtgcgtcaagaacagttcataccactcctctctgcataggcacataatctcacattcgggcaacaatccctacgggtgcgaagagtgtggaaagaaaccctgcacatgcaagcagtgtcagaagacaagcctgtcagtgacaagagtgcaccgggatactgtgatgcacaccggaaacggacattacggctgcaccatttgcgaaaaggtgttcaacatcccttctagctttcagattcaccagcgcaaccatacgggtgaaaagccgtatgagtgcatggagtgtggaaaagctcttggcttcagtcggtcgctgaataggcataaaagaattcacaccggcgaaaagagatatgagtgcaaacagtgtggcaaggccttcagcagatcctcacacctcagggatcacgagagaacccacactggcgaaaaaccgtatgagtgtaaacactgtgggaaggcattcagatacagcaactgtctacactatcacgagcgcacccacacgggtgaaaagccttatgtttgcatggagtgtggcaaagcgtttagctgtctgtcttcactgcaggggcacataaaagcgcatgcgggagaggaaccctacccgtgtaaacagtgcgggaaggcatttcgctacgcctcttctctccagaaacacgagaaaacccacatcgctcaaaagccttacgtctgcaacaattgcggaaaaggcttccggtgtagcagctccttaagggaccacgaacggactcatactggcgagaagccttatgaatgccagaagtgcggtaaagcgttttccagagcaagcacactatggaagcacaagaaaacacacacaggagaaaaaccatacaaatgtaagaaaatgtag

SEQ ID NO: 247264 - DNA, 222 bp, Artificial Sequence
  Description of Artificial Sequence: Synthetic coding sequence
atgagtggccaccctggatcatgggaaatgaactccgtcgcatttgaggacgttgccgtaaattttacgcaagaggagtgggccctcctcgacccctctcagaaaaatttataccgtgatgtcatgcaggaaacatttcgaaatctcgctagtatcgggaacaagggagaggaccagtcaattgaggatcaatacaagaattcgtcaaggaatctgagatag

SEQ ID NO: 247265 - DNA, 1770 bp, Artificial Sequence
  Description of Artificial Sequence: Synthetic coding sequence
atggaagctgaggagacgatggagtgtttgcaggaatttcctgaacaccataaaatgattcttgatcgcctgaatgagcagagggagcaggaccgctttaccgatattaccctaatcgtggatggacatcactttaaagcccacaaggctgtgctagcagcgtgttccaaatttttttacaaattcttccaagagttcacccaggagccgctggtcgaaattgagggcgtttcaaagatggcattccgccacctgatcgaatttacttacaccgcgaagctgatgatccagggcgaggaggaagccaacgacgtttggaaggctgctgaattcttacaaatgctagaggcgatcaaggctctcgaagtgcggaataaagagaattccgcaccactagaagagaacacaactggcaagaatgaagctaagaagaggaaaatcgccgaaacctccaacgttatcaccgagagcctgccatccgcagaatctgagccagtggagatcgaggtggagattgcagaggggacgattgaggtggaggacgaagggatcgaaactctcgaagaggtggccagtgctaaacaaagtgttaaatatatccagtccaccggttcttccgacgattcagcccttgcattgctggccgacatcacttctaagtatagacaaggcgacagaaaaggacagatcaaggaagacgggtgtccttcagacccaacaagcaaacaggagcatatgaaaagtcatagcaccgagtcattcaagtgcgaaatctgcaacaagcggtaccttcgcgaatccgcttggaaacagcacctgaactgttaccatctcgaggagggaggtgtctcaaagaagcagagaacaggaaagaaaatccacgtctgccagtactgtgagaaacaattcgaccatttcggccactttaaagagcaccttagaaagcacaccggcgaaaagccttttgaatgtccaaactgtcatgagcggtttgcacggaatagtacgctaaagtgccacttgacagcatgtcagacaggagtaggcgctaagaaaggaagaaaaaaactgtatgagtgccaggtatgcaacagcgtcttcaattcctgggaccagtttaaagaccatctggtgattcataccggggacaagcccaaccactgcaccctctgtgacctatggttcatgcaaggcaacgaactgcgtcgccatctctcagatgcacacaatattagcgagaggctggtgactgaggaagtgctctctgtggagactagggtacagactgaaccggttacatcaatgacgattatagagcaagtcggaaaggttcatgtgttgcctctgcttcaggtccaagttgatagcgcacaagtgaccgttgagcaggtccatcccgatctgctacaggattcacaggtccacgacagccacatgtccgaactgcctgagcaagtgcaagtaagctatctagaggtggggagaatccagacagaagagggaaccgaggttcatgttgaagagctccatgttgagagggtaaatcagatgcctgtggaagtgcagaccgagctactcgaagccgatctggaccacgtgacacccgagataatgaaccaggaggaacgcgagtcatctcaggcggacgctgcggaggctgctcgggaagatcacgaggacgccgaagatctggaaaccaagccgacagtggattcagaggccgagaaggcggaaaatgaagaccgtactgcattgccagtgttagagtag

SEQ ID NO: 247266 - DNA, 1872 bp, Artificial Sequence
  Description of Artificial Sequence: Synthetic coding sequence
atggaggccgaagaaaccatggagtgtttgcaggagttcccagagcatcataaaatgatactcgatagactgaatgagcagagggaacaggatcgattcactgacattaccctcatagtggatggacatcacttcaaagctcataaagccgtcttggcagcttgtagcaaatttttttacaaattctttcaggagttcacacaagaacctctcgtggaaattgaaggcgtgtctaagatggcattcagacacctaatcgaatttacttacactgccaagctgatgattcagggggaagaggaggctaatgatgtatggaaagctgccgaattcctgcaaatgctggaggccataaaggccctcgaagtccgaaataaggaaaattccgcccctttagaggagaatacgaccggcaaaaacgaggcaaagaagagaaaaatcgctgagacctccaacgtaatcacggaatctctaccgagtgccgaatccgagcccgttgagattgaggtggaaatcgctgagggcacaattgaagtggaggatgagggtattgaaaccctggaggaagtggcaagcgctaagcagtccgtgaagtatatccagtctaccgggtcctctgacgatagcgctctcgcgctgttggcagatatcacatccaagtatagacagggcgaccgcaagggccagatcaaggaggacgggtgtccctccgaccctacttccaaacaggtggaaggcattgagatcgttgaactgcaattgtcacatgtgaaagacttattccactgcgagaagtgcaaccgatcctttaagctgttctaccacttcaaggagcatatgaagagccatagcacagagagctttaaatgtgaaatatgcaacaaaaggtatcttagagagagtgcatggaagcagcacctgaattgctaccatctcgaagagggcggagtgtccaaaaagcagcgtacaggcaagaaaatccatgtgtgccagtactgtgagaagcagtttgaccacttcgggcactttaaggagcatctcaggaagcataccggcgaaaagcctttcgagtgtccaaattgccatgagagattcgccaggaattctacacttaagtgtcatctcacagcatgtcaaactggtgttggggcaaaaaagggacggaagaagctgtacgaatgccaggtctgtaattccgtctttaattcttgggatcagtttaaggatcatctggtcatccacaccggtgataaacccaaccattgtactttgtgcgacctttggtttatgcagggaaatgagcttcgtcggcatctgagcgatgctcacaatatttccgagagacttgtcaccgaagaagtcctcagcgtcgaaaccagagtccaaactgaacccgtgacttctatgaccattattgaacaggtcggtaaggtccatgtgctacctttactccaggtgcaggttgacagcgcacaggtgaccgtggaacaggtgcacccagacctcctgcaggattcccaggtgcacgattcacacatgagtgaactgccagaacaggttcaagtgtcttatttagaagttggaagaatccagaccgaagagggtaccgaggtacatgtagaggaactacatgttgagcgcgtaaaccagatgccagtcgaagtccagacagagctgttggaagcggacttagatcacgttacacccgaaatcatgaaccaggaggaaagagagtctagccaagctgatgcagccgaagctgccagggaagaccacgaagacgcagaggatctcgagacgaaacctacagttgacagcgaagccgagaaagccgagaacgaggatcgtaccgccctgccagtgctggagtag

SEQ ID NO: 247267 - DNA, 1770 bp, Artificial Sequence
  Description of Artificial Sequence: Synthetic coding sequence
atggaggcagaagagactatggaatgtctgcaggagttccccgagcatcataagatgatcctagataggctgaatgaacagcgcgaacaggacaggtttacggatatcacgctgattgtggacggacatcactttaaggctcataaggctgtgctagccgcttgcagcaagtttttttataaattcttccaggaattcacccaggagccattggttgaaattgagggcgtgtcaaaaatggcttttcgccatctgatagagtttacctatacagctaagctgatgatccagggagaggaagaggccaatgatgtctggaaggcggctgagttcctacagatgctggaagccatcaaggcattggaggtgagaaataaggaaaatagtgcaccgctggaagaaaacaccacagggaagaatgaagcaaagaagagaaagatcgccgagaccagcaacgtcatcacggagagcctgccttcggccgagagcgagcccgtggagatcgaggtggagattgctgagggcaccatcgaagttgaggacgaggggatagaaaccttagaggaagtagcatccgcaaagcagtccgttaagtacattcaaagcactggcagcagtgacgactctgccctcgccctcctggccgacatcactagcaagtatcgccagggtgacagaaagggccaaattaaggaagatgggtgtccatcagatcccacgagcaaacaggaacacatgaaaagccattccactgaatcctttaagtgtgagatctgcaataaacgataccttcgggagagtgcttggaaacagcacctcaattgttatcatctagaggagggcggtgtgtcaaagaagcagaggactggaaagaaaattcacgtatgccagtattgtgagaaacaattcgaccattttggacactttaaggagcacctaaggaagcacacaggagagaaacccttcgaatgccccaattgtcatgagcgctttgccaggaacagtacactaaaatgtcacctgacagcctgtcaaactggcgtgggtgcgaagaaaggtcgaaagaaactgtatgaatgtcaggtctgcaattctgtctttaatagttgggatcagttcaaagaccacctggtgatccatacaggcgacaagccgaaccattgtacactgtgcgatttgtggttcatgcagggcaacgaactgcgcagacatctgtctgacgcacacaatatttcagaacggctggtgactgaagaggttctgtctgtggaaacacgcgtccagacagagcctgtgacctctatgaccattattgaacaggtgggaaaagtgcatgtactccctctcttacaggtgcaggttgattcagctcaagtgactgtcgagcaggtgcacccagacctgttgcaggactcccaggtccatgattcccacatgtcggaactgcccgaacaggtacaagtgagctacctggaggttgggcgtatacaaacggaagaggggactgaagtccatgtggaggagcttcacgttgaaagggtcaatcagatgccagtggaggtgcagaccgagctgcttgaggctgatcttgaccacgttaccccagagatcatgaaccaggaggagcgggagagcagccaggccgacgctgcagaggccgctagagaggaccacgaggacgccgaggacctcgagaccaagccgacagtggattctgaagctgaaaaagcggagaatgaagaccgaactgcgctgccagtcttggaatag

SEQ ID NO: 247268 - DNA, 456 bp, Artificial Sequence
  Description of Artificial Sequence: Synthetic coding sequence
atggaggccgaggagactatggagtgtttgcaggagttccccgagcatcacaagatgattctggatcggctgaacgagcagagggagcaggatagattcactgacataaccctgattgtggacggtcaccatttcaaagctcataaagctgtgttagctgcctgttccaagttcttctataaattcttccaagagttcacccaagaacctcttgttgagattgagggtgttagtaagatggcatttcgccatctcatagagtttacgtacactgctaagctcatgatccaaggggaagaagaggccaatgacgtgtggaaggctgcagaattcctgcagatgctggaagccattaaagcactcgaagtgcgtaacaaagagaacagcgccccactggaggaaaatactactggaaagaacgaagcaaagaagcggaaaatcgcagaaacctcgtag

SEQ ID NO: 247269 - DNA, 1872 bp, Artificial Sequence
  Description of Artificial Sequence: Synthetic coding sequence
atggaggccgaagaaaccatggagtgcttgcaagagtttcccgaacaccataaaatgatcttggaccggctgaacgagcaaagagagcaagatagattcactgacataaccttgattgtggacggccaccatttcaaagctcacaaagctgttcttgcggcttgttcaaagtttttctacaagttcttccaggaatttacccaggagcccctggtcgagattgaaggcgtttctaagatggctttccgccacctcattgaattcacctacactgcgaagctcatgatccaaggggaggaggaagccaacgacgtgtggaaagccgctgaatttctgcagatgcttgaagccattaaagcccttgaggtcaggaataaagagaactctgctcccctggaagaaaacactactggcaaaaacgaggcaaagaagagaaaaattgctgagacatcaaatgtaattacagaaagccttccgtcagcagagtccgaacctgttgagattgaggtggagatagctgaaggaactatcgaagtggaagatgagggaattgaaaccctggaggaggtggccagcgccaaacagagtgttaagtatattcagagcactggttcttccgacgactcggccctggccctgctggctgatattacctcgaagtatcgacaaggcgaccggaagggtcagataaaggaagatggatgtccctccgacccaacttccaagcaagtcgaaggaattgaaatagtggaactccagttgagccatgtcaaagatctgttccactgtgaaaaatgcaataggtccttcaagctcttctatcacttcaaagagcacatgaaatctcattccacagagtcgttcaaatgcgagatctgcaacaagaggtatcttcgagagtctgcttggaagcagcacctaaattgttaccacctagaggagggaggggtgagtaaaaaacaacgcacggggaaaaagattcatgtgtgccaatactgtgaaaaacaattcgatcattttggccacttcaaggagcacctccgcaaacacacgggagaaaagcctttcgagtgtccgaactgccacgagagattcgccaggaattcaacattgaaatgccacctcacagcctgtcagactggggtaggtgccaagaaaggcaggaagaaactgtatgaatgccaggtctgcaatagcgtgttcaactcctgggatcagtttaaggaccacttggtgatacatacaggagataaacccaaccactgtactctttgcgatctatggttcatgcagggaaatgaactgcggaggcatctgagcgatgctcacaatatctccgagcggctcgttactgaagaagtactgagcgtggaaactcgcgtgcagaccgagcctgtgaccagtatgaccatcattgaacaggtgggaaaagttcatgtactccccttattacaggttcaggttgatagcgcccaagtcaccgtggaacaggtccacccagatttgctgcaggattcacaggttcacgatagccacatgtccgaactgcctgagcaggtgcaggttagctacttggaagtcggtcgaatccaaacagaagaaggcacggaggtgcatgtagaagaactgcatgtcgagagggtgaaccaaatgccagttgaagttcagacagagttgctagaagctgatctggaccatgttacacccgagattatgaaccaggaggagcgagaatcaagccaggcagatgccgcagaggccgcaagagaagatcatgaggatgctgaggacctggagacaaagccaactgtcgattcagaagctgagaaggccgagaatgaggaccgaacggccttgcccgtgctggagtag

SEQ ID NO: 247270 - DNA, 420 bp, Artificial Sequence
  Description of Artificial Sequence: Synthetic coding sequence
atggaagcagaagagacaatggagtgtctgcaggagtttccggagcaccataaaatgattctcgatcggctgaatgaacagagagagcaggatcgattcacggatatcactctgattgtggatggccatcatttcaaagctcacaaagccgtgcttgctgcttgctccaaattcttttacaagttctttcaggagttcactcaggaacccctcgtggagatcgagggagtgtcaaagatggcattcaggcacctgatcgagtttacatacacagctaaactaatgatccagggcgaggaagaagccaacgacgtttggaaagcagccgagttcctccagatgctggaagcaatcaaagcccttgaggtgcgcaacaaagaaaatagcgcccctctcgaagagaacacgaccgggaaatag

SEQ ID NO: 247271 - DNA, 1770 bp, Artificial Sequence
  Description of Artificial Sequence: Synthetic coding sequence
atggaagccgaggaaacgatggaatgcctacaggaatttcccgagcaccacaagatgatcttggatcggctcaatgaacagcgagagcaagatcgcttcacggatatcaccctcatcgtcgacggccaccattttaaagcacataaagccgtactggccgcttgctccaagtttttctacaagttcttccaggagtttacacaagagcccttggtcgagatagagggcgtgtcaaagatggcgtttaggcacctgatcgaattcacttataccgcgaagctaatgattcagggagaagaagaggcaaatgatgtgtggaaggctgcagaatttctgcagatgttggaagccattaaggctttggaggtgcgtaacaaagaaaattccgccccactggaagaaaacactactggcaagaacgaagccaaaaagagaaaaatcgccgagacgtcaaacgtcattacagagagcctgccaagtgcggagagcgagcccgtggaaatcgaggtagagatcgcagagggtaccatagaagtggaagacgaaggaattgagacgctggaggaggtagcctccgctaagcagtctgtcaagtacatacagtcgacaggaagctccgatgacagcgcgctggctctgctggcagatatcacgagtaagtaccgccagggcgatagaaaggggcagataaaggaagatggttgtccctcggacccaacttccaagcaggagcatatgaaatctcatagcactgaatcatttaaatgcgaaatttgcaataagcgatacctgcgcgagagtgcttggaagcagcacctcaactgttatcacttagaggagggcggagttagcaagaagcaaagaactggcaagaagatccatgtgtgtcagtactgcgaaaaacagtttgatcacttcggacactttaaagagcatctcaggaagcatacaggtgaaaaaccttttgagtgtccaaactgccacgaacggtttgcacggaatagtacccttaagtgccatctcaccgcatgtcaaaccggcgtgggcgcaaagaaggggaggaaaaagctctatgagtgccaagtctgtaattccgtcttcaattcatgggaccaatttaaggaccacctggtgatacacacgggcgataaacccaaccactgtacactatgcgacttgtggtttatgcagggtaatgagctcaggagacacctctcagatgcgcacaatatatccgagaggcttgtcacagaagaagtactgtccgtggagacccgcgttcagaccgaaccagtgacaagcatgacgataatagagcaggttggtaaagtgcatgtgcttcctttgcttcaggtccaggtggattcggcccaggtgactgttgagcaggtgcatcccgatctgctgcaggattctcaggtgcacgacagtcatatgagcgagttaccggaacaagtccaggtgtcctacctggaagtgggtagaattcagacagaggagggcacggaggtgcatgtggaagagcttcacgtggaacgcgtgaatcaaatgccggtggaggtgcaaactgaactcttggaagccgacctcgaccatgtgacccctgagatcatgaatcaggaggaacgggagtcgagccaagccgatgctgccgaagccgcacgcgaggaccacgaagacgcagaagacctggaaaccaagcctactgtcgattcagaagccgagaaagctgagaatgaagataggactgccctaccagtgctggagtag

SEQ ID NO: 247272 - DNA, 798 bp, Artificial Sequence
  Description of Artificial Sequence: Synthetic coding sequence
atggaggcagaggagacaatggaatgtcttcaagaatttcctgaacaccacaagatgattttggataggctcaatgagcaacgagaacaggatagattcaccgatattaccctgatcgtggacggccatcactttaaggcccacaaagcggtgctggcagcctgctccaagttcttctataaattttttcaggaatttactcaggagccgcttgtcgaaatcgaaggtgtgagtaaaatggcttttcggcacctgatcgaattcacatataccgctaagctgatgattcaaggagaggaagaggcaaatgacgtctggaaagcggctgaatttctccagatgttagaggctattaaggccctggaagttcgaaacaaagagaattctgcccctctcgaggagaacacaacaggaaagaatgaggcgaaaaaacgaaaaatcgctgagacctctaacgtgattactgaaagcctgccaagcgccgagagtgagcctgtcgaaatagaggttgagatcgcagagggcactatagaagtggaggatgagggcattgagacactggaggaggtggctagtgctaagcagtccgtcaagtatatccagtcaacaggttcgagcgacgacagtgcactggctctactggcggacatcacatctaagtatcgccaaggcgatagaaagggacagattaaggaggacggctgcccctccgaccctacatcaaagcaggaacatatgaaatctcatagcacagaaagtttcaaatgtgaaatctgtaataagcgctacctgcggtag

SEQ ID NO: 247273 - DNA, 2121 bp, Artificial Sequence
  Description of Artificial Sequence: Synthetic coding sequence
atggccctcccatccccccaggtgctcatgggcctcccagcattactaatgggacctgcgcaacacacttcttggccgtgcggtagtgccgttcccacccttaagtccatggtgacctttgaagacgtcgctgtgtacttctcgcaggaggaatgggagctgctggatgccgcacagaggcacctttatcactcggtgatgctagagaacctcgaactggtgaccagtcttggaagctggcacggcgtggagggcgagggtgcccatcccaaacagaacgtgtccgttgaagtgctgcaggttcgcattccaaatgccgatccatccactaaaaaggctaattcttgtgatatgtgcggtccctttctcaaggacattctccacctggccgaacatcagggtacccagtctgaggagaaaccctacacgtgtggcgcttgtggtagagatttctggcttaacgctaacctgcatcagcaccagaaggagcactctggcggaaagccgttccggtggtataaggatagagacgcccttatgaaaagcagcaaagttcacctgtccgagaatccattcacctgcagagaaggcggaaaggtgatcctgggcagctgtgacctgctccagctgcaggcagtggatagcgggcagaagccatattcaaatctgggtcagctgcccgaggtgtgcaccacacaaaaattgttcgagtgttccaactgcggcaaagcttttcttaagagctccaccctgccaaaccacctgcgcactcacagcgaagaaatcccttttacatgcccaactggtggcaacttcctcgaggagaaatcaattctgggaaacaaaaagttccatactggcgagatccctcacgtgtgcaaagagtgtggtaaggcgtttagccacagcagcaagctgcgtaaacatcagaaattccatactgaggtgaagtattatgagtgcattgcatgcggcaaaacatttaaccacaagctaacttttgtccatcaccaaaggatccatagcggagaaaggccttacgaatgtgacgagtgcgggaaggccttctcgaatcgatcgcacctgatacgccacgaaaaagtccatacgggcgaaaggcctttcgaatgtctgaagtgtggacgcgctttttcacagagcagcaactttctacgccaccagaaagtgcatactcaggtgcgaccttatgagtgctcccaatgtggaaaaagcttcagtaggagttcggccttaatccagcactggagggtacataccggcgagcgaccatatgagtgctctgaatgcgggcgagccttcaataataattcaaacctggcacagcaccaaaaagtgcacaccggagaaagacccttcgaatgcagcgaatgcggaagagattttagccagagcagccatctcttgcgccaccaaaaggttcacaccggggagaggccatttgaatgttgtgattgcggaaaagcattttctaattcaagcacactgatacagcaccaaaaagttcatacagggcagaggccttacgagtgttctgagtgccggaagtcattctcccggtcttctagcctcattcaacactggcggatccatacaggcgaaaaaccctatgaatgtagtgagtgtggcaaggcttttgctcacagttctaccctcatcgagcattggagggtgcacactaaagaacgcccatacgaatgtaatgaatgcggaaagttttttagccagaactccattctgatcaaacatcagaaagtacacactggcgaaaaaccttacaaatgctctgagtgtggtaaattcttcagccgtaaaagttcattgatctgtcactggagggtacatactggggagagaccttatgaatgttccgagtgcggaagagctttttctagtaattcacatcttgtgcgtcaccagagggtccacactcaggaacgtccctatgagtgcatacagtgcgggaaggccttctccgaaagatccacactggtgagacaccagaaagtccacactcgggaacgcacgtatgagtgctcccagtgtgggaagctgttcagccacctgtgtaacctggcacaacataagaagatccatacctag

SEQ ID NO: 247274 - DNA, 1191 bp, Artificial Sequence
  Description of Artificial Sequence: Synthetic coding sequence
cctacacttaagagtatggttacattcgaagacgtggctgtctacttctcccaggaggaatgggaactcctcgatgcagctcagaggcacctttaccattccgttatgctcgagaacctcgaactggtgacttccctggggaacgccctgagccaacatgtgtgtttgttccccatagagagttcagtacatcctaaggcccgatcttgggtcctcctgcctagtagggtgagttgttgtaggtgctggggggctgaggtattattaggagttgagggtgagggggctcatcctaaacagaacgtgtctgttgaggttctacagcaccaaaaggagcacagtggtggaaagccgtttaggtggtataaggatagttccgggcagaagccatacagcaatctggggcaacttcccgaggtgtgtactacccaaaaactcttcgaatgtagcaactgtggtaaggcctttctgaaatcttcaactttgcccaatcatttacgaacacactccgaggagatccctttcacatgccccaccggcggtaatttcttagaagagaagagcatcctaggtaacaagaaatttcatacaggtgagattccgcatgtgtgcaaagagtgcggaaaggctttcagccattcttctaagctccggaagcatcagaagtttcatacagaggtccgtccctatgagtgttcccaatgcgggaagagttttagtcggagtagcgccttgatacagcactggaggatacacacgggcgagaagccatacgagtgctcagagtgtgggaaagcatttgctcactcctccacgctgatcgagcactggcgtgtccataccaaagaacgcccatatgaatgtaacgagtgcggcaagtttttctcccagaatagcatcttaatcaaacatcagaaagtccacacgggcgagaagccctacaaatgttccgagtgtggaaagtttttctctcggaaatcatccttaatatgccactggagagtccataccggagaacgcccatatgagtgttccgaatgtggcagagcattctcctccaattcgcatctggtaaggcatcaacgcgtgcatacgcaagaaaggccctacgaatgcatccagtgtggcaaggctttttccgagcgcagcacactggtgcgacaccagaaggtgcacactagggagagatag

SEQ ID NO: 247275 - DNA, 1965 bp, Artificial Sequence
  Description of Artificial Sequence: Synthetic coding sequence
atggcttttcgagatgtggccgtggatttcacccaagacgagtggcggttgctttcacccgctcagcggaccctttacagagaggtgatgctcgagaactatagtaacctcgtctccctcggaatttctttttccaaacccgagttgattacacagttagagcagggcaaggaaacttggcgggaagaaaagaagtgttcccccgctacatgtcctgcagatcccgaaccagaactctacctggatcctttctgtcccccagggttctcatctcagaagttccctatgcagcacgtcctatgtaatcacccaccatggatctttacctgtctctgtgccgagggcaacattcagccaggagaccctgggccaggtgaccaggagaagcaacaacaagcctctgaagggagaccttggagcgatcaggcagaggggcctgaaggtgagggagcaatgccgttgttcggacggacgaaaaagaggacgctgggggctttttctcgaccaccacagaggcagccagtttcatcccgaaacggactacggggtgtggaacttgaagcttctcctgctcagtccggaaatcctgaagaaaccgataagctcctgaagaggatcgaagttttggggtttggaaccgtcaactgtggcgaatgcggacttagcttctccaagatgacaaatttgcttagtcatcagagaatccatagcggagaaaagccctatgtttgcggtgtttgtgagaaggggttttccctgaaaaagtcattggcacggcatcagaaggcccacagtggcgagaaaccaattgtgtgtagggagtgtggaaggggatttaacaggaagagcaccctaatcatccacgagaggacccacagcggagagaagccctacatgtgctccgagtgcggtagggggttcagtcagaagtcaaacctgattattcaccagcgaactcattccggcgagaaaccgtacgtgtgtcgcgaatgcggcaagggattctcacagaaatccgccgtggtccggcaccaacgcactcacctggaggaaaagacgatcgtctgttcagattgcgggctcggattctctgataggagcaatctgatcagccaccagcggacacacagtggtgaaaaaccttatgcctgcaaggaatgcggcaggtgcttccgacagagaaccacactcgttaatcatcagcgcactcatagcaaggaaaaaccttatgtctgcggcgtctgtggccattctttctctcagaatagtactctgatatctcaccggagaacgcacacaggagagaaaccttatgtgtgcggagtgtgtgggaggggtttcagtttaaaatcccacttaaacaggcatcagaatatccacagtggcgaaaaaccaattgtgtgcaaagattgtggcagaggcttctcccagcagtcaaatctgatcagacaccaacggacccacagtggcgaaaagccaatggtgtgtggggagtgcgggagggggtttagtcaaaaaagcaatctcgtggcccaccaaagaactcattccggcgagaggccctatgtttgtcgcgaatgcggtcgtggctttagtcaccaggccggtctgattagacacaaaagaaaacactctagagagaagccatacatgtgccgccagtgcggactgggatttggtaataagagcgctctaataacacacaaaagagcccattccgaagagaagccctgtgtgtgtagggaatgcggtcagggcttcctgcagaagtcccaccttaccctgcatcagatgacccacactggcgaaaagccttatgtatgcaagacttgcggcaggggttttagcttaaaaagtcatctgtccaggcacaggaagactaccagcgtacaccatcggctgcccgtccagcccgatccagagccctgcgcaggccagccatcagatagtctttatagtctctag

SEQ ID NO: 247276 - DNA, 300 bp, Artificial Sequence
  Description of Artificial Sequence: Synthetic coding sequence
atggcttttagagacgtcgcggtggacttcacacaggacgagtggagactattgtcaccagctcagcggaccctctaccgtgaggttatgctggagaattactctaacctggtttctcttgggatttctttcagcaagcccgaattgatcacacaactcgagcagggaaaggagacttggcgggaagagaagaagtgcagcccagccacctgtccagaccatcaggaatatggaaacaattgtgatctgcaaaaagaggccgaccctgagccagagctgtatctggatccgttctgttag

SEQ ID NO: 247277 - DNA, 1962 bp, Artificial Sequence
  Description of Artificial Sequence: Synthetic coding sequence
atggcttttagagacgtcgcagtggatttcactcaggacgaatggagactcttgtctcctgctcaaagaacactgtatagggaggtgatgttggagaactattcaaatctggtttctttgggtatcagtttctcaaagcctgaactaatcactcagctggaacagggtaaagagacctggagggaggaaaaaaagtgtagcccagccacttgccctgaccctgagcccgaactctatctagacccattttgccctccaggctttagctctcaaaagtttcccatgcaacacgttctgtgcaatcatcctccatggattttcacttgtctgtgtgccgaaggtaatatacagcctggtgaccccggacccggagaccaggagaagcagcaacaggcctcggaaggccgaccttggagcgatcaagctgagggccctgagggcgagggagcaatgcccttgtttggtcgtactaaaaaaagaaccctgggggctttctcaagacccccacagaggcagccggttagcagccggaacggtttaaggggagttgagttggaagcatcacccgcacagtctggaaatccagaggaaaccgacaagcttctgaagagaattgaggttctcggattcggcacagtgaattgcggcgagtgcgggcttagcttcagcaagatgacgaacttactgtcccaccaacgaattcacagcggggagaaaccttacgtctgcggagtatgtgagaagggattttcattgaagaagtccttagctaggcaccagaaggctcactccggcgaaaaaccaatagtgtgcagggaatgtggaagggggttcaacagaaaatcaaccctcataattcatgagcggacccatagtggagaaaaaccatacatgtgctcagaatgtgggaggggcttcagtcagaaatccaacctgatcatccatcaaaggactcacagtggggaaaagccttatgtctgtcgtgaatgcggtaaggggttctctcagaaaagcgctgtggtgagacatcagaggacacacctggaggaaaaaaccatcgtgtgcagcgactgcgggttaggcttttcagatcggtctaaccttatctcacatcaacggacccattctggtgaaaagccctatgcgtgcaaggagtgcggcaggtgttttaggcagcgaacgactctcgtcaaccaccagaggacacactccaaagagaaaccctatgtctgcggagtgtgtgggcacagcttcagccagaattcaactcttataagccaccgcagaacccacacaggcgagaagccatatgtctgtggagtgtgtggacgtggattctctctcaagtcccatcttaatcgccaccagaacatccactctggtgagaagcccatcgtttgtaaagactgcgggaggggattctcacagcagtcaaatctcatccgccatcagcgtacccactctggagaaaagccaatggtgtgcggggaatgcggcagagggttttcccagaagtcaaatctggtggctcaccaacgcacacattccggagaacggccttacgtttgtcgggagtgcgggagagggtttagccatcaggcaggcctgatcagacataagcggaagcacagccgcgaaaaaccttatatgtgtaggcagtgcggcctgggcttcggcaacaagtccgctctgattacccataaacgcgcacacagcgaagaaaagccctgcgtctgtagagaatgtggccaggggttcctgcagaaaagccacctgaccttgcatcagatgactcacacaggcgagaaaccttacgtctgcaagacctgcggccgtgggttctcactcaagtcccacctctctagacatagaaagacaacttccgtacatcacagattgcctgttcaaccggaccctgagccatgcgccggtcaaccttcggactctctctactctctatag

SEQ ID NO: 247278 - DNA, 1974 bp, Artificial Sequence
  Description of Artificial Sequence: Synthetic coding sequence
atggcccacatggcctttagggacgtcgcggtggatttcacccaagatgaatggcgcctcctaagcccggctcagagaacactgtatagggaagtgatgcttgagaactactcgaacctcgtgtctttgggcatctcattctcaaagccggaactgatcacgcagctcgaacaaggaaaggagacctggagggaagaaaaaaagtgttcacctgccacttgccctgccgatccagaacccgaactgtacctagatccgttttgcccacctggctttagcagccagaagtttccaatgcagcacgttctgtgcaaccacccaccttggatcttcacttgtctgtgcgccgaagggaacatccagcctggggatcccggtcccggtgaccaggagaaacagcagcaagcctccgagggacgtccctggagtgatcaggccgaaggccctgagggcgagggcgcaatgcccctgttcgggaggactaagaagcggaccctcggagccttctcccgcccaccacaaaggcagcccgtcagctcccgcaatggactgaggggcgtggagttagaggcaagccctgctcagtctggcaatcccgaagagaccgataagctcttaaaaaggatcgaggtgttaggatttgggacagtaaactgtggagagtgcggcctgtctttcagcaaaatgaccaaccttctctcccaccagcggattcattccggggaaaagccatatgtgtgtggagtgtgcgagaaggggttttcactgaagaagtccctcgcacggcatcagaaggcacactctggagaaaagccaatagtgtgtagagaatgcggccgtgggtttaataggaaatccacactgataattcatgagcgtactcactctggggagaaaccctatatgtgctccgagtgtggcagaggcttctcacagaagtcgaacttgatcatccaccagcggactcattctggagagaagccctacgtctgcagagagtgtggcaaaggtttcagtcaaaaaagtgctgtcgtgcgccatcagagaacacatctagaggagaagacaatcgtctgctctgattgtggtctagggtttagcgaccggtcgaatctgatctcccaccaacgtacccactcaggcgaaaagccatatgcctgcaaagagtgcggcaggtgtttccgtcagcggaccacactcgtcaaccaccaacgcacccactccaaagaaaaaccatatgtgtgtggtgtctgcgggcactccttcagccagaattctactttaatatcacatcgtagaacccataccggcgaaaaaccatatgtttgtggtgtatgcggaagagggttcagcttaaagtctcacctgaaccgccatcagaatattcattctggggaaaagcccattgtctgcaaagattgcggccgtggtttcagccagcagagtaatctaatccggcatcagagaacccattcaggagaaaaacctatggtgtgcggcgagtgcggccgtggatttagccagaagagtaacctcgtcgcccaccagcgcactcacagtggagaacgcccttacgtgtgccgcgaatgtggaagagggttctcacaccaggcgggactcatccgacacaagcggaaacacagccgtgaaaaaccatatatgtgccgacagtgcgggttgggatttggaaacaaatctgcgttaatcactcataaacgtgctcactctgaagaaaagccatgcgtttgccgtgagtgtggtcaaggctttctccagaaatcccatctgaccctccatcagatgacacacactggagagaaaccatacgtgtgtaaaacatgtgggagagggtttagtctgaaatcccatctgtcgagacatcgcaaaaccacgtcagtccaccataggcttcccgtacagcccgatcctgagccatgcgcgggacaaccttctgattccctgtattctctatag

SEQ ID NO: 247279 - DNA, 1965 bp, Artificial Sequence
  Description of Artificial Sequence: Synthetic coding sequence
atggctttccgcgatgtcgctgtggatttcacacaggacgagtggcgtctgctttctccggctcaacggacactgtacagggaagtgatgcttgaaaactacagcaatctggtctccctcggaatttcatttagcaagcccgagctcattacacaactggaacagggaaaggaaacatggagagaggagaagaagtgcagtcccgctacatgtcctgctgatcctgaaccagagttatatctcgacccgttttgtcccccagggttttcctcacaaaagttcccgatgcagcatgtcctctgtaatcaccctccatggatcttcacatgtctctgcgcagagggtaatatacagcctggagatcctggtccaggggaccaggaaaaacagcaacaggcttccgaagggcgaccctggagcgaccaagcggaaggccctgagggagagggagctatgccattattcggacgcactaagaaaagaactttgggcgcattttcccgacccccacagagacaacctgtgagttctcggaatggcctgagaggagtcgagctggaggcatcccctgcccagtcaggcaaccccgaggaaaccgataagctgttgaagcgcatagaagtgctcggatttggaacagttaattgtggtgaatgcggcctctccttcagtaagatgactaatttacttagccaccaacgcatccacagcggggaaaaaccgtatgtatgtggcgtgtgcgagaagggattttctctaaaaaagtccctggccagacaccagaaggctcacagcggtgagaagcccattgtttgtagggaatgtggtcgcggatttaatcgcaaatcaactctgattattcacgagaggactcacagcggcgagaaaccctacatgtgcagcgaatgcggtcggggttttagccagaaaagcaatctaataattcaccagaggacccattcaggtgagaaaccgtatgtttgcagagaatgcggcaaaggattctcccagaagtccgcagtagtgcgccatcaacggactcacttggaggagaaaacaatcgtgtgctccgactgtgggctcggattctctgaccgatcaaacctgatcagtcaccagcgcacccactcgggagaaaaaccatatgcttgcaaggaatgtggcagatgcttccgccagcggactacactcgttaaccaccagagaacacatagcaaggagaagccatatgtgtgtggagtgtgcggccacagcttttcacagaattccactctgatttctcaccgacgtacccatacaggggagaaaccttatgtctgcggcgtgtgtggaagggggttctctttgaagagccacctgaatcggcaccaaaacatacactctggcgaaaagcctattgtctgcaaggactgcggcaggggcttttcacagcaaagcaatctcattcgtcatcagaggacccacagtggcgagaagcctatggtgtgcggggagtgcggcagagggtttagccagaagagtaacctcgtggctcatcaaagaacgcacagcggtgagaggccttatgtatgccgcgagtgcgggagaggattctctcatcaagccggattaattagacacaagaggaagcactcaagggagaaaccctatatgtgccggcagtgtgggctgggatttggaaacaagagcgccctgattacccataagagggcacattctgaggaaaaaccctgcgtctgccgcgaatgcggccaggggttcctgcaaaaatctcacctcaccctgcatcagatgactcacaccggtgagaagccttacgtttgtaaaacctgcggcaggggattctccttgaagtcccacctgtcacgccatagaaagacaacttcggtgcaccatagacttcccgtgcagcccgatcctgagccctgcgcaggacagccgtcagattctttatactctctgtag

SEQ ID NO: 247280 - DNA, 1776 bp, Artificial Sequence
  Description of Artificial Sequence: Synthetic coding sequence
atgtgcaacggtagaaagacagtactcgcagacccggagcctgaactgtacttggatccgttctgtccgccaggattttcaagtcagaaatttcccatgcagcatgtattgtgcaatcaccccccttggatctttacttgtctgtgtgctgagggcaatattcagccaggagaccctggtcctggggaccaggaaaagcaacaacaggcttcggaggggaggccctggtccgatcaggcagaagggccagaaggagagggcgcaatgccactgttcggccgaacaaaaaagcggactctaggggctttcagccgacccccacagagacagccagtttcaagccgcaacggactgcggggtgtcgagctggaggctagtccggcacagagcgggaatcctgaagaaacagacaagctgctgaagcgcattgaggtgctgggcttcggcaccgtgaattgcggggagtgtggcttgtcgttttccaaaatgactaacttgctgtctcaccagcgtattcatagtggcgagaagccctacgtttgcggcgtctgtgaaaaaggattctcactgaaaaaatccttagcccgacaccaaaaggcccactctggcgaaaagcccatagtgtgtcgcgaatgtggacgaggctttaaccggaagagtaccctcataatccacgagagaactcactcaggggaaaagccttacatgtgctccgagtgtggacgcggattttcccagaagagcaaccttataattcaccaacgtacccattctggggagaaaccttacgtgtgtcgggaatgtggcaaagggtttagccaaaaatccgccgtggtgagacaccaaaggacacacctggaggaaaagacaattgtgtgcagcgactgcgggcttggtttttcggacaggtcaaacttaatctcccatcagagaactcacagcggagaaaaaccctacgcctgtaaggagtgcggtagatgctttcgtcagcgcaccacacttgtgaatcaccaacgaactcatagcaaggagaagccatatgtttgcggagtctgtggccactctttcagtcaaaatagtaccctgatttctcatcgtaggacccacactggcgagaagccatacgtttgcggagtatgcggtaggggcttctcccttaaaagccatctgaatcggcatcagaatatacactcgggtgagaagccaattgtgtgcaaagactgtggccgtggtttctcccaacaatctaacctgatccggcatcagagaactcacagcggagagaagcccatggtgtgcggcgaatgcggccgtggcttctctcagaaaagcaaccttgtggcccatcagcggacccactccggagagcgcccttacgtttgtcgcgaatgcggacggggatttagtcatcaggcaggccttattcgtcacaagcggaaacatagtagagaaaagccatatatgtgccggcagtgtggactgggtttcggtaacaaaagcgccctcatcacacataagagggcgcatagtgaagagaagccatgtgtgtgcagagagtgcggacaggggttcttgcagaagagccatctcacactgcaccagatgacacacacaggagagaaaccatacgtgtgtaaaacttgcggtaggggattctccctgaagtcccatttgtctcggcatcggaagacgacttctgtccaccataggctccccgttcagccagatcctgagccatgtgctgggcagccttccgattcattatacagcctgtag

SEQ ID NO: 247281 - DNA, 540 bp, Artificial Sequence
  Description of Artificial Sequence: Synthetic coding sequence
atggcatttcgggacgtagccgtggattttactcaagatgagtggcgactactgtcccctgctcagcgtacactctaccgcgaggtaatgctggaaaactacagcaatctggtgtccttgggtatatcgttcagcaagccagaattgattacgcagttagagcaggggaaagagacttggcgggaagaaaagaagtgtagccctgctacatgcccggcagacccagaaccggaattgtacctggatccgttttgcccccctggcttctcctcacagaagtttccaatgcagcacgtgctctgcaatcacccaccttggatttttacttgtctctgcgccgaaggtaacatacagcctggagacccaggtcctggagatcaggaaaaacagcagcaagcttcggagggaagaccttggtccgatcaagctgaaggtcctgagggagagggagccatgcctctctttggacggacaaagaagcggacactgggggcattctctcgcccacctcaaagacagcccgtatcctcccgtaactag

SEQ ID NO: 247282 - DNA, 432 bp, Artificial Sequence
  Description of Artificial Sequence: Synthetic coding sequence
atggccttcagggacgtggccgtcgactttacccaagatgagtggaggcttttgtcccctgctcagagaacactttatcgtgaagttatgctggaaaactacagcaacttggtgagcctgggaatttccttttccaagcccgagctgattacccagctggagcagggcaaagagacatggagagaggagaaaaagtgttcaccggcaacatgtccagcagatcccgaaccggaactttacctggacccattttgccctccaggcttctccagccagaaatttcccatgcagcacgttctgtgtaaccatccgccttggatctttacatgtctgtgcgccgaaggcaatatccagccaggcgatcctggcccaggagaccaggagaagcagcagcaagcctcagaaggccgtccctggtctgaccaggcctag

SEQ ID NO: 247283 - DNA, 1680 bp, Artificial Sequence
  Description of Artificial Sequence: Synthetic coding sequence
atgcagcacgtgctctgcaatcacccaccctggatattcacctgcctttgtgccgagggcaacattcagcccggagatcccggtcctggtgaccaggaaaagcagcagcaggcttctgaaggtcggccatggtcagaccaggcagagggcccagagggtgagggcgctatgccgttatttggtcgcactaagaaacgaactctcggcgcattctcaagacctcctcagaggcagcctgtgtctagtcggaatggtctgaggggcgtcgaactcgaggcctcacccgctcagtctggcaatccggaggaaacggataagctcctgaagcgaatcgaggtgctgggattcgggaccgtcaactgcggcgagtgtggcctcagtttctctaaaatgactaatctactgtctcatcagcggattcactcaggtgaaaaaccatatgtgtgtggcgtgtgcgagaaggggtttagcctgaaaaaaagccttgcacgacatcagaaggcccacagtggtgagaagcctatcgtctgtagagagtgcggtagggggtttaataggaagtcgacattgatcatccacgagcgtacacattctggcgaaaaaccatacatgtgtagcgagtgcggcaggggcttctctcagaagtccaatctgattatccaccagcggacacactccggcgaaaaaccctacgtatgcagggaatgcgggaagggcttctcccagaagagcgcggtagtgcgccatcaaaggacgcacctggaagagaagactattgtgtgtagcgattgtggacttggtttttcagacagaagtaacctgataagccatcagcgcacccatagcggagagaagccctacgcctgcaaagaatgtggcaggtgcttccgccagcggacaaccctggtgaatcatcaacggacccattccaaggaaaaaccctacgtctgtggagtctgtgggcatagcttctcacagaacagtacgttgattagccatcgcagaactcacacgggggaaaagccctatgtgtgcggagtatgtggtagaggattctctttgaagagtcacctaaatcgccaccagaatatacacagcggggagaaacccatcgtgtgtaaagattgtggacggggattctcccagcagtctaacttgattcgacaccaacgaacccactccggggaaaaaccgatggtctgcggcgaatgtggccgagggttctctcaaaaaagcaatctcgttgcgcaccagcggacacattctggcgaaaggccttacgtgtgccgcgagtgtgggcgagggttctcacaccaagcaggtctgatcagacacaagagaaaacatagccgggaaaagccttacatgtgccgccagtgtggcctagggtttggcaacaagtccgcccttattacacacaaacgtgcccactccgaggaaaaaccttgcgtctgtcgcgagtgtggccagggtttcctccagaagagtcacctgacattgcaccagatgactcataccggcgagaaaccctatgtgtgtaaaacttgtggacgtggattctctctcaagagccatttgtcccgacatagaaagactacctcggtgcaccaccgcttgcctgtacagccagatccagaaccatgcgccggacaaccctctgatagtctgtattctttgtag

SEQ ID NO: 247284 - DNA, 1680 bp, Artificial Sequence
  Description of Artificial Sequence: Synthetic coding sequence
atgcagcatgtgctctgtaatcacccaccatggatcttcacgtgtctgtgcgcggagggaaatatacaacctggggatccaggacctggcgaccaagagaagcagcagcaggcctcagagggacgcccatggagcgatcaggcagagggacctgagggcgaaggcgctatgccgctgtttggacgaactaaaaagcgcacacttggggcattctcacgcccacctcagagacagcccgtgtctagtcggaacggattgcgcggagtagagttagaggccagccccgcacaaagcggaaatcctgaagagactgacaagctgcttaagagaatcgaggttctggggttcggtactgtcaattgcggtgaatgtggcctctcctttagcaagatgaccaacctgctgagccatcagcgcattcattctggggaaaagccatatgtttgtggtgtctgtgaaaagggcttctctctcaagaagtctttggcgaggcaccagaaagcacatagcggcgaaaagccaatcgtttgcagagagtgcgggaggggattcaacaggaagagtactttgataattcatgaacggacccactctggcgaaaagccttatatgtgcagcgagtgtggaaggggattctcacaaaaatctaacctcattattcaccaacgaacccattccggggaaaagccatatgtctgtagggaatgtgggaaagggttcagccaaaagagcgccgttgtgcggcatcaaagaactcatctcgaggaaaaaacgatcgtatgctccgattgcggtctaggcttcagcgataggtccaacttgatcagccatcagagaacacatagcggcgagaaaccatacgcgtgtaaggaatgtggcagatgcttccgccagagaactactctggtgaatcatcagcgaacccactccaaagaaaagccatacgtgtgtggggtgtgtgggcatagtttctcccagaatagcaccctcatatcacatcggagaacacatacaggggaaaagccctacgtttgcggcgtctgcggcagaggtttttcgctgaagtcccatctgaatcggcaccaaaatatccatagtggagagaaaccaatcgtgtgcaaagactgcggtcgcggtttttctcaacagtcaaacctcattcggcaccagaggactcatagtggcgagaagccgatggtatgcggagaatgtggtcggggattctcccagaagagcaacctggtggcgcaccagcgtacacactccggagagcgcccttacgtgtgtcgtgagtgtggtagagggttttctcaccaggctggcttgatcagacacaaaaggaaacattctagagaaaagccctatatgtgtagacaatgtgggctgggtttcggaaataaatctgcactgatcacccataagcgtgcacattcagaagaaaaaccatgtgtgtgtagggaatgtgggcagggattccttcagaagagccacctgacgctacaccaaatgacccataccggcgagaagccctacgtgtgcaaaacttgtggtaggggcttttcgcttaaatcgcacttatctcgccaccggaagacgacatccgttcaccacaggcttcccgtgcagcctgatcctgagccttgtgccggacagcctagcgacagtctgtacagtctctag

SEQ ID NO: 247285 - DNA, 1284 bp, Artificial Sequence
  Description of Artificial Sequence: Synthetic coding sequence
atgaccctggtcaccgcgggtggggcatggaccggccctggttgttggcacgaagttaaggatgaggagagttcatccgagcagagtatcagtatcgccgtgtcacacgtcaacactagcaaggccggactcccggcacagactgcattgccatgcgacatttgcggacccatcttgaaagacattttgcacctcgacgaacaccagggaacgcaccacgggctaaagctgcatacctgcggagcatgtggtcggcagttctggttttccgcaaacctgcaccaataccagaagtgctactcaattgaacagcctctccgacgggataaatctgaagcctccatagtgaagaattgcactgtatcaaaagagccacacccatcggagaagccgttcacatgcaaggaggagcagaagaactttcaggcaactctgggcggttgtcagcagaaggctattcactcaaagcgaaagactcaccgaagcacagagagcggagacgccttccacggagaacagatgcactataagtgcagcgagtgcggaaaagctttctcccgaaaagacaccctcgtgcagcaccaacggatccattctggagagaagccatacgaatgctccgaatgcgggaaagccttctctcggaaagctaccctcgtgcagcatcagcgtattcataccggcgaacgaccttatgaatgcagtgagtgtggcaagacgttttctcgaaaggacaatctaacccagcataaacgtattcacaccggcgagatgccctacaaatgcaacgagtgcgggaaatatttttcccatcactcaaacctcattgtccaccagagagttcacaacggggctcgcccttacaaatgctctgactgtggtaaagtctttaggcacaagtccacactggtgcagcacgaaagtattcacacaggcgagaatccttacgactgtagcgactgtggcaaaagtttcggccacaagtatacccttataaaacatcagagaattcacacagaatccaaaccgttcgaatgcatagaatgtgggaaatttttctctaggagctctgactatatcgcacaccagagggtgcatacaggtgaaaggcccttcgtgtgttccaagtgtggcaaagatttcattcgaacctcgcatctggtgagacatcagcgagtgcatacgggagagcgcccatatgaatgtagcgagtgcgggaaagcatattcactcagttctcatctgaatcggcatcagaaagtacacacagccggacgactctag

SEQ ID NO: 247286 - DNA, 1485 bp, Artificial Sequence
  Description of Artificial Sequence: Synthetic coding sequence
ctgcggtggaaccacagaagcagaagctcaggtctccttggaggctccgaggtgacggaagccggaggctgtgggagaagcagatgttctctgtgcggagtggccagacaacgccgaccaaggctacgtccacgtgggaggacgactgcagttcctggctcaagggatctgggcccacctcgcggatccggctggtccacaaattgtgacggcggtggccgaggcgatggtcccggagccggatgctggcatgaggtcaaagacgaagaatccagctccgaacaatcgatatctatcgctgtgagccacgtcaatacgtctaaggctggcctacctgcgcagaccgccctcccctgcgatatttgcgggccaatactgaaggacatccttcatctggacgagcatcagggcacacaccacggactgaaactccacacatgtggggcttgcggccgacaattctggttcagtgcgaaccttcaccaatatcagaaatgctactccatcgagcagcctttgagaagggataaatccgaggcctctatcgtcaagaactgcacggtttcaaaagaaccgcatccctctgagaagccgtttacctgtaaagaagagcagaagaactttcaggcaacactaggcggatgtcagcaaaaagctatccactcgaagcgcaagactcaccggtctacagagagcggggacgcctttcatggcgaacagatgcactataaatgtagcgaatgtggaaaagcctttagtcggaaagacactttggtgcagcatcagcgaattcactctggagagaaaccatatgaatgcagcgaatgtggcaaagcattctctcgtaaggctaccctagtgcagcaccaaagaatccacactggagagagaccttatgaatgctccgaatgtggtaagacctttagccggaaggacaaccttacccagcacaagaggatccacaccggtgagatgccttacaagtgcaacgagtgtgggaaatatttctcccatcacagcaacctcattgtgcatcagcgtgttcacaatggggctagaccctacaaatgctctgactgcggcaaagtgttccgtcacaagtcgactttggtgcagcatgagagtattcacacaggagaaaacccttacgattgtagcgattgcggtaaatcattcggccacaaatacaccctaataaagcaccagcggatccatacagagtccaaaccattcgagtgtattgaatgcgggaagttctttagccgcagctccgactatatcgcccatcaaagggtccacacaggggagcgcccattcgtctgctcaaaatgcggtaaagatttcattaggaccagccacctcgtcagacaccaacgagtgcacaccggggagcggccatatgagtgtagcgaatgtggcaaagcatattcacttagcagccacctgaaccggcaccaaaaggtgcacaccgcaggcagactctag

SEQ ID NO: 247287 - DNA, 1044 bp, Artificial Sequence
  Description of Artificial Sequence: Synthetic coding sequence
atgtgggggatgtgggagaccattctcgtgcagtgcctgcatcaatatcagaaatgctatagcattgaacaacctttaaggcgggacaaatccgaagctagcatcgtgaagaattgtacagtctcgaaggaacctcatccctctgaaaaaccatttacatgtaaggaggaacaaaaaaattttcaggccaccttgggcggatgccagcagaaggcaatacactctaaacgaaaaacccatcggtccactgaaagcggagacgcatttcacggcgagcagatgcattacaagtgtagcgagtgcgggaaggccttcagcaggaaggacacactcgtccagcaccagcggattcatagtggggagaagccatatgagtgttcagagtgtgggaaggccttttccaggaaggccactctggtccagcatcagcgtattcacaccggtgaaagaccgtatgaatgttccgaatgcggcaagacctttagccgcaaggacaacctgactcagcataaaagaatacacactggcgaaatgccttacaagtgtaatgaatgtgggaaatatttctctcaccattcaaatctaattgttcatcagcgggtgcacaatggtgcccgtccttacaagtgttccgactgtgggaaggtgtttagacataagtcaaccctcgtgcagcatgagtctatccacaccggcgagaacccctatgactgtagtgattgtggaaaaagctttggtcataagtacacactcataaaacatcagcgaattcacacggagagcaagcccttcgaatgtatcgagtgtggaaagttctttagtcggtcgagtgattacatagcccaccaaagggtgcacacgggtgagaggccattcgtgtgcagcaaatgtggaaaggacttcattcgtacatcccatcttgtgagacaccagcgagttcataccggggagagaccatatgagtgctccgaatgcgggaaagcctatagtctgagtagtcatctgaacaggcaccagaaagttcacactgcgggtagattatag

SEQ ID NO: 247288 - DNA, 1977 bp, Artificial Sequence
  Description of Artificial Sequence: Synthetic coding sequence
atgactcccggagtacgcgtctctacagatccagaacaagtgacatttgaggacgtggtggtgggtttcagtcaggaggagtggggtcagcttaaaccagctcagcgtacactctaccgagatgtgatgcttgacacattcaggttgttagtcagcgtgggtcactggctgcccaagccaaacgtgatctcacttctggaacaggaggcagaactgtgggccgtggaatcccgcctaccccagggcgtgtatccagacctggagacacgccctaaggtcaaactcagtgttctcaaacagggtatcagcgaagaaatttcaaacagtgtgattttagtggaacgttttctgtgggatggactatggtactgcaggggtgaagatacagaagggcactgggagtggagctgtgagagtttggagagcttggctgtgcctgtggccttcactcccgtcaagacgccagtcctcgaacagtggcagagaaacggattcggtgaaaacatcagcctcaatccagatttgcctcatcagccaatgacgcccgagaggcaatctccacacacttggggaactagagggaagcgcgaaaagcccgatctgaatgtcctgcagaagacctgtgttaaggaaaaaccttataaatgccaggaatgcggcaaggcatttagccactcttcagccttgatcgaacaccaccgaacacacactggcgaacgaccttatgagtgccatgagtgtctgaaaggcttcaggaactcttctgcgttgaccaaacaccagcgtatccacacgggggaaaagccctacaaatgcacacagtgcggacgcactttcaatcaaatagctcccctgatccagcatcaaagaacccacacaggtgagaaaccttacgagtgctcagaatgcggaaaatcttttagcttcaggtctagcttttcccagcacgaacgtacacacacaggcgagaaaccttacgagtgcagcgagtgcggcaaagcctttcgccagagcatccacctgacacagcatttgcgtattcataccggcgagaaaccttaccagtgcggagagtgcgggaaggccttttcccattcatctagcttgacgaagcatcagagaatacacactggagaaaaaccttacgaatgtcacgagtgtgggaaggcctttacacagatcacccccttaatccagcatcaaagaactcacactggtgagaagccatacgaatgcggggaatgtgggaaggccttttcccagtccaccttacttactgaacacaggagaattcataccggggagaagccatatggatgcaacgagtgtggtaagacattctcccattcatcctccctttcacagcacgaacgtacgcacactggtgagaaaccgtacgagtgttctcagtgtggaaaggccttccgacagtctactcacctgacacaacatcagcgtattcacacaggcgagaagccttacgaatgtaatgactgcgggaaagccttcagccactcatcatcactgacgaagcatcaaagaatacacacgggcgagaaaccttatgagtgtaatcagtgtggcagggcattcagccaactggcacctctcatccagcatcagaggatacatacaggtgagaaaccatatgagtgtaaccagtgtggccgtgcctttagtcaaagcagtctcctcatcgagcatcagaggattcatactaaggagaaaccatacggatgcaatgagtgcgggaagagttttagtcacagctccagcctgtctcaacatgaacgaacacacaccggcgagaagccttacgaatgccacgactgcggaaaaagtttcagacaatctacccatttaacgcaacaccggcgaatccacaccggagagaagccctatgcttgccgtgattgcgggaaggcttttacacactccagtagcctcacaaaacaccagagaacccatactgggtag

SEQ ID NO: 247289 - DNA, 1173 bp, Artificial Sequence
  Description of Artificial Sequence: Synthetic coding sequence
atggagctgggtagtagacggagaagcgtcgggtgccggtgtcggggactgtgcttggcggttcgaagggagcaagttacatttgaggatgtggttgtggggtttagccaagaagagtgggggcaacttaaacccgctcagagaacactctaccgagacgtgatgttggatacctttagactcttagtatctgtcggacactggctgcccaagcccaacgtcatttcgcttctggagcaggaagccgaactatgggctgtagagagccgcctcccccaaggtgtgtaccccgacctggaaacacgaccgaaggttaagctgtcagtgctgaagcagggcatctctgaggagatatctaacagcgtgatactcgtcgaacgatttctttgggatggtctgtggtattgcagaggagaagacactgagggacattgggagtggtcctgcgagtcactggagagcttggcagtgccagtcgctttcactcccgtaaaaaccccagttttggaacaatggcaacggaacgggtttggagagaacatttccctgaatccagacttgccacaccagcccatgactcccgaacgccagagcccacatacttggggcacccgcggtaagagggagaaacctgacctaaatgtactgcagaaaacctgcgttaaggaaaaaccatataaatgtcaggagtgcggcaaagcattcagccacagcagcgccttaatcgagcaccacagaacacacactggagaaaggccctatgagtgccacgagtgcttgaaaggattccgaaactcttccgcactcacaaagcaccaacggattcacacgggcgaaaagccctacaagtgcactcagtgcggccgtactttcaaccagattgcccctctgatccagcaccagcgaacccacaccggtgagaagccttatgaatgctcagaatgtggaaagtcattctccttcagatcctcattttcacagcatgagcgtacgcatacgggagaaaaaccctatgaatgttctgaatgtggtaaagcttttaggcagagcatccatctgactcagcacttgaggatccatactggagagaagccctaccagtgcggggagtgcggcaaagcattcacacactctagctccctcactaagcaccagagaactcacaccgggtag

SEQ ID NO: 247290 - DNA, 2049 bp, Artificial Sequence
  Description of Artificial Sequence: Synthetic coding sequence
atggagctaggtagtcggaggaggagcgtgggctgtcgttgccgaggattgtgtcttgccgtaagaagagagcaagtgacctttgaggacgttgtcgtgggcttctcccaagaggaatgggggcagctgaagcctgcccagaggaccctctatcgcgatgttatgttggatacatttcggcttcttgtgtcagtaggccactggctacctaagccgaacgtaatctctctactcgagcaggaagccgaattgtgggctgtcgagtcacgactcccccagggcgtttaccccgagattaaaggccatttccagttcttgctgctaagcgatctggagacgcggcctaaagtgaagctgtccgtgttgaagcaaggcatctccgaagagataagcaactcggtcattctcgtggaaaggtttctgtgggacgggttatggtattgccgcggtgaggatactgaggggcactgggagtggagttgcgagtccctcgagtcccttgccgtccctgtggctttcacccctgttaagacgcctgttttggaacagtggcagcggaatggttttggcgaaaacattagtcttaatcccgacctgcctcatcagcctatgacacccgagcggcaatccccacatacttggggcactcggggaaaaagggaaaaaccggacctaaacgtgctacaaaagacctgcgtgaaggagaaaccttataaatgtcaggaatgtggaaaggcctttagccacagctctgcactgattgagcaccatcgcacacataccggggagcgtccctatgagtgccacgagtgcctgaaggggtttaggaattcctcggcactgaccaaacatcaacgcattcacacaggagaaaaaccttataaatgcacacagtgtggacgtacctttaatcagattgccccactgattcagcaccagcgcactcataccggagaaaaaccttatgaatgtagcgagtgcggcaagagtttctctttcagaagcagcttcagtcagcacgagaggacccatacaggggagaagccctacgagtgttccgagtgtggcaaggcttttcgtcagagtattcatctgacccagcacctgcgcatacacacgggtgagaagccttaccagtgcggcgagtgtggcaaggctttcagccactcgtcaagcctaaccaagcaccagcggattcacacaggagaaaaaccctatgagtgccacgagtgcggcaaggccttcacacagatcacgcccctgatacaacaccagagaacccatactggcgaaaaaccctacgagtgtggcgagtgcgggaaggcattctcccagtccactctactgaccgagcatcgccgtatccacactggggagaagccgtatggatgtaacgaatgcggaaaaactttctctcacagtagctccctctcccagcacgagagaactcatacaggggagaagccctatgagtgtagtcagtgcggaaaggctttcaggcagagcacccacttgacacagcatcagcgcattcacacaggcgaaaaaccatatgagtgcaacgattgcgggaaggcattcagccatagcagttccttgaccaagcaccagagaatccatactggggaaaaaccatatgagtgtaatcagtgcggcagagcctttagtcagcttgcgccactcattcagcaccaaagaattcataccggagaaaagccttatgaatgcaatcagtgcggcagggctttctctcaaagttcattgctcatagagcatcagagaattcataccaaggaaaagccttatggctgtaatgaatgcggcaaaagtttctcgcacagctccagcctgtcacagcacgagcggacccataccggcgaaaagccctatgaatgtcatgactgtggcaagtcatttagacaatccacacacctcacacagcataggcgcatccacaccggtgagaagccttatgcatgccgagattgcggtaaagcattcactcattctagtagcctgaccaagcaccaaaggacacacacgggatag

SEQ ID NO: 247291 - DNA, 1977 bp, Artificial Sequence
  Description of Artificial Sequence: Synthetic coding sequence
atgacccctggcgtgagggtctccaccgaccctgagcaagtgacatttgaggatgtagtggtaggtttcagtcaggaggagtggggacagctcaagcccgcacaaagaacactctaccgtgacgtcatgctggataccttcagactgctggtatctgtaggccactggctacccaagcccaacgtgatctctctgttggaacaggaggccgaattatgggcagttgaatcccgcctgcctcagggagtgtaccctgacttggagaccaggccaaaagtaaaattgagcgttctgaagcaagggatcagcgaggagatctcaaactcagtgatcttagtggaacggtttctatgggatggactctggtactgcaggggggaagacaccgaaggacattgggagtggtcctgcgaatccctagagtcactggcagtccccgttgcctttaccccggtgaagacgcccgttctcgagcagtggcagcgtaatggctttggcgaaaacattagccttaaccctgatttaccccaccagcccatgacccccgagagacagtctccgcacacttggggtaccagaggcaaacgtgaaaaacctgacctgaacgtgctgcagaaaacttgcgtcaaagaaaaaccctacaagtgtcaggagtgcggaaaagccttctcccacagtagcgctctgattgagcaccatcgcacacacactggcgaacgcccatatgaatgccatgaatgcctgaaggggttccgaaactcttccgctctcacaaagcatcagcgaattcacacaggcgaaaaaccctataagtgtactcaatgcggacggacattcaaccaaatagcgcctctgatccagcatcagcgcacccacacaggcgaaaaaccttacgagtgcagtgagtgcggaaaaagcttttcatttaggtctagcttctcacagcacgaacgtacccacaccggtgaaaagccatacgagtgcagcgagtgtggaaaagcctttaggcagagcatccatctaacccagcacttacggattcatacaggagaaaagccgtatcaatgcggtgagtgcggcaaggcgttttcccatagcagctccctcacgaagcatcagaggatccacacgggggagaagccttatgaatgtcacgagtgcggcaaagcctttactcagatcactcctctgatccagcatcagagaacccacactggggagaagccatatgagtgcggtgaatgcggcaaagccttcagtcaatcaactcttctgacggaacatcgcaggatccacaccggggaaaagccttatgggtgcaatgaatgcggcaagactttctcacacagtagttcactgtcccagcatgagcggacacatacgggggagaagccctatgaatgtagtcagtgcggaaaagcattccgccaatcaacccaccttactcagcaccagaggatccacacaggggaaaaaccgtacgaatgtaacgattgtggaaaggccttctcacatagcagttccctgaccaagcaccagagaatccacactggagagaagccttacgagtgtaatcagtgcggacgtgcattttcacagctggcacctctgatccagcaccaacggatccacacgggtgagaaaccctacgagtgcaaccagtgtggcagggcgttctcccagtcttctctgctgatcgagcaccagcggattcacacaaaagagaaaccttatggctgcaacgagtgcgggaaaagcttttcacactcatcgtctctgtcccagcatgaacggactcatactggggaaaagccgtatgaatgccacgactgtggcaagagtttcagacagtcaacccacctgactcagcaccggaggattcacacgggggagaaaccttatgcctgtcgggattgcggaaaggcttttacgcattcttcaagtctgacaaaacatcaacgaactcacactgggtag

SEQ ID NO: 247292 - DNA, 1851 bp, Artificial Sequence
  Description of Artificial Sequence: Synthetic coding sequence
atgctggacaccttcaggctgctggtcagcgtgggacattggctcccaaaaccaaatgtgatctccttactggagcaggaggctgagctgtgggccgttgagagtaggctcccccagggcgtctaccctgatctggaaaccagacccaaagtcaagctaagtgtgcttaagcagggaatatctgaggagatctctaacagcgtgattctggtcgagcgatttttgtgggacggactctggtactgcaggggggaagataccgaaggtcactgggagtggtcctgtgaatcactggaaagtctggctgtgcccgtagcgttcaccccagtaaaaacccccgttctggaacagtggcagcggaacggttttggagagaatatatcactcaatccggatctgccacatcagcccatgactcccgagcggcagagtccccatacctggggcaccaggggaaagagagagaagcccgacctgaatgttctacagaagacatgcgtcaaagaaaagccatataaatgtcaggagtgcgggaaggcgttcagtcattcttctgccctgatcgaacatcaccgcacgcacacaggggagcgtccatacgaatgccatgagtgcctgaagggatttaggaacagctccgctctgactaagcaccagcggattcacaccggcgagaagccatataagtgcacacagtgtgggcgaactttcaatcagattgcgcctttaattcagcaccagcgtacgcatacgggggagaagccctacgaatgtagtgaatgcggaaaaagtttctccttccggtcttcattctctcagcatgagaggacacacacgggagaaaaaccttatgaatgtagtgagtgcggcaaggcctttcggcaaagcatacacctgacacagcacctgagaattcacaccggcgagaaaccctatcaatgtggtgaatgtggaaaagcttttagccactcaagcagtctcactaagcaccaacgtatacacacaggggagaaaccgtatgagtgccacgagtgcggcaaagcatttacccagatcacacccctgattcagcatcagcgcacccacaccggggagaaaccctatgagtgtggcgagtgtggaaaggctttttcacagtccacgctgctgacagaacatcggagaattcataccggtgagaagccctacggttgtaacgagtgtggcaagaccttttctcattcgagcagcctgagtcagcacgaaaggacacacaccggcgaaaagccttacgaatgcagccagtgcgggaaggcttttcgccagtccactcacctgacccaacaccagcgtatacatacaggtgagaagccatatgagtgcaatgactgtgggaaagcgttctcacattcttcatccttaacaaaacaccagcggattcatactggagagaaaccgtatgagtgtaaccaatgtggcagggcattctcacagctggcacctcttattcagcaccaaagaatccacacaggggagaagccttatgagtgtaatcagtgtgggagagcattctcccagtcttccctgttaatagaacaccagaggattcatactaaagagaagccctatggatgcaacgaatgtggaaagagcttctcccatagcagctcactctcacagcacgagagaacccatacaggcgagaaaccctacgagtgccacgactgcgggaagtcatttagacagagcactcacttaactcagcacaggaggatccatactggggaaaagccttatgcttgccgcgactgcgggaaagcatttactcatagttcatctttgacaaagcaccagcggacccatactggatag

SEQ ID NO: 247293 - DNA, 2013 bp, Artificial Sequence
  Description of Artificial Sequence: Synthetic coding sequence
atgacgcccggagtccgcgtcagcacagatcctgaacaggttacgttcgaagacgtggtggtgggctttagccaggaagagtgggggcagctgaagcccgcacaacggactctataccgcgatgtgatgcttgatacatttcggcttctggtgtcagtgggccattggctccctaagccaaacgtcatcagtctgctggagcaggaggctgagctgtgggcagtggagagcagacttccccaaggagtgtacccagaaatcaagggtcattttcagttcctcctgttatcggaccttgagacccgacccaaagtgaaactttcagtgttaaaacagggtatttctgaagaaatctctaacagtgtaattctcgtggaaagattcctgtgggacggcctgtggtactgtcggggtgaagacaccgaaggccattgggagtggagctgtgagtccctggagagcttagccgtgccagtggcatttaccccagtgaagacacccgtgctggagcagtggcagcggaacgggttcggcgaaaatatatcgctcaatccagacttgccccaccagccgatgacgcctgaaagacagtcccctcatacctggggcactagagggaagagagagaagcccgaccttaatgtcctccagaagacctgcgtgaaggagaagccatataagtgccaggaatgcggaaaggccttttcacacagcagtgctttgattgagcaccacagaacacatacaggcgagcgcccatacgaatgccacgaatgtcttaaagggtttagaaacagctctgcgctgacaaaacaccagcgcatccacacaggcgagaagccgtataaatgtacccagtgtggtagaacttttaaccaaatcgccccactcatccagcaccaaaggactcacacaggggagaaaccctatgaatgctctgaatgcgggaagagctttagcttccgaagctcattctcccagcatgaaagaacgcataccggcgaaaaaccatacgagtgcagtgaatgtggcaaggccttccgacagtccattcaccttacacagcatctgcggattcacacgggagagaaaccttatcaatgcggggaatgcgggaaggcattcagccattcctcaagcctgacaaagcaccagcggatccataccggagagaagccctatgagtgccatgaatgcgggaaagcctttacacaaatcacacctctgatccagcaccagaggacgcatacaggcgagaagccctacgagtgcggcgaatgcggtaaggcattcagtcaaagtacgcttctgacggagcatcgtaggatccacacaggggagaaaccctatggctgtaacgaatgcggcaagacattctcccactcatcatctctgtcacagcacgagcggactcacaccggggagaagccatatgagtgttctcaatgtggaaaggcgttcaggcagtccacccacctgacccagcaccagagaattcacacgggtgagaagccctacgaatgcaacgattgcgggaaggctttcagccattccagcagcttaaccaaacaccagcgcattcatactggggagaaaccttacgaatgtaatcagtgtggcagagcattttcacagttggccccactcattcagcaccagagaatccataccggcgaaaagccctacgaatgcaaccagtgcggaagagccttttctcagagcagtctgctaattgagcatcaaagaatacacactaaggagaaaccctatggctgtaatgagtgtggtaagtccttcagccatagttcctctctgagtcagcatgagcgcacccacactggagagaaaccctatgaatgtcatgactgtgggaaatccttccgccaatcaacgcacctcacacagcaccggaggatacacacaggtgagaaaccttacgcatgtcgggactgcggcaaagccttcactcattcctctagcctgaccaagcatcagaggactcatacgggatag

SEQ ID NO: 247294 - DNA, 2031 bp, Artificial Sequence
  Description of Artificial Sequence: Synthetic coding sequence
tgacgcagcgtcggctgtaggtgtcgcggactttgtcttgccgtcagacgtgagcaggtaaccttcgaagatgtcgtggtaggcttcagtcaggaggagtgggggcaattgaaaccagcccagaggacactttacagggatgtgatgctggacaccttcaggctcctagtgtccgtcggacactggctgcctaaaccgaacgtgataagcctgctggaacaggaagccgaactttgggcagttgagtctaggctacctcagggtgtgtaccccgagatcaagggccacttccagttcctgctgctgtccgatctggaaacacgtcccaaagttaaactctcagtcctgaaacagggaatcagcgaagagatctcaaatagtgtaattctagtcgagcgcttcctatgggacgggctttggtactgccgaggcgaggacacagaagggcactgggaatggagctgcgaatccctggagtcgttagctgtgcccgttgcttttactccagtcaaaacacctgttcttgagcagtggcagcgaaatggcttcggggaaaatataagcctcaaccctgatctgccacatcagcccatgacgcctgaaaggcagtcaccccacacctggggcacccggggaaaacgggagaagcccgatcttaacgtcctccaaaaaacttgcgtcaaagagaaaccttataagtgccaggagtgcgggaaggctttctcccactcaagcgccttgattgagcatcacagaacccacacgggggaaagaccttacgagtgccacgaatgtctgaagggtttcaggaactcaagcgccctaaccaaacatcagaggatacataccggtgagaaaccctataagtgtacacagtgtggcagaacctttaaccagatcgctcccctgattcaacatcagcgcacacacactggagaaaagccctatgagtgctcagagtgcggtaaaagtttctcatttcggtcgtctttttcacaacatgagcggacccataccggagaaaagccatacgaatgcagcgaatgcggtaaagcttttcggcaatcaattcacttaacgcagcacttgcgaatccatactggggaaaagccttaccagtgtggagaatgtggaaaggcgttttctcactcttcctcattaaccaagcaccagaggattcacacaggcgagaagccgtatgaatgccacgagtgcgggaaggcttttacccagataacacccctgatccagcatcagagaacacacacaggcgaaaagccttatgagtgcggggaatgcggcaaggctttcagtcagtccacgcttctcaccgaacatcgcaggattcacaccggggagaagccctatggatgcaatgagtgcggtaaaacattcagccattcttcgtccctgtcacagcacgaaagaacacacacaggggagaaaccatatgagtgctcacagtgtggaaaggcatttcgccagagcactcaccttacacagcatcagcgcatccacaccggcgagaaaccctatgagtgcaatgactgtggtaaggctttttcacactccagtagcctgacaaaacatcaaagaattcacacaggggaaaagccctacgagtgcaaccagtgcgggagggccttctcgcagctggcccctctgatccagcaccagaggattcatacgggagagaaaccatacgagtgcaatcagtgcggtcgggcattctcccagtcgagcctcctgattgagcatcagaggattcatacaaaggagaagccctatggctgcaatgaatgtggaaaatccttcagtcattccagctccctgtcccaacatgagcgcacgcatacaggagaaaagccatatgagtgccacgactgtggcaagagctttagacagtccactcatctaacccagcaccgacgcatccataccggcgaaaagccctacgcctgtagagattgtggtaaggctttcacccatagcagcagcctcacgaagcatcaacgtactcatacagggtag

SEQ ID NO: 247295 - DNA, 1623 bp, Artificial Sequence
  Description of Artificial Sequence: Synthetic coding sequence
atggacagtgttgccttcgaggatgtagatgtcaacttcacccaggaggagtgggctttactcgatccctcccagaagaacctgtatagggacgtgatgtgggagacaatgcggaatctcgcctctattggaaaaaagtggaaagaccagaacatcaaagatcattataagcatagaggcagaaatttgagatcgcatatgcttgagcggctgtaccagacgaaggacggttcccagcgcggaggcatcttttcccaattcgccaaccagaatttgtctaaaaagatccccggtgttaaactgtgcgaaagcatcgtgtacggcgaggtcagtatgggccagtcaagtctcaaccgacacattaaggaccatagcggccacgaacctaaggaataccaggagtacggggaaaagccagacacccggaaccagtgttggaagccatttagcagccatcacagctttaggactcatgaaatcatccacaccggagagaaactgtatgactgcaaggaatgtggcaagacctttttttctttgaagagaattcggagacatatcattacgcattctggctacacaccatataagtgtaaggtttgtgggaaggccttcgactaccccagccgctttagaacccacgagcggagccacaccggggaaaaaccctacgagtgtcaggagtgcggaaaggccttcacatgcatcacatccgtgagacgtcacatgattaagcatacaggcgacgggccttacaaatgtaaagtgtgcggtaagccatttcacagtttgtcgagcttccaggtccacgagaggattcacacaggcgagaagcccttcaagtgtaagcagtgcggcaaagctttttcctgcagccctaccttaagaatccatgagcgcacccacaccggcgaaaaaccgtatgaatgcaagcaatgcgggaaagctttctcctacttaccttctctcaggttgcacgaacgaattcacaccggagaaaagccctttgtttgcaaacagtgcggtaaagcgtttcgcagtgcctcaacattccaaattcatgagcgcacccacaccggcgagaaaccctatgagtgtaaggagtgcggggaggccttttcttgtatcccctctatgaggcggcacatgatcaaacacactggcgaaggaccttacaaatgtaaggtttgcggtaaacctttccacagtctgtcgcccttccgtatccatgagcgcacgcacacaggcgagaagccatacgtatgtaaacattgcggaaaagcctttgtgtcctcaacttccatacgtattcatgaacggacacacactggagaaaagccttacgagtgtaaacagtgcgggaaagcatttagttacctgaatagcttccgcacccacgagatgattcatactggagagaagccttttgagtgtaagcgctgtgggaaagcattccggtctagtagcagcttcaggttgcatgagcggactcacaccggacaaaaaccataccattgtaaggagtgtggaaaggcttacagttgtagagcctcctttcaaagacacatgctgacccatgctgaagacgggccaccctacaaatgtatgtgggaatcactatag

SEQ ID NO: 247296 - DNA, 1425 bp, Artificial Sequence
  Description of Artificial Sequence: Synthetic coding sequence
atgctggaacgactgtatcagacaaaggatgggagtcagcggggaggcattttctcacagtttgccaaccagaacctgagcaagaaaattccaggagtgaaattatgcgagtctatcgtatacggggaagttagtatgggccagtcttcgctgaacaggcacatcaaagatcacagtggccatgaaccaaaagagtatcaggaatatggcgagaaacccgatactagaaaccagtgttggaaaccattcagttctcatcactcttttcgcacccacgagatcatccataccggggagaagctgtatgattgtaaggaatgcggaaagaccttttttagcctgaaacggattaggcgccatattattactcatagtggatatactccctacaagtgcaaggtgtgtggaaaggcttttgactatccttctagatttcgtactcatgaacgctcccatactggggaaaagccctacgaatgccaagagtgtggcaaggcctttacttgtatcacttctgtgcggaggcacatgatcaagcacactggggacggaccctacaaatgtaaagtgtgtggcaagcccttccacagcctttccagctttcaggttcatgagagaattcatacaggtgaaaagccgtttaaatgtaaacagtgcggcaaagcgtttagctgttctccgaccctgagaatacacgagcgaacacacacaggtgaaaagccctacgaatgcaaacagtgcggaaaggccttctcatacctgccgagtttgcgccttcacgaaagaattcacacgggggagaagcccttcgtgtgtaagcaatgcggaaaagcatttcgaagcgcttccactttccagattcatgagcggactcatacaggtgaaaagccatacgagtgcaaagagtgtggcgaggctttcagttgcatcccctcgatgagaagacatatgattaaacatacaggcgagggaccatataagtgtaaagtgtgtggcaagccattccatagcctttccccctttcgaatccatgaacggactcacacgggcgaaaaaccatacgtgtgtaagcactgtggcaaggcatttgtgagttccacatctatcagaatacacgaacgcactcacaccggagagaagccgtatgaatgtaagcaatgcggcaaggcctttagctacctgaatagcttcagaacccacgagatgattcacacaggcgagaaaccgtttgaatgtaagaggtgtgggaaggcgttcagatcctcctcgagctttagactccatgagcgtacgcatacaggtcaaaagccttaccattgcaaggagtgcggaaaggcctattcatgtcgagcctctttccaacgacatatgctgacacacgcagaagatggacctccttacaaatgcatgtgggagtccctatag

SEQ ID NO: 247297 - DNA, 960 bp, Artificial Sequence
  Description of Artificial Sequence: Synthetic coding sequence
atgggccctctcacattcatggatgtggccatagagtttagcctggaggaatggcagtgtctcgatactgcccagagaaacgtgtacagacacgtgatgctggagaactaccgaaatttggtgtttcttgatctaatcacatgtttggagcagggaaaagaaccatggaacatgaaacgccacgaaatggtggtggctaaacattctgcactgtgcagtaggtttgcgcaggatctgtggttggaacagaacatcaaggacagcttccagaaggtgaccttgtcacgctatggcaagtacgggcataagaatctccaactgcggaaggggtgcaagtccgtggacgaatgtaagggtcatcagggtggttttaatggcctgaaccaatgcctgaagattacaacatcgaagattttccagtgtaacaaatatgtgaaggtaatgcacaagttcagcaacagcaatcggcacaagataagacacacagagaacaagcacttccggtgcaaagagtgcgataaaagcttgtgtatgctctctcgtcttacccagcacaagaagatacatacgcgagaaaacttctataaatgtgaggagtgtgggaagacatttaattggtcaaccaacctaagcaagccgaagaaaattcacactggcgagaaaccttataaatgcgaggtctgcggtaaggcctttcaccagtcgtccatcctaacgaaacacaagatcattaggacaggcgagaagccttacaagtgtgctcactgtgggaaggcctttaagcagtcaagccacctcaccagacacaagatcatccataccgaagaaaagccatataaatgcgagcagtgcggaaaagtctttaagcagagtccgacactgactaagcatcagattatatatacaggcgaagaaccctacaaatgcgaagagtgtggaaaagcgtttaatttatcgtag

SEQ ID NO: 247298 - DNA, 789 bp, Artificial Sequence
  Description of Artificial Sequence: Synthetic coding sequence
atgaaacgacacgaaatggtcgtggccaaacactcagctctgtgtagcaggttcgcccaggatctctggctcgagcagaacatcaaagatagttttcaaaaagtgacgttaagtcggtatgggaaatatggacacaagaatctccagttgagaaaagggtgcaagtctgtagatgagtgtaaaggccatcagggcggatttaatggacttaatcaatgcctgaagatcaccactagcaaaatcttccagtgcaataaatacgttaaagtcatgcataagttcagcaattccaacaggcacaagatccgccatacagagaataagcactttcgctgtaaggaatgcgataagtccctgtgcatgctcagcagactcacccagcacaagaagatccatacccgggaaaatttctacaaatgcgaagagtgcggaaagacctttaactggagcaccaatctaagcaaacctaagaaaattcataccggagagaagccatacaagtgtgaggtctgtggcaaggccttccaccagagctcaatcctcactaaacacaaaattattcgcacaggcgagaagccgtataagtgcgcgcactgcggaaaggccttcaagcagtcctcgcaccttaccagacacaaaatcatccacacagaagagaagccgtacaaatgcgagcagtgcggtaaagtgttcaaacaaagccccactctgactaagcatcagatcatttacaccggggaggagccatataagtgtgaggagtgtggtaaggctttcaaccttagctag

SEQ ID NO: 247299 - DNA, 789 bp, Artificial Sequence
  Description of Artificial Sequence: Synthetic coding sequence
atgaagaggcacgagatggtggttgcgaagcatagtgcactctgctcgcgattcgcacaggacctctggctggaacagaatataaaagattcattccaaaaagtcacgctcagtagatacggcaaatacgggcacaagaatctgcagcttcgcaaggggtgcaagagtgttgacgagtgcaaggggcatcaaggcggtttcaatggcttgaatcagtgtctgaaaatcacaacgagcaagatcttccagtgtaacaagtacgtgaaggttatgcataagttcagtaacagcaaccgccataagattcgccataccgaaaacaaacatttcaggtgtaaggagtgtgacaagagcctctgcatgctgtcgagacttacccagcacaaaaaaatacacacaagggaaaatttctataaatgtgaggagtgcggcaagacgttcaattggtctacaaatctgagcaaaccaaagaagatccacactggagaaaagccgtataagtgcgaagtgtgcgggaaagcattccaccaaagcagtattctgacaaagcacaaaatcattagaacaggcgagaaaccgtacaagtgcgctcactgtggtaaagccttcaagcagagcagccacctgaccaggcataaaattatccacactgaagaaaagccatataagtgtgagcagtgcgggaaggtctttaaacagtccccaactctgaccaagcatcagattatctacaccggggaagagccgtataaatgcgaagagtgtggaaaggcgtttaatctgtcctag

SEQ ID NO: 247300 - DNA, 864 bp, Artificial Sequence
  Description of Artificial Sequence: Synthetic coding sequence
atggatgtcgccatcgagttctctcttgaagagtggcagtgcctcgacacggctcagcggaacgtgtatcggcatgtgatgcttgaaaactatcgcaacctggtcttcctggcattgtgttcacgatttgcccaagatctgtggctcgaacagaatattaaggactcgttccaaaaggtgactttgtcccgttacggtaagtatggccataagaatctccagctgaggaaggggtgcaaatctgtggatgagtgtaaagggcaccagggcggattcaacggacttaaccagtgtcttaagattactacaagcaaaatattccagtgcaataagtatgtgaaagtgatgcataagttttccaattccaaccgacacaagattaggcatacggagaacaaacatttcaggtgtaaggagtgtgacaagtctctttgtatgcttagtcgcctgacgcagcacaagaaaatccacacccgcgagaacttttacaagtgcgaagagtgtggaaaaacattcaactggtccaccaatctaagtaaaccgaaaaaaatccataccggagagaagccctataagtgcgaagtatgcggcaaggctttccatcagagtagcatacttaccaaacataagatcatccggaccggggagaaaccatataaatgtgcccattgtggcaaagcattcaagcaatcttcacacctcacgagacacaagatcatccatacggaggaaaaaccatataaatgtgaacagtgtgggaaagttttcaagcagtcaccgacacttacaaaacaccagatcatctacaccggggaggagccgtataaatgtgaggagtgcgggaaagctttcaaccttagctag

SEQ ID NO: 247301 - DNA, 882 bp, Artificial Sequence
  Description of Artificial Sequence: Synthetic coding sequence
atgggcccactcacatttatggacgtggccatcgagttcagcctcgaggagtggcagtgtctcgatacagctcaacgcaatgtttaccggcacgtaatgctcgaaaactaccgcaacttggtattcttagccctatgcagccggtttgctcaggacctgtggctggaacagaatataaaggactctttccagaaagttaccttgagtcggtacggcaagtacggccacaaaaacttgcagctcagaaagggatgtaagtctgtggacgaatgtaagggacaccaggggggatttaatggactcaaccagtgcctgaaaatcacaacgtccaaaatattccagtgtaacaaatatgtcaaggtaatgcacaaattttcgaactccaaccggcataagatccgacataccgagaataagcatttcagatgcaaggagtgtgataaaagcctctgcatgctgagtcgtctaacacaacacaaaaaaatccatacccgggaaaacttctacaagtgcgaagagtgtggcaaaacgtttaactggtcaacgaatttgagtaagcccaaaaaaatccacacaggcgaaaagccgtacaagtgcgaggtgtgcgggaaggccttccaccagtcgagcattctgaccaaacacaaaattatccgcacaggggaaaaaccatataaatgcgctcactgcgggaaggcattcaaacagagctcgcacctcacacgccataagattattcatacggaagaaaagccttataaatgtgaacagtgcggaaaagttttcaagcagtcaccaacacttacgaaacatcagatcatttatactggagaagagccctacaaatgtgaagaatgtggaaaagcctttaacctcagctag

SEQ ID NO: 247302 - DNA, 381 bp, Artificial Sequence
  Description of Artificial Sequence: Synthetic coding sequence
atgggacctcttacctttatggacgtggctatcgagttcagtctggaagaatggcagtgtctggacactgcccagaggaatgtgtaccgacacgtaatgctggagaactataggaatttagtgtttctggacctcataacctgcctggaacagggaaaggagccctggaatatgaagcggcatgaaatggtggtcgccaagcacagcgcagtcgcatttacttttgatttgtcagggttgaacatactgtcttttcagtccattctgccgtttgttagcgcgctctacgtaatgggcaatcgaaatcagtgcctgcagaaacacttggaggccagaaacaaggatctgtgcgtcctcgtgctccccaagacattcggatag

SEQ ID NO: 247303 - DNA, 1929 bp, Artificial Sequence
  Description of Artificial Sequence: Synthetic coding sequence
atggatagtgtctcctttgaggacgtggccgtgaattttacgctggaggagtgggcgctgttggacagctcacaaaagaaattgtacgaggatgtcatgcaggaaacatttaaaaacctggtttgcctggggaagaagtgggaagaccaggacatagaggatgaccaccggaaccagggaaaaaacaggcgatgtcatatggtggagagattatgcgaaagtcgaaggggaagcaagtgtggcgaaactacatcgcagatgcctaatgtgaacataaacaaggaaacatttacgggcgctaagcctcacgaatgctcgttctgtggccgagatttcatacatcatagcagtctcaaccgacatatgaggagccacaccggtcagaagccgaatgagtatcaggagtacgagaaacagccttgtaagtgtaaggctgttggcaaaacattcagctatcaccattgtttccgcaagcacgaacggacccatactggagtgaaaccttacgagtgcaaacagtgcgggaaggctttcatctattaccagccctttcaacgacatgaacggacccatgccggacagaagccgtacgagtgcaaacagtgcggaaagactttcatttattaccagagcttccaaaagcacgcccatacgggcaagaagccttacgagtgcaaacagtgtggcaaagcattcatctgttaccagtctttccagagacacaagcgcactcataccggtgaaaaaccctacgaatgcaagcaatgcggaaaagcgttttcttgccctacctattttaggactcacgaaagaacccataccggagagaagccttataagtgtaaggagtgcggtaaggccttctccttcttaagttcttttcggagacataagaggacccatagcggggaaaagccttacgagtgtaaggagtgcgggaaggccttcttctattccgcatcgtttagagcgcacgtcattattcataccggggctcggccttacaagtgcaaggagtgtggcaaagctttcaattcatctaactcctgcagggtccacgaacggacacacatcggggagaagccctacgagtgtaaaagatgcggaaagtcgttttcatggtccattagcctgaggctgcacgagagaacacatactggggagaagccctacgaatgtaagcaatgccataagactttctctttttcctctagcctcagagagcacgaaaccactcacaccggcgaaaagccttatgagtgtaaacagtgcggaaagactttctccttctcaagttcactgcagcgccacgaacgcactcacaatgcagaaaaaccttacgaatgtaagcagtgtggtaaggcattccgttgcagcagttacttcagaatacacgagcgctcccacaccggcgaaaagccgtatgaatgcaaacagtgtggcaaagtgtttattcgatcgtcaagttttcgcctgcacgaacgcacacacacaggggaaaagccttacgagtgcaaactgtgcggcaaaactttttcattttcttctagcctgagggagcatgaaaaaatccataccggaaataaaccttttgaatgcaaacaatgcggcaaggcctttcttcgcagcagccagattagactgcatgaacggacacataccggcgaaaagccctaccagtgtaaacaatgtggaaaggcctttatctcttcaagtaagtttcggatgcatgaaagaactcataccggcgaaaaaccttacagatgcaaacaatgtggcaaggccttcagattcagctctagcgttcgtatccacgagcgcagccataccggagagaaaccctacgagtgcaaacagtgtggcaaagccttcatctcatcatcgcatttccggttgcacgagcgaacccatatgggagaaaaagtgtag

SEQ ID NO: 247304 - DNA, 1374 bp, Artificial Sequence
  Description of Artificial Sequence: Synthetic coding sequence
atgtcccagggttctgtcacgttccgggatgtcgccattgacttcagccaggaggagtggaagtggctgcagccggctcagcgcgacctctacagatgtgtcatgctggagaactacgggcacttggtgagcctgggactttcaatctcgaagccagacgtggtgtccttattagagcagggcaaggagccatggctgggcaaacgtgaggtgaaaagggatctgttctctgtctctgagagctcaggggagattaaagattttagtccgaagaatgttatttacgatgattcgtcccagtatctgataatggaacgcattcttagccaggggccagtgtactcttccttcaaaggcggttggaagtgcaaggaccacaccgagatgctgcaagagaatcaaggatgcattcggaaggtgactgtttctcaccaggaagccctggcccagcatatgaatatcagcactgtagaaagaccttacggctgtcatgagtgtggcaaaacgtttggaagacgattcagcttagtgcttcaccagcgcacacacaccggagagaagccctatgcttgcaaggagtgcggaaagaccttctctcagatctcaaatctggtgaaacaccagatgattcacacggggaagaaaccacacgagtgcaaggattgcaacaaaacttttagctacctcagtttcttaattgagcaccaacgcacacacacgggtgaaaagccttacgaatgtacagaatgcggcaaggctttttcccgcgcatccaacttgacgcgacaccaacgcatccatattggcaagaagcagtacatttgcaggaagtgtggcaaggcttttagttctggcagtgaacttatcagacatcagataactcatactggagagaagccttatgagtgtatcgagtgtggcaaggcgttccgcagattcagccatcttacccgacatcagtctatacatacaaccaaaacaccttatgagtgtaatgagtgcagaaaggccttcagatgtcactcttttctaattaagcaccagagaattcacgctggtgaaaagctctatgaatgcgacgaatgcgggaaggtttttacatggcatgctagcctgattcaacacaccaagagtcacactggagagaagccctatgcctgcgctgagtgcgacaaggcattctcacgctcttttagcctcattctgcatcaacgcacccacactggggaaaaaccttacgtgtgcaaggtgtgtaacaaatctttcagctggtcctccaacttggcaaaacatcagaggacgcacacacttgacaatccttacgagtatgagaattcctttaattatcacagcttcctgaccgagcatcagtag

SEQ ID NO: 247305 - DNA, 351 bp, Artificial Sequence
  Description of Artificial Sequence: Synthetic coding sequence
atgagccagggatcagtgaccttcagggatgtagcaatcgattttagccaggaagaatggaaatggttacagcccgctcagcgtgacttatatcgatgtgtgatgctggaaaattacgggcatctcgtttcactgggtttatctattagcaaacctgatgtcgtgtctctcctggagcagggaaaggaaccttggctggggaagagagaggtgaaacgcgatctcttctctgttagcgagtcttctggggaaataaaagatttttcacctaagaacgtcatttacgatgacagcagccagtacctgatcatggagcgaatcttaagtcagggccctgtctatagttcatag

SEQ ID NO: 247306 - DNA, 684 bp, Artificial Sequence
  Description of Artificial Sequence: Synthetic coding sequence
acacatacgggggagaaaccgtacgcttgcaaggaatgtggcaaaaccttttcgcagattagcaatctggtcaagcaccagatgattcacactggtaagaaaccgcatgaatgcaaagattgcaataagactttcagctatctgtccttcctcatcgaacatcagcggacacatactggtgaaaaaccctacgagtgcacagagtgcggcaaagcattctcaagggcgtcaaatctgacccggcaccagcggatccacatagggaaaaaacagtacatctgtcggaagtgcggcaaggcgtttagctctggctccgaactgattcggcaccagattacgcacacaggcgaaaaaccctatgaatgcattgagtgtggaaaggcgtttcgcagattcagccacttgacaaggcaccagcggattcatgcaggcgaaaaactctacgagtgcgacgagtgcggtaaggtgtttacctggcacgccagtctgattcagcacactaagtcgcacacaggagaaaagccctacgcttgtgcggaatgtgataaagccttctctaggagcttttctctgatcctgcaccagaggacacacactggagagaaaccatatgtttgtaaggtatgcaacaagagcttttcatggtcatctaatttggcaaagcatcaaagaacgcacacctag

SEQ ID NO: 247307 - DNA, 1065 bp, Artificial Sequence
  Description of Artificial Sequence: Synthetic coding sequence
atggaacgaatcctgagtcaagggccagtgtactcatcgttcaagggcggttggaagtgcaaggatcacacggaaatgctgcaggagaaccagggctgtataagaaaggtaaccgtgagtcaccaggaagccctggctcagcacatgaacatcagtaccgtggagcggccatacggctgtcacgagtgtggaaagacgtttgggcgacgcttttctctcgtgttgcaccagcgcacccacacaggagaaaagccctatgcttgcaaggaatgcggtaagaccttctcacagatcagcaatctcgtcaagcaccaaatgattcatactggaaagaagcctcatgagtgtaaagattgcaataaaaccttttcctacctgtcctttttgatcgagcatcagcggacccacaccggcgagaagccctatgaatgcaccgaatgcgggaaggctttctctcgtgcaagcaaccttacccgccatcagagaatccatattgggaagaagcagtatatttgtaggaagtgcggcaaagctttctctagtggatctgagctgatcagacaccaaatcacacataccggcgaaaaaccttatgagtgtatcgagtgtggaaaagcgttcaggagatttagccacctgacacggcatcaatcgatacatactacaaaaacaccttacgaatgcaacgaatgtagaaaagccttccgctgccattcttttctcatcaagcatcaaaggatacatgccggtgaaaaactgtacgagtgtgacgaatgcggtaaagtattcacatggcatgcctccttgattcagcatacaaaatcgcacactggggaaaagccctacgcttgtgcagagtgtgataaagccttctcacggagtttctccctgatactccatcaacgtactcatacaggcgagaaaccttacgtgtgcaaggtgtgcaacaaaagcttttcatggagttccaacttggccaagcatcaaagaacccataccctagataatccatacgagtatgaaaacagtttcaactatcatagctttctgacagagcaccagtag

SEQ ID NO: 247308 - DNA, 1425 bp, Artificial Sequence
  Description of Artificial Sequence: Synthetic coding sequence
atggaattgctgacatttcgtgacgtagccatagagtttagtcctgaggagtggaagtgcctggatcctgaccaacagaatctctatcgggacgtgatgctcgaaaactatcgtaatctagttagcctgggcgtggctatcagtaatcctgacttagtaacctgtttggagcagagaaaagaaccatacaacgtcaagatccacaagattgtcgccaggccacctgccatgtgtagccatttcactcaggatcattggccagtccaggggattgaggattcatttcacaagctgatactgcgcagatatgaaaaatgtgggcacgataaccttcagttacgcaaagggtgcaaaagcttgaatgagtgcaaattgcagaagggcggttacaatgaattcaatgagtgtcttagcacaactcagtctaagatcctgcagtgtaaggcctctgtcaaagtggtttctaagttcagcaacagcaacaaacgcaaaacacgacataccggggagaagcacttcaaagaatgcgggaagagcttccagaaatttagccatctgacccagcataaagtcatacacgccggtgaaaaaccttacacctgtgaggagtgtgggaaggcatttaagtggtcgctgatatttaatgaacacaagcgaattcacaccggcgaaaaaccgtttacctgtgaagagtgcgggtcaatattcacgacatcgtctcactttgccaaacacaagataattcacaccggcgaaaagccttataagtgcgaggagtgcggaaaagctttcaatcgcttcactaccctgaccaagcacaagaggatccatgccggtgaaaagcccattacatgtgaagaatgtcggaagatattcacttcgtcctccaactttgccaaacacaagcgcatccataccggcgaaaaaccctataagtgcgaggaatgtggtaaggcctttaatcggagtactacacttactaagcacaaacgcatccatacgggcgaaaagccctacacttgtgaagagtgtggtaaagcgtttagacagagttctaagctgaatgaacacaagaaagtgcacaccggcgaaaggccttacaaatgcgacgagtgcggcaaggctttcgggaggtcccgggtcttaaatgaacataagaaaattcacacaggggaaaagccctacaaatgtgaagagtgcgggaaggccttccgtagaagcacggaccggtcacagcacaagaagattcactcggccgataaaccatataaatgcaaggagtgtgacaaggcctttaaacagttttcacttctctctcagcacaagaaaatacatacagtggataaaccatataagtgcaaagattgcgacaaggcctttaaacgcttctctcatctgaataagcataagaagattcatacatag

SEQ ID NO: 247309 - DNA, 606 bp, Artificial Sequence
  Description of Artificial Sequence: Synthetic coding sequence
atggagctgttaacattccgtgatgtcgctattgagtttagcccggaggagtggaagtgtctggatcccgatcagcagaacttgtatcgcgatgtcatgcttgaaaattaccggaatctggtctccctgggcgtagccatttcaaatccggatttagtaacatgtctggagcagcgtaaggagccctataatgtaaagattcacaagattgtggccagacctccagcgatgtgcagccacttcactcaggatcattggcctgtgcaaggaattgaggacagctttcacaaactcatccttcgccgatacgagaaatgcggtcacgataatctgcagctgcgaaagggctgtaaatccctcaacgagtgtaaactccagaaagggggttacaatgaattcaatgagtgcctgtccaccacgcagagcaaaattctccagtgtaaggccagtgtgaaagtcgtctccaagtttagtaacagcaacaagaggaagactagacacaccggtgaaaagcattttaaagagtgcgggaaatcgtttcaaaagttctcacacctgactcaacacaaaaacagtagcatctccatgacaactagccctttttag

SEQ ID NO: 247310 - DNA, 5063 bp, Artificial Sequence
  Description of Artificial Sequence: Synthetic coding sequence
atgactgacccccttctggactcacaaccggcaagcagcacaggggagatggatgggctgtgtccagaactgctcctgatcccaccaccgctgtccaacagagggatactggggccagtgcagtccccatgcccctccagagaccctgcccctattccgaccgaaccaggttgcctgctggtagaggcaaccgctaccgaagagggcccaggaaatatggagattattgttgagaccgtcgccggtaccctcactcccggagcacccggagagactcctgcccctaaacttccacctggggagagagagccttcacaggaagcgggtacacccctccccggacaggagaccgcggaagaggagaacgtggagaaagaggagaagagcgatacccagaaagatagtcaaaaggccgtggataagggccagggagcccagagactcgaaggtgacgtggtgtccggcactgagtctctcttcaagacacacatgtgcccagagtgtaaacggtgttttaagaaacggacccatctggtcgaacacctgcatttacactttcctgacccaagcctccagtgcccaaactgtcaaaagttcttcactagtaagtccaagctcaagacccatcttctgcgcgaattgggcgaaaaggcgcaccactgccctctgtgtcattattccgcggttgagcgaaacgccctcaatcgacacatggctagcatgcacgaagatattagcaacttctacagtgacacgtacgcgtgtcctgtgtgtagggaggagttccgcctcagccaagccctgaaagagcaccttaaatcccacacggcggcagccgctgcggaacctctacccctcaggtgcttccaggaaggctgcagttacgctgctcctgatcgtaaggcatttatcaaacaccttaaagagacccatggggtaagggcagtggaatgccgccatcatagctgtccaatgttgttcgctaccgcggaagccatggaggcccatcacaagtcccactacgcattccactgcccgcactgtgactttgcctgcagtaacaagcatctttttagaaagcacaagaaacaaggccaccccggaagcgaagaactgcgctgcactttttgcccttttgctacatttaatccagtcgcctaccaggatcatgtgggtaaaatgcatgcccatgagaagatccaccagtgccctgagtgtaattttgccacggcgcacaagagagtgctgatcaggcacatgctgctacacacaggcgaaaaaccccacaagtgtgaactgtgcgacttcacgtgcagagacgtttcctacctctccaagcatatgctgactcattctaacaccaaagactatatgtgcacagaatgtggctacgttactaaatggaagcattacctaagagtacacatgcggaaacacgcgggtgacttgcggtatcagtgcaatcaatgttcctacagatgccacagagcggaccagttgtcatcccacaagttgaggcaccagggcaagtctctgatgtgcgaggtttgtgcatttgcctgtaagcgcaaatacgaactgcagaaacacatggcctcacagcaccatccaggaacacctgccccactgtatccatgtcactattgctcctaccaaagtaggcataaacaggcagtcctctcccatgaaaattgtaagcacactcgcctgagagagttccactgtgcactgtgcgactataggacctttagcaacaccaccttactcttccataagagaaaggctcacggctacgtgccaggtgaccaggcctggcaattgagatacgcctctcaggaacctgagggggcaatgcagggcccaacccccccaccagactcagaaccctctaaccagttgtcagccaggccagagggccctggacacgaacctgggacagttgtggatcccagcctcgaccaggcacttcccgagatgtctgaggaagtcaatactggcagacaggaagggtccgaagccccacacggcggtgacctaggtggcagcccttcgccggctgaggtggaagaagggtcttgcaccctccacctggaggcattaggtgtcgagctcgaatctgtgacggaaccacccctggaggaagtcaccgagacagcgcctatggagttcagaccactagggctggagggacctgacgggctggaaggcccagagctttcatcatttgaggggattggaacctccgacctttctgctgaagagaaccctctgttggagaaaccagtgtccgagccctccaccaatccaccttctctggaggaagcgcctaacaattgggtaggcacatttaaaacgacacctcctgccgagaccgctcccctccccccactgcccgagagtgagagcctgttaaaagcacttcgcagacaagataaggagcaggccgaagctcttgttctcgaaggacgcgtccagatggtggttatccaaggcgaggggcgtgcgtttcgatgtccccactgtcccttcatcactcgtagggagaaggccctgaatcttcatagcaggacaggatgccaagggagaagagagccgttactatgccctgagtgcggcgctagtttcaaacagcagcggggactgagcacccacctgctcaagaaatgtcctgtgcttctgcggaaaaataaaggactgcccagacctgattcccccatcccactgcagcctgtgctccccggtacacaggcgtctgaagatacggaaagtggaaagcccccacctgctagtcaggaggccgagctcttgctgccgaaagacgcccctctggagctacccagagaaccggaggagacagaggaacccctggcaactgtgtcaggtagcccagtgccccctgcgggtaactccttgcctacagaggcaccaaagaagcactgtttcgatcctgtgcctcctgctggtaacagctccccaaccgaggcccctaagaaacaccacctggaccccgtaccgcctgcaggcaactcctcacctacagaggctttgaagaaacaccgattcgagcaggggaaattccactgtaattcatgccccttcctctgtagccggctgagcagcattacaagtcatgtggccgagggctgtaggggaggacgaggtggaggcggaaaaagggggacgcctcagactcagcccgatgtctcccccctatccaatggcgatagcgccccacccaagaatgggagtaccgagtcatccagcggcgacggggacacagtgctcgtccagaagcagaaaggggcacgctttagctgccccacgtgtcccttctcctgccagcaagaacgggcactacgcacccatcagattcgaggctgcccactcgaggaaagcggtgagttgcattgctctttatgtcctttcacggcacctgccgcaaccgccttgcggctgcaccaaaaaagacgccatccaacagccgctccggcaagaggacctagaccacatcttcaatgtggtgactgtgggtttacttgcaagcagtctagatgcatgcagcagcatcggaggttaaaacacgagggcgtcaaaccacatcagtgccctttctgcgacttctctactacccggaggtatcgattagaggcacatcaatcgcgtcataccggcatcggacggatcccctgctcctcctgccctcaaaccttcggcaccaacagtaagttgcgcctccaccgcctgagagtgcatgacaaaacaccaacgcacttttgccccctgtgcgactatagcgggtacctgagacatgatatcactcggcacgttaacagctgccaccagggcaccccagcctttgcctgcagccagtgcgaggcacagttcagtagtgaaaccgcgctgaagcaacacgcactgcgtagacaccccgaaccagctcagccggctccagggtcacctgcggaaaccactgagggccctctgcattgcagccgctgtgggctcctgtgtccttcacctgctagcctgcgaggccacacccgcaaacaacaccccaggctagaatgcggggcttgccaggaggctttccctagtagactggccctggacgaacaccgcaggcaacagcattttagccacaggtgccagctgtgtgactttgcagcacgggagagagtcggactagtcaagcactacctggaacagcacgaagaaacctccgccgcagtcgccgctagcgacggggatggcgacgccggacaacccccattgcactgtcccttttgtgacttcacgtgtcgccaccagttggtgttagatcaccatgtaaagggccatggtggcacaaggctgtataagtgtaccgattgcgcctattctacaaaaaatagacagaagatcacctggcactctcggatccacaccggagagaaaccctaccattgccacctgtgtccctacgcctgcgctgaccccagccgtctgaagtatcacatgaggatccacaaagaggagcgtaagtacctgtgtcccgaatgtggctataagtgcaagtgggtgaatcagctgaagtaccacatgacgaaacacacaggcctgaagccctaccagtgcccagagtgcgagtactgcaccaatagggctgacgcgctgcgggtgcaccaggaaacccgtcacagagaagcacgcgcatttatgtgcgaacagtgtgggaaggcctttaaaactcgcttccttctgcgaactcaccttcgcaaacatagcgaagctaaaccctacgtttgcaacgtgtgccacagagcctttaggtgggctgccggattgaggcaccatgctctgactcacaccgatcgacaccccttcttttgtcgactctgtaattacaaagctaagcagaagttccaggtcgtgaagcacgtccgtaggcaccatccggaccaggctgaccccaatcagggagtcggaaaagacccgactaccccgacggtccacctgcatgatgttcagttagaagacccaagccccccagccccagcagcccctcataccggacctgaaggata

SEQ ID NO: 247311 - DNA, 45 bp, Artificial Sequence
  Description of Artificial Sequence: Synthetic coding sequence
atgactgaccccctgttggatagccagccggctagctcaacctag

SEQ ID NO: 247312 - DNA, 5063 bp, Artificial Sequence
  Description of Artificial Sequence: Synthetic coding sequence
atgaccgaccccctgcttgactcgcagccagcttctagcaccggtgagatggacggtctctgccctgagctgctgctaatcccgcctccactgtccaatagaggcattctgggcccagtccagtccccgtgccccagcagagatccagccccaatccctaccgaaccaggatgcttactcgtggaggccaccgctaccgaagaaggaccagggaatatggaaattattgtggaaacagtggccggtaccttgactccaggtgctcccggagaaacccccgcacctaaactgccacccggagagagggaaccatctcaggaagcagggacaccactgccaggacaagaaacagccgaagaggaaaacgtcgagaaagaagagaaaagtgacacccaaaaggactcccaaaaggcggtcgacaaaggccagggggcacagaggttagaaggcgatgtggtgagcggcaccgagagcctgttcaagacgcacatgtgccctgaatgcaagcgctgcttcaaaaaacggacacacctagtggaacacctccacctgcatttccccgatcccagcctgcagtgccccaattgtcagaagttttttaccagcaaatccaaactgaaaacacatctcctgcgggagttgggtgaaaaagcacatcactgcccactgtgccattattctgcagtggagaggaacgcccttaatcgccacatggcctctatgcacgaggatatttccaacttttattctgatacttatgcttgtccagtgtgtagagaagaatttagattatctcaagccctgaaagaacacctgaaatcccataccgctgctgccgcagctgagcctcttcccctgcgctgtttccaagaggggtgtagttatgcagctcctgatcgcaaggcttttattaaacacttaaaagaaacccacggcgtccgggctgtcgagtgtcggcatcactcatgtccgatgttgttcgcaacggctgaagccatggaggcccaccacaagtcccattacgcctttcattgcccacactgtgatttcgcctgttccaacaagcacctgttcaggaagcacaaaaaacaggggcaccctggcagcgaagaactgcggtgcaccttctgccccttcgcaacgtttaatccagtggcttatcaagaccacgtggggaagatgcacgcccatgaaaaaatccaccagtgtcctgaatgtaattttgccacggcccacaaacgtgtgcttataaggcacatgctgctgcataccggggaaaaacctcataagtgcgaactatgtgactttacatgccgggacgtttcatacctgtcaaaacacatgctaacgcacagcaacacgaaggactatatgtgcactgagtgcggctatgtcacaaagtggaaacattacctacgtgtccacatgagaaagcatgcaggtgacctaaggtaccaatgtaaccagtgctcatatcgctgtcaccgggctgatcaactgtcctctcataagctgagacatcagggtaagagtctgatgtgtgaggtgtgtgccttcgcttgcaagaggaagtatgagctccagaagcatatggccagccagcatcatcctggcacccctgctcccctgtatccatgtcactactgctcataccagagcagacacaaacaggctgtgctgagccacgagaactgcaaacacactaggctcagggaatttcactgcgcactgtgtgattatagaacatttagcaacacaaccctactctttcataagcgcaaggcccacggttatgtgccaggggatcaggcctggcaactgaggtacgcatcccaggaacctgagggagcaatgcagggcccaactccacctccggatagcgaacctagcaaccagctatctgcacgtccggaaggcccaggacacgagccaggtacggtggtggatccttccctcgatcaggcccttccagagatgtcagaggaggttaatacaggcaggcaggagggatctgaggctccacatggcggtgatctggggggaagtccttctccggctgaggttgaagaagggtcctgcacgctccatctggaagccctgggcgtggaactggagtccgtcacggaacctcctctagaagaggtgacagaaacagcccctatggaatttaggccattggggctggagggcccagacggattagagggacctgagctcagttccttcgagggaatcgggacttctgatctgagcgcagaggaaaacccactcctggaaaagccggtttcagagccgagcacaaaccctcctagtctagaggaagcaccgaacaactgggtcggtactttcaagactaccccccctgcggaaaccgctcctctcccacctctgcccgaatctgagagcctgctgaaggctttgaggcggcaggataaggagcaggctgaggctctcgttctcgagggcagagtccaaatggttgtgattcagggagagggccgtgcttttaggtgcccgcattgtccattcatcacacgcagagaaaaggctctaaacctgcatagcagaactggttgtcagggaaggcgcgagcctcttctatgccccgaatgtggtgcctcattcaaacagcaacgaggccttagcactcatctgttgaaaaaatgtccagtgctgcttcgtaaaaacaagggtctgccaagacctgactcaccaattccgctgcagcccgttctgccaggcacccaggcttccgaggatacagagagtggaaaacctccacccgcaagccaggaagccgagcttctcttgccaaaagatgccccattggagctgcccagagagcccgaggagaccgaagaaccacttgccacagtttccggaagtccagtgccccctgccggtaactccttaccaactgaagcccctaaaaaacattgtttcgaccccgttccgccagccggaaacagcagtccaactgaagccccaaagaaacatcatctcgacccggtgcctcccgcaggcaactccagccctaccgaggctttaaaaaagcataggtttgaacaaggcaaatttcactgcaactcgtgcccattcttatgctccagactcagctcaattaccagccacgtcgcagagggctgtaggggtgggcgtgggggaggtggtaaaaggggtaccccccagacacagccagacgtcagccctctctctaacggagattcggcccctccgaagaatggctccaccgaaagctcttcaggcgacggcgacaccgtcctcgtgcagaagcaaaaaggggcacgcttcagttgccccacgtgccccttctcatgccaacaggagcgcgctctgagaacccaccagataagagggtgccctttggaggaatctggcgagctgcactgcagtctatgtcctttcaccgcccctgccgcaactgccctgcggctgcaccagaagaggagacaccccacggctgctccggctcgagggcctcggcctcacttacagtgcggggactgcggcttcacatgtaagcagtccagatgcatgcaacaacacaggcggttaaagcatgaaggcgtgaaaccccaccagtgccctttttgtgattttagcactacccggaggtaccgtctggaggctcaccagtcccggcacacaggcatcggcaggattccctgctccagttgccctcagacttttggcaccaatagcaagctcagactccatcggttgagggtccatgataagacccccacgcacttttgtcccttgtgtgattactctggttatctgcgccacgacattacgcggcacgtgaactcctgccatcagggcacgccagccttcgcttgctcccagtgtgaggcacagttctcctctgagacagccctgaaacagcatgccttaagacggcatcccgaaccagcacagcctgctcctggatctcccgctgagaccaccgagggccctctccactgcagtcgctgcggactgttatgccccagtcccgcaagcttgaggggccatacccggaaacagcaccccagactggagtgcggcgcatgccaagaagcattccccagtcggctggcactggatgagcatcgcagacagcagcatttttcacacaggtgtcagttgtgtgacttcgcagcacgagagcgggttggactggtcaaacactatctggagcagcacgaggaaacatctgccgcagttgccgcttccgacggggatggggacgctggtcagccccctctgcattgcccattctgtgatttcacttgcaggcaccagctggtgttggatcatcacgtcaagggacacgggggaactcgtctttacaagtgtacagactgtgcatacagtaccaaaaaccggcagaaaattacgtggcattcacgaatccacactggggagaagccctaccactgccatctgtgcccttacgcatgcgctgacccttcgcgtttgaagtatcacatgaggatacacaaagaagagaggaaatatctctgtccggagtgtggttacaaatgcaaatgggtcaatcagcttaaataccacatgaccaaacatacgggcctgaagccatatcaatgtccagagtgcgagtactgcactaatcgggctgatgctctgcgagtacaccaagagacccgtcacagagaggcacgtgctttcatgtgtgagcagtgtggaaaggcgtttaagacacgctttcttctacgaactcaccttcgtaagcacagtgaggctaaaccctacgtgtgcaacgtgtgtcaccgagctttcaggtgggccgcagggctgcggcatcacgcgttgacccacacggatcgccaccccttcttttgcagactgtgtaactacaaggccaagcagaagtttcaagtggtgaaacacgttcggcgacatcaccccgaccaggcggaccccaaccagggagtgggtaaggatccgaccacacctacagtacacctccatgacgttcagctggaggatcccagccctccggcaccagccgcaccccacacagggccagaaggcta

SEQ ID NO: 247313 - DNA, 81 bp, Artificial Sequence
  Description of Artificial Sequence: Synthetic coding sequence
atgactgaccccttgttggactcccagcctgcgagctctacaggtgaaatggacgggctgtgccccgagctgctcctatag

SEQ ID NO: 247314 - DNA, 1824 bp, Artificial Sequence
  Description of Artificial Sequence: Synthetic coding sequence
atgctgttggcacagatcaaccgcgacagccaggggatgaccgagttccctggcggtggcatggaagcgcaacatgtcactctgtgtctgaccgaggcagtcacagtggctgacgcaaagttgatagacggacaggttattcaactcgaggatggcagtgcagcttacgtgcaacacgtgcctattcctaaatccaccggagattcgctccgccttgaagacggacaggccgttcagctcgaagacggaacaacagcgttcattcatcacacctcgaaggattcttacgaccagagtgccctgcaggcagtccagctcgaagacggtaccaccgcctacatccaccacgccgtccaagtgccccagtctgatacaatcctcgctattcaagccgacggcactgttgccggactccacaccggcgatgctactatcgacccagatacaataagcgcattggaacagtatgctgcaaaagttagtatcgacggcagcgaatctgtggcgggtactggcatgattggcgagaatgaacaggagaaaaagatgcagatcgtgctccagggtcatgccaccagggtcacagccaaatctcagcaatctggcgaaaaagccttccgttgcgaatacgacggttgcggtaagctctacactaccgcccaccatctgaaagttcacgaaaggagccacactggagatcgcccatatcagtgcgagcacgcaggatgtggcaaagccttcgcgaccggctatggacttaagagccacgtgagaacccacacaggtgaaaaaccttaccgctgctccgaggacaactgtacgaaatcttttaaaacatcaggcgatctgcagaagcacattagaacgcataccggcgaaaggccctttaaatgtccatttgaagggtgcggacggtctttcactacctccaacattcgtaaggtccacgttaggacacataccggtgaaagaccgtactactgcactgagcccggatgtggacgggcttttgccagcgctacaaactacaaaaaccatgttaggatccacacaggtgagaagccctacgtctgcactgtcccgggttgtgacaagcggttcacagagtattccagcctgtataagcatcacgtggtgcacacacacagcaagccatacaattgcaaccattgtggcaaaacctataagcagatttccacactggctatgcataaacggacggctcataacgacaccgaacccatcgaggaggagcaggaggccttttttgaacctccaccaggtcagggggaagatgtgctcaaggggtcacagataacgtacgtgactggtgttgaaggcgatgacgtagtgtccactcaagttgccaccgtcactcagagtggccttagtcagcaggttaccttgatcagccaggacggcacgcagcacgtgaatatctcgcaggcagacatgcaggcaatcgggaataccatcacaatggtcacacaggatggaacacccataacggttcctgcccatgatgcagtaattagctccgccggtactcactctgttgcaatggtgaccgccgagggtactgagggcgagcaggtggctattgtggcccaggatctggctgcattccataccgcttcctctgagatgggccaccagcagcatagtcaccacctggtaactaccgagacaagaccactcactttggttgctactagcaacggtacccagattgcggtgcaactgggggaacagccctcgttggaagaggccatccgtatcgcctcacgcatccagcagggagagacacctggccttgacgattag

SEQ ID NO: 247315 - DNA, 1917 bp, Artificial Sequence
  Description of Artificial Sequence: Synthetic coding sequence
atgttgcttgctcagattaatcgggactcgcagggaatgaccgagtttcccggaggcggtatggaggcccagcacgtcaccctctgcctgactgaagccgtaactgttgccgacggagataaccttgaaaatatggaaggcgtttctctgcaggccgttactttggcagatggatccacagcctatatccagcataattcaaaggacgccaaactcatcgacggccaggtgattcagctggaggacggtagcgccgcatacgtccaacacgtgcccatccccaagtccactggcgactccctgcggctagaggatgggcaggccgttcaattggaagacggaactacagcgttcatccatcacactagtaaggactcgtacgaccaatccgccctccaggccgtgcaacttgaggacgggactacagcctacattcatcatgccgtgcaggtgccccagtccgataccatcctcgctatccaggcggatggaacagtggcaggactgcatactggcgacgcaacaatcgacccggatactatctccgctcttgaacagtatgcagccaaggtctctatcgacggatctgagtctgtggcgggaactggcatgatcggcgagaatgagcaggaaaagaagatgcagatcgtactccaaggacacgctacgcgcgtcaccgcaaaatcccagcagtccggagagaaagcctttaggtgcgagtacgacgggtgcggaaagctgtacaccactgcccaccatctaaaggtccacgaacgctctcataccggagacaggccatatcaatgtgagcatgccggttgcgggaaggcctttgccacgggctacggcctgaaatctcacgtgagaactcatacgggtgagaaaccctaccgatgctcagaggacaattgtactaagagttttaagacatccggcgacttacagaagcacataagaacccacaccggcgagcggccatttaaatgtccattcgagggttgtggcaggtcattcacaacctccaacatcaggaaggttcatgtaaggacccacacaggtgagcggccttattactgcactgagcctggctgtggcagagcatttgcctccgcaaccaactacaagaaccacgtgcggattcataccggagagaaaccatatgtctgcacagtccccggttgcgacaagaggttcactgaatactcatccctgtacaaacatcacgtcgtccacactcactcaaagccatataactgcaaccattgtggtaaaacgtataaacagatctcaaccttggcaatgcacaagagaacagcccacaatgacacagaacccatcgaagaagagcaggaggcctttttcgaacctccgcctggacagggtgaggacgtacttaagggctctcagataacctatgtgacaggtgtagagggagacgatgtagtgtctactcaggtggcaactgttactcagagcggcctgtctcagcaagtgacactgatttctcaggatggcacacagcatgttaatatttcccaagctgacatgcaggccatcggcaacactatcaccatggtgacacaggatggtacaccgatcacagtccccgcacacgatgcggtgatttcctctgctggaactcacagcgtcgctatggtaacagcagaagggactgagggcgagcaggtcgctatagtcgcccaggatctcgcagcgttccacaccgccagtagtgagatgggtcaccagcagcactctcaccatctggttacgactgagacccgtcctcttacccttgtggccacctcaaatggaacccagatcgcagtccagctgggagaacagcctagtctcgaagaggcaattagaattgcctcccgtatacagcagggggagacacctggcctagatgactag

SEQ ID NO: 247316 - DNA, 429 bp, Artificial Sequence
  Description of Artificial Sequence: Synthetic coding sequence
atgttgcttgcccagattaacagggactctcagggcatgacggagttccctggcggagggatggaggctcagcatgtgactctatgcctgacagaggccgtgactgtagcggacggcgacaatctcgaaaatatggagggcgtttccctgcaggctgttacactcgcagacggttctaccgcatacattcaacacaacagtaaagatgcgaagctgattgatggacaagtgatccagctcgaggacggatctgcggcttatgtgcaacacgtgcctataccaaaatcacgtgacagtctgcgactcgaggatggccaggcagtgcagctcgaagacgggaccacagcgttcatccaccacacatccaaagactcatatgaccagtctgccctacaggccgtccaactcgaagacgggactacagcctag

SEQ ID NO: 247317 - DNA, 255 bp, Artificial Sequence
  Description of Artificial Sequence: Synthetic coding sequence
atgttgttagctcagattaatagagacagtcagggtatgaccgagttcccagggggtggcatggaggcacaacatgtgaccctctgcctgaccgaggcagtgacagttgctgatggagacaacctggaaaatatggagggggttagccttcaggccgtgaccttggccgacggtagcacggcatacattcagcataacagtaaggacgcaaagctgatcgatggacaggtcattcagttggaagacgggagttag

SEQ ID NO: 247318 - DNA, 222 bp, Artificial Sequence
  Description of Artificial Sequence: Synthetic coding sequence
atgctgctggcccagattaatcgtgatagccagggcatgacggagtttcccggtggtggcatggaggcacagcatgtaaccctgtgcctcactgaggcagtgacagtggcggacggggacaatctggaaaacatggagggagtgtctctgcaagctgtcaccttggcagatggctcaaccgcatacatccagcacaacagcaaggacgccaaactgatctag

SEQ ID NO: 247319 - DNA, 573 bp, Artificial Sequence
  Description of Artificial Sequence: Synthetic coding sequence
atgttactggctcagatcaatcgggattcacagggaatgactgagtttccgggtggaggcatggaggcccaacacgtcactctgtgcttgaccgaggctgtgacagtggctgatggggacaacctcgaaaatatggagggtgtcagcctccaggctgttaccctcgctgacggatccaccgcatacatccagcataactccaaggatgccaaactcatcgacggccaggtgatccagctagaggacggatccgcagcatacgtgcagcacgtccctatacccaagagtactggggatagcttgaggctggaggacgggcaggctgtccagctggaggacggaacgaccgcgttcattcaccatacatccaaggattcttacgaccaatccgccctccaggctgtccagctggaggacggtaccacggcctacatccaccacgctgtgcaagtgccccagtctgacaccatcctcgccatccaagctgatgggacagtggcaggcctccacaccggcgacgcgaccattgatcccgacacgatcagcgctctggaacaatacgccgcaaaatag

SEQ ID NO: 247320 - DNA, 411 bp, Artificial Sequence
  Description of Artificial Sequence: Synthetic coding sequence
atgctgctcgcccagatcaacagggattcccagggtatgaccgagttccctggtggcggaatggaagcacagcatgtaacgctgtgcctaaccgaagcagtcacagtcgccgatggagataacctggaaaatatggagggcgtgagcctccaggccgtgactctcgctgacggctccacagcatacattcagcacaattctaaagacgccaagctgatcgacggccaggtcatccagctggaggatggctccgccgcttacgtgcagcacgtccccatccctaagtccacgggcgattccttgcggctggaagatggacaagccgtgcaactggaggacggcacgaccgccttcattcaccataccagtaaggattcttatgatcagagcgcacttcaagcagtccagtag

SEQ ID NO: 247321 - DNA, 528 bp, Artificial Sequence
  Description of Artificial Sequence: Synthetic coding sequence
atgctgttggcccagataaaccgggatagtcaaggaatgacggaattccccggtggcggaatggaggcgcagcatgtcacactctgtcttacagaagctgtgaccgtggcagatggcgacaatctcgaaaacatggaaggagtaagcctgcaggccgtgacccttgctgatggctccactgcatatattcaacataattccaaggatgcaaagctgatagacggccaagttatccagctggaagacggatcagcagcttacgtgcagcacgtgccaattcccaaaagcaccggtgactccctacgcctcgaagacggacaagcagtacagctcgaagatggtacgactgcattcatccaccatactagcaaagatagctacgaccagtcagcattacaagcagttcagctcgaggatggcacaacagcctacatccaccatgcggtccaagtcccccaatccgataccattctcgccatccaggccgatggcacagtggcaggactgcataccggagacgctacctag

SEQ ID NO: 247322 - DNA, 879 bp, Artificial Sequence
  Description of Artificial Sequence: Synthetic coding sequence
atgtcacatctctctcagcaaagaatatactcgggtgaaaacccttttgcatgcaaagtctgcggtaaggtattttctcacaagtctaatctcacggagcatgaacactttcacaccagagagaagcccttcgaatgcaacgagtgtgggaaagccttttctcaaaagcaatacgtaattaaacatcagaacactcacactggagaaaagttgttcgaatgcaacgaatgcgggaagtctttttcccagaaagaaaatcttctgactcatcaaaaaatacatacaggcgaaaaaccatttgaatgtaaagactgcggaaaggcattcattcagaaatctaacctgattagacaccagcgcacgcacaccggagaaaaaccctttgtttgcaaagagtgtggtaagacttttagcgggaaatccaacttaacagagcacgaaaaaatccatataggcgagaaaccttttaaatgttctgagtgcggaacggcgttcggtcaaaagaagtaccttatcaaacatcaaaatatccacacgggcgaaaaaccatatgaatgtaacgaatgtggcaaggccttcagccagcggacgagtttgattgtgcacgtcaggatccactccggagacaagccctatgagtgcaatgtctgtggaaaggcgtttagtcagtcttcaagtctcacggtgcacgtgagaagccacacgggcgagaaaccttacggttgcaatgagtgcggaaaggctttctctcagttcagtacattggccctgcatctccggattcacacaggaaaaaagccctatcagtgttcagaatgtgggaaagccttcagccagaaaagccatcatatccggcaccaaaaaattcatacacattag

SEQ ID NO: 247323 - DNA, 879 bp, Artificial Sequence
  Description of Artificial Sequence: Synthetic coding sequence
atgtcccacctgtcacaacagagaatttattcaggggagaatccattcgcctgcaaggtctgtgggaaggtgttcagccacaaatctaatttgactgagcatgagcattttcacacccgtgagaaaccgtttgagtgtaatgaatgtggaaaagccttctcccagaaacaatatgttataaagcaccagaacacacatacgggtgagaagctgttcgaatgcaacgaatgcggtaaatctttctcccaaaaggagaacttgctcacccaccagaagatccataccggagagaagccctttgaatgcaaggattgcggcaaggcgttcattcagaagtccaacttaattagacaccaacgcacacacaccggagaaaaacccttcgtttgcaaagagtgtgggaaaactttctctggcaaaagtaatctgacggagcacgaaaagattcacattggcgagaaaccctttaagtgtagtgaatgtggcaccgcattcgggcaaaaaaaatacctgataaagcatcagaacatccacactggtgaaaagccctacgagtgcaacgaatgcggaaaagccttttcgcagcgcacttctttgattgtgcatgtccgaatccactccggagacaaaccctatgaatgtaatgtgtgtggcaaggcgttcagccagtctagcagtctgacggtgcacgttaggtcccataccggagagaaaccctacgggtgtaacgaatgcggcaaggcattttcacagttttccaccctggccttgcatcttagaattcacacgggtaaaaaaccttaccagtgcagtgagtgcggtaaggctttcagtcagaaaagccatcatattagacaccagaaaatccacacccactag

SEQ ID NO: 247324 - DNA, 2385 bp, Artificial Sequence
  Description of Artificial Sequence: Synthetic coding sequence
atgaacatcgatgacaagctcgaaggactattcctaaagtgtgggggaatagatgaaatgcagtcctctaggaccatggtcgttatggggggagtctccggccagtctacagtaagcggggagttgcaggactccgttcttcaggatcgaagcatgccacatcaggaaatactcgccgctgacgaggtcttgcaggaatcagagatgcggcagcaagatatgatatcccatgacgaactcatggtgcatgaagagacagtgaaaaacgatgaagagcagatggaaacccacgagagactgccacaaggactgcagtacgcgctgaatgtacctatctcagtcaagcaagagattacttttactgatgtctccgagcaactgatgagagataaaaaacaaatacgcgaacccgtggatcttcaaaaaaaaaaaaagcggaagcagcgtagccccgctaagatcttaacaattaacgaggacgggagtttaggactcaagacaccgaaaagtcacgtctgcgaacattgcaacgccgcttttcgcaccaattaccaccttcaacgccacgtttttattcatacgggagaaaagccttttcaatgtagtcaatgtgacatgaggtttatacagaagtacctgctgcagcgtcatgagaagatccataccggtgagaagccatttaggtgtgatgagtgcggcatgagattcatccagaagtaccatatggagcggcacaaaagaacacactccggtgagaagccataccagtgtgaatactgcctgcaatatttctcgaggacagatcgcgtgctgaaacacaagcggatgtgtcatgagaatcacgataaaaaactgaaccgttgtgcaatcaagggaggcttgctgacgagcgaggaagacagcggtttctccacaagcccgaaagacaactcgttgcctaagaaaaagaggcaaaaaaccgagaagaagagctccggtatggacaaggaaagtgcactcgataaatctgaccttaaaaaagacaaaaacgactacctgccgttatatagctccagtaccaaagtcaaggacgaatatatggtggcagagtacgccgttgagatgccgcactcctctgtgggaggttcacacttggaagacgcttctggtgagatccacccaccgaagttggtgctgaagaagatcaactccaagaggtctctgaagcagcctctggaacagaaccagacaataagtcctcttagcacatacgaggagagcaaagtgtcaaaatacgcattcgaattagtggataaacaggccttattggatagcgagggaaatgccgatatcgaccaagtcgacaacctgcaggagggaccctcaaaacctgtgcactctagcactaactatgacgacgctatgcagttccttaaaaaaaaacgctatctccaggctgctagcaataatagccgggagtacgcgctgaatgtaggcacaatagctagccagccctcggtcacccaagcagcggttgcctccgtgatcgacgagtctaccactgcgagcattcttgaatcacaggccctcaatgtggagatcaagagtaatcacgataagaacgttattccagatgaggtgcttcagaccttgctagatcattactctcacaaggccaacggtcagcatgaaataagcttctctgtggcggataccgaggtcacctcatccatctctatcaattctagcgaggttcccgaggtcaccccatcggaaaatgtcggatctagcagccaggcgagcagttctgacaaagccaacatgcttcaggagtattcaaaatttttgcagcaggccctggatagaaccagtcaaaatgacgcttatctgaattcaccaagcctgaacttcgtcactgacaatcagaccctgccgaaccagccagcattctcctccatcgataaacaggtgtacgccaccatgcccatcaattcattccgttccggcatgaattctccgctgaggactactcccgataaaagccatttcggcctaatcgtgggtgactcccaacacagctttccattctctggggacgagaccaatcacgccagtgccacatctacacaggacttcttagatcaggtaacctcacagaaaaaagcagaggcccaacctgttcaccaagcgtaccagatgtcttcttttgaacagcctttccgcgcaccttatcatggatctcgcgcaggcatcgccacccaattctcaacagctaatgggcaggtcaaccttcggggacctggtactagcgccgagttctctgaatttccgttagtcaatgtgaacgacaacagggcagggatgacttcaagccccgatgctactaccggccagaccttcggctag

SEQ ID NO: 247325 - DNA, 252 bp, Artificial Sequence
  Description of Artificial Sequence: Synthetic coding sequence
atgaatatcgatgacaagttggaagggttgtttctgaagtgtgggggaatagatgaaatgcaatcttccaggacgatggtggtgatgggcggtgtgtcaggacagtccacagtctcgggggagttgcaggattcagtgctacaggaccgaagcatgccccatcaagagattctggccgctgacgaggtcctgcaggagtcagaaatgcgtcagcaggatatgataagccatgacgaattaatggtccattag

SEQ ID NO: 247326 - DNA, 435 bp, Artificial Sequence
  Description of Artificial Sequence: Synthetic coding sequence
atgaagggcgagaaacccttccagtgttcacagtgcgacatgagattcatccagaaatacctgctgcagcgtcacgagaagattcacactggcgagaagccctttagatgcgatgagtgcggcgacgagacaaaccacgcaagcgcaaccagtacgcaagattttcttgaccaggtcacctcacagaagaaagccgaggcgcagccagtccaccaggcataccagatgtctagctttgagcaacctttccgcgcaccataccatgggtcccgagctggtattgctacacagttttcaactgcaaatggacaggttaatttgaggggcccagggacctctgccgagttttcagagtttccactggtgaacgtcaacgacaacagggctggaatgaccagttcccccgatgctacgacgggtcaaacatttggctag

SEQ ID NO: 247327 - DNA, 78 bp, Artificial Sequence
  Description of Artificial Sequence: Synthetic coding sequence
atgaacattgatgacaagctggagggactgtttctgaaatgcgggggtattgacgagatgcaaagtagtcggacttag

SEQ ID NO: 247328 - DNA, 2385 bp, Artificial Sequence
  Description of Artificial Sequence: Synthetic coding sequence
atgaatatcgacgacaaacttgagggcttgtttctcaaatgcggaggaattgacgaaatgcaatccagtagaaccatggtggttatgggaggtgtcagcgggcaaagcactgtgagtggagaacttcaagatagtgtgcttcaagacagatctatgccacatcaagaaatacttgctgccgacgaggtgctgcaggaaagcgaaatgagacaacaggacatgatcagccacgatgagctgatggtgcatgaggagacagttaaaaatgatgaagaacagatggagacacacgagcgcctgcctcagggactccagtatgccctcaacgtcccaataagtgtgaaacaggagattacgttcaccgacgtgagcgagcagttgatgcgggataaaaaacagattcgcgaacctgttgacctgcaaaagaaaaaaaaacgaaaacagcggagcccggctaagatactgactatcaatgaagacgggagcctcggcctcaagacacctaagagtcacgtgtgtgagcactgtaatgccgcttttcgcactaactatcatttgcagaggcatgttttcatccatactggcgagaagcctttccagtgctctcagtgcgatatgcggtttatacaaaagtatttgctgcagagacacgagaagattcataccggtgaaaagccttttcgctgtgatgaatgtgggatgcgatttattcaaaagtaccacatggagagacacaaacgcacacactccggcgaaaaaccataccagtgtgagtactgcctgcagtacttttctagaacagaccgcgtcctgaagcacaagcgcatgtgccacgaaaatcacgataaaaaactgaacagatgtgccatcaagggcggtctgcttaccagcgaagaggacagcggattctccacgagccctaaagataactcccttcccaagaaaaaaagacagaagacggagaagaagtcaagcgggatggataaggagagcgccctggataaaagcgacttgaaaaaggataagaacgattacttacctttatattcttccagcactaaggtcaaggacgaatacatggtcgccgagtacgccgtagagatgccccactccagtgttggaggcagccatctggaagatgccagcggcgagatccaccctcctaagctggtgctcaagaaaattaacagcaaacggagtctgaaacagcctttggagcagaatcagacaatctctccactgagtacttacgaggaatctaaggtgtcaaaatatgctttcgagctagtggataaacaggctctattggatagtgaaggcaatgccgacatcgatcaggtcgacaatctgcaggagggcccatctaagcccgtgcactcctcaacgaactatgatgacgctatgcagttcctgaaaaaaaagcgctacctgcaggcagccagcaataactcacgggaatacgccttaaacgtgggtaccatagcctcacaaccttccgtgactcaagctgccgtcgcatcagtaatcgacgagagtaccacagcgagcatcttggaaagccaagctctgaacgtggaaatcaaatccaaccatgataagaatgtgatccctgatgaggtacttcagaccctgctagatcactactcgcataaggctaacgggcagcacgaaattagcttttccgtcgctgacaccgaagttacatcatctatcagcattaattcttccgaagtgcctgaggtgacaccatctgaaaatgtcggctccagtagccaggcttcttcctcggacaaggcaaacatgctccaggagtatagcaagtttcttcagcaagctttagacagaaccagtcagaatgacgcttacctgaactcgccgtccctcaacttcgtgaccgacaaccagaccctcccaaatcagccagccttttccagtattgacaagcaggtctatgctaccatgccgatcaacagcttccggtctggcatgaattctcctctgcgcacgacacccgacaagagccacttcgggctgattgtgggcgacagccagcattccttcccctttagtggagacgagactaatcacgcctctgccacctctacccaggactttttagaccaggtgacttctcagaaaaaagcagaggcccagcccgttcaccaggcataccaaatgtccagtttcgagcagccctttagggcaccgtaccatggatctagggccggaattgctacccaattctcaaccgctaatggacaggtgaacctgcggggtccaggcactagtgccgagttctctgaatttccactggtcaacgtcaacgacaatcgtgcagggatgacctcaagccctgatgccaccaccggccagacgttcgggtag

SEQ ID NO: 247329 - DNA, 2385 bp, Artificial Sequence
  Description of Artificial Sequence: Synthetic coding sequence
atgaacatagacgacaagctcgagggtttgttcctgaaatgtggtgggatcgacgagatgcaatcaagtcgcacgatggtagtcatgggaggtgtctcaggccagagcaccgtgtccggcgaactgcaggattcagtgctgcaggaccggtccatgccccaccaagagatattggccgctgacgaagtgctgcaggagtctgagatgaggcagcaggacatgattagtcatgacgaactgatggttcacgaggaaacggtgaagaacgacgaagaacagatggagacacacgaaagactcccccagggacttcaatatgccctgaatgtgcctatcagcgtgaagcaggagataacctttactgacgtgtcggagcagctcatgagggacaagaagcagatacgtgagccagttgacttgcaaaagaaaaaaaaaaggaagcaacggtctccagcgaagattctcactattaatgaagatggaagtctcggcttgaagacacccaagagtcacgtgtgcgaacactgcaacgctgcattcagaaccaactaccacctgcaacggcatgtgtttattcacactggagagaagccgtttcagtgtagccaatgtgatatgagatttattcagaagtacttactccagagacacgagaaaatccatactggcgagaagcccttcaggtgcgatgagtgtggaatgcgatttatacagaaataccatatggaaagacataagcggacacactctggggagaagccgtatcagtgcgagtattgcttgcagtactttagtaggaccgaccgggtcttgaagcataaaaggatgtgtcacgagaatcatgataaaaagctgaaccgctgtgccatcaagggcggtctgctgacatccgaggaggactctgggttttcgacgtcacctaaagacaactctcttcccaagaaaaagaggcaaaaaactgagaagaagagcagcggaatggacaaggagtccgcattggataagagtgacctgaagaaggacaagaacgactatctgcccctatactcatcatctacgaaagtgaaagacgaatatatggtggccgaatatgctgtggagatgccccatagttctgtgggtggtagccaccttgaggacgcctccggcgagattcatcccccaaaactggtccttaaaaagataaatagcaaaaggtctttgaaacagccccttgaacagaatcaaactatctctcccctgtctacatatgaagaaagcaaagtgtctaagtatgcctttgagctggttgacaaacaagcactacttgatagcgagggcaacgcggacatagatcaggtggataacctgcaggagggcccaagcaagcctgtccactcatctactaattatgacgatgccatgcagtttctgaaaaagaaacgatatttacaagcggcatctaacaattccagggaatatgccctgaacgttggcaccatagcctctcaaccaagcgtgactcaggccgctgtggcctctgtcatagatgaatctaccactgcgtctattctggaatctcaagcactgaatgtcgaaatcaaatccaatcatgacaagaatgtgataccagatgaagtattgcaaaccctgctcgatcattactcacacaaggcaaacgggcagcatgaaatctctttctctgtcgcggatacggaagtgacatccagcatctccataaattccagcgaagttcccgaagttactccctcagaaaatgtgggatcttcttcccaagccagctcatccgacaaagcgaacatgctgcaggaatattccaaatttctgcagcaagcactcgataggaccagtcagaatgacgcctatctgaactctcccagcctgaactttgtgacagacaaccagactctccccaatcagcctgcctttagcagtattgataaacaagtgtatgcaactatgccaattaacagcttcagaagcggtatgaattccccactacgcacgacacccgataagagtcacttcggactgattgtgggtgattctcaacactctttccccttctcaggggatgagaccaatcacgccagcgccacctccacccaagattttcttgaccaggttaccagccaaaaaaaagcggaggcccaacccgtccatcaggcctatcaaatgtctagcttcgagcagccatttagagccccatatcatggttccagggccggtatagccacccagtttagtaccgccaatggtcaagttaacctccgcggaccaggcacttccgccgaattcagcgaattccccctggtcaacgtaaacgataacagggcgggaatgacatcaagccccgacgcaactacaggccagacgtttggttag

SEQ ID NO: 247330 - DNA, 2385 bp, Artificial Sequence
  Description of Artificial Sequence: Synthetic coding sequence
atgaatatcgacgataagttggaagggctgtttctgaagtgcgggggtatagatgaaatgcaaagcagtcggacgatggtggtcatggggggtgtctctgggcagtctaccgtaagtggcgagctgcaagactctgtcctccaagacagatcaatgcctcaccaagaaatcctggctgctgacgaagtccttcaggaatccgagatgcgacaacaggacatgatcagccatgacgagctcatggtgcacgaggagacggtgaagaatgacgaggagcagatggagacccacgagagactcccccaaggactgcagtacgccttaaacgttcctatctcagtcaagcaggagatcacctttactgatgtatctgagcaactaatgagagataagaagcaaatcagagaaccagtggacttgcagaagaaaaaaaaacggaagcaaaggtcccctgccaagatccttacgattaacgaagacggaagcctaggcctcaagacccccaagagccacgtgtgtgagcactgcaacgccgctttccgcactaactaccacctacagcggcatgtgtttatacacacaggcgaaaagcctttccagtgttcacagtgtgatatgaggttcattcaaaagtatctgctgcagcggcatgagaagatacacaccggtgaaaagcctttcagatgtgatgaatgtgggatgcgatttatccagaaataccatatggagaggcataagaggacccactctggagagaagccttatcagtgtgaatactgtctccagtacttctcgagaacagatcgcgtgctcaagcataagagaatgtgtcacgagaatcacgataagaaattgaacagatgtgctattaaagggggtctgctgacttcagaggaagactccgggtttagtacaagtccgaaggataattcactcccaaagaaaaaacgccaaaagaccgaaaaaaagtccagtgggatggataaagaaagcgcacttgacaaatctgatctgaagaaggataaaaacgattacctaccactctatagctcctccactaaggtgaaagatgaatatatggtagctgaatacgccgtcgagatgccacacagctccgtcgggggatctcatttggaggatgccagcggagagattcaccctcctaagttggttctgaagaagattaacagcaaacggagtctcaaacaacccttagaacagaatcagacgatctctcccttgagtacctacgaggaatccaaagtttcaaagtacgccttcgagctcgtagacaagcaggccctgctggattccgaaggaaacgcagacattgatcaggtggacaatcttcaggagggcccttccaaacctgtgcattcctcaacaaattacgacgatgcgatgcagtttttaaagaagaagagatacctgcaggccgcttcgaataactctagagagtatgcccttaacgtgggaacaatcgcatctcagcctagtgtaacccaagctgcagtggcctcagtcatcgacgagtcaaccaccgcttctatcctcgagtcccaagccctgaacgtggagattaaatccaatcacgacaagaatgtgatcccagatgaagttctgcaaacactacttgaccattactctcacaaggctaacgggcaacacgaaatcagcttttctgtggctgacaccgaggtgacgtcctctatcagtataaactcgtccgaagtgcccgaggtaacacccagcgagaatgtaggatctagcagtcaggccagtagttcagataaggcaaacatgctgcaggagtattcaaaattcttgcagcaggcgttggatagaacatctcagaacgacgcctatctcaacagtccatcccttaactttgtgaccgataatcagaccttgccaaatcagcccgctttctctagcatcgataagcaggtgtacgccaccatgccaatcaactcctttcggtccggtatgaactcacctctcaggacaactcctgataaaagtcattttggcctcattgtcggtgactcgcagcactcatttccgtttagtggggacgagacaaaccacgcctctgccaccagtacccaggatttccttgaccaggtgacaagccagaagaaagcagaggctcaacccgttcatcaggcataccagatgagctccttcgagcagccgtttcgggctccctaccacgggagtcgggctggcattgctacccagtttagtacagcaaacggtcaggtcaacctgcgaggacctgggacatcagccgaattcagcgaatttccactggtaaacgtgaacgacaaccgcgctggaatgacttctagccctgatgctaccacaggccagacctttggctag

SEQ ID NO: 247331 - DNA, 228 bp, Artificial Sequence
  Description of Artificial Sequence: Synthetic coding sequence
atgaatatcgatgataaactggagggattgtttctcaaatgtggagggattgatgagatgcagagcagtagaactatggtggtaatgggaggcgtttctggccagtctaccgtgtcaggagagctgcaggatagcgtgctgcaagatcgcagcatgccacatcaggaaattcttgccgcagacgaggtactgcaagagtcagaaatgcggcagcaggatatgatctag

SEQ ID NO: 247332 - DNA, 1365 bp, Artificial Sequence
  Description of Artificial Sequence: Synthetic coding sequence
atgaacattgacgacaagttggagggcctgtttctgaagtgtgggggtatagacgagatgcagtccagcaggactatggtggtcatggggggtgtgagcggtcaaagtaccgtgtctggagagttgcaggattcagttctccaggaccggagtatgcctcatcaagaaatcctcgctgcagacgaggtcctacaagagtccgagatgaggcagcaggacatgatttctcacgacgaactgatggtgcacgaagagaccgtgaaaaacgacgaagagcagatggaaacccatgaacggctgcctcaaggattgcaatacgctctgaatgtgcctatatccgtgaagcaggaaatcacgttcacagacgtgtccgagcagttaatgcgggacaaaaagcagataagggaaccggtggatcttcagaaaaagaaaaagcgaaagcagaggtccccagcaaaaattctaactattaacgaagacggtagccttggcctgaagacacctaagtcccacgtgtgtgagcattgcaacgctgcatttaggaccaactaccacctgcaacggcatgtgttcattcacaccggtgagaagccattccagtgctcacagtgtgacatgcgctttattcagaaatacctcctacagagacatgagaaaatccacactggagagaagcctttccgatgcgacgagtgtggcatgcggtttatccaaaagtatcacatggaacggcataagaggactcactcaggcgagaagccttaccaatgcgaatattgcctgcagtacttctctagaaccgatcgcgtgctaaagcacaagcgcatgtgtcacgagaaccatgacaaaaagctgaacagatgtgcaatcaaaggtgggttgctcacgtccgaggaggattctggcttctctacttcacctaaggacaattctctgcccaagaaaaaacggcagaagactgagaaaaaaagtagtgggatggacaaggaaagtgcgcttgacaaatccgacctgaagaaggataagaacgattatctgcccctttacagcagctcgactaaggtcaaagatgaatatatggtggccgagtacgcagtggaaatgccacactccagtgtgggtggatcacatttggaagatgctagcggtgagattcacccgcctaagctggtgctcaagaagatcaacagcaagcggtcattaaagcagccactggagcagaaccaaacaatctctccattgagcacatacgaggaaagcaagttccagtctatgctgctcaacctgtggatcaacaggttatactggacccagaaggccatgctcactttgatccgactcatcatctgcaggcgtgcccagtag

SEQ ID NO: 247333 - DNA, 396 bp, Artificial Sequence
  Description of Artificial Sequence: Synthetic coding sequence
atgcgcttcatccagaagtacctgttgcaaagacacgagaaaatccacaccggagagaagccatttcgttgcgacgagtgtggagacgaaactaaccatgcctccgccactagcacacaggattttctagaccaggtgacaagtcaaaaaaaagccgaggcgcagccagtgcatcaagcctatcagatgtcttcgttcgagcagccgttcagagcaccatatcatggatctcgggcagggatcgctacccagttttcgacagctaacggacaggtcaatctgcgcggacccggaaccagcgcagagttttccgaattcccactggttaacgtcaacgacaaccgtgctggaatgacaagttcacctgatgcaaccaccggccagacatttggatag

SEQ ID NO: 247334 - DNA, 432 bp, Artificial Sequence
  Description of Artificial Sequence: Synthetic coding sequence
aagacacactataattgtggagaacacacaaaagcattctctgggaagcatacactagtgcaacagcagaggaccttgaccaccgagagatgctatatatgcagcgagtgtggcaagtccttttcgaacaagtccaatctgattaaacatcggcgtgtgcacacaggagaacggccttatgagtgttcggagtgcggcaaaagcttttcgcaacgctcagcgctgctgcagcataggggcgttcacaccggggagcggccttacgagtgctcagagtgtgggaagttttttacatatcacagcagcctcattaaacaccaaaaagttcactctgggagtaggccttatgagtgtagtgagtgcggcaagtcatttagtcagaactcctcgttgatcgaacatcatagggtgcatacaggggaacgcccttag

SEQ ID NO: 247335 - DNA, 1314 bp, Artificial Sequence
  Description of Artificial Sequence: Synthetic coding sequence
atggccgctgctaccctcagaactcccacccaggggaccgtgacttttgaagacgtcgccgtgcatttctcttgggaagaatggggcctgttggatgaggcgcagcgctgcctctaccgtgacgtgatgctggagaatctagccctactaacaagcctggacgtgcaccaccagaaacagcacctgggagaaaaacactttaggagcaatgtgggcagagccctgttcgttaagacttgcactttccatgtgtcaggcgaaccctctacctgtcgcgaggtggggaaagattttcttgctaaactgggctttttacatcagcaggccgctcacacgggagaacagagcaatagtaaaagcgatggcggtgcgatcagtcatagaggcaaaactcactataattgcggtgagcataccaaggcatttagcggcaagcacactttagtacagcaacagagaaccctgactacagaacgctgctacatctgctcagagtgcggcaagagctttagtaaatcttatagtctgaacgatcactggcgactgcacactggcgaaaagccatacgagtgcagggaatgtggcaaatctttcagacagtcttcttctcttatccagcaccgcagagtgcacacagccgtgaggccacacgaatgcgatgagtgtgggaagctgttcagcaataaatccaatctcattaagcaccgcagagtgcacacaggagagaggccctatgagtgctcggagtgtggaaagtcctttagccagaggagcgcccttttacagcatcgcggtgttcataccggggagcggccatatgagtgctcagaatgcggcaagttcttcacctaccactccagtctgattaagcaccagaaggtgcatagcggcagcagaccatacgaatgctctgaatgtggcaagagttttagtcaaaattccagccttatcgagcaccacagagtgcacaccggggaacgtccctacaaatgctccgagtgtggaaaatctttctcgcagcgtagcgcactactacagcaccgtggcgttcataccggggagagaccttacgaatgttccgaatgtggaaaattctttccgtattcttcctcccttaggaagcatcagagggtccacaccgggtcgcgaccctacgaatgcagcgaatgcgggaaaagcttcactcagaactccgggctgatcaaacacagacgcgtgcacactggagagaagccctacgaatgtacagagtgcggaaaatctttctcacataactcatctcttataaaacaccagaggatacactcccgatag

SEQ ID NO: 247336 - DNA, 1314 bp, Artificial Sequence
  Description of Artificial Sequence: Synthetic coding sequence
atggctgcagctacactgcgcacccctacccaaggcacagtaaccttcgaggatgttgccgtccacttcagttgggaagagtggggactactagacgaggcacagcgctgcctctatcgggatgttatgctggaaaatcttgccctcctgactagcctcgacgtgcaccatcagaaacagcacctgggagaaaagcattttcgttctaacgtcgggagagcactgttcgttaaaacatgcacattccacgtctcaggagaaccaagcacatgccgagaggtggggaaggactttttggctaaactgggattcctgcaccagcaagcagcacacacaggcgagcaaagcaactcaaaatccgatggcggagccattagccacagaggtaagacacattataactgcggggaacacaccaaggctttctccgggaaacacacgttagtgcagcaacagagaaccttaacaactgagaggtgttacatttgttccgaatgcggaaagagtttctctaagtcatactccctcaacgatcactggagactccatacgggcgagaaaccttatgagtgcagagaatgtgggaaatcatttcgacagtctagctccttaatccaacaccgtagagtgcacactgcggtccgccctcatgagtgcgacgagtgcggaaaactgttttcgaacaagagcaatttgattaagcaccgcagagtgcatacaggagaacgcccttatgagtgttcagagtgtggaaagtctttttcacagcgtagtgctctgctgcagcacagaggagtgcacacaggtgagcgaccctacgaatgtagcgaatgcggtaagttttttacttatcacagctctctaatcaaacatcagaaggtgcatagcgggtcccgaccctatgagtgttctgagtgcggaaagagtttctcccagaacagtagcttgatcgaacaccaccgtgttcatacgggagagagaccctataagtgtagcgagtgcgggaagtcctttagccaaagatctgcgctcctgcagcacaggggggttcatactggcgaacggccatacgaatgcagcgaatgtggaaaattctttccatatagctctagtctgaggaagcatcagcgtgtgcacaccgggtctagaccttatgagtgctccgagtgcggaaagtcatttactcaaaactctggactgattaaacataggagggttcatactggagagaaaccctatgagtgtacagaatgtggaaaatcatttagtcataattctagcctgatcaagcaccagcggatccatagtaggtag

SEQ ID NO: 247337 - DNA, 1617 bp, Artificial Sequence
  Description of Artificial Sequence: Synthetic coding sequence
atgacaacttttaaggaggcggtgacattcaaggacgttgccgtggtgttcaccgaagaggagctgggacttcttgatccagcacagagaaagctgtacagggatgtgatgctcgagaacttccggaacctgttgtccgtggggcatcagccctttcaccaggacacttgccactttctgcgagaagagaagttttggatgatggggacggcaacccagagggagggaaactcgggaggaaagatccagacagagttggagtccgtaccagaggccggtgcacacgaagaatggtcgtgccagcagatctgggaacagatagcaaaagatttgactagatcccaggacagcattattaacaactctcagttttttgagaacggtgacgttccgagtcaggtcgaggctggcctccccaccatccataccggacagaagccttcacaggggggaaagtgtaagcaatcaatctccgacgttccaatatttgatcttccccaacagctgtactcggaggaaaaaagttacacttgcgacgaatgtgggaagtccatctgctacatcagcgctttgcatgtgcaccagcgcgtgcatgtgggggagaaactctttatgtgcgatgtgtgtggtaaagagttctcccaatctagccatcttcagacccaccagagagtacacacgggtgaaaagccgtttaaatgtgaacagtgtgggaaagggttcagcaggcgctctgcactgaacgtacaccgcaaactccacacaggtgaaaagccctatatctgtgaggcctgtggaaaggcatttatccacgacagtcagctgaaagaacacaaaagaatccacacaggagagaagccatttaagtgtgatatttgcggaaagactttttactttcgcagtagactgaagtctcattcaatggttcatacgggggagaaacccttccgctgcgatacgtgtgataaaagtttccatcagcggtctgcactcaatagacattgcatggtgcatacaggtgagaaaccataccgttgtgagcagtgcggcaaaggtttcatcggcagactcgatttctataaacatcaggttgtgcacacaggagagaagccatataattgtaaagaatgcgggaaaagtttccggtggtcatcatgcctcttgaatcaccagcgcgtgcattccggagagaagtcctttaagtgcgaggagtgcggcaaagggttttatacaaatagccaattgagctcccaccaacgctctcatagtggcgagaagccctataaatgcgaggagtgtgggaagggttacgtgactaagtttaacttggatctgcaccagcgggtgcacacaggcgagaggccctataattgcaaggagtgcggtaaaaatttctctcgtgcctccagtatccttaatcataagcgcctccactgccagaagaagccttttaagtgtgaagactgcggcaagcgccttgttcatagaacctataggaaggatcagcccagagattacagcggcgagaatccttctaaatgcgaggattgtggaagaaggtacaagaggaggcttaacctggacatcctgttgtcccttttcttaaacgatacctag

SEQ ID NO: 247338 - DNA, 1650 bp, Artificial Sequence
  Description of Artificial Sequence: Synthetic coding sequence
atgattaagcgttcaaaggtcctcgttttttgctcaaagatcatggaagaggctgtgacatttaaggatgttgccgtagtgttcacagaagaggaactggggctcctggaccctgcccaacgcaagctataccgcgacgtcatgctggaaaatttccggaatctgctttctgtgggtcatcagccgtttcaccaggacacatgtcatttcctgagggaggaaaagttttggatgatgggtaccgctacacaacgggagggcaacagtggtgggaagattcagactgaactagaatccgtgcctgaggcaggggctcatgaagagtggtcatgccaacaaatttgggaacagattgcaaaggatctgacgagatctcaagacagtatcatcaacaactcacagttttttgaaaacggtgatgtgccatcacaagtcgaagccggattacccacaatccatacgggccaaaagccatctcagggagggaagtgtaagcagagcatttctgatgtcccaatttttgatttgcctcagcagctgtactccgaggaaaaaagctacacctgcgatgaatgtggcaagagcatttgttacatcagcgccttgcacgtgcaccagcgagtgcacgtaggggagaagctgtttatgtgcgacgtctgtggcaaggagttcagtcagtcctctcacctccagactcatcagagagtccatacaggtgagaaacctttcaagtgcgagcagtgtggcaagggattctcgaggaggagtgcattaaacgtgcaccgaaagttgcatactggtgaaaagccctatatttgtgaagcatgtggaaaagccttcatccacgatagccagttaaaagagcataaacgcatccatacaggagagaagccattcaaatgcgatatctgcggtaaaacattttactttaggagcaggcttaagtctcactccatggttcataccggagagaagccatttcgctgtgacacttgtgacaaatcatttcatcagagatccgccctgaacagacattgcatggttcacaccggagagaaaccttataggtgcgagcagtgcggcaagggtttcatcggaaggctggacttctataaacaccaggtcgtgcatactggggaaaagccgtacaactgtaaggaatgcggcaagtcgtttagatggagtagttgcctgctaaaccatcagcgagttcactccggagaaaagtcattcaagtgtgaggagtgtgggaaagggttctacacaaattctcagctgtcgtcccaccagagaagtcactcaggcgagaagccctacaaatgtgaggaatgcggtaaggggtacgtgactaagtttaatctggacctgcaccagagagtgcacaccggtgagagaccgtacaactgcaaagagtgtgggaagaattttagccgagcctccagcattctgaatcacaagcgcttgcactgccagaagaaacccttcaaatgcgaagattgtggcaagagattagttcacaggacctataggaaggaccagccccgagactacagcggcgagaatcctagcaaatgtgaagattgcggcagaagatacaaaaggagactgaatctagatattcttctgagccttttcctgaacgacacatag

SEQ ID NO: 247339 - DNA, 693 bp, Artificial Sequence
  Description of Artificial Sequence: Synthetic coding sequence
atggtgatgagtcctccgagactgaagcaagactatccacagttcattcaggatcgcaacctgccacgggttggcagcgttaactctccatctgtgatgttcccatcacttatttttctgtctagctacactcagaaacgtagtctgattcatgtcatgtctgtggagaaagcctccgtcacttctcaacttttcatgttcattagggaatctacatgggagcggaacagtctatgcgtgatgtgtgtggcaaggaacctagtcaaggcacacatctgcaagttaattcgggagtccaccctggagaggaatcactcaaacgtgtccaacgtcggtaaggtctcagtggtggatcagcacttgatgtttatagtcaattatacacaagaaagaaatctgacctttgtgagacacgtgggacgaccctcgtttatgatcccgtctcttagaaacatacgagagagtattctgggtcgcaatcactcgaacgttatctacgtcgtgcgtccatccatactgggacaggaccttagagcgataccttggttcacacaggaaaagaatcacctcggagtaattcacgtgataagagctttcatccgggaccagcacttgattgggattgcttggagtacacaggaaagaaaccgcacagacgtgtctagcgtggagaaggctctgctggtgggctag

SEQ ID NO: 247340 - DNA, 1521 bp, Artificial Sequence
  Description of Artificial Sequence: Synthetic coding sequence
atgccagccaatggtacctcaccccagagattcccagccttgatacctggagaacccggaaggtctttcgaggggtctgtctctttcgaagacgtcgcggtggattttactcgccaggagtggcacagattggatcctgcccagcgtaccatgcacaaagacgtcatgttggagacatattctaacctggctagcgtggggctgtgcgtggccaagccggagatgattttcaagctagagcggggagaggagctatggatcctcgaggaagagagctcaggacacggttacagtggaagtctttctttgctgtgtggtaacgggtctgtgggtgacaacgcgctgcgccacgacaacgacctactccaccaccaaaagattcagacattggatcagaatgtagaatataacggatgtcgcaaagcctttcacgagaagacaggatttgtgaggaggaagcgaaccccaaggggtgataagaactttgagtgccacgagtgcggcaaggcctattgccgtaagagcaatctggtcgaacaccttcggatccatacgggcgagaggccgtatgagtgtggcgaatgcgcgaagactttcagcgctaggtcctatctgatcgcccatcagaagacccacacaggcgagaggcctttcgaatgtaacgaatgtggtaagagttttggcaggaagtctcaactgattctccataccagaacccacaccggcgaaagaccgtacgagtgcacagagtgcgggaaaaccttctcggagaaagctacattgactatccatcagagaacccacacgggggaaaaaccttacgagtgcagtgaatgcgggaagactttcagggtgaagatcagcttaacacagcatcatcgtacccacacaggcgagaagccgtacgagtgcggtgaatgcggcaaaaatttcagagcaaaaaagtctctgaatcagcatcagcgcatacatactggggagaagccatatgagtgcggagagtgcgggaaattttttagaatgaagatgactctgaacaatcaccagcgaacccacacgggtgagaagccctaccagtgcaacgaatgtggaaaatcctttcgtgtgcacagttccttaggaatacaccagaggattcacaccggcgaaaaaccctatgaatgcaatgagtgtggtaatgccttttatgtcaaagcacgcctcatcgagcaccaacgcatgcactcaggggagaagccttatgaatgctccgagtgtggaaaaattttctctatgaaaaagagcctgtgtcaacaccgtcgtacacacactggcgagaagccctacgagtgctcagaatgcggtaacgccttctatgttaaggtacgcctgattgagcaccagcggatccacaccggcgagaggccctttgagtgtcaggagtgcggcaaagctttttgtcgtaaggcccacctgactgagcatcagcgcacacatatcggctggtcttggcgttgtaccatgaagaaagcttctcactag

SEQ ID NO: 247341 - DNA, 2049 bp, Artificial Sequence
  Description of Artificial Sequence: Synthetic coding sequence
atgccatctctgcgcactcggagggaggaggcagaaatggagctcagcgtcccgggaccctcgccgtggacccctgcagctcaggcacgggtgagagatgccccagcagtgactcatcctggctccgcagcatgcggaacaccctgctgtagcgacaccgaattggaggcaatttgtccacactatcaacagccagattgtgacaccagaaccgaggacaaggaattcttgcacaaagaagacattcatgaggatctggaaagtcaggctgagatttcggagaactatgctggggacgtttcccaggtgcccgaactaggtgatctgtgcgacgatgtctctgagcgcgattggggcgttcccgagggccgacgcctaccccagtcactgtctcaagaaggtgactttacccctgctgccatgggactgctgaggggtcctctcggagagaaagatctggattgcaatggctttgactcccgcttttccctgagtcccaatcttatggcctgccaggagattccaaccgaagaaagaccccatccttatgatatgggtggccaatcctttcagcattctgtggacctgaccggtcacgaaggcgtgcccactgcagagagtccattgatttgtaacgagtgcggcaaaactttccaaggaaaccccgatcttatccagaggcaaatcgtgcacaccggggaggcaagctttatgtgcgacgactgcggaaagactttcagccagaatagcgtactcaaaaaccgccacagaagtcacatgagcgagaaggcctaccagtgcagcgagtgcggcaaagcctttaggggtcattccgatttctcgcggcatcagtctcatcattcaagtgaaaggccttacatgtgtaatgagtgtggtaaggctttcagccagaactcctctctcaagaagcaccagaaaagccatatgagcgagaagccctatgaatgcaacgagtgcgggaaggcctttcgtagatccagtaacttgatccagcatcagcgtatccattctggcgaaaaaccatacgtgtgttccgaatgcgggaaggccttcaggaggagtagtaacctaattaagcatcatagaacccacacaggagaaaagccatttgagtgcggagagtgtggcaaagctttttcacagtctgcccacctacgcaaacaccagagggtgcatacaggtgaaaaaccttacgagtgcaatgactgcggtaagccattctccagagtgagtaacttgatcaaacatcaccgggttcatacgggagagaaaccatataagtgcagcgattgcggaaaagccttcagccagagttcgtcccttatccagcatcgcagaatccacaccggggagaaacctcacgtttgcaacgtgtgtggcaaagctttctcttattcctccgtcttaagaaagcaccagatcatccatactggcgagaaaccttatcgctgctcggtttgcggcaaagccttttcacattcctcggctttgatccaacaccagggggtgcacacaggagacaagccctatgcctgtcatgaatgtggcaagactttcggcaggtccagcaacctgattctgcaccagcgcgtgcatactggtgaaaaaccttacgaatgcactgaatgcggcaaaacattctctcagtcgagcacacttatccagcaccagcgcattcataatggcctaaagccacatgaatgtaaccagtgtgggaaggcttttaatcggtcatccaacctgattcaccatcaaaaagtgcacaccggagaaaaaccttatacttgtgttgagtgtgggaaagggttcagccagtcctcacatctcatacaacaccagattatccacacaggtgagagaccgtacaagtgtagcgagtgtggtaaagccttctctcaaaggtccgtacttatccaacatcagcgaatccataccggcgtcaagccttatgactgcgctgcatgcggcaaggctttttcacaacgctccaagctgattaagcaccagttaatccatactcgggagtag

SEQ ID NO: 247342 - DNA, 2049 bp, Artificial Sequence
  Description of Artificial Sequence: Synthetic coding sequence
atgccttccttaaggacccggagggaagaggctgaaatggagctctccgtgcccggaccttccccctggacaccggctgcccaggcacgggtgcgggacgctcccgctgtgacccaccctggttccgcagcctgcggtacaccgtgttgctccgatactgagttggaagccatctgccctcactatcagcagcccgactgtgatacaaggaccgaggacaaagagttcctgcacaaggaggacattcacgaggacttagagagccaggcagagatcagcgaaaactatgctggggatgtgagccaggttccagagctgggagatctctgtgacgatgtcagcgagagagactggggggttcccgagggccgtcgcctgcctcagtccttatcacaggaaggggatttcacacctgccgctatgggcctgttaagaggacccttaggcgagaaagacttggattgtaacggttttgactcaagattctccctgagtcctaacctaatggcctgccaggagataccaaccgaggagagacctcacccctatgacatgggcggtcagagtttccaacactccgtggacttgactggtcacgagggggtccctaccgccgagtcacctttaatttgtaatgaatgcggtaaaaccttccagggaaaccctgatctgatccagcgacaaattgtgcacacaggcgaggcaagcttcatgtgtgatgactgcggcaaaacatttagccagaatagcgtattgaaaaatagacatcgaagtcacatgagcgaaaaggcctaccagtgttccgaatgtggcaaagcgtttagggggcactctgatttttctcggcaccagtcccatcactcatcagaaaggccctacatgtgcaacgagtgtggaaaggccttcagtcaaaatagttctctgaagaagcaccaaaagtctcacatgtctgaaaaaccatacgaatgcaacgagtgtgggaaggccttccggcgttcgagcaatctgatccaacatcagcgtattcatagcggcgaaaagccatacgtgtgttccgaatgtggcaaggcttttaggcgatcttcgaatctgattaagcaccatcgcactcacaccggagaaaaaccgttcgagtgtggcgagtgtggcaaggcctttagccagtccgcccacctgcgcaagcaccaacgcgtgcatactggggagaagccatacgagtgtaatgattgtgggaagcccttttcccgagttagtaatctaattaaacaccatagagtacataccggcgaaaaaccctataaatgttccgactgtggtaaagcattttcccaatcaagttccctgatacagcacagacgaatacatacaggagaaaaaccacacgtgtgcaatgtgtgtggaaaagcattcagctactctagcgtcctgcggaaacatcagattatacataccggggagaagccctataggtgttccgtctgtggcaaggcgtttagccactcctctgcattgattcagcaccaaggcgtgcacacaggggataagccctacgcttgtcacgaatgtggcaagaccttcgggaggtcaagcaacctcattcttcaccaaagagtgcacacaggggaaaaaccttacgagtgtaccgagtgtggtaagacgttctcacaatcaagcaccctgattcagcatcagcgaatacataatggcctgaagcctcatgagtgtaaccagtgcggaaaggcgtttaatcggtcatcaaacctgatacaccatcaaaaagtgcatacgggggagaagccttatacttgcgttgagtgcgggaagggattcagtcaatcaagccaccttatccagcaccagatcatccatacaggagaacgtccctacaagtgctccgagtgtggtaaggctttcagccagagatcagtgctcattcaacaccagcggatacacacgggggtgaaaccctacgactgcgccgcttgtggcaaggcattcagccagcggtccaaattaattaagcatcagctgattcatactagggagtag

SEQ ID NO: 247343 - DNA, 444 bp, Artificial Sequence
  Description of Artificial Sequence: Synthetic coding sequence
atggccctcactcaagtgaggctcacgtttcgggacgtcgctatcgaatttagccaggaagagtggaagtgccttgatcccgcacagaggatcctgtaccgggatgtgatgctcgaaaattactggaacctggtgagcctcggtctgtgccatttcgatatgaatatcataagtatgctcgaagaagggaaagaaccgtggactgtgaaatcttgcgtgaagatagcgaggaaaccgagaacccctgaatgcgttaagggcgtcgttactgaccttctccggaggtggaagcattggctcctcttgctcggtatttgttgccccaaaccacatggacgggtgtcttctaggctgagactatctaggagccttggccacttttttcattcagcttttgccacattcatgggggtctgtgataaacgcgtcgggtcgatcttctag

SEQ ID NO: 247344 - DNA, 2457 bp, Artificial Sequence
  Description of Artificial Sequence: Synthetic coding sequence
atggcactgacccaggtgcgtcttacttttcgtgatgtcgctatcgagtttagtcaggaggaatggaaatgcctggatcctgcacaaagaatactgtacagagacgtcatgctggaaaattactggaatctcgtgtcattagggttgtgccactttgacatgaatatcatctcgatgttagaagaaggaaaagaaccttggaccgtgaaatcctgcgttaaaatcgcacggaagccaagaactcccgagtgcgttaaaggtgtcgtgactgacatcccgccaaaatgtactattaaagacctcctgccgaaggagaagagtagcactgaggctgtcttccataccgtggtgttggagagacatgagtcacctgatatagaagatttttcctttaaagaacctcagaaaaatgtacacgattttgagtgccagtggcgggatgacaccggcaactataaaggcgtgttgatggcgcagaaggagggaaaaagggatcagcgagaccgtagagatatcgaaaataaactaatgaacaaccagctcggggtctcttttcatagtcacctgcctgagcttcaactgtttcagggtgagggaaaaatgtacgagtgcaaccaggtggaaaagtccacgaataatgggagctcagtgtccccattgcagcagatccctagtagtgttcagacccaccgatccaaaaaatatcacgaactcaaccactttagtctgctgacacaaaggaggaaggccaattcgtgcgggaaaccatataagtgcaatgaatgcggcaaggcttttactcaaaactccaatcttactagtcatcgtcgaatccactccggagagaaaccctacaaatgctctgaatgtgggaagacttttacagtgcgatcaaatcttaccatacatcaggtcatccacaccggtgaaaagccgtataaatgccacgagtgtggcaaggtgttcaggcataattcttaccttgccactcataggaggattcacactggcgagaaaccttacaaatgcaacgaatgcgggaaagccttccgaggccactctaatctgaccactcaccagcttattcacaccggtgagaagccatttaagtgcaacgagtgcggcaagctgtttactcagaacagccatttgatatcgcattggcgcatccacactggcgagaagccctataagtgtaatgagtgtggcaaggcattctcagtgcgttcctctctggcaatacaccagaccatacacacaggcgaaaagccctataagtgcaacgaatgcgggaaggtgtttagatataattcgtacctcgggaggcacagacgagtacacactggtgaaaaaccctataagtgtaacgaatgcggaaaggccttcagcatgcattccaatttagccactcaccaagtcatccacaccggcaccaagccatttaagtgcaacgaatgctcaaaagtattcactcagaactcgcagttagccaaccaccggagaattcacactggggaaaaaccatacaagtgtaatgagtgtggcaaagccttttctgtcaggagcagcctaaccacacaccaggcaattcacagcggcgaaaagccatacaaatgtattgagtgtggtaaaagtttcactcagaagagccacctgagatcccaccggggtattcacagcggcgagaagccctacaaatgcaatgaatgcggaaaagtgttcgcacagacgtcacagctggctagacactggcgggttcacacgggagagaaaccatataagtgcaatgactgcgggcgagccttctctgacagatcatcccttacgttccatcaagccatccacacaggagagaaaccctacaagtgccacgagtgtgggaaagtctttaggcacaacagctaccttgctactcaccgcagaatccataccggagaaaagccttacaagtgtaacgaatgcggcaaggccttttccatgcactccaatctgactacccataaggtgatccacacgggtgagaagccctataagtgtaaccagtgcgggaaagtcttcacccaaaactcacatctggccaaccaccagcggacacatactggagagaagccatatcggtgtaacgaatgcggaaaggcgttctcagtgcgttcttcccttacaactcaccaggccattcacactgggaagaaaccgtacaaatgtaatgagtgtggaaaggtatttacccagaatgcccatctggctaatcacagaagaatccatactggggagaaaccataccgatgtaccgaatgcggtaaggcttttcgtgtgcgaagcagcctgaccactcatatggcgatccacaccggcgagaagcgttacaagtgtaatgaatgtggtaaggtgttccgccagtcatctaacttggcttcgcatcaccggatgcacaccggggagaagccctacaaatag

SEQ ID NO: 247345 - DNA, 2457 bp, Artificial Sequence
  Description of Artificial Sequence: Synthetic coding sequence
atggcgttgacgcaagtgcggctgactttcagagacgtggccatagaattctctcaggaagaatggaaatgtttggaccccgctcagaggattctctacagagatgtgatgctggagaactattggaatttagtttctctgggcttatgccactttgatatgaacattatcagcatgctggaggaggggaaggagccgtggaccgttaagtcttgcgtgaagatcgctaggaagccaagaactcctgagtgtgtgaagggcgtcgtaacagatattcctccaaaatgcacgattaaggatctgctgcctaaggagaagagtagtaccgaagcagtctttcacaccgttgtgttggagcgacatgagtcccctgacatcgaagatttttcctttaaggagccacaaaagaatgtgcatgatttcgagtgccagtggcgggacgacaccggaaattataaaggagttctaatggctcagaaggaggggaaaagggatcagagggatcgaagagacatcgagaataagcttatgaacaatcagctcggggtttctttccatagtcatcttcccgagttgcagctatttcagggcgagggcaagatgtacgaatgtaatcaggtggagaagagcacaaataatggatctagcgtgtcaccactgcagcagataccatcttcagttcagacccacagatccaagaagtaccacgagctgaaccatttctcactgctgacccaacggcgtaaggctaattcctgtgggaagccctacaagtgtaacgaatgcggtaaggccttcacacagaactcgaacctgacatcacacagacggattcactccggagagaaaccctacaagtgctccgagtgtggaaaaacatttactgtgaggtccaatctcaccatccaccaggttattcatactggggaaaagccctacaagtgtcacgaatgtggcaaggtgttcaggcacaacagttacctggccacacatcggagaatccacactggcgaaaagccgtataagtgcaatgagtgcggtaaagcttttagggggcacagcaatctcactactcatcagctcattcacaccggagaaaagcctttcaaatgcaacgaatgcggcaagctgttcacccagaactctcatctcattagccattggcgaattcacaccggagagaaaccatataaatgcaatgaatgtgggaaagcgttttccgtccgcagcagcttagctatccaccaaacaatccataccggcgagaagccctataaatgcaacgagtgtgggaaggtgtttcggtataacagctatttaggcaggcatcgccgtgttcacaccggagagaagccatataagtgcaatgagtgcgggaaggccttctcgatgcactcgaacctggcaacgcatcaagtgattcacacaggtaccaaaccatttaaatgtaatgaatgttctaaggtgtttacccaaaactcacaattggctaaccaccgaaggatccacaccggcgaaaagccgtacaagtgcaacgagtgtggcaaagccttttcagttcgctcatctctcacaactcatcaggccatacatagcggagaaaagccgtacaaatgcatagagtgtggcaaatctttcacacaaaagtcccatctgaggagccatcggggtatccatagcggcgagaagccttacaaatgcaatgaatgcgggaaagtgttcgcccaaacgtcacagctagctcgccattggcgcgttcatactggcgaaaaaccatacaaatgtaatgattgcggacgtgcatttagtgacaggtctagtctgacttttcaccaagccatccataccggagagaagccttataagtgtcacgaatgtggcaaagtgtttagacataactcgtacctggctacccaccggaggattcacaccggcgagaaaccctacaagtgtaacgagtgtggaaaggctttttccatgcactccaatctaacaactcacaaggtgatccacactggcgagaaaccttacaaatgtaatcaatgcggaaaggtatttacacagaactcccacctcgcaaatcatcagcgaacccacacaggggaaaaaccctaccgctgtaatgaatgtggaaaggctttttcagtgagatcgagccttacaacccaccaggctatccataccgggaagaaaccctataaatgtaatgagtgtgggaaggtgtttactcaaaacgcccacctggccaatcatagaaggatccacactggcgaaaaaccctacaggtgcactgagtgcgggaaggcctttagagtccggagtagccttaccacccacatggctatccacaccggcgaaaagaggtacaaatgtaacgagtgcggcaaggtctttcggcagtcatcgaatctggcgtcccatcacaggatgcacactggagaaaaaccatacaaatag

SEQ ID NO: 247346 - DNA, 2457 bp, Artificial Sequence
  Description of Artificial Sequence: Synthetic coding sequence
atggcactcacccaggtacgcctgacgttccgggacgtggctatcgaattcagccaggaagagtggaagtgtctggatcccgcacagcgtatcctctaccgcgatgtgatgcttgagaactactggaacttggtttccctgggtttgtgtcacttcgacatgaatatcatcagtatgctggaagaaggcaaggagccatggactgtgaaatcatgcgtcaaaattgcccgaaaaccccgaactcctgagtgtgtgaagggtgtagtaaccgacatcccaccaaaatgtaccattaaggacctgcttccaaaagagaagagtagcaccgaggcagtcttccatactgtcgtcctcgagcggcatgaaagccctgacatagaggattttagttttaaggagccccaaaagaacgtgcacgatttcgaatgtcaatggcgcgatgacaccggaaattacaaaggcgtcttaatggctcaaaaggaaggaaaaagggaccaacgggataggagagatatcgaaaataagctcatgaacaatcagctgggagtgagtttccactcacacctgccagaactgcaactcttccagggcgaagggaaaatgtatgagtgtaatcaggtggagaagagcaccaataatggtagttctgtgtcccccctgcagcaaatcccttccagcgtgcagacccaccggtccaaaaaatatcacgaactgaaccacttctctcttcttacacagcgcaggaaagctaattcctgcggaaaaccctataaatgtaacgaatgtgggaaggccttcacccagaatagtaatctgacctcacacaggaggatccacagtggggaaaagccgtacaagtgcagtgagtgcggcaaaaccttcaccgtgcgaagtaacctgactatacaccaggtaatccatactggggaaaaaccctacaagtgccatgaatgtggaaaagtgttcaggcacaacagctaccttgcaacacacaggcgtatacataccggagaaaagccgtacaagtgcaatgaatgcggtaaggcatttagaggtcactctaacttgacaacacatcagcttatccacaccggcgaaaagccttttaaatgcaacgaatgtggaaaattgttcacacaaaactcccatctgatcagccactggaggatacacactggagaaaaaccttacaagtgtaatgaatgcggaaaggccttttctgttcgtagttcgctcgcgattcaccagaccatccacaccggtgagaagccctacaagtgtaatgaatgcgggaaggtctttcgctacaacagctatctggggagacatagaagggtgcacacaggagaaaagccctataagtgtaacgaatgcggcaaggctttcagcatgcactccaacctagcaacgcatcaagtaatccacactggcaccaaaccctttaaatgcaacgagtgtagcaaggttttcacacagaactcgcagctggccaatcatcggaggatccacaccggcgagaagccgtataagtgtaacgagtgtggaaaagctttctctgttcgcagctcgcttacaacccaccaggccattcatagcggcgagaaaccttataaatgcatcgagtgtggtaagtcattcactcagaaaagccatctgcgatctcaccgcggaatccattccggagagaagccttacaagtgtaacgagtgtggtaaagtgtttgcccagacgtcccagctggccaggcactggcgggtccacacgggggagaaaccctataaatgcaacgattgcggtagagccttctctgatcgcagctccctgacatttcatcaggctatccataccggtgaaaagccatataagtgccacgagtgcgggaaggtgttcagacacaactcatacctggccacccatagaagaattcatacgggggagaagccttataagtgcaatgagtgtggaaaagctttctctatgcactctaatctaactacgcataaggttatccacactggcgaaaagccctacaaatgcaaccagtgcggcaaggtgtttacacagaatagccatctggctaaccatcagagaacccacacgggcgagaaaccttaccgatgcaatgagtgcgggaaggccttttcagtgaggtcttccctcacaactcatcaagccattcataccgggaagaaaccctacaagtgtaatgaatgcgggaaggtgtttacccagaatgctcacctggcgaatcaccgccgtatccacacaggggaaaagccataccgctgtacagaatgcgggaaggccttcagggttcggtcaagccttacaacccacatggctattcacactggagaaaaaagatataagtgcaacgagtgtggaaaggtgtttcgacagtcctctaacttagccagccatcataggatgcatacaggagaaaagccttacaaatag

SEQ ID NO: 247347 - DNA, 1350 bp, Artificial Sequence
  Description of Artificial Sequence: Synthetic coding sequence
atggagttcttcatcagcatgtccgaaactatcaaatacaatgacgatgaccataaaacactcttcttgaaaactttgaacgaacaacgcctcgagggcgaattttgcgacatcgcgatagttgttgaggatgttaaattccgcgctcacaggtgtgtgttagcggcatgctccacctacttcaagaaactctttaagaagcttgaagtagactcctccagcgtgatagagatcgactttctccgcagcgatatatttgaagaggtcctaaactacatgtacactgcgaagatttcagtgaagaaagaagatgttaacctgatgatgtcgagcgggcagattttgggcatacgctttcttgataaactgtgttcccaaaaacgcgacgtgtcatctccagatgagaataacggtcaatccaaaagcaaatactgtctgaaaatcaaccgacctattggtgacgcggcagacactcaggacgacgacgtcgaggaaataggcgaccaggatgacagcccttcagatgacacagtggaggggacgcccccatctcaggaggacggaaagtccccaactactactctccgcgtgcaggaagccattctcaaggaactcgggtccgaagaggtgcgcaaggtcaattgctacggtcaggaggttgagagtatggaaaccccagagtctaaagacctagggtctcagacgccccaagcactgacattcaatgatgggatgagtgaagtgaaggacgagcaaacacccggatggaccactgctgcctcagacatgaagtttgaatacctgctatatggtcaccaccgcgagcaaattgcctgccaagcatgtgggaagacgttcagcgatgagggtcgccttcggaaacatgagaaactgcacacagcagaccgaccttttgtttgtgagatgtgcactaaggggtttactactcaagcccatttgaaagagcacttgaaaattcacacaggctacaagccgtattcttgtgaggtctgtggcaagagctttatcagggcccctgacttaaagaaacatgagagagttcactccaatgaacggccatttgcctgtcatatgtgcgataaagcatttaagcataagtcccatctgaaggaccacgagcgcagacaccgcggagagaaacctttcgtttgtgggtcctgcaccaaagcattcgctaaagcctctgatctcaaacggcatgagaacaatatgcattcggaacgcaaacaggtgactccaagcgccattcaatcagagaccgaacagctgcaggccgctgccatggccgctgaagctgagcagcaactcgagacaatagcatgttcatag

SEQ ID NO: 247348 - DNA, 1350 bp, Artificial Sequence
  Description of Artificial Sequence: Synthetic coding sequence
atggagtttttcatctccatgagtgagacgattaaatacaatgacgacgaccacaaaaccttatttcttaaaacactgaacgagcaacggctggagggtgagttttgcgacatcgccatagtggtggaagatgtgaaattccgagcacataggtgtgtgctcgctgcctgcagcacatattttaagaagctcttcaagaaactcgaagtggacagttcaagtgtcattgaaatcgatttcttaaggagcgatattttcgaggaggtgctcaattacatgtatacggccaaaataagcgtgaagaaggaagacgtgaatctgatgatgtcttccggacaaattctcgggatccgttttctggataaattgtgcagtcagaaaagagatgtgagttctcctgacgagaataacggacagagtaagtctaaatactgtctcaaaatcaatcggccaatcggcgatgccgcagacacccaggacgatgacgtggaggagattggggaccaggatgattcacctagcgatgataccgtggaagggacacctcccagccaggaggatggcaagagccccacaaccacccttcgtgttcaggaggcaattctgaaggagctgggcagcgaagaggttcgcaaggtgaattgttatggccaagaagttgaatctatggaaacacctgaatctaaagatttaggctcacagacacctcaggccttaacatttaacgatggcatgagtgaggtcaaggacgagcagactccaggatggacaaccgcagccagtgacatgaagttcgaatacctcctgtacggccaccatcgagagcagatcgcctgtcaggcatgcggtaaaacctttagcgacgagggcagactaagaaaacatgagaaactgcacacagcagacaggccgtttgtgtgtgaaatgtgtaccaaggggtttacgacccaggctcatcttaaggagcacttaaaaatacacacaggctataaaccttactcatgtgaggtatgtggcaagtcctttattagggcacctgatctgaagaaacacgaaagagtgcactctaacgaaaggcccttcgcctgccacatgtgcgataaggccttcaagcataagtcccaccttaaagatcacgaacgcaggcaccgcggtgagaagcccttcgtctgcgggtcctgtaccaaggccttcgctaaggcctccgacctcaaacgccatgagaacaatatgcatagcgaaaggaaacaggtgacaccttctgcaattcagtcggagactgagcagctgcaggctgcagcaatggcagctgaggctgagcagcagctggaaacgatcgcctgtagctag

SEQ ID NO: 247349 - DNA, 1458 bp, Artificial Sequence
  Description of Artificial Sequence: Synthetic coding sequence
atggctactgagccaaaaaaggctgcagcccagaatagtcctgaagacgaaggactgctgatcgtcaagatcgaagaggaggagttcatccacggccaggatacttgcttgcaaaggtccgagctgttgaagcaagagctctgtagacagcttttccgtcagttctgctaccaggactctcctggcccaagggaggctctcagcaggttgagagagctgtgttgtcagtggctcaaacccgagatccacactaaggaacagatactagagctcctggtgctcgaacagttcctcactattcttccgggagacctgcaagcttgggtgcacgaacattatccagaaagtggagaggaggctgtgaccatcctcgaggatctggaacggggaaccgacgaggccgtgctgcaggtgcaggcccacgaacatggccaagagatttttcaaaagaaggtgtctccccctggacccgcactgaatgtaaagcttcagccggtggagactaaggcacacttcgatagcagcgaaccacagctgctttgggattgtgataacgagagcgagaattctagatctatgcctaaactcgaaattttcgagaagatcgaatcacagcgaataatctcaggcaggatctccgggtacatcagtgaggcttcgggggagtcccaggacatttgcaagtccgctggcagagtgaaacgtcagtgggaaaaagagtccggggagtctcagcgtctgagtagtgcacaagatgagggttttgggaagattttaacgcacaagaacacagttaggggcgagattatctctcacgacggatgcgagcgccgtctgaatctgaattctaacgagttcacacatcagaaatcctgcaagcatggcacttgtgaccagtcattcaagtggaattccgatttcataaaccatcagattatttacgctggtgagaaaaatcatcagtacgggaagagcttcaaaagccccaagctcgcaaagcacgctgcggtgttttccggagataagacccaccagtgtaacgagtgcggcaaggccttcaggcacagtagcaaactagcacgtcaccaacggatccataccggggaaaggtgttacgagtgcaacgagtgcggcaagagtttcgcagaatcctcggatctgactcgccatcggaggatccacaccggtgaaaggccattcggttgtaaagaatgcggccgtgcgttcaatctcaacagtcatctgatccggcaccagcgtatccataccagggagaagccatacgagtgctctgaatgtggcaagacctttagagtgtcctctcacctgattaggcatttccggatccacactggagaaaaaccgtatgagtgtagcgaatgtggccgagcgttctctcagagcagcaacctgagccagcaccagagaattcacatgagggaaaatctgctgatgtag

SEQ ID NO: 247350 - DNA, 1239 bp, Artificial Sequence
  Description of Artificial Sequence: Synthetic coding sequence
atgtcacttgggggttctgataccatgctgaaaggcgctgacactagtgaaagtggcgcagtcatcaggggaaattatcgactcggattaagtaagaagagctccctgttctcgcatcaaaagcaccacgtttgtcccgagtgcggcaggggattttgccagagatcggatttgatcaaacaccagagaacacacacaggcgagaagccctatctttgcccagagtgcgggaggcgattctctcagaaagcttccctgtcaatccaccagaggaagcacagcggggaaaagccttatgtgtgtcgtgaatgcggtcggcacttcagatatacaagctccctcaccaaccacaagcgcatccatagcggagaacgacctttcgtctgccaggagtgtgggagaggcttcaggcaaaaaatcgcgctccttctgcaccaaagaacccatttggaggagaaaccttttgtgtgtcctgagtgcggaaggggcttctgccaaaaggccagcctcctgcagcatcagagcagccacactggtgaacggcctttcctgtgtttggagtgcggcaggtcttttcgacagcagagcttgctcttgtctcaccaggtcacccattcaggagaaaagccgtatgtgtgcgccgaatgcgggcattcttttaggcagaaggtgacactcatccgccaccagcggacacatacgggagagaagccctacctgtgcccccagtgcggcagaggtttctctcagaaggtaactctaatcggacaccagagaacacatacaggcgaaaaaccatatctatgcccggattgcggcagaggttttggccaaaaagtcaccctgatcagacaccagcgcacgcatactggggagaaaccttatctctgtcctaaatgcggtcgcgcttttggattcaaatctttgctaacacggcaccaacgcacccacagcgaagaggaactctatgtggacagagtttgtggacaggggttggggcaaaaatcccacctgattagtgatcagaggacccacagcggagaaaagccatgtatttgcgacgaatgcggtcggggatttggttttaaatcggcactcatcaggcaccagcgaacacacagtggtgagaaaccatatgtctgcagagaatgcggacggggattctctcagaaatcccaccttcacagacatagaaggactaagtccggtcatcagctcttgccccaagaagtcttctag

SEQ ID NO: 247351 - DNA, 291 bp, Artificial Sequence
  Description of Artificial Sequence: Synthetic coding sequence
atgtcgcctggattgcttactaccagaaaggaggcactcatggcattcagggacgttgccgtggcctttacacagaaagagtggaaactactgagctctgcccaaagaactctgtatagagaagtcatgctcgaaaactactcccacttggtgagccttggtatcgcattcagcaagccaaaactgattgaacagcttgaacaaggagacgagccctggagggaagaaaacgaacacctactggatctgtgccccggaaggcgcattacacggtctggagtcagagattag

SEQ ID NO: 247352 - DNA, 1812 bp, Artificial Sequence
  Description of Artificial Sequence: Synthetic coding sequence
atgagcccgggactgttgacgacgcgcaaggaggccctgatggccttccgcgacgtggctgtcgcattcacccagaaagagtggaagctcctgtcttccgcacagagaaccctatatcgcgaggtcatgctagaaaattactcccacttagtgtctctgggtatcgcttttagtaagccaaaacttatcgaacagttagaacaaggcgatgaaccatggcgagaagaaaatgaacatcttctggatctctgccctgaacctcgtaccgagttccagccaagtttccctcatctggtggcattcagtagtagtcagttgctccggcaatatgccctgagcggccacccaacacagatctttcctagcagcagtgccggaggggacttccagttggaggctccgagatgcagttccgaaaagggtgagagtggcgagaccgagggccctgacagctcattgcgaaagaggccaagtagaatttccagaacatttttctcaccccaccagggcgatcctgtggaatgggttgagggaaatagagagggcggaacagatctgcgcctagcgcagcggatgtccctgggcggatctgacacaatgcttaagggcgctgacacttcagaaagcggagccgtcattcgcggaaactatcgactgggattgtcaaaaaaatcatccctgttttcccaccagaagcatcacgtgtgccccgagtgtggcagaggtttttgccagcgaagcgacttaattaaacaccagcgcacgcacactggtgaaaagccgtatctttgtcccgagtgcggaagacgtttctcccaaaaggccagcctatccattcatcagagaaaacacagtggtgaaaagccttacgtgtgtcgcgagtgtggccgtcacttccgatacacaagttctctgaccaaccacaagcgcatccattccggtgaacgcccattcgtgtgccaggagtgcgggagggggtttaggcagaaaattgccttgctcttgcatcagcgaacccacttagaggagaagccattcgtgtgtcctgagtgtggacgcggtttttgccaaaaggcgtctctgctccagcaccagagtagccatacgggagaacgtccgttcctttgcctggaatgtggcaggtcctttaggcagcagtctttactgctgagccatcaggtgacccactccggcgagaagccttatgtttgcgctgaatgcggccattcattcaggcagaaagtaaccctcatccgtcatcagcgaacacacactggggagaagccctacctctgcccccagtgcggaagaggtttctcccaaaaggtaactcttatcggacaccagcgcacacatacaggggagaagccatacttgtgtccggactgtggcagaggcttcgggcaaaaggtgaccttaatcaggcaccagagaacccatacaggagaaaagccctatctgtgtcccaagtgcggtagggcattcggcttcaagtccttgttgacccgccatcagcgcacacactcagaagaggagctgtatgttgacagggtttgcgggcaaggcttgggacagaagtcccatctcatcagtgaccagaggactcactctggcgaaaagccctgtatctgtgacgaatgtggacgtgggttcgggtttaagtcggctcttatccggcaccaacgcacccacagcggtgagaaaccatacgtttgtcgtgaatgtggtcgtgggttcagtcagaagtcccacctccaccgccacaggcggacaaagtcaggtcaccagttgctccctcaagaggtgttttag

SEQ ID NO: 247353 - DNA, 1224 bp, Artificial Sequence
  Description of Artificial Sequence: Synthetic coding sequence
atggccgctaaaatggagatcaccctaagctcgaacactgaagcatctagtaagcaggagcggcacattatcgccaagttagaggagaagcggggacctcccctacagaaaaattgcccagacccagaactttgtcgacagagcttccggaggttctgctaccaggaggtttccggcccacaggaagccctctcacagctgcgccagttgtgtaggcagtggttacaaccagagttacacacgaaggaacagatcctggaactccttgttatggaacaatttctgaccattctcccgccagaaatacaggcgagggttaggcataggtgccccatgtcctccaaggagatcgtcaccctggtggaggattttcatcgtgcttccaagaagcctaagcagtgggttgccgtgtgtatgcagggacagaaggtattgctcgagaagaccggctcacagcttggggaacaggaactgccggatttccagcctcaaacccccaggcgcgacttgcgagagtcaagtccagcggaaccttctcaggctggggcatatgataggctgtctccacaccattgggagaaaagtcccctcctgcaggagcctacccccaaactggcaggcaccgaggctccccgaatgaggagcgacaataaagagaacccgcaacaggaaggagcaaagggtgccaaaccatgcgcagttagtgcgggaagaagcaaaggtaacgggctgcagaaccccgagcccaggggcgcaaacatgtcagaacctcggctgagtcgtcgacaggtgagctctcccaacgcacagaaaccattcgcccactaccaacggcattgccgtgtggaatacatcagtagccctttgaagagccatcccctcagggagctgaagaagtccaagggaggaaagcgttctctgtcaaatagactgcagcatctgggccatcaacctacccggtccgccaagaaaccatacaagtgcgatgattgtggtaagtccttcacttggaactctgagctcaagcggcacaagcgggtacacacaggcgagagaccatatacatgcggtgaatgcggtaattgttttggtcgtcagtcgacactcaagcttcaccaacgaattcataccggcgagaaaccataccaatgtggccagtgcgggaaaagcttccggcaaagtagcaatcttcatcaacatcaccggctgcaccacggggactag

SEQ ID NO: 247354 - DNA, 705 bp, Artificial Sequence
  Description of Artificial Sequence: Synthetic coding sequence
atggccgctaaaatggaaattacactgagcagcaacacggaggcgtcctccaagcaggaaagacacattatagcaaagctcgaagaaaagcggggtccccctttacagaagaattgccccgatcctgagctctgccgccagtcattccgtcggttttgttaccaagaagtgtcaggccctcaagaagccctgagccaactgaggcagctatgtcggcagtggcttcaaccagaactgcacaccaaagaacagatcctagaactgctcgtcatggagcagtttctgacaatactgccccctgaaatccaggccagggtccgacatcgttgccccatgagctctaaagagattgtaactttggtggaggattttcaccgggctagtaaaaagcctaagcagtgggtggcagtgtgcatgcaggggcagaaagtcctgctcgaaaagaccggatcacagctcggcgaacaggaattgcctgacttccagcctcagacccctagacgggacctgcgtgagtcatccccagccgagccaagccaggccggtgcctatgaccgcctgagcccacatcactgggaaaaatctccgttactccaggaaccaacccctaaactcgcagggaccgaactgctgattgaaaagactgatccgaacatggccactgacgaactcccctgcaagctctggctctcgttcattgcctag

SEQ ID NO: 247355 - DNA, 2136 bp, Artificial Sequence
  Description of Artificial Sequence: Synthetic coding sequence
atgccagcagacgttaacctgtctcagaaacctcaggtgctggggccagagaagcaggatgggagctgcgaggcgtctgtgagcttcgaggacgtgactgtcgactttagcagggaagagtggcaacagctggatccggcacagaggtgtttgtatcgggacgtcatgttggagctgtacagtcatctttttgccgtcggttaccacatcccaaaccctgaagtcatattccgcatgctgaaggagaaggaaccgagagttgaggaagctgaggtctcccatcagcggtgccaagaaagggaatttggcctcgaaatcccgcaaaaagaaattagtaagaaggcatccttccagaaagacatggtgggagagtttacacgcgacgggtcttggtgctctattctagaagaattacggctggatgcagacagaactaaaaaggacgaacagaatcaaattcaacctatgtcccactccgcgttctttaataagaaaactctaaacactgaatcgaattgtgagtacaaggacccgggtaaaatgattcggacccgaccacatcttgcctctagtcagaaacaacctcagaaatgctgtctgttcactgagtcactgaagctgaacctcgaggtgaatggccagaatgaatccaacgacactgaacaactggatgacgtggtaggcagcgggcagctgttcagccactcttcctcggacgcctgtagtaagaatattcacaccggggagacattttgcaagggcaatcaatgccggaaggtgtgcggccacaagcagtctttgaagcaacaccagattcatacccagaagaagcctgacggctgctctgagtgcgggggatcttttacccagaaatcccacttgttcgcccagcagaggattcacagcgtgggtaatctgcacgagtgcggaaaatgtggcaaagccttcatgcctcagctgaagctgagtgtgtaccttacagaccatacaggagacatcccttgtatatgcaaggaatgtggtaaagtgtttatccagagaagcgagctgctgactcatcaaaaaacacacacccggaaaaagccatataagtgccacgactgtggtaaggccttcttccagatgctatcgctgtttaggcaccagcgaactcacagcagggagaaactgtatgaatgtagcgagtgtgggaaaggtttcagccaaaactccacgctgatcatccatcagaaaatccataccggggaacgtcaatacgcatgcagcgagtgcggaaaggccttcacccagaagtcaacgctgtccctgcaccagcgcattcattccggccagaaatcctacgtgtgcattgaatgtggccaggcatttatccaaaaggcccacttaatcgtgcaccagcgctctcataccggagagaagccttaccagtgtcacaattgtgggaagtctttcatctctaaaagccagcttgacatccaccacagaattcatacaggagagaagccgtatgaatgtagcgattgcggaaagactttcacacaaaaaagtcacctgaatatccaccagaagattcacactggcgagcgacatcatgtgtgttctgagtgtggtaaggcttttaaccagaaaagtatcctaagcatgcaccagcggatccacacaggtgagaagccctataaatgctccgagtgtggaaaggcatttactagcaagtctcagtttaaagaacatcagagaatccacaccggagagaaaccctatgtatgcaccgaatgcggaaaagccttcaatggtcgctccaattttcataaacatcaaatcacacacactagggaacggccattcgtatgctacaagtgcggcaaggccttcgtgcagaagtcagagctgataacccaccagaggacacacatgggagagaagccatatgaatgtcttgactgtggcaaaagtttctccaaaaaacctcagctgaaggtgcatcagcgcatccacacaggtgagcgcccttacgtatgctctgagtgcggtaaggccttcaataaccgtagcaattttaacaagcatcagacgacgcatacccgggataagtcatacaagtgtagctattctgtgaaaggctttactaagcagtag

SEQ ID NO: 247356 - DNA, 966 bp, Artificial Sequence
  Description of Artificial Sequence: Synthetic coding sequence
atggcagccggatggctgactacttggtcccaaaattctgtgacttttcaagaagtcgccgtggacttcagtcaggaggaatgggccttactggacccagcccagaagaatctttataaggatgttatgcttgaaaactttcgcaacctggcatccgttgggtaccagctctgcaggcattcgctcatcagcaaagttgatcaagaacagctgaagactgacgagcggggaatcctgcagggagactgtgcagactgggagacacagttgaagcctaaagacacaattgccatgcaaaatatccctggaggaaaaacttcgaacggcataaacactaactgtgtgcggactcatagcggtgagatgccatatgaatgctccgactgcggcaaagccttcatttttcagagttctctgaagaagcacatgcgaagccatactggcgagaaaccttatgagtgcgatcactgcgggaagtcattttcccaaagctcacacttgaatgtccacaagaggacacacaccggagagaagccctatgactgtaaggagtgtgggaaggcattcaccgtgccttcatctctgcaaaagcacgtaaggacccacacaggggagaaaccctacgagtgcagcgattgcggtaaagcattcatagatcaatctagccttaaaaagcacacgcggtcccataccggggaaaaaccgtatgagtgtaaccagtgtggaaagtctttctcaacaggaagctacttaattgtacacaagcggactcatactggagagaagacctatgaatgtaaagagtgcggtaaagcctttaggaattccagctgtctccgggtgcacgtgaggacgcacaccggagaaaagccttataagtgtatccaatgcgaaaaagcattctcaaccagtacaaatctcatcatgcacaagcgcatccacaacggccaaaaactgcacgagtag

SEQ ID NO: 247357 - DNA, 1446 bp, Artificial Sequence
  Description of Artificial Sequence: Synthetic coding sequence
atggccgctggctggctgaccacttggtcccagaactctgtgaccttccaggaggtcgccgttgatttctcccaagaggagtgggccctgttggacccagcacagaaaaacctgtacaaagatgtgatgctggaaaacttcaggaatcttgcctcagtcggatatcagctatgtaggcattctctgatctctaaggttgaccaggaacagttgaaaactgacgagcgcggaatcctgcagggcgactgtgccgattgggaaacccagctgaagcctaaggatacgatcgccatgcagaatataccagggggaaagacttcaaacggtatcaacacggcggaaaatcaacccggagagcatagcctggaatgcaatcactgtggcaagttccgaaagaacacccgatttatttgcacgaggtattgcaagggcgaaaagtgttacaaatatatcaaatactctaaagtgtttaatcatccaagtacactgcggtctcacgtgtctatccatatcggagagaagaccttagagtttacggattgtcggaaagcctttaatcaagagagctcactccgtaaacatttacgcactcccactggccagaagtttcaggagtacgagcaatgtgacatgagctttagccttcactctagctgcagtgttcgggaacaaataccaaccggcgaaaaaggcgatgagtgttcagattacggaaaaatctccccgctgagcgtccacactaaaactgggtccgttgaggaggggctcgaatgcaacgaacacgaaaagacttttacagatccgctttccctccagaactgtgttaggactcattcaggcgagatgccatatgaatgcagtgactgcggtaaagcttttatcttccaaagctcactgaagaaacacatgagatcgcatactggggaaaaaccatacgagtgcgaccactgcggaaaatccttttctcagtcatcccacctgaacgttcacaagaggacccacaccggggaaaagccctacgattgcaaagaatgcggcaaggccttcacggtgcctagtagcctgcagaaacacgtgcgtacccacactggagaaaaaccatatgagtgcagtgattgcggaaaagccttcatcgatcagtcctctttgaagaagcacaccaggtctcataccggggagaaaccttatgagtgcaaccagtgtggaaaatccttctccactggaagctatctcattgtgcacaagaggacccataccggtgaaaagacttacgaatgtaaggagtgtgggaaggcctttcgcaactcctcatgtctcagggtgcacgttcggacacacaccggtgagaagccctataagtgcatccagtgtgagaaggctttttctaccagcactaaccttattatgcataaaaggattcacaatggtcagaagttgcacgagtag

SEQ ID NO: 247358 - DNA, 363 bp, Artificial Sequence
  Description of Artificial Sequence: Synthetic coding sequence
atggcagcgggttggttgaccacttggagccagaacagtgtgacttttcaggaggtggcagttgatttcagtcaagaggagtgggcgttgctggatcccgcacagaagaatttatacaaggacgtgatgctcgagaactttaggaacctcgccagcgtcggataccagctgtgtcgtcactccttgatctcaaaggtggatcaggaacagttgaagacagatgaaaggggcatattgcagggtgactgtgctgactgggaaacccaactgaaacctaaggacaccattgccatgcagaacattccaggtggcaagacttccaacggaataaacaccaatccacatggacgggagtttttgtag

SEQ ID NO: 247359 - DNA, 966 bp, Artificial Sequence
  Description of Artificial Sequence: Synthetic coding sequence
atggccgctggctggctcacaacttggtcgcaaaattccgtaaccttccaagaagttgccgtagatttcagccaggaagagtgggcactcctggacccagcccagaaaaatctttacaaggacgtgatgctcgaaaactttagaaatctggctagtgtggggtatcaattgtgccgacattctctcatctccaaggttgatcaagagcagctgaaaaccgacgaaaggggaatcctgcagggggactgtgccgattgggaaacccagctcaagccgaaggatacgatagcaatgcaaaatattcccggaggaaagaccagcaacggcatcaataccaattgcgtgcggactcacagtggtgagatgccttatgaatgcagtgattgtggtaaagccttcatctttcagtcgtcattaaagaagcatatgaggagccacaccggcgaaaagccttatgaatgtgaccattgcgggaaaagcttcagtcaatccagccatctgaatgttcataaacgtacacatactggagagaagccatacgattgtaaggagtgcggcaaggcttttacagtgccatcttctctgcagaaacacgtgcgaactcacacaggagagaagccctacgagtgctccgactgtggaaaggcctttattgaccagtcctcgctgaaaaagcatactcgcagccacaccggggagaaaccctacgagtgcaatcagtgcgggaagtcattctctacggggtcttatcttatcgtgcacaagaggacccatactggcgaaaaaacatatgagtgtaaggagtgtggcaaggcattcaggaattcgtcctgtctcagggtacatgtacgcactcacactggcgagaagccttataaatgcatccagtgtgagaaggcattttctacatccacaaatctgatcatgcataagcgtatacacaacgggcaaaaattgcacgaatag

SEQ ID NO: 247360 - DNA, 1650 bp, Artificial Sequence
  Description of Artificial Sequence: Synthetic coding sequence
atgccagtagatctgggtcaggcgttggggctcctcccttctctcgccaaggcagaagattcccagttttctgagtccgacgccgctctgcaagaagaactgtcttctcctgagaccgcaaggcaactcttcaggcagttcagatatcaagtgatgtccggccctcatgagacactgaaacagctaaggaagctgtgcttccagtggcttcagcccgaagtacataccaaggaacagattctggaaattttgatgctcgagcagttcttaactatcctgcctggtgagattcaaatgtgggttaggaaacagtgtccagggagcggcgaagaagcagtcaccctagtggagtctctgaaaggggacccccagcggctgtggcaatggatttccattcaggtgctcggtcaggatattttgagtgagaagatggagtcgccatcctgccaggtgggtgaggtcgaacctcacctcgaagtggtaccacaggaactgggccttgagaactcatcttctggccctggtgagctgcttagtcacatcgtgaaggaagagagcgatactgaagctgagctcgctctggctgcttcccagcctgctaggctagaggaacgcttgattcgggaccaagatctgggcgcttctcttttgcccgctgccccacaagagcagtggcgccaattagattcaacccagaaagagcaatattgggaccttatgctcgaaacttacggcaagatggtctccggagcaggcatctctcaccctaaatccgacctcacaaatagcatcgaattcggagaagagctggcgggtatatacctccacgtgaacgagaaaatcccaaggccaacttgtatcggagatagacaggagaacgacaaagagaatctaaatctggaaaaccaccgagaccaagaattactgcacgcatcttgtcaggcctcaggcgaagtaccctcacaagccagcctgagaggattttttactgaggacgagccaggatgcttcggggaaggtgaaaatttgcccgaggcactgcagaatatccaggatgagggtacaggagagcagttatcccctcaggaacgtatatccgagaagcagctaggccagcatctgccaaatccacattccggggaaatgtccactatgtggctggaggagaagagagaaacaagccaaaagggacagccacgcgctcctatggctcaaaagctccctacctgccgtgagtgcggaaaaactttttatcgaaattcacaattaatcttccaccagcgcacccatacgggagagacctactttcagtgtaccatctgcaagaaagcattcctacggtcatcagattttgttaaacaccagcgcacccataccggagagaaaccatgcaaatgtgactattgtggcaaagggttctccgatttcagtggtcttagacaccacgaaaagattcacaccggcgaaaagccatacaagtgtccaatctgcgagaagtcattcatccagcgttccaactttaataggcaccagcgggtgcacactggtgagaagccttacaaatgcagccactgtggaaaatccttcagttggagcagctccctggataagcaccaaagatcccatctggggaagaaacccttccaatag

SEQ ID NO: 247361 - DNA, 1650 bp, Artificial Sequence
  Description of Artificial Sequence: Synthetic coding sequence
atgcctgtcgatctcggccaggccttggggcttttgccctcacttgccaaagctgaggattcccagttctccgagagcgacgccgcactgcaggaagagctgagttccccagaaactgccaggcagcttttccgtcagtttcggtaccaggtcatgagcggacctcacgaaaccctgaagcaattacgaaagctgtgtttccaatggttgcaacccgaagtacacacaaaggaacagatccttgaaatcctgatgctcgaacaattcctgaccattttacctggagagatccagatgtgggtgaggaaacagtgccctggctccggggaggaagcagtcactctggttgaatctttgaagggcgatccccagcggctctggcagtggatctcgatacaggtactgggacaagacattctgagtgaaaagatggaatcacctagctgtcaggtcggagaggttgagccacaccttgaggtcgttccccaggaactcgggctggaaaattcctcctccggcccaggcgaacttctgtcacatatagtgaaggaggaatccgatacagaggccgagctggccctggctgcctctcagccggcaagattagaggagcgcctgatccgggaccaggacctgggggcttcacttttgcctgccgctcctcaagagcagtggaggcagctagacagcacccagaaagaacaatactgggacctgatgctggaaacttatggcaaaatggtatctggagccggtatcagtcaccccaagtccgacctgacaaattctatcgaattcggagaggagctagctggaatctacctgcacgtgaatgagaaaataccgaggcccacatgcatcggggatcgccaggaaaatgacaaggaaaaccttaacctggaaaatcacagggaccaagaactgctgcacgcatcatgtcaggcgagcggagaggtaccatctcaggcctcactacggggatttttcacggaagacgagcccggatgcttcggcgagggagaaaacctgcctgaggcgctccaaaacatccaggacgaaggaacgggggagcaactcagtccccaggagcggatttccgagaagcagttaggacagcatttgcccaatccccactcaggagaaatgagtaccatgtggcttgaggagaagcgggagacctctcagaagggacagccccgagcaccgatggcgcagaagctgcctacttgcagggaatgcggtaagactttctatagaaactcacagctcatttttcatcaacgaacacacaccggcgaaacctactttcaatgcaccatctgcaagaaggccttcctgaggagctcagacttcgtgaagcaccagcgaacacataccggcgagaaaccatgtaaatgtgactactgcgggaaaggatttagcgacttttctggtctccgacaccatgaaaaaatccacactggagaaaaaccttacaagtgtcccatctgcgagaagagttttatccagcgatcaaatttcaacaggcaccagcgagtgcatactggtgaaaagccatacaagtgctcccattgcggcaagtccttctcttggagcagctccttggacaaacaccaaagatcacacctcggcaaaaagccattccagtag

SEQ ID NO: 247362 - DNA, 1959 bp, Artificial Sequence
  Description of Artificial Sequence: Synthetic coding sequence
atgattaatgcccaggagctgttgaccctcgaagacgtaactgtggaatttacctgggaagagtggcagctgttaggaccatttcagaaagacctgtatcgggatgtgatgcttgaaatctacagcaacctgcttagtatgggctaccaggtcagcaaacctgatgccctgagtaagctggaacgaggagaggagccctggacgatggaagatgagcgacattccaggatctgccctgaaaacaacgaggtggatgaccatttacaggatcatctggagaaccagaggatgctcaaatccgtggagcagtaccatgaacacaatgcttttggaaacaccgccagccagacaaagagcctgtgtctattcagagaaaaccatgataccttcgagttgtatattaaaacattaaaatcaaacctgtccctagttaaccagaacaagagctgcgagattaacaattcaaccaagttttcaggtgatggaaagagcttcctccacggaaactatgaagagctgtattccgccgctaaattttccgtgagcacaaaagcgaatagtaccaagtcccaggtaagtaaacatcagaggacgcacgaaatcgaaaagaatcatgtatgcagcgagtgcgggaaagcctttgtcaaaaagagtcagctgactgaccacgagcgagtccatactggagagaaaccatatggctgtaccctctgcgctaaggtgttttctcggaaatctcgtctgaatgaacatcagcgcattcataagagggagaaaagcttcatttgtagcgagtgcggtaaagtgttcactatgaagtctaggcttatcgagcaccagagaactcacacaggggagaagccctacatctgcaatgaatgcgggaagggatttccaggaaagcgcaacctcattgttcatcagcggaaccacaccggtgagaaatcgtacatatgcagcgagtgtgggaagggatttacaggaaagagtatgctcattatacaccagcgtacacacactggagaaaagccttatatctgttcagagtgcggtaagggttttacaacgaaacactatgtcataatccaccagcgaaaccacacaggcgagaagccgtacatatgcaacgaatgcggcaaggggtttaccatgaaatcccgaatgatcgagcaccagcggactcatactggagagaagccttatatttgtagcgagtgtggtaaaggattcccaagaaaaagcaacttgatcgtccatcagaggaaccataccgtcgagaaaagctatctgtgtagcgaatgcggcaagggctttacagtgaagtccatgttgatcattcatcagcgcacacacaccggcgaaaagccttacacttgctctgagtgtggtaaaggatttcccttgaagtctagactcattgtgcaccagcggacccatacgggggaaaagccataccgctgcagtgagtgcgggaaaggattcatagtgaacagtgggctaatgcttcaccagagaacccatactggtgagaagccctatatttgcaacgagtgcggaaagggtttcgcctttaagtccaacctggtggtacaccagcgaacccacaccggggagaaaccatttatgtgttcagagtgtggaaaaggcttcacaatgaagagatacttaatcgtacatcagcaaatccacactgaagagaagagttgcatctgtagcgagtgcggtagagggttcgccaaagaaactgaactcgccctccacaaacaggtgcataccggcgagaagccatatgggtgtaacgaatgtggaaaagggtttactatgaaaagcaggctgatcgtgcaccagaggacccataccggtgaaaaacctttcgtgtgtagtgagtgccgcaaggctttctcgtccaagcgcaatcttattgtgcaccagcggacacacaacggtaataaaccgtag

SEQ ID NO: 247363 - DNA, 2004 bp, Artificial Sequence
  Description of Artificial Sequence: Synthetic coding sequence
atgagagcttgcgcaggctctactcgcgaggccggatcaggggctcaggatctttctactcttctgtgtctggaggaaagcatggaggaacaggacgagaagccccctgagccccctaaggcctgcgcccaggagggggtgaattttaagatcgtcactgtggattttacaagggaggaacaggggacctggaatcctgcgcagagaacactcgatcgtgacgtgatcctggaaaaccaccgcgacctggtttcgtgggacctggcaaccgctgtcgggaagaaggattccacatctaaacaacggatttttgacgaggaacccgctaatggtgtcaaaatagagcgattcacacgagacgacccatggctgtcatcctgtgaggaggtggatgattgtaaagatcagcttgaaaaacagcaggagaaacaggaaatactgctccaggaggtggccttcacacaaaggaaagcggtgatccacgagagggtgtgcaagtctgatgaaactggggagaaaagcggactgaattcttccttgttttcctcgccagtgatccctattcgcaatcatttccacaagcacgtcagccacgcaaaaaaatggcatcttaatgccgcagtgaacagccatcagaaaatcaacgagaatgagacgctctacgagaataacgagtgcggaaaaccccctcagagcatacacttgatacagttcacacgcacgcaaaccaaggataagtgttatggcttctcagacagaatccagagtttttgccacgggaccccgctgcatatccacgagaagatccatggcggtggcaagacttttgactttaaagagtgcggccaggtgttgaaccccaagatcagccacaatgagcaacagcggatacccttcgaagagtcgcaatacaaatgcagcgagacctctcacagttccagcctaacgcagaacatgcgaaataactctgaagagaaaccctttgagtgtaatcaatgtggtaagagcttctcttggtcctctcatctggtggcccatcagcggacccacaccggggagaagccttatgaatgcagcgagtgtggaaaaagtttttcacgttcttcacacttagtgagccaccagagaacccacacgggtgaaaaaccttataggtgtaaccagtgcggcaaatccttctctcagagttacgttttagtggtgcaccagagaacccacacgggagagaagccatacgagtgcaatcagtgcggcaaaagcttccggcagagctataaactcatcgcccatcagcgcacacacactggcgagaagccttatgaatgtaatcagtgtggcaagtccttcatacagtcctataagctgattgctcaccaaagaatacacaccggggaaaaaccctatgagtgcaatcagtgcggtaaaagtttttcacaatcttacaaattggtggctcaccagcggacacacactggggaaaagccgtttgagtgtaatcagtgcgggaagtcattttcgtggtcttctcagctggttgcacatcagaggactcatacgggcgagaagccatacgaatgttccgaatgcggaaaatcgttcaaccgatcatcgcatctggtgatgcaccaacggatccacacaggcgaaaaaccatacgagtgtaaccaatgcggcaagtcctttagccagagttatgttctggtcgtgcatcagcgcacccacactggggaaaagccctacgaatgttcacaatgcgggaaatcattccgtcaatccagctgccttactcagcaccaaagaactcacaccggtgagaagccattcgagtgtaatcagtgcgggaagacatttagcctgagtgcaagacttatcgttcaccagcggacccatacgggcgagaaaccctttacctgcattcaatgcggtaaggcattcattaactcctacaagctaatcaggcatcaggccacgcatactgaagagaagctttacgaatgtaactag

SEQ ID NO: 247364 - DNA, 1848 bp, Artificial Sequence
  Description of Artificial Sequence: Synthetic coding sequence
atgccacaactgcagtaccctgaaggatacctggcgccaaacagatgtctggtgtctaattgcggtgtaaacaaaatgtcgaacgatgagctggtgggacagaatcacggaatggagggtgaggcctgtattggaggcgatgtgactttcaacgatgtcgccattgactttacacacgaggaatggggatggctatcttcagcgcagagagatctctacaaagacgtaatggtgcagaattacgaaaatctggtgtcggttgctggactgtctgtcactaagccttatgttattacgttgctggaagatgggaaagagccatggatgatggagaagaaactgagcaaaggtatgattcctgattgggaaagtcggtgggaaaacaaagaactgtccacaaaaaaggacaattatgatgaggattcaccacagacagtcataatcgagaaagtggtgaaacaatcatacgagtttagcaatagtaaaaaaaatctggaatacatcgagaagctggagggcaagcacggaagccaggtcgaccacttccgcccagcaattctgacttctagggaaagtcctactgctgatagcgtttacaagtacaatatctttagatccacctttcattcaaagtccacattgtcagaacctcagaagatctctgccgaaggaaactctcacaagtatgacattcttaaaaaaaaccttcctaagaaatcggtcatcaagaatgagaaggtcaacgggggaaaaaagctgctcaactcaaacaaatctggcgctgcgttcagtcagggaaagtccttgacactgccgcaaacgtgtaaccgcgagaagatttacacgtgctctgaatgtggcaaggcgttcgggaagcagagtattttgaataggcattggagaatacacaccggagaaaagccatatgaatgcagagagtgcggtaagacattttcacacggttcctcactcacccggcacctgatctcacacagcggggagaaaccttacaaatgcattgagtgtggaaaagccttctctcacgtgagctccctgaccaaccaccagtccactcacacaggggagaagccctacgagtgtatgaactgcggcaagtccttctcgcgcgtctcacacctcatcgagcaccttcgcattcatactcaagagaagttgtacgaatgtaggatttgcggcaaggcatttattcatcgttcctcccttatccaccatcagaaaattcacacaggagaaaaaccctatgagtgcagagagtgtggtaaggctttttgctgttccagccacctcactaggcaccagaggattcatacgatggagaagcaatacgagtgtaataaatgcctcaaggtgttctcatctcttagcttcttagtgcagcaccagtcgatccacactgaggagaaaccatttgaatgccagaagtgtaggaaaagtttcaaccagcttgaatccctgaatatgcacctaaggaaccatatccgtttaaagccatatgagtgtagcatctgtggcaaggcgtttagccatagaagcagccttctgcaacatcaccgaattcatactggcgagaaaccatatgagtgcatcaagtgtggtaaaactttcagctgctcatcgaacctaaccgtccatcagaggattcacaccggcgagaaaccttataaatgtaatgaatgcggtaaagcattctcaaagggttctaatttgactgcccatcaaagggtgcacaatggtgaaaagcccaacagtgtcgtgagtgtggaaaaaccccttgactatatgaaccattatacatgtgagaaatcttacagacgcgagactgtatag

SEQ ID NO: 247365 - DNA, 1404 bp, Artificial Sequence
  Description of Artificial Sequence: Synthetic coding sequence
atgccacaggtgaccttcaacgatgttgcgatcgactttacccacgaggagtggggctggctgtcatctgcgcagcgggacctgtataaggacgtgatggtgcagaactacgagaatttggtgagcgtcgggctctcagtgactaaaccctatgtgattaccttgcttgaagatggcaaagagccctggatgatggagaagaaattatctaagggcatgatacctgattgggagtctaggtgggaaaataaggaactctctaccaagaaagataactacgacgaggattccccgcagacagtgataattgagaaggtcgttaaacagagctatgagttttctaatagtaagaaaaacctggagtacattgaaaaactggagggtaaacatggtagccaggttgatcatttccggcctgctattctcaccagccgagaatcgccgacagccgatagcgtctacaaatataatatattccggagcacttttcattccaaatcgaccctttccgaaccccagaaaatatcagctgaaggtaatagtcacaagtacgacattctgaagaagaacctgcccaagaagagtgttattaagaatgagaaggtgaatgggggaaaaaagctccttaactctaataaaagcggtgcggcatttagtcaggggaagtctctcactctgccacagacctgtaaccgtgagaagatttacacttgttcagaatgcgggaaggcattcggtaagcaatccatcctgaacaggcattggcgcattcacactggagaaaagccttatgagtgtcgggaatgtggcaagactttctcgcacggctcaagcctgacaaggcacctcatatcccactcaggcgagaagccttacaagtgcatagaatgcggaaaagccttctcccacgtgagctccctgacaaaccaccagtctactcacacaggcgagaaaccatatgagtgcatgaattgcggaaagtcttttagtagagtgagccacctgattgagcacttgcggatccatacgcaagaaaagctctacgagtgtcggatctgtggcaaggcctttattcaccgctcgtctcttatccaccatcagaagatccacacaggggagaagccttacgagtgccgggagtgcggcaaggcattctgctgtagtagtcaccttaccaggcaccaaaggatccataccatggagaagcagtatgagtgtaataagtgtctgaaagttttcagctctctatcctttctggtgcagcatcaaagcattcacacagaagagaagccttttgagtgtcagaagtgtcgcaagtccttcaaccagttagagtccctgaatatgcatttgcgaaaccacatcgagactctcaggatgcagtacatgtgggagagtttgtag

SEQ ID NO: 247366 - DNA, 1713 bp, Artificial Sequence
  Description of Artificial Sequence: Synthetic coding sequence
atgcctcaagtgaccttcaatgacgtcgcgatcgattttacccacgaggagtggggctggctttcatccgcgcagagggatctatataaggatgtgatggtccagaactacgagaatttagtctccgtgggattgagtgtcacaaagccttatgtaatcaccctgcttgaagacggcaaagaaccttggatgatggagaagaagctgtccaaaggaatgatacctgactgggaatctcgttgggagaacaaggaattatctaccaagaaggataactacgatgaagactcccctcaaaccgttataatcgagaaggttgtgaaacagtcctacgaatttagcaacagcaagaagaatctcgagtacatagaaaagctcgaaggaaagcacgggagtcaagttgaccacttcaggccagcaattttgaccagtagggaatctccaacagctgactcagtctataagtataacatcttcagaagtacattccacagcaagtccacgctgagcgaaccacagaagatctctgctgagggtaattcgcacaaatatgatattttaaagaagaatctgcctaaaaaaagcgtcatcaaaaatgagaaagtgaatggaggaaagaagctgctgaattccaataagagcggagccgctttttctcaaggcaagagcctgaccctgccccagacatgcaacagggaaaaaatttatacctgctctgagtgcggtaaggcattcggcaagcagagtatcctgaatcgtcattggagaatccacactggggagaaaccctacgagtgtagagagtgcggaaaaacgttcagccacggtagctcgctcacgcggcatctgattagccactcaggcgaaaaaccatacaagtgcatcgaatgcggaaaggccttttcacacgttagctccttaacaaatcaccagtccactcatacaggtgagaagccatatgagtgcatgaattgcggcaagagtttctctcgggtcagccacttgatagagcatctgcgcatccatacccaggaaaaattgtatgagtgtcgtatctgcggtaaggccttcatccaccggtcctccctgatccatcaccagaagatccacacaggggaaaaaccatacgaatgcagagagtgtggcaaggcattttgctgctctagccatttaactcgtcatcaaagaattcatacaatggagaagcagtacgagtgtaacaagtgcctgaaagtcttcagctctctctcatttttagtgcaacaccagagcatccacaccgaggagaaaccttttgaatgccagaagtgccggaagtctttcaaccagttggagagcctaaatatgcatctacggaatcacatcagactgaaaccatacgaatgttctatatgcggtaaagcttttagccatcggagtagtcttctgcagcaccatcggatacacacgggagaaaagccctacgagtgcattaagtgcggaaaaaccttttcctgtagctcgaatttgacagtgcaccagaggattcacaccggcgagaagccttacaaatgcaacgaatgtggcaaagctttttccaaagggagcaatctgaccgctcatcagcgcgtgcacaatggcgagaaaccaaacagcgtcgttagcgttgagaaacctttggactacatgaaccattatacctgcgaaaaaagctatcgcagggaaacagtatag

SEQ ID NO: 247367 - DNA, 1716 bp, Artificial Sequence
  Description of Artificial Sequence: Synthetic coding sequence
atgcctcaggtgacattcaacgacgttgctatcgattttacacatgaggaatgggggtggctttcctccgcccaaagagatctatacaaagacgtgatggtgcagaactacgaaaatctggtctccgtggcgggattgtccgtcaccaagccgtacgtgataactctgctggaagacggtaaggaaccttggatgatggaaaaaaagctctccaaggggatgattccggattgggaaagcaggtgggagaataaagagctctctactaagaaggacaattacgatgaggacagtcctcagaccgtgatcattgaaaaagtggtaaagcagtcctatgagttctctaattcaaaaaagaatctggaatatatcgaaaagctggagggaaaacatggatcccaggttgatcactttagacctgccatcttaactagcagggagtccccaactgctgacagtgtatacaagtataacatatttagaagtaccttccactcaaaatcaaccttgagtgagccccagaaaatcagcgccgaaggaaattcacataaatacgacatcctgaaaaagaacttacctaagaagtccgtgataaaaaatgaaaaggtcaatggcggtaagaagctgttgaactcaaataagagtggggcagctttttctcagggcaagtccctgaccctcccacagacttgcaaccgcgaaaaaatatacacatgctccgagtgcggcaaggcatttggcaaacaatccattctgaaccggcactggcgcatccacacaggtgagaagccatacgagtgtcgtgagtgcgggaagactttttcccacggcagctcactgacccgccatctcataagccacagcggcgaaaaaccttataagtgcatcgagtgtggcaaggcattctcacacgtgagcagtctgaccaatcatcaatcaacacacacaggtgaaaaaccttacgaatgcatgaactgcggtaaatcattttctcgagtcagccatttaatcgagcacttgaggatccacacacaggaaaagttgtacgagtgccggatctgtggcaaggcatttatccatagatcaagcttgattcaccaccaaaaaatccacaccggcgagaagccatacgagtgtcgcgagtgtggtaaggccttctgttgttcctctcatctcaccaggcaccaaaggatccacactatggagaaacaatatgaatgtaacaagtgccttaaagtgtttagctctttgtcctttttagttcagcatcagtcaattcacactgaagaaaagccattcgaatgccagaagtgtagaaagtcatttaaccagttagagtctctgaacatgcatctgaggaaccacatccgactgaaaccgtacgagtgttcaatctgcgggaaggcgttcagtcaccgctcttctctgctacaacaccatcggatccacaccggtgagaaaccttacgaatgcattaagtgcggtaagaccttcagttgctcctcaaatctaaccgtccatcagagaatccacactggagaaaagccctataagtgcaacgagtgcgggaaagctttctctaaaggatccaacctcacagcccaccagcgtgtgcacaacggtgaaaaacctaattctgtagtgagcgttgagaaaccactggactacatgaatcattacacgtgcgaaaaatcctaccggcgtgaaacagtgtag

SEQ ID NO: 247368 - DNA, 1920 bp, Artificial Sequence
  Description of Artificial Sequence: Synthetic coding sequence
atgacacccgcttccgcatcaggtgaggattctggcagcttctacagctggcagaaggccaagcgcgaacaaggactcgtgactttcgaggacgtcgccgtcgattttacgcaggaagaatggcaatatcttaaccccccacagagaaccctgtatcgcgatgtcatgctggagacctactccaaccttgtgttcgtggggcagcaggtgacgaaacccaacctcatcctgaagctcgaggtagaagagtgccccgcagaaggaaaaatcccattctggaatttcccagaggtgtgtcaggtcgacgagcagatcgaaagacagcaccaggacgatcaggataaatgcctgctgatgcaggtgggtttctcagacaaaaagaccattataactaaatcggctagggactgtcacgagtttggcaacatcctccatctgtccacaaacctcgtagccagtatacaaagaccagataagcacgagtcatttggaaataatatggtggataacctggatctgttctcacgcagctcggccgagaataaatacgataacggttgtgctaagttgtttttccacaccgagtatgaaaagaccaacccgggaatgaagccctatggttacaaagagtgtgggaagggcctgcgccgtaagaagggcttgtctcttcaccagaggattaaaaacggagagaaaccatttgagtgtacggcgtgcagaaaaaccttttccaaaaagtcgcatctcatcgttcactggaggacccacacaggtgagaagcctttcgggtgcaccgagtgcggcaaagcgttctcccagaaatcccaactgatcatacacctgagaacccatacaggagagcgaccttttgagtgtccagagtgcgggaaggctttccgcgaaaagtccacagtgattatccactacagaacgcacaccggagagaagccttacgagtgtaatgaatgcggcaaagcttttactcagaagtccaatctgatagtgcaccagaaaacacataccggcgagaaaacttatgagtgcaccaaatgcggcgagagttttattcagaaattagacctaatcattcaccacagtacgcataccggcaagaaaccccacgagtgtaacgagtgtaaaaaaaccttttctgataagtccacactcattatccatcagcggactcacactggggagaaaccccacaaatgcacggagtgcggcaagtctttcaatgagaagtcaaccctcatagtgcaccagaggacacatacgggggaaaaaccctacgaatgcgatgtatgcggcaaaaccttcacacagaagagtaatctgggagtacaccagagaacgcactctggagaaaagccgttcgaatgcaatgagtgtgagaaagctttctctcagaaatcctacctcatgcttcaccagcggggacacacaggggagaaaccgtatgaatgcaatgagtgtgagaaggctttctctcagaaatcttatctcatcattcaccagcgtacacatacagaagagaagccttataagtgcaatgaatgtgggaaagcattccgagaaaaaagcaaattgatcatccaccaacgaattcacacaggggaaaagccctatgagtgccctgtttgttggaaggcattttctcagaaatcacaacttattatccaccagagaactcataccggtgagaagccatatgcctgtacagagtgtggcaaagcgtttcgcgagaagtctaccttcaccgtccaccaaaggactcacaccggcgagaagccatataagtgtacggagtgtgggaaggcttttacccaaaagtccaacctcatagtccatcagagaacacatgcaggtaaaaaagctcacggacgcggtcataccagaaaatccaagttcatggcgcactag

SEQ ID NO: 247369 - DNA, 1863 bp, Artificial Sequence
  Description of Artificial Sequence: Synthetic coding sequence
atggctaagcctcaaggcctggttactttcgaagacgtcgctgtggacttcacgcaagaggaatggcagtacctcaatccaccccaacggactctttaccgagacgtaatgctcgaaacttattcaaatctggtgttcgttggccaacaggtaaccaagccaaatttaatcctgaagctggaggtggaggaatgcccagctgaagggaagatccccttctggaacttccccgaggtatgccaggtggatgagcaaattgagaggcagcatcaggatgatcaggacaaatgcctgctgatgcaagtgggcttttctgataaaaagactatcattaccaaatcagccagagattgccatgagtttggtaatatccttcatcttagcactaatcttgtcgccagtatccagcgccctgataaacatgagtcatttggaaacaatatggtggataacctggacctctttagccgttcatcggccgaaaacaaatatgacaacggctgtgctaagctgttctttcatactgaatatgagaagactaatcccggaatgaaaccctatgggtacaaggaatgtggcaaggggctgcggagaaagaagggcctgtctttgcatcaaaggataaaaaacggggaaaagccattcgaatgtacagcctgcaggaagactttttctaaaaaatcgcatttgattgtacactggcggactcacaccggagaaaagccgtttggctgtactgaatgcggcaaagcattctcccaaaagtcccagctcattatccacttgcggactcacacaggcgagcgcccatttgagtgtccagaatgcggtaaggctttccgcgagaaatctaccgtcattatccattatcgcactcacaccggtgaaaagccttacgagtgtaatgagtgcggtaaggctttcacccaaaaatctaatttgatcgtgcaccagaaaacacatacgggggagaaaacatacgagtgcaccaaatgcggtgagtcctttattcagaaattagatctgatcattcatcacagcactcacacaggaaagaagccacacgagtgcaacgagtgcaagaagaccttctctgacaagagcaccttgatcatccaccagcggactcacactggcgagaaaccacataagtgcactgagtgcgggaagtcctttaatgagaagagcacgcttatcgtgcaccagagaacccacactggcgaaaagccctacgaatgtgacgtatgcggcaagaccttcactcagaagagcaacctgggggtgcaccagagaacgcactcaggtgagaaaccatttgagtgtaatgaatgcgaaaaagccttttctcagaagtcatacctcatgctgcaccaacgcggacataccggggagaaaccctacgaatgtaacgagtgtgagaaagcgttttcccagaagagctacctcatcatacaccagcggactcacaccgaagaaaaaccctacaagtgtaacgagtgtggtaaggcctttcgagagaagtccaaactgattattcatcagcggattcatacaggcgagaagccctacgaatgtccagtctgttggaaagcgttttcccagaaatctcagcttattattcaccagcgcacgcataccggggagaagccttacgcctgcaccgagtgtggcaaggcattcagagagaagtctacatttactgtccaccagaggacccacacgggagaaaaaccgtacaagtgtacggagtgcgggaaagcttttacccagaaatctaacctgatagtccaccaacgaacacacgccggaaagaaggcacatggtcggggacacactcggaaatctaaattcatggctcattag

SEQ ID NO: 247370 - DNA, 1920 bp, Artificial Sequence
  Description of Artificial Sequence: Synthetic coding sequence
atgacccctgcttcagcttccggcgaggattctggttctttctactcctggcaaaaggctaaaagagagcaaggcctagtgacattcgaggatgtagcagttgactttacccaggaagagtggcagtatctcaatccccctcaaagaactctttatagggatgtgatgctggaaacctatagcaacctggtcttcgtcggacaacaggttacaaagcccaatctgatcttgaagcttgaagtggaggagtgccccgcagaaggaaagattcccttctggaatttcccagaggtgtgtcaggtcgacgagcagatcgagcgtcagcatcaggacgaccaggataagtgcctactgatgcaagtcgggttctcagataagaagaccataattactaagagtgcacgggattgccacgagtttggcaacattttgcatctgtccactaatttggtcgcctctatacagaggcccgacaagcacgagagctttggcaataacatggtagataatctcgatctcttttccagatcaagtgccgagaacaagtacgacaacgggtgcgcgaaattgttctttcacacagaatatgagaaaacaaatcccggaatgaagccctacgggtataaggagtgcggcaaagggctgaggagaaagaaggggctgtctctgcaccagcgcatcaagaatggcgagaagccgttcgagtgtaccgcctgcagaaagacgttctcgaagaagtcgcacctcattgtccactggaggacccataccggcgagaagcctttcggatgcacggaatgtggaaaagcttttagtcaaaaaagtcaactcatcatccacctgcgaacccacacaggcgagagaccctttgaatgtccagagtgtggaaaggcttttcgagaaaagtctaccgtcattattcactatagaacccatactggtgaaaaaccctatgagtgtaatgagtgtggtaaggctttcacccagaaatctaaccttatcgtgcaccaaaagacacacacaggcgaaaagacatacgagtgtactaagtgcggtgagagctttatccagaagttggacctgattatccatcactccacccataccgggaaaaaaccacacgagtgtaacgagtgtaaaaaaactttttccgataaaagtaccttgataattcatcagcgcactcacaccggtgagaagccccacaaatgtacagaatgtggtaaatcttttaacgaaaaaagcaccctgatcgttcaccagagaacgcataccggcgaaaaaccgtacgaatgcgacgtgtgtggcaaaaccttcacacagaagtctaacttaggcgttcatcagcgcactcactcaggcgagaagcccttcgaatgcaatgaatgcgaaaaagcgttttcacaaaagtcatacctgatgttgcatcaacggggacataccggggagaaaccctacgagtgcaacgaatgtgaaaaagctttttcccaaaaaagctatttaattatacaccaaaggactcacacagaagaaaagccatacaaatgcaatgaatgcggcaaagcctttcgggagaaatccaagctgataatccaccagcggatccacacgggagaaaaaccttatgagtgtcccgtttgctggaaggctttctctcagaagagccagctcataattcatcagcgtacacataccggcgagaagccatatgcctgcaccgaatgcggcaaggcctttcgggagaaaagcacctttacagtgcatcagcgtactcataccggagaaaagccttataagtgcaccgaatgtggcaaggcgtttacacagaaatcaaatctgatagtccaccaaaggacgcacgccggaaagaaggcccatgggcgaggccacacacgcaaaagcaagtttatggcccattag

SEQ ID NO: 247371 - DNA, 921 bp, Artificial Sequence
  Description of Artificial Sequence: Synthetic coding sequence
atgagttcagagaagagcgggttgcctgacagtgttccacacacaagtcctcctccatacaatgcaccgcagcctcctgccgaaccacctgcccctccccctcaggctgctcctagctcgcatcaccatcaccaccaccattaccaccagagtgggaccgcaacactcccgcgtctgggcgcaggcggactggcatcatcagcagctacggctcagaggggtccttctagttctgcaactctgccacgaccccctcatcacgcccctcccggacccgctgctggcgcacctccaccaggctgcgctacactcccaagaatgcctccggacccctatcttcaggagacccgtttcgaaggtccattgccacccccacccccagctgccgctgccccacctccacctgccccagcacaaacagcccaggccccagggtttgtggtccccacccatgctggcacggtcggaacactgcctctgggcggttacgtggcccctggctatccgctgcaactgcagccctgtacggcctacgtccctgtctacccggttgggactccttacgctggcggaacccccggaggtactggggtcacaagcactctgccacctccgccacagggtcccggactggcactgctcgaacctcgtcgacccccacacgattatatgcccatcgcagtcctgactacaatctgttgtttctggcccacaggcattattgccatcttcaaggctgtgcaagtcaggacggcgctcgcccgtggcgatatggtgtcagcggagatcgcgagtagagaggccaggaactttagttttatctcgttagctgtcggaatagccgctatggtgctgtgcactattctgacagtggtcatcattatagcagctcagcaccacgagaattattgggatccatag

SEQ ID NO: 247372 - DNA, 2004 bp, Artificial Sequence
  Description of Artificial Sequence: Synthetic coding sequence
atggaggaccttagctccccagactccacactgcttcagggcggacacaacctcttgagcagcgcctcctttcaggaagcagtaacattcaaggacgtaatcgtggactttacccaggaggagtggaagcagctggatccaggacaacgggacttatttagggatgtcactttagaaaattatactcacttggtgtccatcggtctgcaggtctccaagcccgatgtcataagtcaactggaacagggcacagaaccatggattatggaaccttctatccccgttggcacatgcgccgattgggaaacccgactcgagaattccgtatctgctcccgagcccgacataagcgaggaggagctcagtcctgaggtgattgtagaaaaacacaaaagagacgacagttggtcaagtaatctgctcgagagctgggagtatgaaggcagcttggaaagacagcaggccaaccagcagaccctgcccaaggagattaaagtgacagaaaaaacgattcctagctgggaaaagggacctgtgaacaacgagtttggcaagtccgtgaatgtcagcagtaatctggttacacaggaaccaagccccgaagagacatctactaagagaagcatcaagcagaactctaaccctgtgaaaaaggaaaaatcttgtaaatgcaatgagtgtggaaaagcattctcctattgtagtgccctgatcaggcaccagagaacgcacacaggcgagaagccatataaatgcaatgaatgtgaaaaagctttctcccggtctgagaatctgattaaccaccagagaattcacacgggcgacaagccgtataagtgtgatcaatgtggcaaaggattcatcgagggcccaagccttactcaacaccagcggattcacaccggggagaagccctacaagtgcgacgagtgtgggaaggcgtttagtcagcgcactcatctggtccagcaccagcgcattcatacaggggaaaaaccttatacatgtaacgagtgcgggaaggcctttagccaacgaggacactttatggaacatcaaaaaatccacaccggtgagaagccctttaagtgcgacgagtgcgataaaacgtttacaaggtctacccacctcactcagcaccagaagatccacaccggagaaaaaacatacaaatgtaatgaatgcggcaaggccttcaatgggccatccactttcatccggcaccatatgattcatactggagaaaagccctatgaatgtaacgagtgtgggaaagctttctcccagcatagtaacctcacccagcatcagaagacacatacacaggagaaggcttatgaatgtaaagaatgtggtaaggcattcataagatcgtcctcattggctaaacatgaaagaatccacaccggcgagaagccgtaccagtgtcatgaatgtgggaaaaccttttcttacggctccagcctgattcaacaccgtaagattcacacgggtgaacggccttacaagtgcaatgaatgcggcagagcgttcaaccagaacattcatctcactcagcacaaaagaattcatacaggggctaaaccttatgagtgtgccgagtgcggcaaagcgtttaggcactgctcttccctcgcccagcaccagaaaactcacaccgaagaaaagccgtaccaatgtaacaaatgcgaaaaaacatttagccagtcctctcatctgacacaacaccagagaatacacaccggggagaaaccttataaatgtaacgagtgcgacaaggcgttttctcgatccactcatcttacggaacaccagaatacccacaccggggaaaagccctacaactgcaacgagtgcagaaagaccttttcgcagtcaacctatcttattcaacatcagcggattcacagcggcgaaaaaccctttggctgcaatgactgcggcaaatctttcaggtatcgcagcgccctgaacaaacaccagcgactgcatcccggaatctag

SEQ ID NO: 247373 - DNA, 2256 bp, Artificial Sequence
  Description of Artificial Sequence: Synthetic coding sequence
atggaggacctatcttctcccgactcaaccctgctccaagggggtcataacctcttgtcctctgctagctttcaggaggccgtgacgtttaaggacgtgatcgtggatttcacccaggaggagtggaagcagctcgaccctgggcagcgggatttgtttcgggacgtgacattggaaaattatacccacctagtgtctataggcctgcaggttagcaagccagatgtcatctcccagctggagcagggaaccgagccatggataatggaaccctccatccccgttggcacgtgtgccgattgggaaactagattggagaattccgtgtctgccccagagccagatatctcagaagaggagctgtccccagaagttattgtggagaaacacaaaagggatgactcttggtcctctaaccttctggagtcctgggagtacgaggggagcctggaaagacagcaggcaaatcaacagacgctccctaaggaaatcaaggtgacagagaaaaccatccctagctgggagaaagggccagtgaacaatgagtttgggaagagtgtaaatgtttcaagtaacctggttacacaagaacctagcccagaagagacgtctacgaagagatctataaagcagaactctaacccagttaaaaaagagaagtcttgcaaatgcaacgaatgtggcaaggccttctcgtactgttcggccctgatacgacatcaaagaacccatacaggtgagaaaccatacaaatgcaacgagtgcgaaaaggcattttcaagatccgaaaacctgatcaatcatcagcgcatccacacaggtgataagccctacaagtgtgatcagtgcggaaagggcttcatcgaggggcctagcctcacacagcaccaacgaattcacactggtgagaagccttacaagtgcgatgaatgtggaaaggccttctcccaaagaactcaccttgttcagcaccagcgcatccacaccggggaaaagccatacacctgcaacgaatgtgggaaggctttcagccagagaggccacttcatggagcaccaaaaaatccacaccggcgagaagccctttaagtgcgacgaatgtgacaagacttttacaagatctactcacctgacccaacaccagaaaattcatactggagaaaaaacatacaaatgcaacgagtgcggaaaagcctttaacggaccttctacctttatcaggcaccacatgattcacacaggggagaaaccctacgagtgtaatgagtgtggaaaggcattctcgcaacatagcaatctgactcagcatcagaagacacatacaggagaaaaaccttatgactgtgccgaatgcgggaagtcttttagctactggtccagcctcgctcagcatttgaagattcacactggggaaaaaccatacaaatgcaacgagtgtggaaaagcctttagttactgcagtagcctgacccagcaccgtaggattcacactcgagaaaaaccctttgagtgctccgaatgcggcaaggcgttctcctacttgagtaatctcaatcagcatcagaagacccatacacaagagaaagcatacgagtgtaaggaatgtgggaaggccttcattcgctccagctcccttgccaaacacgaacgcatccacacaggcgaaaagccatatcagtgccacgagtgtggcaagacttttagttacggcagctcattaattcagcaccgcaaaatccataccggcgaacgcccatataagtgtaacgagtgtggcagggcgttcaatcagaacatccacttaacacagcacaagagaattcatacaggcgctaagccgtatgagtgtgctgaatgcggtaaggcattccgtcactgttcttccctcgcacagcaccaaaagactcacactgaagagaaaccttaccaatgtaataaatgtgagaagactttctcacagtcctcacacctcacccagcatcaaaggatccacaccggagagaaaccctataaatgcaacgagtgcgacaaggccttctctagatcgacccacctgaccgagcaccagaatacacacacaggggagaagccttataactgcaacgaatgtagaaagacgtttagccaatcaacttatttgatccagcaccagaggattcattccggagaaaagcctttcggatgcaacgattgcggtaagtcgttcaggtatcggagtgctttaaacaagcatcaaagactgcacccgggtatttag

SEQ ID NO: 247374 - DNA, 234 bp, Artificial Sequence
  Description of Artificial Sequence: Synthetic coding sequence
aaagccttctcacagcgaacccatcttgtgcaacatcagcgaatccacactggcgagaaaccctatacatgcaacgagtgtggcaaagctttctcacagcgcggacacttcatggagcatcagaaaatacataccggtgagaaaccatttaaatgcgacgagtgtgacaagaccttcacaagatccacacatttgacgaccagtaaaaactcatactggagaaaaaacttatag

SEQ ID NO: 247375 - DNA, 1755 bp, Artificial Sequence
  Description of Artificial Sequence: Synthetic coding sequence
atgatggagaactacggcaacctagtgagtctggacgtactcaacagggacaaggacgaagaaccgaccgtgaagcaggaaatcgaggagattgaggaggaggtggagccacaaggcgttatcgtcacacgaatcaaatccgagatcgaccaggaccctatgggtagagagacgtttgagctggtgggtcgcctagacaaacagcgaggaatcttcctgtgggaaataccaagagaatccctgacgcaggagcagcggatgtttagggaaaatactaatatcatccgcaaaagacccaatagcgaggagaagtgtcacaagtgtgaggaatgtggaaagggatttgtaagaaaggctcatttcatacagcaccagagagtgcatacgggcgaaaaaccttttcagtgcaatgagtgtggcaagtccttctcgagatccagctttgtgattgaacatcagagaatccacacgggcgagaggccatatgagtgtaactattgtggaaagacattctcagtgagtagtaccctgatccgtcatcagcggatccatacaggggagagaccttatcagtgtaatcagtgcaaacagtccttctcccagaggaggagcctggtgaagcaccagagaattcacactggagagaaaccccataagtgctctgattgtggaaaggccttttcctggaagagccacttaattgagcatcagcgtacacacactggggaaaagccttatcattgcactaagtgtaaaaaatctttcagcagaaactctctcctcgtagagcatcagaggatacataccggcgagcgccctcacaaatgcggtgagtgtggcaaggcgttccgcttatctacatacctaattcagcaccagaaaatccacacaggggagaaacccttcctgtgcatcgagtgcggaaagtcctttagtcggtcctcatttctgatcgaacatcagcgaatacatacaggtgagcggccttaccaatgcaaagagtgcggtaagtcgttcagccagctttgcaatctgactaggcatcagcgcatccacacaggagataaaccacataagtgtgaggagtgtggcaaagccttctcccggagtagcggtctgattcagcatcagcgcatccatacccgggaaaagacatatccatacaatgaaaccaaagagtcttttgacccgaactgctcgctcgtgatccaacaggaggtatatccaaaagagaaaagctacaagtgtgatgaatgtggtaagacgttctcggttagcgctcaccttgttcagcatcagagaatacatactggtgagaagccttatctgtgcaccgtatgcgggaagtcgttctctcggagcagcttcttgattgaacaccagcgcatacacaccggcgagcgcccttacctgtgcagacagtgtggaaagtccttctcccagctgtgcaatttaatcagacaccagggagtccacacaggcaacaagccccacaagtgtgacgaatgcggaaaagcattctctaggaattccggcctcatacaacatcagcggatccacactggtgaaaagccctataagtgtgaaaagtgtgacaagtccttctcccagcaaaggagcctcgtcaatcaccagaagatccacgcagaggtgaagacacaggagacacacgagtgcgacgcatgtggtgaagccttcaattgtaggatctccttgatccaacatcagaaattgcacactgcttggatgcagtag

SEQ ID NO: 247376 - DNA, 1881 bp, Artificial Sequence
  Description of Artificial Sequence: Synthetic coding sequence
atggcgtccccttccccccctcctgagtcaaaaggcttactcacgttcgaagacgtcgcggtgttttttacacaagaggaatgggactatctggatccagcacagagatccttgtataaggatgtgatgatggagaattacggaaatctggtatctctggacgtcctcaaccgggataaggacgaggagccaactgtcaaacaggaaattgaagagatagaagaggaagtggagccccagggcgtgatagtcacacgcattaagagtgaaattgatcaagaccctatgggcagagagactttcgagctggtcgggagactggataagcaacgagggatcttcttatgggagatcccgagggagtccctgacccaggaacaacgaatgtttcgggaaaacaccaacataattcgaaagaggcccaacagcgaagaaaaatgccataagtgtgaagagtgtggtaaaggattcgttcgcaaggcacacttcatccagcatcagcgggtacacacaggggaaaaacctttccaatgtaatgaatgtggaaagtccttctctcggagttccttcgtgattgagcatcaacgtatccataccggcgaacgcccatacgaatgcaactattgcgggaaaacgttctccgtatcttcgacactgatcaggcaccaaaggattcacaccggtgagcggccatatcagtgcaaccagtgcaaacagagcttcagccagcgtagaagcttagtcaagcatcagcggatccacaccggggaaaagcctcacaaatgttcagactgcgggaaggcctttagctggaagagccatttgattgagcaccagagaacacacaccggggagaaaccctatcattgcaccaagtgcaaaaagtctttctcacgtaattcgctgcttgtggagcatcagcgcatccacactggagagaggccccataaatgtggggagtgcggtaaggcgttcaggctgtctacatacctgatccagcaccagaagattcacaccggcgagaaacccttcttatgtattgaatgtggcaagtcctttagccgatctagtttcctgatagaacaccagagaatccacaccggggaaaggccataccagtgcaaggaatgcggaaaatccttttcacagctgtgcaatctgacgaggcaccagcgtatccatacaggagacaagccacacaaatgcgaagagtgtgggaaggcctttagcaggagcagtggcctcatccagcaccagcgaatccacacccgggagaaaacttatccttataacgagacgaaggagtccttcgaccccaactgtagcctggtgattcaacaggaagtgtaccccaaagaaaaaagttataaatgtgacgaatgcggaaaaactttttctgtgtccgctcatctggtacaacaccagcgcatacacaccggagagaagccctacctctgtaccgtctgcggaaagtccttcagccgctccagctttttgattgaacaccaaaggatacacaccggcgaacggccttatctctgtcggcagtgtggtaagtctttttcccaattgtgcaatctgattcgccatcagggagttcacactggcaataagcctcacaagtgtgatgagtgcggtaaagctttcagtagaaactctggcctgattcagcaccagcgaattcacaccggggaaaaaccttataaatgtgaaaaatgtgataaaagcttttcacagcagaggtctctagttaaccaccagaaaatccatgcagaggtcaagacccaagagacccatgaatgtgatgcttgtggcgaggctttcaactgccgcatcagccttattcagcatcaaaagcttcatacggcatggatgcagtag

SEQ ID NO: 247377 - DNA, 1839 bp, Artificial Sequence
  Description of Artificial Sequence: Synthetic coding sequence
atggcgtctcccagccccccaccggagtccaaggaggaatgggactacctggaccccgctcagcgcagtctctacaaggatgtgatgatggagaactacggaaacctggtgagtttagatgttcttaatagagacaaagatgaggagcctactgttaaacaggagatcgaggagattgaagaagaggtggagcctcagggggtgatcgttactcggataaaatcagagatcgaccaagaccccatgggtagagagactttcgaactagtgggtcgtcttgacaaacagcggggaattttcctctgggaaattccacgggagtcgctcacccaagaacagcggatgttcagagaaaacaccaatatcatccggaagaggccgaattccgaagaaaagtgccacaaatgtgaggagtgcgggaagggctttgtgcgtaaagcccacttcatccagcaccagcgcgtccacacaggcgagaaacctttccagtgtaatgagtgtggaaaaagcttctctaggagttccttcgtcatcgaacatcaaagaattcacaccggcgagcggccttatgaatgcaactactgtggaaagaccttttccgttagtagcacattaattcggcatcaacggattcatacaggcgagaggccctaccaatgtaaccagtgtaagcagagtttcagccaacgcagatcactcgttaagcatcagcgaatccacacaggtgagaaaccccacaaatgtagcgattgcggtaaagctttttcatggaaaagccaccttatcgagcaccaacggacccacaccggtgagaaaccatatcactgtaccaaatgtaagaagagcttctcccgaaactctctgctagtggagcaccaacgaatccacactggcgaaagaccgcacaagtgcggcgagtgcggtaaggcattcaggttaagcacgtacctgattcagcaccaaaaaatccacactggtgagaaaccatttctgtgtattgagtgcggtaagtctttcagccgctcatcatttttgatcgaacatcagagaattcataccggcgagagaccctaccaatgcaaagaatgcgggaaatcgttcagccagctgtgcaatctgactcgtcaccagaggatccataccggcgataaaccacataaatgtgaggagtgtggcaaagcattctcgcgatctagtgggctgatccagcatcagcgtatccatacccgcgaaaaaacatacccttacaacgagaccaaagaaagtttcgacccaaactgttcacttgtaattcaacaggaggtttacccaaaggaaaagtcctacaagtgcgatgaatgcgggaagactttttctgtttccgcccatttagtccaacaccagcgtatccacacgggcgaaaagccgtatctttgcacagtttgcggtaaatccttcagcagatctagtttcttaatcgagcatcaaagaatccatactggtgagagaccctatctgtgcagacagtgcggcaagtcattcagccagctatgcaatctcatacggcatcaaggcgtgcacacagggaacaaaccccacaaatgtgacgaatgcggtaaagcttttagtcgcaacagtggccttatccagcatcaaagaatacacacaggagagaagccttacaagtgcgagaagtgcgacaagtccttttcccagcaaagatctctggtcaaccatcagaaaatccatgccgaggtgaaaacccaggaaacccatgagtgtgacgcttgcggcgaggctttcaattgtagaatatctctgatacagcatcaaaagcttcacactgcatggatgcagtag

SEQ ID NO: 247378 - DNA, 1377 bp, Artificial Sequence
  Description of Artificial Sequence: Synthetic coding sequence
atggctgcaatgcctctgaaggctcaatatcaggagatggtaacctttgaagacgtcgccgtgcacttcaccaagaccgaatggaccgggctgtctcctgcacagagggccctgtataggagcgtaatgctcgagaatttcggaaatctgacagctctggggtaccccgttcctaagccagctcttatcagcctgctggagcgcggagacatggcctggggcttggaggcccaggacgaccccccagccgagcgtaccaagaacgtatgcaaggacgtcgaaacaaatatagacagcgaatccacgttgatccaggggattagtgaggaacgggacgggatgatgagccatgggcaacttaaaagcgtgccccagcggaccgatttccccgagacacgaaatgtcgaaaaacaccaggatataccaactgtcaagaatatccagggcaaggttccacgtatcccttgtgcccgaaagcccttcatctgtgaggagtgtggaaagtcattttcttatttctcatattacgctcggcaccagcggattcatacaggagagaagccattcgaatgttccgagtgcggtaaggcattcaatggtaatagctccctgatacggcatcagagaattcatacaggggaacgtccttaccagtgcgaagagtgtggccgagcctttaacgacaacgccaatcttattcggcaccagcggattcactctggggatcggccatattactgcaccgagtgtgggaatagcttcaccagctcctccgaattcgtgatccaccaacgaattcacacaggagaaaagccgtatgagtgcaacgagtgtggaaaagctttcgtcggtaactcgcctctcctgagacaccagaagatacacactggcgagaagccctacgaatgtaatgagtgtgggaaatccttcgggcgtaccagccacctgtcgcagcatcagagaatccacacaggggaaaagccatactcctgcaaggtatgtggacaggctttcaacttccacactaagttgacaagacaccagcgcattcactccgaggagaaacctttcgactgtgttgattgcggcaaggccttttccgctcaagaacaactgaagagacacctaaggatccatacccaggagagctcttatgtctgcgacgagtgtggcaaagccctgacatctaagaggaatctgcaccaacaccagcgcattcacaccggcgagaaaccatacgaatgcagcaaatatgaaaaggcatttggaacgagctcccagctgggtcatctggagcatgtttattctggcgaaaagcccgtgcttgatatctgccggtttggcttaccagaattcttcacccctttctactggtag

SEQ ID NO: 247379 - DNA, 1737 bp, Artificial Sequence
  Description of Artificial Sequence: Synthetic coding sequence
atggctgaagagtcccgaaagccatcggcgccatctcctcccgaccagacacccgaggaggatctggtcatcgtcaaggtggaggaggaccacggctgggatcaggagagctctctacacgagagcaatcccttggggcaggaggtgttcaggttgaggtttagacagctccgataccaagaaaccttaggcccaagggaggctctcatccagttacgggctttgtgccatcaatggctgagacccgatctgaacacgaaggaacagatcctggaactattggtgctggagcaattcctgaccattctccctgaggagctccagactctggtgaaagagcaccagctggaaaatggcgaagaggtggtgacacttctggaagacctcgagcgccagatcgacatccttgggcgacctgtgtctgcccgtgtgcatggccacagagtcctgtgggaagaagtggtgcactctgcctcagctccagagccacccaatactcagcttcagagcgaagccacacagcacaaatcacccgtccctcaggagtcccaagaacgtgcaatgtccacctcacaaagccccacacggagccagaaaggtagcagtggcgaccaagaaatgactgccactctcttgacagcaggttttcagactcttgaaaagattgaagacatggctgttagtctgatccgtgaagagtggttgctagacccatcacagaaggatctttgccgagataatcggccagaaaactttagaaatatgttttcacttgggggagaaacccggagtgaaaatagggagctcgcctccaagcaggtcatctctaccgggattcaaccccacggcgagaccgccgcaaagtgcaacggagacgtgatcagggggctggaacacgaggaggctcgagacctgcttggaaggctcgaacgtcagagaggtaatcccacacaggagaggagacataagtgtgatgagtgcggtaagagtttcgcccagtcaagcgggctcgttagacactggaggattcatactggcgagaaaccctatcagtgtaacgtgtgcggaaaagcattttcctatcgaagcgccctgctatctcaccaggacatccataacaaggtgaaaagataccattgcaaggagtgtgggaaagccttttcgcagaataccggcctcatactacaccagagaatccacaccggtgagaagccttaccaatgtaaccagtgtggtaaggccttttcacaatctgccggactcattctgcatcaacgtattcactccggggaacggccatatgaatgcaacgaatgcggcaaggccttctctcactctagccacctgatcgggcaccaaagaatccacaccggcgagaagccatacgagtgtgacgagtgcggcaagactttcagacgttcttcccacttaatcggacatcagagatctcacactggggagaagccctacaagtgcaacgagtgcggacgcgcattcagtcagaagagtgggctcatagaacaccaacggatacacactggtgaacgaccctacaagtgcaaggaatgtggtaaagctttcaatggcaacacaggtctgattcaacacctgagaattcatactggggaaaaaccttaccagtgcaacgagtgcggcaaagcgttcatccaacgctcatctctcattcgacatcagcgcatccacagtggagaaaagagcgaatctatttcagtgtag

SEQ ID NO: 247380 - DNA, 1737 bp, Artificial Sequence
  Description of Artificial Sequence: Synthetic coding sequence
atggctgaagagagtcgaaagccgtctgccccttctccaccggaccaaaccccggaggaggatcttgtcatagttaaggttgaggaggatcacggctgggaccaggagtcttctctgcatgaatctaatcctcttgggcaggaagtgtttcgccttcgatttaggcagctgaggtatcaggaaactcttggacccagggaggccctgatccagttgcgggctctttgccaccagtggctgaggcccgatttaaacactaaggaacagatcctcgaactgttagtcttagagcagtttctgacaatccttcccgaagagctccaaacattggtcaaggagcatcagctcgagaacggagaggaggtggtaaccctgctggaggacctcgaacggcagatagacatcctcgggaggcccgtatctgccagagtccacgggcatcgtgtgctgtgggaagaggtggtgcactcagccagcgcgccagagcctcctaatacccagctgcagtctgaagccacccagcacaagtctcctgtcccacaggagagccaagagagggccatgtctacatcccagtcgccaactcgttctcaaaaggggagttccggtgaccaggagatgactgctactctcctcactgctggtttccagacactcgaaaagatcgaagatatggccgtgtccctcatccgcgaagaatggctgctagatccctcccagaaggacctgtgtcgcgacaacaggccggagaattttaggaatatgttctctttaggcggtgagactaggtctgagaaccgtgaactagcgagtaaacaagtgatttccacaggaatacagcctcatggcgaaacagcagccaaatgcaacggcgatgtaatccgcggactcgagcatgaagaggcaagggacttgttggggagactggagagacagagggggaacccaacacaggagaggcgacacaagtgtgacgaatgcgggaagtcttttgcacagagttctggcctggtgagacattggaggattcacactggggaaaaaccctatcagtgtaatgtgtgcggaaaggctttttcctatcgctctgcgttgctgagccatcaggacatccacaataaagtcaagagatatcattgcaaagaatgcggcaaggcgtttagccaaaacaccggactcattctgcaccagaggattcataccggagagaaaccttaccagtgtaatcagtgtggtaaggccttttctcaatcagcaggcttaatcctgcatcagcggatccattctggagaacggccatacgagtgtaatgaatgtggcaaggctttctctcattcctctcatctcataggtcaccagagaatccataccggtgagaaaccttatgagtgcgatgaatgcgggaaaactttccgtcgttccagccacctgattggtcatcagcgaagtcacaccggagaaaagccctataaatgtaacgaatgtggacgggcattcagtcaaaaatccggattaatagaacatcagcggattcatacaggcgaaaggccctacaaatgtaaagagtgtggaaaagcgtttaatggcaacacaggtctgattcaacatctgcgaatccatacaggggaaaaaccataccaatgtaatgaatgcgggaaggcattcatccagcggagctcactaataagacaccagagaattcacagcggggaaaagtctgaaagtatttccgtgtag

SEQ ID NO: 247381 - DNA, 477 bp, Artificial Sequence
  Description of Artificial Sequence: Synthetic coding sequence
atggccgaggagagcaggaagccctccgctccctccccccctgaccaaacccctgaggaagatttggttattgtcaaggtggaagaggatcacggctgggaccaggagtcatctttacacgagtccaatccccttggacaagaagtcttccgccttaggttccggcagcttcggtatcaggaaaccctggggccacgggaggcactaatccagttgcgcgctctgtgtcaccaatggctacgcccagacttaaacacaaaagagcagattctggagttactggtcctcgaacagtttctgaccattctgccagaagaactccaaacactggtcaaagaacaccaactcgaaaatggtgaggaagtcgttacattattggaggacctggaacgacaaatcgacatactgggacgacccgtgtcccgcaggagatcccaactagcctacatggacatcggatattccggcagaaggtag

SEQ ID NO: 247382 - DNA, 1185 bp, Artificial Sequence
  Description of Artificial Sequence: Synthetic coding sequence
atgaacacaaactcaaaggaggtcctatctcttggggtccaggttcctgaagcctgggaagagctacttaccatgaaggtggaagccaagtcacacctgcagtggcaggaatccaggctgaagcgaagcaacccccttgcacgagagatctttcgacgccacttccgtcaactctgctatcaagaaacacccggaccaagagaggctctgactaggttgcaggaactgtgctaccaatggctgagaccccacgtctctactaaagagcagatccttgacctattggtgctggagcagttcctgtctattctgccaaaggagctgcaaggttgggttcgggagcattgcccggagtcaggggaagaagcagtcatcctcttggaggacctcgaacgggagctggatgagccccagcacgagatggttgctcatcggcacaggcaggaagttctctgtaaggaaatggttccactggcggaacagactcccctgacattacagtcgcaacctaaagaacctcagctgacctgtgacagcgcacagaaatgtcactcaataggagaaacggacgaagtgacaaagactgaggaccgggaactggtccttaggaaagactgccccaagatcgtggaaccccatgggaagatgtttaatgaacaaacatgggaagtcagccagcaagatcccagccacggggaagtgggagaacataaagacagaattgaaagacaatgggggaacttgctcggtgagggccagcataaatgcgatgagtgcggaaagtcttttacacaatcaagcggcttgattcgacaccagaggatccacaccggcgaacggccatacgaatgcaatgaatgtggtaaagcttttagtcgctcgagcggcttgtttaatcatcggggaattcacaacatccaaaagagataccattgcaaggagtgcggcaaagtgtttagccagagcgcgggactaatccagcatcaacggatccacaagggggagaagccctatcaatgctcccagtgctcaaaatcatatagccggagaagcttcttgatcgaacaccaaaggtcgcacactggagagcgccctcatcaatgtatcgaatgcggtaagtcttttaaccgtcattgtaatctcatccgccatcagaagattcacaccgtggcagagctcgtgtag

SEQ ID NO: 247383 - DNA, 126 bp, Artificial Sequence
  Description of Artificial Sequence: Synthetic coding sequence
atgaatacaaactctaaggaggtgctttcacttggggtacaagtgccagaggcttgggaggagcttttaactatgaaagtcgaggcaaagtctcacctacaatggcaggaatcaagactgaagtag

SEQ ID NO: 247384 - DNA, 1185 bp, Artificial Sequence
  Description of Artificial Sequence: Synthetic coding sequence
atgaataccaattcaaaagaggtcctctcgctgggggtgcaagtgccggaggcttgggaagagctactgaccatgaaggtggaagcaaaaagtcacctacagtggcaggaaagccgtttgaagaggtccaacccgctagcgagagaaattttcaggaggcactttagacagctctgttatcaggaaaccccagggcctcgcgaagcgctgacgaggttgcaagagctgtgctaccagtggttgagaccccacgtaagtaccaaagagcagatactcgatttactggttctggagcagttcttgagtattctgccaaaagagctgcaggggtgggttagggaacactgccccgaaagcggcgaggaggccgtaatccttcttgaggatctcgagagagaactcgacgaaccccagcacgaaatggtggctcaccgccatcgacaggaggtgctgtgtaaggagatggttcccttggctgagcagacgcccctcacgctccagagccagccgaaggagccccagctgacttgtgatagcgcacagaaatgtcatagcatcggcgaaacagacgaggtcacgaaaactgaggatagagagttggtgctccggaaagactgcccaaagattgtcgagcctcacggcaaaatgtttaacgagcagacgtgggaagtaagccagcaggacccctcccatggggaggtgggggaacacaaggatcgaattgagcgacagtgggggaacctcctgggagagggccagcataaatgtgacgagtgtgggaagagtttcacccagagttctgggctgatccgccatcagagaatccacaccggcgagcgaccctatgaatgtaacgaatgtggcaaggccttcagcagatccagcggcctgttcaatcaccgaggaatccataatattcagaagaggtaccactgtaaggagtgcgggaaggtcttttcccagagcgcagggctgatccagcaccagcggattcataagggggaaaaaccttaccagtgctctcagtgctccaagtcctacagccgcaggtctttccttattgaacaccagaggtcccacacgggagagcgccctcaccagtgtatcgagtgcggcaaaagctttaacaggcactgcaacctgattagacatcagaagattcatacggtggccgaattggtgtag

SEQ ID NO: 247385 - DNA, 1338 bp, Artificial Sequence
  Description of Artificial Sequence: Synthetic coding sequence
atgaataccaattctaaagaggtattaagcctgggggttcaggttccggaggcctgggaggaactcctaacaatgaaagttgaagcgaagagccatctccagtggcaagaaagccgattgaagaggagcaatcctctggctcgcgagattttccgacgtcattttagacagctctgttaccaggagacccctgggcctcgcgaggccctgacgcgcttacaggaattatgctatcaatggctaagacctcacgtatcgaccaaggagcagatattggatctgctggtgctggaacagttcctgagcatcctccccaaagagctccaaggatgggtgagagagcactgtcctgagagtggagaagaggcagtgatactgctcgaggatctggagcgagaactcgacgaaccacagcacgaaatggtggcacatcggcaccgtcaggaggtcctctgtaaggagatggtcccgctcgcagaacaaaccccacttacccttcagtcccagccaaaagaacctcagctgacttgtgatagtgcacagaaatgtcacagtataggcgagaccgacctgatcaggtcactgagacgacgagcagtactcatccctcttggcgcacatcttttttccaccgacaccttcctgttctctaagcccgtggtgattccccagcttaagggaggaggagagacctggcccaataaccgcggagtgcttcgtgatgaagtcacgaagacagaagaccgcgaactggtgctgcggaaggactgcccgaaaattgtggaacctcacgggaaaatgtttaacgagcagacgtgggaagtctcacagcaagacccttcacacggcgaggtgggcgaacacaaggatcggatcgagagacagtggggcaatctgctgggtgaaggtcaacacaagtgcgatgaatgcgggaagtcgttcacccagtcctctgggctgattagacaccagaggatccacactggagaaaggccctacgaatgcaacgagtgtgggaaagcattttccagatcttccgggctgttcaaccatagagggatccacaacattcaaaaaagatatcattgtaaggaatgcggcaaggtgttttcccagagcgctggcttaattcaacatcaacggattcacaaaggggagaagccctatcagtgctcccagtgctccaaatcctatagccgcaggagttttcttatcgagcatcaacgctcgcacacaggggaacgacctcatcagtgcattgagtgcggaaagagctttaatcggcattgtaatctgataagacatcaaaagattcacaccgtggcagaacttgtttag

SEQ ID NO: 247386 - DNA, 1821 bp, Artificial Sequence
  Description of Artificial Sequence: Synthetic coding sequence
atgactttgctgacatttagagatgtggccatcgaattttccctggaggagtggaagtgcctagatctggcccagcagaatctttacagagatgtgatgttagaaaattatcgcaacttgttctctgttggactgacagtctgtaaacccggtcttattacgtgcctcgagcagcggaaggagccttggaatgtaaaaaggcaggaggctgccgatggacatccagagatgggctttcatcacgccacacaggcctgcttggaacttctgggctcatctgacctgcctgctagtgccagtcaatcagctggcattaccggtgtaaatcaccgagcccagccaggattgaacgtgtcggtagacaagttcaccgccatgtcatcacatttcacgcaggatctgttacccgaacaggggatacaagacgcatttcccaagcgaattctgaggggctacggaaattgtgggctggataacctttatcttcggaaggactgggaatccctggacgaatgcaaactgcaaaaagactataatgggctcaatcagtgctctagcacgacgcattccaagatctttcagtacaataagtacgtcaaaatttttgacaattttagtaacctgcaccgacgaaatatttcaaataccggcgaaaaaccttttaaatgtcaggagtgtggcaagtcttttcagatgttatcatttctgacagagcatcagaaaattcatacgggcaagaagtttcaaaaatgtggggaatgcggtaaaactttcatacagtgtagtcactttactgaacctgagaacattgacacaggggaaaaaccatacaagtgccaggaatgcaacaatgtaataaaaacctgctctgtgctgactaaaaaccgcatctacgcaggaggtgaacactatcggtgtgaggagttcgggaaggtcttcaaccaatgctcccacctgaccgagcatgaacatggcacagaagagaaaccatgtaaatacgaagaatgcagtagcgtgtttatttcctgttcaagcctctctaaccagcagatgatcctggctggcgaaaaactctcgaaatgtgaaacttggtacaagggatttaaccacagccccaaccctagtaaacaccagcgtaatgaaatcggaggtaagccctttaagtgcgaagagtgtgactctatcttcaagtggttctccgatctgacgaagcacaaaagaattcacaccggcgaaaaaccgtataaatgcgatgaatgcggaaaagcctacacccagtccagccacctgtctgagcatcggcgtatccacacaggggagaagccctatcagtgtgaagagtgtggcaaggtgttccgtacctgctcaagcctgagcaatcacaaacggacacacagcgaagagaaaccttacacctgcgaggaatgtggcaatatattcaaacagttaagcgacttgacaaaacataagaagacccataccggggagaagccctataagtgcgacgaatgtggtaaaaacttcacgcagtcctcgaaccttattgtgcacaagcgcatccacacgggcgagaagccctacaagtgtgaggagtgcggcagggtcttcatgtggttttccgatatcactaaacataaaaagacccatacgggagagaaaccctacaagtgcgacgaatgtggcaagaactttactcagagctctaacctgatcgtacacaagcgtattcacactggcgagaagccctataaatgcgagaaatgtggaaaggcattcacccagttttcacatctcaccgtccacgagtccatacatacatag

SEQ ID NO: 247387 - DNA, 1686 bp, Artificial Sequence
  Description of Artificial Sequence: Synthetic coding sequence
atggccggagcccaaactttgctgacattccgcgacgttgccatagagttcagcctggaagagtggaaatgcctcgaccttgcacagcagaatctgtatcgggatgtgatgctcgagaattataggaaccttttctccgtgggtctgacggtgtgcaaaccgggtctgatcacgtgtctggaacagcgtaaggagccttggaacgtgaaaagacaggaggcagccgacggtcaccccgcaatgagctctcattttacacaggacctgctgcctgagcagggcattcaggacgcatttcccaagcgcatcttgaggggttacggcaactgcggattagacaatctctatctgcgtaaggattgggagagcctggacgaatgtaaattacagaaagactataatggactgaaccaatgtagctcgacaactcactctaagatcttccaatataacaagtatgtcaagattttcgataacttctccaaccttcaccgcaggaacatttcaaatactggggagaaacccttcaaatgccaggaatgcggaaagtcattccaaatgctgagtttcctaacggaacaccagaaaatacatacaggaaagaagtttcagaagtgcggggagtgtgggaaaaccttcatccagtgctcacacttcactgaaccagaaaacatcgataccggggagaaaccctacaaatgccaagagtgtaacaacgtgatcaagacttgctcagtgctcactaaaaaccggatatacgcaggcggagagcactaccgatgcgaggagttcggcaaggtgtttaaccaatgctcccaccttacggagcatgaacatggaaccgaagaaaagccctgtaaatacgaggagtgttcttctgtgtttatttcctgctctagccttagcaaccagcagatgatcctggcaggggagaagctgagcaaatgtgaaacttggtacaaaggattcaaccacagcccaaatccaagtaagcatcagcgcaacgagattggcggaaagccgtttaagtgcgaggagtgcgacagcattttcaaatggttcagcgacctgacaaagcacaagcggatccataccggcgagaagccgtataaatgtgacgagtgcgggaaagcctacactcaaagtagccatctatcggagcaccgcaggatccataccggcgaaaaaccatatcagtgcgaagagtgcggcaaagtgttcagaacctgtagcagcctgtccaatcataagcgaactcactcggaagaaaagccctacacatgtgaggagtgcgggaatatcttcaaacagctgagcgatctcaccaaacacaaaaagactcacacaggcgagaaaccctataagtgtgatgaatgtggcaagaacttcacacagagctcaaatcttatcgtgcataaaagaattcacactggcgaaaaaccttacaaatgcgaggagtgtggcagagtttttatgtggttcagcgatatcaccaagcacaagaaaacacataccggggagaagccctataagtgcgatgagtgcggcaagaatttcacccagtcttcgaacctcattgtacacaagcgtatccacactggcgaaaagccttacaaatgcgaaaaatgtggtaaagccttcacccagttctcccatctgactgtgcacgaaagtattcatacttag

SEQ ID NO: 247388 - DNA, 1674 bp, Artificial Sequence
  Description of Artificial Sequence: Synthetic coding sequence
atgactctcctaactttcagggatgtggcgatcgaattctcactcgaagaatggaagtgccttgatttggctcagcaaaacctctacagagacgtgatgttggaaaattaccggaacctattctctgtgggacttaccgtatgcaagcccggtttgattacctgcttggagcagcggaaggagccttggaatgtgaagaggcaggaagctgccgacggccatcctgccatgtcatctcactttactcaagacctactgccagaacagggaattcaggacgcttttcctaagagaattcttcgtggctacggaaattgtggtttggataatctctacctccggaaagactgggagagcctggacgagtgtaagttgcaaaaagactacaatggcctcaaccaatgctccagcaccactcattccaaaatcttccaatataacaaatatgtaaagatctttgacaatttttcgaacctgcacaggcggaacatctctaatacaggcgagaagccttttaaatgtcaggaatgcggtaagagctttcaaatgctttcgtttcttaccgagcatcagaaaatccatacgggaaaaaagtttcaaaagtgcggtgagtgcgggaagacatttatacaatgcagccactttaccgaacccgagaacattgataccggggaaaaaccgtacaaatgtcaggagtgcaataacgtaatcaagacctgcagcgtactcacaaaaaacagaatttatgcaggaggagagcattatcggtgtgaagaattcgggaaggttttcaaccaatgcagtcatttaacggagcacgaacacggaaccgaggagaagccttgcaaatacgaagagtgcagctcagttttcatttcgtgctccagcctttccaaccaacagatgatactggccggtgagaagctgtccaaatgcgaaacttggtataaaggattcaaccacagtcctaatccgtccaagcaccaaagaaacgagatcggcggtaagcctttcaaatgcgaggaatgcgattctatattcaagtggttctctgacctgactaagcacaaaagaatacacaccggggaaaaaccctataaatgcgacgagtgtgggaaggcctatactcagtcctctcatctttcagaacacagacgcattcatacaggggagaagccttatcagtgtgaggagtgcggcaaagtctttcgaacatgtagttctctatctaaccacaagcgtacccacagtgaggagaaaccatatacgtgtgaggaatgcggtaacatattcaagcagttaagtgaccttacgaaacacaaaaagacgcataccggagagaagccctataaatgtgatgagtgcgggaagaactttacccagagctctaatctgatagtccataagaggatacacactggcgaaaaaccctataagtgcgaagagtgcggaagagtgttcatgtggtttagcgatattaccaaacacaaaaagacccacaccggcgagaagccatacaagtgtgatgagtgcggcaaaaattttacacaatctagtaacttgatcgtgcacaaaaggattcacactggcgaaaagccctacaagtgcgagaaatgcggtaaggccttcacacagtttagccacctgacggttcacgagagtattcatacgtag

SEQ ID NO: 247389 - DNA, 1890 bp, Artificial Sequence
  Description of Artificial Sequence: Synthetic coding sequence
atgactttgctgaccttcagggacgtggccattgagtttagtctagaagaatggaaatgcctggatctggctcagcagaacctgtacagagatgtgatgcttgagaactaccgaaaccttttttctgtggggctgactgtgtgcaagcccggattgatcacttgtctcgagcagaggaaggagccctggaacgtgaagagacaggaggccgctgatgggcacccagaaatggggtttcaccatgctacccaggcatgcttagagctcctgggtagttccgacctgcccgctagtgcctcccagagtgcaggtatcaccggcgtgaatcatagagcccagccgggtctgaacgtgagcgtggataagtttaccgccttgtgttcgcctggcgtgttacagaccgtgaagtggttcctggagttcaggtgtattttttcactggcaatgtctagccatttcacccaggacctacttcctgagcaggggatccaggacgccttcccaaagaggattctgcgaggttacggaaattgcggactggataatctgtatctgcgcaaggattgggagtcattggatgaatgcaagcttcagaaagattacaacggccttaaccagtgctcgtccaccacacattccaagatttttcagtataacaaatacgttaagatattcgacaactttagcaatctccaccgccgaaacattagtaacaccggagaaaaacctttcaaatgccaggagtgcggtaaaagtttccaaatgttgtcgttcctcactgagcatcagaagatacacaccggtaagaagttccaaaaatgtggagagtgtgggaagaccttcatccagtgttctcacttcactgagcctgaaaacatcgataccggagagaagccctacaagtgccaggaatgcaataatgtaataaagacctgctcagtcctcacaaagaatcggatatacgccggtggggagcactatcgctgcgaggagttcggcaaggtgttcaaccaatgttcccacctcaccgaacatgaacacggaaccgaggagaaaccttgcaaatacgaagaatgttctagcgtttttatttcatgcagctccctgtcaaaccagcagatgattctggccggtgaaaaattaagcaagtgtgagacatggtataagggatttaaccactcccccaatccgtcgaaacaccagcggaatgagattgggggtaaacccttcaagtgcgaggagtgtgatagtatcttcaaatggtttagcgacttaaccaaacacaaaaggatccacacaggtgagaagccctacaagtgtgacgaatgcggtaaggcttatacacaatcttcacacctctctgaacacagaaggatacacactggtgaaaagccttaccagtgtgaggaatgtgggaaagtcttccggacgtgctccagcctgtcaaatcataagcggacgcattccgaagaaaagccatacacgtgtgaggagtgcggcaacatttttaagcagctaagcgacctcactaagcacaagaaaactcataccggggagaaaccttacaaatgtgatgaatgtggtaagaactttacacagagctccaacctcatcgtgcataagcgtatccatactggcgagaagccttacaagtgtgaagagtgtggccgtgtgtttatgtggtttagcgatataaccaaacataagaaaacccacactggcgagaagccatacaagtgcgatgagtgcggcaagaattttacacagagctcaaatttgattgtgcacaagaggatccatacaggggagaagccatataagtgtgaaaagtgtgggaaagcatttactcagttctcccatttaacggtacacgaaagcatccatacgtag

SEQ ID NO: 247390 - DNA, 1686 bp, Artificial Sequence
  Description of Artificial Sequence: Synthetic coding sequence
atggccggagctcagacattgctgaccttccgtgacgtggctattgaattcagcctcgaagaatggaaatgccttgatctcgcccaacaaaacctctacagagacgtaatgcttgagaattaccgcaatcttttttcggttgggcttacagtgtgcaaacctgggttgattacctgcctcgaacagcgtaaggagccgtggaatgtgaaacggcaggaggcagccgatgggcatcccgctatgagtagtcactttacccaggacttgctacccgaacaaggcatccaggatgcgtttcctaaaaggatcctcagaggctacggaaactgcgggctggacaacctgtacctgcgcaaggactgggagtccctcgatgagtgtaaactgcagaaagactataacggcttaaatcagtgttctagcactacccacagcaaaatcttccagtacaacaagtacgtcaaaatcttcgataatttctctaacctgcatagaaggaacatcagcaacaccggggagaagcctttcaaatgccaggagtgtggaaagagtttccaaatgctgtcctttctcactgagcaccagaaaattcacactggcaaaaagtttcaaaaatgtggggagtgcgggaagacattcatacaatgttcacactttacagagccagagaacattgatactggggaaaagccttacaagtgtcaggagtgtaataacgtgatcaaaacttgtagcgtgctaacaaaaaatcgaatatatgcaggtggagagcactatcgctgcgaagagttcggaaaagtcttcaaccagtgtagtcacctgacggaacatgagcacggtacagaggagaagccctgcaagtatgaggagtgtagcagcgtctttatttcctgttcctccttgagcaaccagcaaatgatactggccggagagaaactctcgaaatgcgaaacatggtacaaaggtttcaaccattcgccgaacccaagtaagcaccagcgtaatgagataggcggaaaacccttcaaatgtgaagagtgcgactccatcttcaaatggttctctgatctcaccaagcataagaggatccatactggggaaaagccttataaatgcgatgagtgtggcaaggcatatacacagagtagccatctttcggagcatcgcaggatccacacaggcgagaagccctaccagtgcgaagagtgcggaaaagtgtttagaacatgctctagtctttccaatcacaagcgcacccattctgaagagaaaccgtatacctgcgaggagtgcggcaacatttttaaacaactttctgatctcaccaagcacaaaaaaacacatactggcgagaagccatataagtgtgatgaatgcgggaagaatttcacccagtctagtaacctgatagtccacaagcgtatccacacaggtgagaagccatacaaatgtgaggagtgtggacgggtctttatgtggttcagcgacatcacaaaacataaaaaaacccacaccggtgagaagccttacaagtgcgatgagtgcggcaagaattttacccagagtagcaaccttattgtgcataagcgcattcataccggcgagaagccctataaatgtgagaaatgcggcaaggcctttacccagtttagccatcttaccgtccacgaatccatccatacgtag

SEQ ID NO: 247391 - DNA, 1833 bp, Artificial Sequence
  Description of Artificial Sequence: Synthetic coding sequence
atggccggagcacagaccctgttaacttttagagatgttgctatcgagttctctcttgaagagtggaagtgcttagacttagcccagcaaaacctctaccgagatgtgatgctggaaaactataggaacctgttctccgttgggcttacagtgtgtaagccaggcctgattacctgcctggagcagaggaaagagccctggaacgtgaaacgccaggaagccgctgacgggcacccagaaatgggctttcatcatgccacccaagcctgtttggagctgctcggttcatccgatctgcctgcctcggcaagtcagtctgctgggattacaggggtgaaccatagagcccagccaggcctgaatgtctccgtcgataaattcaccgccatgtcttctcattttacccaggacttgctgcccgagcaaggcatccaggatgcctttcccaaaaggatcctaagaggctatggcaactgcggactggataatctctaccttaggaaagactgggagagcttagatgagtgcaaactacaaaaggattacaacgggctgaatcaatgttcctctacgacccactccaaaatcttccagtataacaaatatgtcaagatatttgacaacttttccaaccttcaccgcaggaacatctctaatactggagagaagccattcaaatgccaagagtgcggaaaaagcttccagatgcttagttttctgactgagcatcagaaaatccatacagggaagaagtttcagaagtgtggtgaatgcggcaaaacctttatccaatgctcgcacttcactgagccagaaaacatcgataccggagagaagccttataaatgccaggagtgcaacaatgtgatcaaaacttgttcagtgctgaccaaaaaccgtatctatgccggaggggagcactaccgttgtgaggaattcggaaaagtctttaatcagtgctcccacttgacagagcacgaacacgggaccgaggagaaaccttgtaagtacgaggagtgctcttcagtctttatttcgtgctcctcgctgtctaaccagcagatgattcttgctggggagaaactatcaaaatgcgaaacatggtataagggctttaatcactctccaaatccaagtaagcaccaacgtaacgaaataggcggaaaaccattcaagtgtgaagagtgtgattccatattcaaatggttttccgatctcacgaaacacaaacggatccatacaggggagaagccctacaagtgtgacgaatgtggcaaggcatacacacagagctcacacctgtccgagcatcggaggatacacaccggagagaagccgtaccagtgcgaggagtgcggcaaggtgttcaggacatgcagctcgctttcaaaccataagcgaacacacagtgaagagaagccttatacctgtgaagaatgcgggaatattttcaagcagctctccgacttgacgaaacacaaaaagactcacaccggcgagaaaccctacaagtgtgatgagtgtggcaaaaacttcacacagagctcaaacctgatagtgcataagagaatacatactggagaaaaaccttacaagtgtgaagagtgcggtcgggtgtttatgtggtttagtgacattacaaaacacaagaagactcataccggagaaaaaccgtataagtgcgatgaatgtggaaagaatttcactcagtcctccaacctgatcgtccataagaggatacatactggagagaaaccttataagtgtgaaaaatgcggcaaggcatttacacaattcagccatctaactgtacatgaaagcattcatacatag

SEQ ID NO: 247392 - DNA, 396 bp, Artificial Sequence
  Description of Artificial Sequence: Synthetic coding sequence
atggccggagctcagactctgttaacattcagagacgtggccatagaattcagcctggaggagtggaaatgtcttgatcttgcgcagcagaacctctacagagacgtgatgttggagaattatcgcaacctgttctccgtaggcttaactgtctgcaaacccggactgataacctgccttgaacaacgaaaggagccttggaacgtgaaaagacaggaagcagccgacggacaccctgcgatgtcttcccatttcacacaggacttgctgccggagcagggcatccaggacgcttttcccaaacggattttgcgcggatacggtaattgcggtctagacaatttgtacctgaggaaagattgggaatctctcgatgagtgcaagctgcagaaatag

SEQ ID NO: 247393 - DNA, 348 bp, Artificial Sequence
  Description of Artificial Sequence: Synthetic coding sequence
atggcaggggcacagaccctactgacctttagagatgtggcgatagagttttcacttgaagaatggaagtgtctggacctagctcagcagaacttataccgtgacgtgatgctggagaattaccgaaatctttttagcgtcggactgacggtttgcaagcctgggctgattacatgcctggagcagagaaaagagccgtggaacgtgaagcgtcaggaggccgctgacgggcatcctgaaatgggatttcatcacgccactcaggcctgccttgaactgttgggatcctcagatcttcctgcctctgcctcacagtccgccggtattacaggcgtgaatcatcgttag

SEQ ID NO: 247394 - DNA, 1281 bp, Artificial Sequence
  Description of Artificial Sequence: Synthetic coding sequence
atggctgctgtatcaccgacaacaagatgccaggagtccgtgacttttgaagacgttgcggtcgtgttcacagatgaagagtggagccggctcgtcccaatccagcgagacttgtacaaggaggtcatgctggaaaattacaattctattgttagtttgggactacccgttccccagcccgatgtgatcttccagctgaaaaggggcgacaagccttggatggttgatcttcatggcagcgaggaaagagagtggcctgagtcagtgtccctggattgggagactaagccagagattcatgatgcctccgacaaaaagagcgaaggttccctgagggagtgtttaggaagacagagccccctgtgccctaagttcgaggtgcacactccaaacggccgtatgggaactgaaaaacagagtccatcgggcgagaccaggaagaaaagtctgtccagagataagggtctgcgtaggcggcgaagcgccctgagcagggaaatcctgaccaaggagcgccaccaggagtgctcagactgtgggaagaccttttttgaccacagctctctgactcgacaccagcgaactcacacaggggaaaagccctatgactgcagggagtgtgggaaagccttttcccacagatcttccctaagccggcatctgatgagccacacaggggaaagcccctacgagtgctccgtttgtagtaaagctttcttcgatagaagcagcctgacagtgcaccagcgtattcacactggggaaaagccatttcagtgcaacgaatgtggtaaagcctttttcgaccgatctagcctaaccagacatcagagaatccatacaggggaatcgccatatgagtgccaccaatgtggcaaagccttttcacagaaaagcatcctgacaagacatcagttgatccacactgggagaaagccgtacgagtgcaatgagtgcggaaaggctttttacggtgttagctccttgaacagacaccagaaagctcacgctggagatccccgatatcagtgtaatgaatgcggcaaagcctttttcgacaggtcttctctgacacaacatcagaaaattcacaccggggataagccttacgagtgtagcgagtgtggaaaagctttctcacagagatgccgcctaacgcggcatcaacgagtgcacacaggggagaaacccttcgagtgcaccgtatgtggcaaggtgttcagtagcaagagctccgtcattcagcaccagagacgctatgcgaagcagggaatcgattag

SEQ ID NO: 247395 - DNA, 1155 bp, Artificial Sequence
  Description of Artificial Sequence: Synthetic coding sequence
atgctagagaactataactctatcgtgtctttgggcctgcccgtgccccagcccgacgtaatatttcagctcaaacgcggagacaagccttggatggtagacctccatggaagcgaggaacgggagtggcccgagtccgtgagtctcgactgggagactaagcctgagatacacgatgcctccgataagaagagcgagggtagcctgcgcgagtgtcttgggagacaatcccccctgtgccccaagttcgaagtgcacactccaaacggaagaatgggcaccgaaaagcagtcacccagcggagagaccagaaaaaaatctttatcaagggataaaggcctccgccgaagacgtagtgcactgtctagggagatcctgaccaaagagcgccaccaggaatgctccgactgcgggaaaaccttctttgaccacagttctctgaccagacatcagagaacgcacacaggggagaaaccctacgactgtcgagagtgtggcaaagcttttagccataggagcagtctttcccgccacctgatgtcccacaccggcgagtcaccgtacgaatgctctgtttgcagtaaggctttctttgaccggagcagcttgacggtgcatcagaggatacacacgggcgaaaagcccttccagtgcaatgagtgcgggaaggcattctttgatcggtccagtctgaccaggcaccagcgaatccatactggagagtcaccctatgagtgtcatcaatgcggaaaggctttctcccagaagtcaatacttacccggcaccaactcattcataccggaaggaagccctacgagtgtaacgaatgtggcaaggccttctatggcgtgtctagccttaaccgccaccaaaaagcgcacgcgggagatccgaggtaccagtgtaatgaatgtggcaaggccttctttgaccgctcttctctaacacagcaccagaaaatccataccggcgacaaaccctacgagtgttccgaatgtggtaaggctttcagccagaggtgcagactcactaggcaccagcgcgtgcacactggggagaaaccgttcgagtgcacggtatgtggtaaggtgtttagctcgaagagctccgtgatacaacatcagaggcgctacgccaaacagggaatcgactag

SEQ ID NO: 247396 - DNA, 1041 bp, Artificial Sequence
  Description of Artificial Sequence: Synthetic coding sequence
atgctcgaaaattataattcgatcgtgagtcttgactgggagactaaaccagagattcatgacgccagtgataaaaagtccgagggctcacttcgggagtgtctgggcagacagagtcccttgtgtcccaagttcgaggtgcacacaccaaatgggaggatgggcactgagaaacagagcccgtctggagaaacaagaaagaagtcgctaagtagagataaggggctccgtcgtaggcggagtgcgctgtctagagaaattctgaccaaggagagacaccaggagtgctcagattgcgggaagacgttctttgatcactcttctctaacgcggcaccaaaggacgcacacaggcgaaaaaccctatgactgcagagaatgcggaaaggcattctctcaccgttcatccctctcacgacatcttatgtctcataccggcgagagcccttacgaatgtagcgtatgctcaaaagctttctttgatagaagtagcctgacggttcatcagagaatacacactggggaaaagcctttccagtgcaacgaatgtggcaaagctttcttcgatcgcagcagcctgacaagacaccaacgtatccataccggagaatcaccttatgagtgtcaccagtgcgggaaggcattctcgcagaagtctatccttacgcggcatcaactgattcatacgggaaggaagccttatgaatgcaatgagtgtggtaaggcattttatggggtctctagtctcaacagacaccaaaaggcccatgcgggagatccacgataccagtgcaatgaatgtggcaaagcttttttcgacaggtcttccctgactcagcaccagaaaatccatactggtgataaaccatacgagtgctctgaatgcggaaaggccttcagccaacgatgccggctgacacggcaccagcgtgtgcatactggagagaagcctttcgagtgtactgtctgtggaaaggtattttcatcaaagtccagcgttattcagcaccaacgcaggtacgccaagcaagggattgattag

SEQ ID NO: 247397 - DNA, 1320 bp, Artificial Sequence
  Description of Artificial Sequence: Synthetic coding sequence
atggcagcagtgagtccaacaacccgttgccaggagagcgtcaccttcgaggatgttgcagtggtgtttacggacgaggagtggagccgcctggtaccaattcagcgagacctctacaaggaggtcatgctggagaactataacagtatcgtcagtctgggtctgccagtaccacagcccgatgtgatctttcagttaaaaaggggcgacaaaccttggatggtcgacctgcacggctctgaggaaagagagtggcccgagagtgtgtctttggcacaggagaaaaactgtatttgcttcctattcgtccccgactgggaaaccaagcccgaaattcatgatgcttccgacaaaaaatcagaaggctcccttcgtgaatgtctgggacggcaaagccctttgtgtcctaagttcgaagtacatacgcctaacgggcgaatgggtaccgagaaacaaagtccgagcggcgagacaagaaaaaagtctttatctcgagacaagggactccgtcgcagacggtctgccctgtcacgcgagatcctgaccaaagagcggcaccaggaatgtagcgattgcgggaagacattttttgatcacagctctctcacgcgccaccagcgaacccacactggcgaaaaaccctacgattgtagggaatgtgggaaggccttttcgcatagatcaagtttgagtcgacacctgatgtcacacactggcgaaagtccatatgagtgctcagtgtgttcaaaggccttcttcgataggtcatccctgacagttcaccagagaatccacacaggcgaaaagccctttcagtgtaacgaatgcggtaaagcatttttcgacagaagctcgttgacccgccaccagcgaatacacacaggagaatctccttacgaatgccaccaatgcgggaaggcctttagtcaaaaatcgatcttgacacggcaccagctgattcacaccggtcgaaagccatacgagtgtaatgaatgcggtaaagccttctacggagtcagctccctaaaccgacaccagaaagctcatgcgggagatcccaggtaccaatgcaatgagtgcgggaaagcttttttcgacaggtcatcattgacgcagcaccaaaaaattcacaccggcgacaagccttatgaatgcagcgaatgtggcaaagccttttcgcagcgatgtcgcttgactaggcatcagagggtgcatactggcgagaaacccttcgagtgtaccgtttgcgggaaggtattcagtagtaaaagcagcgtcattcaacaccaacgcaggtatgcaaaacaaggtatagactag

SEQ ID NO: 247398 - DNA, 1611 bp, Artificial Sequence
  Description of Artificial Sequence: Synthetic coding sequence
atgatgttccaagatagcgtggccttcgaggacgttgcagtgtccttcacccaggaggaatgggccctgctggacccgagtcagaagaatctgtatcgagatgtcatgcaggagacctttaagaatttaactagcgtcggtaaaacatggaaagtacagaatattgaggacgagtacaagaacccacggagaaacctgtcattgatgagggaaaaactgtgtgaatctaaggaatctcaccactgcggcgaatcttttaatcagattgccgatgatatgctgaatcgcaaaaccctgccaggcattaccccatgcgagtcaagcgtgtgcggtgaggtggggacaggtcactccagcttgaatactcacataagagcagacacaggccacaagagctcagaataccaagaatacggagaaaatccctaccgtaataaggaatgcaagaaggcctttagctatctcgacagtttccaaagtcatgataaggcttgcacaaaagaaaagccgtacgatgggaaagagtgtacggagacatttattagccactcctgtattcaacggcacagggtgatgcacagtggagatggtccctacaagtgtaagttctgtggcaaggcattttactttctgaatttatgtctgatccatgagagaattcacactggcgtgaagccctacaagtgtaaacagtgtggaaaagccttcactcgatcgacaacactgccggtccatgaacgaacccatacaggagtgaatgccgacgaatgcaaagagtgtgggaacgccttctcttttccgagcgaaattcgacggcacaagcgcagtcacaccggcgaaaagccatatgagtgcaagcagtgtgggaaggtgtttatatctttctcatccattcagtaccataagatgacacataccggcgagaagccttacgagtgcaaacagtgtggcaaagccttccgctgtgggtcccacctgcaaaagcatggtaggacccacactggggagaagccttatgaatgtcggcagtgtggcaaggccttcagatgcacatcggatctacaaaggcatgagaaaacccatacagaggataaaccttacggctgcaagcaatgcgggaaggggtttcggtgcgcttcacagctgcagattcacgagaggacccatagcggcgaaaagcctcacgagtgtaaagagtgcggaaaagtgttcaaatactttagtagcctgcggatccacgagagaacacatactggagagaaacctcatgagtgcaaacagtgtggcaaagcattccggtacttttcatcactgcatatccatgagcggactcacaccggagacaagccttacgagtgtaaggtgtgcgggaaagcttttacctgcagcagctctattcgctaccatgagcggacgcacactggggaaaagccttatgagtgtaaacactgtggcaaggccttcatttcgaactatattcggtatcacgagcgaacccatacgggagaaaagccgtaccaatgtaagcagtgtggaaaagcttttatcgttccagttcatgtggagaatatgaaggaactgataccccttatagatgagaaatccttctag

SEQ ID NO: 247399 - DNA, 1599 bp, Artificial Sequence
  Description of Artificial Sequence: Synthetic coding sequence
atgatgttccaggactctgtggcctttgaagatgtggccgtgtcctttactcaggaggagtgggcattgctggacccatcacagaagaacctctatcgcgatgtgatgcaggagaccttcaaaaacctcaccagcgtggggaagacatggaaagtccagaatatcgaggacgagtataagaaccccagacggaacctctcgcttatgcgagaaaagctttgcgagtccaaggaatcacatcattgtggcgagagcttcaaccaaattgccgacgatatgctgaatcgaaagaccctccccggtatcacaccctgtgagagcagcgtctgcggagaagtaggtacaggacacagttcgctcaacactcacattagagcagacacaggacataagtcatctgagtatcaggagtacggagaaaatccctacaggaacaaggagtgcaagaaggctttcagttacctggattcttttcaaagtcacgataaagcctgcactaaagaaaaaccctacgatggcaaagagtgcacagagacttttattagccacagctgcattcagaggcatcgcgtcatgcacagcggcgatggtccctacaaatgtaagttttgcgggaaggctttttacttcctcaacctgtgtctgatccacgaacgaatccacacaggtgtgaaaccatacaaatgcaagcagtgcggaaaagcctttacacggagcactacgttaccggtacatgagagaacccatacgggagtcaatgccgatgagtgcaaggagtgtgggaacgctttcagctttcctagtgagataaggcggcataaacgctctcacaccggcgaaaaaccctacgagtgcaagcaatgcgggaaagtgttcatatcctttagcagcatccagtatcacaaaatgacacacacaggcgagaaaccctacgaatgtaaacaatgtggcaaagcatttagatgtggttcacatttacaaaagcatggacgcacccacactggagagaaaccctacgaatgtcgccagtgcggaaaggcatttcgatgcacctccgatctgcagcgacatgagaagactcatacagaagacaagccttatgggtgtaagcaatgtgggaagggatttcgatgtgcctctcagctgcagattcacgagaggacccatagcggcgagaaaccacacgaatgtaaggaatgcggaaaagtgttcaagtacttctcctcgctccgcatacacgaaagaactcatactggggagaagccgcacgagtgcaaacagtgcgggaaggcattccgatatttttccagtctgcatatccacgagagaactcatacaggcgataagccttacgagtgcaaagtctgtggcaaggcctttacctgttccagctcaatcagataccacgagcgaactcacaccggcgaaaagccatacgaatgtaagcactgcgggaaagcctttattagcaactacatcagataccacgagcgaacgcacaccggcgagaagccatatcaatgtaagcagtgtggaaaagcatttattcgagctagttcctgtcgcgaacacgaacgcactcacactattaaccgatag

SEQ ID NO: 247400 - DNA, 1185 bp, Artificial Sequence
  Description of Artificial Sequence: Synthetic coding sequence
atgatggcggcaaaagtcgtgccaatgccacctaaacccaagcaaagcttcattctgcgagtaccgccagactcaaaactcggccaagatcttctccgcgatgccactaacggtcctaaaactattcaccagcttgttctggaacactttttaactttcctgcccaaaccaagtctggtacagcccagtcagaaagtcaaggagactttggtgattatgaaagatgtgtctagttctctccagaatagagttcaccccagaccactagtaaagttactgcccaagggcgttcaaaaagaacaggagaccgtttctctataccttaaggctaaccccgagctggtggttttcgaggatctgaatgttttccactgtcaggaagaatgcgtatcgttggatcctacacagcagttgacatccgagaaggaagacgacagcagcgtgggcgagatgatgctgctggctgtgaatggctccaacccggagggggaggatcccgaacgggagcccgtggaaaacgaggactacagggaaaaatcgagtgatgatgacgagatggacagcagcttagtttcccagcaaccaccggacaaccaggaaaaagagagactgaacaccagcataccacaaaagcggaagatgagaaacctcttagtcacgatcgaaaatgatacccccttggaagaactgtcaaagtatgtggacattagcatcatcgctctgaccagaaatagacgcacccgccgatggtacacatgcccactctgtgggaagcagttcaacgagtcgtcctacttgatatcacaccagcggacccacacaggcgaaaagccctacgattgtaaccattgtggcaagagtttcaatcataagaccaacctgaataagcacgagcgaattcacacaggtgaaaagccctacagctgttcccagtgcggaaagaacttccgtcagaattctcacaggagcaggcatgaagggatccacatcagagagaaaatttttaagtgcccggagtgcggcaaaacttttcccaagaacgaagagttcgttctccacctgcagtcccatgaggctgaacgcccttatggttgcaagaagtgcggccgtagattcggcagactgtctaactgtactagacatgagaagacccacagcgcttgtaagacacggaagcaaaagtag

SEQ ID NO: 247401 - DNA, 1188 bp, Artificial Sequence
  Description of Artificial Sequence: Synthetic coding sequence
atgatggctgcgaaagtcgtccctatgcccccaaagccgaaacagtcatttatattaagagtgccccctgactctaaactgggccaggacctgttgcgggacgctacaaacggcccaaaaacgatacaccagttggtcctcgaacattttctcacttttttaccaaagccaagtctagtgcagccatcccagaaagtgaaggagaccctagttatcatgaaggatgtctcttccagccttcagaacagagtgcacccaaggccccttgttaaactgttgcccaaaggcgtgcagaaggaacaggagacagtgtctctgtatctgaaggctaatccagaagaactggttgtgttcgaagatctgaatgtgtttcattgtcaagaggagtgcgtctcgctagatccaacacagcagctgaccagtgagaaggaagacgactcctcagtcggagagatgatgctgcttgccgtgaacggaagcaacccggagggggaggaccccgagcgggaaccggtagaaaacgaggactacagagagaagtcctctgatgatgatgagatggactctagtctggtgtctcaacaacccccagacaaccaagagaaggagcgcctgaacacctcaattccacaaaaacgcaaaatgcgaaacctgctcgtcacaattgagaatgacacacctcttgaggaattgtccaaatacgtggacattagcataatcgcacttacccgcaaccgcaggaccagaagatggtatacttgccccttatgcgggaagcagtttaatgaatcttcatatttgatctcccaccaaagaacacacaccggagagaaaccttatgactgcaaccattgtgggaagtcttttaaccacaaaacaaacctcaacaaacatgagcggattcacacaggagagaagccctactcctgctcgcaatgtggaaagaacttcaggcagaatagtcatcgctctcggcatgaaggtatccatatacgcgaaaagatcttcaagtgtccagaatgtggaaagacatttcccaagaacgaggaatttgtgctgcaccttcaaagtcacgaggcagagcgcccttacgggtgcaagaaatgtggtcggcgatttggtcgcctttctaattgtacccggcacgagaaaactcattccgcgtgtaaaacccgcaaacagaaatag

SEQ ID NO: 247402 - DNA, 1185 bp, Artificial Sequence
  Description of Artificial Sequence: Synthetic coding sequence
atgatggctgccaaggttgtgccgatgcctccaaagccgaaacagagctttattttgcgagtgccacctgatagtaaacttggccaagacttgctgcgggatgccaccaacgggcctaaaactattcaccagctggtgcttgaacattttctcaccttcctacccaagccatcactcgtgcagccttctcagaaggtcaaggaaaccctagtcattatgaaggacgtgtcgagttctctccagaatcgcgtgcacccacggcctttagttaagttactgccaaagggcgttcagaaggaacaggaaacggtatccctctacctgaaggctaatccagaggaattggtagtattcgaagatttgaacgtgttccattgccaggaagaatgtgtgagcctagatcctacacaacagctgaccagcgagaaggaggacgattcttccgttggcgaaatgatgctgttagtgaacgggtctaatcctgagggcgaagaccctgagcgggagccagtggagaatgaagactacagggaaaagtcgtctgatgatgacgaaatggactcttccctcgtcagtcagcagcctcctgataatcaggaaaaggagcgcctgaatacctccatcccacagaagagaaagatgcgcaacctgctagtcaccatcgagaacgatacccccttagaggaactaagcaaatacgtcgatattagcatcatcgccctgaccagaaaccgtaggactcgaaggtggtatacttgtccgctctgtgggaagcagtttaacgaaagtagctatctgatatcacaccaacggacccatacaggagagaaaccatatgattgcaaccattgtggaaaaagctttaaccataagaccaacctgaacaagcatgagaggatacacaccggcgaaaaaccatatagctgttcccaatgcggcaaaaactttagacagaattcacacagatccaggcacgaaggcatccacatcagggaaaaaatcttcaagtgcccggaatgcggcaagacattcccaaagaacgaggaatttgtactccatctgcagagtcatgaagccgagcgaccttatggttgcaagaagtgcggtaggcgatttggaagactcagcaattgcaccagacacgagaagacccacagtgcatgcaagacaagaaagcagaagtag

SEQ ID NO: 247403 - DNA, 1185 bp, Artificial Sequence
  Description of Artificial Sequence: Synthetic coding sequence
atgatggcagcgaaggtggtgccaatgcctccaaagcccaaacagtctttcattctcagagtgccacccgatagcaagctgggtcaggatttactacgcgatgctacaaatggccctaagaccatccatcagttggttctcgagcacttcctgacatttttacctaagccaagtctagtacagccctcccagaaagtgaaggaaaccctcgtgattatgaaagatgtaagctcatccttacagaaccgagtgcatcctagaccattagtgaaactgctgcccaaaggcgtgcaaaaggaacaggagaccgtctctctttatttgaaagccaatcctgaggaactggtggtgttcgaggacttaaatgtgttccattgtcaggaggagtgcgtcagcctggatcccacacagcaactcacatcagagaaggaagatgatagtagcgttggtgaaatgatgctgctcgtgaatgggtccaatccagagggtgaagatccagaacgagaaccagttgagaacgaagattatcgcgagaaatcatccgatgacgatgagatggactccagtctggtgagccaacagcctcctgacaatcaggaaaaggaaagactaaacacctcaattccccagaaacgcaagatgcgtaacctactagtaaccatagagaatgatacccccctagaagaattgagtaagtacgttgacatatcaataatcgctctcaccagaaaccggaggacccgacggtggtatacatgtcccctctgtggtaaacaattcaatgaatctagttatctgatttcacaccaacgaacgcatacaggcgagaaaccttacgattgtaatcactgcgggaagagctttaatcacaagactaacctcaataaacacgagcgtatacacaccggagagaaaccatattcatgtagccagtgcgggaaaaacttccgacaaaactcccacagaagtcgccacgagggcatacacatcagggaaaaaattttcaaatgtcctgagtgcggcaagacctttccaaaaaatgaggaatttgtcttgcacctgcagtcccatgaggcagagagaccatatgggtgcaagaaatgcggccgaaggtttgggagactcagcaactgtactaggcacgagaagacccactctgcttgcaagacgaggaaacaaaagtag

SEQ ID NO: 247404 - DNA, 1188 bp, Artificial Sequence
  Description of Artificial Sequence: Synthetic coding sequence
atgatggctgccaaagtcgttcccatgccaccaaagcccaaacagagtttcattttgcgcgtgccccctgacagcaagcttggacaggacctgctcagggacgccaccaatggacctaaaacgatccaccagctggtgctagaacacttcttgaccttcctgccaaaaccatcactcgtgcaacctagtcaaaaggttaaggagacactggtgatcatgaaagacgtttcatcttcactgcagaatagagtgcacccacgacccctggtcaaactcctgccgaaaggggtacaaaaggaacaggagactgttagtctgtacttgaaggctaatccagaagaactcgtggtctttgaagacctgaatgtctttcactgccaggaagagtgtgtcagccttgacccgacccagcagttaacgagcgagaaggaggacgacagcagcgttggagagatgatgctgctcgcagtgaacgggtctaacccggaaggagaagatcctgaacgagagccggttgagaacgaggactatagagaaaagtcctctgatgatgacgagatggactcctctctggtctctcagcagcccccagacaatcaggagaaagagaggctgaacacgagcatccctcaaaagagaaaaatgcggaacttactggtcacaatcgaaaacgacacacccctggaagaactttctaagtatgtggatataagtataatcgccctgaccagaaataggagaactcgaagatggtatacctgtccactctgtgggaaacagtttaatgagtcttcctatctgatctcccaccaacgtactcataccggggagaagccttacgactgcaatcattgtggtaaaagtttcaaccataaaacaaacctaaataaacatgaaagaattcacactggggagaagccatactcgtgcagccagtgcggtaagaacttcaggcagaatagccacaggtcgcgccacgagggcatccacatcagagaaaagatattcaagtgtcccgagtgtgggaaaacgttccctaagaatgaggagttcgtactgcacctgcagagccacgaagcggaacgcccatacggatgtaagaagtgtggcaggagattcggcagactgagcaattgcaccagacatgaaaagactcactccgcgtgcaaaacacgcaagcagaaatag

SEQ ID NO: 247405 - DNA, 1947 bp, Artificial Sequence
  Description of Artificial Sequence: Synthetic coding sequence
atggcaacagccgtggaaccagaggaccaggacctatgggaggaagagggaatcctaatggttaaactggaagatgatttcacgtgccgcccagaaagcgtgctgcaacgggacgaccccgtgttagaaacatctcaccagaattttcggaggttccgctaccaagaagctgctagccctcgcgaagccctcattcggcttcgggagttgtgccaccagtggctgagacctgagcgacgaaccaaggagcagatcctggaactgctggtactggagcaatttcttaccgtgttgcccggagagctgcaatcgtgggttcgcggacagaggcccgagtctggggaggaggcggtgacactggttgaagggctacagaaacagcctcgccgtccccgtaggtgggtgacggtccatgtgcatggacaggaagtactgtcggaagaaacagtgcatcttggggttgagccagagagtccaaatgaattacaggacccggtgcagtcaagcacacctgagcaatcaccagaggagacaacacaatctcccgacctgggagctccagcagaacagcgaccacatcaggaggaggaactgcaaactctgcaggagagcgaggtcccagtacccgaggaccccgatctgcctgccgaaagaagtagcggcgactccgagatggtggccctcctcacagctttatctcagggcctggtaacttttaaggatgtggctgtatgcttctctcaagaccagtggagcgatctggaccctacacagaaagaattctacggcgaatacgtgcttgaggaagactgtggtatcgtggtctcccttagttttcccataccaagacccgatgaaatttctcaggttcgagaggaggagccctgggtacccgatattcaagagccccaggaaacccaagagccagaaatcttaagtttcacttatacaggcgataggagtaaggatgaagaggaatgcctggagcaagaagacctttcactggaagatattcatagacctgttctcggcgagccggagattcaccaaacgcccgactgggaaatagtctttgaagataatcctggaagactgaatgagagacggttcggcacgaatatcagccaggttaattccttcgttaacctccgcgagaccacccccgtgcacccacttctggggagacatcacgactgctctgtgtgtgggaagagcttcacctgcaatagccacctggtgcggcatctgcgaacccacacgggggagaagccttacaagtgtatggagtgcggcaagtcgtatacacgaagcagccacctggccaggcaccagaaagtacacaaaatgaacgccccatacaaatatcctctgaaccgcaagaatctcgaggagacttcaccagttactcaggccgaacgcacgcccagtgtggaaaagccctacagatgtgacgactgcggaaaacactttagatggacttccgacctcgtcaggcaccagagaacacacacgggagagaagccatttttttgtacaatctgcggcaaaagcttttcacagaaatccgttctgaccactcaccagcgtatccatctgggaggtaaaccatacctttgcggggagtgtggagaggatttctctgaacataggcgctatcttgcccaccggaaaacgcacgccgcagaggagctctatctttgctccgagtgtggcaggtgctttactcattccgcagcctttgccaaacacctgaggggacacgcctcagtgcgcccttgccgatgtaatgaatgtgggaagtcattctctcgcagagaccacctcgtgcggcatcagaggacacatactggggaaaaacccttcacgtgccctacttgcgggaaatctttctcccggggttaccatctgatccggcaccagaggacccacagtgaaaagacctcttag

SEQ ID NO: 247406 - DNA, 1947 bp, Artificial Sequence
  Description of Artificial Sequence: Synthetic coding sequence
atggctaccgctgtcgaaccggaagatcaagatctctgggaggaagaggggattctcatggtgaagttggaggacgacttcacttgcaggcccgaatcagttctgcagcgcgacgatcccgtgttggagactagtcaccagaactttcggaggtttaggtatcaggaggccgcatcccccagagaagccttgatccgtctgagagagctctgtcaccagtggctcagaccagagaggcgcaccaaggagcaaatccttgaactgctggttttagagcagtttttaactgtgcttccgggtgagctgcagtcttgggtgcgtggacagcgacctgaatctggtgaagaggccgtgacccttgtggaaggcctgcagaagcagcctcggaggcctcggagatgggtgacagtacatgtacacgggcaggaggtgctgtcagaggaaacggtgcatctcggtgtggaacccgagtctccgaacgagttgcaggaccccgtgcaatcgagcacgccagagcagagccctgaagagacaacacagtctcccgatctgggtgccccagctgagcaaagaccccatcaggaagaagagctgcagacattacaggaatcagaggtcccagtccccgaggaccccgacttgcccgctgaacggtcctctggtgacagcgagatggtagcactccttacggctctgtctcaagggctggtgacatttaaggatgttgctgtttgcttcagtcaggaccagtggtcagacttagatcccacacagaaagagttctacggggagtatgtccttgaagaggactgtgggattgtggtgtccctgtcattccccattcctcggcctgatgagatatcccaagtaagggaggaggagccgtgggtgcctgatatccaggaacctcaggaaacccaggaacctgaaattctgagtttcacctatacaggtgatagatccaaggacgaagaggaatgtcttgaacaggaggatttaagcttggaggatatccatcgaccggtgctgggcgagcccgaaatccatcaaacacctgattgggagatcgttttcgaagataatccgggacggctcaacgagcgacgatttgggaccaatatctcacaggtcaactcattcgtgaacctaagagagaccacccctgtgcatcccttattaggcaggcatcacgattgcagcgtctgtgggaagtcctttacatgtaatagccacctcgtgcggcacctacggacccacaccggagagaagccgtataaatgtatggagtgcggcaagtcatacactcgtagttcgcatttagctagacatcaaaaagtacacaaaatgaatgcaccgtacaaataccccctcaacaggaaaaacctcgaagagacatcccccgtgactcaggccgaacgcactccgtccgtagagaaaccgtacagatgtgacgattgcggcaagcattttcggtggacaagcgatctcgtgagacatcagaggacccacacaggagaaaagccctttttttgtacaatctgtggcaagagtttcagtcaaaagtcagtattaaccacacatcaaaggattcacctgggcggaaagccctacttgtgtggcgagtgcggcgaagatttttccgaacatcggaggtaccttgcgcacaggaaaactcacgcagctgaagaactgtacctgtgcagtgagtgtggtagatgctttacacactcagcagcctttgctaagcatcttcgcggacacgctagtgtacgcccttgcaggtgcaatgagtgtggtaagtccttctcaaggagggatcatcttgtgcgccaccagaggacacacaccggcgagaagcccttcacatgtcccacatgcgggaaatcattctcaaggggatatcatctcatccgccaccagaggacccactccgagaagacatcttag

SEQ ID NO: 247407 - DNA, 1947 bp, Artificial Sequence
  Description of Artificial Sequence: Synthetic coding sequence
atggcaacagctgtagaacctgaagaccaagatctgtgggaggaagaggggatacttatggtgaagttggaagatgacttcacgtgcaggcctgagagcgtcttgcaaagagacgatcccgttctagaaacatcccaccagaattttcgcagattccgataccaggaagcggcatcccccagagaggcacttattagactgagggaactttgtcaccagtggttacgccctgaacgaaggacgaaagagcagatcctggaactgttggtgctggagcagttcttgaccgtgctgcccggagagctgcagtcatgggtgagaggccagcgaccagagagtggtgaggaagccgtgaccctggtcgagggactgcagaaacagccgagacgtccacggcgatgggtcacggtgcacgtccacggccaagaggtgctgagcgaggaaaccgtgcacctgggcgtcgagcctgaatctcccaacgagctgcaagatccagttcaaagctctacccctgagcagagccccgaggagacgactcagagcccggaccttggggctcccgctgagcagaggcctcaccaagaggaggaattacaaaccctgcaggaaagtgaggttccggtaccagaggaccctgacctacctgctgaaagaagcagcggcgactcagagatggtggccctgctgaccgccctcagccagggtttagtaactttcaaggatgtggccgtatgcttcagtcaagatcaatggagcgatctcgatccaacacaaaaggaattctatggcgagtatgtgctcgaagaagactgtgggatagtcgtaagcctcagtttcccaatccccagacccgatgaaatcagccaggttagagaggaagaaccctgggtgcctgacatacaggagccacaggaaacccaggagccggagatcctatcattcacatatacgggagaccgatccaaagacgaggaggaatgtctggagcaggaggacctttcactggaggacatccatcgccctgtccttggggaacccgaaatccaccagacaccggattgggagatcgttttcgaggacaacccagggaggcttaacgaaaggcgcttcgggactaacatttctcaggtaaactctttcgtaaacctccgcgagaccaccccagtccaccctctcctgggtcggcaccatgattgtagcgtgtgcggcaagagctttacctgtaatagccacctggtgcgacaccttagaacacacacgggggagaagccctataagtgcatggaatgtgggaaaagctatacacgttcttcacacctcgcacggcatcagaaagtgcataaaatgaacgccccttataagtaccctctgaacagaaagaacctcgaagaaacatcccccgtcacgcaggctgagcgcaccccatcagtagaaaagccttatcggtgcgacgattgcggtaaacatttccgttggaccagcgacctggtcagacaccagcggacacatactggagagaagccatttttttgtaccatatgtgggaagtccttctcccagaaaagcgtgctcaccactcatcagcgcatccatttaggcggtaaaccatatctctgtggtgaatgcggcgaggatttttctgaacacagacgatacctggcccatcgcaaaacacacgcggcagaagaactgtacttgtgcagcgaatgcggtcgttgcttcacacacagtgcggcatttgcgaagcacctgagagggcacgcatcagtccggccatgtaggtgtaatgagtgcgggaagtccttcagccgcagagatcatctggtgcgacaccagcgaacgcataccggtgaaaagccattcacatgccctacgtgcggaaaatcattcagccggggttatcacttaattcgtcaccagcggacccatagtgaaaaaaccagctag

SEQ ID NO: 247408 - DNA, 399 bp, Artificial Sequence
  Description of Artificial Sequence: Synthetic coding sequence
atgacagcggcagcctccctgttggcctcactcctgcccgctctgcccccactgaatctgcaagacgccaaatttgtcgaagagagaaggaagcagctgcagaactatttgcgcagcgtaatgaataaagtgatccagatggttcccgagtttgctgcttcccctaaaaaggagacactgattcagctcatgccttttttcgttatgggactccaagtcggtatgtacggcctatttcatttcggcgtcatgatggatcagccacaaccctcacttaccagagctgacgaatcaccctgcgaccgggtgctatctccctgcgcagcccatcgaaagcagcgcgactgctgcctgtcctggaaggccgaaccggaacgtttcctggttaagaaaaagtag

SEQ ID NO: 247409 - DNA, 1665 bp, Artificial Sequence
  Description of Artificial Sequence: Synthetic coding sequence
atgtctgccgacggcggaggaatacaagacactcaggacaaggaaacccctcctgaggtgcccgataggggccatcctcatcaggaaatgccttcgaagttgggggaggcggtcccgtccggcgatactcaggaatcacttcacattaagatggagcccgaagagcctcactcagaaggagccagccaggaggacggggcacagggcgcttgggggtgggcccctctgagccacggatcaaaggaaaaggctctgtttcttccaggaggagctttgccgagtccgaggatccctgttctgagtagggagggcaggacaagggacaggcaaatggcagccgcactgctcacggcctggtctcagatgcccgttacatttgaggacgtggctctgtatctttctcgggaagagtggggtagactggaccatacccagcagaacttctacagagacgtcttgcagaagaagaatgggctgagcctaggctttcccttctccagacccttttgggcacctcaggctcatggtaaaggtgaagcttcaggaagctccaggcaggccggagatgagaaagagtggaggggagcatgtactggagccgtagaggtcgggcaacgagtccagacctcgagcgtcgccgcactgggcaacgtcaagccgtttaggactagggcaggcagggtgcagtggggggtccctcagtgtgcacaggaagccgcttgcggtcgctcttctgggccagccaaagacagcgggcagcctgccgagcccgacaggactcccgatgccgcacctccggacccctcaccaactgagcctcaggagtacagagtgccagaaaaacctaatgaggaggagaagggggcaccggagtcaggcgaggagggtcttgccccagattctgaggtggggaggaaatcctacagatgtgaacagtgcggaaaaggcttctcctggcactcacacctggtgacacacagacgcactcacactggcgagaagccttatgcttgtaccgattgcggaaagaggttcggccgttcttctcacctgatccaacaccaaatcattcacactggcgaaaagccctacacttgccccgcatgccgaaaaagtttctctcaccacagtactcttattcagcaccagaggattcatacaggagagaaaccttatgtctgcgacaggtgtgccaagcgttttaccaggaggagcgatctggttacacatcagggcacccatacgggcgctaaaccccataagtgtcccatatgtgcaaaatgcttcacccaaagctccgccctggtgacacatcagaggacacacaccggcgtgaaaccctatccctgtccagagtgcgggaaatgcttttcccaacgttccaacttgattgctcacaacaggacgcacactggcgagaagccctatcactgtttagactgcggaaaaagtttcagtcactcttctcatctcacggcacatcaacgcactcatagaggtgtgaggccgtatgcctgccccttatgtgggaagagcttctctcgacgatccaatcttcacagacatgaaaaaatacataccaccggtccaaaggctctcgcaatgctcatgctcggagcagccgcagccggagcccttgccacaccaccccctgccccaacttag

SEQ ID NO: 247410 - DNA, 840 bp, Artificial Sequence
  Description of Artificial Sequence: Synthetic coding sequence
atgagcgccgatgggggaggcattcaggatactcaggataaagagaccccacctgaggtgcctgatcgcggtcaccctcatcaagaaatgccatcaaaactgggcgaggcagttccaagcggcgatacgcaggaatctcttcacattaagatggaaccagaggaacctcacagcgaaggcgcatctcaagaggatggggcacagggcgcttggggttgggcccctctttctcacgggtcaaaagagaaagccctgttcctgcccggtggagccctgcccagtccccgtatccctgtcctctcgagggaaggacgcacaagggatcgtcaaatggctgccgcactgctgaccgcatggtctcagatgcctgtaacctttgaggacgtggccctctacctgtcacgcgaggaatggggaagactcgaccatactcagcaaaacttttatagggacgtcctgcagaaaaaaaacggcctgagcttaggattccctttctcacgccctttttgggctccccaggcgcacgggaagggcgaagcctcaggttctagtagacaggccggagacgagaaggagtggcggggtgcatgcactggggcagtggaggtaggccagagggtgcagacttctagcgttgccgcactgggcaacgtcaaaccctttcggactagagcaggcagggtgcaatggggagtgccgcagtgtgcacaggaggctgcttgtggaagaagtagtggacccgcaaaggactctggccaacctgctgagcccgacagaaccccagatgccgcacccccagatcctagtcccaccgaaccccaggagtacagggtgccatag

SEQ ID NO: 247411 - DNA, 357 bp, Artificial Sequence
  Description of Artificial Sequence: Synthetic coding sequence
atgagcgctgatgggggtggcattcaagatacccaggacaaggagacacctcccgaagtgcctgaccgcggacatccacatcaggagatgcccagcaaattgggcgaggcagttcccagcggggatacacaggagagtctacacatcaagatggaacccgaggagcctcactcagaaggagcttcacaggaggacggcgctcagggagcatggggttgggcccctcttagtcatggttccaaggagaaggcgctgttcttacccggtggcgctctaccctcgccacgcatacctgtgctgtccagagagggacggactagggatcgacagatggctgctgccctgttgacagcatag

SEQ ID NO: 247412 - DNA, 1392 bp, Artificial Sequence
  Description of Artificial Sequence: Synthetic coding sequence
atggggagaaagaagaaaaaacaactcaaaccctggtgctggtattgtaacagagattttgacgacgagaaaattctgatccaacatcaaaaggcgaagcatttcaagtgtcacatctgtcacaagaagctatataccggtcccggactcgctatccactgcatgcaggtccataaagagaccattgacgctgtacctaatgcaatccctggtaggacagacattgagctcgaaatttatggaatggaggggatacccgaaaaagatatggacgaacggagacggttgttggagcagaaaacgcaggagtcacagaagaaaaaacagcaagatgattctgatgagtatgatgacgacgacagcgcagccagcacctcctttcaacctcagccagtacagccacagcagggttatatcccaccaatggcacagccgggtcttccaccagtgccaggcgctcccggaatgcccccaggaatcccccctttgatgcctggggttcctcccctgatgcctgggatgccaccagtaatgccgggaatgccccctgggctacaccaccaaagaaaatacacacagtctttttgcggagagaacattatgatgcccatgggtggaatgatgccccctggcccaggcataccccctctgatgcctggcatgcccccaggaatgccgcctcctgttccaaggccgggaatacctcctatgacacaggcgcaggccgtctccgccccaggcattttgaataggccacccgcacctactgctaccgtgccggctccacagccccctgttacgaaaccgctattcccctcggccggacaggcccaggcagcggttcagggccctgttgggacagattttaagcccctcaattctactccagcaacaacgacggagcctcccaaaccaacatttcctgcctacacccagagtaccgccagcacaaccagcaccaccaactccaccgcggcaaaacctgcggctagtattactagcaagcctgccacactgacaactacatcagccacctctaaactaatacatccagatgaagatatctccttagaagaacggcgagcccaactgcctaagtaccagagaaaccttcccaggcccggacaggctcccatcggcaaccctcctgtggggcctatcggcggaatgatgcctccccagccaggcattccacaacagcagggaatgaggccacctatgccgcctcatgggcagtacggcggacatcatcagggcatgcctggttacctccctggagctatgccaccttacggacagggtcctcccatggttcccccttaccagggaggacctccgagacccccaatggggatgaggccacccgtcatgtcccaggggggaagatattag

SEQ ID NO: 247413 - DNA, 1188 bp, Artificial Sequence
  Description of Artificial Sequence: Synthetic coding sequence
atgggcagaaagaagaagaagcagctaaagccttggtgctggtactgcaaccgcgacttcgacgatgagaagatactaatccagcatcaaaaggcaaaacattttaaatgccacatctgtcataagaagctttatacaggactgccccctgtaccgggtgcacccggaatgccgccaggaattcccccactgatgcccggagtgccgccattgatgcccggtatgccccctgttatgcccggaatgcctcccggacttcatcaccaacgcaagtacactcagagcttctgtggagagaacatcatgatgcctatgggagggatgatgccccctgggccaggtattcctcccctcatgccaggtatgcccccagggatgccacccccagttcctcggccaggaatccctcctatgacccaggcacaagccgtgtctgctcctggcatcctcaaccggcctccagcccctaccgccaccgtccctgccccacaacctccagtgactaaaccactatttccctcagccggacagatgggcactcctgtgacctctagttcaaccgcatcatcaaacagcgagagcctcagcgcctcatcgaaagctctctttcccagcacggcccaggctcaggctgcagtccaggggccagtcggtaccgacttcaaacctctgaattctacacccgcaacaacaaccgagccgccaaaacccacttttcctgcctatacacagagtacagccagcaccacgagtacaactaactcaacagccgctaagccagctgcaagcatcacatccaaaccagctactttgacaacaacatctgccacatcaaaactcatccaccccgacgaagacataagcctggaggagcggagggctcagctgccaaaatatcagcggaacctcccaaggcctggtcaagctcccattgggaatcctccagttggcccaatcgggggaatgatgcctccccaaccaggcatccctcagcagcagggaatgcggcctcctatgcccccacacggccagtacggcggacaccaccagggtatgccaggctacctcccgggagctatgcccccatatggccagggcccaccgatggttcctccgtaccaggggggacccccacgccctccgatgggtatgcggccacctgttatgagtcaggggggaaggtattag

SEQ ID NO: 247414 - DNA, 1437 bp, Artificial Sequence
  Description of Artificial Sequence: Synthetic coding sequence
atggggagaaagaaaaagaagcaactgaagccctggtgctggtactgtaatagggattttgatgatgaaaaaatcctgatccaacatcaaaaggccaaacatttcaagtgccatatctgccacaagaagctgtacactggacccggattggctattcattgcatgcaagtgcacaaggagaccattgacgccgtacctaacgccatacccggtcgcaccgatatcgagcttgaaatttacgggatggagggcattccagagaaggacatggacgagcgtcgacgtttgctcgagcagaagacccaggagagtcaaaagaagaagcaacaggacgacagtgatgaatacgatgatgacgattcagctgccagcacctctttccaaccccagcccgtgcagccccagcaggggtatattccgcctatggcacagcccggtttgcccccagtgcctggggctcccggaatgccacccggaatacctccattgatgcccggagtcccccctctgatgcctggaatgccacccgtaatgccaggcatgcccccaggcatgatgcccatgggcggtatgatgcctcctggacccggaatcccgcctctcatgcccggaatgccccctggtatgccaccccctgtgccacggcctggaattccaccgatgactcaagcgcaggcagtctcagctcccggaatactaaaccggccacctgctccaaccgcaaccgtgccggctcctcaaccaccggtcactaagcccttattcccatccgctggccagatggggaccccagtaactagcagctccacagcgagcagcaactccgagtccctttcagcttcttccaaagcactgttcccaagcactgcccaagcacaggcagcggtgcaggggccagtggggaccgatttcaaacctttgaactccaccccagctacaacgacagagcccccaaagccaactttccccgcttatacacagagtaccgccagcacaacgtctaccaccaattctacagctgccaagcccgcagctagcatcacatctaagcccgctacgctgactaccaccagtgccacatccaaacttatacaccccgacgaggatatctctctggaggaacgcagagcacagctgcctaaataccaacggaatcttccacgacccggacaggctcccattggaaaccctccagtgggacctattggagggatgatgccccctcaacctggcattcctcagcagcaggggatgcggcctcccatgccgcctcacggacaatacggcggacatcatcagggcatgcccggttacttacctggtgctatgccgccatacgggcagggaccgcctatggtcccaccatatcaaggaggtccaccacggcctcccatgggtatgagacctcctgtgatgagccaggggggacgttactag

SEQ ID NO: 247415 - DNA, 1485 bp, Artificial Sequence
  Description of Artificial Sequence: Synthetic coding sequence
atgggaagaaagaagaagaaacagctcaaaccttggtgctggtactgcaatcgggacttcgacgatgaaaaaattttaattcagcaccaaaaggccaaacacttcaagtgccatatctgtcacaaaaaactgtacactgggccaggattagcaattcactgcatgcaggtgcacaaggaaacaatagacgctgtgcctaacgccattcccggaaggaccgatatagagctcgaaatttacggtatggagggcataccagagaaggatatggatgaaaggcggaggctgctggagcaaaaaactcaggaaagccaaaaaaagaaacagcaggatgacagcgatgagtatgatgatgacgactcagcggcttctaccagctttcagccccagcccgtgcagccacaacagggatacatcccacccatggcccagcccggattgccaccagtgccgggtgcccctgggatgcctccaggaatcccaccgttgatgccaggcgtgccgcctcttatgcctggcatgccccctgtgatgccagggatgccacccggactgcaccatcaaaggaagtacacccagtcgttctgcggagagaatatcatgatgccaatgggaggcatgatgccacctggccctgggatccctccactcatgcctgggatgccacctggcatgccgccacctgtgccacgccctgggatcccccctatgacccaggcgcaggcagtgtccgctcccggtatactgaaccggcctcccgcaccaaccgctacagtccctgcgccacagccaccagtgactaagcccctgtttccatccgccggacaaatggggactcccgttacaagtagttcaacagcgtccagtaattccgagtccttatccgcgtctagtaaagcgctcttcccgtctaccgcccaggcacaggccgcagtccagggccctgtcgggaccgacttcaagcctcttaactctacaccggcaacaactaccgagccacccaaacctacttttcctgcatacacgcagtctaccgcctcaaccacctctactacaaacagcacggcagctaaacctgccgcatctataacctctaagcctgccaccctcacaacaacctctgccacatccaaactgatccaccctgacgaagacatttcacttgaggagcgcagggcacaactgccaaaataccagaggaatcttcctaggcccggacaagctccgattggcaacccaccagtcgggccaattggcggaatgatgcccccacaaccagggatcccccaacaacagggaatgaggccgcctatgccgccacatggacagtacggcggtcaccaccaaggcatgccaggctacctgcctggcgcaatgcccccttatggacagggaccacccatggttccaccgtatcaaggaggaccgccaagaccccctatgggtatgagaccacccgtgatgtcccagggcggtcgctattag

SEQ ID NO: 247416 - DNA, 1344 bp, Artificial Sequence
  Description of Artificial Sequence: Synthetic coding sequence
atgggccgaaagaaaaaaaagcagttaaagccttggtgttggtattgcaatagggatttcgacgacgaaaaaatactcattcagcaccagaaggctaagcattttaagtgccatatctgccataaaaagctttacaccgggcctgggctcgcaatccactgtatgcaggtgcacaaagaaacgattgacgctgtccccaatgctataccagggagaacagatatcgagctagagatctacggaatggagggaatcccggaaaaagacatggatgaaagaagaagactgctggaacagaaaactcaggagagtcagaaaaagaagcagcaggacgacagcgacgagtacgatgacgatgattccgcagcctctactagcttccagcctcagccggttcagccccagcagggttacattcctccaatggctcagccaggactgccacctgtacccggagccccaggcatgccccctgggattccccctcttatgccaggggtccccccactaatgcccggtatgcccccagtgatgcctggcatgccacctgggatgatgccaatgggaggtatgatgccccctgggccagggatcccaccacttatgcccggtatgcctcctggaatgccacccccagttccccgacccggtatccctcccatgacacaagcccaggccgtgtccgccccaggtatcctcaacagacctccagcacccactgctacagtgccagctccacagcctccagttacaaaacccctttttccatcagcgggtcaagcccaggccgcagtgcaaggaccggtgggcaccgatttcaagcccctcaattctactccggctaccactaccgagccacccaaaccaacctttccagcctacacccagagtacagccagcacgacatctactacgaatagtactgctgcaaaacccgctgctagcatcacatctaaaccggcaaccttgactaccacgagtgccacatctaaactgatacacccggatgaagacattagcctcgaagagcgcagggctcagctccccaaatatcagagaaacttaccgcgtccaggtcaagcgcctattggaaaccctcctgtgggacccattggtggaatgatgccccctcagccgggtatcccgcaacagcaggggatgcgcccacccatgccgcctcatggtcaatatggaggccaccaccagggaatgccagggtatctcccaggagcaatgcctccgtatggccagggcccacctatggtgccgccttatcaaggaggaccaccgcgaccgcctatggggatgagacctccagtcatgtcacagggcggtagatactag

SEQ ID NO: 247417 - DNA, 1491 bp, Artificial Sequence
  Description of Artificial Sequence: Synthetic coding sequence
aatacagttatggggagaaagaagaaaaaacaactgaagccatggtgttggtattgcaacagagacttcgatgacgagaagatcctgatccaacatcagaaggctaaacactttaagtgccatatctgccataaaaagctgtataccgggcctggcctggccattcactgcatgcaggttcataaagaaaccatagacgcagtgcctaacgctatccctggcaggaccgacatagaactagagatctatggtatggaagggatccccgaaaaagatatggatgaaaggaggcgcttgctggaacagaaaacacaagagagtcaaaagaagaagcagcaggacgattcagacgaatacgatgatgatgactcggctgcgtcaaccagctttcagccacagcccgtgcagccgcagcagggatacataccaccaatggcccaaccaggcctgccaccagtacccggagctcctggcatgcctcctgggatcccccctctcatgcctggggtaccccctctgatgccaggaatgccgccagtgatgcctggcatgcctcccggactgcatcatcagaggaaatatactcagagcttttgcggtgaaaacatcatgatgccaatggggggaatgatgccaccagggcctgggatccccccactaatgcctggcatgccgcctggcatgcctccgcctgtgccgagacctggcattcctcccatgactcaggctcaggctgtttccgccccaggcatcctaaacagaccgccagcccctaccgctactgtcccagctccgcagccccctgttaccaagcctctatttccctcagcaggtcagatgggcacgccagtaacgtcttcatcgactgcaagctcaaactctgagtccttgagcgcatcttcaaaagctctcttccccagcacggcccaggcgcaggctgccgtgcagggaccggtcggaacagattttaagcctttgaactccacacctgccacaactaccgaaccaccaaaaccaacgtttcctgcctacacacagtcaactgcctcgacaacatcaaccactaattcaactgctgccaaacctgccgcaagcataacttcaaaaccagctaccctgaccaccacatccgctacgtctaagttaatacacccggatgaagacatcagcctcgaagaaaggagagcccagcttccaaaatatcagagaaacttgcccagacctggtcaagcccctattggaaacccgccagtcggcccaatcggcggaatgatgcctccccagccaggaatcccccagcagcagggcatgcggcctcccatgcctcctcatggccagtatgggggacatcatcaggggatgcctggataccttcccggagctatgccaccctacgggcagggccctcccatggtccctccttaccagggcggacccccaagaccacctatgggaatgcgaccacccgtgatgtcccaaggccttccgtag

SEQ ID NO: 247418 - DNA, 3843 bp, Artificial Sequence
  Description of Artificial Sequence: Synthetic coding sequence
atgggcagtctgacttttagggatgtagcaattgagttttcgctggaggagtggcaatgcttagatacagctcagcagaatctgtatcgcaatgtaatgcttgagaactatagaaacctcgtctttcttgggattgccgctttcaaacctgacctgatcattttcttggaggagggcaaggaatcatggaacatgaagaggcacgaaatggtggaggagagccctgtgatttgttcccatttcgcacaagatctgtggccagaacaaggaattgaggactcttttcagaaagtcatcctgcgccgatatgaaaagtgcggtcatgaaaacctacatctgaagattggttacactaatgttgatgaatgcaaggttcataaggaaggctataataagttaaaccagtccctgacaacaacacagtctaaggtgttccagcgaggtaagtatgcaaatgtcttccacaagtgttccaattctaatagacataaaatccgacacaccgggaagaagcatctccagtgcaaagagtatgtgagatccttttgcatgctctcgcatctcagtcagcataaacgcatctacaccagggaaaattcctataagtgtgaagaaggcggaaaggcattcaactggagttctacacttacctattacaagagcgctcacactggagaaaaaccataccgatgcaaagagtgtgggaaagcgttttccaagttttccatcctgactaaacataaggtgatccacacaggagagaagagttacaaatgcgaagaatgtggcaaggcattcaaccagagtgcaattctcaccaagcacaaaattatccacactggcgaaaagcctaataagtgcgaggagtgtggcaaagccttttccaaggtatccactttaaccacgcataaagccattcacgctggcgagaaaccgtataagtgcaaggaatgcggtaaggcttttagcaaggtttccacactgatcactcataaggccattcatgcaggcgagaagccatacaaatgcaaggaatgcggtaaagctttctccaagttctcaatcttgaccaagcacaaggttattcatacaggtgaaaagccgtacaagtgtgaggagtgtgggaaagcatacaaatggccgtcaacactttcctaccacaaaaagattcacactggcgagaaaccttataagtgtgaggagtgcggaaagggttttagcatgtttagtatactcaccaagcatgaagttatccatacaggcgagaagccctacaaatgtgaagagtgtggtaaagctttcaattggtcgtctaatctaatggagcataagaaaatccatacgggggagactccatacaagtgcgaagaatgcggaaagggattttcgatgtttagtatccttaccaagcataaggtaatccataacggcgagaagccttataaatgcgaagaatgtgataaagcaactcatgcgggtgaaaaaccttacaagtgcgaggagtgtggcaaagcttttaactggtccagcaacctgatggagcacaaaaggatacatacaggagagaagccctacaagtgtgaagaatgcggaaagtccttttctaccttcagcatcctgactaaacacaaggtcatccatacgggggagaaaccatacaaatgtgaagaatgtggaaaagcctataagtggtcttctacactctcataccacaagaagatacatactgtagagaagccatacaagtgcgaggaatgcggaaaagccttcaatcagtctgcaattcttataaaacacaaacggatccataccggggagaagccctataaatgtgaagagtgcggtaagacctttagcaaagtcagtacactgacgactcataaagccattcacgcaggagaaaagccgtataaatgcaaagaatgcggaaagacgtttatcaaggtgtctaccctgacaacccataaggccattcacgccggagaaaaaccctacaagtgtaaggagtgcggcaaagccttttccaagttctccattctcaccaagcacaaggtcatccacactggtgagaagccctataagtgcgaggaatgcggcaaagcctttaattggagcagcaatctgatggaacacaagaggatacataccggggagaagccttacaaatgcgaagagtgcggtaagtccttttccacgttcagcgttctgacaaagcacaaagtgatccacactggcgaaaaaccttacaagtgcgaggaatgtggaaaggcctataaatggtccagtaccttatcctaccacaagaagattcacacagtggagaaaccctataagtgcgaggaatgcggaaaggcattcaacaggtctgcgatccttatcaagcataagcgaatccataccgacgagaagccttacaagtgcgaggagtgtgggaaaaccttcagcaaggtgtctactttgaccactcataaggctatccatgcaggagaaaaaccctataagtgcaaggaatgtggaaaggcatttagtaagttttccatcctcacaaaacacaaggttatacacacaggtgagaaaccatacaagtgcgaggaatgtggtaaggcttataaatggccatccacgctcagctatcacaaaaaaatacacacaggcgaaaaaccgtataagtgtgaggaatgtgggaagggcttcagcatgttttcaatcctgactaaacacgaggttatccatacaggcgagaaaccttataaatgcgaagaatgcggaaaggccttttcatggctatctgtgttctcaaagcacaaaaagactcacgccggagagaagttctataaatgcgaggcttgtgggaaggcttacaaatcttccagcaccctgtcttaccacaaaaaaattcataccgaagaaaagccctacaaatatgaggaatgtggcaagggattttccacgttttcaatactgaccaagcataaggtcattcatacgggggagaaaccctacaagtgtgaagaatgtggcaaggcctttaattggagctcaaacctgatggagcataaaaaaattcacacaggtgagaccccttacaaatgtgaggagtgtgataaagccttttcgtggccaagctccctgaccgagcacaaggccacgcacgcgggtgaaaagccttataagtgtgaggagtgcggcaaggctttttcctggcctagtcgcctcactgagcacaaagccacgcatgctggcgaagagccttacaaatgcgaggaatgtggcaaggcattcaattggtcctccaaccttatggagcataagcgcatccacacaggggaaaagccctacaaatgtgaagagtgcggaaagtcgtttagtacattcagtatcctgacaaagcacaaggtgatccataccggggagaaaccatacaaatgcgaagagtgcggaaaggcctacaagtggagttctaccctgagctaccacaagaaaatccatactgtcgagaagccctacaagtgtgaagaatgcggcaagggattcgtcatgttttcaatccttgcaaaacacaaagtgatccatacaggtgagaagctttacaagtgcgaagaatgcggaaaagcatataagtggccgtcaacattacggtatcacaaaaagattcacacgggggaaaaaccctacaagtgcgaggagtgtgggaaagcgttctccaccttttccatcttgaccaagcacaaggtgatccacaccggggagaaaccctacaaatgtgaggagtgcggaaaggccttctcgtggctctctgtttttagcaagcataagaagattcatacaggggagaaactgtag

SEQ ID NO: 247419 - DNA, 123 bp, Artificial Sequence
  Description of Artificial Sequence: Synthetic coding sequence
gggaaaggcttctccatgttctctattctgacgaagcacaaagcaacacatgcgggtgaaaaaccctacaagtgcgaagagtgtggtaaagcctttaattggagctccaacctaatggaatag

SEQ ID NO: 247420 - DNA, 3504 bp, Artificial Sequence
  Description of Artificial Sequence: Synthetic coding sequence
atgggctctcttaccttcagggacgtggcgatcgaattctctctcgaagaatggcaatgcctggacactgcccagcagaatttgtatagaaatgttatgctcgagaattatcgcaacctggttttcctgggcatcgctgcatttaaacccgacctgattattttcctcgaggaaggcaaggaatcctggaacatgaagagacacgagatggtggaggaatcccctgtgatctgctcccacttcgcccaggacctgtggcctgagcagggcatcgaggacagtttccaaaaagtcatcctgagacgatacgaaaaatgcggtcacgaaaatctgcacctgaagattggttatacaaacgtggacgagtgcaaagtacataaggaaggatacaacaagctgaatcagagtttaaccaccacacagagcaaggtctttcagcggggaaaatacgccaacgttttccataagtgctcaaacagtaacaggcataaaatacgtcataccgggaaaaagcacctccagtgtaaggaatatgtgcgatccttttgtatgttatcccacctgtcacagcacaagcgtatatatactcgcgaaaattcctacaagtgcgaggagggcggaaaggccttcaactggtcgagtacattaacttattacaaaagtgcccatacaggcgaaaagccctacagatgtaaggaatgtgggaaggccttctccaaattcagcatcttgacaaaacacaaggttattcataccggcgagaagtcctacaagtgcgaagaatgcggcaaagcctttaaccagagtgcaatactcaccaaacacaagatcatccatacgggcgaaaaacctaacaaatgcgaggaatgtggcaaagccttttcaaaggtgagcactctgaccacccacaaagcaatccatgctggagaaaaaccctataaatgcaaagaatgcggcaaagctttcagtaaagtatcaaccctcattacccacaaggccatccatgccggtgagaaaccttataagtgcaaagaatgtggtaaggccttttcaaaattttcaattctcactaagcataaagtgattcatacgggggaaaagccctataaatgcgaggagtgtggcaaagcctataagtggccctccacactttcataccacaaaaaaattcatacaggggaaaagccatacaaatgcgaggaatgtggcaaaggcttcagcatgttttctatcctaactaagcatgaagtgatccacaccggcgaaaaaccctataagtgcgaagagtgtggcaaggcctttaattggagctccaatctgatggagcataaaaagattcacacaggtgagactccctataagtgtgaggagtgcggcaagggcttcaagtggtcctctactctgagctaccacaaaaaaatccataccgtagaaaaaccatataagtgcgaagagtgcgggaaagcgtttaaccaatcagccatcctgattaagcacaagaggatccatacaggggaaaaaccatataagtgcgaagaatgcgggaagactttcagcaaagtgtctacgttaactacacataaagcaatacacgctggggagaaaccttataagtgcaaagagtgtggcaagactttcataaaagtatccacgctgactacccacaaggccatccacgctggggagaagccttacaaatgcaaggaatgcggcaaggccttttctaaattctcaatactgacaaagcataaggtcattcatacgggtgagaagccgtacaagtgcgaggagtgcggaaaggccttcaactggagcagcaatctgatggaacataagaggattcataccggagagaaaccgtacaaatgtgaagaatgcggaaaaagcttcagtactttttccgtgctcactaagcacaaggtaattcacacaggggagaaaccttataagtgcgaggaatgcggtaaggcttacaagtggagctctactctatcttatcacaaaaagattcataccgttgagaagccctataagtgtgaggagtgcggtaaggcgtttaaccgctctgctatacttattaagcataaacgtatccacacagatgaaaagccttataagtgtgaagaatgcggtaagaccttctccaaagtaagcacattaactactcacaaggccatccacgcaggcgagaaaccctacaaatgcaaagagtgtgggaaggctttttccaaattttctattttaacaaagcataaagtgatccataccggggaaaaaccatataaatgtgaagaatgtggtaaagcgtataaatggccatccaccctgtcttaccataaaaagattcatactggcgagaagccctacaagtgcgaagagtgcgggaagggctttagcatgttttctatcctcaccaagcacgaggtgatccacaccggggagaagccgtacaagtgtgaggaatgtggcaaggcattcagttggctgagtgtattttcaaagcacaagaagacacacgcgggagaaaagttctataaatgtgaagcctgcgggaaggcctataacactttttcaatcctgactaagcataaagtcatccacacgggagagaagccatataaatgtgaagagtgcgggaaggctttcaactggtcctcgaacctgatggagcataagaaaattcacaccggcgagacgccatataaatgcgaagagtgtgacaaggcattttcctggccatccagtctcacagagcataaggcgacacacgccggagagaaaccatacaaatgtgaagaatgcggaaaggcattcagttggccgtcacgcctgacagagcataaagccacacacgccggagaggagccctacaagtgcgaagagtgcgggaaggcctttaattggagcagcaacctcatggagcacaagcgcatccacacgggcgagaaaccctacaagtgcgaggagtgcggcaaatcattcagcactttcagtatcctgactaagcacaaagttattcacacaggtgaaaaaccatataagtgtgaggaatgtggtaaggcttataagtggagttccacattatcgtaccacaagaagatccacactgtcgaaaaaccttataagtgtgaagagtgcggtaaagggttcgtcatgtttagtattttagctaaacacaaagtgatacacactggggaaaaactgtacaaatgcgaggaatgtggcaaggcgtacaagtggccaagcacgcttagataccacaaaaaaattcatacgggcgaaaaaccttataaatgcgaagaatgtggcaaggccttctccaccttttccatccttacaaagcacaaggtcatacataccggagagaagccctacaaatgtgaggaatgtggcaaggctttctcatggctttcagtcttttcaaagcataagaagattcatacaggggtacctaatccacctacccacaaaaagatacacgcaggggagaaactgtataagtag

SEQ ID NO: 247421 - DNA, 1488 bp, Artificial Sequence
  Description of Artificial Sequence: Synthetic coding sequence
atggccgagtccgctcctgccaggcatcgcagaaaacggaggagcaccccattgacgtccagcaccttaccttctcaagctactgaaaagtcatcatacttccagactacagagatctccctatggaccgtggtggctgctatacaggctgtggagaagaaaatggaatctcaagccgctcgcctccagtcactcgaaggaagaacaggaacggccgaaaagaagctcgcagattgcgagaaaatggcagtggaattcggaaatcagttagagggcaagtgggctgtgctaggcacactgctccaggaatacggcctgcttcagcggaggctggaaaacgttgagaatctcctgcgcaacaggaacttttggatcttaagattaccgcctggatcgaaaggcgaagcccctaaagtgagccggtcactggaaaacgacggggtgtgtttcacggaacaggaatgggaaaacctcgaggactggcagaaggagctttaccgaaacgtcatggagagcaactatgagacactggtgtctctcaaggttttgggccagacagagggagaagcagaactgggcacagaaatgttgggcgatctggaggaggagggcccaggaggtgcgcatcctgccggaggagtcatgataaaacaggaactgcagtacactcaggaaggccctgccgacctgccgggagaattctcttgtatagctgaagagcaggcctttctttcccccgagcagacggagctttggggtggccaagggtcaagcgtactcctggagaccggaccaggggactcgactctggaagagcccgttggatctagagtgccaagtagcagcaggacggtgggctgtccaaaacagaagtcacatagacaggtgcaactggatcaggagtgtggccaaggtctgaagctcaagaaggatacaagccggccttatgagtgttcggagtgcgagatcacatttcgctacaaacaacagctagcgacgcatctgcgctctcactccggctggggctcctgcactcctgaggaaccagaagagagtctgcgcccaaggccgagactgaaaccccagactaaaaaagccaagctgcaccagtgcgacgtgtgtctgcgcagttttagctgcaaagtgagtctggtcacgcatcagcgatgtcatctgcaggaggggcctagtgcaggacagcatgtgcaagaaaggtttagcccgaacagcctagtggctcttccaggtcatattccttggcggaaaagccgtagtagcctgatctgtggctactgtggcaagtctttcagtcacccctcggatctggtaagacatcagaggatccacaccggcgaacgtccatacagctgcactgagtgtgagaagtcttttgtgcagaaacagcatctgttacagcaccagaagattcaccagcgagagaggggcggactcgcattggagccgggtcgaccaaatggcctgctgtag

SEQ ID NO: 247422 - DNA, 1380 bp, Artificial Sequence
  Description of Artificial Sequence: Synthetic coding sequence
atggctgcaccgcttgaagctcaggaccaggcaccaggggaaggcgagggactgctgatcgtcaaggtggaagattcatcttgggagcaggaatccgcccaacacgaggacggcagggattctgaagcttgtagacagcggttcaggcagttttgctatggggacgtacatggcccacacgaagccttttcacaattgtgggaactctgttgccgttggctacgtccagaacttagaactaaagaacagatactggaacttctggtactggagcagttcctcacggtgctgcccggagaaattcagggttgggtgcgcgaacagcaccccggtagtggtgaggaggctgtggcattggtggaggacctgcagaaacagcctgtaaaagcatggaggcaggatgtaccaagtgaggaagccgagccagaagccgcaggaaggggctcacaggccacgggtccgcctccaacagttggagcgagacgtcgtccttcagttccacaggaacaacactctcactctgcacagcctccagccttactcaaagaagggagacccggagagacaacagatacctgctttgtgagcggtgtacacggtcctgttgctttgggcgacataccattctatttctcccgcgaggagtggggtactctcgaccccgcacagcgagaccttttctgggacatcaaaagagagaactccaggaacacaaccctggggttcgggctcaaaggccagtcagaaaagagcttattgcaggagatggtgccagtggtgcctgggcagactggcagcgacgtgaccgtctcttggtcccccgaagaggcagaagcctgggaatctgagaacagaccgagggcagcacttgggcctgtggtcggggcacggcgaggccgaccaccgactcggagaaggcagtttcgggacctcgcagcagagaagccacatagctgtgggcagtgtggcaagcgctttcggtggggaagtgatctcgctcggcatcaacggacgcataccggagagaaaccccacaaatgcccagagtgcgacaagtcctttcggtcctcttcggacctagttagacaccagggtgtacacactggagagaaacctttcagctgtagcgagtgcggtaagagcttcagcagaagcgcctatctcgcagatcaccagcgtatccatactggagagaaacctttcggctgtagcgattgcggcaagagcttttccctgagaagctacttattggaccaccgccgtgttcacaccggtgaaaggccattcgggtgcggggaatgcgataaaagctttaaacaacgcgctcatctgatagcgcaccagtcattacacgccaaaatggcacagccggttgggtag

SEQ ID NO: 247423 - DNA, 906 bp, Artificial Sequence
  Description of Artificial Sequence: Synthetic coding sequence
atgtgcccccgtcggcgaaggaaccctcggcttcaagccggagacccaagacccaggggtctgcctaggcgatggggccatgggggaggtcgtctcttcccacgcagttctaccgccatagccggacccgttgctcttggagatattcccttttacttttcaagggaagaatggggcaccctcgaccctgcccaacgggatctgttttgggacatcaaacgcgaaaacagccggaatacgaccctgggcttcggcctgaagggacagtctgaaaagtccttacttcaggagatggtacctgtagtgccaggccaaacagggagcgacgtgactgtgagttggagtcccgaagaggcagaagcttgggagtctgagaataggcctagggccgctctcggtcccgtcgtgggtgccagacgaggacgccctccaacacgccgaaggcagtttcgagatctggctgcagagaaaccacatagctgcggccagtgcggtaagcgcttcagatggggttccgacctcgcgaggcaccagcggacacacacgggagagaagcctcataaatgccccgaatgcgataaatcctttagaagctcctccgatctggtcaggcaccagggggtccacaccggagagaagccttttagttgttctgagtgtggcaagagctttagccggagtgcttatctcgccgatcatcaacgtatccataccggggagaaaccgtttggatgctccgattgcggaaaatctttctccctgcgaagctatctcctcgaccacagaagagtgcacacaggcgaacgccctttcggttgtggagagtgcgacaagtcatttaaacaacgcgctcacctgattgcacaccagtcccttcacgctaaaatggctcagcccgtcggctag

SEQ ID NO: 247424 - DNA, 1821 bp, Artificial Sequence
  Description of Artificial Sequence: Synthetic coding sequence
atggctgttacttttgaagacgtgactattatctttacttgggaggagtggaaatttctcgattcgtctcagaagcggttgtaccgtgaggtaatgtgggagaactatactaacgtgatgtcagttgaaaactggaatgagtcttataaaagccaggaagagaaatttcgttacttagagtatgaaaacttcagctactggcagggctggtggaacgccggagcacagatgtacgaaaaccagaactatggagagacagtccaggggactgactccaaggatctaacccaacaagacagatcacagtgtcaggaatggctgatcctgtccacccaggtccccggatatggcaattacgagctgaccttcgaatccaagtctttgcgaaacctcaaatacaaaaatttcatgccctggcagagcttggagacaaagacaacacaagactacgggcgagagatatatatgtctggctcccatgggttccaggggggaagatacaggctgggcatttcccggaagaacctgtcaatggaaaaagaacaaaagctaatcgtccaacactcctacatacccgtggaggaggcgttgccccagtatgttggagtgatctgtcaggaggacctcctgcgcgactccatggaagaaaagtattgcggatgcaataagtgcaagggtatctactattggaactcaaggtgcgttttccacaagcgcaatcagcctggcgagaatttgtgtcagtgttctatctgcaaagcatgtttttctcagcggagtgacttgtatcgacacccccgaaaccatattggcaaaaagttgtatggatgtgacgaggtggacggtaacttccaccagagttctggcgtgcatttccatcagcgggtgcacattggagaggtgccatacagttgcaatgcctgcggcaagagcttctctcaaatatccagtctccacaaccaccagagggtgcataccgaagagaagttctataagattgagtgtgataaggatctgagtcgcaatagtctgctccacattcaccagcgcttgcacatcggcgaaaagccttttaaatgtaaccaatgtggcaaatccttcaatagaagttcagtcctacatgtccatcagcgtgtgcacaccggcgaaaaaccatataaatgcgacgagtgtggcaaggggttcagtcagtcttcgaacctgcggattcatcagctcgtccacactggggagaagagttataagtgcgaagactgtggcaagggctttacacagagatcaaacctgcagattcatcagagggtccacacaggggagaagccgtacaaatgtgacgattgtgggaaggatttctcccatagctccgacctgcgcattcatcagcgggtgcacacaggcgagaagccctacacctgcccggagtgtggcaaggggttttctaaatccagtaagctgcatacacatcagcgggtgcacaccggggagaagccttataagtgcgaggagtgcggaaaagggttctcccaacgctctcacttactcatccaccagagagtgcataccggcgagaaaccatacaagtgtcacgactgtggaaagggattctcgcactctagtaatctgcatattcatcagcgagtccacactggagagaagccctatcaatgcgccaaatgcgggaagggcttttcccactctagtgctctccgtatccatcaacgagtgcacgccggagagaaaccctataagtgcagggagtactataagggctttgaccacaacagtcacttgcataataatcacagaaggggaaatttgtag

SEQ ID NO: 247425 - DNA, 1821 bp, Artificial Sequence
  Description of Artificial Sequence: Synthetic coding sequence
atggcagtcacatttgaggacgtgactattattttcacatgggaggagtggaaatttctcgacagcagccaaaagaggctgtatcgggaggtgatgtgggagaactacacaaacgttatgtctgttgagaactggaacgagagttataaaagccaggaggaaaaattccggtacttggagtacgagaatttttcctattggcaaggatggtggaacgccggtgcccagatgtatgaaaaccagaactacggcgagacagtgcaaggcaccgatagtaaggatctcacgcaacaagacaggagccagtgccaggaatggttgattttaagcacccaagttcccggatacggcaactatgaactaacgtttgaatccaaatccctccggaacctgaagtacaaaaacttcatgccttggcaatccctggagaccaagacgacccaggactatgggagggaaatctacatgagtggatcccatggttttcaggggggaaggtacaggcttggaatttccaggaaaaacctgtctatggagaaggagcagaagctcatcgttcagcactcatatatcccggtggaggaagctctgccccaatacgttggcgtcatttgccaagaagacctcttgcgcgactctatggaagagaagtactgcggatgcaacaagtgcaagggcatatattattggaatagcaggtgtgtcttccacaaaaggaaccagccaggcgagaatttatgccagtgttctatttgcaaggcttgcttctcacagcgctccgacttataccgacaccccaggaatcatatcgggaagaagttgtacggctgcgatgaggtcgacggaaattttcatcagagtagtggagtgcacttccatcagcgcgtacacattggagaagtcccatattcctgcaatgcctgcggcaagagctttagtcagatttcaagtctgcacaaccaccagcgggtgcacacggaagaaaagttctataagatagagtgtgacaaggacctgtccagaaattctctcctgcacatccatcaaagactccatataggtgaaaagcctttcaaatgtaaccagtgtggtaagagctttaatcggtccagcgtgctgcatgtgcatcaaagagtgcacaccggagaaaagccctacaagtgcgacgagtgtgggaaagggttctcccaatcttctaatttgcggatccaccagctagtccatacaggcgaaaagagctataaatgcgaagactgtggaaaaggtttcactcagcgcagtaacctgcaaattcaccaaagagtgcatacaggtgagaagccctataagtgtgatgactgtggtaaggacttcagtcacagttcggacctgcggattcaccagagagttcacaccggcgaaaaaccttacacttgcccagagtgtgggaagggtttcagtaaaagctccaagctccatacccaccaacgggtgcataccggtgaaaagccctacaagtgtgaagagtgtggaaaaggcttttcccagcgatcccatctgcttatccaccaaagagtacataccggcgaaaagccgtataagtgccacgactgcggaaaggggttcagtcatagtagcaacctacatatccaccaacgggtacatactggcgagaaaccttaccaatgtgccaaatgtggaaagggtttttcgcattcttccgccctacgcatccaccagcgggttcacgccggagaaaagccatacaaatgccgtgagtactacaaaggcttcgaccacaattctcacctccacaataatcacagacgaggcaacctttag

SEQ ID NO: 247426 - DNA, 1554 bp, Artificial Sequence
  Description of Artificial Sequence: Synthetic coding sequence
atgcagccactgagtaagctgatggcgatttccaagcctagaaacctgagcctgcgtgaacagagagaggtcttacgtgctgatatgagctggcagcaggaaacaaatcctgtggtggagactcacgactccgaggcctcccgtcagaagttcaggcatttccagtatctgaaggtgagtgggcctcatgaagccctgagccagctgtgggagttgtgtctccagtggctccggccagagatccatacaaaaaagcagataattgagttgctggtgttagaacagttcttggcaatcctgccagaagaggtgaggacatgggtgaacctgcagcatcctaataatagtaaggacatggtgactttgatagaagacgtcatcgagatgctggaggatgaagacatgccatgcaaagactcagccctccagatgggttcaattaaggagaaaatgaaagctggaagcaggacaggcaagccacaggagcccgtcactttcaaggacgtggtcgttgaatttagtaaagaagagtggggccagctggacagtgccgttaagaacctctatcgaaatgttatgctggagaattttcggaacctgaacagcctgcggaaggcccatctgctttctaaaccttttgaaagcctgaaactggagtctaaaaaaaagcggtggattatggaaaaagaaatccccagaaaaactatctttgatatgaaatccatatcgggggaagagtcctcccacggggtcatcatgacaagactcaccgagtctgggcatcctagttcagatgcctggaagggagagaattggctgtatcggaaccaaaaaaaatgggatattaatctgcctcaggaggcattcattcctgagaccatatacacagaagaggaggatttcgagtgctctgagaataagaagagcttcgacataaactccgtgtctagcatttgtgccatccaggttggcataccctcacgtaagggcagccctaagtgcgacaaatttaagacttactttaagttcaaccttgacagcgtggggaaacagcattcagaatatgaatatgggaatgacctcagtctctctactgacattcgccaccaaaagagccatacaacaatgaattcatacgagtgttatcagtgcgggaaagccttctgtcgctcgtcatcgctcatcagacatcagatcatacacaccggtgagaagccgtataaatgcagcgaatgcggcagattcttcaaccgacggacaaacctgaccaagcaccagaaattacacgctgaagccaaggcctgtacttcaaataagtgcggaaaggcttttagtaaatccgaggatagtaacaaccctacacttcacttcgggaacaatttctaccagtgtgtgaattgcgggaaatcttttaaccggtcatccagcctgatccggcaccaaatgatccatacaggagagaaaccgtttaaatgtaaggaatgtagcaaggctttcaacaggagttcaaatctggtgaaacaccaaaagctgcacacacgtgacaagagctag

SEQ ID NO: 247427 - DNA, 1554 bp, Artificial Sequence
  Description of Artificial Sequence: Synthetic coding sequence
atgcaaccgttatccaagctgatggccatctcaaaacccaggaatttaagcctgcgggaacagcgcgaggttttacgggctgacatgagttggcagcaagagaccaaccccgtggtggagacacacgattccgaggcttctcgacaaaagttcaggcatttccagtacctcaaggtgagtggccctcatgaagccttgagccagctttgggagctctgtctgcagtggctgcgccctgaaattcacaccaagaagcagataatagaactattagtgctcgaacagtttctggctatcctccctgaagaggtgagaacatgggtgaatttgcaacaccccaacaactcaaaggacatggttacacttattgaggatgtgatagagatgctcgaggatgaggacatgccatgcaaggatagcgccctccaaatgggctccataaaggagaagatgaaggccggttcacgaactggcaagcctcaggaacccgttacctttaaagatgtagtggtagagttctcaaaagaggagtggggccagttggactccgccgtgaagaacctataccgtaacgtgatgttggaaaatttccggaatctgaacagcctaagaaaagcccacctcctcagtaaaccctttgaaagtctgaaattagagagcaagaagaagcgttggatcatggagaaggagattccacggaaaacaatatttgacatgaaatctatcagcggcgaggaaagcagccacggcgtgatcatgactcggttgacagagagcgggcacccaagctctgacgcttggaaaggagaaaactggctctatagaaatcagaaaaagtgggacattaatctgccacaagaagcattcataccggaaaccatatatactgaggaagaagactttgagtgcagcgagaataagaagtcttttgacataaactcagttagttcaatttgtgcgatacaagtcggcattccaagcaggaagggcagccccaagtgcgacaagttcaaaacatatttcaagttcaacctggactccgtggggaagcagcacagcgagtacgaatacggcaacgacctgtccttatctactgacattcgccatcaaaagtcacacacaaccatgaacagctatgagtgctatcagtgtggcaaagcgttttgcagatccagctctctcatcaggcatcagatcattcatacgggcgaaaaaccttacaaatgtagcgaatgcggcaggtttttcaacaggcgcacaaatctgactaagcaccagaagctgcacgccgaggcaaaggcctgcacttctaacaaatgcggaaaggccttctccaaaagtgaagattctaacaaccctactcttcattttggcaacaacttttaccagtgtgtgaattgtggcaaaagtttcaatcgcagctcctcactcattaggcaccaaatgatccatacaggtgaaaaacctttcaagtgtaaagagtgttctaaagccttcaatagatcctctaaccttgttaagcatcagaaactacacacgcgggacaagagctag

SEQ ID NO: 247428 - DNA, 915 bp, Artificial Sequence
  Description of Artificial Sequence: Synthetic coding sequence
atgcagcctctttccaagcttatggcaattagtaagccgcgaaatctctcacttcgagaacagagagaagtgttacgagccgacatgagctggcagcaggagaccaatcccgtcgtcgagacacacgatagcgaggcatccagacagaaattccgccattttcagtacttaaaggtgagcggtccccacgaggcactttcgcaactgtgggagctatgcctgcagtggctgcgaccagaaatacacacgaagaaacagattattgagctgttagtcctagagcagttcctcgctatcttgccggaagaggttaggacttgggtcaacttacagcatcctaataatagtaaggatatggtcaccctcatcgaagacgtaatagaaatgctggaggatgaagatatgccatgcaaagactccgcgttacagatgggaagtattaaagaaaagatgaaggccggttctagaacggggaagccacaggagcccgtaacattcaaagacgtggttgtggaattctccaaggaagagtggggtcagctggattctgccgttaagaatctataccgaaatgtcatgcttgagaatttcaggaaccttaattcattacgtaaggcacacctgctgagcaaaccttttgaatccctgaaactcgagtcaaaaaaaaaaaggtggatcatggagaaggagatcccacgcaagactatatttgacatgaaatctatcagcggtgaggaatcttcacacggagtcatcatgacaagattaacagagtctggacacccgagttccgacgcatggaaagacggagtttcacttctccttccaaggcttgagtacaatgatgccgtgtctgcccattgcaacctgcatttgtgggtacaggtcattctgttgccacagccaccagaatag

SEQ ID NO: 247429 - DNA, 3147 bp, Artificial Sequence
  Description of Artificial Sequence: Synthetic coding sequence
atgcaatccaaagtgacgggaaatatgccaacgcagtccctgctgatgtatatggatggtcctgaggtgattggatcctccttgggctcccccatggaaatggaggatgcactgtctatgaagggcaccgctgtcgttcctttccgggctacccaggagaagaatgtgattcagatcgagggctacatgccactggactgtatgttttgctcacagacttttacacactccgaagatttgaataagcacgtgttgatgcagcacaggcctaccctctgcgagcctgctgttctgcgtgtagaagctgaatacctgagtcctctcgacaaatcccaggtgcggacagaaccacccaaagaaaaaaattgcaaagaaaatgaattttcttgcgaggtatgcgggcaaactttccgcgtggcgttcgacgtggagatccatatgaggactcacaaggattctttcacatacggatgtaacatgtgcggaaggcggttcaaggagccttggtttctgaagaaccacatgcggacacacaacggcaagtcaggtgccaggtccaagctgcagcaggggctcgagagctctcccgcaactatcaatgaggtggtgcaggtccacgccgctgagtctatcagtagcccttacaagatttgtatggtgtgtggttttctgtttcctaataaggagagcctgattgaacaccggaaagttcacacgaagaagacggcctttggaacatcatccgctcagactgatagcccacaggggggaatgcctagttcacgtgaagacttcttgcaattgttcaacctgagacccaagtctcacccagagaccggaaaaaaacccgtacgctgcatacctcagcttgacccctttacaacgtttcaggcttggcagttggcgactaaagggaaggtggcgatctgtcaggaggtcaaggagagtggacaggaaggcagcacagataacgatgacagctcctctgagaaggagctgggtgaaacaaataaaggcagttgtgctggactctcccaagagaaggaaaagtgcaaacatagccacggcgaggcgccttccgtggacgcagaccctaagctcccgagctctaaggagaaaccaacccactgctctgaatgtggcaaggctttcagaacttatcaccagcttgtcctccattctcgcgttcacaagaaagataggcgcgcaggagccgagtctcctaccatgagcgtagacggacgacagccgggaacctgttcccctgacctggctgccccactggatgaaaacggagccgtggataggggtgagggtggttccgaagacggctccgaagacggcctcccagaagggattcacctggataagaacgacgatggaggaaaaattaagcatctgacaagcagtagagaatgttcctactgtggcaaatttttcaggtctaattactatttgaacattcacttgagaacacacaccggtgaaaagccctacaagtgcgaattctgtgaatacgcagctgcccaaaaaacttcacttcgctatcacctggaacggcaccataaagagaagcaaacggacgtagcggctgaggtaaaaaacgacgggaaaaaccaagatacagaggatgcactgctgaccgccgacagcgctcagacaaaaaatttaaagcggttcttcgatggcgcaaaggatgtgacgggatctccacctgccaaacagctgaaggaaatgccgtcagtgtttcagaacgttctgggtagcgccgtactgagtccagcccataaggatacacaggacttccacaaaaacgcagctgacgatagcgctgataaagtgaacaagaaccctacacctgcttacttggatttgctgaagaagcggtctgcagtagagacccaggccaataacctgatttgccgcactaaggccgacgtgacccccccacctgacgggtcaactacccataacctagaggtgtctcccaaggagaaacagacagaaacagcggcagattgtagatataggcccagtgtggactgccacgagaaaccactgaatctgtcagtcggggcactccataattgtccggctatctctctcagcaagtcattgattcctagcataacatgcccattctgcacttttaagacgttttaccccgaggtgttgatgatgcaccagcggctggagcataagtataatccagacgtgcataagaattgtaggaataaaagccttctgaggtccaggaggacaggctgccccccagccttgcttggaaaggacgtgcctcctttatcctccttttgtaagcccaaacctaagtctgcgtttccagcacagagtaagagcctaccaagcgctaaaggtaagcagtcgccacctggacccggaaaggctcccctaacttcaggcatcgacagttctaccctcgcaccttccaatctcaaaagccaccgtccccagcagaatgttggcgtgcagggcgcagcgactcgccagcagcagagcgagatgttcccaaaaacctctgtcagccctgcaccggataagacaaagcgccctgagactaaattgaagcctcttcccgtggcaccctctcaacccaccctggggagctcaaacatcaacggttccattgattatccggcaaaaaacgatagcccttgggcccctccgggacgagactacttctgcaatcgaagtgcttctaatactgcagctgaatttggggagcccttgccaaaacggctgaagtcctcagtggtagcccttgacgtggaccagcccggagccaattatagaagggggtatgatctgccaaagtatcatatggtcagagggatcacctcactacttccccaggattgcgtgtatccttctcaggctctgccacctaaacctagatttctgtcaagttccgaggttgattcccctaacgtcctgactgtgcaaaagccatatggaggatcaggtccactctacacatgcgtccccgcaggaagccctgcttcctcttctaccctggagggtaagagacctgtgagctaccagcacctctcaaattccatggcgcaaaaacgtaactacgagaattttatcggtaacgctcactataggcctaatgacaagaagacctag

SEQ ID NO: 247430 - DNA, 3147 bp, Artificial Sequence
  Description of Artificial Sequence: Synthetic coding sequence
atgcagagcaaagtgacggggaacatgcccacacagagtctactcatgtacatggacggacccgaagtgatcggatctagtctaggatctcccatggaaatggaagatgctctgtctatgaaggggaccgccgttgtgcccttccgcgcaacgcaagaaaagaacgtgatccagatcgaaggttacatgcccttggactgcatgttttgctctcaaactttcactcactctgaagacctcaacaaacacgtgctgatgcagcaccggccaacattgtgcgagccggcagtgttgcgagtcgaggctgaatatctatctccactcgataagtcccaagtgcgaaccgagcctcccaaggaaaagaactgtaaggagaacgaattttcttgtgaagtatgcggacagacgtttagggtggccttcgatgtggagattcacatgcgaacccacaaggacagcttcacttatggctgtaacatgtgcggccgaaggtttaaggagccctggtttctcaaaaatcacatgcgaacacataatggcaaaagcggggctagaagcaagctccaacaaggtctggaaagttcccccgcaacgattaacgaagtagttcaagtccatgccgctgagtctatatcatcgccctataagatttgcatggtgtgtggctttctgtttccgaacaaagagtcactgatagaacaccgcaaggtgcacaccaagaagacagcattcggcacgtcttcagcccagacagatagccctcagggcggtatgccctcgtccagagaagattttttacagttatttaacctgcgccctaaatctcaccctgaaacgggcaagaaacccgtgcgatgtatcccccagcttgacccctttacgacattccaggcttggcaactggccacaaaaggaaaggtggccatctgccaggaagtaaaagaatccggtcaggaggggagtacggacaatgacgattccagcagcgagaaggagctcggagaaaccaacaaaggcagctgtgccggactttctcaagagaaggagaaatgtaagcattcgcacggtgaagccccatctgttgatgctgacccaaagctgccttcttctaaggaaaaacctacacattgttcagagtgcgggaaggccttccggacatatcatcagctagtcctacattctcgggttcataagaaggatcgacgagctggcgcagaaagcccgacaatgtccgtggatgggcgacagcccggaacatgctctcccgacctcgctgctccactggatgagaatggtgctgtcgatcggggagagggagggagcgaggatgggtccgaggacggcctgccagagggcattcacttggataagaatgatgatggcggaaaaattaaacacttaacatcctcaagggagtgttcatactgcggcaaatttttccgttctaactattatctgaacatccatttgcgtacgcacacgggagagaagccgtataaatgcgaattttgcgagtacgccgcagcacaaaagacatccctgcgctaccatctggaacgtcatcacaaagagaaacaaaccgacgtggctgcagaggtgaagaacgacggaaaaaatcaggacactgaggacgctcttctcaccgctgacagcgcacaaacaaagaatttaaaacgattcttcgatggggctaaggacgttaccggctcgccacccgctaagcagctgaaggagatgccgagcgtgttccagaatgtactgggtagcgctgtcctctctccagcacataaagacacacaggacttccataaaaatgccgctgatgattcagctgataaggtgaataaaaacccaacaccagcctatttagacctcttgaagaagcggtcagccgtggagacgcaggctaacaatctgatctgtcgcacaaaggccgacgttaccccaccacctgacgggagcacaacccataacctggaagtgagtcctaaggaaaagcagaccgagacggcggcagattgccgctatagaccgagcgtggattgccacgaaaagccattaaacttgagcgtgggagctcttcataattgcccagctatcagtttatcaaagtctctcatcccttctatcacatgccccttttgcactttcaaaaccttctatcctgaggtgctcatgatgcaccagagactcgaacacaagtataaccctgacgtgcataaaaattgtcgcaataagtcgctgctgcggtcaaggcgcacaggatgtccgcctgctctccttggtaaagatgttccgcctctgagctcattctgtaagcctaagccgaagtccgcatttcccgctcagtcaaagtccctccccagcgccaagggcaagcagagccccccaggtcctggaaaagcccctctgacatctggaattgattcttctactttggcaccttcgaacctcaagtcccacaggcctcagcagaatgtgggagtacaaggtgcagccacacgtcagcagcagagcgagatgtttcccaaaacctccgtatcaccagcccctgacaaaactaaacggcctgaaaccaaactgaaacccctccccgtggcacctagtcagccgactctgggctcttccaacattaatggctctatagattaccccgcaaaaaacgactccccttgggcaccgcctggacgcgactacttctgtaacagatccgcttccaataccgcggctgagttcggtgagccactcccaaaacgcctcaaatctagcgtggtggcattggacgtggatcaacccggtgccaactacagaaggggttacgatctgcctaaataccacatggtccgaggtatcacaagcctgctacctcaggactgtgtgtatccatcgcaggctctgcctcctaagccaagatttctctcatccagtgaagtagacagcccaaacgtattgacagttcaaaagccatatgggggatccggcccactgtatacatgtgtccccgcagggagcccagcctcaagctcaactttagaaggtaagcgcccagtttcatatcaacatctgtctaacagtatggctcagaagcgcaattatgaaaactttatcggtaacgctcattacaggccgaacgacaagaagacgtag

SEQ ID NO: 247431 - DNA, 666 bp, Artificial Sequence
  Description of Artificial Sequence: Synthetic coding sequence
atgtttccaaagaccagtgtgtcacccgctcctgataaaacaaaacggccagaaacaaagctcaaaccactacctgttgccccatcacagccaactctcggcagcagcaacattaatggtagcattgattatcccgctaagaatgacagcccctgggcacccccaggcagagactacttctgtaaccgcagtgcttcgaatactgctgccgagttcggggagccactgccaaaacgtttgaaatcaagcgttgttgccctggacgtggatcaacctggtgctaactacagacggggatacgacttgccgaagtatcatatggttaggggaataacatccctcttgcctcaggattgcgtttacccatctcaggcattacccccaaagccaagattcctgtcatcctccgaagtggatagccccaatgtcctgacagtgcagaagccatacggtggatccggaccgctctacacctgtgttccggcaggttctcctgcttcttcatccaccctggaaggattgggtggctgccagtgtctactacccatgaaactaaattttacctcctcttttgagaagcggatggtaaaagcgacggaaatatcatgcgattgcaccgtacataaaacctacgaagaaagcgctcggaatactacagtagtgtag

SEQ ID NO: 247432 - DNA, 288 bp, Artificial Sequence
  Description of Artificial Sequence: Synthetic coding sequence
atgcagagcaaggttacagggaatatgcccacacagtctctgctcatgtacatggatgggcctgaagtgatcgggagctcgctaggctctcccatggaaatggaagacgcattgtcaatgaagggcactgccgtggtgccatttagagccacacaagagaagaatgtgattcagatcgagggctacatgcccctggactgtatgttctgttcgcagactttcacacatagcgaggatctaaacaaacacgtgctgatgcagcacagaccaaccttgtgcgagccatag

SEQ ID NO: 247433 - DNA, 2169 bp, Artificial Sequence
  Description of Artificial Sequence: Synthetic coding sequence
atggaggggtctaggccacgcgctccatcgggccatctggctcctagccctcccgcttttgacggggaactggatttacagcgatattccaatggtcccgcagtatctgctggttctctagggatgggcgcagtaagttggagcgaaagccgggcaggtgagcggcgttttccctgtcccgtgtgcggcaaaaggtttagattcaactctattctggccttacatttaagggcccaccctggggcacaggcctttcagtgcccccactgtggacaccgagcggctcagagggctctacttcggtcacacctgagaacccaccaaccagaaaggccccgttctcccgcagccaggttgctcctagaacttgaggaaagagctctgttgcgggaggccaggctgggacgtgctcgttcgagcggcggaatgcaggcaacgcctgctacagaggggctggcaaggcctcaggccccaagtagtagtgcattccgctgtccgtattgtaagggcaagttcagaacatccgccgaacgggagagacatctccacatcttacacagaccgtggaagtgcgggctctgcagtttcggctccagtcaggaagaagagctcctacatcactcactgacagcccatggggcaccggagcggccacttgcggcaacctccgccgctccgccaccacagcctcagccccaacctccccctcagccagagccacggtccgttccgcaaccagagccagaacccgaacccgaacgagaggcgactcccacacctgctcccgcagctcccgaggagccgccagccccacccgaatttaggtgtcaagtctgcggacagtccttcacacagtcctggttcctgaaaggtcacatgcgaaagcataaagcctcattcgaccatgcatgtcccgtgtgtgggaggtgtttcaaagagccttggtttctcaagaatcacatgaaggtgcacgcatccaagctgggacccctaagagcgccaggccctgcctccggacctgctagagcccctcagccgccagacctggggctcttagcctatgagccccttggccctgccctgctgcttgcccctgccccaaccccagcagagcggagggagcccccatctctgctggggtatctgagtttgcgggcaggagagggacgcccaaatggagaaggcgctgaacctggccctgggagatcttttggaggctttcgaccactctctagcgcactccctgctagggcacgaagacaccgggctgaggaaccagaggaggaggaagaggtcgtagaagcagaggaggagacatgggcgaggggcaggtcactgggctcattggcgagcctccatcctaggcctggtgagggacctggacactccgcaagcgccgcaggcgctcaggcgaggagcaccgccacgcaggaagagaatggcctgctggtgggaggaacccgccctgaagggggtcgaggtgccactggaaaggactgcccattttgcggcaagtcattccggtccgcccaccacctcaaggtgcatttacgcgttcacacaggcgaacgaccatataagtgtcctcactgcgattacgccggaacccaatcaggatcattaaagtaccacttacaacgccaccacagggaacagcgttccggagcgggacccggtcctcccccagagccgccaccaccttcacaacgcggatctgcaccacagtcaggagcgaagccatcacctcagccagctacgtgggtggagggagcatctagccctcgtcctccttcttcaggagccggacccggttctaggagaaagccggcaagccccggaaggactttgaggaatggacgtggcggtgaagctgaacctctcgacttgtctctcagagcagggccaggaggtgaggctggccctggcggagccctacaccggtgtctgttctgtccttttgccaccggtgcccctgagctcatggccctgcatctacaggttcaccactccagacgcgctcggggacggaggcccccacaggcagacgcctcgccgccatatgcacgggtaccaagcggtgagaccccaccttctcccagtcaggagggggaggaaggcagtgggctgtctaggccgggagaggcgggattgggaggacaggagcgatag

SEQ ID NO: 247434 - DNA, 2169 bp, Artificial Sequence
  Description of Artificial Sequence: Synthetic coding sequence
atggagggaagccgacctagggcaccttcaggacacttggcgcctagcccaccagcattcgacggagagctggacctgcagagatatagcaatggccctgcagtgtccgccggatccttgggcatgggagccgtctcgtggagcgagtcaagggcaggagaacgtcgattcccatgccctgtgtgtggtaagcgcttccgctttaattctatacttgcgctccatctgagggctcaccccggagcacaggcttttcaatgtccccactgcgggcatcgggctgctcagagagcccttctgagatcccacctccggactcaccaacccgagcggccacgcagcccagcagcgaggctcctcctggagctcgaagaaagggcactccttcgcgaagcacgactcggcagggcgagaagctccggcggaatgcaggcaaccccagcaactgaaggcctggccaggcctcaggcacccagtagctccgcattccggtgtccgtattgcaaggggaaatttaggacttccgccgagcgggagcgccacttgcatattctccataggccatggaagtgcggcctgtgcagtttcggctcctcacaggaggaagagctgctgcaccactcactcacagcccacggtgctccggagaggccactcgcggctacctccgctgctccaccaccacaaccgcagccccagccgcctcctcagccagagccaagatccgtgccacagcccgagcccgaacctgaaccagaacgcgaggctacccctacacctgcgcctgctgctccagaagagccccctgcccctcccgagtttcgctgccaggtgtgcggtcagagcttcactcagagctggtttctcaaaggccacatgcgaaaacataaggcaagcttcgaccatgcatgtcctgtgtgcggaaggtgttttaaagagccatggttcctgaaaaatcatatgaaagtccacgcctcgaagctcgggcctttgcgggctcctggaccagcctccggaccagctcgtgcccctcagcccccagacctgggtttgctggcttatgaaccactaggacccgctcttctgctcgcacccgctccgacgcccgctgaacgcagagagccgccatccttacttggataccttagcctgcgagctggcgaaggaaggcctaacggtgaaggggcagaaccaggtccgggaaggagcttcggaggatttcgtccgctcagctccgcattacctgctcgagcacggagacatcgcgctgaagaaccagaagaagaggaagaggtagttgaagctgaggaagagacttgggcccgaggaagaagccttggcagcctcgccagcctccaccccaggcccggagagggtcccggtcacagtgctagcgccgctggcgctcaggccaggagcactgctacgcaggaggagaacggcctgctagtgggaggaacccgcccagaggggggacggggagctacgggaaaggattgccccttctgtgggaagagtttccggtctgctcaccacctgaaggtgcatttaagagtgcatacgggggagcggccatacaagtgcccacattgtgactatgctgggacgcagagtggaagcctcaaatatcacctccagcggcatcatcgtgaacagagaagcggagctggacccggtccccctcctgaacctcctcccccttctcagcggggaagcgcaccccagagcggtgccaagccttccccacagccagcaacctgggtggagggcgcatcaagtccaaggcctccgagcagtggggcaggtccaggctcaaggcgcaaaccggcaagtccaggtcgtaccctgaggaatggcagagggggagaggccgagcccctcgacctgtccttgcgggctggccctggaggggaggcaggccctggtggtgcgcttcatcgctgcctgttttgtccattcgccacaggagcgccagagctgatggctctgcatctgcaggtgcatcactcaaggcgcgctcggggaaggcgtccaccacaggcagacgcgagccccccatatgcgcgagtcccgagcggggaaacacctccttcccctagccaagagggagaggagggtagcgggctttcgcgccctggtgaagctggtttgggagggcaggaaagatag

SEQ ID NO: 247435 - DNA, 2169 bp, Artificial Sequence
  Description of Artificial Sequence: Synthetic coding sequence
atggagggatcccgaccgagggcaccctccggtcacttggctccatcccccccagccttcgatggggagctcgatctccagcgctattcaaacgggccagccgtctctgctgggagcttgggcatgggcgctgtgtcttggagtgaatccagagccggtgagaggcggtttccatgccccgtctgtggcaagaggttcaggttcaactcgatcttggccctgcacctgcgggctcatccgggtgcacaggctttccagtgcccccactgcggtcatcgagccgctcaaagagccctccttcgatcacatttgagaacccaccaaccagagcgtcccagatcccccgcagcccgtcttctcctggaacttgaagagcgagccctcctgcgggaggcacggttgggcagagctagaagctctgggggtatgcaggcaactcctgcgaccgaaggtctcgctcgacctcaggcgccttctagctctgctttcagatgtccctactgtaaggggaagtttagaaccagcgcagagagagagcgccacttgcatatcttgcaccgaccctggaagtgcggtctctgttcattcggatcttcccaggaggaagaactactgcatcacagtctgacggcccatggagccccagagcgaccactggccgctacctccgccgcacctccaccgcagccccaaccgcagccgccaccgcagccagagccgcgttctgtcccccagcccgaacccgagcctgagccggagagggaagcaactcctactccagcacctgcagctcccgaggaaccaccggcacccccagagttccggtgccaggtctgtgggcagagtttcacccagagctggttcctcaaaggacatatgaggaaacacaaggcctcattcgaccatgcatgtcccgtctgcggtagatgttttaaggaaccctggttcctgaagaaccatatgaaggtgcatgcaagtaagcttgggccattacgcgctcctggtcctgccagcggccctgccagggcaccacaaccccctgatctgggcctgctggcatacgagcctttaggcccagcactgctgctggccccagccccaactccagcagaacgcagggaacctccttccttactgggatacttaagcttgcgggcaggcgagggacgtccgaacggcgagggagcagagccaggcccaggccgtagttttggtgggtttcggcctctgagctccgctcttcctgctcgggctcggagacatcgcgctgaagaacccgaagaagaggaagaggtggtggaggcggaggaagagacttgggctagggggagaagtcttgggagtctggcatctctgcaccccaggccaggggaagggccaggacatagtgcctcagccgctggcgctcaggccagatccaccgccacgcaggaagagaacggcttgctagttggagggacccgccctgaaggcggaaggggggctacagggaaggattgcccgttttgtggaaagtcctttagaagcgcccaccatctgaaggtccacttgcgcgtgcataccggggagaggccctataaatgcccccattgcgactatgcaggcacccaatccggctcacttaaatatcacttgcagcgtcaccacagggagcagcggtcaggggcaggaccagggcctcctcctgaaccccctccgcctagtcaacgtggttctgcccctcagagcggggctaagccatcacctcagcccgctacatgggtggaaggtgcttcctcacccagacctccatcgtctggtgccggacctgggtccaggaggaaacccgcatcacccggacggacgctgcgaaacggcagggggggtgaagctgagcccttggacctatccctccgtgctgggccaggtggcgaggccggtccaggtggagctttgcataggtgtctgttctgccccttcgccacaggcgcaccagaactgatggcactgcatctacaggtgcaccattcacggagagcgagaggacgacggccacctcaggctgacgcttccccaccttatgccagggttccgtccggggaaaccccaccttcaccctctcaggagggcgaggaggggtcagggctgtcacgacctggagaagccggtctgggtgggcaagaacgttag

SEQ ID NO: 247436 - DNA, 324 bp, Artificial Sequence
  Description of Artificial Sequence: Synthetic coding sequence
atggaaggctctcgccctcgagctccttcaggtcatcttgccccatcaccccctgcctttgacggggaactggacttgcagcggtactcaaatgggcctgcagtgagtgcaggctctctcggcatgggagctgtgtcttggtcagagtcacgagcaggtgaaaggcgttttccctgtcctgtgtgcggaaagcgctttcggtttaacagcattctggctctgcacctgagagctcatcctggcgcacaggcttttcagtgtcctcactgcggccacagggcagcccagagggccctgctgcgctcacatctcagaacccactag

SEQ ID NO: 247437 - DNA, 636 bp, Artificial Sequence
  Description of Artificial Sequence: Synthetic coding sequence
atggagggatcccgcccacgcgcaccatctggccacttggccccaagcccaccagctttcgatggcgaacttgacttgcagcgctactctaacggtccggctgtgagtgcgggatcattaggaatgggagccgtgagttggtctgaaagtcgcgctggtgagcgacggtttccttgtccagtgtgtgggaagagattccgattcaattcgatactggccctccacttacgggctcatcctggtgcacaagccttccagtgtccccattgcgggcatcgagccgcacagagagctctgctcaggtcgcacctgagaacccatcagcccgagagacctagaagtcccgctgctcgcctactcctggagctggaggagagggcactcttacgggaggcccgtctgggacgggcacgttccagcggaggcatgcaagcaacccctgcaacagagggacttgcgagaccgcaggctccctcatcttctgcatttcggtgcccttactgtaaggggaagttccggacttcagctgaaagagagcgtcatcttcacatcctccataggccttggaaatgtggactgtgctcatttggctcctcccaggaagaagagctgttacatcacagtctgacggcctag

SEQ ID NO: 247438 - DNA, 96 bp, Artificial Sequence
  Description of Artificial Sequence: Synthetic coding sequence
atggagggctcccgccctcgggcacccagtggacacctggcccctagcccaccagctttcgatggtgaactggaccttcagcgctattccaattag

SEQ ID NO: 247439 - DNA, 336 bp, Artificial Sequence
  Description of Artificial Sequence: Synthetic coding sequence
atggaggggtcccgcccaagggctcctagtggtcatctagctccatcccctccagcctttgatggagaacttgatttgcagcgctatagcaatgggccagccgtgtccgccggatctctcggaatgggtgctgtgtcctggagtgagtcaagggccggagagcgcagatttccatgtcccgtttgtggtaaaaggtttcggttcaacagcatacttgcattacatctgagggcacacccaggtgctcaggcattccagtgccctcattgcgggcacagggccgctcagcgggctttactccgtagccacttgagaacgcatcagcccgaacggtag

SEQ ID NO: 247440 - DNA, 675 bp, Artificial Sequence
  Description of Artificial Sequence: Synthetic coding sequence
atgagactcgccaagccaaaggccggaatttctcgcagctcaagccagggtaaggcctacgagaataagcgtaagacaggcaggcagcgccagaaatgggggatgacaattcgttttgatagcagcttttctcggctgaggcgatcattggatgacaaaccatacaagtgcacggagtgcgagaagtcatttagccagagctctaccttgttccaacatcagaagatccacacaggcaaaaagtctcataaatgtgcagattgcggcaagtctttttttcagtcctccaaccttattcagcaccggcgtattcacaccggagagaagccttataaatgtgatgagtgtggtgagtcatttaaacaatcctccaacttaattcaacatcagcgtattcacaccggggagaagccatatcagtgtgatgaatgtggcagatgcttttcacagtctagtcaccttatccagcatcagcggacccatactggcgagaagccctatcaatgctcagaatgtggcaaatgcttttctcagtcctcacaccttcgccagcacatgaaagttcataaagaagaaaagccaagaaagaccagaggcaaaaacattagggtcaagacccacctcccctcttggaaggctggtacgggcagaaagagtgtggctgggcttcggtag

SEQ ID NO: 247441 - DNA, 237 bp, Artificial Sequence
  Description of Artificial Sequence: Synthetic coding sequence
atgacaactttcaaagaggcaatgacgttcaaggatgtggcagtggttttcaccgaggaggagttagggctactggacctggcccagcggaagctgtaccgagatgtcatgttggagaatttccgcaatttactcagtgtgggccatcaagcatttcatcgcgatacattccactttcttcgggaagagaagatctggatgatgaaaacagccattcagagggaaggcaattcttag

SEQ ID NO: 247442 - DNA, 2124 bp, Artificial Sequence
  Description of Artificial Sequence: Synthetic coding sequence
atgactacctttaaagaagccatgacattcaaggatgtggctgtggtgttcaccgaggaagagttggggctgcttgacctagcccagagaaagctctatagagatgttatgctcgagaactttcgcaacctgctgtcagtgggacaccaagctttccatcgggacactttccattttctgcgcgaagagaaaatttggatgatgaagactgccattcagagagaggggaacagtggagacaaaatacaaaccgaaatggagacagtgtccgaagccggaacgcaccaggagtggtcattccaacagatatgggaaaagatagctagtgacctaacacggagccaggatctgatgatcaactctagccagttcagcaaggaaggtgacttcccctgccagacagaggcgggtctatctgtgatacacacaagacagaagtcatcccaaggcaacggatataagccatccttttctgacgtcagtcacttcgactttcaccagcaactccacagtggggagaaaagtcacacgtgtgacgagtgcgggaagaacttttgctatatctcagccctcaggatccaccagagagtccacatgggcgagaaatgttacaagtgtgatgtttgtggaaaggagttctcacagtcttcccatctgcagacccaccagcgggtccataccggtgaaaagccttttaagtgcgtggaatgcggaaaggggttttcacggcgaagcgccctgaacgttcaccacaaattacacaccggtgaaaagccctataactgcgaggagtgcgggaaggcatttattcatgattcccagttacaggagcaccagaggatccataccggagagaaaccctttaaatgcgatatctgtggcaagtcattttgcggcaggtctcgcctgaaccgccactcgatggtacatactgccgagaagcctttcagatgcgatacatgtgataagtcctttcggcaaaggtccgctcttaactcccaccgcatgattcatactggggagaagccgtataaatgtgaagaatgcggtaaaggcttcatctgtcgaagggatctgtacacccaccacatggtccatacaggcgagaagccttacaattgcaaagaatgtggcaagtctttccggtgggcttcatgtttgctgaaacaccagagagtgcatagcggagagaagcctttcaagtgcgaagaatgcggcaagggtttttataccaattctcagtgttattcacaccaacgatcacactccggcgaaaagccttataagtgtgtggaatgcgggaaggggtacaaacgcaggctggacctagactttcatcagcgagtgcataccggggagaaattatacaattgcaaggagtgcggaaagtccttttccagagctccttgtctcctcaaacatgaaagactccattctggggaaaaaccttttcagtgtgaagaatgtggtaagaggtttactcaaaattctcatctgcattctcatcaacgggtgcatactggtgagaagccctacaaatgcgaaaaatgcgggaaaggatataactccaaatttaatctggacatgcaccaaaaggtgcacaccggcgaaaggccatacaactgcaaggaatgcggcaagtcttttggctgggcgagctgcctgctcaaacaccagaggctgcactctggagaaaagccttttaaatgtgaagagtgtgggaaaagatttactcagaatagtcagctgcactcgcaccaacgtgtgcacactggcgaaaaaccatataagtgtgacgagtgcggcaaaggcttcagctggtcatccacacggctaacccaccagagacgccattctcgcgaaactcctctgaaatgtgagcagcacggaaaaaacatcgtccagaattcattctctaaagttcaggaaaaagtgcacagcgtggagaaaccctataaatgcgaggattgcggcaaggggtacaacaggaggctgaacttagatatgcatcagcgagtacacatgggcgaaaaaacctggaaatgccgagaatgcgacatgtgcttctcacaggcctctagcttaaggcttcatcagaatgtccacgtgggcgagaaaccttag

SEQ ID NO: 247443 - DNA, 1932 bp, Artificial Sequence
  Description of Artificial Sequence: Synthetic coding sequence
atgctggagaactacggaaatgtggcgagtttaggcttccccttactgaaaccagctgtgatttcacagctagagggtggctctgagttaggtggatccagccctttggcagccggaacaggcctgcaagggctgcaaactgacattcaaaccgacaacgacttgaccaaggagatgtatgaaggaaaggaaaatgtgtcttttgaactgcagagagacttctctcaggaaactgatttcagcgaggcctcactgctcgagaagcagcaggaggttcattccgctggaaatatcaaaaaggaaaaaagtaataccattgatggcactgtcaaggacgagaccagccccgttgaggagtgcttctttagtcagagctccaactcttaccagtgtcacaccattactggcgagcaaccctccggttgcaccggcctcgggaaatcaatctcttttgacaccaaactcgtgaagcacgagatcatcaatagcgaggaaagaccattcaagtgtgaagagctggtggaacccttcaggtgtgattcccaactgatacagcatcaagagaataacacagaagagaagccgtatcaatgttccgagtgtgggaaggctttctctattaatgagaagctcatatggcaccagcgtctacactctggtgagaaaccgttcaagtgcgtagaatgtggtaagtccttctcatatagctcacattatatcactcaccagaccatccactccggtgaaaaaccctatcagtgcaaaatgtgtggcaaggccttcagcgtgaacggctccttgtcaagacatcagcgaatccacactggagaaaagccctatcaatgcaaagaatgcgggaatggcttcagctgctcatccgcatatataacgcaccaacgcgtacacacgggggagaagccatacgagtgcaacgactgtggcaaggcctttaatgtaaacgccaaattgatccagcaccagaggatacacaccggggagaaaccttatgaatgcaatgaatgcgggaaggggttcaggtgctcaagccagctgagacagcaccagtccatacataccggagaaaaaccatatcagtgcaaagaatgtggaaaaggctttaacaataacaccaagcttattcagcatcaacgaattcatacgggggaaaagccttacgaatgcacggagtgcggcaaagccttctctgtgaagggaaaactcattcaacaccagagaatacataccggggagaagccctatgagtgcaacgagtgcgggaaggctttccgttgcaattcccagtttcgccagcacctgaggattcataccggtgagaagccctacgaatgcaacgaatgcggcaaggccttttctgtaaacggtaaactgatgaggcaccagaggattcataccggagaaaaaccttttgagtgtaatgagtgtgggcgatgctttacctccaaaaggaatctgctggaccaccacagaatacacaccggggagaagccttatcaatgcaaagagtgcggaaaagccttttcaattaacgccaaactcactagacatcagaggatacacactggagaaaaaccctttaagtgcatggaatgcgaaaaggcgttcagttgctcctcaaattacatcgtgcatcagcgtatccatacaggggagaagcccttccagtgtaaggagtgcggaaaggcttttcatgtgaacgcacatctcattagacaccagaggtcccacactggcgagaaaccctttcgctgcgtagaatgcggaaaagggttttccttttcctccgactatatcattcatcaaactgtacatacctggaaaaagccatacatgtgttccgtgtgtggaaaggcttttcgatttagttttcagttgtcacaacatcaatccgtacactcagaagggaagtcttag

SEQ ID NO: 247444 - DNA, 1248 bp, Artificial Sequence
  Description of Artificial Sequence: Synthetic coding sequence
tgcggcaaggccttttcaataaatgagaagctgatctggcaccagcggttgcacagcggagagaaaccttttaaatgcgtagagtgcggcaagtctttctcctactcatctcattacatcacccatcaaaccatacactctggcgagaagccttatcaatgcaaaatgtgcgggaaagcatttagcgtaaacggatcccttagcagacaccagcgtattcacactggtgaaaaaccataccagtgtaaagagtgcggtaatgggttttcttgctctagtgcttatataacgcaccagcgtgtgcacaccggagaaaagccatacgagtgcaatgattgtgggaaggcctttaatgttaacgcaaaactcatccagcaccagcgaattcacacaggcgaaaagccatatgaatgtaacgagtgcggcaagggctttaggtgttcatcgcagctgcgacagcatcagtctattcatactggcgagaaaccataccagtgcaaggaatgcgggaagggattcaataacaacacaaaactgatccagcatcaaaggattcatactggcgaaaagccgtatgaatgcaatgagtgtggtaaggcctttcgctgtaacagccagtttaggcagcatctacgcattcacacaggagagaaaccttatgagtgcaacgagtgtggaaaggccttctccgtcaatggaaagctgatgagacatcagcggattcatacgggagagaaacccttcgaatgcaatgaatgcggaaggtgctttacaagcaagcggaacctgcttgaccaccaccgcattcacacaggggagaaaccctaccaatgtaaggaatgcggaaaggccttttctattaatgccaagctcacacgacaccagcggatccatacaggggagaagccttttaagtgtatggagtgcgagaaagcctttagttgcagctcgaattacatagtgcatcagagaattcacacgggagagaaacctttccagtgcaaagaatgcggtaaggcctttcatgtcaacgcccatctgattaggcatcagcgtagtcataccggcgaaaaaccgtttagatgcgtggaatgtggaaagggtttcagcttcagctccgattacatcattcaccagaccgtgcatacatggaaaaagccctatatgtgttcagtatgcgggaaagcgtttagattttcattccagctgtcccagcatcagtcagtccactcagaaggaaaatcatag

SEQ ID NO: 247445 - DNA, 1932 bp, Artificial Sequence
  Description of Artificial Sequence: Synthetic coding sequence
atgcttgaaaactacgggaacgtcgcttcacttggctttccacttttgaagcctgccgtcatctcccagctggagggcggatcagaattgggaggatccagtcctctggctgctggcactggcctacaagggctgcagactgacatccagaccgacaacgaccttaccaaagaaatgtacgagggcaaggaaaacgtgtcttttgagctccagcgagattttagtcaggagacagatttcagcgaggcctccctcctcgagaagcaacaggaagtgcactcagccggaaatatcaaaaaagaaaagtctaacactatcgacggcaccgtcaaggacgagacctctccggttgaggaatgtttcttcagccaaagcagtaactcttaccaatgccacaccattactggcgagcagcccagcgggtgcacggggctgggcaaatcaatcagtttcgacaccaagttggtgaaacatgagattattaattctgaggaaagaccctttaaatgtgaagaactggtagagcccttcagatgtgactctcaacttatccagcaccaggagaataatacggaagagaagccttaccagtgcagcgagtgcgggaaggccttctctatcaacgagaagctgatttggcatcagaggctccattctggtgagaagcctttcaagtgcgtggagtgcggtaaaagcttttcttattcaagtcattatatcacccatcagacaatacatagcggggagaaaccgtatcagtgcaaaatgtgcggtaaggcattttctgtaaatggtagcctctcacggcatcagcgcatacataccggtgaaaagccctatcagtgcaaagaatgtggcaacgggttttcatgtagttcagcatacattacccaccagagagttcacaccggcgagaagccatatgaatgcaatgactgcgggaaggctttcaacgtcaacgccaaactgatccagcatcaaagaattcacaccggggagaagccgtatgagtgtaacgaatgcgggaaaggctttagatgcagttcccagctgaggcagcaccagagcatacacacaggcgaaaagccttatcagtgcaaggaatgcggaaaaggatttaataataacacaaagctaatccagcaccaacggatacacactggcgaaaaaccttacgagtgtaccgaatgcggtaaggccttcagtgtcaaaggcaaactgattcagcaccagagaatccacaccggagagaagccttacgaatgtaacgaatgcggtaaggccttccggtgcaatagccaattccgccaacatctgcgtattcacactggagagaaaccctatgagtgtaatgaatgtggaaaggctttcagcgtgaatgggaagctaatgagacaccagagaatccacactggcgaaaagcctttcgaatgcaacgaatgtggcagatgcttcacttcaaagcggaacttactggaccatcatcggatacatactggcgagaaaccataccagtgcaaggagtgcgggaaggctttctcaatcaatgccaagctaacgcgccaccagcggatccacaccggagagaagccttttaagtgcatggagtgtgagaaagctttttcgtgcagcagcaattatattgtgcaccagcggattcacacgggcgaaaaaccctttcagtgtaaagagtgcggaaaagctttccacgttaacgcccatctgataagacaccagcgcagccacacaggcgagaaacccttcagatgtgtggaatgcggaaagggcttttccttttcctccgactacataattcatcaaacagtgcacacttggaaaaagccttacatgtgttccgtctgcgggaaggcgttccgcttctcttttcagctgagccagcaccagagtgtgcatagtgagggtaaatcctag

SEQ ID NO: 247446 - DNA, 1932 bp, Artificial Sequence
  Description of Artificial Sequence: Synthetic coding sequence
atgctggaaaactacgggaatgtggcatcgcttggcttccctttgctgaagccagccgtgatcagccaactcgagggaggctctgaactgggcggttcgtccccattggccgctgggaccggcctgcaaggactgcagaccgatattcagaccgataatgatctgaccaaagagatgtatgaaggcaaggaaaatgtatcttttgaacttcaacgagacttttcccaggaaactgacttctctgaggcctcactgttagagaagcagcaggaagttcacagtgcaggaaatattaaaaaggaaaaatcaaacactattgacggcaccgtgaaggacgaaactagtcccgtggaagagtgtttcttctcccaaagctcaaatagctaccagtgtcacaccataacgggggagcaaccttctggttgtacaggattaggtaagtccatctctttcgacacaaaattagttaagcatgagatcattaactccgaggaacgtccgttcaaatgtgaagagctggttgaaccctttcgctgcgattctcagctgatccagcatcaggagaataacactgaggagaaaccctatcagtgcagcgagtgtggaaaggccttctcaataaacgaaaagctgatatggcatcagcgccttcacagcggggagaagccctttaaatgtgtggagtgtggaaaaagcttcagctattcttcccactacattacacatcagacaatccacagcggggagaagccctaccaatgcaaaatgtgtgggaaagctttctcagtgaatggtagcctttcacgacatcagaggatccacaccggagagaagccctaccagtgcaaggagtgtgggaacggatttagttgctcatcagcttacataacacaccagcgtgtgcacaccggcgagaaaccatacgagtgcaatgactgtggcaaagcctttaacgtaaacgccaagctgattcaacaccagcgtatccacacgggggaaaagccctatgaatgcaatgagtgtgggaaagggtttaggtgcagcagccagttaaggcagcatcagagtattcatactggcgagaagccctaccagtgtaaagaatgcggaaagggctttaataataacactaagctcatccaacaccaacgtatccatactggagagaagccttacgagtgcactgagtgcggtaaggctttctctgtgaaaggaaaactgatccagcaccaaaggatccataccggagagaagccctatgagtgcaacgagtgtggaaaggccttcaggtgtaactcgcaattcagacaacatttgagaatacacacaggcgagaaaccatacgagtgcaacgaatgcggaaaagcttttagtgtaaacggcaagctgatgcggcatcagcgtatacacaccggggagaagccctttgaatgcaatgagtgcggcagatgcttcacctccaagcgaaacctgctggatcaccatagaatacacacaggagagaagccctaccagtgcaaggaatgcggaaaggcctttagcatcaatgccaaactcactagacatcagagaatccacactggagagaaaccgtttaaatgtatggagtgcgaaaaggcattttcctgcagcagcaactacatcgtgcaccaaagaatccacactggtgaaaaaccattccagtgtaaagagtgcggaaaggccttccacgttaatgcccacttaattagacatcagagaagtcacacaggggagaagccgttccggtgcgtcgagtgcggaaagggattttcattttctagcgactacataatacaccagacggtgcatacatggaagaaaccctacatgtgctccgtgtgtggcaaagctttcaggttttcctttcagctctctcagcaccagtccgttcacagtgaaggaaagagctag

SEQ ID NO: 247447 - DNA, 1758 bp, Artificial Sequence
  Description of Artificial Sequence: Synthetic coding sequence
atgtacgaaggcaaagagaacgttagtttcgagcttcagcgcgatttctcccaggagactgatttctctgaggcgtcgcttctcgaaaaacaacaggaagtccattcggctggaaacataaaaaaagagaaatccaatactatcgatgggactgtaaaagatgaaacctcaccggtcgaagaatgttttttttctcagtcttccaactcataccagtgccacaccatcaccggtgagcaaccatcaggctgcacaggtcttgggaaatcaatctcgttcgacaccaagctcgtgaagcacgaaatcatcaatagcgaggagcgaccatttaagtgcgaggagctagtggaaccctttaggtgtgactctcagttgattcaacaccaggaaaacaacactgaggagaaaccttatcaatgctcagagtgcgggaaggcttttagtataaatgaaaaacttatatggcatcagcggttacacagcggggaaaagcctttcaagtgtgtggaatgtggtaagtctttctcctactcctctcactacataacccatcagactatccactccggcgagaaaccttaccagtgtaaaatgtgcgggaaggcgttttcagtgaacggctctcttagtaggcatcaacggattcacaccggtgaaaagccttaccagtgcaaggaatgtggcaacgggttctcctgcagtagtgcgtatatcactcaccagcgagtgcacacgggcgagaaaccctacgagtgcaacgactgcggcaaagcttttaatgtcaacgcgaagctgattcagcaccagcgaattcacactggagagaaaccttatgaatgcaatgagtgtggaaagggctttcggtgcagctctcagctgaggcagcaccagagtatccacacaggcgagaagccttatcaatgcaaggaatgtgggaaaggattcaacaacaacacaaaactgattcaacatcaacgcattcacactggagagaagccgtacgaatgtaccgaatgcggcaaagccttcagcgttaagggaaagctgatacagcaccagagaattcacactggagagaagccctacgagtgtaacgagtgtgggaaagcttttcgatgcaactctcagttccgccagcatctcagaattcacacaggcgagaaaccatacgagtgtaacgaatgtggaaaagccttcagcgtcaacggaaaacttatgaggcatcaaaggattcacactggtgaaaagccttttgagtgtaacgagtgcggtcgttgttttacaagcaagcggaatctgctggaccaccatcggatccatacaggagagaagccctaccagtgtaaggagtgcggcaaggctttttcaatcaacgctaagcttacccggcaccagaggatacacactggcgagaaaccttttaagtgtatggagtgtgagaaagcctttagctgttctagcaattacatcgtacaccagcggatccatacgggtgaaaaaccctttcagtgtaaagagtgcggaaaggctttccacgtgaacgcacacctaatcagacaccagcgaagccacacaggggaaaagccctttcgctgcgtcgagtgcggcaaggggttcagttttagtagtgattacatcattcaccagactgtgcatacatggaagaagccatacatgtgctccgtgtgcggcaaagccttccggtttagttttcagctatcccagcatcagtctgttcactctgagggtaaaagctag

SEQ ID NO: 247448 - DNA, 1758 bp, Artificial Sequence
  Description of Artificial Sequence: Synthetic coding sequence
atgtatgaaggcaaggaaaatgtgtcttttgagttgcagagagatttctctcaagaaacagacttctccgaggcaagtcttcttgaaaagcaacaggaggtgcattctgctggcaatattaagaaagagaagtccaatacaatagatggcacggtcaaagatgaaactagtccagtcgaagagtgcttttttagccagtccagcaatagctatcaatgccacaccattacaggagagcagccaagtggatgcacagggctcgggaaatcaatcagctttgataccaaactcgtgaagcatgaaattattaattcggaggaaaggcccttcaagtgcgaggagttggtggagccctttcgctgtgattcacaactgattcagcaccaagagaataatacggaagaaaagccgtaccagtgcagtgagtgcggaaaggcattcagcattaacgagaagctgatctggcatcaacggctccacagcggggagaagcctttcaaatgcgttgaatgcggaaagtctttctcttattccagccattacattacccatcagactattcactcgggtgaaaaaccgtatcagtgcaagatgtgcggcaaggcttttagtgtcaatggctcgctaagccgccaccagaggatccacactggcgaaaagccttaccagtgtaaagaatgtgggaatggattttcgtgttcttccgcatacatcactcaccagagggtccatactggcgagaaaccgtacgaatgcaatgactgtgggaaggcattcaatgtgaatgctaagttgattcaacaccagcgcattcacacaggtgaaaagccgtatgaatgtaatgaatgcgggaagggttttcgttgcagctctcagctgaggcaacaccaaagcattcacacgggagagaagccatatcagtgcaaggagtgtggcaagggcttcaataacaacactaaactgattcagcatcaaaggattcacacaggggaaaagccttacgagtgtacggaatgcgggaaagctttctcggtcaaggggaaactcatccagcaccagcggattcataccggggagaagccttatgaatgcaacgagtgtggaaaagccttccgctgcaactctcaattccgccaacacctgagaattcacacaggtgagaagccatacgaatgtaatgaatgtggcaaagccttcagcgtcaatggcaaactcatgcggcaccagcgtatccatacaggcgagaagccgttcgagtgcaatgaatgcggaaggtgcttcacctctaagcgcaatctgcttgatcaccatcggattcacacaggagagaaaccttaccagtgcaaggagtgcggaaaggcattcagcataaatgcaaaactgacccgccaccagcggatccatacaggcgagaagccctttaagtgtatggaatgcgagaaagccttctcttgtagcagtaattacatcgtacatcagagaatacacactggagaaaagcctttccagtgcaaggaatgcggcaaggcctttcacgtgaacgcacacctgatcaggcatcaacgttcccatacaggagaaaagccatttcgctgcgtcgagtgtggaaagggcttctccttctcctccgattacattattcatcagacagtgcacacttggaaaaagccatacatgtgctccgtttgtggcaaagcgttcaggtttagcttccagttgtctcagcaccagagtgtgcatagtgaagggaaaagctag

SEQ ID NO: 247449 - DNA, 5538 bp, Artificial Sequence
  Description of Artificial Sequence: Synthetic coding sequence
atgggactctgcggcctcctcgagcgatgctggctccatcacgaccctgacggggtcttgactttgaacgccgaaaacactaactacgcataccaggtgcccaacttccacaagtgtgaaatttgcctcctctctttccctaaggagtctcagttccagagacacatgagagaccacgaacggaatgacaaaccacaccggtgtgaccagtgcccccaaacgtttaacgtagaattcaatctaacactgcataaatgcacacactctggggaggatcctacttgcccagtgtgtaataaaaagttcagccgagtcgccagcctcaaagcccacataatgcttcatgagaaagaggaaaatctgatctgctcggaatgtggggacgaatttactctgcaaagccagcttgcggtgcacatggaggagcaccgccaggaactggccggaacacgccagcacgcgtgcaaggcctgtaagaaggaatttgaaacatccagcgaactgaaggagcatatgaaaactcactacaagattagggtgagtagcacacggtcatacaacagaaacatagaccgctccggctttacctactcttgcccccactgcggtaagacctttcaaaagccctctcagcttactagacacataaggattcataccggggagcgaccctttaagtgttccgagtgcggcaaggcgtttaatcagaagggcgcactccagacacacatgatcaaacatactggagagaagccccatgcttgtgcgttctgccctgccgctttttcccaaaaggggaacctgcagagccatgttcagagggtgcacagcgaagtgaagaatggcccaacatacaactgcactgagtgcagctgtgtcttcaaatctttgggatccctcaacactcacatttccaaaatgcatatgggcggaccacagaacagcacctccagcactgagacagcgcatgtgctcaccgcaacattgtttcagaccctccccctgcagcaaactgaagctcaggccacttccgcctcctctcagccgtcatcacaagcagtgagcgatgtcattcagcaactgctcgagctgtcagagcctgctcccgtggaatccggtcagtcaccccagcctggacagcaactaagcatcaccgtgggtattaaccaggatattctccagcaagcactggagaattccggcctgtcgtctataccagccgctgcccatccaaacgactcatgccatgctaaaacatctgcgcctcatgcccagaatcccgatgtgagctccgtctcgaatgagcagacagacccaaccgatgccgagcaggaaaaggagcaggaatctcctgagaagctggacaaaaaagaaaaaaagatgatcaaaaagaagagtccattccttccaggctccatacgggaggagaatggtgtccgctggcacgtttgcccgtactgcgctaaggaattccggaagcccagtgatctggtacgacacataagaatccatacacatgagaaaccattcaaatgccctcaatgtttcagagcattcgccgtgaagtccacgctcacagcccatatcaaaacccacaccggcataaaagcttttaagtgtcagtattgtatgaagagctttagtacctctggatctttgaaggtgcacatccgtctacacaccggcgttaggccatttgcttgcccacattgtgataagaaattccgaacttctggtcaccggaaaacacatatcgccagccatttcaagcacactgaattaagaaaaatgcggcatcaacggaaaccagcgaaagtgcgtgtagggaagacgaacattccagttcctgatattcccttgcaagaacccatcctgatcacggatctgggtttgatccagccaatacccaagaaccaattttttcagagttacttcaataataattttgtgaacgaagcagacaggccttacaagtgcttctattgtcacagggcgtacaaaaagtcttgccacttgaaacaacacatcaggtcacacacaggagagaagcctttcaagtgttcacagtgcggtcggggatttgtcagcgcaggcgtgctgaaagcgcacattaggactcacacaggtcttaagagttttaaatgtctgatttgtaacggcgcttttacaactggaggatcgctacggaggcacatgggcatccacaacgaccttcgtccctatatgtgtccctattgccagaaaacctttaagaccagcttgaattgcaagaaacacatgaagacccacagatatgaattggcacagcagttacagcaacaccagcaggccgcaagtatagacgacagcactgtggaccagcagtcaatgcaagcctccacacagatgcaggtggagattgaatcggacgagcttcctcagacggccgaggtggtagcagccaaccccgaggccatgctcgacctcgagccccagcacgtcgttggtaccgaagaagcgggtctgggccaacaattggcagaccagccactggaggcggacgaagatggcttcgtagcccctcaggaccctttaagaggacacgtggaccagtttgaagagcaatccccagcccagcaaagctttgagccggctgggctccctcaggggtttacagttaccgacacataccaccaacaacctcaattcccaccagtgcaacagttgcaagattcttccactcttgagtcacaggctctgtccacgtcatttcaccagcaaagcctgttgcaggcccctagcagcgacgggatgaacgtcactaccaggctgatccaggaaagcagccaagaggagttagacctacaggctcaaggatcacagttcctagaggataacgaggaccaaagtcgtaggagctatcgctgtgactactgcaacaaaggattcaaaaaatccagccatcttaaacaacatgtgcgcagtcacacaggagaaaagccgtataaatgcaagctgtgtggaagaggttttgtctcatccggggtgcttaaaagccatgaaaagacccacacaggagtcaaagcttttagctgcagtgtgtgtaacgccagctttacaaccaatggatccttgacccgccatatggccacacacatgtcgatgaagccatataaatgccccttctgtgaggaagggttcaggacaactgtgcactgtaaaaagcacatgaaacgccaccagacagtgccgtctgccgtatcggctactggagagacggaggggggagatatctgcatggaagaagaggaggagcactccgatcggaatgcatcccggaagagtcggcctgaggttattacattcaccgaggaggaaacagctcagctggccaaaataaggccccaggaaagtgcaacagtgtctgaaaaggtgctcgtgcagtcagcggctgaaaaggacaggatttctgagctgcgggataagcaggcagaactccaggatgaacccaagcacgctaattgctgtacatactgtccaaaatcatttaagaaaccttccgatctggttcgccatgttcggatccacaccggcgaaaaaccgtataagtgtgatgagtgtggcaagtcattcactgtcaagagtacactggattgccatgtgaaaacccacactgggcaaaaacttttctcctgtcatgtttgcagcaatgcctttagcacaaagggatccctcaaggttcatatgcgcctccacacaggagctaaacctttcaagtgtcctcattgcgagctgcgattcagaacgtccggccgaaggaagacacacatgcagtttcactataaaccagatcccaagaaggcccgtaaacccatgacgaggtcctcctctgaaggtctgcaaccggtcaacctactaaactcaagctccacggacccaaacgtttttatcatgaataattccgtcctgaccggccagtttgatcagaatctgctacagcccggacttgtgggccaagccatattgcccgcatcagtgtcagccggaggcgatctcaccgtctcgctgacagacggctccctcgcgacattggagggcattcaactgcagctcgccgcaaatctggttggaccaaacgtgcagatttccggcatcgacgccgcttctattaacaatattacacttcagatcgacccctcaatcctgcagcagaccctgcagcaagggaatcttcttgcacagcagctgactggtgagccaggcctggcgcctcaaaattcctcacttcaaacgagcgattcaaccgttcctgcctctgtggtcattcagccaatttcgggattgagcttgcagccgacagtgacatccgctaacctgacgatagggcctctgagtgagcaggattcagtcctgacaacaaatagcagcgggacgcaggatctgacacaggtcatgacgagccagggactagtgtctccgtcggggggacctcacgagatcacactgacaattaacaattccagtttatctcaagtgttagcccaggccgctggacctacagccacttccagcagcggatctccccaggaaatcacactcacaatctctgaacttaataccacgtctggctctttacctagcaccacaccaatgtccccctcagccattagtacacaaaacctggtgatgtctagcagcggagtcggtggggacgcctccgttacattgactttggcggacactcaggggatgctgtctggaggccttgacactgtgactctcaatattactagtcaggggcagcagttcccagcactgctaaccgacccatccctgtctggacagggaggggctggatcaccgcaggtgatcctcgtttcccacactccacagtccgcctcagcagcctgcgaggagattgcctatcaagtggcgggagtttccggaaatctcgctccgggtaatcaacccgaaaaagaaggacgagcacatcagtgtctggaatgcgatcgcgcatttagttcagccgctgtgctaatgcatcattccaaggaagttcacggacgagagagaatccatggttgtcccgtctgccgaaaggcatttaagagagctactcacctcaaggaacatatgcagactcatcaggccggacccagtctgagctcccagaaacctagggttttcaagtgtgatacttgcgaaaaagcgtttgctaagccctcccagctggagagacactccagaattcacacaggagagcgcccttttcattgtacattatgtgaaaaagcattcaatcagaaatctgccttgcaagtccatatgaagaagcacactggcgaaaggccttacaaatgtgcatactgcgttatgggtttcactcagaaaagcaacatgaagctgcacatgaaacgtgctcactcttatgctggcgcactccaggagtctgccggtcaccccgaacaggacggcgaggaactctctaggactctgcatctggaagaagtcgtacaggaggctgccggagagtggcaggcactgacccacgtgttctaa

SEQ ID NO: 247450 - DNA, 4677 bp, Artificial Sequence
  Description of Artificial Sequence: Synthetic coding sequence
atgggcctgtgcggcttgctagaacgctgctggctacatcacgatcccgatggcgttctaaccttgaacgctgagaacaccaactatgcttaccaggttccaaactttcataaatgtgagatctgcctactcagcttccccaaagagtcgcagttccagcggcatatgcgcgatcacgagaggaacgataagccccaccgatgtgatcagtgccctcagacatttaacgtagagttcaacctaacgctccataaatgcacacattcaggagaggatccgacctgcccagtctgtaacaagaagttcagccgggtagcctccctcaaggcacatatcatgcttcatgaaaaagaggagaatcttatctgctccgagtgcggagatgaattcaccctccagagccagttagccgtgcacatggaggagcatagacaggagctggccggtacccgacagcatgcttgtaaggcatgtaagaaggagtttgagacaagcagcgagctgaaggaacatatgaaaactcactacaagataagggtgtccagcacccgatcctacaacaggaacattgatcgctctggatttacttactcatgcccccattgtgggaagacctttcagaagccttcccaattaacacgacatattaggatacatactggggagaggccgtttaaatgttccgaatgcgggaaagccttcaaccagaaaggggctctacagacgcacatgatcaaacatacaggggaaaaaccgcatgcgtgcgcgttctgccctgccgctttcagccaaaaaggcaaccttcagagccacgtacagcgggtgcactccgaagtcaagaacggcccaacttataattgtactgagtgctcctgcgttttcaagtctctcggatccctgaatacacacatatccaagatgcacatgggcggaccacagaacagcaccagtagtacagagactgcccatgtgttgactgcgaccctgttccaaaccttgcccctgcaacagacagaggctcaagccacctcagcctcttcacaaccttcaagccaggcggtgtccgacgtcatccagcaacttcttgagctgagcgagcccgcacctgtggaatccggacagagcccccagccgggacaacaattgtctattaccgtgggaattaaccaggacattctgcaacaagcgctggagaattctggactttccagcatccctgcggctgcccacccaaatgacagttgccatgcgaagacatcggccccacatgcccaaaatcccgacgtaagctcggtgagcaacgaacagacagacccaaccgacgctgaacaagagaaggagcaggaaagccccgaaaagcttgataagaaggagaaaaagatgatcaagaagaagagcccattcttacctgggagcatccgggaagaaaatggcgtgcggtggcacgtgtgtccttattgcgccaaggaattccgcaaaccctccgacttagtcagacacataaggattcatacacacgagaagccattcaaatgcccccaatgtttccgggcatttgccgtcaagtccacacttacagcccacataaaaacccacaccggtatcaaagcctttaaatgtcagtattgtatgaaaagcttcagtactagcggaagcctgaaggtccacatccgtcttcacaccggagtgcgtccattcgcttgcccgcattgcgacaaaaaatttcggacctctgggcaccgaaagactcatatcgctagtcactttaagcacaccgagcttagaaaaatgagacatcagcgcaagccagctaaagtccgcgtgggcaagactaatatccccgtgcccgatatccctctgcaagagcccatcctgatcacagatttgggtctgatacaacctattcccaagaaccaattcttccaatcatacttcaacaataacttcgtgaacgaagcagatcggccttataagtgcttttattgccaccgagcctacaagaagagttgtcacctgaaacagcatatccgatcgcatacaggggaaaagccatttaagtgttcccagtgcggacgcggttttgtgtcagcaggggtgctgaaggcccacatcagaacccacacggggctgaaaagctttaagtgtcttatttgcaatggagccttcactaccggcggaagtctgcgacgtcacatgggcattcacaatgatctgagaccatacatgtgtccctattgtcagaaaactttcaaaacttcacttaattgcaagaagcacatgaagacccaccgctatgaactggctcagcagttacaacagcatcagcaagccgcatcaatcgatgatagcactgtagaccagcagtccatgcaggcttccacacagatgcaggtggagattgagagtgacgaactgccgcagacggcggaggtggtggcagctaaccccgaagccatgttggatcttgaaccgcagcacgtggttggcactgaggaggcaggtttaggacaacagctcgcggatcagcccctagaggctgacgaagacggcttcgtcgctccgcaggatcccctgcgtggccacgtggatcaatttgaagagcagtccccagcacagcagtccttcgagcccgcaggcctcccccaaggatttacagtaaccgacacctaccaccagcagccacagtttccacccgtgcaacagttgcaagatagtagcaccttagaatcgcaagcattaagtactagcttccaccagcaaagcctgttacaggcaccctcttccgacgggatgaacgtaacaactcgtctcatccaggagtctagccaggaagagctggacctccaagcacagggcagtcagtttcttgaagacaatgaggaccaatctcggagaagctataggtgcgattattgcaacaagggctttaagaaatcgtcccatctgaagcagcatgttaggagccacacaggtgagaagccctataaatgcaagttgtgcggaagaggtttcgtgtcaagtggcgtgctgaagtcacatgagaagacccacacgggcgtgaaggcatttagctgttcagtatgcaatgcgtcattcaccacaaacggctctctgactcgccatatggcgactcatatgagcatgaagccctacaaatgccccttctgcgaggaggggtttcgaacaacagttcactgtaagaagcacatgaagcggcatcagacagtgccctctgccgtctccgctaccggcgagaccgagggaggcgacatatgtatggaggaggaagaagagcacagcgatcgaaatgcttctaggaagagccgcccagaagtgataacctttaccgaggaagaaaccgcacagcttgcgaagatccgaccgcaggagagtgccactgtgagcgaaaaggtactggtgcagagcgccgctgaaaaagaccggatctccgaactgagggacaaacaagcagagcttcaggatgaacctaagcatgcgaactgctgcacctattgccccaagtcgtttaaaaagccctctgatctcgtgcggcacgtgcggatccatactggcgagaaaccctataaatgcgatgagtgtggtaagtcctttacggtgaaatcgactctggattgccacgtcaagactcataccggacagaagttgttcagctgccatgtgtgctcaaacgcattttcaacaaaagggtcattaaaagtccatatgagactccacaccggcgctaagccatttaagtgcccccactgcgagctgcgatttagaaccagcgggcgacggaagacacacatgcagtttcactacaaacctgatccgaagaaggccaggaagcctatgacgaggtcttcctccgaaggactccaacctgtgaatctgcttaacagctcatcaaccgaccccaacgtgtttatcatgaacaactcagtccttaccggccagttcgatcagaatctgctccagccgggattggtagggcaggccatactgccagcctcggtttcagcgggaggagatctgaccgtcagtctgactgacggttcactggcaaccctcgagggcatccagctgcagctagcggcaaatcttgtgggcccaaacgttcaaatctcaggcattgacgccgcaagtattaataatatcacgcttcagattgatccaagcatattacagcagaccttacagcagggcaatttactcgcccagcagttaacaggtgaacccggactggcaccgcagaacagctctctgcagacctctgattccacggttccagccagcgtagtgatccaacctataagcggcctgtccctgcagcccacagtcacatcagcgaacctgacaatcggaccgctgagcgagcaggattcagtcctgactacaaattctagcggcactcaggatctgactcaggtcatgaccagtcaggggctggtctccccgtctggcggaccgcacgagatcactttgaccattaacaattctagtctcagccaggtgctggcacaggccgctggacctactgctacgtcttcttcaggctcacctcaggaaatcactcttacaattagtggctctcgtagtgtgcagcactccgtgggacctcaagagtgcggcagtgtcgaagcactgtatctggagaacagcagtgacaaaacctag

SEQ ID NO: 247451 - DNA, 4676 bp, Artificial Sequence
  Description of Artificial Sequence: Synthetic coding sequence
atgggtctgtgcgggctgttagagagatgctggctgcaccatgaccctgatggggtcctgaccttgaacgcggagaacaccaactacgcttaccaggtgcctaacttccataagtgtgagatatgcttgctgagcttccccaaagagtcccaatttcagcggcatatgcgagaccacgagaggaacgataaacctcacaggtgcgatcagtgcccgcagacattcaatgtcgagtttaacttgaccctccacaagtgtacacactccggagaagacccgacttgccctgtgtgtaacaaaaagtttagcagagtggcttcactgaaagcacatatcatgctgcatgaaaaagaggagaacttgatctgtagtgagtgtggcgacgagtttacgctccaatcccaactggccgtccatatggaggagcatagacaagagctcgctggcacccgccagcatgcatgcaaagcctgtaagaaggagttcgaaacgtcatcggagctgaaagaacatatgaagacccactacaaaatccgggtgagctcaacgcggagctataataggaacatcgacagaagcggctttacatatagttgcccccactgcggcaagacgttccagaaacctagtcagctcacaaggcatatcagaattcacacaggcgaacgtcctttcaaatgtagtgaatgtggtaaggccttcaatcagaagggagcactgcagactcatatgattaagcacactggagagaagccccacgcgtgtgccttctgtcccgctgcatttagccagaagggcaatctgcagtcacacgtgcaacgagtacactccgaagttaaaaacggtcccacttacaactgcaccgagtgctcatgtgtgtttaaaagcctggggagtctcaacacccacattagcaagatgcacatgggaggcccacagaattcaacatcctccactgagaccgcccacgtgctgacggccacactctttcagacgcttccattgcaacagactgaggcccaggccactagcgcctctagccagccctcctcacaggccgtttctgatgtcatccagcagttgctggaattaagcgagcctgcgcctgtagaatccggccagtctccccagccaggccagcagctttccatcactgtgggaatcaaccaggacatcctacagcaggcgctagagaactctggcctgtcctctatccccgctgctgcacatccaaatgactcatgccacgctaagacctcagcacctcacgcccagaaccctgacgtgagctcagtttccaacgagcagactgatccgacagatgctgagcaggagaaagaacaggagtcccctgagaaactggacaagaaggagaaaaagatgatcaaaaagaagtctccgttcctgcccggatctatcagagaggaaaacggggtccgctggcacgtctgtccctattgcgccaaagaatttaggaaaccgagcgatctagtgaggcacatacggatccacacacatgagaagccatttaagtgccctcagtgcttccgcgcatttgcagttaaatccacccttaccgcccatatcaaaacccacactggcataaaggccttcaagtgccagtattgtatgaaaagttttagcactagtggatctctgaaagtccatatacggctgcataccggcgtgcgtccattcgcctgcccccactgtgataagaaattcagaacgagcggtcaccgcaaaacccatattgcctctcattttaaacacactgagctaagaaagatgaggcatcagagaaaacctgccaaggtacgagtgggcaaaaccaacattcctgttcccgacatcccattacaagaaccgatactgattacagatcttggccttattcagcccataccaaaaaaccagttttttcagtcttacttcaataataattttgtgaatgaagcagatcgaccctacaagtgcttctactgtcacagagcctacaaaaaatcttgtcacctcaagcagcatattcggagccataccggcgaaaaaccctttaaatgttcccagtgtggccgtggctttgtctctgctggggtattgaaggcacacataaggacacatactggtctcaaatcttttaaatgcctgatctgtaacggcgcatttactaccgggggtagtcttagaaggcatatgggcatccataatgatttacgaccttatatgtgcccctattgccagaaaacctttaagacaagcctcaactgcaagaaacacatgaagacccacagatacgagctggcgcaacagctgcagcaacaccagcaggccgctagcattgatgatagcacagtggaccagcagtcgatgcaagcatctacccagatgcaagttgaaattgagtcagacgagctgccgcagacagcagaagtggtggcggctaacccagaggccatgcttgacctcgaaccccaacacgtggttggcacggaggaggccggacttggtcagcagttagcagaccagcctttggaggccgatgaagacggattcgtagcgcctcaggaccctctacggggtcatgtcgatcagttcgaagaacagtccccagctcagcagtccttcgagccagctggtctgccacagggcttcacagtaacagacacctaccatcaacagccacaatttcctccggtccagcagctccaggactccagcacactcgagagccaggcactgagtacttcgttccaccagcaatcgctgctacaggctccttcctccgacggtatgaacgtgactactaggttaatccaagaatcatcccaggaagaacttgatctacaggctcaggggtcacagttcctggaagataacgaggatcagtcacggaggtcctatagatgtgactactgcaacaaagggtttaagaagagttcccacctgaaacagcatgtgaggagccacactggggaaaaaccctacaaatgcaagttatgcggccgtgggttcgtctcatcaggcgtgctgaaatctcacgagaaaacccacactggcgttaaggcattcagttgtagcgtttgtaacgcctcttttacaaccaatgggagtctcacacgacacatggccactcatatgagtatgaagccgtataaatgccccttttgcgaagaagggttcaggacaactgtccattgtaagaagcatatgaaaaggcatcagaccgtgccttcagccgtctctgccacaggcgaaaccgaaggcggagacatctgcatggaggaagaggaggagcactcggacaggaacgcctcacgtaagagccgccctgaggtgataactttcactgaagaagaaaccgctcagctggccaaaatccgacctcaggagagcgctaccgtcagtgagaaggtgctggtgcaaagcgcggcagaaaaagacaggatctcagaactccgggataaacaggccgagttgcaggatgagcctaagcacgcaaactgctgcacatattgcccaaaatctttcaaaaagcccagcgacctggtgcgccacgtcagaatccacactggcgaaaaaccttataagtgtgatgagtgcggtaagagctttaccgtcaaaagcactctcgattgccacgtgaaaacgcataccgggcagaagctgtttagttgccatgtgtgtagcaacgctttctcgacaaaggggtccctgaaggtgcacatgagattgcataccggcgcaaaaccttttaaatgccctcattgtgagctgcgttttagaacctcaggaaggcggaagacacacatgcagttccactacaagcccgaccccaagaaggcgaggaagccaatgacgagaagcagctccgaaggtcttcaacctgttaatctgttgaactcaagctctactgacccaaatgtgttcatcatgaataatagcgtccttacagggcaattcgaccaaaacttgttgcagcctgggctcgtagggcaggcaatcctgcctgcctctgtgtctgccggaggcgatctcaccgtttcacttactgacgggtcattagccactctcgagggaatacagttgcagcttgccgcaaatctggtcggtcctaatgtacagattagcggtatcgacgcagcatcaatcaacaatatcactctgcagatcgatccaagcatcctgcaacaaactctgcaacaggggaacctgctagcacagcagctcaccggcgagcctggactggccccacagaacagtagcctgcagacctccgactccactgtacctgccagcgtggtaatccagccaattagtggattaagtctgcagcccacggtaacaagtgctaacttaactattgggccactctccgaacaggattccgtcctgacaactaatagtagcgggacacaggacttaacacaggttatgacctcacaggggttggtctcacccagcggcggtcctcatgagattacactcaccataaacaattcatccttgtctcaggtcctcgcgcaggcagcgggacctacggccacctccagtagtggctcacctcaagaaattactctgaccatatccggctctaggtccgtccagcactccgtggggccacaggagtgcggatccgtcgaggcattgtatctggagaattcttctgacaaaacgta

SEQ ID NO: 247452 - DNA, 1596 bp, Artificial Sequence
  Description of Artificial Sequence: Synthetic coding sequence
atgtgtcctaagggatacgaggattctatggaatttcctgatcattctaggcacctcctgcaatgcctgagcgagcaaaggcaccagggatttctctgcgactgtaccgtgctcgttggcgacgctcagtttagagctcacagagccgtgctggccagttgttccatgtactttcacctgttctataaggatcagctggacaagagggacatagtgcacctcaattctgacatcgtgacggcccctgccttcgcactcctcctcgagtttatgtatgagggcaagctgcagtttaaggaccttcccatcgaagatgtgcttgctgctgcgagttatctccacatgtatgatattgttaaagtctgtaagaaaaaactcaaagagaaggcaactacagaggctgattctactaagaaggaggaggacgcctcatcgtgttccgacaaagtcgagagcctctctgatggatcgagccatattgcgggtgatctgccatctgacgaagatgagggggaagatgaaaaactgaacatcctgccgtccaaaagagacctggcagctgagccgggtaatatgtggatgagattaccctccgacagcgccggaattccccaggccggaggcgaggctgaaccacacgccacagccgctggcaagacagtggccagcccctgctccagcactgagtctctcagccagagatctgtgactagtgtcagagatagcgccgacgtggattgtgtgttggacttgtctgtaaagtctagtctgtcgggcgtggagaatctgaacagcagctacttctcgtctcaggacgtactcaggagtaacctggtccaagtgaaggttgaaaaagaggctagctgtgacgagagtgatgtgggtactaacgattacgatatggaacactctaccgttaaagaaagtgtctcaaccaacaacagagtgcaatatgagcccgctcacttagcccctttgcgagaagactcagtactgcgggagctcgacagggaagataaagcgagcgacgatgaaatgatgacaccggagtcagaacgcgtgcaggtggagggaggtatggagagttcgttactgccttacgtgtccaatatcctttcaccggctggacagatcttcatgtgccccctttgcaacaaagttttccccagtccacatatcctccaaatccacctgtcaactcatttcagagaacaggacgggatcaggtcgaagccggctgctgacgtgaatgttcctacatgctctctgtgtggcaaaaccttctcctgtatgtataccctgaagcgacatgagaggacccacagtggggagaaaccatacacatgcactcagtgtggcaagtcctttcagtatagtcacaatctaagcaggcacgccgtggtgcacacgagagagaagccccacgcttgcaaatggtgtgaaaggagatttacgcagagtggcgacctgtataggcatatccggaaattccactgtgagctggtgaactccctctccgtgaaatctgaagcgctgtcactgccaactgttagagattggacgctggaggattcttcccaggaattatggaaatag

SEQ ID NO: 247453 - DNA, 1464 bp, Artificial Sequence
  Description of Artificial Sequence: Synthetic coding sequence
atgtgtcctaagggttatgaagactcaatggagtttccagaccactcccgccacctcctgcagtgcttatctgagcagcggcaccaaggattcctctgtgattgcacagtgctggtcggggatgcgcagtttagagcccaccgcgcagttctcgcctcatgtagcatgtatttccatcttttttataaagatcagctggataaaagggacatagtgcatctcaactccgatatcgttacagctcctgcattcgcccttttgctagaattcatgtacgagggcaagctgcagttcaaggatctccccattgaggacgtgcttgctgccgcatcttacctccacatgtatgacatcgttaaggtctgcaaaaaaaaactgaaggagaaggccacaaccgaggccgacagcaccaaaaaggaagaggacgcttcctcttgctctgacaaagtagagtctctgagtgatgggtcctctcatattgccggtgacctgccaagcgacgaggacgaaggggaagatgagaaactgaacatattacctagtaagcgagatctcgcagcggagcccggtaacatgtggatgagactgccatcagacagcgccggaattccccaggcgggtggggaagcagagcctcacgccacagctgccggtaagacggtggcgagtccttgtagcagcaccgagtctctgagtcagagatcagtgaccagcgtaagagacagcgccgacgttgactgcgtgctggatcttagcgtgaagagctcactgtcaggagtagaaaatctcaattcttcatacttttcttcacaggacgttctgagatcaaatttagtgcaggtgaaggtagagaaagaggcctcatgcgacgagagcgacgtgggcactaacgactatgacatggagcacagcacagtgaaagaaagcgtgtccacaaacaatagagtgcagtacgaaccagcgcatctggcccctctccgggaggactctgtgctgcgtgaactggacagagaggataaggcatccgatgatgagatgatgacccccgagtcagagcgcgtacaggtggaaggcggaatggagagcagcctactgccctatgtaagtaacatcttatcccccgcagggcagatatttatgtgccctctttgcaataaagtgttcccctctcctcatattcttcagatccatcttagtacacactttcgagaacaggatggaattagatcaaagccagctgcagacgtcaatgtacctacctgttctctctgtggtaagaccttttcttgcatgtatactttgaagagacacgaacgcactcatagtggagagaagccctacacctgcacccagtgcgggaagtccttccagtactctcacaatctgagtagacttcaagttgtgagggcccaggtccacgccgtaaggggcccagtgcagactcactcccaggtgcccctgtag

SEQ ID NO: 247454 - DNA, 1377 bp, Artificial Sequence
  Description of Artificial Sequence: Synthetic coding sequence
atggcaagcacgattaccggatctcaagactgtattgtaaatcatcggggagaggtcgacggtgaaccagaactcgatatctccccctgtcagcagtggggcgaggcctcatccccaatttcccgtaacagggatagcgtgatgaccctgcagtccggatgtttcgagaatatagagtctgaaacctatctgcctcttaaggtgtcaagtcagatagacacacaggatagcagtgtcaagttctgtaagaatgaaccgcaggaccaccaggaatcacgaaggcttttcgttatggaggaatcaactgaacgcaaagtgatcaagggagagtcctgtagcgaaaatctccaggtgaaactggtgtcagacggccaggaacttgcatctccgctgctgaacggggaagcgacctgtcagaatggccagttgaaggaaagtttagatcccattgattgcaattgcaaggatattcatggctggaagtctcaggtggtgtcttgcagccaacagcgtgcacacacggaagagaaaccttgtgaccacaacaattgtggcaaaatactgaacactagccctgacggacacccttacgagaagatccacaccgcagaaaagcagtatgaatgcagccagtgcggcaagaacttctcacagagttcagaactgttgttgcaccagcgagaccacaccgaggagaaaccttataagtgtgagcagtgcgggaaaggcttcacccgcagcagctcactgctgatccaccaggctgttcacacagatgaaaaaccttataagtgcgataaatgcggtaagggattcacccggtcgtccagcctgctaatccatcacgctgtccataccggcgagaaaccctataaatgcgataagtgcggcaaaggctttagccagtctagtaaattacacatccaccaaagagtacacactggggagaagccctatgagtgtgaggaatgcgggatgtcattttcacagcgctctaacctccatatacaccaacgcgttcacactggagagagaccttacaagtgcggtgaatgcggtaagggctttagtcagtcttcgaacttgcatattcacagatgcattcataccggggagaagccctaccagtgttacgaatgcggaaaaggcttttcacagagctccgacctgcggattcatttacgtgtacataccggggaaaaaccctaccattgtgggaaatgcggcaaggggttctctcagtcatccaaactgcttatccaccagcgcgtgcacaccggcgaaaaaccatatgagtgctctaagtgcggaaaagggtttagtcagtccagtaacctacatatccaccagagagtgcacaaaaaggatcctaggtag

SEQ ID NO: 247455 - DNA, 1377 bp, Artificial Sequence
  Description of Artificial Sequence: Synthetic coding sequence
atggcctcaacgatcactggcagccaagactgtattgtaaaccaccggggagaagtagacggcgagcctgagctggacatctcaccctgccagcagtggggggaggcttcctctccgatcagtaggaatagagatagtgtgatgacacttcagtctggctgctttgagaatatcgagtcagagacgtatctaccactgaaagtcagtagccagatagacacacaggactcctctgtcaaattttgcaagaatgaaccccaggatcatcaagaatctcggaggttgtttgtgatggaagagagcacagagcgcaaagtgattaagggcgagtcttgtagtgaaaatctccaggtcaaactggtgagcgatggtcaggagctagccagccccctgttgaacggcgaagctacctgccaaaacgggcaattgaaggagtccctcgatccaattgattgcaactgtaaggacatccatggttggaagagccaggtggtcagctgcagccagcagcgcgcacataccgaggagaaaccatgtgaccacaataactgcggcaagatcctgaacacctcccctgatggccacccctatgaaaagatccacactgccgaaaagcaatatgaatgctcacagtgtggcaagaacttcagccaatcgtcagagctcctgctccaccagcgagatcatacagaggaaaaaccgtacaagtgtgagcagtgcgggaaagggtttactcgttcatcttccctgctcatccaccaggctgttcatactgacgaaaagccttataaatgcgacaaatgcggaaaggggttcacccggagcagcagcctcttgattcaccatgccgtgcacactggggagaagccttataaatgtgataagtgcggaaagggattttctcaatctagtaagctccatatccatcaacgggtgcataccggggagaaaccatatgagtgcgaagagtgcggtatgagtttttcccaacggtctaacttgcatattcatcaaagggtccacacaggggaacgcccatataaatgcggcgagtgtggcaagggcttctcacaaagttccaatttacatatacatcgatgcatccacacaggggaaaagccctaccagtgttacgagtgtggaaagggattttctcagtcatcggacctgcgaattcatctccgcgtgcacaccggcgaaaaaccataccactgcggaaaatgcggcaagggttttagtcagagctcaaagcttctgatccatcagagggtgcatacaggtgaaaagccttacgagtgcagcaaatgtggcaagggatttagtcagtcatctaatttgcatatccatcaaagagtgcataagaaagaccccaggtag

SEQ ID NO: 247456 - DNA, 1377 bp, Artificial Sequence
  Description of Artificial Sequence: Synthetic coding sequence
atggctagcacaatcacagggagccaggattgcatagtaaaccatcgtggcgaagtcgatggcgagcccgagttggatatttcgccctgtcaacaatggggtgaggcttcttcccccatctcacgaaacagggatagcgtgatgaccctgcagtcagggtgctttgagaacattgaatccgaaacatatctccctctgaaagtgtcatcccagatcgatacacaggactcttctgttaaattttgtaagaacgagccccaagaccaccaggagagtcggagactattcgtgatggaggagagcaccgaacgcaaggtgatcaaaggggaaagttgttctgagaacctgcaggtgaagttagtgtccgatgggcaagagctcgccagccctctgctcaatggagaggctacatgccaaaatggccagcttaaggagagcctggatcctatcgattgtaattgcaaggatatacatgggtggaaatcccaagtcgtgtcttgttcgcagcaacgggcacacaccgaggagaagccatgcgatcacaacaattgcggcaaaatcctgaacacaagtcccgacggccacccttatgaaaagatacacactgcggagaaacaatatgaatgctctcaatgcggcaaaaacttttcccagagtagcgagctgcttctgcatcagagggaccatacagaggagaaaccatataagtgtgagcagtgcgggaagggatttacccgtagcagtagcttgctcattcaccaagcagttcataccgatgaaaaaccctacaaatgcgataagtgcggcaaagggttcacccgcagttcctccttactgatccaccacgccgtgcataccggtgagaaaccatacaaatgcgataaatgcggcaaaggattcagccaatcctccaagctgcacatccatcagagggtccacacaggagagaagccgtacgagtgtgaagagtgcgggatgtcattctcccagcgtagcaacctccatatccaccaacgcgtgcacaccggggaacggccttacaaatgtggagagtgtggcaaaggattcagtcagagtagcaatctccatatccacagatgcattcacaccggtgaaaagccgtatcaatgctatgagtgtggaaagggctttagtcaatcttctgacctgcgtatacaccttcgagtgcatacaggggaaaaaccataccactgtggaaaatgtggcaaggggtttagtcagtcttcaaaattgttaatccatcagcgtgtgcacacgggggaaaaaccctacgaatgctcaaaatgcggcaaggggttttcacagagtagcaatctccacatccatcaaagggtccataagaaggacccacggtag

SEQ ID NO: 247457 - DNA, 1377 bp, Artificial Sequence
  Description of Artificial Sequence: Synthetic coding sequence
atggcaagcacaattaccggctctcaagattgtattgtgaatcaccgcggagaggtagacggggaacctgagcttgacatctctccatgccagcagtggggagaggcctcatcccctatttcccggaacagagattcagttatgactcttcagagcggctgcttcgagaatatagaatcagagacctacttaccactgaaagtgtccagccaaatcgacacacaggattccagcgtaaagttctgcaagaatgagcctcaagatcaccaggaatcacgcagactgttcgtcatggaagaatcaaccgaacgcaaggtgatcaaaggcgagagctgcagtgagaatctgcaggtgaagcttgtcagtgacggccaggaactagcctcacccctgctgaatggagaagccacttgtcagaacggacaactgaaagaaagcctggaccctatcgattgtaactgcaaagacattcacggatggaagtcccaggtcgtcagctgttctcaacagcgggctcacaccgaagaaaagccctgcgatcacaacaattgtggcaaaatcctcaataccagccccgacggccatccgtacgaaaagattcacactgcagaaaaacagtatgagtgctctcaatgtggtaagaatttctcacagtcctccgagctgcttctgcatcaacgtgaccatacagaagaaaagccatataagtgtgagcaatgcggcaaagggttcacccggtcaagctctctgttgatacaccaggccgtgcatacagatgagaaaccctacaagtgcgacaagtgcgggaaggggtttacgagatctagttctctgctcattcatcacgccgtccacactggcgaaaaaccttataagtgtgataagtgcggaaagggattcagccagagctctaagctgcacatacatcagcgggttcatactggggaaaaaccttatgaatgtgaggagtgcgggatgagtttttctcagagaagtaacctccatatccaccaaagggttcacaccggggaacgaccctacaagtgtggcgagtgtgggaagggtttttcacaaagcagcaacctccatattcatcgctgtattcacacaggagagaagccctaccagtgctatgagtgcggaaaagggttctcacagtcctctgacctgcggattcacctgagggtgcacactggggagaagccataccactgcggaaagtgtggcaaaggattctcccagtcatctaagctgctcattcaccaacgggtgcatacaggagagaaaccttacgagtgtagtaaatgcggaaaaggcttttctcagagttcaaacctccatattcatcagcgcgtccacaaaaaagacccccgttag

SEQ ID NO: 247458 - DNA, 1377 bp, Artificial Sequence
  Description of Artificial Sequence: Synthetic coding sequence
atggcttctaccatcactgggagccaagattgtattgtgaaccatcgaggagaggtggacggtgagcccgagctggatatcagcccatgccagcagtggggcgaggcgagcagccccattagcaggaaccgtgatagtgttatgacactgcagtccggttgcttcgagaacattgaaagtgagacttacctacctcttaaggtcagctctcagatagacacacaggactcaagcgttaaattttgtaagaacgagccccaggatcaccaagagagtaggagactgttcgtgatggaggagtctaccgagagaaaagtcattaagggcgaaagttgcagcgaaaacctacaggtgaaactcgtgtccgatgggcaggagctggcctctcctttactcaacggcgaggctacctgtcaaaatggtcagctgaaagagagtcttgatcccatcgactgcaattgtaaggatatccatggctggaagagccaggtagtaagctgtagtcagcagcgcgctcataccgaggaaaagccttgtgaccataacaactgtggaaaaatcctgaatacctccccagatggtcatccttacgagaaaattcacactgcagaaaaacaatacgagtgttcccagtgtgggaagaattttagccaatctagtgaactcttactccatcagcgtgatcacaccgaagagaagccttacaagtgcgaacagtgcggaaaggggttcacacggtcttcatcgttgctgattcatcaagcagtgcacacagacgagaagccatacaaatgcgataagtgcggcaaaggatttacccggagttcttcactgctgattcatcacgctgttcatactggcgagaagccctacaaatgcgacaaatgcgggaagggtttttcccagagtagcaagctgcacattcaccaacgagttcataccggcgaaaaaccatacgagtgtgaggagtgtggaatgtctttctctcagcggtccaacttacatatccaccagcgcgtccacactggagaaagaccgtacaaatgcggggagtgcggaaaggggttttctcagtccagtaacttgcacatacaccgctgcattcacactggcgagaagccgtatcaatgctatgagtgcggcaaggggttttctcagagctccgacctgcgcattcacctgagagtgcataccggggagaagccgtaccattgcggcaagtgtggcaaaggcttctctcaaagctccaaactcctgatccatcaacgggtacatactggggagaaaccctatgagtgctctaaatgcggaaaggggtttagccaaagctccaatctacacatccaccagcgggttcataagaaagaccctagatag

SEQ ID NO: 247459 - DNA, 1107 bp, Artificial Sequence
  Description of Artificial Sequence: Synthetic coding sequence
atgtctgcacagtctgttgaggaagatagcatactcataatcccgactcccgacgaggaggaaaaaatccttcgcgtgaaattagaggaggatcccgatggagaagaaggctcgtcgattccctggaaccatcttcccgatcccgagattttccgccaaagattcagacagtttggctatcaggattctcctggcccaagagaggcggtctctcagctccgggaactgtgtaggttgtggctcagaccagagacccacactaaggagcagattctcgagttagtggtgctggaacagttcgtagcaattctcccaaaagagctccagacctgggtgagagaccatcatccagagaatggcgaggaagccgtgacagtcctggaagacttggagtcggagttggatgacccaggacagcctgttagcttgcggcgaagaaagcgggaggtgctggtagaagacatggtgtcccaggaggaagctcagggactgccctcatcagagttggacgcggtggaaaaccagctgaagtgggcctcatgggaactgcattccctccgacattgtgacgatgacggaaggaccgaaaacggggcactcgctcccaagcaagaactaccttcagccctggaatcccacgaggtgcccggtactctcaacatgggagtgccacagattttcaagtatggcgagacatgttttcctaaaggccgattcgagagaaaacgcaacccatcaagaaaaaagcagcacatctgcgacgaatgcggaaaacatttcagtcagggctcagcactaatactccaccagcggatccattctggagaaaagccttacggctgcgtggagtgtggtaaggctttcagcaggtcatctatcctggtgcaacaccagcgcgtccacactggcgaaaaaccctacaaatgtctggaatgtggtaaagccttcagccagaatagcggccttatcaatcaccaaaggatacatactggtgaaaaaccctacgagtgcgtccagtgcgggaagtcgtatagccaatccagtaatctgttccggcaccagcgccgtcacaacgctgaaaaacttcttaatgtcgtcaaagtatag

SEQ ID NO: 247460 - DNA, 1107 bp, Artificial Sequence
  Description of Artificial Sequence: Synthetic coding sequence
atgtctgcacaaagcgtggaggaggatagcattcttattattcccacacccgacgaggaagagaagatactgcgagttaagttggaggaagatcccgatggtgaggagggatcttccataccctggaatcacctgcccgatcccgagatttttaggcagagattcaggcagtttgggtatcaggattcccccggtcccagggaagctgtgtcccagttgcgagagctttgtcggttatggcttaggccagaaacccacaccaaggagcagattttagagctagtggtgctcgaacagttcgtcgcaatcctcccaaaggagctacaaacatgggtgagggaccaccaccctgagaatggcgaggaggccgtgaccgtcctagaagacctggaaagtgagctggatgatccaggtcagcccgtcagcttgagaagaagaaagcgtgaagtcttggtggaggatatggtcagtcaagaagaagctcaaggtttgcccagcagcgagctagacgcggtcgaaaatcagctgaaatgggcctcatgggagctccatagcttaagacactgtgacgatgatggcagaactgagaatggagcgctggcccctaaacaggaactaccatcggccctagaatcacacgaggttcccggtacactgaatatgggtgtgccccagattttcaagtatggagaaacttgttttccaaagggaaggttcgagagaaagcgtaatccgtctagaaagaagcagcatatttgtgatgaatgcggaaagcacttttcacagggcagcgccctgattctccaccagagaattcactctggcgagaagccttacggctgcgtggagtgtggaaaagccttctcccgatcctccatcttggttcagcaccaacgggtgcatacaggagagaagccgtataagtgccttgaatgtgggaaagcattctcacagaactcggggctgattaaccatcagcgaatccacacgggcgagaaaccctacgagtgcgtccagtgcgggaagtcctactcccaaagctcaaacctttttaggcatcaaaggagacataacgccgagaaattgttaaacgtcgtgaaggtatag

SEQ ID NO: 247461 - DNA, 1371 bp, Artificial Sequence
  Description of Artificial Sequence: Synthetic coding sequence
atgaataagtttcagggacctgtgacgcttaaggatgtaattgtggagtttacaaaagaagaatggaaactcctcacgcctgcacaaaggacactctacaaggacgtcatgctggagaactacagccacctagtgtccgtaggctatcacgttaataaacctaatgccgtcttcaagttaaagcagggcaaggagccatggatcctcgaggttgaatttccccaccgcggtttccctgaagatctgtggtccatccacgacctggaggcacggtaccaggaatcccaagcagggaactcccgaaatggcgagctaaccaaacatcagaagactcacacaactgaaaaagcttgtgagtgtaaagagtgcggaaaattcttttgtcagaagtccgctctgatcgtgcatcagcacacacactcgaaaggcaagtcatatgactgcgataagtgcggcaaaagcttctcgaaaaacgaagacctgatccgacaccaaaagattcacacgagagataagacctacgaatgcaaagaatgtaaaaagattttttatcatcttagcagtctgtcacggcatctgagaacccacgctggggaaaaaccatatgaatgtaaccagtgtgaaaaaagtttttaccagaagccccaccttactgagcaccagaagacacatactggcgagaaacccttcgaatgcaccgagtgcgggaagtttttttatgtcaaggcctacttgatggtgcaccaaaaaacgcacaccggggagaagccctatgagtgcaaggaatgtgggaaggctttcagccagaaatcccacctgaccgtccaccagcggatgcatactggcgagaagccatacaagtgtaaggagtgcggcaaattcttctcacggaactcccatctgaagacacaccagcgcagccacacaggggaaaagccttatgaatgcaaggaatgtagaaaatgcttctaccagaagagtgcgctgacagttcaccaacgaacgcacacgggtgaaaagccatttgagtgcaacaaatgcggcaaaaccttctactacaagtcggatctgacaaagcatcagagaaagcacacaggagaaaaaccctacgagtgtaccgagtgtggcaaatcgttcgcagttaactctgttttgaggcttcaccagagaacccatacaggagagaaaccctatgcttgtaaggaatgtggaaagagttttagtcagaaaagccatttcatcattcatcagcgcaaacacaccggcgaaaaaccctacgagtgtcaggagtgcggggagacgtttatacagaagagtcagctgacggcccaccagaaaacacatactaagaaaaggaatgctgaaaaatag

SEQ ID NO: 247462 - DNA, 1263 bp, Artificial Sequence
  Description of Artificial Sequence: Synthetic coding sequence
atgctcgagaactactcacacctcgtatccgtcggataccacgtgaataagcccaatgccgtgtttaaactgaagcagggtaaggagccttggatcttggaggttgagttcccccatagaggtttcccggaggacctttggtccatccacgatcttgaggccaggtatcaggagtctcaggccggtaattctcggaacggggagctcaccaagcatcagaagacacacacgaccgagaaggcatgcgaatgtaaagaatgcggcaaattcttttgccagaagagcgctctaatcgtccatcagcatacacattccaaaggcaagagctatgattgcgataaatgtgggaaaagctttagtaagaatgaagaccttattcgccatcagaagattcacacccgcgataaaacttacgagtgcaaagagtgtaaaaaaatcttctatcacctaagctcattgagtcgccatctgaggacccatgccggtgaaaaaccctacgagtgtaaccagtgcgaaaagtccttctaccagaagccacatttaacggagcaccagaaaacccatactggcgaaaagccgttcgagtgcacagagtgcggcaagttcttttacgtaaaggcctacctcatggtgcatcagaaaactcatacgggtgagaaaccctatgagtgcaaggagtgtggaaaagcatttagccagaagtcccatttgactgtacaccagcgcatgcacaccggagaaaagccctacaaatgtaaggagtgcggcaagtttttctcccgaaacagtcacctgaaaacccaccaacgatctcacaccggagagaagccctatgaatgcaaggaatgccggaagtgcttttaccagaagtctgctttaaccgtccatcagaggacccacaccggagagaagcctttcgagtgtaataagtgcgggaagacattctactacaagtccgatctgactaagcaccagaggaagcacactggtgagaaaccttacgaatgcaccgaatgcggtaagtcttttgcagtgaattctgtgttacggctgcatcagcgaactcacacaggagaaaagccatatgcttgtaaagaatgcggcaaatccttcagccagaagtcccattttattatacaccagcgaaaacataccggggaaaaaccatatgagtgtcaagaatgcggcgaaacatttatccagaaaagccagctaacagcccatcaaaagacacataccaaaaagagaaacgcagaaaagtag

SEQ ID NO: 247463 - DNA, 1500 bp, Artificial Sequence
  Description of Artificial Sequence: Synthetic coding sequence
atgggacctttgcagtttcgtgacgtggctatcgaattctccctggaggaatggcactgcctggacaccgcccagaggaatctttatagagatgtgatgctagaaaattacagaaatctggtcttcttgggcatcgttgtgtcaaagcccgacctcgttacttgtctcgaacagggcaagaaaccgttgactatggagaggcacgaaatgatcgccaaaccgccagttatgagctcccactttgcccaggacctgtggccggaaaacatacaaaactccttccagatcgggatgctgcgcaggtacgaggaatgtaggcatgataaccttcagctgaaaaaaggatgtaagtccgtgggtgagcataaggtccataaaggtggatataacgggctgaaccagtgtctgacgaccacgcagaaggaaattttccaatgcgataagtacggtaaggtcttccataaattctctaattcaaatacgtacaagacacggcataccggtattaatctgtttaagtgcatcatttgcgggaaggctttcaagcgaagcagtacacttactacacacaaaaagattcataccggcgaaaagccgtacaggtgcgaggaatgtggcaaggcattcaaccagtcagccaacttgaccactcacaaacgcatccatacgggggagaaaccctacaggtgcgaggagtgtggcaaagccttcaaacagagctctaacttgaccacccataagaaaattcataccggcgagaaaccatataagtgtgaagagtgcggaaaagccttcaaccgaagtaccgaccttactacccacaagattgtgcatacaggtgaaaagccctacaagtgcgaggaatgcggaaaagcgttcaagcacccctcccatgtgaccacgcataaaaaaatacacactaggggcaaaccctacaactgtgaagagtgtggcaaaagctttaagcactgtagtaatttaacaatccacaagaggattcacaccggcgaaaagccgtacaaatgtgaggagtgcgggaaggcctttcatctcagcagccatctgaccacacacaaaattctgcacaccggggaaaaaccgtatcgttgtagggaatgcgggaaagctttcaaccactctacgaccctctttagccatgagaagatccacactggcgagaagccttataagtgcgatgaatgcggcaaaacgtttacctggccctcaatcctctccaaacacaaacgtactcacaccggagaaaaaccttacaagtgcgaagagtgcggcaaatcgtttactgctagcagtacactgacgactcataagcgtattcacaccggagaaaagccttacaaatgcgaagaatgcggcaaagcctttaattggagttcagatctcaataaacataaaaaaatccacatagaacggaaaccatacatagtcaaaaatgttactgacctcctgaacgtccccccactgctgatctctatacgctag

SEQ ID NO: 247464 - DNA, 1500 bp, Artificial Sequence
  Description of Artificial Sequence: Synthetic coding sequence
atgggtcctctacagttccgagacgtcgctattgaattctcactggaggagtggcactgtctcgacacggcccagaggaatctgtaccgagatgtcatgttagagaactacagaaatcttgtgtttttggggattgtcgtttcaaaacccgacctggtgacctgcctggagcaggggaagaaacccctgacaatggagcgtcacgagatgatcgccaaacctcccgtcatgtcttcacacttcgcacaggatctgtggcccgagaacatccagaactcctttcaaattgggatgttgcggagatacgaagaatgccggcacgacaacctgcagctaaaaaagggctgtaagagcgtaggggaacataaggtgcacaaggggggatacaatggcctcaaccagtgtttgacaacaactcagaaggaaatcttccagtgtgataagtatggtaaggtctttcataagttcagcaattcaaacacttacaagacccgccacacaggcattaacctctttaagtgcattatttgcgggaaggctttcaaaagaagctccacactcacgactcacaaaaagatccacacgggtgagaagccatacagatgtgaggaatgtggaaaggcttttaaccagagcgccaatctgacaacgcacaagcgaatccacaccggagagaaaccatatcggtgtgaggagtgcggaaaggcatttaaacagtcctctaacttaactacgcacaagaaaatccatactggcgagaagccctataaatgtgaagagtgcgggaaagcctttaaccgctctacagacctcaccacacacaaaattgtgcacacgggagaaaagccctataagtgcgaagagtgcgggaaggctttcaaacaccccagtcatgtcacaactcataagaagattcatacaaggggtaagccgtacaattgcgaagagtgcggaaaaagctttaagcactgttctaatctgactatacacaaacgtatccacactggcgagaagccctataaatgcgaggagtgcggcaaggctttccacctgagctcccatcttaccactcataagatactgcataccggcgagaagccctacaggtgcagagaatgtggtaaggccttcaatcatagtaccacactttttagtcacgaaaaaatccatactggagagaaaccttacaaatgtgatgagtgcgggaaaacctttacgtggccatccatattgtcaaagcacaagagaactcacacgggggagaagccttataaatgtgaggaatgtggcaagagctttacagccagctcaacacttacaactcacaagcgaatccacacaggagaaaagccctacaaatgtgaagagtgtggaaaggcgttcaattggtcttctgatctgaataagcataaaaagatacatatcgaaaggaagccctacatcgttaagaatgtgactgatctcttgaacgttccacctctgctgatcagtatccgttag

SEQ ID NO: 247465 - DNA, 276 bp, Artificial Sequence
  Description of Artificial Sequence: Synthetic coding sequence
atgccaggaccgccacggtccctcgaaatggggctcttgacttttagggacgttgctatcgaatttagcctggaggaatggcaacatctggatatagcccagcaaaacctgtaccgcaacgtgatgctggagaattatcgtaaccttgcattcttgggaatcgctgtgtctaagcccgatctgatcacctgtctggaacaagggaaagaaccgtggaatatgaagcggcacgaaatggtcgatgaacccccaggtctggacttcagcctgctgtag

SEQ ID NO: 247466 - DNA, 1725 bp, Artificial Sequence
  Description of Artificial Sequence: Synthetic coding sequence
atgtgtccccactttgcgcaggatctgtggcccgagcagggtatggaggattcatttcagaaagctatcttgcggcgatacggcaaatatggtcacgagaatctgcagctgaggaaggggtgtaaatccgtggacgagtacaaggtcaacaaggagggatataatggcctaaatcagtgctttaccactgcacagagtaaggtgttccagtgcgataaatatctgaaagttttctataagtttctgaacagtaatcgcccaaagattagacacactgagaaaaaatccttcaaatgcaaaaagcgagttaaattattttgcatgcttagccacaaaacgcagcacaagagtatatatcatagggagaaatcctacaaatgtaaagagtgcggcaagacctttaattggagctcaactttaaccaaccatcgcaaaatttacaccgaggagaaaccatataaatgtgaagagtacaataagtcaccaaagcaactgagtacccttaccacgcacgaaatcatccacgccggtgagaaactgtataagtgtgaagaatgtggagaagcttttaaccgatctagtaacctcactactcacaaaattatccacacaggagagaaaccctacaagtgcgaggaatgtggaaaagcgtttatttggagttccaccctcactgagcacaaaaaaatccacactcgtaaaaagccatacaagtgcgaggaatgcggtaaagcctttatatggtcttcaacattgactcgacacaagagaatgcacactggcgagaagccctacaaatgtgaggaatgcggtaaggcatttagccagtccagtacgctaacaacgcataagattattcatactggggagaagagatacaaatgccttgagtgtggaaaagcttttaaacagttgagtaccctgacaacccacaaaatcattcacgtaggcgaaaagctgtataagtgcgaagaatgcgggaaaggctttaaccgatcaagcaatctaacaacccataagataattcataccggggagaaaccctataaatgcgaagagtgtggcaaagcattcatctggtcttccaccctcacgaaacacaagagaatccatacgcgggaaaagccttataaatgcgaggagtgcgggaaggcgtttatttggtcctcgaccctcacacgccataagcgcatgcacaccggagaaaagccctataagtgcgaggagtgcggaaagagcttcagccagtcctccacgctaacaacccacaaaataattcacactggtgagaaaccttataagtgtgaggaatgcggcaaggcctttaattggagttctacgctaacaaagcataagattattcacactgaagaaaaaccctataaatgcgagaaatgcggtaaggcctttaagcagtcttctatcctaaccaaccacaagagaattcacaccggcgagaaaccatacaagtgtgaagagtgcggcaagagcttcaacagatctagcacatttaccaagcacaaagtgatccacaccggcgtgaaaccatataaatgtgaggaatgcggaaaagcattcttctggagcagtacgctgacaaagcacaagcggatacacaccggcgagcagccctataagtgggaaaaatttggcaaggcgtttaacagatcttctcacctgaccactgataagataacccactggagagagatactgcaagtgtag

SEQ ID NO: 247467 - DNA, 1980 bp, Artificial Sequence
  Description of Artificial Sequence: Synthetic coding sequence
atgcctggccctcccagatcactggagatgggcctgttgacttttagagacgtcgcaatcgagttttcccttgaagagtggcagcaccttgacatcgcacagcagaatttgtacagaaacgtgatgctcgagaattatagaaaccttgctttcctgggcatcgccgttagcaagcctgaccttattacgtgcctggagcagggcaaagaaccgtggaatatgaaaagacacgagatggtggacgagcccccaggaatgtgcccacacttcgcacaggacctctggccagagcagggaatggaagactcttttcagaaagccatcctccgcaggtatgggaagtatgggcacgaaaacctgcagctgcgcaaggggtgcaagtccgtggatgaatacaaagtgaataaagaaggttacaacggacttaatcagtgcttcaccaccgcccagagcaaggtttttcaatgcgataagtacctgaaggtcttctataagttcctcaactctaatcggccaaaaattcggcacaccgaaaagaagtccttcaagtgtaaaaagagggtgaagctcttctgtatgctgtcacataagacacagcacaagtccatctatcatcgagaaaagtcttacaaatgtaaagagtgtggcaaaacattcaactggtctagtacactcactaatcaccgtaagatttatactgaggagaagccctataagtgcgaggagtataataaatccccgaagcagctgtccacactgacaactcatgaaatcatccacgccggagagaaactgtataagtgtgaggagtgcggagaggcatttaatcgttctagtaatcttaccacacataaaatcatacataccggtgagaaaccatacaagtgcgaagagtgtgggaaggcatttatctggagttcaaccttgactgagcacaaaaagattcatactaggaaaaagccatataaatgcgaagaatgtgggaaagctttcatttggtcaagtaccttaactaggcacaaaagaatgcatactggtgagaaaccgtacaagtgcgaagaatgcgggaaggccttcagtcagtccagcacactcacaacgcacaagatcatacacacgggggagaaacgatataagtgcctcgaatgcggtaaggcattcaaacagctcagcaccttgactacgcataaaatcattcacgtcggagagaaactgtacaagtgcgaagagtgtgggaaggggttcaataggtcctcgaatctgaccacacacaagatcattcataccggtgaaaagccttacaagtgtgaggaatgtggaaaagcctttatctggtctagcacccttaccaagcacaagcgtatccatacccgtgagaagccctataaatgcgaagagtgtggcaaggcatttatatggtcatcaaccctgacgcgacacaagagaatgcacaccggagagaaaccctacaaatgtgaggagtgtggaaagtcattctctcagtcctcaaccttaacaactcataaaatcatccacactggggaaaagccttacaagtgcgaagaatgcgggaaagcgttcaactggtcatccaccttgaccaaacacaaaattattcataccgaagagaaaccgtacaaatgcgaaaagtgtgggaaggctttcaagcaaagctccattctgaccaaccacaaaagaattcataccggcgagaagccctataagtgtgaggagtgtggaaaatcgttcaatagaagctccaccttcacaaagcacaaggtgattcacaccggagtgaagccctacaaatgtgaggaatgcgggaaggcctttttttggtctagcaccctcaccaagcataagcgcattcatactggcgagcagccatacaaatgggaaaaatttggaaaggcctttaacaggtcgtcacacctgactactgacaagattacacactggcgggagattttacaggtctag

SEQ ID NO: 247468 - DNA, 1056 bp, Artificial Sequence
  Description of Artificial Sequence: Synthetic coding sequence
atgcccggacccccacgaagtctggaaatgggcttgctaacgttccgggacgttgcaattgagtttagcctcgaggaatggcagcacctcgatatcgctcagcagaacctgtatagaaatgtcatgctggagaattaccgcaatctggctttcctgggtattgccgtgtctaagccagacctcattacttgcttagaacaagggaaggagccatggaacatgaaacgccatgagatggtagacgaaccgccaggtatgtgcccgcattttgcccaggacctatggcccgagcagggcatggaggactcctttcaaaaagccatcttacggcgatacgggaagtacggacacgaaaatcttcaattgaggaaaggttgcaaatcagttgacgagtacaaagtaaataaagaggggtacaacggcctgaatcaatgcttcacgactgctcaaagcaaggtgttccaatgcgacaagtatttaaaagtgttttataaattccttaacagcaatcggccaaaaatacgacatacagagaagaagtcttttaagtgcaagaagcgagtcaaattgttctgcatgctgagccacaaaactcagcacaagagcatataccacagagaaaagtcatacaagtgtaaggagtgcggcaagaccttcaactggagttctacactgaccaaccatcgcaaaatctatacggaggaaaaaccttacaagtgcgaagaatacaataaaagccccaagcagttgagcaccctgacaacccacgagatcatccacgcaggcgagaagctgtacaaatgtgaggagtgtggagaggccttcaaccggagttctacattcacgaagcataaggtcatacatacaggagtgaagccctataagtgcgaggagtgcggcaaggcttttttctggtcctctacgctgacaaagcacaaaaggattcataccggggaacaaccatacaagtgggaaaagttcggcaaagcttttaataggtcttcccatttaaccaccgacaagatcacccattggcgagagattcttcaagtgtag

SEQ ID NO: 247469 - DNA, 1884 bp, Artificial Sequence
  Description of Artificial Sequence: Synthetic coding sequence
atggccgctgctgaattgacggcccctgcgcaaggcatagtgacatttgaagatgtggcagtgtatttcagctggaaagaatggggactgctggatgaagcccagaaatgcctgtaccatgacgtcatgcttgaaaacctgactctcaccacctcactcggaggaagcggggcaggggacgaagaggcgccatatcagcagtctacatcaccgcagcgtgtgtctcaagtgcgtatccccaaggctttgcctagcccccaaaagaccaacccttgtgaaatttgtggcccagttcttcgacagattctccatctggtggaacatcaaggaacccatcacggacaaaagctgtacactgatggagcctgcagaaaacaactccagtttactgcctatctgcatcaacaccagaaacagcacgtcggacagaagcacttccgttctaacgggggacgagacatgttcctcagctcctgcacatttgaagtctcagggaagccatttacttgtaaggaagttggaaaagactttctcgtacggtcccggtttctccagcagcaggcagcccatacaagaaagaagtctaatagaacgaagagtgctgtggcatttcacagcgtcaagaaccattataattggggagagtgtgtgaaggcatttagctacaagcacgtacgcgtgcagcaccaaggagaccttattagggagaggagctacatgtgttctgaatgtggcaagtctttttccacatcatgtagcctgagtgaccatctgcgcgtgcatacatccgagaaaccttacacttgtggagaatgtgggaaatcctatagacaatcttcctcactgataacacacagaagaatccacacaggggttcggcctcaccagtgcgacgagtgtggcaaactcttcaaccggaaatatgatctgctgattcatcagagagttcacaccggggaacgaccctacaagtgttccgagtgtggtaagtccttttcacattcatcttcgcttatcactcatcagcggatccacacaggcatgcggccatatgagtgttccgagtgtgggaaaagttttatacactccagtagcttgatcacacaccagcgggtccacactggtacccggccatacatgtgttcagagtgcggcaagagcttttcccagagctgccatctgatcaagcataggcgcctacacatcggcgagggaccgtacgaatgcagtgagtgcggaaaactgtttacatatcgctcaagattttttcagcaccagcgtgttcacacaggtgtacgctcacatgagtgtcatgagtgcgggaaacttttctcccgaaagtttgatctgatagtgcacgagcgcgtgcatactggcgaaagaccctacgagtgtagtgagtgcgggaaaagttttacatgcaaaagctacttgatttctcactggaaggtacacacaggcgctaggccttacgagtgcggcgaatgcggaaaaagtttcactcacagctcgacacttttgcaacaccagcgcgtccacacaggtgaacgcccatacgagtgtaacgaatgtgggaaattcttcagtcagtcttcctcactgatcagacaccgacgctcccacacaggcgaaaggccatatgagtgcagtgaatgttggaagtccttcagtaatcacagctcactcgtgaaacaccgtcgcgtgcacaccggggagcgtccttatgaatgttcggaatgtgggaagtcctttagccaatctagcaatctcacaaatcatcaaagaatccattctggagagagaccttacgagtgcagtgattgcggcaaattttttacctttaactcgaatttgcttaaacatcagaatgtccacaaaggctag

SEQ ID NO: 247470 - DNA, 1608 bp, Artificial Sequence
  Description of Artificial Sequence: Synthetic coding sequence
atgggccctctgacaatcagggacgttaccgtcgaattttccctggaagagtggcactgtctggacacagctcagcaaaatctctaccgagatgtaatgttggagaattacagaaatctcgtattcctgggtatcgctgtgagtaaacctgatttgatcacatgcctggaacagggaaaggaaccctgtaacatgaagagacacgagatggtggccaaacctccagtgatgtgcagccacatcgccgaggatctctgccctgagagggacatcaagtatttttttcagaaggtgattctgagacgttatgacaaatgcgaacacgagaacttgcagctccggaagggatgcaaaagcgtagatgagtgcaaggtctgcaaaggaggatataatggcctgaatcagtgcctgatcacaactcaatccaaaatgtaccagtgtgacaagtatgtaaaggtgttctacaagttctctaacagtgaccgccataaaatccgtcatactgaaaagaaaacctgtaagtgtaaagagtgcggtaaagcctttaaccagtcctccgccctgacccgccataagatgactcatacaggggagaagccttacaaatgtgaggaatgcggtaaggcattcaataggtccagtcacctgacacagcacaaggttattcacacacgggaaaaaccctataaatgcgaggagtgtggtaaagccttcaatagatctagccatataactcaacacaagcggatccacaaccgagagaagccatttaaatacgacgagtgttgcaaagcatttaagtggtcctctgcgttgactaccttaacccagcataaacgtatccatacaggagagaagccatacaaatgtgaagaatgtggcaaggctttcaaccaaagttctgccctcacgaggcataaaatgatacacacaggtgagaaaccgtttcagtgtgaggagtgcggcaaggctttcaaccgctccagtcaccttacacagcacaagatcattcacactaaggaaaaaccctacaagtgcgaagaatgcggtaaggcctttaatcgcagctctcacctcactaaacataagagaattcatacacgggagaaggcatacaagtgcgacgagtattgcaaggcctttaactggtcttccgcgctgacaacactaacacagcacaagataatccacaccggggaaaagccatataaatgcgaagaatgtggaaaagcctttaacaggtcctcttaccttatcaggcacaaaatcatccacacgggagagaagccttataagtgtgaggagtgtggcaaggccttcaaccagtccagccatctgacccagcacaagatcattcacaccggagagaaaccttataaatgtgaagagtgcggcaaggcctttaaccggagttctcacctttctcagcacaaaatcattcatactggcgagaagccctacaaatgtgaagaatgtgggaagcccttcaacaggttttcctaccttactgtgcataagcggattcacgccggtgaaaatcccaacaagtatgaggaatgcggtaaggcctgcaatcactcgtctaacttgacaaagcataacagctag

SEQ ID NO: 247471 - DNA, 1692 bp, Artificial Sequence
  Description of Artificial Sequence: Synthetic coding sequence
atgggaccgctcacgatccgcgatgttaccgttgaatttagtctggaagaatggcattgtcttgataccgctcagcagaacctgtaccgcgacgtgatgctcgaaaactatagaaatctggtttttcttggcatcgcagtatctaagccggaccttattacatgtctggagcagggcaaagaaccatgcaacatgaaaaggcatgagatggtcgctaagcctcctgtcatgtgttcacatatcgccgaagacctgtgtccagagagagatatcaaatattttttccagaaggtgatactacgtcgatacgataagtgcgagcacgaaaacttgcagctgcgtaaagggtgcaagtccgtagatgaatgcaaagtgtgtaagggcggatataatggacttaaccagtgcctgattactacacagtccaaaatgtaccagtgtgacaagtacgtgaaggtattttataagtttagcaactccgatagacacaagattcgccatactgagaagaaaacgtgcaagtgtaaagaatgtggaaaaagcttctgcatgctgtcccagctgacaagacacaagcgcatccatatccgagagaattcccataagtgcgaagaatgtggaaaagcctttaatcagagctccgccctgactagacataagatgactcacacaggggaaaaaccatacaaatgcgaggaatgcggaaaggccttcaataggagcagtcacctgacccaacataaagtgatccacacccgcgaaaagccatacaagtgcgaagagtgtggaaaagcattcaatcgttcttcacatattacccagcacaaaagaatccataacagggagaagcccttcaagtacgacgagtgctgcaaggccttcaaatggagtagtgccctgaccaccctgacccagcacaagagaatacacactggagagaagccgtataaatgcgaggaatgtggcaaggcatttaaccagagttccgcccttacacgccacaagatgattcacaccggggaaaagccgttccagtgtgaggagtgcggcaaggcttttaacagaagttcccatttgactcagcacaagattattcacaccaaggagaaaccctacaaatgtgaagaatgcggcaaggcattcaaccgcagttctcacctgaccaagcacaaacggatccacaccagggagaaggcttacaagtgcgatgagtattgcaaagctttcaattggagctccgccttgacaacgctaacccagcacaaaatcatccatacgggcgaaaaaccgtataagtgtgaagagtgcggaaaagcattcaacaggagtagttacttgatacggcacaagataattcatactggtgaaaagccatataagtgtgaggaatgtggcaaggcctttaatcagagctcccacctcacacagcacaagatcatccacacaggagagaaaccctataagtgtgaagagtgcggaaaggccttcaatcgctcatctcatttgagccagcacaagattatacatacaggtgagaagccctacaaatgtgaggagtgcggaaaaccctttaatagattttcgtatcttacagttcacaaacggattcacgccggtgaaaaccccaataagtacgaggagtgcggcaaggcctgcaatcacagcagcaacctgacaaagcacaattcatag

SEQ ID NO: 247472 - DNA, 1692 bp, Artificial Sequence
  Description of Artificial Sequence: Synthetic coding sequence
atgggcccactgactatcagagacgtgaccgtggagttctccctcgaagagtggcactgcctcgacactgcccagcagaacctttaccgcgacgtgatgctcgaaaactatagaaacctcgtttttcttggaattgccgtttctaagcccgatctgatcacgtgcctagagcagggtaaggaaccttgtaacatgaaacggcacgaaatggtagccaagcctcccgtgatgtgcagccatatcgctgaagacctgtgccccgaaagggatatcaagtacttctttcagaaagtgattcttcgcagatacgataagtgtgagcacgaaaatctgcagctgcgaaagggttgtaaatcggtagatgaatgtaaggtgtgtaagggcggttacaacggcttgaatcagtgcctcatcaccacgcagtctaagatgtaccagtgtgataaatacgtgaaagtgttctataagtttagtaactcagataggcataaaattaggcatacggaaaagaagacctgtaagtgcaaagaatgtggaaaaagcttttgcatgttgtcacaattgaccaggcataagcgcattcatattcgagaaaatagccacaagtgtgaggagtgcggaaaagcatttaaccagtcctccgctctgacccggcacaagatgacacacaccggagagaagccctacaaatgtgaggagtgcggaaaggctttcaataggagtagccatctgactcaacacaaagtcatccacacgcgcgagaagccatataagtgtgaggaatgcggtaaagcatttaatcgttcttctcacattacccagcacaagagaattcataacagagagaagccctttaagtacgacgagtgttgcaaggcctttaaatggtctagcgcactgaccactctgacgcagcataagagaatacacacaggagagaaaccatataagtgcgaagaatgtggaaaggcctttaaccagtccagtgctttgaccagacataaaatgattcacaccggggagaagccatttcaatgcgaagagtgcggaaaagcctttaatcggtctagtcatttgactcaacataagattattcataccaaggaaaagccctataagtgtgaggaatgtgggaaagctttcaacagaagctcccatttaaccaaacacaagcggattcatacaagggagaaggcttacaagtgtgacgaatactgtaaagcattcaactggtcctccgctctgaccactctgacacaacacaagataattcataccggggaaaagccatacaagtgtgaggaatgtgggaaggcttttaatcgctcatcttaccttatcagacacaaaattatccacactggggagaagccctacaaatgcgaagagtgtgggaaggcgtttaatcagagtagtcatctgactcagcacaagatcatccacaccggcgagaaaccttataagtgcgaggagtgtggcaaggccttcaaccggtcttctcatttgtcacagcacaagataatccacactggagaaaagccgtacaaatgcgaggagtgcgggaaaccattcaacaggttctcctacctcaccgtgcacaagagaatccatgctggcgaaaaccctaataaatacgaggaatgcggcaaggcctgtaaccatagctctaacctcacgaaacataactcctag

SEQ ID NO: 247473 - DNA, 1602 bp, Artificial Sequence
  Description of Artificial Sequence: Synthetic coding sequence
atggccacatcatttagaaccgcctcatgctggggccttttgagcttcaaagatatatccatggagttcacttgggacgagtggcagctcttggattcaactcagaaatacctttaccgagatgtcatcctggagaactatcacaacctgatctcggtcggatatcacggaacaaagcctgatctgatttttaaactggaacaaggggaggatccttggataatcaacgcaaagataagtagacagtcctgtccggacggctgggaagagtggtatcaaaacaaccaggatgagcttgaaagcatcgaaagatcctacgcatgcagcgtactggggaggctgaatttatccaaaacccatgatagttccaggcagaggttgtataatacacgaggaaagtccctcacccaaaactctgccccatcacgctcatatttgcgcaaaaaccctgacaagttccacggatacgaggaaccgtattttctaaaacaccagcgcgctcactccatcgagaaaaactgtgtttgctctgaatgcggcaaagcttttaggtgcaagtcgcaactcattgtacacctccgcatacacacaggtgaacggccttacgaatgttccaagtgtgaacgcgcattcagcgccaaaagtaatttgaacgcccatcagcgcgtgcacacaggcgagaagccctactcctgcagtgaatgtgagaaagtgttttcctttcggagccagttaatcgttcaccaggagattcacactgggggtaaaccatacgggtgctcggaatgtggtaaggcctacagctggaagtcccagctgctattacaccagcgtagccacaccggagtaaaaccttatgagtgctctgagtgtggcaaagccttctcactcaagagcccttttgtggtgcaccagcgaacccatactggtgtcaagccccataaatgttcagagtgcggaaaggccttcaggtctaagtcatatttgcttgtgcacattagaatgcatactggggaaaaaccctatcagtgttctgattgtggaaaggcctttaatatgaagacacagttgattgtccaccagggcgttcatactggcaacaacccataccagtgcggcgaatgcgggaaggcttttgggaggaaagagcagctgaccgcccatctgcgcgcacacgcaggggagaagccctatggttgctccgagtgcgggaaagccttcagctcgaagtcctacctggtcatacacagacggactcataccggagaacgtccctacgaatgttccctctgtgaaagagccttctgtgggaaatcccaacttatcatccaccagcggactcactcgacagaaaaaccctacgaatgcaacgagtgtgagaaagcctacccaagaaaggcgtcactgcagatccaccagaagacgcacagtggcgaaaaaccttttaagtgtagtgaatgcggaaaagcctttacccagaaatcatccttgagtgagcaccaacgggtgcatacaggagaaaagccatggaagtgttcggagtgtggcaaaagtttctgttggaatagcggcctccggatccatcgcaagacccacaaatag

SEQ ID NO: 247474 - DNA, 1542 bp, Artificial Sequence
  Description of Artificial Sequence: Synthetic coding sequence
atggagttcacctgggatgagtggcaactgctggactctacacagaagtacttataccgagatgtgattctggaaaattaccacaatttgatctcagttggataccacggaaccaagcctgacttgatatttaagctcgaacagggcgaagacccctggatcattaacgcaaagatctctagacagagctgccctgatggctgggaggagtggtaccagaacaaccaggatgagctagaaagcatagagaggtcttacgcctgttcggtcctaggccgactgaaccttagtaagacccacgactccagcagacagaggctctacaatacacgcggaaagtctttgacacagaattccgcgccatccagaagctatttgagaaaaaacccagacaagttccacggatacgaggagccatactttctcaaacaccagcgggcacacagcatcgagaagaattgcgtctgttcagaatgtggtaaagcttttcgatgtaagagtcagttgatcgtgcacctgcgaatccacacgggagaaagaccttatgagtgcagcaagtgcgaaagagccttcagcgcgaaaagcaacctgaatgctcatcaaagggtgcacacaggagaaaagccctattcgtgttctgaatgcgagaaagtgttttcattcaggagccagctgattgtgcaccaggagatccacaccggaggtaaaccatatgggtgcagcgagtgcggaaaagcttactcctggaagtcacagctcctgctgcaccagagaagccacaccggtgtcaaaccttatgagtgttccgagtgcggtaaagcatttagcctgaagtccccttttgtcgtacatcagcgcacacacacgggcgttaagcctcacaaatgttcagagtgtggaaaggcttttcgaagtaagagctacttgctagtgcatataaggatgcatacaggcgaaaagccctatcagtgcagtgactgtgggaaggcatttaacatgaagactcagttgattgtgcatcagggcgtgcacaccggaaacaatccctatcagtgtggagaatgtgggaaggcatttgggaggaaggagcaacttaccgcgcacctcagagctcatgctggcgagaaaccatatgggtgcagcgaatgtggcaaggctttcagttcaaaatcctacctggtgatccacaggcggactcacacgggagagcgaccctatgaatgttcactttgtgagagagctttttgcgggaagtctcagctaattatccaccagaggacgcattccacagagaagccctacgaatgtaatgaatgcgaaaaggcttatcctcgaaaggctagtttgcagattcaccagaaaacccatagtggagaaaagccatttaagtgttctgagtgcggaaaagccttcactcaaaagtcatctctttctgaacaccagagggtgcacactggcgaaaagccatggaaatgtagcgagtgcgggaaatcattctgctggaatagtgggctcagaatccaccggaagactcacaagtag

SEQ ID NO: 247475 - DNA, 1239 bp, Artificial Sequence
  Description of Artificial Sequence: Synthetic coding sequence
atgattggcatgttggaatctttgcagcacgagtccgatctgctccagcatgaccagattcacactggggaaaaaccttacgagtgcaatgaatgccgcaagaccttcagcctgaagcagaatctcgtggaacataagaagatgcatacaggggagaagagccatgagtgcacagaatgcggaaaagtgtgctcccgcgtgtcatccctcactctgcatttgagaagccacactggaaaaaaggcgtacaagtgcaacaagtgtggcaaagccttctcacagaaggaaaattttcttagccaccagaaacaccacactggagagaagccctatgagtgtgagaaggtgagtattcaaatgccaaccatcatccggcatcagaagaatcacactggaacaaagccctatgcatgcaaggagtgcgggaaagcctttaacggaaaggcctacctgaccgaacacgaaaagattcacacaggggaaaaaccttttgagtgcaaccagtgtgggcgtgccttctcccagaagcaatacttgatcaaacatcagaatatccatactgggaagaaaccattcaagtgcagtgaatgcggaaaggcctttagtcagaaggagaacttaattattcaccagcgcatccacacaggcgagaagccctacgagtgtaaagggtgcggcaaggcttttatccagaaatccagcctaatcaggcaccagcggtctcatacaggggagaaaccctatacatgtaaggagtgcggcaaagccttctctggaaaatccaacttaacagaacacgagaagattcacatcggcgaaaaaccctataagtgcaatgagtgtgggactatttttcgacagaaacaatatctaattaagcaccataatatacataccggggaaaagccgtacgaatgtaataagtgcgggaaagccttctctagaattacatcactcatcgtgcacgtccggatacatacaggcgacaagccatacgagtgcaaggtttgcggtaaggcattctgccagagcagttccctgaccgtgcatatgcggagtcataccggggagaagccatacgggtgcaatgagtgcgggaaggcgttttcacagttttcaaccctggccctacatatgagaatacatactggagaaaagccatatcagtgcagcgagtgcggtaaagccttcagtcagaagagccaccatatcaggcaccagcgaatccacacgcactag

SEQ ID NO: 247476 - DNA, 1239 bp, Artificial Sequence
  Description of Artificial Sequence: Synthetic coding sequence
atgatagggatgttggaatcccttcagcatgagtccgatctgcttcaacacgaccaaatccatactggagaaaaaccctatgaatgcaacgaatgcaggaagaccttttcgttaaagcagaacctggttgagcacaagaagatgcacaccggggaaaagtcacacgaatgtaccgagtgtggcaaggtgtgttctcgggtctcttccctgaccttgcacctgaggtcacatacaggaaaaaaggcctacaagtgcaacaaatgcggcaaagccttctctcagaaagaaaacttcttaagccatcagaagcatcacacaggagaaaaaccctatgagtgcgaaaaagtaagcatccagatgcctacaattatacggcaccaaaagaatcacaccggcacaaagccttacgcatgtaaagaatgcgggaaggccttcaacggaaaagcctatctcactgagcacgagaagattcacacaggggaaaaaccatttgagtgcaaccagtgtggtcgggctttctcacagaaacagtacctgataaagcaccagaatattcatactggcaagaagccctttaagtgttctgagtgtggtaaagccttttcacagaaagagaatctgattattcatcaaagaattcacacaggcgaaaagccctatgagtgtaaaggctgcggtaaggctttcatccagaagtcctctctgatcaggcatcagcggagtcacactggcgagaagccctacacctgtaaagaatgcggtaaggccttctctggcaaaagcaatctcaccgaacatgaaaagatccatatcggagagaagccctacaagtgtaacgaatgtggtacaatttttaggcaaaaacaatatctaataaagcaccataacatccataccggtgaaaagccgtatgaatgtaacaagtgtgggaaagctttctctaggatcacctccttgattgtgcacgtgcgtatccatacaggtgacaagccttatgaatgcaaggtctgcggcaaggctttctgccagtcatccagtctcacagtccacatgcgatcacacaccggtgaaaaaccatacgggtgcaacgaatgcggaaaagctttttcacagttttctactctggccctgcacatgcgaattcataccggtgagaagccgtaccagtgttccgagtgcgggaaggccttctcccagaaatcccaccacatacgccaccagcgcatccacacccactag

SEQ ID NO: 247477 - DNA, 1884 bp, Artificial Sequence
  Description of Artificial Sequence: Synthetic coding sequence
atggcagccgctgtgttgactgaccgagctcaggtaagtgtgacattcgatgacgtcgccgttaccttcactaaggaggagtggggccagttagacctggcacagaggaccttgtaccaagaggtgatgctcgaaaactgtggattgctggttagtttgggatgcccagttcctaaagcagagctcatatgtcatcttgaacacggacaggaaccttggacacgcaaggaagacctctcgcaagacacgtgccccggtgataaaggcaaacctaaaaccacagagcccacaacatgcgagcctgccctttctgagggcatctctctccaagggcaggtcacgcagggtaattcggtggatagccagctgggccaggcggaggaccaggacggcctgtccgagatgcaagagggccacttccggccaggcatagatccccaggaaaaaagccccggaaagatgagcccagaatgtgacgggctcggcaccgccgacggagtgtgtagtagaattgggcaggagcaagtgagcccaggagaccgcgttagatctcacaacagctgcgaatctggtaaagaccctatgattcaggaggaagaaaacaactttaaatgtagcgagtgtgggaaggtctttaacaagaaacacctcctggccggtcatgagaagatccattcaggtgtcaagccttacgagtgtactgaatgtggcaaaacatttattaagtctactcatcttttacaacatcacatgattcatacaggagagagaccctacgaatgtatggaatgcggaaaggccttcaatagaaagtcctatctcactcagcaccagcggatccatagcggggaaaagccttataagtgcaacgagtgtggcaaggcattcacgcacagaagcaatttcgtattacacaatcgcagacacactggagagaagagctttgtgtgtacagaatgtggacaggtctttcgacacagacccggatttctccgacactacgttgtccacagtggtgagaatccctacgagtgcttagagtgcggtaaggtgtttaaacatagatcctacctaatgtggcaccagcagacccatactggggagaagccctatgagtgttccgagtgcggcaaagtattcctggaatccgcagcactaattcaccattatgtgatacacacaggtgaaaagccgtttgagtgtttggaatgcggaaaggcatttaaccataggagctatctgaaacgacaccaacggattcacactggcgagaagccatttgtgtgttctgagtgcgggaaagcctttacgcattgcagcacattcatcctccataaaagagcccacaccggagagaagccatttgaatgcaaagagtgcggcaaggcgttctctaatcgcaaggacttgatccgtcatttttcaatccacaccggggagaagccctacgaatgtgtagagtgcgggaaagccttcactcgcatgagtgggctcacacggcacaagaggatccactcgggcgaaaagccttatgaatgtgtagaatgcgggaagagtttttgttggagcaccaacttgatccgccatgcaattatccataccggtgagaaaccttataaatgttccgagtgtggtaaggccttctcccgtagcagtagcttgacacaacaccagcgaatgcacacgggaaagaaccctatcagcgtcactgatgtggggcgaccattcacaagtgggcagacctctgtgactctgagggagctccttttaggcaaagattttcttaatgtaacgacggaggcaaatatcctgcctgaagagacatccagtagcgcatcagaccagccctaccagcgcgagactccgcaggtgtcttccctgtag

SEQ ID NO: 247478 - DNA, 1884 bp, Artificial Sequence
  Description of Artificial Sequence: Synthetic coding sequence
atggcggcagccgtgctcacggacagggcccaggtctcggtgacgtttgacgacgtggctgttacttttactaaggaggagtggggccagttggatttagcgcagcgaacgctgtaccaggaggtcatgctggagaactgcgggctcctggtgagcttaggatgccctgtgcctaaggctgagcttatctgccaccttgagcacggccaagagccatggactagaaaagaggacctgtcacaggacacgtgcccaggagataaaggtaagcccaaaaccactgagccgacaacctgcgaacccgctcttagtgaaggaatctcactacaaggtcaggtcacacaaggcaattctgtggatagccagctaggccaggcagaagaccaggatggcctctctgaaatgcaggaggggcacttccgcccaggcatcgaccctcaggaaaagagccccggtaagatgtcccccgagtgtgacgggctgggaaccgcagatggagtgtgttcacgcatcgggcaggagcaagtcagccctggagaccgggtgcgctctcacaattcttgtgaatccgggaaagatcctatgatccaagaggaggaaaataatttcaagtgctcagagtgcggaaaggtctttaataaaaagcatctgctggctggacacgaaaagattcattcgggggtgaagccttacgagtgtactgagtgtgggaaaacgtttattaagagcacgcatctgctgcaacaccatatgatccatacaggtgagcggccatacgaatgcatggagtgcggcaaggcttttaaccgtaagagctacctgacacaacaccagaggatacacagcggcgaaaagccctataagtgtaatgagtgtgggaaagccttcacccacagatccaactttgtcctgcacaataggcggcatacaggcgaaaagagcttcgtctgcaccgaatgtggccaggtgtttaggcatcggccagggtttctcaggcactacgttgtacactctggcgagaatccctatgaatgcctggaatgcggaaaggtgtttaaacaccgcagctatctgatgtggcaccagcaaacacacacaggcgagaaaccatatgagtgtagcgaatgtggcaaagtatttctggaatccgcagcactgatccatcactacgtgatccacaccggggaaaaaccatttgagtgccttgagtgcgggaaagcctttaaccatcgctcctatctgaagaggcaccagcgaatacacacgggggaaaagccctttgtatgttctgaatgcggaaaagcatttacccattgctccacatttattctacacaagagagcccacacgggggaaaagcctttcgagtgtaaagaatgtggcaaggcattttctaatagaaaggacctgattcggcatttttccatccacaccggggagaaaccatatgagtgtgtggagtgcgggaaggcatttactcgtatgtctgggttgacgagacacaaacgaatccattcaggagagaagccctacgagtgcgtggagtgtggaaaaagtttctgttggtctaccaatttgatccgccatgcgattatacatacaggcgaaaagccttacaagtgctcagagtgtgggaaagccttctcacggagctcatctctgacacagcaccagagaatgcacacaggaaaaaacccaatatctgtgaccgacgttgggaggccatttaccagtggtcagaccagtgtgacgctaagggagctgctgcttggtaaggattttctgaatgtaaccacagaagccaacatcctgccagaagagacttcatcatctgcctcagaccaaccatatcaacgcgagaccccccaggttagctccctgtag

SEQ ID NO: 247479 - DNA, 1650 bp, Artificial Sequence
  Description of Artificial Sequence: Synthetic coding sequence
atgcttgaaaactacaagaacctggcaacggtgggatatcagctgttcaagccctccctcatttcctggcttgagcaggaggaatctcgcactgttcagcgcggtgactttcaagcaagcgagtggaaggtccaactaaagactaaggagctggctctgcagcaggacgtcctgggggaacccaccagcagcggaatccagatgattgggagccataatggaggagaggtctccgatgtcaagcaatgcggggatgtcagctctgagcattcttgcctgaaaacacacgtgaggacccaaaattctgagaacacttttgaatgctatttgtacggcgtggactttctcaccctccacaaaaaaacctccactggggagcagcgaagtgttttcagtcaatgtggcaaagccttttctcttaatcctgatgtcgtctgtcagaggacttgtaccggcgagaaggccttcgattgctccgacagtggaaaatcatttatcaatcacagccacctgcagggacacttgcgtactcacaatggcgagtctctgcatgaatggaaggaatgtggcagaggtttcatacattcgaccgacctcgccgttcgcatccagacacacaggtcagaaaagccctacaaatgcaaggagtgcggcaaagggtttagatactccgcctatcttaatattcatatggggacacacactggcgacaatccatatgagtgtaaagagtgtggcaaagcatttacgaggtcatgtcagctaacccagcacaggaaaactcatactggggagaaaccatacaagtgtaaggactgcggaagggcctttacggtttcttcttgtctctcccaacatatgaagatccatgttggggagaaaccttacgagtgtaaggagtgtgggattgcctttacgcggtcctcccagcttactgaacatcttaagactcacaccgccaaagatccatttgaatgcaaaatttgtgggaagtcgttccgcaacagcagttgcctgagcgaccattttcggatccacaccggtatcaagccctacaaatgtaaagattgtggcaaggcgtttacacagaacagtgacctgacaaaacatgctaggacacattccggcgaacggccatatgagtgtaaagagtgtggcaaggcattcgctcggtcttcacgcctcagtgaacacactcgcacacacaccggcgagaagccctttgaatgtgtgaagtgtggtaaggcgtttgcaatcagctcaaacctctctggacatctccgcatacatactggtgagaagcctttcgaatgtcttgaatgtggcaaagcctttactcattccagcagcctgaacaatcacatgagaacacattctgctaaaaaaccatttacctgtatggagtgtggtaaggcgtttaagtttccaacatgtgtgaacctgcatatgaggattcataccggcgagaagccctacaagtgcaagcagtgcgggaaaagcttttcatactccaatagctttcagttgcatgagcgaacgcacaccggcgaaaagccctacgaatgcaaagaatgtggcaaagccttcagcagttcttcttccttccgtaatcacgagcgaaggcacgcggacgagaggctatccgcctag

SEQ ID NO: 247480 - DNA, 1650 bp, Artificial Sequence
  Description of Artificial Sequence: Synthetic coding sequence
atgctagaaaactacaaaaatctggccactgttggttatcagctgtttaaaccctctctgatttcctggctggaacaagaagagtcacgtactgtacagagaggggattttcaagcgtcagagtggaaagtccaactgaaaactaaggaattagcccttcagcaggacgttctcggagagcccaccagtagtggaattcagatgattgggtctcacaatggaggggaagtctctgacgtcaaacagtgcggagatgtgagctctgaacacagctgtctaaagacccacgtgcgtactcagaattctgagaacacatttgagtgttacctatatggggtcgatttcctaaccttgcacaaaaaaactagtacgggtgagcagagatccgtcttttcccaatgcggtaaagcattctctttaaacccggacgtagtctgccagcgtacctgcacaggggagaaggcattcgactgctccgattcaggcaagtctttcataaatcactcgcatcttcagggccatctgcggacccataatggggaatccctgcatgaatggaaggagtgcggacgcggattcatacattctaccgacctggccgtcaggatccagacgcaccggtcggagaaaccctataagtgtaaggagtgcgggaagggtttccgatactctgcttaccttaacattcacatggggacccacacaggggataatccatatgaatgtaaggagtgtggcaaagcatttacgcggtcctgccaattgacccagcaccggaaaacccacactggtgaaaaaccttataagtgtaaggactgcggcagggctttcaccgtgtctagttgcttatcccaacacatgaagattcacgttggggagaaaccctatgagtgtaaagagtgcggaattgccttcacccggagcagtcagttaactgagcatctgaagactcataccgcaaaggacccctttgagtgcaaaatttgcgggaagtcttttcgcaactccagttgtctttctgatcactttaggatacacaccggtatcaagccgtacaagtgcaaggactgtggcaaggctttcacacagaatagcgatttgactaagcatgcacgtacccacagcggcgaacggccttatgagtgcaaggagtgtggaaaagcctttgccagatcgagtagattgtctgagcacacgagaacccatactggggagaagccctttgaatgcgtcaagtgcggtaaggccttcgccatttccagcaacttgtccggacatctgcgcatccatactggtgaaaagcccttcgagtgtcttgaatgcggcaaggcctttactcattccagctctctcaacaaccacatgcgtactcactctgccaaaaaaccctttacctgtatggagtgtggcaaagcgttcaagttccccacttgcgttaacctgcacatgaggatacacaccggggagaaaccttacaaatgtaagcagtgcggcaaaagtttcagctacagcaattcttttcagctgcacgaaaggacccataccggcgagaagccatacgaatgcaaggaatgcggcaaggctttttcctcctcctcttcattcaggaaccacgagcggagacacgctgatgagcgtctgtcagcttag

SEQ ID NO: 247481 - DNA, 1650 bp, Artificial Sequence
  Description of Artificial Sequence: Synthetic coding sequence
atgctggagaattacaagaatctggctaccgtggggtatcagctgtttaagccatctcttatatcatggttagagcaggaagaatcacggaccgtgcagcggggagattttcaggcgtccgagtggaaagtccaactgaagaccaaagaattagctttacagcaggacgtgctcggggagcccacatcttcggggatacagatgatcggatcccacaatggaggggaggtgtccgatgtcaaacaatgtggggacgtgtcctctgagcattcatgcctaaaaacacacgtccgcacccagaacagcgagaacactttcgagtgttatttatacggcgtagattttttgactcttcacaaaaagacctccactggagagcagaggtcagtcttctctcagtgtggaaaggcatttagcctgaaccctgacgtcgtctgccagagaacatgcaccggagaaaaggcctttgattgtagcgacagcggtaagagcttcatcaaccactctcacctccaggggcatctccgcacacacaacggtgaatccctccacgagtggaaagagtgcggccgaggttttattcattctactgatttagcggtgcggatccagacacatcgaagcgagaagccatacaaatgcaaagaatgcggtaaggggttccggtactcagcctacctcaacatccacatgggaacacacacaggcgataacccttacgaatgcaaggagtgcgggaaggcctttactcgtagctgccaacttacccagcatcgaaaaacacacactggcgagaaaccctataaatgcaaggattgtgggagggcatttacggtgtcatcgtgtctatcccagcacatgaaaatccatgtaggagaaaagccatatgagtgcaaggaatgtggcatagctttcacccgctcttcgcagctgaccgaacatctgaagacgcacactgccaaggatccgtttgagtgcaaaatctgcggaaagagcttccgaaacagctcatgcctgagcgatcacttcagaatacatacggggataaaaccatacaagtgcaaggactgcggtaaggctttcacacagaattctgacctcacaaagcacgccaggactcacagcggggaacgtccttacgagtgcaaggagtgcggcaaagcgtttgcaaggagttcaaggttatctgaacatacacggactcacaccggggagaaacctttcgagtgcgttaagtgcggaaaagcattcgcaatctctagcaatctttccggacacctcaggatacacaccggggaaaaaccattcgagtgtctcgaatgtggaaaggcttttactcacagctcatccctcaacaaccacatgcgcactcactcagccaagaagcccttcacctgcatggagtgtggtaaggcctttaagtttcccacttgcgtgaacctgcatatgaggattcacaccggtgaaaaaccctataaatgtaagcagtgtggtaaatcatttagctatagcaatagttttcaactccacgaacgaacacacaccggcgaaaagccatatgagtgcaaggagtgcggtaaggcattctcctcctcatcctctttccgcaatcacgagagaaggcatgctgacgaaaggctgagtgcctag

SEQ ID NO: 247482 - DNA, 2232 bp, Artificial Sequence
  Description of Artificial Sequence: Synthetic coding sequence
atgggtctcctgacctttcgcgatgtggccgttgaattctctctggaggagtgggaacatctggaaccagcacagaaaaatctctatcaggatgttatgctggagaattaccgcaatctggtatctttgggtcttgttgtctccaagcccgatcttataaccttcctggagcagcggaaagagccttggaatgttaaatcagaggagacagtggctatccagcccgatgtattctcccactacaataaggatctgctgacggagcactgtaccgaagcctcattccagaaggtgattagtaggagacatggatcatgtgatttagagaacctgcacctccgcaagaggtggaaacgcgaagagtgcgaggggcacaatggatgctatgacgagaaaacattcaaatatgaccagtttgacgagtcctccgtggaatctctgtttcaccagcagattctcagctcgtgtgctaagagctataactttgatcaatatagaaaagtgtttacccatagcagccttcttaatcagcaggaagagattgatatatgggggaaacaccacatttacgataaaacttctgttctgtttcgacaagtttctactctcaactcctataggaacgtgttcatcggagagaagaactaccattgtaataacagcgaaaaaacactcaatcagtcatcatcccctaagaaccaccaggaaaactacttcctggaaaagcaatacaaatgtaaagagtttgaggaggtattcctccagtcaatgcacggacaagagaagcaggaacagagttataaatgcaataagtgcgttgaggtgtgcacacagtcacttaaacacatccagcaccagaccattcatattagggagaattcgtactcgtataacaagtatgacaaggacctttctcaatcctctaacctccggaagcagataattcacaacgaggaaaagccatacaagtgcgagaagtgtggagactcgctcaaccactccctccatctcacacagcatcagatcattccgaccgaagagaaaccctgtaagtggaaggaatgtggaaaggtcttcaacttgaactgctccctctatctcactaaacagcagcagattgacaccggcgagaatttgtataagtgtaaggcttgcagcaaaagcttcacccggtcgtccaatctcatcgtccaccagcggatccacacgggtgagaaaccctacaagtgcaaggaatgcgggaaagccttcagatgcagttcatacctgaccaagcataaacgcattcacacgggcgagaaaccatacaagtgcaaggaatgcggtaaagcattcaaccgaagttcgtgccttacgcaacatcaaacgacccacacaggagaaaaactctacaagtgtaaggtttgttccaagagttatgccagatcctccaatctgatcatgcatcagcgtgttcatacaggagaaaaaccttacaagtgcaaagagtgcgggaaagtgttttcaagatccagctgccttactcaacacaggaagattcatactggggaaaatctgtacaaatgcaaggtctgtgccaagcccttcacctgtttttccaacctcatagtccatgagcgcattcacacaggagagaagccctacaagtgcaaagaatgcgggaaggccttcccctattcaagccacctgatccgtcatcataggatccataccggagagaagccgtacaaatgcaaagcttgctctaagtccttctccgactcctccggtcttactgtccaccgaaggacccacacaggcgaaaagccttacacctgcaaggagtgtggcaaagcattttcctacagctctgatgtcattcagcaccgcagaattcacaccggccagagaccatataagtgcgaggagtgcggcaaggctttcaattacaggagctacctaaccactcatcagcgctcccatacaggagaaagaccatataagtgcgaggagtgtggcaaagctttcaactctcggagctacctcacaacgcatcggagacggcataccggcgaaagaccctacaagtgtgacgaatgtggtaaggcattcagctataggagttatctgacaactcatcgacgtagccattctggggagcggccatacaagtgcgaagaatgcgggaaggcttttaattctaggagctatcttatagcccaccagcgctcccacactagagagaagttatag

SEQ ID NO: 247483 - DNA, 840 bp, Artificial Sequence
  Description of Artificial Sequence: Synthetic coding sequence
atgggccttctgacctttcgggacgtggccgtagaattttcactggaagaatgggaacacctggagcccgctcagaaaaacctgtaccaagatgtgatgttagagaattaccgaaatcttgtgagcttggggctggtcgtctcaaagcccgatctccttactgagcattgtactgaggcctccttccagaaagtgatttctcgcagacacggctcctgtgatttagagaacttacacctccggaaaaggtggaaacgggaagagtgcgaggggcacaacggttgttacgacgaaaaaacttttaagtatgaccaattcgatgagtcgagtgtggagtctctttttcatcagcagattctctcaagctgcgccaagtcttataatttcgatcagtatcggaaagtgttcacccattcaagcttgttaaaccaacaggaagagattgacatctggggcaagcatcacatatatgataagacaagtgtcctgtttcgacaggtgtcaaccttaaatagctaccgcaacgtctttatcggcgagaaaaactaccattgtaacaattctgaaaaaactctgaatcagagctcatcaccgaagaaccatcaggaaaactacttcctggaaaaacaatacaagtgcaaagaattcgaggaggtttttttgcagagcatgcacgggcaggagaagcaagagcaatcttacaagtgtaacaaatgtgtggaggtatgtactcagtccctcaagcacatccagcaccagactatccacattcgggagaattcctatagttacaataagtacgataaagacctgtctcagagctccaatctcagaaagtag

SEQ ID NO: 247484 - DNA, 2892 bp, Artificial Sequence
  Description of Artificial Sequence: Synthetic coding sequence
atggcaaccgcagccgaaaccagtgcaagtgaaccagaagcagagagtaaagccggtccaaaggctgatggagaggaggatgaggtcaaggccgctcgtacccggagaaaggtgctgtctcgggctgtggcggcagccacttataagaccatggggccagcctgggaccagcaggaagaaggggtatctgaaagtgacggtgacgagtacgctatggcctctagcgcagagtcttctcccggtgaatacgaatgggagtacgacgaagaagaagaaaagaaccagttggagatcgaacgtctcgaagagcaactgagcataaatgtgtacgactacaactgccatgtcgacctgatccggttactacgtctggaaggggagttgactaaagttcgcatggcacggcaaaaaatgtccgaaatatttcctctcactgaagagttgtggctcgaatggctgcatgacgaaatctctatggcccaggacggactggatcgggagcacgtgtatgatctgtttgagaaagcggtgaaggactacatatgtccgaacatctggcttgaatatggccagtattcggtggggggtataggccagaaaggcggtctcgagaaggtacgcagtgtattcgagcgagcgttgagctccgtaggcttgcacatgactaaaggattagcactatgggaagcatatcgagagttcgagagtgcgattgtcgaggcggctaggcttgagaaggttcattctctttttcgtcgccagctcgcaatcccgctgtacgacatggaggccacgtttgccgagtacgaggaatggtccgaagatcccatccccgagagtgtgatccagaactacaataaagctctgcaacagttagagaaatataaaccgtacgaggaggccctgctgcaagcagaagcccctaggctcgcggagtatcaggcctacattgatttcgagatgaagatcggcgatcctgcacggattcagctgatattcgagcgagcgcttgttgagaattgccttgtacccgacctttggatccgttactcgcagtacttagacaggcagctgaaagtgaaggatttggtcctgtctgtacataacagagcaattcgaaactgcccgtggacagtcgcgctgtggtcaaggtaccttctggccatggaaagacacggggtagatcaccaggttattagcgttacttttgagaaagccctgaacgcaggcttcatacaggcaactgattacgtggaaatttggcaagcttacctggattacctcagaagacgagtcgactttaagcaagattcgtcaaaggagctggaagagctgcgtgccgcattcacgcgtgccctcgagtacctgaaacaagaggtagaagaacgtttcaacgaaagtggcgatccatcctgcgtgatcatgcagaattgggcgaggattgaggccaggctgtgcaacaacatgcagaaggcaagagaactgtgggattctattatgacaaggggcaacgctaaatacgccaatatgtggctggagtactacaaccttgagcgcgctcacggcgatactcagcattgtagaaaggcattacatagagccgtccagtgcacctcagattacccagagcatgtatgcgaggtcctccttacaatggagcgcacggagggttccctggaggactgggacattgcggtgcagaaaaccgaaacgagacttgccagggtcaacgaacagagaatgaaagcagccgagaaagaagctgcactggtccagcaggaggaggaaaaggctgaacagcgtaaacgtgccagagcagagaaaaaagcactcaagaaaaagaagaaaatccggggacctgagaaaagaggtgcagacgaggacgatgaaaaggagtggggcgatgacgaagaggaacagccgagcaaaagacggagagtcgagaactccattccagccgctggcgagactcaaaacgtcgaggttgcagcaggcccagctggaaagtgtgccgcagtggatgtcgaacccccatctaagcaaaaagaaaaggccgcttccctgaaaagggacatgcctaaggttctgcatgactccagtaaggactccattactgtctttgtgagtaaccttccctatagcatgcaagaacccgatactaaactacgccctttattcgaggcatgcggtgaggttgtccagatcagacccattttcagcaacaggggggacttccgtggatactgttacgtagaatttaaagaagagaagtcagcactgcaggccctggaaatggaccgaaaatcggtggaggggaggccgatgttcgtgtctccctgtgtggataagtcaaaaaatcctgattttaaggtcttccgctactccacatcactggagaaacacaagctcttcatcagcgggctgccattttcatgcaccaaagaggagctggaagaaatttgtaaggctcatggaactgtaaaggatctcaggctcgttaccaatagggctgggaagcccaaaggccttgcatacgtcgagtacgaaaatgagagtcaagcttcccaggctgtgatgaaaatggacggaatgactattaaggagaatatcatcaaggtggcaatctccaaccccccacagcgcaaagtgcctgagaagcccgaaacacggaaagccccaggaggccctatgctcttaccccagacatatggcgcacgtggaaaaggtcggacccagctgtcactcctcccgcgagccctgcagcgacccagcgcagcagccccacaggctgagaacggccctgctgccgctcctgccgtggcagcgccagctgccaccgaggctcctaagatgagtaatgctgactttgctaagctgtttctgcgcaagtag

SEQ ID NO: 247485 - DNA, 1077 bp, Artificial Sequence
  Description of Artificial Sequence: Synthetic coding sequence
atggacgccaagtcactgacagcctggagccggactctggttaccttcaaagatgtattcgtagacttcacaagggaggagtggaaactccttgacaccgctcagcagattgtgtataggaacgtgatgttggagaactacaagaacctcgtgagccttggttatcagctgactaagccagatgtcatcctgcggctcgaaaaaggagaggagccatggcttgtggagcgggaaattcaccaggaaactcatcccgactcagagaccgcattcgaaatcaaatcatctgtttctagcaggagcatctttaaggacaagcagagctgcgatattaagatggaaggaatggcaaggaatgatctgtggtacctgtcactggaggaagtctggaaatgtcgggaccaactggacaagtatcaggagaatcccgagcgacacttgtccattccgcgagttctatctctgccagccagacacacaaaacttaccgtggggatggccacaagagtacgtactgcctccatttgggttccaccactgcaggaaagaaatagcagttgggaccgcataaggaaactgcaggggcaggaatcaattctaggacagggaacgccagggctgcaaccactgccaggtacgccaaggcagaaacagaaatctaggcggattgaaaaagtcttggaatggctgttcatcagccaggagcagcccaagatcactaaatcatggggaccgctgtctttcatggacgtgttcgtggacttcacctgggaagaatggcagctgcttgaccctgctcaaaagtgcctgtaccgatctgttatgcttgagaactactcaaacctggttagcctcggttaccaacatactaaacccgatatcatttttaagcttgagcaaggggaagaactgtgcatggtacaggcacaggtccccaatcagacgtgcccaatactaaaggctggaaaatccaaggcaaaggtactggctggactcgtctccggtgaggggctactttgcgcatctaagatgactccttgttgctgcattctctggcggcattctcttgaaaattag

SEQ ID NO: 247486 - DNA, 504 bp, Artificial Sequence
  Description of Artificial Sequence: Synthetic coding sequence
atggcaacacgcgtacggacggcctcaatttgggtgcccccactccaggaacgcaattccagttgggacagaattaggaaactgcagggacaagagagcattctcggacagggcacgccaggtcttcagccattacctggtaccccaaggcaaaaacagaaatcaagacgaattgaaaaggttctggagtggttgtttattagccaggagcaacccaagataacaaagtcctggggcaccaatacccctaacttaatctcttcctcaagctggaataaggaaaagtcttgtgtgtggtgccggcctaaattccagatcaggcctgtgcaaacacagagcgggaaattaatgattctctggattggcattaggaagattaagacctcctgggaggttcgacagaaagccctgaacgccctgcatctggagaactatgtgttcctggtacagtctatttttcaggataagaacctcatcaatgtggccagaatggagagggtgtag

SEQ ID NO: 247487 - DNA, 2361 bp, Artificial Sequence
  Description of Artificial Sequence: Synthetic coding sequence
atggattggcatcaggagaataaggataaacttggctccacggctaagtcgttcgaatgcacaacgttcggcaagctgtgcctgctgtccaccaagtacctgagccgtcagaagccacataagtgcggcacccatggcaagtccctaaagtatattgactttacctcagattacgccagaaataacccaaacggctttcaagtgcatggtaagtctttttttcactccaagcatgaacagacagttatcgggatcaagtactgtgaaagcatcgagagtggcaagactgtgaacaaaaagagccagctcatgtgccagcaaatgtacatgggcgagaagccatttgggtgctcatgctgcgaaaaggctttctcctcaaagtcctacctactcgtccatcagcagacacacgccgaggagaagccctacgggtgcaatgaatgtggtaaagacttttccagcaagtcatacttaattgtgcatcagcgaattcacacaggggagaagctgcacgagtgttctgagtgcagaaaaaccttctctttccactctcagctcgttattcatcaacgcatccacacaggagagaacccctacgagtgttgtgaatgcggaaaggtcttcagccgcaaagatcagcttgtgagccaccagaagactcatagcggtcagaaaccttatgtgtgtaacgagtgtgggaaggcgtttgggctcaaatcccagctgattatccatgagcgaattcacacaggcgaaaaaccgtacgaatgcaatgagtgtcaaaaggccttcaacaccaaatctaatttaatggtgcaccaacggacccacacaggggagaagccttatgtgtgttctgactgtggcaaggccttcactttcaagtcccagctgattgtccatcagggcatccacacaggcgtgaagccatacgggtgtattcagtgcggcaagggtttcagtttaaagtcccagctcattgtccatcagagatcccataccgggatgaaaccctacgtgtgcaacgaatgtgggaaagcctttagatcgaagtcctatcttatcatccacacacgaacccacacaggcgagaagctacacgaatgcaataattgcggtaaagcgtttagcttcaagtcgcagcttatcatacaccagaggattcataccggtgagaacccatacgaatgtcatgagtgtggcaaagcatttagccggaagtaccagctgataagtcaccagcgcacccatgctggagaaaaaccatatgaatgcaccgactgtgggaaagcctttggcttaaaatctcagctgattatccaccagagaactcatacgggggaaaagccatttgagtgcagcgaatgccaaaaagccttcaatactaaaagcaatctgatcgttcatcagagaacccacaccggcgaaaaaccatactcatgcaatgaatgcggaaaggcatttacgtttaagtcacaactgatcgtgcataagggggtccacaccggcgtcaagccctatggatgttcacaatgcgctaagacattttcgctcaaatctcagctcattgtgcaccagagaagccacaccggagttaagccctatggatgtagtgagtgcggcaaggctttccgaagcaagtcctatctgattatacacatgcgtacccacacaggagagaaaccacacgagtgccgggaatgcggaaaaagcttctcatttaactcccagttaatcgtacaccagcgaatccacaccggagaaaacccctatgaatgctccgagtgtggaaaagcttttaaccgcaaagaccaactgattagccatcagcgaacccacgctggagagaaaccttacggctgctcagaatgtgggaaggctttctcaagtaagagttacttgatcatacatatgcgaacacatagcggcgagaaaccctacgagtgtaacgaatgcggaaaagctttcatctggaagtctctgctgatcgtccacgaaagaacccatgccggagtgaacccgtacaaatgctcacagtgtgagaaatcctttagtggcaagctaaggctgctggtccaccagaggatgcacacccgcgaaaagccatatgagtgcagtgagtgcgggaaggcatttattcgcaattcccagctgatagtacatcaaaggacacactccggggagaagccgtatggatgtaatgaatgcggcaagactttttcacagaagtctatcctgtcagcccatcaaagaacgcataccggagaaaaaccctgcaagtgtaccgaatgcggaaaagccttctgctggaagtctcagcttattatgcatcaacggacccatgtcgatgataagcactag

SEQ ID NO: 247488 - DNA, 2844 bp, Artificial Sequence
  Description of Artificial Sequence: Synthetic coding sequence
atggctacccgagtacgcaccgcatccatatgggtgcctccgctgcaagaacgaaacagtagctgggatagaattcgcaaattacagggacaagaaagcattctggggcaagggacccccggactgcaacctcttccgggtaccccacgtcagaagcagaaatcacgcagaatcgagaaagtcctcgagtggctattcatttctcaggagcagcccaaaattaccaaatcttggggcccattaagctttatggacgtgttcgttgacttcacctgggaagaatggcaactcctggaccccgcacagaaatgcctgtacaggtcggtcatgctggaaaactactcaaatctagtttccctcgggtaccagcacaccaaaccggatataatttttaaacttgagcaaggtgaggaactgtgcatggtacaagctcaagtgccaaatcaaacatgtcccaacaccgtctggaaaattgatgatctgatggattggcaccaagagaacaaagataagctgggttccacagctaaatcgttcgagtgcactaccttcggcaagttgtgcctgctgtctaccaaatacctctcgcgccagaagccacataagtgcggtacccacggtaagtccctgaaatacatcgactttactagtgattacgcgaggaataaccccaatgggtttcaggtgcacggcaagtcgttctttcattccaagcatgaacaaactgttatcggtattaaatactgcgagtctatcgaatccggaaaaaccgtgaacaaaaaatcacagttaatgtgccagcagatgtacatgggtgaaaagccatttgggtgtagctgctgtgagaaggccttttcatctaagagttatttgctggtgcatcaacaaacccacgctgaggagaagccttatggctgcaatgaatgtgggaaagattttagttccaaatcctacctaattgtgcatcagcgaattcataccggggaaaagcttcacgagtgcagcgaatgccgcaaaactttttcattccattcacagctggtcattcaccaacgaatccacaccggtgagaatccttacgagtgttgtgaatgtggtaaggtgtttagtcgtaaagaccagttagtgagccaccagaagacccacagcggacagaagccgtatgtttgcaacgaatgcggcaaggcgttcgggctgaaatcccagctgataattcacgaacgaatccataccggagagaagccttatgaatgcaatgagtgccagaaggcatttaacactaagtctaacctcatggtacatcagcggactcacaccggggaaaaaccctacgtgtgtagtgactgtggtaaggcatttacctttaagtcccagcttatcgtccaccaagggattcacacaggggtcaagccctatggatgtatacaatgtggcaagggtttcagcctcaaaagtcagctaatcgtccaccagcggtcccacaccggaatgaaaccctacgtgtgcaacgaatgcggaaaggcttttaggtccaagagctatctgattatccacaccaggacccatacaggcgagaaactccatgaatgtaacaattgcgggaaggccttcagttttaaatcccagctgattatccaccagcgcatccacaccggagagaacccctacgagtgtcacgagtgtggaaaggcattctctagaaaatatcagctaatcagccatcagcgtactcacgccggagagaagccctacgagtgcaccgattgcggaaaggcgttcggactgaaatcgcagctgatcattcaccagagaacacatactggagaaaaaccctttgagtgcagtgagtgccagaaggcatttaatacaaagtctaatctcatcgtgcatcagcgaactcatactggagagaagccctactcttgtaacgaatgcgggaaagcgttcacatttaagtcgcagctcattgtgcacaagggagtccatactggggtcaagccatatggatgcagccagtgcgccaagacttttagtctgaaatcacagctgatcgtgcaccaacgaagtcacaccggcgtgaagccttatgggtgcagcgaatgcggcaaagcttttcggagtaaatcttatctgatcattcatatgcggacacatacaggagagaaaccgcacgaatgtcgggagtgcgggaaatccttcagtttcaacagccagctcatcgtgcaccagagaattcataccggcgagaatccctacgagtgttctgaatgcggtaaggcgttcaacaggaaagatcagctgatcagccatcagcgcacacacgccggagagaagccatatgggtgcagcgaatgtggcaaggctttcagttccaagagttaccttattatacacatgagaacccacagcggggaaaagccatacgaatgcaacgagtgtgggaaagccttcatttggaaaagcttactaatcgtacacgagagaacccatgccggtgtgaacccgtacaaatgttctcagtgtgagaaatccttttccggtaaattgcgcctcctggttcaccaacggatgcatactcgtgagaaaccctacgagtgttccgaatgcggcaaggcctttatccgtaatagtcagttgattgttcaccagcggacccattcaggcgagaaaccctatgggtgtaacgaatgcggtaaaactttttctcagaaaagcattcttagtgcccaccagaggacacacaccggagaaaagccttgcaagtgcacagagtgcgggaaggccttctgttggaagtcccagctgatcatgcaccagcgcacccacgttgacgataagcattag

SEQ ID NO: 247489 - DNA, 2193 bp, Artificial Sequence
  Description of Artificial Sequence: Synthetic coding sequence
atggattggcatcaggaaaataaggacaagctcggctctactgctaagagcttcgagtgtaccacctttgggaagctgtgtcttctttccaccaagtatctcagtcgccaaaagccacacaaatgtggcacccacggaaagagccttaaatatatcgattttacaagtgactacgccaggaacaaccctaacggtttccaggtgcacggcaagagcttctttcattccaaacacgagcagacagtaatcggaattaaatattgcgagagtattgagtctggaaagacagtcaataaaaagtcccagctcatgtgccagcagatgtacatgggggagaaacccttcggatgttcatgttgtgagaaggcattctcctcaaagagctatcttttggtgcaccagcaaacccatgcggaagaaaaaccctatgggtgtaacgagtgtggcaaagatttcagctccaagtcataccttatcgttcaccagcggatccacacaggagaaaaactgcatgagtgcagcgaatgtcgcaagacattctcattccattcacagctggtcattcaccagaggattcatacaggagaaaacccatatgagtgttgcgaatgtgggaaggtgttttcgcgcaaggaccagttggtcagccaccagaagacccactccggtcaaaagccttacgtatgcaacgagtgtggcaaagcattcggcctgaagtcccagttaataatccatgaacgcattcacaccggtgagaagccatacgagtgcaacgagtgccaaaaggcattcaatacaaagtctaacctgatggtgcaccagcggacacatacgggtgaaaagccatacgtttgttctgattgtgggaaggctttcactttcaaaagccagctgattgtccaccaaggtatccatacaggagtcaaaccgtatggctgcatccagtgcggcaaggggttcagtttgaaatcccagttgatcgtccatcaacgctcacacacaggcatgaagccctacgtgtgcaacgagtgcggtaaagccttcagatccaaaagttatctcattattcacactaggactcatacaggagaaaaactgcacgaatgtaacaactgtgggaaggcattcagtttcaaatcccagctcatcatccatcagagaatccacacaggtgaaaatccatatgaatgccatgagtgcggtaaggccttctcacggaaataccaactgatttctcaccaacgaacccatgctggggagaagccttacgagtgtacggactgcgggaaggctttcggactgaaatcccaactcattattcatcaaaggacacacaccggtgaaaaaccctttgagtgtagcgaatgccagaaagcattcaacactaagtccaatctgatcgttcatcagagaacacatacaggcgagaagccttattcttgtaacgagtgtggaaaggcattcacctttaaatctcagctcattgtccacaaaggagtacacaccggagtgaagccatatggatgctctcagtgcgccaaaacatttagccttaaaagccagcttatcgtccatcaaaggtcccacacaggggtgaaaccgtatggctgctctgaatgcggaaaggcatttaggtctaaatcatatttgattatccatatgagaactcacacgggagagaagcctcacgaatgccgtgaatgcggaaagtcatttagttttaattcccagcttattgtacatcagagaatccatacgggggaaaatccttatgaatgctcagagtgtggtaaggcttttaaccgtaaggatcagttaatctcccatcagcgaactcacgccggagagaagccctatggctgctccgaatgcggcaaagccttctcctccaaatcatacctcattattcatatgcgtactcactctggagagaaaccttacgagtgcaatgagtgtggaaaggcttttatttggaaaagcttgctgatagtgcacgagcgaacacacgcaggggtgaacccttacaaatgctctcagtgcgaaaagagtttttctgggaagctgcgcctgttggtgcatcagagaatgcatacaagggagaaaccttatgagtgtacagagtgtgggaaggctttctgctggaagtcacagctgattatgcatcagcgcacccacgtggacgataaacattag

SEQ ID NO: 247490 - DNA, 303 bp, Artificial Sequence
  Description of Artificial Sequence: Synthetic coding sequence
atggccacacgggtgagaaccgccagcatttggggaaccaatacccctaacttgatatcgtcctccagttggaacaaggagaaatcctgtgtctggtgtcggccaaaatttcaaatccggccagtacaaacccagagtggtaaactaatgatcctgtggattggaatccgcaaaattaaaactagttgggaagtccggcagaaagccttgaacgccctgcatttagagaattacgtattcctggtgcaaagcatattccaggataaaaacctgataaatgttgctagaatggaacgtgtgtag

SEQ ID NO: 247491 - DNA, 381 bp, Artificial Sequence
  Description of Artificial Sequence: Synthetic coding sequence
atggccactagagttcggaccgccagcatctggggtcctctgtcatttatggatgtgttcgtggatttcacttgggaagagtggcagctgttagaccccgctcaaaagtgtctgtatcgaagcgttatgctcgagaattacagcaacttggtgtcgctggggtaccaacataccaagcctgacatcattttcaaactggagcagggtgaggagctatgtatggtgcaggcccaggttcccaatcagacttgcccaatacttaaagccggaaagagcaaggcgaaggtcctagcaggcttggtctccggcgaaggcttactctgcgcatccaaaatgaccccctgctgttgtatcctctggcggcattccttagagaattag

SEQ ID NO: 247492 - DNA, 207 bp, Artificial Sequence
  Description of Artificial Sequence: Synthetic coding sequence
atggccacgagagttcgcaccgctagtatctggactcaatcaggtaagttaatgatcctctggattggcatcagaaaaattaagacatcctgggaagtcaggcaaaaggccctcaacgccctccacttggagaactatgtgttcctcgttcagtcaattttccaagataagaacctgatcaatgtcgcaaggatggaaagagtatag

SEQ ID NO: 247493 - DNA, 504 bp, Artificial Sequence
  Description of Artificial Sequence: Synthetic coding sequence
atggctaccagagtgcgaacagccagtatttgggtaccacctctgcaggaaagaaacagcagctgggacaggattcggaaactgcagggccaggagagcatactgggtcaggggacaccaggtctgcagcccttgccgggaacccctaggcagaagcagaaatcacgtaggattgagaaggtcctggagtggttattcatcagccaagagcagcctaaaataacaaaatcttggggtactaacaccccaaacctgatcagttcaagcagctggaataaagagaagtcctgtgtgtggtgcagacccaaatttcagattcggcctgtgcagacccagagtggaaaactaatgatcctatggatcggtatcaggaaaatcaagacatcttgggaggttcgacaaaaagcgctgaacgctttgcacctggaaaactatgtcttcttggttcagtccatttttcaggacaaaaatctgataaacgtcgctcgcatggaacgagtctag

SEQ ID NO: 247494 - DNA, 381 bp, Artificial Sequence
  Description of Artificial Sequence: Synthetic coding sequence
atggccacaagagtgaggactgccagtatttggggcccactcagcttcatggatgtttttgtcgattttacgtgggaggaatggcagctgctggatcctgcgcagaagtgtctttacaggtccgttatgttagaaaattacagcaatctggtgtccctcggatatcagcataccaaacccgacatcatttttaaactcgaacagggtgaggagttatgcatggtgcaggcacaggtcccaaaccagacttgccccatccttaaggccggaaaatctaaggctaaagtgctcgctggcctcgtttcaggggaggggctcctgtgcgcttctaaaatgacaccatgctgttgcatactgtggcggcacagtctggaaaactag

SEQ ID NO: 247495 - DNA, 1959 bp, Artificial Sequence
  Description of Artificial Sequence: Synthetic coding sequence
atggcctcgcgtctccctacagcttggtcgtgcgagcccgtgacatttgaggacgtgaccctgggctttacaccagaagagtggggcctgctcgacctcaagcagaagtcgttatatcgcgaggtgatgctcgagaactacaggaatctggtatccgtggagcaccagctctcaaaacccgacgtggtgagccaactggaggaggccgaagacttctggcctgtcgagcggggaatcccccaggacacaatcccagagtaccctgagttgcagctggaccccaaactcgaccctcttcccgctgaaagcccactgatgaacatcgaggtcgtcgaggtgctaactctcaaccaggaagtcgctggaccccgtaatgctcagattcaggccttgtacgccgaagacggatcccttagcgccgacgccccttcagaacaggtccagcaacaaggaaagcatcccggagatcctgaagctgctcgccagcggtttcgacaattcaggtacaaagacatgacggggccaagggagcttgatcagctgagagagctgtgtcaccagtggctgcagccaaaagccagaagtaaagaacaaatactagagctgttggtcctggagcaatttttgggcgcattgcccgtaaaactcagaacgtgggttgaatctcagcacccggagaactgccaggaagtcgtcgctctggtcgagggggtaacgtggatgtccgaggaggaggttttgccagctggacagccagctgaggggacaacatgctgcttagaggtcaccgcccaacaggaggagaagcaggaggacgccgcaatttgccctgtgacagtgcttcccgaagaacctgtgacttttcaggatgttgccgtggacttcagccgtgaggagtggggtctgctcggccctacgcagcgtacagagtaccgggatgtaatgctggagacgtttggtcatctcgtctccgtcggctgggaaacgacactggagaacaaggagctggcacccaatagcgacattcccgaagaagagcctgcccctagcctgaaggtgcaggagtctagtcgagattgtgctttaagtagtaccctggaggacactctgcagggcggagtacaggaagtgcaggacactgtcttgaaacaaatggagagcgcccaagaaaaagatctacctcagaagaagcactttgataatcgcgaaagccaagctaacagtggggcactggacacaaatcaggtgtcactccagaagattgacaaccctgaatcccaggccaattctggtgcattagacaccaatcaggtgctcctgcacaagattcctcctaggaagaggcttagaaagcgagactctcaggttaagagcatgaagcacaattccagagtgaagattcatcagaaatcttgcgagcgccagaaggcgaaggaaggaaatggctgtagaaaaactttttccaggagcactaagcaaattactttcatcagaatccacaagggctcacaagtctgtagatgcagcgaatgcggcaagatttttagaaacccccgatacttttcagtacacaagaagattcacaccggggagcggccttacgtgtgccaggattgcggcaaggggtttgtgcagagctcatctcttacccagcaccagcgtgtccactccggggagcgcccatttgagtgtcaagaatgcggcagaacctttaatgacagaagcgccatttcccaacacttgcgtacccataccggcgcaaagccgtacaagtgccaggactgtggcaaggcctttagacagagtagccatttgatccggcaccagcggacccacacaggagaaaggccttacgcatgtaacaaatgtggtaaggcttttacccagtcctcacatctaattggacaccagcgaactcataaccgcactaaacgaaagaagaaacaaccgacaagctag

SEQ ID NO: 247496 - DNA, 1863 bp, Artificial Sequence
  Description of Artificial Sequence: Synthetic coding sequence
atggcctccagactgccgactgcttggtcctgcgaacctgtgacttttgaggacgtgacactcggcttcacacccgaggagtggggtcttctggacttaaaacaaaagtcactatacagagaagtgatgttagagaattacaggaacctggtgagcgttgagtaccccgagctgcagctcgaccctaaactggaccccctcccagccgaatccccactgatgaatattgaggtagtggaagtactcacgctgaatcaggaagttgcaggtccaagaaatgcccagattcaagccctgtatgctgaggatggctccctgtcagctgacgcccctagcgaacaagtacagcaacaaggtaagcaccctggcgaccccgaggctgccagacagcgcttcaggcagtttcggtacaaagacatgacaggaccgcgagagctggatcagttgagggaactgtgccaccaatggctccaacctaaagcccgtagcaaggagcagattttggaacttctggtgttggagcagtttctgggcgctctgccagtgaaactgcggacttgggtcgaatctcaacatcccgaaaactgccaggaggtggttgccctcgtggaaggcgtgacatggatgtctgaggaggaggtgctgcctgccggtcaaccagcggaagggaccacatgttgcctggaggtgacagcccagcaggaagagaaacaagaggacgctgccatctgtcccgtgaccgttctgcccgaagaacccgttacattccaggatgtcgcagtcgacttcagccgagaagagtgggggctactcggcccaacccagagaactgagtacagagacgttatgctggagactttcggacacttagtgtcagtgggatgggaaactactctcgagaacaaagagctggcccctaatagcgacataccggaagaagagcccgcaccctctcttaaggtccaagagtctagtagggattgcgcactttcgtcgactctcgaggatacactccaggggggtgttcaggaggtgcaagacacggtcttgaagcagatggagtctgcccaggagaaagatctcccccagaaaaaacacttcgacaacagagagtctcaggccaactctggagcactggacactaaccaggtgtccctgcaaaaaattgataacccggaatctcaagccaactccggtgccctggacaccaaccaggtgcttcttcataagattcctcctcgcaaacggctacggaagcgcgacagtcaggtgaagtctatgaagcataacagtagggtgaagattcaccaaaaatcatgcgagagacagaaagccaaagagggtaacggctgcaggaaaacatttagtaggtcaacaaagcagatcactttcatccggattcataagggctcacaagtatgtcggtgtagcgagtgcgggaagattttccgcaacccgaggtatttcagcgtccacaaaaagatacatacaggcgaacgcccttacgtttgtcaggactgtgggaagggctttgtccagagcagtagccttactcagcaccagcgggttcactctggagaacgccctttcgaatgtcaggagtgtggacgtaccttcaacgacagatcggctatttcccagcatctgaggacacatacaggggctaagccatacaagtgtcaggactgcggcaaggctttcaggcagagctcacatctcattcgacatcagcgaacccatactggagaacggccatacgcctgcaacaagtgtgggaaggcctttacccagagcagtcacttgattggacaccagcgtacacacaatcggacaaaacgcaagaaaaaacaacctacttcttag

SEQ ID NO: 247497 - DNA, 1644 bp, Artificial Sequence
  Description of Artificial Sequence: Synthetic coding sequence
atgaacatcgaggttgtagaagttttaaccctcaatcaggaggtcgctggcccacgcaacgcccaaatccaggcactgtacgctgaggatggcagtctctcagctgacgccccatctgaacaggtacagcagcagggcaagcatcccggtgatccagaagccgctcgccagagatttcgccagtttcggtacaaagatatgactgggccacgggagctcgatcaacttcgagagctgtgtcatcaatggctccagccaaaagcacggtccaaagagcaaatactggagttgctggtcctcgagcaatttctcggggctctgcccgtgaagctgaggacctgggtggagagccagcaccccgaaaactgtcaagaagtggtcgccttggtcgagggagtgacatggatgagcgaagaagaagttctgccagcgggtcagcctgccgaaggcactacctgctgcctggaggtgaccgcccaacaggaagagaagcaagaggacgctgccatctgtcccgttaccgttttgccagaggagcccgtgaccttccaggatgtagccgtcgactttagtcgcgaagaatggggtctgctgggcccaacccagagaaccgaatatcgggatgtgatgctggaaacttttggacacttggtgagcgtgggatgggaaaccactctggaaaataaggagctggctccgaatagcgacattcctgaagaggagccagctcctagcctgaaagtccaggaaagcagccgtgattgcgccctgagctcaacattggaggacacactgcagggcggagtccaggaggtgcaggacacggtcctcaaacaaatggagagcgcacaggagaaggatttgccacaaaagaaacactttgataaccgcgagtctcaggctaactctggtgctctggacaccaaccaggtgtcactacagaagattgacaaccccgagtcccaggccaattctggggcacttgatactaatcaagtgctgctccataaaattcctcctaggaaacgcctccgtaaaagggacagccaggtgaagagtatgaagcataacagtcgggtgaaaatccaccaaaaatcctgcgaaaggcagaaggccaaggaaggcaatggctgtcggaaaacattctccagaagcaccaaacaaattacattcatccgtattcacaaagggtcacaggtgtgtcgctgtagcgagtgcggaaagatattccgaaaccctcggtacttctctgtgcataaaaagattcacactggcgagcgcccttatgtgtgtcaggactgtggaaaaggcttcgttcagagctccagcctcacacagcatcaacgagtgcattccggcgagagacccttcgagtgtcaggagtgtggtcgcacctttaatgaccggtctgccattagccaacaccttagaactcataccggggcaaagccgtacaaatgccaggactgcggtaaggccttccgtcagtcatcccacctcattcgccaccagagaactcacacaggcgaaagaccttatgcttgtaacaagtgcggaaaggcgttcacccagagtagccatctgatcggtcaccaacgcacgcacaaccgcacgaaacgtaaaaagaagcagccaactagctag

SEQ ID NO: 247498 - DNA, 1353 bp, Artificial Sequence
  Description of Artificial Sequence: Synthetic coding sequence
atggccgcaagcaagacgcaaggtgctgttgcgagaatgcaggaggacagagacggcagttgtagcactgtcgggggagttggttacggcgatagcaaagattgtattctggaacctctctcactgccagaatcacctgggggtaccaccacacttgaaggctcaccttccgtcccgtgcatcttttgtgaagagcacttccccgtggcggagcaagacaaactactcaagcatatgatcatagaacataagattgtcattgctgacgtgaagctcgtggctgatttccagaggtatattctgtactggcgcaagcggttcacagaacagccaattacagacttttgctccgtaatccgaattaattcgacagccccattcgaggaacaggagaattattttttgctctgtgacgtgctgccagaggataggatcttgagagaggaattgcaaaaacaacggcttagggagatacttgaacagcaacagcaagagcgtaatgacacgaatttccatggcgtctgcatgttctgcaatgaggaattccttgggaatcggtctgtaattctgaaccatatggcccgtgaacacgctttcaatattggtcttccagacaacatcgtgaattgcaacgagttcctgtgtacacttcagaaaaaactggacaacctccaatgtctttactgtgagaaaaccttcagagataagaataccctcaaagaccacatgagaaagaagcagcatcgaaaaataaaccccaagaaccgcgagtatgaccgcttttacgtaattaactacttggagctgggcaagtcttgggaggaagtgcagctcgaggacgatcgggagcttctggaccaccaagaagacgattggtcagattgggaagagcacccagctagcgcagtctgtctgttttgtgagaaacaggccgagacaatcgagaagctgtatgttcatatggaagacgctcacgagtttgacctcttgaagataaaatcggaattggggttgaacttttatcaacaagtaaaactagttaatttcatacggcgtcaagtgcaccaatgtcggtgttacggctgtcacgtaaagtttaagtcgaaggcagacctgaggacgcatatggaagagaccaagcatacaagcctcctccccgaccggaagacttgggatcagctagagtactattttccaacctacgagaacgacaccttgctatgtactttaagtgattccgagtcagacttaactgctcaggaacagaatgagaatgtcccaataatatctgaagacacgtccaagttgtacgcccttaaacaaagctcgatcctgaaccagctcctattgtag

SEQ ID NO: 247499 - DNA, 873 bp, Artificial Sequence
  Description of Artificial Sequence: Synthetic coding sequence
atggccgcttccaagacacagggggctgtggcacgaatgcaggaggacagggatggcagctgcagcacagtggggggagtgggctacggcgattctaaggactgtattctggagccgctgagcttacccgaatctccaggtggaaccactaccctggaagggtccccgagtgtgccttgcattttctgtgaggagcactttcctgtcgcagagcaggacaagctgttaaagcatatgattatagagcacaaaatcgtgatagctgacgttaaacttgttgccgactttcagcgttatattctgtactggcgcaaaagatttacggagcagccaattaccgacttctgcagcgttatcagaatcaactccaccgctcctttcgaggagcaagaaaactattttctcctatgtgacgtgctgcccgaggaccggattttgagagaggagctacagaaacaaagacttcgagaaatcctggagcagcagcagcaggagcgcaacgatacaaactttcatggcgtctgcatgttttgcaatgaggaattcttaggaaaccgtagcgttatactgaaccacatggcaagggaacatgccttcaacataggactgccggacaatatcgtgaattgtaacgagttcctctgcacccttcagaaaaaactagataatctgcagtgcctgtactgcgaaaagacctttagggacaagaataccttgaaagatcacatgaggaagaagcagcatcgcaagattaacccgaagaatagagaatatgatcgattctatgttatcaactacttagttagactgtcttttcacaatcttaaatttgactgctccacagccaacaaaatctttctccgtacaaactag

SEQ ID NO: 247500 - DNA, 1428 bp, Artificial Sequence
  Description of Artificial Sequence: Synthetic coding sequence
atgtcaaggagaaaagcagggtcggcccctcggagggtggaaccagcacccgctgcaaaccctgacgacgaaatggaaatgcaagatctggttattgagctgaaacctgagcccgacgcacagccgcagcaggccccacggctgggcccatttagtccaaaagaagtgtccagtgcagggagatttgggggtgaacctcatcatagccctggacccatgcccgctggcgcagccctgctcgccctaggcccaaggaatccgtggacactgtggacacctcttacccccaactaccctgatcgacagccctggacagataagcatcccgatctgcttacatgcggaaggtgtctgcaaacgtttccattggaggctatcacggccttcatggatcacaaaaaacttggatgtcagttatttagaggcccttcacggggacagggctctgaacgggaggaactcaaggccctttcttgtttacgctgtggaaagcagtttaccgttgcgtggaagctgctcagacacgcacagtgggatcacggcttgagcatatatcagaccgagagcgaagctccagaggcccctctgttagggctcgcggaggttgctgcggctgtatctgcagtagtgggcccagccgcagaggccaagtccccgagggcatcgggatctggcttaaccagaaggtcgccaacatgtccagtgtgtaaaaagactctgagctcattcagcaacctgaaggtgcacatgagatctcacacgggagagcggccatacgcctgcgaccagtgtccatatgcctgcgcgcagagctccaagctgaaccgccataagaaaacccaccggcaggtgccccctcaatccccacttatggccgatacttcccaggagcaagcaagcgccgctcctccagagcctgcagtgcacgccgcagcccctacttcgacgttaccatgctcagggggtgagggcgcaggggctgctgctactgcaggtgtccaggagcccggtgccccaggatcaggagcccaagctggccctgggggagatacctggggtgccatcacaacagaacagagaactgacccagctaattcgcaaaaggcatcccctaaaaaaatgccaaaatcagggggaaagtctcgcggacccggtggcagctgcgagttttgcggaaaacacttcacgaacagctctaaccttacagttcatcgccgttctcacaccggcgaacgcccttacacctgtgagttctgtaattacgcttgtgcccagagttctaagctgaatagacatcgcaggatgcacggcatgaccccagggtctacacggtttgagtgcccccactgccacgttccattcggacttcgggctactctggataagcaccttagacagaaacaccccgaagcagccggagaggcatag

SEQ ID NO: 247501 - DNA, 1356 bp, Artificial Sequence
  Description of Artificial Sequence: Synthetic coding sequence
atggaaatgcaggatttagtgattgaactgaaaccagagccagatgcccaacctcagcaggcgcctcggctgggccctttctccccaaaggaggtgtcctcagctggcagattcgggggtgagcctcaccactcacccggacctatgccagcgggagctgctctcctggcgctcgggcctagaaatccatggacattgtggacgcccctcactccgaattaccccgacagacagccctggaccgacaagcaccctgacctgctcacctgcggacgatgcctccagacctttccgttggaagctattacagccttcatggatcacaaaaagctgggatgccagttatttagaggcccaagcagaggccaaggttctgagagggaggaactgaaagctctcagctgtctacgctgtggaaaacaattcacggtagcatggaaactgctgcggcatgcccagtgggatcatggactatcaatttaccagacggaatcagaagccccagaagcacccctgttggggctcgccgaggtcgccgctgccgtctccgcggtggtgggacctgccgcagaggcaaagtctccacgggcttcagggtcgggcttgaccagacggtctccgacatgtcccgtgtgtaagaaaaccctttccagtttttcaaacctcaaggtccacatgagaagtcacaccggggaaaggccatatgcatgcgaccagtgtccatatgcatgcgcgcagagctccaaacttaaccgacacaaaaaaacccatagacaggtgccacctcagtctcctctgatggccgacacatctcaagaacaggcctctgcagctccaccagaacccgctgttcacgccgcagccccaacttccactctgccatgttcaggcggagagggggcaggggcagccgcaaccgctggagtgcaagaacccggagcccctggatctggtgcacaagcaggacccggaggggatacttggggagcgataacaaccgagcaacggaccgatcccgcaaactctcagaaagcaagccctaaaaaaatgcccaaatcaggtggcaagtctagaggcccagggggttcctgcgagttttgtggcaaacacttcaccaacagcagcaatctaactgttcacagaagatcacacaccggcgagaggccctacacctgcgagttctgtaactacgcgtgcgcgcaatcaagcaagttaaacagacaccgcaggatgcatggtatgacccccggaagcactcggttcgagtgtccgcattgtcacgtcccatttggattgcgagctacccttgacaagcacctgcgccagaagcacccggaggcagctggcgaagcctag

SEQ ID NO: 247502 - DNA, 1341 bp, Artificial Sequence
  Description of Artificial Sequence: Synthetic coding sequence
atggaaacccaagctgacctagttagtcaggagccccaggcactgctggacagcgctctaccctcaaaggtcccagctttttccgacaaggactctctcggtgatgagatgttggccgcagctcttcttaaagctaagagtcaggagctagtcacgttcgaggatgtagcagtttacttcattaggaaagaatggaagcggttggaacctgcccaaagagatttgtacagagacgtgatgctagaaaattacggaaatgtcttttctctggatagagagacccgtaccgagaacgaccaagagatttccgaggatacccgctctcatggcgttctcctgggcaggttccaaaaggacattagccagggcctaaaatttaaggaggcctacgaaagggaggtgagcctcaaaaggccactggggaattcacccggagaaagactcaaccggaagatgccagattttggccaggtcaccgtcgaggagaagttgactcctaggggtgagagaagcgagaagtacaacgatttcggcaatagcttcaccgtgaattctaatttaatatctcatcaaaggctgcctgtgggggaccggcctcataaatgtgatgagtgtagcaaatctttcaataggacctcggacctgatccaacatcagcgcattcatacaggcgaaaagccatatgagtgtaacgagtgcggtaaggcattttcccagtcgtctcatctcattcagcaccaaaggattcacaccggggagaagccttacgagtgctctgattgtgggaaaaccttctcctgttcctctgccctgatcttgcatagaaggattcacacaggggaaaagccgtatgaatgtaatgagtgtgggaagaccttctcatggagttctacgcttacacaccatcagaggattcataccggagagaaaccatacgcctgtaacgagtgcggtaaggccttctcaagatcatctactttgatccaccatcagaggattcataccggagaaaaaccatatgaatgcaacgagtgcggcaaagcattttctcagtcctcccacctctaccaacaccagagaatacacaccggcgagaagccctatgagtgtatggagtgcggcggaaagtttacctactctagcgggctgattcagcaccagaggatccataccggtgagaatccctatgagtgctccgaatgtggcaaagcctttcgctactcaagcgccctcgtgaggcatcagcggattcacacgggtgagaaacccctgaacgggatcggcatgtcaaagtcatcactgcgagttacaaccgagctgaatattagggagtcgacatag

SEQ ID NO: 247503 - DNA, 1341 bp, Artificial Sequence
  Description of Artificial Sequence: Synthetic coding sequence
atggaaacgcaggctgacttggtgtcacaggaaccacaggccctcctcgattcagcgcttccttctaaagtccccgctttttcagacaaggactccctgggcgatgagatgctggctgcagccctcctgaaggcaaaatctcaggaactggtaacctttgaggacgttgccgtttacttcatcagaaaggaatggaagagactggaaccagcccagagagatctgtacagggacgtgatgctggagaattacggaaatgtgttcagcctcgaccgtgagacaaggaccgagaatgatcaggagatctccgaggacacacggtcccatggggtgctgctggggaggtttcagaaggacatttcccaaggattgaagttcaaggaggcctacgagcgcgaagtcagcctgaagcgaccccttgggaacagtccaggggagcgcctgaatcgaaagatgccagacttcgggcaggtcaccgtggaagagaagctgactccaaggggggagagatctgaaaaatataatgacttcggaaacagcttcactgtaaattcaaaccttatatcccatcaacgcctccctgtaggggatcgcccacataagtgcgacgagtgttctaagtcatttaaccgcactagtgatctaatccagcaccagaggatccacaccggtgagaagccatatgagtgcaacgaatgtgggaaggcctttagccagtccagtcacctgattcaacatcagcggatccatacaggtgagaagccctacgaatgcagcgactgtggtaagacttttagctgctcctctgctctcattttacatcggagaattcacactggtgagaagccctacgaatgcaatgagtgtggcaagactttttcctggagttctacattgacccaccaccagcgaatccatactggcgaaaagccttacgcttgcaatgaatgtgggaaggctttcagccggtctagcaccctgatccaccaccagagaattcacaccggagaaaagccatacgaatgcaatgaatgtggaaaggcttttagccagagtagccacctttatcaacaccagcgcatccatactggggagaagccttatgagtgtatggaatgtggcggaaaattcacttactcctccgggctaatacagcatcagagaatccacactggtgagaacccctacgagtgctctgaatgtggcaaagctttccgctactcttctgccctggttaggcatcaacgaattcatactggcgagaagccactgaacgggatcggaatgtccaaatcaagcctgagagtcactacagagttgaacatccgtgagagcacatag

SEQ ID NO: 247504 - DNA, 396 bp, Artificial Sequence
  Description of Artificial Sequence: Synthetic coding sequence
atggagacacaggccgatttagtctctcaggagccacaggcactgctggactctgccctgcccagcaaagtgcccgcatttagcgacaaagattcgttaggtgatgagatgctggctgctgccctcctgaaggccaagtcgcaggagctggtgactttcgaggacgtcgccgtttactttatccgcaaagaatggaagaggctcgaaccagcccagagggacctttaccgcgatgttatgctggaaaattacggcaatgtgttttccctcgattggattcacgtttgcctgacgacgcaaaaagtgatgctggcgtggctcacaggaacactctccgttgccaaaggattgtgctcctcagagctcgcttccgtggaaccgcctgacactttttag

SEQ ID NO: 247505 - DNA, 315 bp, Artificial Sequence
  Description of Artificial Sequence: Synthetic coding sequence
atggaaacacaagccgacctggtgagccaagagccacaggccctactggacagcgccctgccatcaaaagttcctgcattcagtgacaaggacagtctcggcgatgagatgctcgccgcagcgttgctaaaggcaaagtcccaagagctcgtcacttttgaggatgtggcagtatactttatacgaaaagagtggaagagactcgagcccgctcagagggatctgtatcgtgatgtgatgttggaaaattacggcaacgttttcagcctagaccgggagacccgcactgagaacgaccaagaaatttcagagtag

SEQ ID NO: 247506 - DNA, 1341 bp, Artificial Sequence
  Description of Artificial Sequence: Synthetic coding sequence
atggagacccaggcggaccttgtttcccaagaaccacaggctcttctggacagtgctctgccttccaaggtccctgccttctctgataaggattcccttggtgacgagatgctggcagccgcactgctgaaagccaaaagccaagagctggtcacattcgaagatgtcgccgtgtatttcatacggaaagagtggaaaagactcgaacccgctcagagagacctgtatcgcgacgtgatgctcgaaaactacggaaatgtgtttagcctggaccgggagacccggacagagaatgaccaggagatctctgaagacaccagaagtcacggcgtcctgttaggacggtttcaaaaagacatcagccagggcctcaaattcaaagaggcctacgagcgcgaagtgagcctaaagcgacctctgggcaactcaccaggcgaacggttgaacaggaaaatgccggatttcggccaggtcacagtcgaggagaagctaacacctcgcggagagcgatctgagaagtacaacgatttcgggaacagtttcacggtgaattctaatctgattagtcaccaacggcttcctgtcggggataggccccacaagtgcgacgagtgttctaagtctttcaataggacaagtgacctgatccaacaccagcgcatccacaccggcgaaaaaccgtatgagtgcaatgaatgcgggaaagccttctctcagtctagccatctgatccagcaccagcggattcatactggcgagaagccctacgagtgttctgactgcgggaaaactttctcttgctctagtgctctgatactccaccgcaggatccataccggcgaaaagccatacgagtgcaacgagtgcgggaaaacattttcctggtcctccacgctgactcatcatcaacgaatccatacaggcgagaaaccatacgcttgtaatgagtgtgggaaggctttttctaggtcctccaccctaatccaccatcaacggatccatacgggcgaaaagccgtatgaatgcaatgaatgtggcaaagcgttcagccagtcttcacacctgtaccaacaccaacggattcacactggtgagaagccatatgagtgcatggagtgcggcggtaagttcacctattcttctggtttaatccaacaccagcgaatccacacgggtgaaaatccatacgagtgctccgaatgtggcaaggcctttaggtattcaagtgccttagtacggcaccagcgtatccacacaggagagaagcccctgaatgggatcggtatgagtaagagtagcctaagagtgacgacagaattgaatatcagagagagcacatag

SEQ ID NO: 247507 - DNA, 558 bp, Artificial Sequence
  Description of Artificial Sequence: Synthetic coding sequence
atggagacgcaggctgacctggtttctcaggagccccaggctctgctcgactcggccctgccaagtaaggtgccagccttctcggataaagactcccttggagatgagatgctggcggcagctttacttaaggcgaagagtcaggagttagttactttcgaggacgtggctgtttacttcattaggaaggaatggaaacggctcgagcctgcacagagggatctgtaccgggatgtgatgctggagaactacggcaacgtgttctctctcgatcgagagacgaggacagaaaacgaccaggaaattagcgaggacacgcggagccacggcgtgcttctgggacgttttcagaaagacatttcccagggattaaaatttaaagaggcatatgaaagagaggtgtcacttaaaaggccgctgggcaatagccccggagagcggctgaatcggaaaatgccggattttggccaggtaactgtggaagaaaagcttaccccaagaggggagcggtcagagaagtataacgatttcggaaattccttcacagtgaacagttag

SEQ ID NO: 247508 - DNA, 558 bp, Artificial Sequence
  Description of Artificial Sequence: Synthetic coding sequence
atggaaacacaggctgacctagtgagtcaagaaccccaggctcttctggactccgccctgcctagtaaagtccccgctttttccgacaaagacagcctgggtgacgaaatgttagccgctgccttgctgaaggctaagtcgcaggagctggtgacttttgaagatgtggctgtttatttcatcaggaaggagtggaaacggctggaacccgctcaacgggacctgtacagggacgtgatgctggagaactacgggaacgttttttccctcgacagagagacgcgcaccgagaatgaccaggagatatcagaggatacaaggtcacacggcgtgctgctcggacgcttccagaaagacatctcccagggcctaaagtttaaggaggcttatgagagagaggtaagcttgaagaggccattgggaaattcccctggcgaacgcttgaaccgcaaaatgccagatttcgggcaggtgactgtggaggagaagctcacacccaggggcgagcgctcagagaagtacaatgatttcggcaattcgttcacggttaattcatag

SEQ ID NO: 247509 - DNA, 1509 bp, Artificial Sequence
  Description of Artificial Sequence: Synthetic coding sequence
atgggcaccgagaataaggaagtgattccaaaagaagaaatcagcgaggaatctgaaccacatgggtccttgctggagaagttcccaaaggtggtatatcagggacacgaattcggcgctggttgcgaagaagacatgctggaagggcactctcgtgagtccatggaagaggttattgagcagatgagtccccaggaacgggactttccgtccggactgatgatcttcaagaaaagcccgtcatcagagaaggaccgcgagaacaatgaaagtgagagggggtgttccccctctcccaatctggtgacccaccagggcgacacaacagagggtgtgagtgcatttgcgacatccggccaaaactttttggagattttggaatccaataaaactcaaaggtcatccgtcggggagaaacctcacacctgtaaggaatgtggtaaggccttcaaccaaaatagccacttgattcaacatatgcgggtccattccggggagaaaccctttgagtgtaaagagtgtgggaagacctttggaacaaactcgagcctgcgacggcacctccgcattcacgcaggagagaagcccttcgcatgcaatgaatgtggcaaggccttcatccagtcatcccatcttatccatcaccatcgtatccacaccggtgaacgcccttacaaatgcgaggaatgtggaaaagctttcagccagaatagcgctctgatactccatcagcgcatccatactggagagaagccatatgaatgcaacgagtgcggaaagaccttcagagtcagtagccagttgatccagcaccaaagaattcacactgaggaaaggtatcacgagtgcaacgaatgcggaaaagccttcaaacactcaagcggccttatacggcaccagaaaatccacacaggagagaagccgtacctctgcaacgagtgcggtaaaggctttggacagagctccgagctgatccggcatcaacgtattcacaccggtgataaaccctatgaatgtaacgaatgtggtaagacatttggccagaattcagaaataatcaggcacatccggatacacactggggagaaaccttacgtctgcaaggaatgcggcaaggccttccggggaaactccgagctattacgccacgagagaattcacaccggcgagaagccatatgagtgttttgagtgtgggaaggcctttcgccgaacaagccacttgatagttcatcagcgcatccacacgggcgagaaaccccaccaatgcaatgagtgtgctcggacattctgggataatagtgagctgttgctacatcagaagattcatattggggagaagccttatgaatgctccgaatgcgaaaagacattttcacagcactcacagttgatcatccaccagcggatccacacaggcgaaaagccctacgaatgccaggaatgtcagaaaacgttctctaggtcgtcacacttgctgcggcatcagtctgtccactgtatggagtag

SEQ ID NO: 247510 - DNA, 1815 bp, Artificial Sequence
  Description of Artificial Sequence: Synthetic coding sequence
atgatgaaaagtcaaggtctggtctcattcaaggatgttgcagtggatttcacacaagaggagtggcagcagctcgacccatcacaacgcacactttaccgcgatgtcatgctggaaaactactctcatttggtttctatggggtatcccgtgtctaaaccggacgtcatcagcaaattggagcagggagaagagccttggatcatcaaaggtgacatctccaactggatatacccagacgagtatcaagcagacggcagacaagatcggaagagcaatctgcacaattcccagagttgtatattaggaacagtctctttccaccacaagattctgaaaggagtcaccagggatgggtcactgtgctccatcttgaaggtctgtcagggggatggccagctgcagcgttttctcgagaatcaggataaactattccgccaggtcactttcgtaaatagcaagactgtgaccgaagcgagcggacacaagtacaatccccttggaaagattttccaggaatgcattgagacagatatcagcatccagcggttccacaagtatgatgcctttaaaaagaacctgaaaccaaacattgacctgccatcctgctataagagcaactctaggaaaaagccagaccagtcttttggcggaggaaaatcttccagccagtcagaacccaatagtaaccttgaaaaaatacacaacggcgtgatcccgtttgatgataatcaatgtggtaacgtgtttaggaacacccagtccctgattcaatatcagaatgtagagaccaaggaaaaatcctgtgtgtgcgttacttgcggtaaagctttcgcgaaaaagtctcagcttatagtccaccagcgcatccacactggcaagaagccatatgattgcggtgcctgcggaaaggctttcagcgaaaaatttcaccttgtggtccaccagcggacccataccggcgagaaaccatatgattgttccgaatgcggaaaggcattttctcagaagagctcacttatcatccaccagcgtgtgcataccggggagaagccatacgaatgctccgaatgtggcaaggctttttcacagaaaagtccattaattatccaccagcggatccacacaggagagaagccgtatgagtgccgggagtgcggaaaagccttttctcaaaaatcccaacttatcatccaccatagagcacacactggggaaaagccctacgaatgcacggaatgcggcaaggcgttctgtgagaagtctcatctgattatccataaacgcatccataccggtgaaaagccttataagtgcgcccagtgtgaggaggcgttcagccggaagaccgaactcatcacccaccagctggtgcacaccggagaaaagccttacgagtgtaccgagtgtgggaagactttcagccgcaagagtcagctcataattcaccagcgcacacacaccggggagaaaccatacaaatgtagcgaatgcggtaaagcattttgtcagaagtcacatctgatcggccaccagagaatccatacgggagagaagccctacatctgcacagagtgcggtaaagcgttttcacagaaatctcacctccccggacatcaaagaatacacacaggcgaaaaaccatatatctgcgccgaatgtgggaaagcatttagccagaagtccgacttagttctgcatcaacgtattcatacaggtgaacgcccatatcagtgcgccatctgcggaaaagcctttatccagaagtcacagctaactgtccaccagaggatccacaccgtggtgaaaagctag

SEQ ID NO: 247511 - DNA, 1815 bp, Artificial Sequence
  Description of Artificial Sequence: Synthetic coding sequence
atgatgaaatcacaggggcttgtatcatttaaggatgtggcagtggacttcacccaggaagaatggcaacaactcgatccgtcgcagcgaaccctctatcgggatgtaatgctcgagaactactctcacctagtcagtatggggtaccctgtgtctaagcccgatgtcatcagcaaactggaacagggcgaggagccatggatcattaaaggggacatcagcaattggatatacccagatgaataccaggccgacggaagacaaggcaaaaagtctaacttacacaacagtcaatcatgcatactggggacagtgtcttttcatcacaagattctaaaaggcgtgactcgggacgggtctctgtgttcaatcctcaaggtgtgtcagggggacggacagcttcagcgcttcctggagaatcaagataaactgttccggcaagtgacatttgttaactctaaaacagtgactgaggcatctggccacaaatacaatccccttggaaaaatttttcaggaatgcattgagactgatatctctattcaacgctttcacaaatatgatgcattcaagaagaatctaaagccaaatatcgacctcccatcctgctataagagcaactcccgaaagaaaccagaccaaagtttcgggggtggaaagtcaagcagccaatctgagcctaactccaatctcgagaaaattcacaacggggtgataccctttgatgacaaccagtgtggcaatgtcttccgcaacacccagagtttgatccagtaccaaaacgttgagaccaaagagaaatcctgtgtgtgtgttacttgtggaaaggcctttgctaaaaaatcacagcttatcgtgcaccagaggatacacacgggtaagaagccctacgactgtggggcatgcggcaaggcttttagcgaaaaatttcaccttgtggttcaccagcggacgcatacgggagagaagccgtatgactgcagcgagtgtggcaaggccttcagccagaaatcatccctcattattcatcagcgtgtccacaccggagagaagccctacgagtgcagtgagtgcggaaaagccttttcgcagaagtcaccgttgatcattcatcaacgtatccataccggcgaaaagccttatgaatgcagggaatgcggcaaagcgttcagccagaaaagtcagctgataattcaccatcgcgctcatactggggaaaaaccatacgaatgtacggagtgtgggaaagcattctgcgagaaatcgcatcttattatccataagagaatccatacgggagagaaaccatataaatgtgcccagtgcgaggaagccttttccagaaaaacagagcttatcactcatcaactggttcacactggtgagaaaccctatgagtgtaccgagtgcggaaagacattcagccgaaagtcccaactgatcatacaccagcgtacccacaccggcgagaaaccatacaaatgctctgagtgtgggaaagcattctgccagaaaagtcacttgattggccatcagagaatccatactggcgagaagccttacatctgtacagagtgcggtaaggccttcagccagaagtctcatctacctggccatcaaaggattcatacaggtgaaaagccttatatttgtgccgaatgtggaaaagcatttagccagaaaagtgatctcgttctccatcagcgtatccacacaggggaacggccataccaatgtgctatttgtgggaaggcattcatccaaaagagtcagctgacggtccatcaacgcatccatacagtggtcaagtcgtag

SEQ ID NO: 247512 - DNA, 1707 bp, Artificial Sequence
  Description of Artificial Sequence: Synthetic coding sequence
atgttagaaaactacagccacttggtaagcatgggctaccctgtttcaaagccggacgtcattagcaaactggagcaaggagaagaaccctggataatcaagggtgacatctccaactggatctaccctgatgagtaccaggctgacggcaggcaagaccggaaatctaacctgcacaacagccagagctgcatacttggaaccgtgagcttccaccacaagattctcaaaggcgtcaccagagacggctctctgtgctcaatactgaaagtctgccaaggagacggccagttgcagcggttccttgagaaccaagataaactgttcaggcaggtcacttttgtgaattccaaaacggtgacagaagcctctggccataaatataacccattgggcaaaatatttcaagagtgcatcgagaccgacatatccattcagcggttccataaatatgacgcctttaagaaaaaccttaaacccaatatcgatctcccttcatgttacaagagcaatagccgaaagaagcctgatcagtcctttggcggaggcaaatcatcaagccagagtgaaccaaacagcaacctggagaagattcacaacggagtcataccttttgacgataaccaatgtgggaacgttttccgcaatacacagagcttaatccagtatcaaaacgtcgagacaaaggaaaagagctgcgtctgcgttacttgtggcaaggcttttgccaaaaagtcccaactgattgtccatcagcggatccacaccggaaaaaaaccatatgactgcggggcatgcggaaaagcgtttagcgagaaattccatctggttgtccatcagaggactcacacaggtgagaagccatatgattgttctgagtgtgggaaggcattctctcaaaagagttctctgattatacatcagagggtgcacaccggcgaaaagccttacgaatgctccgaatgtggtaaagcgttttctcaaaagagccccctgatcattcaccagcgaatccacactggagagaagccctatgaatgcagggaatgtggaaaggctttttcgcagaaatctcagttgataatccaccatagggcgcatactggcgagaaaccctacgagtgcaccgaatgcggaaaagcgttctgcgaaaaatcacacctgataatccataagcggatccataccggagaaaagccatataaatgcgctcaatgcgaggaagccttctcaaggaaaacagagctcatcactcatcagctggtgcacactggcgagaagccatatgaatgtaccgaatgcgggaagaccttttcacgcaagagccagttgattatacaccagcgaacacatactggcgaaaagccttacaagtgtagtgaatgtggcaaggccttttgtcagaaaagccatctgatcggtcaccaacggatccatacgggcgaaaaaccctatatttgcacagagtgcgggaaggcttttagccaaaaaagccacctgcccggacaccagcggatacataccggggaaaagccttacatctgtgccgagtgtggtaaggccttcagccagaagtcagacttagtcctacatcagaggattcataccggcgagcgcccttaccaatgtgccatttgcggaaaagccttcatccagaagagtcagctcacagtgcaccaacgaatccacaccgtcgtgaaatcatag

SEQ ID NO: 247513 - DNA, 1863 bp, Artificial Sequence
  Description of Artificial Sequence: Synthetic coding sequence
atggttcccgcagaaacctcatcatccggcttgctggaggaacagaaaatgatgaagtcccagggattagtcagcttcaaagacgttgccgtcgactttacccaggaggaatggcagcagctggatccctcccaaagaaccctatatagagacgtaatgctggagaattactctcacttggtatctatgggatatcccgtgtcgaagcccgatgttatctcaaaattagagcagggagaagaaccctggattattaagggggacatttccaattggatttaccccgacgagtaccaggctgatggccgacaggaccggaaatctaacctgcacaattcccaaagctgtattctggggaccgtttctttccatcacaagattctgaagggcgtgaccagggatggcagtctctgctcaatcctgaaggtctgtcagggggatggccaactacagcggttcctggaaaaccaggacaagctcttccgacaggtaacgttcgtcaactccaagacagtgacagaagcaagtggacacaagtacaatcccctaggaaagatattccaggagtgtatcgagacagacatcagcatacaaaggttccacaagtatgatgctttcaaaaaaaacctaaagccaaatattgaccttccctcctgttataagtccaacagtcgcaagaagccggaccagtccttcggaggcggaaagagctcaagtcagtcagagccgaatagcaacctggagaagatccataatggcgtcattccgttcgatgataatcaatgcgggaacgtgtttcgtaatacccagagcttgattcagtaccagaatgtcgaaacgaaggaaaaatcctgtgtgtgtgtaacctgcggtaaggccttcgctaagaaatctcagctgatcgtgcatcaaaggatacacacaggaaagaaaccatatgattgcggagcatgcggcaaggccttttccgaaaaatttcacctcgttgtgcatcagcggacacacactggtgagaagccctatgactgctctgaatgtgggaaagccttctctcagaaaagctcgcttatcatacatcagagggtccataccggggagaaaccctatgaatgtagcgagtgtggaaaggccttcagtcagaaaagtcctctgattattcatcagcgcattcatacaggggaaaagccctatgaatgccgcgagtgcgggaaagctttttctcagaaatctcagctgatcattcaccaccgagcccatacgggggaaaaaccatacgagtgcactgagtgcggaaaagctttctgtgaaaagtctcacttgattatccacaaacgcatccacacaggcgagaagccatacaaatgtgcacaatgtgaggaggcattctcgagaaaaaccgagctaataacgcatcagttagtgcacacgggtgagaaaccttatgagtgcacagaatgtggcaagaccttcagccgcaagtctcagttaatcattcaccaacgaacacatacaggtgaaaaaccttacaagtgctctgagtgcggtaaagccttttgccagaaatctcacctgattggtcaccaacgaattcacaccggcgagaaaccctatatctgcaccgaatgtggaaaggccttttcacaaaagagtcatctgccaggccaccagcgaattcacactggcgaaaaaccctacatctgcgctgagtgtggaaaagcgttctctcagaagtctgacctagtgctccaccagaggatccataccggtgaaaggccataccaatgcgccatatgcggtaaagcctttatccagaaatcacaactcacagtgcaccagaggattcatacggtggtcaaatcgtag

SEQ ID NO: 247514 - DNA, 1980 bp, Artificial Sequence
  Description of Artificial Sequence: Synthetic coding sequence
atggccgctgccgtcctgatggatcgagtgcagagttgtgtgacttttgaggatgtcttcgtatatttttcaagagaggaatgggagctgttagaagaagctcagagattcctgtatcgcgatgttatgctggaaaattttgcgctggtggccacattgggtttctggtgtgaggcagaacacgaggcgccaagcgaacagagcgtgtccgtggagggcgtgtcacaggtaagaacggcggagagtggcttgttccagaaagctcacccttgtgaaatgtgtgatccccttctcaaggacatattgcacctcgcggaacaccaaggttcccacttaacccaaaagctatgtactaggggcctttgccgcaggaggttcagtttttccgcaaacttctaccagcatcagaagcagcacaacggagaaaactgctttagaggggatgacggcggtgcttcatttgtgaaaagctgcaccgtccatatgctgggacggtcatttacatgtagggaagagggaatggacctgcccgacagctcaggtttattccagcaccagacaacctataatcgggtgtccccgtgtaggagaacagagtgcatggaatcttttccccatagctcttcgctaagacaacatcagggcgactatgacggtcagatgttgttttcctgcggagatgaaggtaaagcattcctggacacttttacgctgctggattcccagatgacacacgccgaggtaaggcctttcaggtgtcttccctgcggcaacgtcttcaaggaaaagtcagccctcattaaccaccgcaagatacactctggcgaaatatcccacgtctgcaaggaatgcgggaaagcctttatccacttacaccacttgaagatgcatcagaaatttcatacaggcaaacgccactacacatgctctgagtgcgggaaagcattctctcggaaggacacactcgttcagcatcagagggtgcacaccggtgaacgtagctatgattgctctgagtgcgggaaggcttactctagatcttcccatcttgtccagcatcagcggatccacaccggagaacggccatacaagtgtaacaagtgcgggaaggctttttcacgaaaggacactttagtgcagcaccaacgctttcacacaggggaaagaccctatgagtgtagcgagtgcgggaaatttttttctcagtccagccatctaatagaacattggcggattcacacaggagctcgaccatacgagtgcattgaatgtggtaaattcttcagccataattcaagtcttatcaaacaccgcagggttcacactggcgctcgctcatacgtgtgttcaaaatgtgggaaagcatttggatgtaaggataccctagtgcaacatcagattatccataccggcgctaggccttacgaatgtagcgagtgtggcaaagcgtttagtcggaaggatactctggtgcagcatcagaaaatccataccggagagcggccttacgagtgcggggaatgtgggaaatttttcagccacagcagtaatttgattgttcaccagaggatacacactggagctaaaccgtacgagtgcaacgagtgcggcaagtgcttttcgcataactcaagcttaatactgcaccagcgcgttcacacaggagccaggccatacgtgtgtagtgaatgcgggaaggcatacatttcctctagccatctggttcagcacaaaaaggttcacacgggcgctcgcccttatgagtgtagtgaatgcggcaaattctttagcaggaatagtgggttaatcctgcaccaacgggtgcatactggagagaagccatacgtttgctctgagtgcgggaaagcgtactctcgctcaagccacctcgtgaggcaccagaaagcccacacaggggagcgcgctcatgaatgtaatagctttgggggacccctggcagcgtccctcaaactcgtttag

SEQ ID NO: 247515 - DNA, 1980 bp, Artificial Sequence
  Description of Artificial Sequence: Synthetic coding sequence
atggccgctgccgtcttaatggatcgagttcaatcatgtgtgacattcgaagatgtgtttgtctatttttcccgggaggaatgggaattactggaagaggcccagagattcttatatcgcgacgttatgctcgaaaacttcgcccttgtggccacgttgggtttttggtgcgaagctgagcacgaggcccctagcgagcagagcgtcagcgtggagggagtaagtcaggtcaggactgccgaatctgggctcttccagaaagcccacccatgcgagatgtgcgatccactgctgaaggatatactccacctggccgaacatcagggtagtcaccttactcaaaagctttgtacccggggactctgtaggagaagattttccttctctgcaaacttctatcaacaccaaaaacaacataatggagagaattgtttccgcggtgacgacggcggtgcaagctttgtgaagtcatgcacggtccacatgctcggcagatcgtttacttgtcgagaagaggggatggatctgcctgattcaagtggcctgttccagcaccagaccacatacaaccgcgtttctccgtgtcgacggacggagtgtatggagagtttccctcactcctccagcctcagacagcaccagggcgactacgatgggcagatgctgttttcctgcggggacgaaggcaaggcattcctggacactttcaccctgctggatagtcagatgacacacgccgaggtgagaccttttcgctgcctcccatgtggcaatgtctttaaggagaagtcagctttaattaatcataggaagatacactccggagagatttcacacgtgtgcaaagaatgcggaaaagccttcatacacctgcaccacctgaaaatgcaccagaagtttcacacggggaagcgacattatacgtgctcagagtgcggcaaggcattctcacgcaaggataccctggttcagcatcagcgcgtgcacacaggcgagcgctcctacgactgtagtgaatgtggaaaagcttactccagaagcagtcacctggtacagcaccaacgaattcacaccggggaacgcccatataagtgcaacaaatgcggcaaggcgttcagtcgcaaggacacactcgtgcaacaccagcgattccatactggagaaagaccgtacgagtgcagtgagtgtggaaaattctttagccagagtagccatttaatagagcactggaggattcacacaggggctaggccgtatgagtgcatagaatgtggaaaatttttctcccacaattcaagtctcatcaaacacaggcgtgtgcatacgggggctcgaagctacgtgtgttcaaaatgcggaaaagcatttggctgtaaagatactctcgtgcaacaccaaattattcatacaggagccaggccatatgagtgtagtgagtgcgggaaggccttttcccggaaggacactctggtgcagcaccagaagatccacaccggcgaacgcccatacgagtgtggagagtgtgggaagttcttctcacactcctcgaatctgattgtgcatcagagaattcatactggtgccaaaccctatgagtgcaacgaatgtgggaaatgcttttcccataacagcagcctcattctgcatcagagagttcacaccggcgctaggccatatgtctgtagcgaatgcggcaaggcgtacatctcaagctctcacctggtgcagcacaaaaaggttcatacaggcgcaagaccttatgagtgttcagaatgcggtaagttttttagtcgcaattcaggcctgatcctgcaccaaagggttcacactggggaaaagccttatgtgtgcagcgagtgcgggaaagcatactcacgtagttcacatctggtccgacaccagaaagcccacactggcgagcgagcccacgagtgcaacagctttggtgggccattggcagcatctctaaaacttgtttag

SEQ ID NO: 247516 - DNA, 2121 bp, Artificial Sequence
  Description of Artificial Sequence: Synthetic coding sequence
atggctgctgcggtgctcatggacagggtgcaaagctgtgtgaccttcgaggatgtgttcgtatacttctcacgagaggagtgggaattgctggaagaggcccagaggtttctgtaccgcgacgtgatgttggagaatttcgccttagtcgcaacgctcgcattcatcttccctgttccatgtagttgtgcagtaggtggcggaaggaagccctgggtcccagatcgcgctgacataacagctgcaaccgtgaaagagacttaccggggacacgggcctgccgagtgggagctggaggaggggttttggtgtgaggcagaacatgaagctcccagcgaacagtctgttagtgtggaaggcgtgagccaggtgaggactgctgagtcaggccttttccagaaagcacacccatgcgagatgtgtgaccccctgctaaaggatattctacatcttgctgagcatcagggctctcatttgacgcagaagctgtgtacccgaggcttgtgcagaagacggttcagcttttctgctaatttctaccagcaccaaaagcaacacaacggtgagaattgtttccgcggtgatgatggcggagcgtccttcgttaagtcctgtaccgttcacatgctgggccgaagcttcacctgcagagaagaaggcatggatttaccagattccagtgggctgtttcaacaccaaactacatacaatcgagtgtccccctgtagacgcactgagtgtatggaaagctttccacactcctcgtcactccgacagcaccagggcgactacgatggacagatgctcttttcatgcggcgacgagggtaaagcctttcttgatacattcacacttctcgacagtcagatgacccatgccgaggtgcggccattccggtgcctgccatgcgggaacgtctttaaagagaagagtgcactcatcaatcatagaaaaattcattctggcgagatatctcatgtatgcaaagagtgcggcaaggcctttattcatctgcaccacctgaagatgcatcaaaagttccacaccggcaaacggcactacacatgctctgaatgtggtaaagcatttagtcgtaaggacaccctggttcagcatcagcgcgtgcataccggcgagaggagctatgattgttctgaatgtggcaaggcttattcaaggagctcccatctggtgcaacaccaaaggattcacacgggcgagcggccttacaagtgcaataaatgcggtaaagctttctctagaaaagataccctggttcagcatcaacggtttcacaccggagaaagaccctacgaatgttcagagtgtggcaagttttttagtcagagttcacacctcattgaacattggagaattcacaccggggcaagaccttatgagtgtatcgagtgcggtaagttcttttcgcacaatagtagcctgatcaagcacagaagagtccacacgggagctcgcagctacgtgtgttctaagtgcggaaaggccttcgggtgtaaagacacactggttcagcatcaaattatacatactggggctcgtccttacgagtgttccgaatgcggcaaggcattctctcgcaaagacacactggtccagcatcagaaaatccatactggcgagcggccatacgagtgcggcgagtgtgggaagtttttctcgcatagctccaatcttatcgtgcaccaacgcattcacaccggagcgaagccatacgaatgtaatgagtgtggaaagtgctttagccacaattcgagcctaatcctccatcaacgcgtgcatacaggcgcaagaccgtatgtgtgttcggagtgcgggaaagcttacatttcctcctcacatttagtgcaacacaagaaggtgcacacaggagcaaggccctacgagtgctccgagtgtggcaaatttttcagcagaaattctggcctgatcttgcaccagcgcgtgcacaccggcgagaaaccctacgtatgtagcgagtgcggaaaggcttatagccgcagctcacacttagtacgccatcaaaaagcacacaccggcgaaagagcccatgaatgtaactcttttggaggacctctggccgctagcttgaagttggtgtag

SEQ ID NO: 247517 - DNA, 1788 bp, Artificial Sequence
  Description of Artificial Sequence: Synthetic coding sequence
atggccgctctgagcccgacttttgcaactagcactcaggacagcacctgcctccaggactccgaattcccagtctctagcaaggaccattcttgtcctcaaaatctggacttattcgtctgttcgggactggagcctcacacccccagcgtgggatcacaggagagcgtgactttccaggacgtggctgttgacttcaccgaaaaggaatggccattgttggactcgtcacagagaaagctgtataaggatgtgatgctggagaattattccaatctgacctcactgggctaccaggtggggaaaccaagcctcatctcgcacctggaacaggaagaagagcctcgcactgaagaacgaggcgctcaccaaggggcttgcgctgattgggaaacgccctccaaaacaaagtggagcctgttgatggaggacatcttcggtaaggagactccctcaggtgtaaccatggagagagccggactgggagagaaaagtacagaatatgcccatctcttcgaggtctttgggatggatccccacctcacccagcccatgggtcgacatgccggtaaacggccttaccacagacgcgactacggagtcgcatttaagggcagaccacacctgactcagcatatgtcaatgtacgatggcagaaaaatgcacgaatgccaccagtgtcagaaagcctttactacatccgcctccctgacaaggcaccgccgaattcacacaggtgaaaaaccgtatgagtgttctgactgtgggaaggctttcaatgacccatccgccctgcggtcccatgctaggactcacttaaaagaaaagcctttcgattgttctcagtgcggaaacgcttttcgcacactctcagcactgaaaatccacatgagggtgcatactggggagcgaccatataaatgtgaccagtgtggtaaagcctatggccgatcctgccatctgattgctcataagcgaactcatactggggagcgcccttatgaatgccacgactgcgggaaggcctttcagcacccctcacacctgaaggagcacgttcgcaatcatactggagaaaagccatatgcatgtacacagtgtggtaaggcttttaggtggaagagcaactttaatctgcacaagaagaaccatatggtcgagaaaacatatgaatgtaaggagtgtggaaagtccttcggagacctcgtgtcgaggaggaagcacatgcgaatacatatagtgaagaaaccggtggaatgtcgccagtgcgggaagactttcagaaatcagtcaatccttaaaacacatatgaattcccacacgggggaaaaaccttatgggtgtgacctgtgcggcaaggccttctcggcctcctctaacctgacagctcaccggaaaatccatacgcaagaacgacggtatgagtgtgctgcatgcgggaaggtatttggagactacttgtcaagaaggcgccacatgtcagtgcacctggtgaaaaaacgtgtggagtgtagacagtgcggcaaagctttccgaaaccagagcacgcttaagactcacatgaggagccatactggtgaaaagccttacgagtgcgaccactgcggcaaagctttttctatcggatccaaccttaatgtgcacaggcgaatccataccggtgagaaaccttacgaatgtctggtgtgcgggaaagcttttagcgatcattccagtctgagatcccacgtgaaaacccacagaggggagaagctcttcgtgagctccgtctggaagagattacagtag

SEQ ID NO: 247518 - DNA, 1692 bp, Artificial Sequence
  Description of Artificial Sequence: Synthetic coding sequence
atggccgcactttcgcccacctttgcaaccagtacccaggactcgacctgtctgcaggatagcgaattcccagtgtccagcaaagaccacagctgtcctcagaacctcgacctgtttgtgtgtagtggactggaaccccatactccgtctgtgggcagccaggagagtgtcacattccaggacgtggcagtggattttacggagaaagagtggccactgctggactcctcacaaaggaaactatacaaagacgtgatgctggaaaattactctaacctaacaagtctggactgggagaccccctcaaagaccaagtggtcattactgatggaggacatttttggaaaggagacaccctccggcgtgaccatggagagggccggactcggggaaaagtcgaccgagtacgctcatctcttcgaggtgtttgggatggatccgcatttgacacagcccatgggacggcatgccggaaagcggccttaccatagacgcgattacggcgtcgcgtttaaaggacgtcctcacctgacgcagcacatgtctatgtacgacggtcgtaaaatgcatgagtgtcaccagtgtcagaaggctttcactacatccgcctctctgacccgccaccggcgaatccacaccggagaaaaaccttacgagtgtagcgattgcggaaaggccttcaacgatccatccgccctacgctctcatgcccgtacgcacttaaaggagaagccctttgactgttcccagtgcggcaatgcctttcgaacgctgtctgcactcaaaatacatatgcgggtgcacacaggggagaggccttataaatgcgaccaatgtgggaaggcatacggcaggtcatgtcatttaatcgcccacaagcggacccacaccggagagcgcccttacgaatgtcatgattgcggcaaagcttttcagcatccctctcatctcaaagaacacgtgaggaatcacaccggcgagaagccatacgcttgcactcagtgcggcaaagctttcaggtggaagagtaattttaacctgcataaaaagaaccatatggtggaaaagacttacgaatgcaaggaatgtggtaaaagcttcggcgatcttgtgagccgcagaaagcatatgaggattcacattgtaaaaaagcctgtcgagtgcagacaatgcggcaaaactttccggaatcaaagcatactgaaaactcatatgaattcgcatactggcgagaagccgtacggatgcgacttatgcggtaaggccttcagcgcatcctccaatctgactgctcacagaaagatccatacccaggaaagaaggtatgagtgtgcggcatgcggaaaggtgttcggggactacctgtcaagaagacgccatatgagcgtgcaccttgtcaaaaagcgggtcgaatgtcgccaatgcggaaaagcctttcgaaatcagagtactctgaagacccatatgcgctctcacacaggcgagaagccttacgagtgtgaccattgcggaaaagctttcagcatcggttcgaaccttaacgttcatcgaaggatccacactggagaaaagccatatgagtgtctagtctgtggcaaagctttcagcgatcattcatcactgcgaagccatgtaaagacacataggggcgaaaaactcttcgtgtcgagcgtctggaaaaggttgcagtag

SEQ ID NO: 247519 - DNA, 369 bp, Artificial Sequence
  Description of Artificial Sequence: Synthetic coding sequence
atgaacttcagtagccaccggagacggctcccttcaccaccactccccagatcgtactcgcagagttctactagcacccaggacagtacatgcttacaggacagtgaatttcccgtgagttccaaagatcactcttgccctcagaacctcgacttgttcgtctgctcaggactggaacctcacacccctagcgttgggagtcaggagtctgtcaccttccaggacgtcgccgtcgatttcaccgagaaagaatggccactgctggactccagccagcggaaactgtacaaggatgtcatgcttgaaaactacagtaacctcacatctctgggtaaggccagcgctatttctccactgattcatccctag

SEQ ID NO: 247520 - DNA, 822 bp, Artificial Sequence
  Description of Artificial Sequence: Synthetic coding sequence
atgtttggatttcctacagctaccttgctagattgccacgggagatacgcccagaatgttgccttctttaatgtgatgaccgaggctcatcacaagtatgaccatagtgaggcaactggttcaagttcttgggacatccagaatagcttccgacgagaaaagctggaacagaagagtccggatagcaaaacactccaagaggactctcccggagtgcgccaacgtgtgtacgagtgtcaggagtgtgggaaatccttccgtcagaaaggatcattaacccttcacgaacgcatccacacaggtcaaaagcccttcgagtgtacacactgtggtaaaagtttccgggctaaaggcaatttggtcacacaccaaagaatacacactggggagaaaccctatcagtgcaaggagtgcggcaagagctttagccaacgtgggtctctggctgttcacgagcgtttacatacagggcagaagccttatgagtgtgctatatgtcagaggtccttccgcaaccagagtaacctcgctgtccaccggagggttcacagtggcgagaagccataccggtgcgaccagtgtgggaaagcgttctctcaaaagggatcccttatcgttcatatccgcgtgcacaccggactgaagccttacgcttgcacgcagtgccgcaagtcattccacacacgcggtaactgtattctgcatgggaagatacacacaggggagaccccctacttatgtggtcagtgtggcaagtccttcactcagcggggatcgcttgcggtgcatcagaggtcctgcagtcaacggctgacgctgtag

SEQ ID NO: 247521 - DNA, 822 bp, Artificial Sequence
  Description of Artificial Sequence: Synthetic coding sequence
atgttcggcttcccaacagcaaccctactcgactgtcacggtcggtatgcccaaaacgtcgcattcttcaatgtgatgactgaggcgcaccataagtacgaccactccgaagccactggctcctccagttgggacatacaaaattccttccggagagagaagctggaacagaagtcccctgactcaaaaacactgcaggaagattcacccggagtcaggcagagggtgtacgaatgtcaagaatgcgggaagtctttcagacaaaaggggagcctgaccttacacgaacggatccacacaggccagaagccgtttgaatgcacacattgcggaaagtcattccgtgccaaggggaaccttgtgacacaccaaagaattcatacaggtgaaaagccttaccagtgcaaggagtgtggtaagtcattctctcagcggggttcactggccgtgcacgagcgcctccatactgggcagaagccctacgaatgcgccatttgccagcggtctttcaggaaccaaagtaatctcgctgtccatcggagggtccattcaggagaaaaaccctacagatgcgaccagtgtggaaaagccttctcccagaaaggatctctgatcgtacacatcagagtgcacacaggtttgaagccatatgcatgtactcagtgtcgaaaatctttccacacacgcggtaactgcatactgcacggaaaaattcacacaggagaaactccgtacctctgtgggcagtgtggaaagtcgttcacacagcgaggctctttggccgtgcaccagcgttcctgctctcagagactgactctctag

SEQ ID NO: 247522 - DNA, 1530 bp, Artificial Sequence
  Description of Artificial Sequence: Synthetic coding sequence
atggcgcttagtcaaggattactgacgtttagggatgtcgccatcgaatttagccaggaagagtggaagtgcctggatcccgctcaaagaaccctctatcgagacgtcatgcttgaaaattaccggaaccttgtaagcttggacatttcctcaaagtgcatgatgaacactctgagctcaactggacagggaaacacagaggtcatccacactgggacactgcagcgccaggcgagctaccacatcggggcattctgtagtcaggagattgagaaggacatccacgattttgtgttccagtggcaggaggacgagactaatgatcacgaggcccctatgacggagataaagaaactcaccagctcaacggacaggtatgatcaacgccacgcagggaacaagcctattaaaggacagttagagagcagattccatctgcacctgaggagacatagaaggattcacactggggaaaagccctacaagtgcgaggaatgtgagaaggtgttttcctgcaagtctcatttggaaatacaccggatcattcacacaggtgagaagccgtacaagtgcaaggtctgcgacaaggcgtttaaacacgacagccacctggcaaaacatacacggatccaccggggtgataagcactatacctgtaacgaatgtggcaaggtctttgatcagaaagcaacattggcctgtcatcaccgctcacacacgggagagaagccatacaagtgcaatgaatgtggaaagacattcagccaaacaagccacctggtgtaccatcaccggcttcatacaggtgagaaaccctataagtgcaacgagtgtgggaagacctttgcccgaaacagcgttctagtgattcacaaggcagtgcatacagcagaaaaaccctacaaatgtaacgagtgtgggaaggtgttcaaacagagagcaaccctggccggacatcgccgtgtgcacaccggggagaagccctataggtgcgaagagtgcgataaagtatttagtcgtaagtcgcaccttgagcgccatcggaggattcacaccggagaaaagccttataagtgcaaagtctgcgacaaggccttcaggagtgattctcgactggctgagcatcagagggtccacacaggcgagcgtccctacacctgcaacgaatgcggaaaggtcttcagcacaaaggcgtacctcgcgtgtcaccagaagctccacactggagagaaattgtatgaatgtgaggaatgcgacaaagtttacatccggaagagccatctggaacgtcatagaaggatacatacgggagaaaagccacataaatgtggcgattgcggaaaggccttcaatagcccgtctcatcttatccgtcaccaacgtatacatacaggacagaaatcttacaagtgccatcaatgcggaaaggttttcagtttgaggtccctcttggcagaacatcagaagatcccattcggcgacaactgttttaagtgcaacgaatattcaaagccatccagcattaactag

SEQ ID NO: 247523 - DNA, 1530 bp, Artificial Sequence
  Description of Artificial Sequence: Synthetic coding sequence
atggccctgtcccagggtctgctcacctttcgcgacgtagcgatcgagtttagccaggaggaatggaagtgtttagacccagctcagcgcactctatatcgagacgtgatgctcgagaactacagaaacctcgtctccctcgacatttcatcgaagtgcatgatgaacaccctttctagtacaggtcaaggcaacactgaggtgattcacacagggactctgcagcggcaagcctcctaccatatcggtgcattctgttcccaagagattgaaaaggatattcacgacttcgtgtttcagtggcaagaggatgaaacaaatgatcacgaagccccaatgactgagatcaagaaactcacatctagcaccgaccgctatgaccagcgacacgccggtaacaagccaattaagggtcagctcgagagtaggtttcatttgcacctgaggcgacacaggagaatccacaccggagagaaaccctacaaatgtgaggaatgcgaaaaggtcttttcgtgtaagtcacatctcgaaatccaccgaattatccataccggcgaaaagccatataagtgcaaagtgtgcgataaggcattcaaacacgatagtcaccttgccaagcacacacgcatccatcggggtgacaagcattatacgtgcaacgagtgtggaaaggtgtttgatcagaaggctactctggcttgccatcatagatcacatactggagagaagccctacaaatgtaacgaatgcgggaagaccttttctcaaacatctcacttggtataccatcacagactgcataccggtgaaaaaccatacaagtgtaatgagtgtggaaagaccttcgctaggaatagtgtgctcgtgatccacaaagcagtgcatacagccgaaaaaccctacaagtgcaatgagtgcggcaaggtgttcaagcagcgggctactctagcaggtcacagacgtgtgcatacaggcgagaaaccctatcgctgtgaggagtgtgacaaggtattctctcgcaagtctcatctcgaaaggcataggcgcatccatacgggcgagaaaccatataaatgcaaagtctgtgacaaagcgttccgatctgactcaaggttggccgagcaccagagagtccatacaggagagaggccctacacatgtaacgagtgtgggaaagtgttctccacgaaagcttatctggcatgccaccagaagttacacaccggggagaagttatacgagtgtgaggaatgtgacaaggtgtacattaggaagtcccatcttgaacgccatagaagaatacacactggagaaaaacctcataaatgcggcgattgcggcaaagcctttaactctccctcgcacttgatccggcaccaaagaatccatacaggtcagaaatcgtacaagtgtcaccagtgtggaaaggtcttctcccttcgcagtctgttggctgaacaccaaaaaataccattcggggacaactgtttcaaatgtaacgagtattcaaaaccaagttcgattaactag

SEQ ID NO: 247524 - DNA, 1209 bp, Artificial Sequence
  Description of Artificial Sequence: Synthetic coding sequence
atgtacacgagcgaggaaaaatgtaaccagcggacacagaagaggaaaatctataatgtgtgtccacggaagggtaagaagatatttatccatatgcatgagataatccagatagatggtcacatctatcagtgcctagaatgcaaacaaaacttttgtgaaaatctggctctgattatgtgcgaaagaacgcatacaggagaaaaaccatacaaatgcgacatgtgtgagaagacctttgtgcaatcgagcgatcttactagtcaccagaggattcacaactacgaaaaaccttacaagtgcagtaagtgcgaaaaatccttctggcatcacttggcgcttagtggtcaccagaggacacacgcaggcaagaaattctatacctgtgacatctgcgggaaaaattttggtcagagttccgacttattggttcaccaacgatctcacacgggcgagaaaccctatctctgtagcgaatgcgataagtgcttctcaagatcaaccaatctgattagacatcggagaactcatactggtgagaaacctttcaagtgtctggaatgcgaaaaagccttcagcggcaaaagtgatcttatcagtcaccaacggacacacaccggcgaaaggccctacaaatgtaacaagtgcgagaagagctacaggcataggagcgcctttatcgtccacaagagagtccacacgggcgaaaagccatacaagtgcggcgcatgcgagaaatgttttggccagaagagcgatctgatagttcaccaaagggtgcacacaggggaaaagccctacaaatgcctcgagtgcatgaggtcgtttacacggtcagctaacttgatcaggcaccaggctactcacactcacacctttaagtgcctggaatatgaaaaatctttcaattgtagctctgatttgattgtccatcagagaattcatatggaagagaagccccaccagtggtctgcttgcgaaagcggattcttgttaggtatggacttcgtggctcagcagaagatgaggactcagaccgaagaactgcactataagtacacagtctgtgataagtcattccaccaatctagcgcactgttgcaacaccagacagtgcatatcggagaaaaaccatttgtgtgtaacgtttctgagaaggggctggagctctcccctccacatgcctcagaggcgagccaaatgagctag

SEQ ID NO: 247525 - DNA, 1209 bp, Artificial Sequence
  Description of Artificial Sequence: Synthetic coding sequence
atgtacacaagtgaagaaaagtgcaaccagaggacacagaagcgaaagatctataacgtgtgcccaagaaagggaaagaagatcttcatacatatgcacgaaatcatacagattgatggacatatctaccagtgcctggagtgcaaacagaacttttgcgaaaatttagccctgataatgtgcgaacgcactcacaccggcgaaaaaccctataagtgcgatatgtgtgaaaagaccttcgtgcagtcatcagacctgacgtctcatcaacgaatccacaactatgagaagccttacaaatgtagcaagtgtgaaaagtccttctggcaccacctagcactgagcggccaccagaggacacatgccggtaagaagttttatacatgcgatatttgcggcaagaactttgggcaaagcagcgatctgctcgtacatcagagatctcacactggggaaaaaccatatctgtgctctgagtgcgataaatgcttttcaagaagtaccaacctcatccggcataggcggacacatactggcgagaagccatttaagtgtcttgaatgtgagaaagcattctctgggaagtcggatctgattagtcatcagagaacacacaccggcgaaagaccctataagtgcaacaagtgtgagaagtcctatcggcatcgttctgcttttatcgtacacaaacgcgtgcataccggtgagaagccttataagtgcggggcatgtgaaaagtgttttggacagaagtcagatttaatcgtgcatcagagagtgcacacaggcgaaaaaccatataagtgccttgagtgcatgaggagtttcactagaagcgccaaccttattcgccatcaggctactcatacacacacctttaagtgcttggaatacgaaaaatccttcaattgctccagcgatttgatcgtccaccaaagaattcacatggaggaaaaaccccaccagtggtccgcctgtgaatctgggttcctccttggcatggacttcgtcgcccaacagaagatgagaacgcagaccgaagaactccactacaagtacacagtctgcgataagagcttccaccagagcagcgcactgctgcaacatcagacagtgcatataggggagaaaccttttgtgtgtaacgtgtcagagaaaggtctggaattgtcccctcctcatgctagtgaggcttcacagatgtcttag

SEQ ID NO: 247526 - DNA, 81 bp, Artificial Sequence
  Description of Artificial Sequence: Synthetic coding sequence
atgtatacatccgaagaaaagtgcaaccagagaacacagaagcgtaagatctataatgtttgtccaagaaaggggaagtag

SEQ ID NO: 247527 - DNA, 1221 bp, Artificial Sequence
  Description of Artificial Sequence: Synthetic coding sequence
atggcttcaaccgaggagcaatatgatttaaaaattgtgaaagttgaggaggatcccatctgggaccaggaaacacatctgagaggaaataacttttcaggacaggaagccagtagacagctttttcggcaattctgttatcaagagacccccggtcccagggaagctctttccaggttaagggagttatgccaccagtggctccggccagagattcacacaaaagagcagattttggagttgctcgtgctcgagcaatttctgaccatcctccccgaggaactgcaggcatgggtgagggagcaccatcctgagagcggggaggaggcagtggctgtggtggaggatttagaacaggagcttagcgaaccaggaaaccaggccccagatcacgagcacggccactccgaagtgctcctggaggatgttgaacatctgaaggtcaaacaggagccgacagatatccagctccagcctatggtcacccagcttaggtatgagagtttctgtttacaccagttccaggaacaggatggtgagtcgatccccgagaaccaggaactggccagcaagcaggaaatcctgaaggagatggaacatctgggtgatagcaagctgcagcgggatgtgtcgttggacagtaaatatcgagagacatgcaaacgggacagcaaggctgagaagcagcaagcccattcaactggcgagcgccgtcatcggtgcaatgagtgtggcaagagctttaccaagtcctccgtactgatcgaacatcagcggatccacacaggcgagaagccctatgagtgcgaagagtgcgggaaagcattttcccggagatcgtctctcaacgagcatcgaaggtcacacaccggagagaagccttatcagtgtaaggagtgcggaaaagcctttagcgccagtaatggtctgacccggcaccgcaggatacacaccggtgaaaaaccgtatgaatgcaaagtttgtgggaaagccttcctcctatcatcttgcctcgttcagcaccagcgcatccacactggcgagaaacgctatcagtgccgggaatgcgggaaggccttcattcaaaacgcagggctgttccagcacttgcgcgtccacactggggagaaaccctatcagtgttcacagtgctccaagctgttcagcaagcggaccttgctcaagaagcatcagaagatccacaccggtgaacggccatag

SEQ ID NO: 247528 - DNA, 1221 bp, Artificial Sequence
  Description of Artificial Sequence: Synthetic coding sequence
atggcttccactgaagagcagtacgacctcaaaatagtcaaagtagaagaagaccccatctgggaccaggaaacacatctgagaggcaataactttagtggacaggaagcctctcggcaactgtttaggcagttctgttaccaggaaacacccggacccagggaggccctgtctcggcttagagagctctgccaccagtggctgaggcccgagatacacactaaggaacagatattagaactgttggtgctggaacaatttttaaccatcctccctgaggaacttcaggcgtgggtgcgggagcatcaccctgaatcaggtgaggaagctgtggctgtggtggaagatttggaacaggagctgagcgaacctgggaaccaagcacccgaccacgagcacggccactctgaagtgctcctcgaagatgtcgaacatctcaaggtgaagcaggaaccgactgatattcagctgcagccaatggtgactcagctcagatacgaatctttctgtctgcaccaattccaagaacaggatggagaaagtatcccagaaaatcaggagcttgcgtcaaagcaggaaattctgaaagaaatggagcatttgggtgacagtaagctgcagcgggacgtgtcgttagacagcaagtaccgcgagacctgcaagcgggatagtaaagctgagaagcagcaagctcactccacaggtgagcgcagacatcgttgcaatgaatgcggcaaatcctttaccaagagcagtgtactcatcgagcatcaaagaatccacaccggcgagaagccctacgagtgtgaagaatgcggcaaagcattctcccggagatcaagcctgaatgaacatcggagaagtcatactggcgaaaagccctatcagtgtaaggagtgtggaaaagccttctccgccagcaacggactgaccaggcatagacggatccatacaggcgagaagccatacgaatgtaaggtgtgtggtaaagcattccttctctcttcctgcctggtccagcaccagcgcatccatacgggcgaaaaacgctaccagtgtagagagtgcggcaaggcatttatccagaacgccggactgtttcagcatctgagggtgcatactggtgagaaaccttaccagtgttctcagtgttcaaagctattctctaaaagaactcttctcaaaaaacaccagaagattcacactggcgaacggccatag

SEQ ID NO: 247529 - DNA, 1221 bp, Artificial Sequence
  Description of Artificial Sequence: Synthetic coding sequence
atggccagcactgaggagcagtacgatcttaagattgtcaaggttgaggaagaccccatttgggaccaggaaacacatctgagagggaacaacttttccggccaagaagcatcaagacagctttttagacagttctgctatcaggaaactccgggaccaagggaggccctgtccagattgcgggaactatgtcaccaatggctccggccagagatccacacaaaggagcagatccttgagctgctcgttctggagcaatttcttactatcctgccagaggagctccaggcatgggttagagagcaccatcccgagtctggcgaggaggctgtggcagtggtcgaggacctggaacaggagctgtccgagccaggaaaccaggctcctgatcacgagcacggacactccgaggtcctcctcgaagacgtcgagcaccttaaagtgaagcaggagcccaccgacatccaattgcagccaatggtgacccagcttcgctatgagtctttctgcctgcatcaatttcaggagcaggacggggagtccatcccggagaaccaggagctggcctcaaaacaagaaatcctgaaagagatggagcatctgggggacagtaaactgcagagggatgtttctcttgatagtaagtatagggaaacttgtaagcgagactccaaggccgaaaagcagcaggcccactccacaggtgagagacgtcacaggtgcaacgagtgtgggaagtccttcacaaagtcaagcgttctgatcgagcaccagaggattcacacgggcgaaaagccttacgagtgcgaggagtgtggtaaggcctttagtcggaggagttctctcaacgagcacaggcgaagtcataccggagagaagccctatcagtgcaaagagtgtggtaaggcttttagcgcctcaaatggacttacgaggcaccggagaatccatactggagagaagccctacgagtgcaaggtatgcgggaaagcattcctgctgtcctcttgtctggtccagcatcagcggatacacaccggagagaagcgctatcagtgtagggagtgtggcaaggcattcatccagaacgctggcttgttccagcacctaagggtgcacactggcgagaaaccgtaccagtgcagtcagtgctctaagctgttttcaaaacgcacgttattaaaaaagcaccaaaaaattcataccggtgaacgcccatag

SEQ ID NO: 247530 - DNA, 324 bp, Artificial Sequence
  Description of Artificial Sequence: Synthetic coding sequence
atggcttcaacagaggagcaatatgacttgaaaatagttaaggtggaggaagatcctatttgggatcaagaaactcatttaagaggaaataacttcagtggccaggaggcctctaggcagttattccgccaattctgttaccaagaaactcccggacccagagaagcccttagccggctgcgtgagctctgccaccagtggttaaggccggaaatacataccaaagagcagatccttgagcttttggtattagaacagtttcttacaatcctgccagaggagctacaggcctgggtgcgggaacaccaccccgaatcaggatag

SEQ ID NO: 247531 - DNA, 237 bp, Artificial Sequence
  Description of Artificial Sequence: Synthetic coding sequence
atggcttccacggaagaacagtatgacctgaaaattgtgaaagtggaagaggaccccatctgggaccaggaaacacacttgcggggtaacaactttagcggccaggaggcaagtaggcagctgtttagacagttctgttatcaagagacccctggtccacgtgaagccctgtctcggctccgcgaattatgtcatcagtggctgaggcccgagattcacactaaggagcagatctag

SEQ ID NO: 247532 - DNA, 1221 bp, Artificial Sequence
  Description of Artificial Sequence: Synthetic coding sequence
atggcctccactgaggaacagtatgatctgaagattgtgaaagttgaagaagaccccatttgggaccaggagacccacctcaggggtaacaatttctctggccaggaggcttcacgccagttgttccgacagttttgctaccaagaaactccagggccacgcgaggcactgagccggttaagagagttgtgccaccagtggctccggccagaaattcacacaaaagaacagatcctggaacttttggtgttagaacagttcttgaccatattgccagaggagctgcaggcatgggtgcgtgaacatcatcccgaatccggagaagaggctgtggcggtggtggaggatttagagcaggagctaagcgagccgggaaaccaagctcctgatcatgaacacggacacagcgaagttctgctggaggatgtggaacaccttaaagttaagcaggaacctactgacattcagctccagcctatggttacccaactgagatacgagagtttttgcttgcaccagtttcaggagcaggacggcgagtcaatccctgagaaccaggaactggcatcaaagcaggagattctcaaggagatggagcatctgggcgattcaaaactgcagagagatgtcagccttgattctaagtatcgcgagacatgtaagcgtgacagcaaggctgaaaaacagcaagctcacagtacaggggagagaagacatcgatgcaatgagtgtggcaagtctttcaccaagtctagcgtgctcatagaacaccagagaatacatacgggcgaaaagccttatgagtgcgaagaatgcgggaaagctttcagtcggcgatcctcactcaacgaacacaggcggagccacaccggtgagaagccctatcaatgtaaggagtgcggcaaggcattttctgccagcaacgggctgacacggcaccgtcgcatccatactggcgagaagccctacgaatgcaaagtgtgtgggaaagcctttctgctcagtagttgtctagttcagcaccagagaatacatacaggcgaaaagcggtaccagtgtagagagtgcggcaaagccttcatccagaatgcaggattattccaacatctgagggtgcatacgggggaaaagccgtatcagtgtagtcagtgctccaagctgttctccaaaagaaccctgcttaagaagcatcagaaaatccacacaggagagcgaccctag

SEQ ID NO: 247533 - DNA, 54 bp, Artificial Sequence
  Description of Artificial Sequence: Synthetic coding sequence
atggcctctactgaggagcaatatgacctgaaaatagtaaaggtggaagaatag

SEQ ID NO: 247534 - DNA, 468 bp, Artificial Sequence
  Description of Artificial Sequence: Synthetic coding sequence
atggcatcaaccgaagaacagtatgacctcaaaatagttaaggtggaagaagatccgatctgggatcaagagactcatctcagaggcaacaacttctctggtcaggaggcctcacggcagctgtttcggcaattttgctaccaggaaacacctggcccacgcgaggccctcagcaggctgcgggaactttgtcaccaatggctcagacctgagattcacacaaaggaacagattctcgagctcctggtcctagaacagttccttacaattcttcctgaagaactgcaggcatgggtaagggaacatcaccctgagtcaggtgaagaggctgtggctgtcgttgaagatttagagcaagagctgtcagaacccggaaatcaagccccagaccatgaacatgggcattctgaagtcctcctcgaggacgttgaacatctcaaagtaaagcaagagcctaccgacatatag

SEQ ID NO: 247535 - DNA, 75 bp, Artificial Sequence
  Description of Artificial Sequence: Synthetic coding sequence
atggcctccactgaagaacaatatgatcttaaaatcgtgaaagtcgaagaggaccctatctgggaccaggagtag

SEQ ID NO: 247536 - DNA, 312 bp, Artificial Sequence
  Description of Artificial Sequence: Synthetic coding sequence
atggccagtaccgaagaacagtatgacttaaagatcgtcaaagtcgaagaggatcccatttgggaccaagagactcatctgagaggcaataacttcagcggccaggaagcctcacgtcagttgttccggcagttttgttatcaagagacgccgggtccccgtgaagcgcttagcaggttaagagagctgtgtcatcagtggctcaggcccgagatccacaccaaagaacagatcctggagctattagtcttggagcagttcttgactatcctccccgaggagctgcaggcatgggtccgtgagcatcactag

SEQ ID NO: 247537 - DNA, 447 bp, Artificial Sequence
  Description of Artificial Sequence: Synthetic coding sequence
atggctagtaccgaggaacagtatgatctgaaaatcgtgaaagtggaagaagacccaatctgggaccaggagactcaccttcggggaaataatttcagcggtcaggaggcttctcggcagctgtttagacagttttgttatcaggagacccccggaccacgcgaagccctgtcccgtttacgagaattatgccatcagtggctgaggccagagattcacaccaaagaacagatcctggagctgttagtgcttgaacaatttttaacaatcctgcctgaggaactgcaggcatgggttcgtgaacatcaccccgagtctggggaagaagcagttgctgtagtggaggacctggagcaggagttgtccgaacctggcaaccaggcccctgatcatgagcatggtcactctgaggtgttgctagaggacgtggaacatctgaaagtgtag

SEQ ID NO: 247538 - DNA, 654 bp, Artificial Sequence
  Description of Artificial Sequence: Synthetic coding sequence
atggcctccaccgaggagcagtatgacctgaagattgtgaaggtggaagaggatcccatctgggatcaagaaacacatcttcggggtaacaacttctccggacaggaggcgtctcggcaactttttagacaattttgttaccaggagacacctggtcctcgagaggcactctcgcgtctcagagaactgtgccatcagtggttaaggcctgagatccataccaaagaacagattctggagctgctggtactggagcagttcctgaccatacttcccgaggagctccaggcctgggtaagggagcatcaccccgagagcggagaggaggctgtcgccgtagtagaggaccttgagcaagagctttctgagcccggaaaccaggccccagaccacgagcacggccactcagaagtactgctggaagacgtggaacacctgaaggttaaacaggagcctacagatatccagcttcagcccatggtcacccagctcaggtatgagagcttctgcctgcaccagtttcaggaacaggatggagagtccattccggaaaaccaggaactggcttccaagcaggagatcttaaaagagatggagcacctcggggactcgaaactgcagagggatgtttcactggattccaagtaccggtag

SEQ ID NO: 247539 - DNA, 963 bp, Artificial Sequence
  Description of Artificial Sequence: Synthetic coding sequence
atgcctaagaagaaaactggcgctcggaaaaaagctgaaaataggagagaaagggaaaagcaactcagagcctcacggtccacaattgacctagccaaacacccgtgcaacgcttccatggagtgtgacaaatgccaacgcagacagaaaaatcgcgctttttgctacttttgcaatagtgttcaaaagctgcctatttgtgcgcagtgtggaaaaactaagtgcatgatgaaatcatctgactgtgtgattaagcacgccggagtttatagcaccggattggctatggtcggcgcaatatgtgatttctgcgaggcctgggtctgccacggtcggaagtgcttatcaactcatgcatgcgcgtgtcccctgactgatgcagagtgtgttgagtgcgaacgtggagtctgggaccacggaggcaggatttttagttgctcattctgccacaactttctgtgcgaggacgaccagttcgagcaccaggctagctgccaggtgctggaggctgaaacttttaagtgcgtatcgtgtaataggctgggacaacattcctgtctgaggtgcaaggcctgtttttgcgatgaccatacgcgttcgaaggtgtttaagcaggagaaaggtaagcaacccccttgtcctaaatgtggccacgagactcaggagactaaagatctgagcatgagcacgcgttcgctgaagttcggtagacagaccggcggagaggagggcgatggcgcttcaggatatgatgcgtactggaagaatctctcctccgataaatacggcgatacatcctatcatgatgaggaggaggacgaatacgaggccgaggacgacgaagaagaggaggatgaaggcagaaaggattccgatacggaaagctccgacctgttcacaaacctgaacctgggacgcacttacgctagcggttatgcccattatgaggagcaagagaactag

SEQ ID NO: 247540 - DNA, 783 bp, Artificial Sequence
  Description of Artificial Sequence: Synthetic coding sequence
atgccccagtggaacgtgacaagcgtcagggggaaaaccaaatgtatgatgaagtcaagtgattgcgtcatcaagcatgctggcgtgtatagcaccggattagccatggtgggggcaatatgtgacttctgtgaagcctgggtttgtcacggcaggaaatgcctcagcacccacgcctgtgcgtgcccccttacagacgcagagtgtgtggaatgcgagcgaggcgtctgggatcatggtggccgtattttcagctgcagcttttgccacaattttctttgcgaagacgaccaatttgagcaccaggcaagctgtcaggtgctcgaggccgaaacgttcaaatgcgtgtcttgcaataggttgggccagcactcttgtctgcggtgcaaagcatgcttctgtgacgatcacacacggagtaaagtcttcaaacaagaaaaaggaaaacagcccccttgccccaagtgtggccatgagacccaagaaacaaaagacctgtccatgagtacgcggagcctgaagtttgggagacagaccgggggtgaggaaggggatggagcatccggctatgacgcttactggaaaaatttgtccagcgataagtatggtgatactagctatcacgatgaggaggaggacgaatatgaggcagaggatgacgaagaggaggaggacgaggggaggaaagattctgacactgaatcaagcgacttattcacaaatttgaatctgggacgaacgtacgctagcggatatgcccactacgaggaacaggaaaattag

SEQ ID NO: 247541 - DNA, 423 bp, Artificial Sequence
  Description of Artificial Sequence: Synthetic coding sequence
atgcctaaaaagaagaccggagctcgcaagaaggcggagaatcgcagggaacgcgaaaaacagctgcgcgcatcgcggagcactattgatctggcgaagcacccctgcaatgcatccatggaatgcgataagtgtcagcgccgacagaagaatagagcattttgctacttctgtaattccgtgcagaaacttcccatctgcgcccagtgtggcaagaccaaatgtatgatgaagtcttccgattgcgtcatcaagcacgcaggcgtttactctaccggcttggcaatggtgggagccatttgcgacttttgtgaggcctgggtctgtcatggaagaaaatgcctcagcactcacgcctgtgcatgcccccttacagacgccgagtgcgttgagtgcgagcgcggtgtgtgggatcatggatag

SEQ ID NO: 247542 - DNA, 462 bp, Artificial Sequence
  Description of Artificial Sequence: Synthetic coding sequence
atgccaaaaaagaaaaccggagccaggaagaaagcagaaaatagaagggagcgcgagaagcagctgagagctagcagaagtacaatagacttggccaagcacccgtgtaatgcttccatggagtgtgataagtgccaaagaaggcagaaaaatcgcgcattctgctatttttgtaattctgttcagaagctgccgatttgcgctcaatgtggtaaaacaaagtgcatgatgaagagcagcgactgcgtcatcaagcacgctggcgtgtacagcactggcctggccatggtcggcgcaatctgcgacttttgcgaggcatgggtttgtcatggaagaaagtgtctgagcacccatgcttgcgcatgccctctgaccgatgctgaatgcgtggagtgtgaaagaggggtatgggaccacggcggaagaatcttcagttgctccttctgtcacaattttttgtag

SEQ ID NO: 247543 - DNA, 690 bp, Artificial Sequence
  Description of Artificial Sequence: Synthetic coding sequence
atgccaaagaagaaaaccggagccagaaaaaaggccgagaacaggcgcgagcgggaaaagcagttaagggctagtaggagcacaattgaccttgctaagcatccttgcaatgcttcaatggagtgcgacaagtgccagaggcgccagaagaaccgcgcattctgctatttttgcaacagcgttcagaagttacccatatgcgcccagtgcggtaaaactaagtgcatgatgaaaagctcggactgcgtgatcaaacacgcaggggtgtactctaccgggcttgccatggtgggagccatttgtgatttttgtgaggcatgggtgtgtcacggacggaagtgtcttagtacccacgcgtgcgcatgtcccttaaccgacgcagagtgtgtcgagtgtgaacggggtgtgtgggatcatggtggaagaatcttcagctgctccttttgccataacttcttgtgcgaagatgatcagttcgaacatcaggccagttgccaagtcttggaggccgaaaccttcaagtgcgtgagctgcaatcgccttggccagcattcatgtctgcgttgtaaggcatgcttctgcgacgaccacacacgatctaaggtgttcaaacaggaaaagggtaagcagccaccttgtcccaagtgcggccacgaaacacaagagactaaggatctcagcatgagctag

SEQ ID NO: 247544 - DNA, 1392 bp, Artificial Sequence
  Description of Artificial Sequence: Synthetic coding sequence
atggcccagggcctcgttactttcgccgacgtcgccatcgacttctcgcaggaggaatgggcctgtctgaactcagcgcaaagagacctatattgggacgtcatgctggaaaactactccaatctcgttagtttggatctggagtcagcatacgagaacaaatcactgccgaccgagaagaacatccacgaaattcgcgcttctaagcggaattccgaccggcgttccaagtccttggggcgtaattggatatgtgaaggtaccctggagagacctcagagatcccggggtcgatacgtgaaccagatgatcattaattacgtgaaaagacccgcaacccgggaaggaacaccaccaaggactcaccaacggcaccacaaggaaaactcattcgaatgcaaggattgcggtaaagcattttcgagaggctaccagctttcccaacatcaaaagatccacaccggagagaaaccttatgagtgtaaagagtgcaagaaagcctttcgttggggcaaccagctgacccaacaccagaagattcacacaggggagaaaccttacgaatgtaaggattgcggcaaagcttttagatggggtagcagtctggttatccacaagcggatccatacaggagagaagccgtacgagtgcaaggattgcggcaaagcttttcgcagaggtgatgagttgacccagcaccagaggtttcacaccggagagaaggactatgagtgcaaggattgcgggaagacattctctagagtctataagctgatacagcacaaaagaatccactcaggcgagaagccatatgagtgcaaagattgtggcaaggcttttatctgtgggtcatctctcatacagcataagcgcatccacactggggaaaaaccatacgaatgccaggagtgcggcaaggcttttacaagggtgaattacctgacccaacaccagaagatacataccggcgaaaaaccccacgagtgcaaagagtgtggtaaggcattcagatggggctcttcactggtgaaacatgagagaatccacactggcgaaaaaccctataaatgcactgagtgtggaaaggcatttaattgcggctatcacctcacgcaacacgagagaattcatacaggcgagacgccatacaaatgtaaagaatgcggcaaggcgttcatctacggttcgtcactggttaagcacgagaggattcataccggtgtcaagccttatggctgcaccgaatgtgggaaaagttttagccatggccaccagctgacacagcaccaaaagacccatagcggagcaaaatcctacgaatgtaaggagtgcggcaaagcatgtaatcatttgaatcacctgcgcgagcaccagagaattcacaacagctag

SEQ ID NO: 247545 - DNA, 1392 bp, Artificial Sequence
  Description of Artificial Sequence: Synthetic coding sequence
atggcacagggtctcgtcactttcgcagacgtcgctatcgactttagccaggaggagtgggcctgtcttaatagcgcacagcgcgacctctattgggatgtgatgttggaaaactattcgaacctagtgagtctggacctggaatccgcctatgagaacaaatctctgcctacagaaaaaaatatccatgagattagagcaagtaaaaggaacagtgaccgacggagcaagagcttgggcaggaattggatctgcgagggaaccctcgaaagacctcagcgctcccgcggaagatatgtgaaccagatgataattaattacgtaaagcgccctgcaacacgcgagggtacacctcccagaacccaccaacggcaccataaggagaactctttcgagtgtaaggattgtggcaaggcgtttagtagaggatatcagttatctcaacaccaaaagatccatacaggcgagaagccttacgaatgcaaggagtgcaaaaaagccttcaggtgggggaaccagctgacccagcaccagaaaatccatactggagaaaaaccctacgagtgcaaggactgtggcaaggcctttaggtggggtagttctttggtgattcacaagcgcatccacaccggtgaaaaaccatacgagtgcaaggactgcggcaaagccttccgcaggggggatgagctcactcaacaccagcgattccataccggagaaaaggattatgaatgcaaggattgcgggaaaactttctctagagtgtataagctgattcagcataaacggatccacagcggcgaaaaaccatacgagtgcaaagattgtggaaaggctttcatatgtggatccagcctgattcagcataaacgcattcacaccggtgaaaagccttatgagtgccaagagtgtggaaaggcattcacacgtgtgaattatctgacccagcatcagaagattcataccggggagaaacctcacgagtgcaaagagtgcggtaaggccttccgctggggctcctctctggtcaaacacgagaggatccacacaggtgagaagccctataaatgtacagagtgcggcaaggcctttaactgtggctatcacttgacgcaacatgagagaatccacactggcgaaaccccatacaaatgtaaggagtgcgggaaagctttcatttatggctcctctctggtcaaacacgaaagaatccataccggggtcaaaccgtatggctgcactgagtgcgggaagagcttttctcacggccaccaacttacccagcatcagaagacccacagtggcgcaaaatcatacgaatgcaaagagtgcggcaaagcttgtaaccaccttaaccacctgagggagcaccagaggatccacaacagctag

SEQ ID NO: 247546 - DNA, 1392 bp, Artificial Sequence
  Description of Artificial Sequence: Synthetic coding sequence
atggctcaggggctggtcactttcgctgacgtggctattgacttctcccaagaggaatgggcctgcctgaacagtgcgcagcgggacctgtattgggacgttatgcttgaaaattactccaacctggtgtcactggacttggagagcgcctatgagaataaaagcttgcctactgagaagaacatccatgaaatacgggcttctaaacgtaatagtgaccggagatcaaagagcttggggaggaattggatttgtgagggcaccttggagcggccacagcgctctcggggtaggtatgtgaaccagatgatcattaattacgtgaagagacccgctactagagaggggacaccccctcgcacccaccagcggcatcacaaggagaacagctttgaatgcaaggactgcggcaaggccttcagccgtggataccagctgtcacagcaccagaaaatccacactggcgaaaagccgtatgagtgtaaggagtgcaagaaggccttccggtgggggaaccaattgacccagcatcagaagatccacacaggtgaaaagccttatgagtgcaaagattgtgggaaagcctttcggtggggatcctccctggtgatacataaacgtatacatactggtgaaaaaccttacgagtgcaaggactgtgggaaggctttccgcaggggcgacgaactgacacagcaccagcgcttccacacaggcgaaaaagattacgagtgtaaagattgtggaaaaacattttctcgtgtatataagctcatacagcacaaaaggatccacagcggggagaagccatatgagtgtaaagactgtgggaaggcttttatttgcggtagcagcttaatccagcacaagaggatccacacaggagaaaaaccttatgagtgtcaggagtgcggaaaagctttcacccgcgtcaattacctcacacagcaccagaaaatccacacaggggagaaaccacatgagtgtaaggagtgcggcaaggcattccgctggggcagctcccttgtcaaacatgaacgaattcatacgggcgagaaaccatataagtgcacagagtgtgggaaagcctttaattgtggctatcatcttacccaacacgaaagaattcacactggagagacaccgtacaagtgcaaagaatgcggaaaggcattcatctacgggagttcactggttaagcacgagcgcattcacacgggcgtcaaaccctacgggtgtacagagtgtggaaaatctttctcacacggccaccagctgactcagcatcagaaaacccacagtggcgctaaatcatatgagtgcaaggaatgtggtaaggcctgcaaccacctaaatcaccttagagagcatcaaagaatccataactcgtag

SEQ ID NO: 247547 - DNA, 192 bp, Artificial Sequence
  Description of Artificial Sequence: Synthetic coding sequence
atggcccagggactggttacattcgcagacgttgcaattgacttttcccaggaagaatgggcatgtcttaattccgctcagcgcgatttatactgggacgtcatgctggaaaactactccaatctggttagcctcgacctcgagtctgcttacgagaacaaatccctaccgactgagaagaacattcactag

SEQ ID NO: 247548 - DNA, 258 bp, Artificial Sequence
  Description of Artificial Sequence: Synthetic coding sequence
atggcacagggactggtgacctttgccgacgtggccattgacttctctcaggaggagtgggcttgtctcaactccgcacaacgggatctgtactgggacgtgatgctcgaaaactacagcaatcttgtgagtctggacctggagtccgcgtacgagaacaaatccttgcctaccgaaaaaaacatccacgagatcagagcttctaaaaggaattccgaccgcaggagtaaatcgctgggccgaaactggatttgctag

SEQ ID NO: 247549 - DNA, 201 bp, Artificial Sequence
  Description of Artificial Sequence: Synthetic coding sequence
atggcacaaggacttgttacgtttgccgacgtggctattgatttttcgcaagaggagtgggcctgcttgaactctgcacagcgcgacctgtattgggatgtgatgctggaaaattatagcaacttggtatccttggacctggagtcggcttatgaaaacaagagtctgcccacagagaagaatattcacgaaatcaggtag

SEQ ID NO: 247550 - DNA, 195 bp, Artificial Sequence
  Description of Artificial Sequence: Synthetic coding sequence
atggcccaaggattggtgacgtttgcagatgtagctatcgatttttcgcaggaggagtgggcctgccttaatagcgctcagagagacctttactgggatgtaatgttagaaaattatagcaatctggtgtcgctcgatctggaaagtgcatatgaaaacaagtccttaccaaccgagaaaaacatccatgagtag

SEQ ID NO: 247551 - DNA, 534 bp, Artificial Sequence
  Description of Artificial Sequence: Synthetic coding sequence
atggcacagggtttggtcacattcgccgacgttgctattgatttctcccaagaggaatgggcatgcctgaactccgcccagagagacctgtattgggatgttatgctcgaaaattattctaacttggtaagcctggacctggagtccgcctacgagaacaagtctttgcctactgaaaagaacatccatgaaattcgagcaagcaagaggaattctgacaggcggtcgaagagcctaggacggaactggatctgtgagggtacacttgagcgccctcagcgcagccgcggtcgttacgtcaatcagatgatcataaactatgtgaaacgcccagctacgcgagaaggcaccccacctagaacccatcaaagacaccataaagagaacagctttgagtgtaaagactgcggtaaagcatttagccgcggataccagctttcccagcaccagaaaatccacacaggcgagaaaccatacgaatgcaaggaatgtaagaaggccttcagatggggcaatcagctgacacaacattag

SEQ ID NO: 247552 - DNA, 264 bp, Artificial Sequence
  Description of Artificial Sequence: Synthetic coding sequence
atggcccaaggccttgttacgtttgcagatgtggctatcgactttagccaagaggagtgggcctgcctgaactcggctcagcgcgatctttattgggatgtgatgttggagaattactctaaccttgttagtttggatttggaatccgcctatgagaacaagagtctgcctaccgagaagaacattcatgagattcgcgcttccaaacgaaattctgaccgccgaagtaagtcccttggccgtaactggatttgcgaaggatag

SEQ ID NO: 247553 - DNA, 144 bp, Artificial Sequence
  Description of Artificial Sequence: Synthetic coding sequence
atggcacaggggcttgtgacattcgcagacgttgctatcgactttagccaggaggaatgggcctgtttaaactctgctcagcgggacctttattgggatgtaatgttagagaactactccaatcttgtatcgcttgatttatag

SEQ ID NO: 247554 - DNA, 1392 bp, Artificial Sequence
  Description of Artificial Sequence: Synthetic coding sequence
atggcacagggacttgtaacttttgccgacgtggctatcgacttctcacaagaagaatgggcctgtctcaacagcgcccaacgcgacctgtactgggatgtgatgttagagaattactctaacctggtgtccctggacctggagagtgcctatgagaacaaaagtttgccaacagagaaaaacatacacgaaattcgggctagtaagcggaactcagatcgcaggagtaagagtcttgggaggaattggatctgcgaagggaccctcgaacggcctcaaagatcccgaggacggtacgtcaaccaaatgatcattaactatgtgaaacggccagcaactagagagggcacacctcccaggactcaccaacgccatcataaagagaattccttcgagtgcaaagattgtggcaaggccttcagtagggggtaccagctatctcagcatcaaaaaattcacactggggagaagccctacgagtgtaaagagtgtaagaaggctttcagatgggggaaccagctgacccagcaccaaaagatccatactggcgagaaaccatatgaatgcaaagactgcggaaaggccttcaggtggggatcatccttggtgatacataaaagaatccacacgggagagaaaccctacgagtgcaaagactgtgggaaggcatttagacgcggagatgagctgacccagcatcaaaggttccacaccggggagaaggattacgagtgcaaagactgcgggaagaccttctccagggtttataagctcattcagcacaaaaggatccatagcggcgaaaagccctacgagtgtaaggattgtggcaaagcgtttatttgtggctcctccctaattcaacacaaacgtatacataccggggagaagccctacgaatgccaggagtgtggcaaggcctttacccgagttaattatctaacacaacatcagaagattcacacaggggaaaaaccacatgagtgtaaggaatgcggaaaagccttccgttgggggtccagtctggttaagcacgagcggatccatacaggcgagaagccatacaagtgtacagaatgtggaaaggcattcaactgcggttaccatctcacgcagcatgagcggatccacactggcgaaaccccctataaatgcaaggagtgcggcaaagcttttatttacggaagctcactggttaaacatgagcgaatccatacgggggtaaaaccctacggctgcacagagtgtggtaagagtttttcccacggccatcagctcacacagcatcaaaagacacactccggagccaagagttatgagtgtaaagagtgtggtaaagcctgtaatcatttgaatcatctgcgcgagcatcagcgcattcacaatagctag

SEQ ID NO: 247555 - DNA, 318 bp, Artificial Sequence
  Description of Artificial Sequence: Synthetic coding sequence
atggcccaggggctagtgacgtttgccgacgttgctattgatttctcacaagaggaatgggcctgcctgaatagcgcacagagggatctttactgggatgttatgttggaaaactactcaaatctggtgtccctcgatctggagtctgcatacgaaaacaagagtctcccaacagaaaaaaatattcacgagatacgcgcatcgaagagaaacagcgatagaagaagcaagtccctgggaaggaactggatctgcgaggggacactcgagaggccacaacggagtcgaggcaggtacgtgaaccagatgatcatttag

SEQ ID NO: 247556 - DNA, 1392 bp, Artificial Sequence
  Description of Artificial Sequence: Synthetic coding sequence
atggcccaagggttagttacctttgccgatgtggccatcgacttcagccaagaagagtgggcatgcctgaatagcgctcagagagacctgtactgggacgtaatgctggaaaactattctaacctggtcagcctcgatcttgaaagcgcctacgaaaataagagcctgccaacagagaagaacatccatgaaattcgagcaagcaagaggaacagcgataggcgatctaagtcattgggcagaaactggatttgtgaagggacactggagcgccctcagcgctcgcggggacgctatgtgaaccaaatgattattaactacgttaagcgccctgccacacgggaagggacccctccaaggacccatcagcgacatcataaagagaacagttttgagtgcaaggactgtggcaaggcgttttctagaggttatcagctcagccaacaccaaaaaatccatacaggagaaaaaccctatgagtgcaaagagtgtaagaaggcatttaggtgggggaatcagttaacacagcatcaaaaaatccatacaggtgagaaaccctacgagtgtaaggactgtggaaaagcctttagatgggggtcaagtttggtgatacataagcggattcacacaggagagaagccctacgaatgcaaggattgtgggaaggcatttcggagaggcgatgaactaactcagcaccagcgttttcacacaggtgaaaaggactatgaatgcaaagactgtgggaaaaccttcagtcgagtgtacaaattaatccagcacaaacgcatccactccggcgagaaaccctacgaatgtaaagactgcggaaaagcctttatatgtggcagttccctgatccagcacaaacggattcatacgggcgagaagccttatgagtgccaagagtgcggaaaggcttttacaagggtcaactacctgactcaacaccagaaaatccataccggggaaaagccacacgagtgcaaggagtgcggaaaggctttccgatggggatccagcctggtcaagcacgaacgaatccacacaggggagaaaccatataagtgtactgagtgtggaaaagcgttcaattgcggttaccaccttacccagcatgaacgcattcacacaggggagacgccctacaagtgcaaagagtgcggaaaggcattcatatacggcagcagtctcgtcaagcatgagagaatccataccggggtcaagccttatggctgcaccgagtgcggtaagagtttcagccacgggcatcagctgacgcagcatcagaagacacattcaggggctaagagttacgagtgtaaagagtgcggcaaagcctgcaaccacctgaaccacctgagggagcaccaaagaatacacaactcatag

SEQ ID NO: 247557 - DNA, 1392 bp, Artificial Sequence
  Description of Artificial Sequence: Synthetic coding sequence
atggctcagggccttgtgacattcgcagacgtagcgatcgatttctcacaggaagaatgggcatgccttaattctgcccagagggacctgtactgggatgtgatgttagaaaactatagcaatctggtgagcctcgacctggaatcagcctatgaaaacaagagcctccctacagaaaaaaacattcacgaaattcgagcttccaaacgcaattctgaccggaggagtaaaagcctgggcaggaattggatctgtgagggaacgttagaacggcctcagaggtctaggggacggtacgtcaaccagatgattataaactatgtaaagcgacccgcaacaagagagggcactcccccacggacacaccagagacaccacaaagagaatagcttcgagtgcaaagactgtggtaaagctttctccagaggctaccagcttagtcagcatcaaaagatacacaccggtgagaagccatatgaatgcaaggagtgcaaaaaggcttttcgctggggtaaccagctcacacaacaccaaaagatccacaccggagagaagccatacgaatgtaaggactgcggaaaagcgttccgctggggaagctctctggtcatccataaacgcattcacacaggtgagaaaccatatgagtgtaaggactgtggcaaggccttccggagaggcgatgaacttactcagcaccagagattccacacgggtgagaaggactacgaatgcaaggactgtggcaagaccttctctcgcgtctacaagctgatacagcacaagcgtatacattcaggagagaaaccctacgagtgtaaagattgtggcaaggcattcatttgcggatccagtttgattcagcacaagcgtatacatacaggtgagaaaccgtacgaatgccaagaatgtggcaaagcttttaccagggttaattacctgacacaacaccagaaaatccatacaggggaaaaaccccatgagtgcaaagaatgcggcaaagcgttccgctggggctccagtcttgttaagcacgaaaggattcataccggtgagaagccgtataagtgtactgagtgtggtaaagccttcaactgtgggtatcaccttacccagcatgagagaatccacacaggtgagacaccatacaaatgcaaggagtgcggaaaagcgtttatctacggctccagccttgttaagcatgaacgcatccacacgggggtgaaaccgtatggctgcacagagtgcgggaagtcgttttcccatggccatcagttgacccagcaccagaaaactcacagtggcgctaaatcctatgaatgcaaggagtgtggaaaggcttgcaatcatctgaaccatctccgggagcaccagagaatccataatagctag

SEQ ID NO: 247558 - DNA, 297 bp, Artificial Sequence
  Description of Artificial Sequence: Synthetic coding sequence
atggcgcagggactggtaacatttgcagatgtcgccatcgacttttctcaggaagagtgggcttgcctgaacagcgctcagcgcgatctctattgggatgtgatgctggaaaactactctaatttagtttccctagatcttgagagtgcctacgagaataaaagcttgcctaccgagaaaaacatccacgagatacgtgcaagtaaaagaaacagcgatagaaggtccaaaagcctggggagaaactggatctgtgaaggtactcttgagagaccccagaggtcaagaggccgatag

SEQ ID NO: 247559 - DNA, 1392 bp, Artificial Sequence
  Description of Artificial Sequence: Synthetic coding sequence
atggcacaaggtctagtgaccttcgctgatgtggctattgatttttcccaagaggagtgggcttgtctgaatagcgctcagagagatttatactgggacgttatgctggagaattactccaatctagtctcactcgacctggagtcagcgtacgagaataagagcctgcctaccgagaagaacatccacgagattcgagcctccaagcgtaactctgataggagaagcaagtctctgggccgtaattggatctgtgaggggaccttggagagacctcagaggtcacggggtcggtatgtcaatcagatgattatcaattacgttaagcgcccagccacaagagagggcacaccccctaggacccatcaacggcaccacaaagagaacagttttgagtgtaaggactgtggaaaggctttctcacggggatatcaactctcacaacatcagaagattcacactggtgaaaagccctatgaatgcaaggagtgcaagaaagcgtttcgatggggcaaccagctcacgcaacatcagaagattcacaccggagagaagccttacgaatgcaaggattgcggaaaggcttttaggtggggaagttcactggtgattcacaaaagaattcacacaggcgaaaaaccgtacgagtgcaaggattgcggaaaagccttcaggcgcggagacgaactgacacagcatcagcggttccacacgggagaaaaggattacgaatgtaaagattgtggtaaaaccttctcccgggtgtacaagcttattcagcataaacgcattcactctggggagaaaccctatgaatgtaaggactgcgggaaggccttcatatgcggctcctcgctgattcagcacaagagaatccacacaggggaaaaaccatacgaatgtcaggaatgcggaaaggccttcacccgtgtgaattacctgacacaacaccagaagatccacacgggcgaaaagcctcatgagtgcaaagaatgcggcaaagcgtttcgttggggcagttcccttgtgaaacacgaaagaatccacactggcgagaagccctataagtgtactgaatgcggtaaagccttcaactgcgggtaccaccttacccagcacgagagaatacataccggtgaaaccccctacaagtgcaaagagtgcggtaaggccttcatctacggctcgtcgctggttaagcacgagagaattcacactggtgtaaagccatacggatgtactgagtgcggaaaatcattctcccacgggcatcagctcacccaacatcagaagactcacagcggggctaaaagttatgagtgcaaggagtgtggaaaggcttgtaatcatctaaaccatctgcgcgagcatcagagaattcacaactcttag

SEQ ID NO: 247560 - DNA, 504 bp, Artificial Sequence
  Description of Artificial Sequence: Synthetic coding sequence
atggcacaaggtctcgtgacctttgcggacgtggcaatagattttagtcaagaagaatgggcttgcctgaattctgcccagagggatctttactgggacgttatgctcgaaaattattcgaatcttgtttcacttgatctcgagtctgcctatgaaaacaaaagtttgcctactgagaaaaacattcatgagatccgcgcttccaaaagaaattcagatcgacggagcaagagcctgggaagaaattggatatgtgaagggaccctggaacgaccccagaggtcgagaggaaggtacgtcaaccagatgattattaactacgtcaaaaggccggctacaagagaagggactcccccacggacacatcagaggcaccataaggagaatagctttgagtgcaaggactgtggtaaagctttcagtcggggttaccaactctcccagcatcagaaaatccatactggcgaaaaaccgtatgaatgcaaagaatgtaagaaggcttag

SEQ ID NO: 247561 - DNA, 303 bp, Artificial Sequence
  Description of Artificial Sequence: Synthetic coding sequence
atggctcagggtcttgtgaccttcgcggacgttgccatcgatttttcacaggaggaatgggcctgtcttaactcagcccagcgagatctttattgggacgtgatgctggagaattattctaacttggtgtctctcgacctggagtccgcttatgagaacaaaagcctgcccaccgaaaagaacatccacgagatccgcgctagtaagagaaactccgacagacggagtaagtctctagggagaaattggatctgtgagggcacactggagcggcctcaaaggagtaggggcagatacgtttag

SEQ ID NO: 247562 - DNA, 1998 bp, Artificial Sequence
  Description of Artificial Sequence: Synthetic coding sequence
atggagagtgtgacgttcgaagatgtggcagttgaattcattcaagaatgggctctcctggacagcgcacgaagaagtttgtgtaagtaccggatgctggaccagtgtcggacacttgcctcacggggtactcccccttgtaaaccatcgtgcgtcagccaacttgggcagagagctgagccaaaggcaaccgagcgcggaattctgagggcgaccggtgtggcttgggagtcacagctcaaaccagaagaactaccttctatgcaggacttgctggaggaggcaagcagcagagacatgcagatggggcctggcctatttttgaggatgcagctcgttccttcaatcgaagagcgggagacacctctaacgcgggaggatcgaccagcactccaggagccgccttggtccctgggctgcacaggtcttaaggctgcgatgcagatccaacgcgtggtgatacctgtgccaacactaggacaccgaaacccatgggtggccagggatagcgcagtgcccgctcgcgatcctgcttggctgcaggaggacaaggtcgaggaagaggctatggcccctgggctccccacggcctgttcccaggagccagtaacctttgcagacgtcgcagtggtgtttaccccagaggagtgggtgttcttggactcgactcagagatctctttatcgagatgtcatgcttgagaactacagaaatttggcttctgtagctgaccagctctgtaaacccaacgctctgtcttaccttgaggagaggggtgaacagtggactacagaccgcggagtgctttcagatacctgtgcggagccacagtgccagccacaggaggctatccctagccaggacactttcactgagattctgagtattgatgtgaagggagagcagcctcagccaggtgaaaaactttataagtataatgagttagaaaaaccatttaattcaatagagcctcttttccaataccagagaatccacgccggagaggcttcctgcgagtgccaggagatcaggaacagcttcttccagagtgcacatctgatcgttccagagaagattagatccggcgacaagtcttatgcatgcaataagtgtgagaaatcctttagatacagttccgacctgattaggcatgagaaaacccacaccgccgagaagtgctttgactgtcaggagtgtggccaggcgttcaagtatagctctaacctgcggaggcatatgcgcacacacacaggcgaaaagccatttgagtgttcccagtgtgggaagacttttacgcggaacttcaatctcattttacaccaacgaaatcatactggggagaaaccctatgaatgtaaagactgtgggaaagctttcaaccagcctagctctctccgctctcatgtcaggacacacacaggcgagaagcctttcgagtgctcccagtgcggcaaggccttccgcgagcattcaagcttgaaaacccatcttagaacccacactcgagaaaagccgtatgagtgcaatcagtgtgggaaaccttttcgaacctctacacatctgaacgtacataaacgcattcacaccggcgaaaaactctatgaatgcgccacatgcggacaagtgttatcccggctatcaaccctaaaaagccacatgagaactcacaccggagaaaagccttacgtgtgccaagagtgcggacgggcttttagcgagccttcatccttgagaaaacacgctaggacccactccggaaagaaaccatacgcatgtcaggagtgcggtagggcctttgggcagagctctcatctgatcgtacatgtgagaacccattctgcaggtagaccgtaccagtgtaaccagtgcgaaaaagcctttagacactcaagcagcttaaccgtccataagaggacacatgtcggcagagagaccatcagaaacgggagcttgcccctgagcatgtctcatccgtactgtgggccactagctaattag

SEQ ID NO: 247563 - DNA, 549 bp, Artificial Sequence
  Description of Artificial Sequence: Synthetic coding sequence
atggagagcgtcacttttgaggacgttgcggtggagttcatacaggaatgggccctgctagactctgcgcgacgcagcctgtgtaaatataggatgcttgaccaatgcaggaccctcgcctcacggggtacacccccttgtaaaccaagttgcgtgtcccaactgggacagcgcgcagaaccaaaggccaccgaacgtggtattttgagagccacaggtgtggcctgggaatcccaactgaaacctgaagagcttccctcaatgcaggacctgctagaggaagcatcatctcgtgatatgcagatgggacccggactgttcttaagaatgcagttagttccctccattgaggaacgagagaccccccttacgagagaggataggcctgcgctgcaagagccaccatggtctttaggttgcactcttccactgctttcgctcctgttgccgagttgtccagagcctcctctcgtgctgcttgactcttcctcagcacctgaccgacacttgggatctacactcgataccgaggcaagaggtattccatag

SEQ ID NO: 247564 - DNA, 1671 bp, Artificial Sequence
  Description of Artificial Sequence: Synthetic coding sequence
atgcaactagtcccatctatcgaggagcgggagactccactgacgcgcgaggataggccagcgctgcaagagcccccatggtctttaggctgcaccgggttgaaggccgctatgcagatccagcgagtcgtgattcccgtgcctaccctggggcaccgtaatccctgggtggccagagactctgccgtgcccgctcgggatcctgcctggttacaggaagacaaagttgaggaggaggcaatggctcctggtctcccgaccgcttgttcccaggagccggtcacgttcgccgacgtggcggtggtttttacccccgaggaatgggtctttcttgatagcacccagcggtctctgtatagagatgtaatgctagagaattatcgtaatttagcaagcgtagcagatcaactgtgcaagcctaacgccctgagttacctggaggaacgcggtgagcaatggactacagaccgtggcgtcctttccgatacttgcgctgagccccagtgccagccacaggaggccattccatctcaagacacctttacagaaatactctctatcgacgtgaagggtgaacagcctcagccaggggagaagttgtataaatacaatgaacttgagaagccatttaattccatcgaaccactttttcagtatcagaggatccacgctggcgaagcaagttgtgaatgtcaggagattcggaattcattttttcagtcggcacaccttatcgtccccgagaagattcgctctggtgacaagtcgtatgcctgcaacaaatgtgagaagtcattcagatattcctccgatctcattagacatgaaaagactcataccgccgagaagtgttttgattgccaagagtgcggccaggcgtttaaatattcttcgaacctaagaagacacatgaggactcatacgggcgagaagccattcgagtgctcccagtgcggcaaaactttcactcgaaactttaatcttatcctccaccagagaaatcacacaggagaaaagccatatgagtgcaaggactgtggaaaggcctttaaccagcctagcagcctgcgaagtcacgtgaggacccacaccggcgaaaaaccctttgagtgtagccagtgcggcaaagcctttcgcgaacacagctcgctgaagactcacctaaggacacacactagagaaaaaccttacgagtgcaaccaatgtggcaaacccttccgtacatctactcacttgaatgtgcacaagcgaatacacacgggcgaaaaactgtacgagtgcgctacttgcggccaggtgctgagcagactaagtacccttaaatcccatatgagaacgcacacaggcgaaaagccctacgtttgccaggaatgcggtagagctttctctgagccatcttctttaaggaagcatgcacgcacacatagcgggaaaaaaccatatgcttgccaagagtgcgggagggccttcggacagtcatcccatcttatcgtacacgttcgcacccatagcgccggaaggccgtaccagtgcaatcagtgtgagaaagctttcaggcactcttccagtctgaccgtgcacaaaaggacccatgttggtcgggagactatccgaaacggctccctccctctctctatgagtcacccatattgtggacccctggcaaattag

SEQ ID NO: 247565 - DNA, 912 bp, Artificial Sequence
  Description of Artificial Sequence: Synthetic coding sequence
atggagtccgtcactttcgaggatgtcgcggtggagttcattcaggaatgggcactgctggatagcgctcggaggtcactctgcaaataccgaatgctggaccagtgccgcacgctcgcaagccgtgggacacccccttgcaagcccagttgcgtaagccagcttgggcagagggcagagcctaaggccacggagcgaggcattctgcgagcaaccggagtggcttgggagtcccagctgaagccggaggaactgccaagcatgcaagatctactggaagaggcatcctcgcgcgacatgcagatggggccaggcctgtttcttcggatgcagctggtgcccagtatcgaggagcgcgaaaccccactcacgcgggaggaccgtcccgcactgcaggagcccccatggtcactgggctgtacgggcttgaaggccgctatgcaaatccagcgcgttgtcatccccgtcccaactctggggcatcgcaatccttgggtggctagagattctgccgtccctgccagagatccagcttggctgcaagaggacaaggtagaagaggaggcaatggcaccaggtctgcccaccgcatgtagccaggaacctgttacctttgccgatgtggcggttgtgttcacacctgaggaatgggtgttccttgacagcacccaacgctctctgtacagagacgttatgctcgagaactatcggaacctggcctcagtcgctgaccagctttgtaagcctaatgcgttgagttatcttgaggagcgaggggaacagtggaccacagaccggggtgtcctgagtgatacctgcgccgagccacaatgtcaaccacaggaggctatcccgtctcaggacactttcactgaaatcctttcaatagacgtcaaaggccctccaaattag

SEQ ID NO: 247566 - DNA, 3360 bp, Artificial Sequence
  Description of Artificial Sequence: Synthetic coding sequence
gctgctgaggaacgcggatggcgacccaggcgctgtcggtcacagagaggtacatggctgagaaaacctcggagtgaagtaccgcgtccatacgcccctctgtccggaagtcccccaatcagatggcgcagaaccaggtggcgggctgcagcaactagaccattaggactggctggaccgaggagccccctgcgggctgcatgggtctgggcaccaagtagagtccggagacagcagcgccgaagaggccgacccggtgcagggagaggtatcgacgatctggaggaggattcagattataatcccgctgaggacgaaccgagaggtaggcagttacggctccaaaggccaacaccttctaccccacggccacgcaggaggccaggaaggccgagaaagctgcccagactagagatcagcgatctgcccgacggagtcgagggagagcccttggttagcagccagtcaggccagagcccccctgagccccaggacccagaggcaccatcgtcaagcggtcctggccacctggtggctatgggcaaggtttcccgcactccagtggaggccggagtgtcccagtccgacgccgagaacgccgcaccttcatgtccggacgagcatgacaccctgccaagacgaagaggcaggccaagccggagattcctgggtaaaaaataccggaagtattactacaagtctcctaagcccctgctacggccttttctctgcaggatctgtggttccagatttctatctcacgaagacttgagattccatgtgaactcacacgaggctggtgatccacaactgtttaagtgcctgcaatgctcctatcgctctcggagatggtctagcttaaaagagcatatgtttaaccatgtcggctctaagccatataagtgtgacgagtgttcctacaccagcgtgtatcgcaaggatgtcatccgacacgccgctgtgcattccagggaccggaagaagaggcccgatcccacacctaagttgtctagtttcccatgcccagtctgcggcagggtttatcctatgcaaaagcggttgacacagcatatgaagacccatagtacagagaaaccccacatgtgtgataagtgcggaaaatcattcaaaaaacgctatacattcaagatgcatctcctaacacatatccaggctgtggccaatcgtcgcttcaagtgcgaattctgtgagttcgtgtgtgaggacaagaaagcgctgctaaatcaccagctcagccacgttagcgataaacctttcaagtgttcattctgtccctacagaacttttcgcgaagatttccttctcagccatgtggcagtgaagcataccggcgcaaaacccttcgcgtgtgaatactgtcacttttcaactcgccataagaagaacctgaggctgcacgtgaggtgtagacacgcctcctcgtttgaagaatggggccgtcgacacccagaagagcccccatcaagacgtcgcccatttttcagtcttcagcagattgaagagctgaaacagcagcatagtgcagctcccggacctccacctagctctccaggtcctcctgaaatccctcctgaggcgaccacctttcagtcttcggaagctccgagcctcctctgctcggataccctcggaggtgccacgataatctaccagcagggggctgaagaatctacagccatggccactcagaccgctttggacttgctcctgaacatgtccgctcagcgcgagcttgggggtacggcgctgcaggttgccgtggtgaaaagcgaggatgttgaagccggtttagcttctccagggggtcaaccctctcccgaaggagccacccctcaagtggtcacactccatgtcgcagagccaggcggtggcgcagccgcagaatcccagctcggtccccctgacctgccccagatcaccctggctcccggaccatttggaggcaccggatactcggtgataacagccccaccgatggaggagggtacctcagccccagggacaccatactctgaggaacccgctggcgaagcggctcaggctgtcgtggtctccgacaccctgaaggaggcaggaacacactatattatggccaccgacggcacccagctccatcatatcgagttgactgccgatggcagcatcagtttccctagccctgatgcgctagccagcggagcaaagtggcccttactgcaatgcggagggctcccacgcgatggcccagaaccaccctctcccgctaagacccactgtgtaggagatagccagagcagcgccagctcacctccagccactagcaaggctctcgggttggcagtgccacctagccccccttcggctgccaccgctgcatcgaagaaattttcctgtaagatctgcgccgaggcctttccaggcagggccgagatggaatcacacaaacgagcacacgccggtcccggagcctttaaatgtccagattgcccattctccgccagacaatggccagaagtaagagctcatatggcccagcacagttctctgcgccctcatcagtgcagccagtgttcctttgccagtaaaaacaaaaaagacctgagacgccacatgctaactcataccaaggagaagccatttgcctgccacctgtgtgggcaaagatttaaccgcaacggacaccttaagtttcatattcaaaggttgcactcccccgatggccgtaagtcgggtacgcccacggctcgagcgcctactcaaactcccacccagaccatcatcctcaatagcgacgatgaaacgctggctaccttgcatacggctctgcaaagttcacatggtgtgttaggcccagagcgacttcagcaggctctatcccaagagcacatcattgtcgcccaggaacaaactgtgacgaatcaagaggaggcagcctatatccaggaaatcacaactgccgacggacagaccgtgcagcacttggtcacatccgataatcaagtgcagtacattatttcacaagacggggtgcagcacctcttaccccaggagtacgttgtagtgcccgaaggacatcacattcaggttcaggagggccagatcacccacattcaatacgagcagggggcacctttcctgcaggagagccaaatccaatacgtgcccgtctccccagggcaacagctagtgacacaggcccaactggaagccgcagcacattcagccgtcactgcggtggcagatgccgctatggctcaggcccaaggtctattcggcacagatgaaaccgttcccgagcacatccagcagctgcagcatcaaggtatcgaatacgacgtcatcaccttggcagatgactag

SEQ ID NO: 247567 - DNA, 4029 bp, Artificial Sequence
  Description of Artificial Sequence: Synthetic coding sequence
atggaggaaaatgaagtggagagttcctccgatgcggctccgggacccggaagaccagaggaaccatccgagtccggtttgggagttggtacatctgaagccgtgtccgctgattcatccgatgctgcagctgccccaggacaggccgaagctgacgatagcggcgtcggccagtcctctgaccgtgggtcccggtcccaggaagaagtgtccgagagttcctctagcgctgatcctctgccgaacagttatcttccagactccagttcagtttcacacggccctgtcgcgggagtcacaggcggaccaccagctctggtccacagcagcgcgctgcccgatcccaacatgttggttagtgactgcaccgcctcctcctctgaccttggatcggctatcgacaaaatcattgagtcgacaattggcccagatttgatacagaattgcataactgtgacatctgctgaggatggaggggcagaaaccacacgttacctgattctccaggggcctgacgacggagctcccatgactagccccatgtctagttcaactctggcccacagcctggccgctattgaagcactggcagacggcccaacatcgaccagcacttgtcttgaagcccaaggtggtccaagttcccctgtgcagctccccccagccagcggagcagaggaaccagacctgcagtcacttgaagccatgatggaagtggtggtcgtccagcaattcaaatgcaagatgtgccagtacaggtccagcaccaaggccacactgctgcggcacatgcgcgaaagacatttccgcccagtggctgccgctgcagctgctgcaggcaagaagggtaggttgagaaagtggagcacatctacaaaaagtcaagaagaagagggccctgaggaggaagacgatgacgacattgtggatgccggtgccatcgatgaccttgaagaggacagcgactataaccccgcagaggacgagcccagaggtcgccagctccgtctccagcggcctaccccttccacaccaaggcctaggaggcgccctggccgacccaggaaactgcctcgtctcgaaatctccgatctgccagacggcgtggaaggagaacctctggtgtcctcgcagagtgggcagtcgccacccgagcctcaggaccccgaggccccatcctcttctggccctggccacctggtggctatgggcaaggtctctcgcacccctgtggaagctggggtctcccagtcagacgctgaaaacgctgcacccagctgtccagatgagcatgatacgctaccacggcgaaggggacggccatcaagacgattcttgggcaagaaatatcggaaatactattataagtcgccgaagcccttgctgcgacccttcctatgtcgaatctgtggcagtcgattcctcagtcacgaagatttgcgattccacgtcaatagtcacgaagcaggggatccgcagctcttcaagtgtctgcagtgctcttatcgctctaggcgctggtccagcttaaaggagcatatgtttaaccacgtcggcagcaaaccatataagtgcgatgaatgcagctataccagtgtctacaggaaggacgtgatacgtcacgccgcagtgcactccagagatcggaagaaacgaccagatcctactcccaaattgagctcctttccttgtcctgtctgcggcagggtgtacccaatgcaaaaacgtttaacccagcatatgaaaactcattctaccgaaaaaccacacatgtgcgacaagtgcggaaaaagttttaagaagcgatacacctttaagatgcatctcttaactcacattcaggccgttgccaaccgaaggttcaaatgtgagttctgtgagttcgtctgcgaagataagaaggcactgctgaatcaccagctgtcacacgtgagcgacaaaccttttaagtgttctttctgcccatacaggacctttagagaggacttcctattgtcccatgtagcagtgaagcatactggcgcaaagccatttgcttgtgagtattgccacttcagcaccaggcacaaaaagaacctcagattgcatgtgcgttgcagacatgcctcgtcctttgaagagtggggcaggcgacaccccgaagagccgccatccaggcgaagacccttttttagtttgcagcagattgaagaactgaaacagcagcacagcgcggcacctggccctcctcccagctcaccagggcctccagagattccaccagaggctactactttccagtcctcagaagccccaagtttgctctgcagcgacaccctggggggagccacgatcatttaccagcaaggagccgaagagtccactgccatggccacccagacggctctggatttgcttctgaacatgagcgctcaacgagaactgggaggaacagccctccaggtggctgtggtgaagtccgaggacgtggaagccggattagctagcccgggagggcaacccagtcccgaaggtgcgaccccccaggtagtcacgctacacgtggctgaaccaggtggaggggcagctgcagaaagccagctgggacccccagacctcccccaaattacgctggcgcctggtccatttggtggcaccggatactcagtgattactgctccacctatggaggaggggacctctgcaccaggaactccttattcagaggagccagcaggcgaggctgcccaggcggtggtggtctcagataccttgaaagaggccggtactcattacatcatggccaccgatggcactcagctgcatcatattgaactcactgccgacggcagcataagctttccgtcccccgacgcactcgcctcaggagccaagtggcccctgctgcagtgcggagggttaccacgtgatggtcccgaacccccttctcccgctaagactcattgcgttggtgactcgcagtctagcgctagctcacctcccgctaccagtaaagccttgggactggctgtgcctccaagcccgcctagcgcagccacagccgctagtaaaaagttcagttgcaagatttgtgccgaggccttcccgggaagagcagaaatggaatctcacaaacgggctcacgccggaccaggagccttcaagtgtccagattgcccttttagtgcacgacaatggcccgaggttagagcccacatggctcagcactcgtccctgcgcccacatcagtgctcacagtgtagtttcgccagcaagaacaagaaagacttgcggaggcatatgctgactcacacgaaggagaagccctttgcctgtcacctgtgcggtcagcgcttcaaccgtaatggccatctcaaatttcatatccagaggctgcactcccctgatggtcgcaaatccggaaccccaacagcccgagcccctacacagactccaacacagacaatcattctgaactcagacgatgagaccttggccacactgcacactgctcttcaaagctctcatggtgtacttggacccgaaagactgcagcaagctctgagccaagagcacatcattgtggctcaggagcaaacagtaactaaccaggaagaggcggcttacatccaggaaatcacaaccgccgatgggcaaaccgtccagcaccttgtaacaagcgataaccaggtgcagtacatcattagccaggatggtgtccagcatctcctcccccaggaatatgtggtcgtgcccgagggacaccatatacaggttcaggaaggtcagataacacacattcaatatgaacagggagccccttttctccaggagtcccagatacagtacgtacccgtaagtccaggtcagcagttagttacccaagcccaacttgaagcggcagcccatagcgcggtgactgccgtcgcagatgctgcaatggcacaggcacaaggcctatttggaaccgatgagactgtccctgagcacatccagcagctgcagcaccaaggaatagaatatgatgtgatcacccttgcggacgattag

SEQ ID NO: 247568 - DNA, 3564 bp, Artificial Sequence
  Description of Artificial Sequence: Synthetic coding sequence
atggcaacgtcctctatgcccgaaagtgaacggaatgtggccactaaggcttccggagctccaatgacttctcccatgagttcatcaaccttagcccattcacttgctgccatcgaggccctagctgacggccctactagtacctccacatgcctggaagcccagggtggaccctcaagcccggttcagctccctccggcaagcggagccgaagagccagacctacagagtttggaggccatgatggaagtggtcgtcgttcagcaatttaagtgcaagatgtgccagtacagatcctccacaaaggcaaccctcttgcgccacatgagagaaaggcacttccgccctgtggctgccgcagccgcagcagccggaaagaaaggtcgactgcgaaagtggtccacaagcacgaaatcccaagaagaagaaggccctgaggaggaggacgacgacgatattgtcgatgctggggctatagatgacctcgaagaggatagtgattacaatcctgccgaagatgaaccaaggggtaggcagctgagactgcagaggcctacacctagcacaccacgacccagacgtcgacctgggcgaccaagaaagttgccaaggctcgagatatctgatctccccgacggggtggagggcgagccattagtgtcatcccagtcggggcagtctcccccagaaccccaagaccccgaggcccctagttcctctggaccagggcatctggtggccatgggaaaagttagccgcactccagtagaggctggtgtgagtcagtctgacgcagagaacgccgctccgtcttgccccgatgagcacgatacactgccacggagacgcggaaggcccagcagaagatttctcgggaaaaagtaccgaaaatattattataagagtccaaagcccctgctgagacctttcctctgtagaatatgcgggagtaggttcctgtctcacgaggatttgaggtttcacgtcaactctcacgaggctggggacccacaactgttcaagtgcctgcagtgctcttaccggtctcggagatggtcctcccttaaggaacatatgtttaaccacgtcggctcaaagccttacaaatgcgacgagtgctcatacacttccgtttacaggaaagacgtcatacgccacgcagcagtccactccagagaccggaagaaacgacctgacccgactccgaagctgtcctcttttccttgccccgtgtgtggcagggtgtatcctatgcagaaaaggctgacacagcacatgaagacccacagcaccgagaagccacacatgtgtgataagtgcggtaaaagcttcaaaaaacgctatacctttaagatgcatctgctgacccatattcaggccgtcgccaaccgcaggttcaagtgcgaattttgcgaattcgtgtgtgaagacaagaaagccctgctcaatcatcagttgagtcacgtatccgataaacctttcaaatgcagtttctgtccctaccggacattccgtgaggacttcctcctctctcacgttgcagtaaaacacacaggagctaaaccctttgcctgcgagtactgccacttttccacacggcacaagaaaaatcttagacttcacgtgaggtgtaggcacgcctcctccttcgaagaatggggaagaaggcacccagaggaaccaccctcacggagacgcccattcttttccctgcagcaaatcgaggagttgaagcaacaacattcagctgcaccaggccctccacctagcagcccgggtcctcccgaaattccccctgaggctacgaccttccagagttcagaagccccttccttgttgtgtagcgacacactcggcggagcaacaatcatttaccagcagggagccgaagagtccaccgctatggctactcagacagccctcgatcttctcctgaatatgtcagctcagcgggagctaggcggaacagcccttcaggtcgccgttgtcaagtccgaggacgttgaagcaggattagccagtcccggtggtcagccgtctcctgagggcgcaacgcctcaggtggtgacactgcatgttgcagaaccaggcggaggcgctgccgctgagtcgcagctcggcccacccgacctgcctcagatcaccttggctccaggcccttttggcggaacgggatactcagtaattactgccccaccaatggaagagggtacgtctgcccctggaaccccttatagcgaagaaccagccggtgaggcagcccaggccgtggtggtttccgatacactgaaagaggccggaacccactacattatggccacagacggcacacaactgcaccacatagagctgacagcagacgggagcatttcctttccttctcccgacgccctggcatctggggctaaatggccattgctccagtgcggcggactgcctagggacggtcccgagcccccaagtcccgcaaaaacccactgtgtgggcgactctcagagttcggcctccagcccccctgcaacttcaaaagctctggggctggctgtgcctccttcgcccccaagtgcggcaacagcagcatcaaagaaattctcctgtaaaatttgcgcagaagcattcccaggaagagctgagatggaatcccataagagagcccatgctggccctggcgctttcaagtgccctgattgccctttcagcgcaaggcaatggccggaggttcgggctcatatggcacagcactcgtccctccgcccacaccagtgtagccaatgttctttcgcctccaagaacaaaaaggaccttcgtagacacatgctgacccatactaaggagaagcccttcgcctgtcacctgtgtggccaacgttttaatagaaacggtcaccttaaattccacattcagcgtttacattcccccgatggcagaaagagcggaactcccactgccagagcacccacgcagacacccacccagaccataatccttaattccgatgatgaaacattagctacactgcatacagccctgcagtcttctcacggcgtcctcgggccagagcggctgcagcaagccctgagccaggagcacattatagttgcacaggagcagacagttacgaaccaggaggaggcagcatacatacaggagattacaactgccgatgggcagacggtgcagcacttggttacttccgataatcaggtgcaatacattatctcacaggatggggttcaacacttgctgccgcaggagtatgtggtagtcccggaggggcatcacatccaagtgcaagagggccagataactcatatccagtacgagcagggcgctcccttcctccaggaaagccaaatacagtatgtgccggtgtcacctggacaacagctggtaactcaggcccagctggaggccgcagcccatagcgctgtcaccgccgtggcagacgcagctatggcgcaggcacagggcctgttcggaaccgacgaaacggtcccagaacacatccagcaactgcagcaccagggaatcgagtatgacgtgatcacccttgccgatgactag

SEQ ID NO: 247569 - DNA, 330 bp, Artificial Sequence
  Description of Artificial Sequence: Synthetic coding sequence
atgctggaaaactacagcaacctcgtgagtgtgggctactgtgtgcacaaaccagaggtaattttcagactccagcagggtgaagagccttggaaacaggaggaggagtttcccagccagagctttcccgaaatggggttccaccatgtcccagccggattgaagttgctttcaagctccgaccctcccgctctggcttcccagagcggcaggatcactggaatgagccacagcatcccccctgtcatgggcagcttcaagttcacaacctccatcttcacttgcgttggacttttcagattctttttcttttacctgagctggttctag

SEQ ID NO: 247570 - DNA, 417 bp, Artificial Sequence
  Description of Artificial Sequence: Synthetic coding sequence
atgaataaagtcgagcagaagtctcaggagtcggtgagctttaaagatgtgacggtgggcttcactcaggaggaatggcaacacttagatccatcccagcgtgctctgtatcgggacgttatgctggaaaattattctaacctcgtctctgtcggatattgtgtgcataagccggaggtcattttccgactccagcaaggtgaggaaccatggaaacaggaggaggagttcccaagtcaatcattccccgaagtctggaccgccgatcatctgaaagagcgttcccaggagaatcagagcaagcacttgtgggaagtcgtgtttatcaataatgagatgctgactaaagagcagggagatgtgatcgggatcccgtttaatgtggatgcccctgagatgctgatgcccctggactag

SEQ ID NO: 247571 - DNA, 2433 bp, Artificial Sequence
  Description of Artificial Sequence: Synthetic coding sequence
atgaacaaggtagagcaaaaaagtcaggaatccgttagttttaaagacgttacagtgggatttactcaggaggagtggcaacatctcgaccctagccagcgcgctttgtacagggatgttatgctcgagaactattcaaacttggtgtctgtcggctactgcgtgcataaaccagaggtcatcttcaggttacagcagggggaggagccctggaagcaagaggaggaattccctagccagagtttccctgtctggacggcagaccatctgaaggagcggagccaggagaatcagagcaagcacctgtgggaagtagtgttcattaataatgagatgcttaccaaggagcagggcgacgtgattggcatcccattcaacgtggatgtgtcatcctttccaagtaggaagatgttctgccagtgtgatagttgtggcatgtcgttcaataccgtgtctgagctggtgatctctaaaatcaactaccttggcaaaaagagcgacgaattcaatgcatgcgggaagctcctgctaaatatcaaacacgacgagactcacacccaggaaaagaacgaggttctaaagaacagaaacaccctcagccatcacgaagagacactgcagcacgaaaaaatacaaacccttgagcacaactttgaatactctatttgccaggagaccctgctcgagaaagctgtttttaatacacagaaaagggagaatgccgaggagaataactgcgactataacgaattcggacggacactatgcgattcatcaagcctattgttccaccagatcagtcctagtcgtgataaccattatgagttcagcgactgcgagaaattcctttgcgtgaagtctaccctgtccaagccacacggggtgagcatgaagcattatgactgcggcgaaagtggcaataatttccgcaggaaactttgtcttagtcatttgcagaagggggacaaaggtgagaaacacttcgagtgtaacgagtgtgggaaagccttttgggagaagtcccatctcacacggcaccagcgcgtccacaccggccagaagcctttccaatgtaatgagtgtgagaaagctttctgggacaagtctaatctaacgaagcaccagaggagccacacaggtgagaaacccttcgaatgtaatgagtgtggcaaggctttttcacacaagtccgctcttaccctccatcagcgaacccacaccggcgagaagccttaccagtgtaatgcatgtggaaaaaccttctgccaaaagtccgatttgactaaacatcagaggacccacaccggccttaagccatacgagtgttatgaatgtggaaaatcctttagagtaactagtcatcttaaagtgcaccagcggacacataccggcgaaaaaccgttcgaatgtctagagtgcggcaagagcttttccgaaaaaagcaacttgactcagcatcagaggatccacatcggcgataaatcgtacgaatgcaatgcttgtggtaaaacattttaccacaaaagcctcctgacacggcaccaaatcatacacacggggtggaagccctatgagtgttatgaatgcggcaaaacattctgcctgaaatccgatctaacggtccaccagagaactcacacaggccagaagccctttgcttgccccgaatgtgggaagttcttctcccacaagtcgacattgagtcagcattaccggactcacacaggagagaaaccttacgagtgccatgaatgtggaaagattttctacaacaagtcctacctgactaaacacaataggactcatactggagagaagccttacgagtgcaatgaatgcgggaaggctttctatcagaagagccaactgactcagcaccagcgaatccacattggcgagaagccttacaaatgcaacgagtgcggtaaggctttttgccacaaatcggcgctgatagtccaccagcgtactcacacacaggagaagccctacaagtgtaacgaatgtggtaaaagcttctgcgttaagagcgggctcatctttcacgaacgcaagcacactggcgagaaaccttatgagtgtaacgagtgcgggaagtttttcagacataagagttccttaacagtgcaccacagggcacatacaggcgagaagtcttgtcagtgtaatgagtgcggcaaaatcttttacagaaagtctgagcttgcacagcaccaacggagtcataccggcgagaagccttatgagtgcaacacgtgcagaaagacattcagtcagaaaagcaacctgatcgttcatcaaaggcgccacattggtgaaaatctcatgaatgagatggacattagaaattttcagcctcaggtgtctttgcacaatgcttccgagtacagtcattgcggcgagtcaccagacgacatcctgaacgtgcaatag

SEQ ID NO: 247572 - DNA, 2436 bp, Artificial Sequence
  Description of Artificial Sequence: Synthetic coding sequence
atgaataaggtggaacaaaagtctcaggagtctgtctcttttaaagacgtgactgtgggcttcactcaggaggaatggcagcatttggaccccagccaacgcgctttatacagagacgtaatgctggagaactattctaatctcgtgtcggttggatactgcgtgcataagcctgaggtcatttttcgtctgcagcagggggaagaaccctggaagcaggaggaggagttccctagccaaagttttccagaggtatggacggctgatcacctgaaggaaaggtcccaagaaaatcaatccaaacacctgtgggaggtagtttttataaacaatgaaatgctaaccaaggaacagggcgacgttatcggcatccctttcaacgttgatgtgagttcctttccatcacgcaagatgttctgccagtgtgactcttgtggaatgagttttaacactgttagcgaattagtaatatcaaagattaactatctagggaagaaatctgacgaattcaatgcctgcgggaaattgctcctgaatattaaacacgacgaaacacatacccaagaaaagaacgaagtgcttaaaaatcggaacacactctcccaccatgaagaaactctacaacacgagaagatacagacccttgaacataacttcgagtattccatttgccaggagacattgctcgagaaagccgtattcaatactcaaaagcgggagaatgccgaggaaaataattgcgactacaacgaatttggacggaccttgtgtgattccagttcactcctctttcatcaaatctcaccaagtcgcgacaaccactatgagttctccgactgcgagaaattcctatgcgtcaagtccactctcagcaagccacacggtgtttctatgaaacactacgactgcggcgagtccgggaataattttcgcaggaaactttgtctatcacatctgcagaaaggagataagggagaaaaacattttgaatgcaatgagtgtgggaaggcgttttgggaaaagtcccatctaaccaggcatcagcgggttcacactggacaaaagcccttccagtgcaatgaatgcgaaaaggctttctgggacaagtccaacctgaccaagcatcagagatcccacaccggtgaaaagccatttgagtgcaacgagtgcgggaaggccttttcccataagtccgcactgacattgcaccagcgaacacacactggagagaaaccttaccaatgcaatgcgtgtggcaagaccttctgccagaagagtgacttaactaagcaccaacggactcataccggccttaagccttatgaatgctatgagtgcggaaagtcctttagggtgactagccacctaaaggtacaccagcggacccacacgggcgagaagccatttgaatgtctcgagtgcggcaaatctttctctgaaaagagcaaccttacccagcatcagcggatccatattggcgataagagttatgagtgcaacgcatgcggcaaaacgttttatcacaagagcttactaactcgccaccagatcattcacaccggttggaaaccctacgagtgctacgaatgcggaaagactttctgtctcaagtctgaccttaccgttcatcagcggacccataccggccagaaaccctttgcctgtccagagtgtgggaagttttttagccacaagagtacactcagtcagcactatcgtacgcacacgggagaaaagccctatgaatgccacgaatgtggaaaaattttttacaataagtcctacctcaccaagcataaccggacacatactggagagaaaccatacgaatgcaatgaatgcgggaaagccttttaccagaaatcacagcttacacagcatcagcgtatccacatcggcgagaaaccatataaatgtaacgaatgtggaaaggctttttgccacaagtcagccttaattgtgcatcagcgcacccatactcaggagaaaccgtataaatgtaacgagtgtggaaagagtttttgcgtgaagtcgggactgatctttcatgagcgaaagcacaccggggagaagccctatgagtgtaatgaatgtggaaagttctttcgccacaagtccagcttaaccgttcaccacagagcccacacaggtgagaagtcttgtcaatgcaatgaatgtggtaaaatattttatcgcaagtcggaactggcacagcatcaaaggagccataccggggaaaaaccttacgagtgcaacacatgtcgaaagacattttcccagaagtctaatctgatcgtgcaccagaggcggcacataggcgagaacctgatgaacgaaatggatattagaaatttccagccgcaggtctccttgcacaatgcaagcgagtactcccattgcggtgaatcccccgatgacatcctgaacgtgcagtag

SEQ ID NO: 247573 - DNA, 2454 bp, Artificial Sequence
  Description of Artificial Sequence: Synthetic coding sequence
atggccaatgccactagaagagggtcaggtgtggagcagaagtctcaggaatccgtgtcttttaaagatgtgaccgttgggtttacacaagaggagtggcagcacctggatccttctcaacgggcactctatagggatgttatgctggagaattactctaacttagtgagcgtgggttactgtgtgcacaaaccagaggttatattcagattgcagcagggggaggaaccgtggaaacaggaggaggagtttcctagccagtctttccccgtgtggaccgccgaccatttaaaagagcgatcgcaggaaaaccagtcaaagcatctgtgggaggtggtctttatcaacaatgaaatgctgactaaggagcagggggatgttatcggaattccattcaacgtcgatgtgtctagcttcccctctaggaagatgttctgtcagtgcgactcctgcgggatgagtttcaacaccgtttctgaactcgtcattagcaagatcaactacctggggaaaaaatcagatgaatttaatgcttgtgggaagctcctgttgaatattaagcacgatgagactcatacccaggagaaaaatgaggtcttgaagaataggaacacattgtctcaccacgaagagacactgcagcacgaaaagatccagactctggagcacaactttgaatatagtatctgccaagaaactctcttagaaaaagctgtttttaacacacaaaaacgagagaacgccgaggaaaacaattgtgactataatgaattcggaaggacactctgtgattccagttcgctcttgtttcatcaaatcagcccttccagagacaaccattacgaattcagcgactgtgaaaaattcctgtgtgtgaagtccacgttgagtaagcctcacggagtttcaatgaaacactacgattgtggggagtctggcaacaacttccggaggaaactttgtctgagccacctgcaaaaaggagacaagggcgagaagcactttgagtgcaatgagtgtgggaaagccttctgggagaagtcacatctgaccaggcatcagcgggtgcatacgggacagaaaccattccagtgtaatgaatgcgagaaagcattttgggacaaatctaatttgacaaagcatcagcggtcgcacaccggagaaaagccatttgaatgtaacgagtgcggtaaagcgtttagccacaagtccgccctgacgctccatcagaggacacacactggggaaaaaccatatcagtgcaatgcctgcggtaagacattctgccagaagtccgacttaacgaagcatcagcggacccataccggcctgaagccctatgaatgctacgagtgtggcaaatcctttcgcgtaacctcccatctgaaggtccatcaacgaacacataccggtgaaaaacccttcgagtgtcttgaatgcgggaagagttttagcgagaaatctaacctgacacagcaccagcgcattcacataggcgataagagctacgagtgtaacgcatgtggcaaaacgttttaccataagagtttgttaacccgccatcagatcattcacacagggtggaaaccctacgaatgctacgagtgcgggaaaaccttttgtttgaagtctgatctcaccgtacatcagcggactcacaccggtcagaaaccattcgcttgccccgagtgtgggaaattcttcagccataaaagcacactgagtcagcattatcgaacacacaccggggaaaagccatatgagtgccacgaatgcggcaagatcttctataacaagagctaccttaccaaacataatcggacccacacaggtgagaagccttatgagtgcaatgagtgtggaaaagccttttaccagaagtcccagcttactcagcaccagaggatacatatcggggaaaaaccttataagtgtaacgaatgtggcaaagctttttgccacaaaagtgctctcattgtgcatcagagaactcacacccaggaaaagccttataagtgcaatgagtgcgggaagtccttttgcgtaaagtctgggctgatatttcacgaacgaaaacacactggggagaagccctacgaatgcaacgaatgtggcaagttcttcagacacaagtccagtcttactgtccaccatcgggctcatactggggagaaaagctgccaatgcaacgagtgtggaaagatcttttacagaaaatcagaactggctcagcaccagcggtctcacaccggcgaaaagccctacgagtgtaatacgtgccgaaagacttttagccagaagagcaatctcattgtgcaccagcgcaggcatatcggggaaaacctcatgaatgaaatggacataaggaattttcagccgcaagtgagtctccacaacgccagcgagtatagccactgcggggagtccccagatgatatcctgaatgtgcagtag

SEQ ID NO: 247574 - DNA, 2433 bp, Artificial Sequence
  Description of Artificial Sequence: Synthetic coding sequence
atgaacaaagtggaacaaaagagccaggaatccgtcagcttcaaagacgtgacggtgggcttcacccaggaagaatggcagcacctggatccctcccagagggccttatatcgggacgtcatgttggaaaattactcaaacctggtgtcagtcggctactgcgttcataagccagaagtcattttccgactgcagcagggggaggagccctggaaacaagaggaagaatttccatctcagtcttttcctgtgtggactgccgatcacctcaaagaaagatcccaagagaaccagtcaaagcatttgtgggaggtcgtgtttatcaacaacgaaatgcttactaaggagcagggcgatgtgatcggaatcccattcaatgtagacgtgtctagctttcccagcagaaagatgttctgtcaatgcgattcctgtggaatgagttttaatacagtgagcgagcttgtgatcagcaaaatcaactacctcggcaagaaatccgatgagttcaacgcttgcgggaagctgctactgaatataaagcatgatgagacccatacacaggagaagaacgaagtgctgaaaaacagaaatacgctgtcacaccacgaggagacattgcagcacgaaaagatccagaccctggaacacaatttcgaatactccatttgccaggagacactgctcgagaaggccgtgtttaatacccaaaagcgtgagaacgccgaagagaataattgcgattataatgaatttgggcgaacactatgtgattcttccagtctgttgtttcaccagatatctccgtctcgagataatcactacgaattctccgattgtgaaaaattcctctgtgtcaaatccaccttaagcaaaccccatggagtgagcatgaaacactatgactgtggcgaaagcggtaataattttagacggaagctgtgcctctcacatcttcagaagggcgataagggcgaaaagcactttgaatgcaacgaatgtgggaaggccttctgggagaagtcccacctgacaagacaccagagggttcatactggtcagaaaccattccagtgtaatgagtgcgagaaagcattttgggacaaaagcaacttaacaaagcatcagcgctcccacacaggggaaaaaccctttgagtgtaacgagtgtggaaaggccttttctcacaaatccgccttgaccctccaccaaaggacgcatactggggagaaaccgtaccagtgcaatgcgtgtggcaaaactttttgtcagaaatccgatctcaccaagcatcagcggacccatacagggctgaaaccctacgagtgctacgagtgtggaaaatccttccgcgtgacaagtcacttgaaggttcatcagcgaacacacacaggcgaaaagcccttcgagtgcctggaatgcggcaaaagcttcagtgaaaaaagcaacctgactcagcaccagaggattcatattggtgataaatcgtatgagtgcaacgcctgcggcaagaccttctatcacaaatcactactgactaggcatcagattatccatactggatggaaaccatatgaatgctatgagtgtggcaaaaccttttgtctgaagagtgatttgactgtgcaccagagaacccataccggtcagaagcccttcgcttgtcctgagtgcggaaaatttttttcccataagagcacgctgtctcaacattatcggacccacactggtgagaaaccatacgagtgccacgaatgtgggaagattttctacaacaagtcttatcttacgaagcacaacagaacacacacaggcgagaagccatacgaatgtaacgagtgcggaaaagccttttatcagaaatctcagctcacgcaacaccagcgcatacacatcggtgaaaagccatataagtgtaacgagtgcgggaaggccttctgtcacaagtccgctctgatcgtgcaccagagaacccatactcaggaaaagccatacaagtgcaacgaatgtggcaagagcttctgcgtgaagtcgggtcttatctttcatgaaagaaagcatactggggagaagccttacgaatgcaatgagtgcgggaaatttttccgccacaagtccagcctgaccgtgcaccatagggcccacaccggtgaaaagtcatgccagtgcaatgaatgtggcaaaatattttataggaagtctgaattagcacagcatcagagatcccacaccggcgagaaaccttatgaatgtaacacctgccggaagactttcagtcagaagtctaacttgatcgtgcatcagcgcagacacatcggagaaaatctaatgaacgagatggacattagaaattttcagccacaggtaagcctccacaacgcctcagaatactcccactgcggcgaaagtcccgatgatatcctgaacgtgcaatag

SEQ ID NO: 247575 - DNA, 417 bp, Artificial Sequence
  Description of Artificial Sequence: Synthetic coding sequence
atgaacaaggttgagcaaaagagccaggagagtgtatcattcaaggacgtcaccgtggggtttactcaggaagagtggcagcacctggatccgtcacagcgagcactgtacagggatgtgatgctcgagaattatagcaacctcgtatccgttgggtactgcgtgcataagccagaggtgattttccgcttgcagcaaggagaagaaccctggaaacaggaggaggaattcccgagccagtcatttcccgaggtgtggactgccgatcatcttaaggaacgttcacaagaaaaccagtcaaaacatctgtgggaagtggtgtttatcaataacgaaatgcttaccaaggagcagggtgatgtgatcggcattccattcaacgttgacgctcctgaaatgttaatgcctcttgactag

SEQ ID NO: 247576 - DNA, 2337 bp, Artificial Sequence
  Description of Artificial Sequence: Synthetic coding sequence
atgaataaggtcgaccagaagtttcagggctcagtttcatttaaggacgtgacagttggctttacccaggaagagtggcaacacctggacccctctcaaagggccctatacagagatgtcatgttagagaactacagcaacctggtatcagttggatattgtgcccataaaccagaggtcatctttcgccttgagcagggggaggagccgtggcggctggaggaagagttcccttcccagagttttcctgaggtgtggacagctgaccacttgaaggagcggagccaggaaaaccagagcaagcacctgtgggaagtggtgttcataaacaatgaaatgttgaccaaggaacagggaaacgttataggaattcctttcaatatggatgttagctcctttccctcacgaaaaatgttttgtcagtatgatagtcgtggcatgtctttcaatacagtctccgaactggtgatatcaaagatcaactacctgggtaaaaagtccgacgagtttaacgcctgtggaaagctgctgttgaacattaagcacgacgagacacacacaagggaaaagaatgaggtgcttaagaaccgcaacactctgtctcaccgggagaacacactgcagcacgagaagatccagaccctggatcacaacttcgaatactccatttgccaggagacacttctggagaaggcagtattcaatacacggaagagagagaatgctgaggaaaacaactgtgattataacgagtttggtcggactttctgtgatagctcatcacttctgttccaccagatcccgccatccaaggactcacattacgagttctccgactgtgaaaagttcctctgtgtaaagtctaccctatcaaagcatgacggcgttcccgtcaagcactacgactgtggcgagtctggtaataacttccggcgaaagttgtgtctgtctcagttgcagaagggcgataagggtgagaaacatttcgagtgcaacgagtgcgggaaggccttctgggagaagtcacatctcacaaggcatcagcgagtccataccggggagaagcacttccagtgtaaccagtgcggtaagactttctgggagaaaagcaatcttacaaagcaccagcgcagccataccggtgagaaaccatttgagtgcaacgagtgtggaaaagcctttagccataagtccgctctgactctacatcagcgaacccatactggcgagaaaccgtaccaatgtaacgcttgcggaaaaactttttaccagaaatctgatttgacgaagcaccagaggactcatacgggacaaaaaccttatgaatgctatgagtgtggaaagtctttttgtatgaattcacatctgaccgtgcatcaacgtacgcatactggggaaaaacctttcgagtgtttagagtgcggcaaatcattttgtcagaagagtcacttaacccagcatcaaagaacacacattggagataagccttatgaatgcaatgcttgtggcaagactttttatcacaagtccgtcctcacacgccaccagattattcacactgggctgaaaccgtatgagtgttacgaatgtggcaagaccttttgtctcaagagcgatctgaccatccatcagaggactcataccggcgagaagccatttgcctgcccagaatgcggcaaatttttcagccataaatctacgctgagccagcactataggacccacactggagaaaagccttacgagtgtcatgagtgtggtaagattttttataacaagtcctacttaacgaagcacaatcgcacgcatacaggggagaagccctatgagtgtaatgaatgtggcaagactttctgccagaaatcccagctgacccaacaccaacgaattcatattggggagaaaccgtacgaatgcaatgagtgcggcaaggccttttgtcacaagtcggccctgattgtgcaccagcgaacccacactcaggagaaaccttacaagtgtaatgagtgcggcaagtctttctgcgtcaagagcggactgatcttgcatgaaagaaagcacactggagagaagccctacgagtgcaacgaatgtggcaaatcgtttagccacaaatctagcctaactgtgcatcacagggcacatacaggggaaaaatcttgtcagtgtaatgaatgcgggaagatcttttatagaaagtcggatctggccaagcaccagcgaagccatactggagaaaagccttacgagtgcaatacttgtcgaaagacgttctcacagaagtctaacctcattgtgcaccagcgcactcatatcggagagaaaccgtatgagtag

SEQ ID NO: 247577 - DNA, 2235 bp, Artificial Sequence
  Description of Artificial Sequence: Synthetic coding sequence
atgaataaggtggaccagaagtttcagggttctgtttcgttcaaagatgttactgtgggctttacccaggaagaatggcagcacctggatcccagtcagcgcgctctgtaccgggacgtgatgctcgaaaactatagtaatctggtgagcgtaggcacggccgaccatctgaaagaaagatcacaggagaaccagtcaaaacatctctgggaggtcgtctttatcaacaatgaaatgcttacaaaggagcaaggcaatgtgattggcattccatttaacatggatgtctcaagtttcccttcccgcaaaatgttctgtcagtacgatagcagagggatgtctttcaatacagtaagtgagctggtcattagtaaaatcaactacctgggtaaaaagagtgatgagttcaatgcatgcggtaagcttcttcttaacatcaagcacgatgagacgcacactcgagagaaaaatgaagtcctgaaaaataggaacacactgtcacatcgggagaacacactccagcacgagaagattcagacattggaccataattttgagtactccatatgtcaggagacattacttgagaaagctgtgtttaatacccgcaagcgtgaaaacgcagaagagaataattgcgactataatgagtttgggagaaccttctgcgacagcagtagtctactctttcatcaaattccgccttcaaaggattcccattatgaattcagcgattgtgaaaagttcctgtgtgtgaagtctaccctcagcaaacacgatggcgtgcccgtgaagcactacgactgcggtgagagcggtaataacttcaggcgcaagctgtgccttagtcagctgcagaagggggacaagggtgagaaacacttcgagtgcaatgaatgtggcaaagcgttctgggagaaaagccacctgaccaggcaccaaagagttcacaccggggaaaagcacttccaatgcaatcaatgcggaaagacgttttgggaaaagtccaatctgactaaacaccagaggagccacacaggcgagaagccctttgaatgtaacgagtgcggcaaggccttcagccataagagtgctctcacactgcatcaacgcacacatacaggagagaagccctatcagtgcaatgcctgcggcaaaacgttctaccagaagagcgatctgactaagcatcagcgcactcatacaggacaaaagccatacgagtgttacgagtgtggcaaatctttttgtatgaactcacatctgacggtccaccagaggacacacacaggtgagaagcctttcgagtgcctggaatgtgggaagtctttctgccagaaatcccatttaacccagcatcagaggacacacattggtgataaaccttatgaatgcaatgcatgtggtaaaaccttttaccataagtccgttctgacaaggcatcagatcatccacactggactcaagccttacgagtgttacgaatgcggtaagacattttgtctgaagagcgatcttaccattcaccaaaggacccatacgggggaaaagccgtttgcctgccccgaatgcggcaagtttttttctcataagagcactctcagccaacactaccgcacgcacacaggcgagaagccctacgaatgtcacgaatgcggtaaaatattttataataagtcctatctgacaaaacacaaccgaacccacacaggcgagaagccttacgagtgcaacgagtgcggcaaaaccttctgccagaaatcacagctgactcaacatcagcggattcacatcggggaaaaaccctacgagtgcaatgaatgcgggaaagctttttgccacaaatctgccctgattgtgcaccagcgaacacacactcaggagaaaccctataagtgtaatgaatgcggtaaatccttctgtgtcaaaagtggtctgatattacacgagaggaagcacacgggcgaaaagccttacgaatgtaacgagtgcggcaagagcttttcacacaagagcagtctgactgtgcaccacagagcccacacaggcgaaaagagctgccagtgcaacgaatgcggcaagattttttatcggaagagcgacctcgcaaaacatcagaggtcccatacgggcgagaagccgtacgaatgtaatacttgccggaagaccttcagtcagaaatctaacctgattgtacaccagcggacacacattggagagaagccttacgaatag

SEQ ID NO: 247578 - DNA, 1683 bp, Artificial Sequence
  Description of Artificial Sequence: Synthetic coding sequence
atgctcttgctgctgtccgaccagctcctgctgacagccctgaggaagcccaacccccaagccatggctgccctgttcctttctgcccctccccaggccgaggtgacgtttgaagatgtggccgtctatctgagccgtgaagaatgggggaggctggggcctgctcagagaggcctttatagggatgtgatgctggagacatacggaaacctcgtgtccctgggtgtagggccagccggtcccaagccgggagtgatctcccagctggagcgtggggacgagccctgggtcctcgacgtgcagggaacaagcggcaaggaacaccttagagttaactcaccagctcttgggactcggacagaatataaggagttgacttcgcaagaaacctttggcgaggaagacccgcaggggagtgagcccgtcgaggcttgcgatcatatatcaaagtcggaagggtccctggaaaaacttgtggagcaaagaggacccagagctgttaccctgaccaatggcgagtcatcaagggaaagcggtggtaatctgcgacttctaagccgtccagttcctgaccagcgtcctcataagtgcgatatttgcgaacagagctttgagcagcgctcttaccttaacaatcataaacgagtccatcggtctaagaagaccaatactgttagaaacagcggcgagatcttttcggccaatctggtagttaaagaagaccaaaagatacctacaggaaaaaagctgcactattgcagctattgcggcaagacctttcgttactctgcgaatttggtgaagcaccaacggctccacaccgaagaaaaaccatataaatgtgacgaatgcggcaaagcctttagccagtcttgcgagttcatcaatcacagacgtatgcacagcggtgagataccctatagatgcgacgaatgcgggaaaacttttacaaggcgtcccaatctgatgaaacatcagcgcatccatactggtgagaagccctacaagtgcggtgagtgtggcaagcactttagcgcctactcatctctgatttaccaccaaagaatccataccggggaaaaaccttataagtgcaatgactgcggcaaagctttcagtgatggaagcatcctaattaggcatcggagaacacatactggtgaaaaacctttcgaatgtaaggagtgcggcaaaggttttacccagtcatccaaccttatccagcatcagagaatccatactggagagaagccttacaaatgcaacgagtgtgagaaagctttcatacaaaaaaccaaactggttgaacaccagcggtctcacacgggggagaagccatatgagtgcaatgactgtggtaaagtattctcccagtctactcacctcatccagcaccaacgaattcacaccggggagaaaccatataaatgttccgagtgtgggaaagcttttcacaattctagccgactgatccatcaccagcggctgcaccacggggagaaaccttacaggtgtagtgactgtaaaaaggcgttcagtcagagtacttacctgatccagcacagacggattcataccggtgaaaaaccatataagtgttccgagtgcggtaaagctttcaggcattcttccaatatgtgtcagcaccaaaggattcacttacgtgaggattttagcatgtag

SEQ ID NO: 247579 - DNA, 1620 bp, Artificial Sequence
  Description of Artificial Sequence: Synthetic coding sequence
atggctgctctgttcctgagcgcgccacctcaggcagaagtcactttcgaagatgtggctgtatacttaagccgggaggaatggggacgcttgggaccggctcaacgcggattatacagggatgtcatgctggaaacctatggtaatctggtgagcttgggcgttggtccagctgggccaaaaccaggagtgatcagtcagttagaaagaggcgatgaaccttgggtattggatgttcaggggacgtccggcaaggagcatctgagagtcaattccccagccctcggtactcgcaccgaatataaggaattgactagtcaggagactttcggggaggaagacccacaggggtcagaaccagtggaggcctgcgatcatatcagcaaatcggagggttcactggagaagctggttgagcagcggggtccccgtgccgtgactctgaccaatggtgaaagcagtcgagagtctggaggtaatctaaggttactgagtcggccagtgcccgaccaacgacctcacaaatgcgatatctgcgagcagtccttcgagcagaggtcctacctgaacaaccacaagcgtgtccatcgttctaaaaaaaccaacacagtgcggaacagcggggaaatcttttctgctaatctagtagtcaaagaggaccagaagattccaacgggcaagaagttgcactattgcagctattgtggcaaaacgtttcgctattcggccaatcttgtgaaacatcagcggctccacaccgaagagaagccctacaagtgtgacgagtgcggtaaggctttcagtcagagctgcgagttcatcaatcaccgccgaatgcacagcggggagataccttaccgctgcgacgagtgtgggaagacgtttacccgcagacctaatctcatgaaacaccagcggatacacaccggtgaaaaaccttataagtgcggcgagtgcggtaagcatttttctgcttatagctcacttatctatcaccaacgaattcatacaggcgaaaagccatacaagtgtaatgactgcgggaaggctttcagtgatgggtctattctgatcaggcaccgccgaacacatacgggagagaagccattcgaatgcaaggagtgtggcaaaggctttactcaatccagtaatctcatccagcaccaacgaatacacactggggagaaaccttataaatgtaacgaatgcgagaaggcattcattcagaagactaaacttgtggaacatcaacgaagccacacgggtgaaaagccctatgagtgcaatgactgtgggaaggtgttcagccagtccactcaccttattcagcaccagcgcattcacacgggagagaaaccctataagtgtagtgaatgtggaaaagcatttcataactcctctcggctcatccaccaccagagactgcatcacggggagaagccatatcggtgtagcgattgcaagaaggcctttagccagtccacatacctcatccagcaccgcagaatccataccggtgagaagccttataaatgttccgaatgcgggaaagcatttcgtcattcaagcaatatgtgtcagcaccagcggattcacctgcgcgaggattttagcatgtag

SEQ ID NO: 247580 - DNA, 1560 bp, Artificial Sequence
  Description of Artificial Sequence: Synthetic coding sequence
atgtatctgatccgagagtcccatgcttctgggtccagctcagttacaagcagttgctccctgcctagcgagagccctactctaagacaatggcggccatgctcatgcctgccccacccgcgacccggtgtcatctcacagctggaacggggagatgaaccctgggtgcttgatgtgcaggggaccagcggcaaggaacatttgcgtgtcaattcccctgccctaggaacccggacggagtataaggagctgactagccaggagacttttggcgaagaggatcctcagggttccgaaccagtcgaagcttgcgatcacatctctaagtctgaagggtctctggagaaactcgtggaacagcgagggccaagagccgtcaccctgactaatggggagagttcacgcgaatctggtggaaacctgcgcctgctgtctagaccggttccggaccagcggccacataagtgcgatatctgcgagcagtcttttgagcagaggagctatttgaacaaccacaaacgtgtccacaggtctaaaaagacgaacaccgtgcggaacagcggggagatattcagcgctaacctggttgtcaaggaagaccagaaaataccaaccggcaagaaactccactactgttcttactgcgggaagacctttcgctactctgctaacctcgtgaagcatcaacggcttcacactgaggagaagccctacaagtgtgacgagtgtggaaaggctttctcccaatcctgtgaattcatcaaccacaggagaatgcacagtggggaaatcccttacagatgtgacgagtgtggaaagaccttcacgcggaggccaaatcttatgaagcatcagcggatccacaccggagaaaaaccctacaaatgcggtgagtgtggcaagcacttcagcgcgtattcttcactcatctatcaccagcgcatccacacaggagagaagccctacaagtgtaacgactgcggaaaggctttctctgatgggtcgatactgattagacaccgcaggactcataccggtgagaagccgttcgagtgtaaggaatgcggaaaaggtttcacacagtcatcaaacttaattcaacatcagcgcatccatactggtgagaagccttacaagtgtaacgagtgtgaaaaagcctttatccagaagactaaactggttgaacaccaaagatcacacacaggagaaaaaccctacgaatgcaacgactgcgggaaggttttttcccagtcaactcacctaatccagcaccagaggattcatacaggcgaaaagccctacaagtgtagcgagtgtgggaaggcctttcacaatagctctagactgatacaccatcaacgcctccaccacggcgagaagccctaccggtgttcggactgtaagaaggcattttcccaatctacatacctgatccaacaccgacgtattcacaccggcgagaagccctataagtgcagcgagtgcggcaaggcttttaggcactcttcaaacatgtgtcagcaccagaggattcacctgcgtgaggatttcagtatgtag

SEQ ID NO: 247581 - DNA, 1584 bp, Artificial Sequence
  Description of Artificial Sequence: Synthetic coding sequence
atgaccgcagaactgagagaggctatggctctcgctccctggggccctgttaaagtcaaaaaggaggaggaggaggaagagaacttcccaggccaggcgagtagtcagcaggtgcacagcgagaacatcaaagtgtgggcaccagtgcagggattacagactggactcgacggctcagaggaggaggaaaagggccagaacataagttgggatatggctgtggtattgaaggcgactcaggaggcaccagcagccagcaccctgggatcgtacagcctcccaggcacactcgccaagagtgaaatccttgagacccacggtactatgaacttcctcggagctgaaacaaaaaacctgcagctcttggtccccaagacagagatttgcgaggaggcagaaaagccgcttatcataagcgagagaatccaaaaggccgacccgcagggtcccgagctgggagaggcctgtgaaaaggggaatatgttgaagagacagaggatcaagagagaaaaaaaggatttccggcaggtcatcgtaaatgactgccatttgccggagtctttcaaggaggaagagaaccagaagtgtaaaaaaagcggcggaaaatacagtctgaactctggggctgtcaaaaatcccaaaacccaactgggacaaaaaccgttcacttgttctgtgtgcggcaagggattcagccagagcgccaacctcgtcgtccaccagcggattcacaccggggagaaaccctttgagtgccacgagtgcgggaaggcattcattcagagtgctaatcttgtcgtgcatcagagaattcacacaggccagaagccctacgtctgctctaaatgtggtaaggcatttactcagtcaagtaacttgactgtgcaccagaagatccattcactggagaaaacgttcaaatgcaatgagtgtgaaaaggccttctcatacagtagccaacttgctaggcaccaaaaggtacatattacagagaagtgctatgaatgcaatgagtgcgggaaaacttttacccgtagttccaacctcatcgtgcatcagagaatccacaccggggaaaaaccctttgcctgcaacgactgcggcaaagcattcactcagagtgctaatcttatcgtacaccagcgctctcacacaggggaaaaaccctatgaatgcaaagagtgtggaaaagcattcagctgcttctctcatcttatcgtacaccaaaggattcacaccgctgagaagccttacgattgcagtgagtgcggaaaagccttttcacaactctcttgtctaatcgtacaccagcggatccactctggtgatttaccgtacgtctgtaacgaatgcgggaaggccttcacttgcagttcttacctcctcatccaccaaaggatccataatggtgagaaaccatatacctgtaatgaatgcgggaaggccttccgccagcgctcctctcttactgtccaccaaagaacccacactggagaaaagccctacgagtgtgagaagtgtggggctgctttcatctccaactcacaccttatgcgccatcaccgaacccacctggtggaatag

SEQ ID NO: 247582 - DNA, 405 bp, Artificial Sequence
  Description of Artificial Sequence: Synthetic coding sequence
atgacagccgagctacgggaggcaatggcactggcaccctgggggcctgtgaaagtgaagaaagaagaggaggaggaggagaattttcctggccaggcttccagccaacaagtgcattccgaaaacatcaaggtgtgggcgcctgtgcagggtttacagaccggactcgacgggtctgaggaagaagagaagggacagaatattagctgggacatggcggttgtgctgaaggctacgcaggaggccccagccgcttcaactctcgggtcctacagcctgcccggaaccctcgcaaagtccgagattcttgaaacccacggaaccatgaactttctcggtgcagagactaaaaatttacagcttttggtgccgaaaaccgaaatctgcgaggaagccgagaagtag

SEQ ID NO: 247583 - DNA, 339 bp, Artificial Sequence
  Description of Artificial Sequence: Synthetic coding sequence
atgaccgctgaactcagggaagccatggcgttggcaccgtggggccctgtgaaagttaaaaaggaggaggaagaggaagagaattttccagggcaagcctcctctcagcaggtccacagcgagaatattaaagtgtgggccccagtgcagggtttgcagaccggactggatggatcggaggaggaagagaagggacaaaatattagttgggacatggcagtcgtactgaaagcgacgcaggaggcacccgctgcctcaacgttaggaagttactctctgccaggtacactggctaagagtgagattctggagacacacggcacaatgaattttctgtag

SEQ ID NO: 247584 - DNA, 1104 bp, Artificial Sequence
  Description of Artificial Sequence: Synthetic coding sequence
atgctgaaacgccagcgaatcaagcgtgaaaagaaggactttagacaggtcatagtcaacgattgccaccttccagagtcctttaaggaggaagagaatcagaagtgcaagaagtctggtggtaaatactccctgaattccggggcagtcaaaaacccaaaaactcagcttggccagaagcccttcacttgtagcgtatgtgggaagggatttagccagagcgccaatctggtggtgcatcagcggatccatactggcgaaaaacctttcgaatgccatgagtgtgggaaggcattcatccaaagcgctaatctggtcgttcatcagagaatacacacaggacagaaaccctacgtgtgcagcaaatgtggcaaagcgttcacgcagagctccaatctcacagtgcaccagaagatccatagtctggagaagactttcaaatgtaacgaatgcgagaaagcattttcatacagcagccaactggctcggcaccaaaaggtacacatcaccgaaaagtgttatgaatgcaacgaatgtggtaagaccttcacgcgctcctctaatcttatcgtgcaccagcgcatacatacgggggagaaacccttcgcctgtaacgattgcggcaaagcctttacacagagcgccaatttgatcgtgcatcaacgcagtcatactggtgagaaaccctacgagtgcaaagaatgcggaaaggcattctcttgtttctcacatctgattgttcatcaacgcattcatacggcagaaaaaccttatgattgctctgagtgtggcaaagctttctctcagctgtcatgccttatcgttcaccaacgaattcattccggtgatttaccttacgtctgcaacgaatgtggaaaagcattcacatgcagtagttacttgctaatccatcagcgcatccacaatggggagaagccttacacttgcaatgaatgtgggaaggcatttaggcagagatcttctctaactgttcaccagagaacacatactggcgaaaaaccctacgagtgtgaaaagtgcggcgctgccttcatttctaactcccacctgatgcgccaccacagaacccacctggttgagtag

SEQ ID NO: 247585 - DNA, 981 bp, Artificial Sequence
  Description of Artificial Sequence: Synthetic coding sequence
atggatctcacagcgatatatgaatcattgctgtccctctccccagatgtgccagtgccttccgatcacgggggtactgagtccagccctggctggggaagctcaggtccatggtcgctctcgccatctgactcgagtccatctggggtaactagccgccttcccggaaggtccacatctctggtggaaggccgtagttgcggatgggtgccccctccacctggcttcgcaccgctcgccccaaggttgggccctgaacttagccccagtcctacctctcccacagcaactagtactacgccaagtagatacaagaccgaactgtgtaggaccttcagcgaatcaggccgatgtcgttatggagcaaaatgtcagtttgcccacggccttggcgagctcaggcaggcaaatcggcaccccaagtacaaaaccgaactgtgtcacaaattctaccttcaggggagatgcccatacggttcccgatgccatttcatccataatccatctgaagatctggctgcgccaggccatccccctgttctgcggcaatctatttctttctctggtcttccttccggacggagaactagcccacccccacctggactcgccggaccaagcctctcttcctccagcttcagcccgtctagctcacctccccctcccggtgacctgcctctgtctccatctgcctttagcgcagcaccgggaacccctttggcccgtagagatccaaccccggtgtgctgcccttcctgccgtcgagctacacccatttcggtgtggggaccattgggaggactcgtgaggacgccaagtgttcaatccttgggcagcgatcctgatgagtatgcatcctcggggtctagtctaggaggatccgactcacctgtgtttgaggccggtgtctttgcacctccccagcctgttgccgctcccagaaggctgcctatctttaacagaatctcagtttcggaatag

SEQ ID NO: 247586 - DNA, 1017 bp, Artificial Sequence
  Description of Artificial Sequence: Synthetic coding sequence
atgaccactacgctggtgtctgctactatcttcgatctcagcgaagtgttatgcaaagggaacaaaatgctgaactatagcgcccctagtgcaggaggctgcttactcgacagaaaagccgttgggactccagccggaggtggcttcccacggaggcattccgtgaccctgccttcatctaagttccaccagaaccaattgctgtcttccctcaagggcgaacctgctccagcactgagctcaagagattctcgcttccgggaccggagcttctccgaagggggagagagactgctacctacccagaagcaaccaggaggaggccaggtgaacagcagtagatacaaaaccgagctgtgcaggcctttcgaagagaatggcgcttgtaagtacggggataagtgtcaattcgcacacggtatccacgaactcaggagtctgacaagacacccgaaatacaaaacggagctctgtcggacatttcacaccatcggcttttgtccttatggccctaggtgtcattttatccacaacgccgaagagcggcgtgcgctggccggagcaagagacctgtctgccgaccgcccacgcctacagcactctttctccttcgcaggttttccaagtgccgcagcaactgccgctgcgactggcctgctcgacagcccgacatccattacaccccctcccattctctctgccgacgaccttctgggatcacccactctgccagacggcactaacaatccctttgcgttttctagccaggagttagcctccctgttcgcgccatctatgggcctcccaggcggtggtagtcccacaacattcctgtttagacccatgagcgagagcccacacatgttcgattcgcctccctcccctcaggatagcttgtctgatcaggagggctacctgtcctcatctagcagcagtcacagcggatccgactcacctaccctggacaattccagaaggttgccaattttttctcgcctgagcatctcggacgactag

SEQ ID NO: 247587 - DNA, 501 bp, Artificial Sequence
  Description of Artificial Sequence: Synthetic coding sequence
atgaatacatacactagatctgcctcgttcaccccaaaaacattcactttccctctggcgcaaaaccgcacatcacaccctacaacgacatcgaaactgaagtacctgggaagaccctcccccagaagagacgctctgcaggccaacggcgagggacccgaagttggcccaggaaccgaggagccagcccacaggttgcctgtaggatcaggatccgccggagaagctgccgcatcactcggcaccgccagggtgcggagcggtcgtgctgagtgtactgcaaagttggcaggagacggacacgcccgtctcgcgtcagcattcctgcaccggagggccgctctgccaccacccttaggaacgtgcagacctaggctgggcgaagggggttctgctccagcccttgggccatctcccagacgcggtcggagggtctctgaagggttaagggacagcctcccgcctctgggctccctgacactaggcaaaagccctaaatag

SEQ ID NO: 247588 - DNA, 966 bp, Artificial Sequence
  Description of Artificial Sequence: Synthetic coding sequence
atgactacgacgctagtgagtgccaccatcttcgacctatctgaggtgctttgcaagggtaataagatgctgaactatagcgccccatctgcagggggttgcctgctagatcggaaggctgtcggcacaccagccggagggggattccccagaagacattctgttacgctgccttcatcaaaatttcatcaaaatcagctgttgagcagtttgaaaggcgaacccgcacctgccttgagttccagagatagtagattccgagaccggtccttcagtgaaggaggggagcggttactgcccacccagaaacaacctttcgaagaaaacggcgcatgcaaatatggggataaatgtcagtttgctcacggaatccacgagttgaggagcctcacacggcatcctaaatataagacagaactgtgccgaacatttcatacgattgggttttgtccctacggccctcgctgccactttatccataatgccgaggagcgccgagctctcgctggggctcgcgatctctccgccgacagaccacgactgcaacactccttcagttttgcagggttcccatctgcagcagcgactgcagccgctacggggctcctggactctcctaccagtatcactccaccgcctattctctcagctgacgatttgctcggaagcccaacactgccagatggcacaaacaatccattcgcatttagcagtcaagagctggcatccctgttcgccccatccatggggctcccgggtggcggttcccccacaactttcctgttcaggccaatgtccgagtccccgcacatgttcgattcccccccaagcccccaggattcattatctgatcaggagggctacctcagttccagcagcagttcccattcaggaagcgattctcctactctggataatagccggagattacctatatttagccgcctctctataagcgacgactag

SEQ ID NO: 247589 - DNA, 1017 bp, Artificial Sequence
  Description of Artificial Sequence: Synthetic coding sequence
atgactacaacactggtctcagctaccatcttcgatttgtcagaggtcctctgcaaagggaacaagatgctgaactactcagcgccatctgcaggtggatgtctgcttgaccgcaaggcagtcggcacaccagcaggaggcggattccctcggcgtcacagcgtcaccctcccctcgagcaagttccaccaaaaccagttattgagcagcttgaaaggcgagccagcccctgctctctctagccgagacagtcgctttcgggataggagtttctctgaaggcggagagagattgctgcctacccagaaacagcccggagggggtcaggtgaattcaagtaggtacaaaaccgagctgtgtcgacccttcgaggagaacggtgcatgcaaatatggcgataaatgccagttcgcccatgggatacatgaacttcgttccctgacccgccaccccaagtacaagacagagttgtgtcggacattccacacaatcgggttttgcccctacggtccaaggtgtcatttcattcataatgcagaagaacgcagggccctggctggggctcgcgacctgtctgctgataggcccaggctgcagcatagcttttcctttgcaggcttccccagcgctgccgctaccgcagcggctaccggactgctggattcccccacctcaatcactccccctccgatcctgtcagccgatgaccttctgggaagtcctaccctccctgacggcactaataaccctttcgccttttcctcacaggagttggcttccctattcgcgccaagcatgggccttccgggtgggggaagccctaccacatttctatttcgccctatgagcgagtcccctcacatgttcgacagtccgccttctccccaagacagcctttcggaccaggagggatacctgtctagttcttccagctcacactcaggaagcgacagccccacccttgacaactctaggcggctccccatcttctcccgcctgtccattagtgatgactag

SEQ ID NO: 247590 - DNA, 1485 bp, Artificial Sequence
  Description of Artificial Sequence: Synthetic coding sequence
atgtcaacaaccctgttgtctgccttttacgatgtagacttcctgtgtaagaccgagaaatcactggccaacttaaatctgaataatatgctggacaagaaggcagtgggtacacctgtggccgcagctccaagttctggctttgcccctggttttctgaggaggcactcagcttcgaatctgcacgccctcgcccatccagccccatccccgggatcttgctccccaaagttccccggtgccgctaacggttcaagttgcggctctgcagcagccggtgggcctacgagctacggaacgttaaaggagccctccggcggagggggaacggcactgctaaacaaagagaacaaattcagagacaggagctttagcgagaacggggataggagccagcatttactgcacttacaacagcaacagaaaggtggcggaggctcgcaaattaacagcacaagatacaaaaccgagctgtgcagaccatttgaggaatctgggacatgcaaatacggggaaaagtgccaattcgcccatggttttcacgagctgcgaagtctgacccgacatccaaagtataaaacagaactgtgtagaacttttcacactattggtttctgcccctatggccctcgctgtcattttattcacaatgctgatgagcgcaggccagcaccgagcggtggtgcctcaggtgacctccgtgcttttggtactagagatgctctacatttgggttttccacgtgagcccagacctaagctgcaccacagcctgtccttcagtggtttcccctcagggcaccaccagcccccagggggactggaaagccctctactgttggattccccgacatcgcggactccacccccacctagttgcagctccgcctcctcttgctctagctccgcctcgagttgtagtagcgcctctgcagcctcaacaccctccggcgcaccgacatgctgcgcttcagctgccgcagcagccgctgccgctctgctttatgggacgggaggtgccgaagatctcctcgccccaggcgcaccttgcgcggcttgcagctcagcctcatgtgcaaataacgcctttgcttttgggccagagctcagctctctgattacccctctggctatccaaactcataatttcgctgccgtggccgcagctgcttattacaggagccagcagcaacagcaacaacagggcctggctcctccagcccaaccgcctgccccaccctccgccaccttgcctgcaggagctgcggctccaccctctcctccatttagctttcagctcccacggagactgtccgacagcccagtcttcgacgcccctccttcccctccggacagtctgtcagatcgcgacagctacttgagcgggtccttgtcgtcagggtcattgtccggatctgaatcaccatccctggacccaggtcgtcggctgccaatctttagccgcctgtccatatcggatgactag

SEQ ID NO: 247591 - DNA, 651 bp, Artificial Sequence
  Description of Artificial Sequence: Synthetic coding sequence
atgtccgctctgggccagatcacaatcactgtttctcgctgttggaacacagaacgtaaccagacagacaagaacccgtgtcttcacggggcttacctgcagttgagagagaccgtcaagaacaaaagcacacacttgaagaaaccactaatgaaacaggccccaccatggaaggaccacctgacatttcagccattacaccccgcagaacgcaagacacaagtgtggcgttggcagagtgggaacagctccgaccttgagacaacttcctcagcctcaccctggcccacgggctccaatcgagacgtcgtcttgaatacattggccgagagctgctgcggcttatccgagctaataacagcccctccttatgcaggggtgtccatccagggcttcagccagatttgggtgctcttccctttttgcggaggcactttccaccacaatgagaaagatgtgctagggctgcaggactttgagagggagtcagtctcaacatctcagagccgcaacattagcctgctgactctcgggcagctacagaactgtgttatcggaaagctgaccatcatcgatctgctcacggagcacctgctcggagtgaggcacggggtgatctgcttcccctggggcttgccctcatctagctag

SEQ ID NO: 247592 - DNA, 1224 bp, Artificial Sequence
  Description of Artificial Sequence: Synthetic coding sequence
atgcagcaaaaagccttcgaggagtctcgatacccctggcaggagtcgttcgagaacgtggctgtttgtctccctctaagatgcccacggtgtggcgaccataccagattcaggtcattgtcatccttacgtgcacatctcgaattcagccattcatacgaggagaggacactcctgactaagtgttccttgttcccgagtctgaaggacacagatttggtgacttcctcagaattattgaagcctgggaagctacagtcctcagggaatgtggtgaagcagaagccatcctatgtgaatctttacagcatcagccacgaacacagtaaggatcgcaaacctttcgaggttgtggcagagcgccctgtctcatatgttcaaacttacaccgctatggacttgcacgccgactccctcgacggcaccagatctggccctgggctaccaacctcggacaccaaagcctccttcgaagcccatgtgcgcgaaaaattcaatcggatggtggaggccgtggaccgtacgattgaaaaaagaatcgacaaactgacaaaagagctggcacagaagacggcagagctactggaagtgagagctgcttttgtccagcttacacaaaaaaaacaggaggtccagaggcgtgagcgcgctctgaaccgtcaggtcgacgtcgctgtggaaatgatcgcggtgttgcgccagcgtcttaccgagagtgaggaggaactactccgtaaagaggaggaggttgtaacattcaaccacttcctggaagctgcagcggagaaagaggtccaaggcaaggcgaggttacaggactttattgaaaatctgctccagagagtcgagctggctgaaaaacagctggaatattaccagagccaacaggcctccgggttcgttagggacctgtcaggacatgttctgaccgacatcagctccaacagaaaacctaagtgcctgtctaggggacaccctcactccgtctgcaatcacccagatctgaaggcccacttccatcctaagggcagaaaccacctgaagaaggcaaaggatgatcgagcatccatgcaaccagctaaagctatccacgaacaggcagagtcttctcgcgatctgtgcaggcccccaaagaaaggtgaactgctgggtttcggaagaaaaggaaacattcggccaaaaatggcgaagaagaaacccaccgcgatcgtcaatatcatttag

SEQ ID NO: 247593 - DNA, 1002 bp, Artificial Sequence
  Description of Artificial Sequence: Synthetic coding sequence
atgcagcagaaggcctttgaggagagcagatatccctggcaagagtcattcgagaatgtggccgtctgcctgccgctgcgctgcccacgatgcggtgatcatacaaggttcaggagcttgtcatcactccgtgcccatctcgaatttagccatagctacgaggagaggacgcttctcacaaaatgttctctctttccctctctcaaggatacagacctggtgacaagcagcgaactgctgaagccaggtaaactgcagagctctgggaatgtcgttaagcagaagcccagctatgtcaatttatactccataagtcacgaacacagcaaagaccgcaaaccattcgaagtggtggccgaaagaccagtaagttacgtgcaaacctacactgcaatggacctgcatgctgattctcttgacgggacccgaagcggaccagggctccccacgtctgataccaaggccagcttcgaagcacacgtgcgggaaaagttcaatagaatggtagaagccgttgaccgcaccattgagaaacggatcgacaagctgacgaaagagttggcccaaaaaacagcggagctgctcgaggtgcgcgctgcatttgttcagctgactcagaaaaagcaagaggtgcaacgacgagagcgcgcacttaaccggcaggttgatgtggctgtggaaatgatcgctgtactcagacagaggctgacggagtccgaagaggagctactgcggaaggaagaagaagtggttacatttaaccactttctggaggcagcagcagaaaaagaggtgcaggggaaagctaggctccaagactttattgaaaacctactccaacgggtggaattagccgagaagcagttggagtactaccaatcccagcaagcctctggctttgtgagagatctgagcgggcacgttagctggaagggagctggcgaggccagattggtgtgtcagaacgacctggaactcgaggaatctgcgatcgttgagtag

SEQ ID NO: 247594 - DNA, 1389 bp, Artificial Sequence
  Description of Artificial Sequence: Synthetic coding sequence
atgcagcagaaggccttcgaggaatctagatacccatggcaggagagctttgaaaatgtggccgtgtgtcttccccttcgctgccctcgttgtggcgaccatacaagatttcgctcgctgagctccctgcgggcacatcttgaatttagtcattcatacgaagaaaggacccttctaacaaaatgctctctgtttccatcccttaaggatacagaccttgtgacctctagcgagctactgaaacccggtaaactgcagagttctggcaacgtggtcaagcagaagccttcctatgtgaatctttatagtattagccatgagcactccaaggaccggaagccatttgaggttgttgcagagagaccggtttcatacgtccagacttacaccgctatggacctccacgcagattccctcgatggcacacgaagcgggccaggattgccaacctctgataccaaagcctccttcgaagcccacgtaagggaaaagtttaatcgaatggttgaggccgtggatcggactatcgagaaaagaatagataaactgacgaaagagctggcccagaaaactgctgagctgctagaggtaagagccgcttttgttcagctaacacagaagaaacaagaggtgcaaagaagggaacgggcacttaaccgtcaggtagacgttgcagtggaaatgatcgctgtcctgcggcagaggttaactgagtccgaggaagagctgctgcgcaaggaagaggaggtggtgacctttaaccattttttggaagccgcagcggaaaaagaagtgcaaggaaaagcacgcctccaggacttcattgagaaccttctgcaaagagtggaactcgccgaaaaacagctggaatattaccagagccagcaggcctccggattcgtgcgtgatctttctggccacgtttcctggaagggagcgggagaggcaaggctcgtgtgccagaatgatctggagctagagatttttgggcatattaaccaccacctgagcggacttaaagactctcactgtctggtgttcctgcaggcaccaccagtgccttggatcatcttggcaagttttctgtggatccttgggaatccttggacatcctctacagccacggctggcttttcccagatctgggtgttgtttcctttttgcgggggaacatttcatcataatgaaaaagatgttctcggcctgcaggacttcgaacgcgaatcggtgtccaccagtcagtctcgcaatatcagtttgctgactctcgggcaacttcagaactgtgtcattgggaaattaacaataatcgacctactgactgagcatctcctcggagtccggcacggcgttatctgctttccctggggtctgccttcttcctcttag

SEQ ID NO: 247595 - DNA, 162 bp, Artificial Sequence
  Description of Artificial Sequence: Synthetic coding sequence
atgcagcaaaaagcctttgaggagtcacgatacccgtggcaagagagtttcgaaaatgtggcggtttgcctcccgttgcgttgtccgaggtgtggtgatcacacccggtttcgatcgttgtcttccctcagggcacacctggaatttagtcatagctactag

SEQ ID NO: 247596 - DNA, 1893 bp, Artificial Sequence
  Description of Artificial Sequence: Synthetic coding sequence
atgtccgtgtcatcaggtgtacagatactgacgaaaccggagacggtggaccgaaggaggtctgcagagaccacgaaggaggcaggtcggccattagagatggctgtctccgaacccgaagccagcgcagccgagtggaagcagttggatcccgcacagagtaatttgtacaatgacgtgatgctcgagaattattgcaaccaggcttctatgggttgccaggcacccaagcccgacatgatttctaaacttgaaaagggagaagccccatggctgggaaagggaaagcgccctagtcaggggtgtccctcaaagatagcccgaccaaaacaaaaggaaaccgatgggaaggttcagaaggatgatgaccagttggaaaacatacagaagagccagaacaagctgctcagagaggtggcagtcaagaaaaaaacgcaggccaagaagaatgggtctgactgcgggtcactaggtaaaaaaaacaacctgcacaagaagcacgtgccgagtaaaaagcggctgttgaaattcgagagttgcggtaaaattctgaagcagaatctggacttgccagatcacagtcgcaactgcgtcaaacgtaaatccgacgctgcgaaggaacacaagaaaagcttcaaccacagtttgtcagatacacgtaagggcaagaaacagacaggaaagaaacatgagaagctctctagccatagctctagcgataaatgtaacaaaacgggtaaaaaacacgacaaactgtgctgccactcttcttctcatatcaaacaggacaaaattcagaccggggagaagcatgagaagagcccctccctttcaagcagcacaaagcacgaaaagcctcaagcttgtgtgaaaccatacgagtgcaaccagtgcggtaaagtcctgtcccataaacagggactgattgatcatcagcgcgtacataccggagaaaaaccgtatgagtgtaatgaatgcggcattgcgttttctcaaaaaagccatctagtggtgcaccagcgcacccacaccggagagaagccttacgaatgcatccagtgcggcaaggctcatggacacaagcatgctcttactgaccaccttcggattcacacaggggaaaaaccttacgagtgcgctgagtgtggcaaaaccttccgtcactcttcgaatctcattcagcatgtaaggtcccacactggagagaagccttatgagtgtaaagagtgcgggaaaagcttcaggtataacagcagtctgaccgaacatgtacgcacgcacacgggggagatcccttacgagtgcaatgaatgcggaaaagcttttaagtactcaagttcactgacaaagcatatgagaatccatactggagagaaacccttcgaatgtaacgaatgcggcaaagctttttccaaaaagtctcatctgattattcatcagaggacgcacaccaaagagaagccgtataaatgtaatgagtgcggcaaggccttcggacattcttcctccttgacttatcatatgcggacccataccggcgagtcacctttcgaatgcaaccagtgcggcaaagggtttaaacagatagagggactgacgcaacaccaaagagtgcataccggagaaaaaccatacgagtgcaatgagtgcggaaaggccttcagtcagaagtcacacctcatagtccaccagaggacccacacgggggagaagccatacgaatgcaacgagtgtgagaaggccttcaacgcgaagtcccagcttgtgatccatcaacggagccacactggggaaaaaccttatgaatgtaatgagtgcggcaagacattcaagcaaaacgccagcctcaccaaacatgtgaaaacccactcagaggacaaatcccatgagtag

SEQ ID NO: 247597 - DNA, 1938 bp, Artificial Sequence
  Description of Artificial Sequence: Synthetic coding sequence
atgtctgtgagcagtggagtccagatcctgacaaagcctgaaactgttgatcgacgccgttcggccgagacgaccaaggaggcaggaagacccctcgagatggcagtgagcgaacccgaggcatccgctgcagtgagtgttactttcaaacacgtgactatggcttttacacagaaagaatggaaacaattggaccctgctcagagtaatctctataatgacgtgatgcttgaaaactactgtaatcaggcctccatgggatgccaggcaccaaagccagacatgatatctaagttggaaaagggggaagctccttggctgggaaaaggcaaacgcccttctcagggctgcccttcaaaaatcgcaaggcccaaacagaaggaaacggatggaaaggtgcagaaggacgatgatcagctggaaaacatccagaaaagtcaaaacaaactgctgcgagaggttgcagtaaagaaaaaaacccaggccaaaaagaatgggagtgactgcggcagcctagggaaaaaaaacaacctacacaaaaaacacgtgccatcaaaaaaaagacttctgaaattcgagagctgcggaaaaatcctgaaacagaatctggacctcccagatcattcccgaaactgcgttaagcgtaagagtgatgccgcaaaggagcataagaaatcttttaaccattcactgtcggatacccggaaggggaaaaaacagactgggaagaaacatgaaaaactcagttctcatagttcttcagacaaatgtaataaaacgggcaagaagcacgacaagctttgctgtcactctagcagccacattaagcaggacaagattcagaccggcgaaaaacacgagaaatcaccgagcctgtccagctcgaccaagcatgagaagccacaggcttgtgttaagccgtatgagtgtaatcaatgcggcaaggtattaagccacaagcagggcctgattgaccaccaaagggtgcacactggagaaaagccatacgagtgtaacgagtgcggaattgcattcagtcagaagagccatctcgtggtccatcagcgcacccacacaggggaaaagccttacgagtgcattcaatgtggaaaagctcatggccacaaacacgctttgacagaccaccttaggattcacaccggcgaaaagccatacgagtgcgccgaatgcggcaagaccttcaggcattcctcgaacctaatacagcatgtcaggtcacatacaggagaaaagccttatgagtgtaaagagtgtggcaaatccttccgctacaactcaagcttgactgagcatgttaggacccacaccggcgaaatcccgtacgaatgcaatgagtgcgggaaggcgttcaaatatagtagcagtctgaccaagcacatgcgaatccacaccggcgagaagcccttcgaatgcaacgagtgcggtaaggccttctctaagaaatcccacctgatcatccatcaaaggactcacacaaaggagaagccttataaatgcaacgaatgtggtaaagcattcggacatagcagcagcttaacatatcacatgagaacacacaccggtgagtctcctttcgagtgcaaccagtgcggcaagggctttaaacagatcgaggggctgacccagcaccagcgggtacacacaggggagaagccctacgaatgcaacgaatgcggtaaagccttttcccagaagagccaccttattgtgcatcagcgtactcacaccggtgaaaaaccatacgaatgcaatgaatgtgaaaaagcattcaatgctaagtcgcagcttgtcatccatcaaaggagtcacactggggaaaagccttacgaatgtaacgagtgcggcaagactttcaagcaaaatgcctctctcacaaaacacgtcaaaacccacagcgaagacaagagccacgaatag

SEQ ID NO: 247598 - DNA, 1896 bp, Artificial Sequence
  Description of Artificial Sequence: Synthetic coding sequence
atgagcgtttcgtcaggcgtgcagattctgacaaaaccagaaaccgtcgaccgcagaagaagtgcagagaccaccaaagaggctggacgtcccttggagatggcagtctctgagcccgaagctagtgccgcaaaagagtggaaacagctggatccagctcagtcaaatctgtataacgatgtcatgctagaaaattactgcaaccaggcgtccatgggttgccaggcacccaagcctgacatgattagtaaactggagaaaggagaggcgccatggttaggcaagggaaaacgaccctcccaggggtgtccatctaaaatcgctagacccaaacaaaaagaaacagatgggaaggtccagaaggatgacgaccaactggagaatattcagaagagtcaaaacaagttactgagggaagtagctgtcaagaaaaagactcaagccaagaagaacggttccgattgcggcagcttggggaagaagaataatctgcacaagaagcacgtgccctcaaagaagcgactgctgaaatttgaatcttgtggaaaaatcctcaagcaaaacctggatttgcctgaccacagcaggaactgtgtcaaacgcaagagtgacgccgctaaagagcacaagaaatcctttaaccatagcctctctgacaccaggaaaggcaaaaagcagaccggcaaaaaacacgaaaaactgtccagccactctagcagtgataaatgtaataaaaccggcaaaaaacatgataagctgtgttgccattcaagtagccacatcaagcaggacaaaatccagactggggagaagcacgaaaagtcccccagcctgtcgagctcgaccaagcacgagaaaccacaggcttgtgtgaagccttatgaatgtaatcagtgcggaaaggtgttgtcccacaagcagggcctcattgaccaccagagagtacacaccggagagaagccatatgaatgcaatgagtgtggtattgctttttctcagaagagccatctcgtagtgcatcagagaacacacacaggcgaaaaaccctacgagtgtatccagtgcggaaaagcacacggccataaacatgctctcaccgatcacctaagaatccataccggtgagaaaccttatgagtgcgccgaatgcgggaagacatttagacactctagtaatctgatacagcacgtcagatctcacaccggagaaaagccctatgaatgtaaggaatgcggaaagagctttcgatataactctagcctgactgaacacgtacgcactcataccggggaaatcccctatgagtgtaacgaatgcggcaaagcgttcaaatactcttcctcactaaccaaacacatgcgtattcatacaggagagaaaccattcgagtgtaacgaatgtggtaaggcgttcagcaaaaagtcacacttgataattcatcagagaacgcacaccaaagaaaaaccttacaagtgcaatgagtgcggcaaggcttttggccactcctcgtcacttacctaccatatgcggacacataccggagaaagtccgtttgagtgtaaccagtgcgggaaggggttcaagcagatcgaaggtcttacacaacaccaacgcgtccataccggcgaaaaaccgtacgaatgtaacgagtgcggcaaagccttctctcagaaatctcacctcattgtgcaccaacgcacgcataccggcgaaaagccttacgagtgcaacgagtgtgagaaggccttcaacgccaagtcacaactagtgattcatcagaggagtcacactggggagaagccgtatgagtgcaatgaatgtggcaaaacattcaagcagaatgcctctttgacgaagcatgtgaaaacacatagcgaagacaagtcccacgagtag

SEQ ID NO: 247599 - DNA, 1653 bp, Artificial Sequence
  Description of Artificial Sequence: Synthetic coding sequence
atgccactgcagggctccgtgtcttttaaggatgtgaccgtcgatttcactcaggaggagtggcagcaactggatcccgcacaaaaagcactctacagagacgtgatgctggagaattattgtcattttgtgagtgtggggtttcacatggccaaaccagatatgattcgaaagcttgaacagggtgaagagctatggactcagcggattttcccgtcctatagctatttagaagaagatggaaaaaccgaggatgtccttgttaagtttaaagagtaccaggacaggcattctcgcccattgatctttatcaatcataaaaaactcatcaaggaacggagtaatatctacggtaagacgttcacactgggcaagaaccggatctctaaaacaatcctatgtgaatataaacccgatggaaaggtcctgaaaaatatcagcgaactcgtcatcagaaacatttctccaattaaggaaaagttcggcgattctacaggatgggagaaatccctgttaaatacaaagcatgagaagattcaccctgccgttaacctccataagcagacggagagggtgttgagcggcaaacaggaactcatacaacatcagaaggtacaggctcctgaacagccttttgatcacaacgagtgcgaaaaaagcttccttatgaaggggatgctgtttacacacacacgcgcacacaggggggaacgcacttttgaatataataaagacgggatcgcctttatagagaagtccagcttgtcagtccacccctccaacctgatggagaaaaagccaagcgcttacaataaatacggtaagttcctgtgtcgaaagcccgtgtttattatgccccagaggccacaaacagaggagaaaccatttcattgcccatattgcggcaataactttaggcgaaagagttacctaattgaacaccaacggatccatactggcgagaaaccctacgtgtgcaaccagtgtggaaaagcattccgacagaagacagcgctcaccttgcatgagaaaactcacatcgaagggaaaccattcatttgtatcgattgcgggaagtctttccggcagaaggctacactcacaagacaccacaagacacatacaggtgaaaaggcttacgagtgtcctcagtgtggctccgctttcagaaagaaatcttacttaatagatcaccaacggacccacacaggggagaaaccctatcagtgtaacgaatgtggcaaggcctttatccagaaaaccaccctcactgttcaccaacgaacacacacaggtgagaaaccttatatctgcaatgagtgcggaaagtcattctgccagaaaacaacactcaccctgcaccagaggattcacacgggtgagaagccgtacatctgtaatgagtgtggtaagtcctttagacaaaaagccatcttgactgtgcaccaccgcatccacacaggagaaaagtcaaacgggtgtccccagtgtgggaaggccttctctaggaaaagcaaccttatccggcaccagaaaacccacactggcgagaaaccttacgagtgtaagcaatgcggcaagttctttagctgtaagtctaatttgatcgtccatcagaagacccataaggtggagacgaccggaattcagtag

SEQ ID NO: 247600 - DNA, 1650 bp, Artificial Sequence
  Description of Artificial Sequence: Synthetic coding sequence
atgtctcaaggatccgttagcttcaaggacgttaccgtggatttcacccaggaggagtggcagcagctcgatcccgcacagaaggcactatatagagatgtcatgctggaaaactactgccactttgtttcagttggtttccacatggccaagccggacatgattcgcaagttggaacagggcgaagagctatggacacagaggatattcccttcctattcgtacttggaagaagatggcaagacagaggacgtgctggtcaaatttaaagagtatcaagacaggcactctcggccacttatttttattaaccataaaaaacttataaaagaacgcagcaacatttacggaaagaccttcactctcgggaagaaccgcatctccaagacaatcttatgtgagtataaaccagacggcaaagtgctgaagaatatatctgaattggtgattcgcaacataagccccattaaagagaagttcggggactcaaccggatgggaaaaatctttgctgaacaccaagcatgaaaagatccacccagctgtgaatcttcacaagcaaaccgagcgcgtgctttccggaaaacaggaattaatccagcaccagaaagttcaggcaccagagcagccatttgaccacaacgagtgtgagaagtctttcttgatgaagggcatgctcttcacacacacacgtgcgcaccgaggcgaaaggaccttcgagtacaataaggatggcatcgctttcatcgagaaaagctcactgtctgtgcatccttctaacctgatggagaagaagcccagcgcttataataaatatggcaaatttctatgccggaagccagtttttataatgccacagcggccacaaaccgaggagaagccgtttcattgcccctattgtggtaacaatttcagacggaagtcctacttgatcgaacaccagcggatacacaccggcgagaagccttatgtctgcaatcagtgtggcaaggcctttaggcagaagactgctcttactttgcatgaaaagacacacattgagggaaagcccttcatttgcatcgactgcggcaaatcatttcgacagaaagcaacactgactcggcaccacaaaacccacacaggagagaaagcttatgaatgtccccagtgcgggtcagcctttcgcaagaagtcatacctaatagatcatcagaggacgcatacaggcgaaaaaccctatcagtgtaacgagtgcgggaaagcttttatccagaaaactaccctcaccgtccatcaaagaacccacaccggtgaaaaaccctacatctgcaatgaatgtgggaaatccttttgccaaaaaactacgctaacactgcatcagcgtatccacacaggcgaaaagccatacatctgtaatgagtgtggtaaaagtttccggcaaaaggccattttaaccgttcaccatcgcatacatactggagagaaatctaacgggtgtccgcagtgcggtaaagcattcagtcggaagagtaacctcatccgccaccagaaaacgcatactggtgagaagccctatgaatgtaaacagtgcgggaagtttttcagctgtaagagcaacctcatcgtccaccaaaaaacacataaggtcgaaaccacggggatccagtag

SEQ ID NO: 247601 - DNA, 1503 bp, Artificial Sequence
  Description of Artificial Sequence: Synthetic coding sequence
atggaagagagtcactttaacagcaacccctacttttggccttcaatccccactgtgagtggccagatcgagaatacaatgttcattaataaaatgaaggatcagctgctcccagaaaaggggtgtggccttgccccaccacattatccaactctgctgaccgtgcccgctagcgtttccctccctagtggcatatccatggataccgagtcaaagtcagaccaactgacaccacactctcaagcatctgttacacagaatatcaccgtggtgccggtcccttctaccggtctgatgacagccggtccgggtttggtgataacctctccttccgggagtctcgtgacaaccgcttcttctgcgcagacctttcctatctccgcaccaatgatcgtatccgcacttcctcctggcagccaggccttgcaagtggtgcctgatttatccaaaaaggttgcctccacactgaccgaggaaggagggggaggaggcggaggtggtggctcagtggcccctaagccccctagagggagaaaaaaaaagaggatgctggagtcgggcctgccagaaatgaacgacccatacgtcctcagccctgaggatgatgacgatcatcaaaaagatgggaagacctaccggtgccgtatgtgctccctgactttttattccaagtccgaaatgcagattcattctaaatcacacaccgagacaaaacctcacaagtgcccccactgcagtaaaacgttcgctaacagtagttacctagcgcagcacattcgcatacactcgggcgcaaaaccatactcatgtaacttctgcgagaagagcttccgccagctgtcacatctgcagcagcatactcggatccacactggagacagaccctataagtgcgcccacccaggatgtgaaaaagcgtttacacaactgagcaacttgcagagccacaggcgccagcataataaagataagccttttaagtgccataattgtcatagggcatataccgatgccgcaagtctcgaggtgcacctgtcaacacacacagtaaaacacgccaaagtgtatacctgtacgatttgttccagagcctacacctctgagacgtaccttatgaaacatatgcgcaagcataatccacccgaccttcagcagcaggtgcaggcggctgccgcagctgccgcagtcgctcaggcccaggctcaagcccaagctcaggcccaggcccaagcacaggctcaagctcaggcccaggccagtcaggcctcccaacagcagcagcaacaacaacaacagcagcaacagcaacagcagcaaccaccgccacacttccagtcgcctggggctgcccctcagggtggagggggaggtgactctaacccaaatccccctccacagtgttcattcgacttgactccatataaaactgctgagcatcataaagacatttgcttaaccgttaccaccagcaccattcaggtggaacatctcgcaagcagctag

SEQ ID NO: 247602 - DNA, 1734 bp, Artificial Sequence
  Description of Artificial Sequence: Synthetic coding sequence
atggaagaaagtcacttcaactccaacccctacttctggccctccattcccaccgtgtcaggccaaatcgagaataccatgttcattaacaagatgaaagatcagctgttgccagaaaagggctgtggcttggcccctccccactaccccaccctcctgacggtgcctgccagcgtgagcttgccatctgggatcagcatggatacagagtcgaagtctgaccagctgactccacacagccaggcttccgtcacacagaatataactgtcgtacctgtgccctctactggactgatgaccgcaggcgtctcctgttcacagcgctggcgccgagaagggtcccagagcagaggcccaggcctggttattacaagcccgtccggctctctggttaccaccgcaagctcagctcaaactttcccgatctcggcaccaatgattgtcagcgcactcccacccggaagccaggctctgcaggtggtgcctgatctctccaaaaaggtggcctccacccttacagaagagggtggcggtggcggaggtggcggaggcagcgtcgcacccaaacccccacggggacgcaaaaaaaagagaatgctggagagcggcttgcccgagatgaatgacccgtacgtcctgtcaccagaagatgacgacgatcatcagaaggatggtaagacttacaggtgccgcatgtgttcccttacgttttactccaaatccgaaatgcagatccacagcaagtctcacaccgagaccaagccacacaagtgccctcactgtagtaagactttcgccaattccagctacctcgcccagcatattcgtatccacagtggagccaaaccatactcttgcaatttttgtgaaaagtccttccggcaattgtcacatctgcagcagcataccagaatacactctaagatgcacactgagactatcaagccccacaagtgccctcattgtagcaagaccttcgcaaataccagctacctcgcgcaacacctgcggatacacagcggggctaaaccctataactgttcttactgccagaaggcttttcgtcagttaagccacctgcagcagcacacacggatccacactggcgatcggccatataagtgtgcccatcctgggtgcgagaaggcgttcacacagttgtccaatctccaatcgcatagacgacagcacaataaagacaagccattcaagtgtcacaattgccacagggcttataccgatgcagccagcctggaggtccatctaagtacccatactgtgaagcatgccaaagtatatacctgcactatttgctccagagcctacaccagtgagacgtatctgatgaagcacatgagaaaacacaatccacccgacctgcaacagcaggtgcaggccgctgctgccgcagcagccgtggcgcaggcccaagcccaagcacaggcccaggcacaggcccaggctcaggcgcaggcacaggctcaggcatcacaggcttctcagcagcagcagcagcagcagcaacagcaacagcagcaacagcagcagccaccaccacacttccagtctcccggagctgctccacagggcggaggtgggggagattctaatccaaacccaccaccacaatgttcgtttgaccttaccccctacaagacagctgagcaccacaaggacatttgcttgactgttactaccagcacaattcaggttgaacacctcgcctcctcctag

SEQ ID NO: 247603 - DNA, 1551 bp, Artificial Sequence
  Description of Artificial Sequence: Synthetic coding sequence
atggaggagagtcacttcaactctaatccctacttctggccctcgattccaacggtctcaggccagatcgagaacaccatgtttataaacaaaatgaaggatcagttgctgcccgaaaagggctgcggcttggcacctccccattaccctactttgttgaccgtgcctgcctcggtctctctgccatctggcatcagtatggatacagagtctaagagtgaccagctgaccccacacagccaagccagcgtgacgcaaaacatcactgtagtgccggtcccgtccacaggcctgatgactgctggcgtgtcatgttcccaacgttggaggagggagggaagccagtctcgtgggccagggctggttattacctccccgtccggatcactcgtgaccactgccagtagcgctcagacatttccgatatctgcgccaatgatagtgagtgctctaccacccggtagccaggctttgcaggtcgtgcctgatctcagcaaaaaggtcgcaagcacattgaccgaagaaggcggaggtggcggagggggaggaggctccgtggcgcctaagccgcctcggggtagaaagaaaaaaagaatgctagagtctggtctcccagaaatgaacgacccttatgtactgtcacctgaagacgacgacgatcaccagaaagacgggaagacctacaggtgcaggatgtgtagcttgaccttctattcaaagtcagagatgcagatccatagcaaatctcacaccgaaacgaaacctcacaagtgccctcattgcagcaaaacctttgcaaatagctcttacctggcacaacatatcaggatccacagcggtgccaagccatactcttgtaatttctgtgaaaaaagtttcaggcagctctcccacctgcagcagcatactcgtatccacacaggagatagaccctacaagtgcgcgcacccagggtgcgagaaggctttcacccagttgtcaaacttacaatctcataggcgacagcacaacaaggataagccttttaaatgtcataattgccacagggcttacactgacgctgcgagcctggaggtacacttaagcacacatacagtaaaacacgccaaagtttacacctgtacaatctgttcgcgggcttacacatccgaaacttacctgatgaaacacatgcgcaagcacaatccccctgacctgcagcagcaagtgcaagccgcagcagctgcagcggcagttgcgcaggcacaagcgcaggctcaggctcaggctcaggctcaggcacaagcacaggcgcaggcgcaggcctctcaggcatctcagcagcagcaacagcagcagcaacagcaacagcaacaacagcaacagccgcctccacacttccaaagtccaggcgcagcaccgcagggcggtggtggaggcgactctaacccaaacccaccgcctcagtgttcttttgatctgaccccttacaaaactgccgaacaccataaggacatatgcctcaccgttacaacaagcacaatccaggtagaacatctggccagttcttag

SEQ ID NO: 247604 - DNA, 1551 bp, Artificial Sequence
  Description of Artificial Sequence: Synthetic coding sequence
atggaggagtcccactttaattccaatccctacttctggcccagcattccaaccgtgtccgggcagattgaaaacactatgtttattaacaagatgaaagatcaactgctccctgaaaaggggtgcggcctggcgccaccccattaccccactctgctcaccgttcccgcttccgtgagccttcccagcggtatttccatggatacagagtccaagtcggaccagcttaccccccactcacaagcatccgtgacccagaacatcacagtggtgccagttcccagcactggcctcatgactgctggagtctcatgcagtcagcgatggcgaagagagggaagccagagccgcggtccaggactggtcattacctctcccagtgggtctctggtgacaactgccagcagcgcacagacttttccaatttccgcgcctatgatcgtctctgcattgccacctggctcccaggctttgcaggtggttcccgacctctccaagaaggtcgctagcactttgactgaagagggaggaggtgggggaggaggaggcggttcagtggcaccaaagcctccgcgaggcaggaaaaagaaacggatgctggaaagcggattaccggaaatgaatgatccctatgtattaagcccagaggacgacgacgaccatcagaaggatgggaagacgtatcgctgtcgaatgtgctctctcaccttctactccaaatcagagatgcagatacactctaagtctcacacagagaccaagccacacaaatgtcctcattgttctaaaacctttgccaattcgagctaccttgcccagcacatcagaattcactccggcgctaagccttactcgtgcaacttctgtgaaaagtcattccgccagctgagccacttgcaacagcacactcgcattcacacaggcgacaggccttataaatgtgcacaccctgggtgcgagaaagccttcactcaattgtccaacctgcagtctcataggagacagcacaacaaggacaaaccttttaagtgtcacaactgtcacagggcatatacagatgccgcttccctcgaggtgcaccttagcacccataccgtcaagcatgcgaaagtctatacgtgcaccatctgcagtcgcgcatacaccagcgagacctacctcatgaaacatatgaggaaacacaacccaccagacttgcaacagcaggttcaggctgccgcagcggcagcagccgtcgcacaagcacaggcccaggcccaggcacaggcccaagcccaagcccaagcccaggcgcaggcccaggcctctcaggcaagccaacagcagcagcaacagcagcagcagcagcaacaacagcagcaacagccacctcctcatttccagtcacctggggctgcaccacaagggggaggcggaggggacagcaatcccaacccacccccacaatgctcattcgaccttacaccctataaaactgcagagcaccacaaagacatatgcctgacagtaacaacgagcaccattcaagttgaacatttggcctccagttag

SEQ ID NO: 247605 - DNA, 1734 bp, Artificial Sequence
  Description of Artificial Sequence: Synthetic coding sequence
atggaggagtcacacttcaacagtaatccatacttctggccgagcatccctaccgtgagcgggcagatcgagaacacaatgttcatcaataagatgaaggatcagcttttgccggaaaagggctgcggcttggcacctccccactaccccacactgctgacggtgcccgcttcagtatctctgccttcagggatctctatggatacagaatctaagagtgatcagctgacccctcatagccaggcctccgtcactcagaacataacagtagtgccagtgccttccacgggactgatgactgccggtgtctcttgcagccaacggtggagacgcgagggtagccagagccgcggacctgggctggtgataaccagcccttctgggtccttggtgactacggcgtcctccgcgcagactttcccaatcagcgccccaatgatcgtatccgccctgcctcccggttcccaggcattacaggtcgtgcccgatctgagcaagaaggtagcaagtaccctaaccgaagagggcggtggagggggaggagggggaggtagcgtggctcccaaaccacccaggggcaggaagaagaagaggatgctcgaatctggtcttcccgaaatgaatgacccctacgtgttgagtcccgaggatgatgacgaccatcaaaaagatggaaagacatatagatgtcgtatgtgctcgttgacattctactcaaagagcgagatgcaaattcattccaaaagtcacactgagactaaaccccataagtgtcctcattgtagtaaaacctttgctaattccagttacctcgcccaacacatacggattcactctggggctaagccctacagctgcaacttctgtgaaaagtcattcagacagctttcccatcttcagcagcatacaaggatccactctaaaatgcacacagagactatcaagccacataaatgccctcactgtagcaaaaccttcgccaatacaagttatttggctcaacaccttcgtattcattccggggcaaaaccttataattgttcttactgccagaaggcctttagacagctgagccacctgcagcagcacaccaggatccacaccggggatcgaccttacaaatgcgctcatcccggatgtgagaaagctttcacacagctatcaaatctacaatcacacagaagacagcacaataaagataagccttttaagtgtcacaattgccaccgtgcctacacagatgccgcatcactggaggtgcatctgtctacccacaccgtgaagcatgccaaagtctacacatgcacaatttgcagccgagcctacactagcgagacatacctaatgaaacacatgcggaagcataaccccccagatctccagcaacaggtgcaggcagctgcggctgcggctgccgtcgcccaagcccaggctcaggctcaggcacaagctcaggcccaagcgcaggcccaggcccaagctcaggccagccaggcctcccagcagcaacagcagcagcagcagcagcagcagcagcagcagcagcagcctcctcctcactttcagtcacccggagctgcgcctcagggcggaggcggaggagattccaatcccaacccgccaccacagtgctcctttgacttaaccccctacaaaaccgccgaacatcataaggatatctgcctgaccgtgacaacgagtaccattcaagttgaacacctcgcatcctcatag

SEQ ID NO: 247606 - DNA, 1008 bp, Artificial Sequence
  Description of Artificial Sequence: Synthetic coding sequence
atggaagagagtcacttcaacagtaacccttacttttggcctagcatcccgaccgtctccggacaaattgagaacaccatgtttattaacaagatgaaggaccagttactgcccgaaaagggttgtggtcttgccccaccccactatccaactcttcttaccgtccctgcaagtgtgtcactgccttcaggaatctctatggacactgagagtaaaagtgatcagctgactccccactctcaggccagcgtcacccagaacattacagttgtgcctgtacctagcaccgggctgatgaccgcaggggtgagttgctctcaacgctggagaagggaagggtctcagtctcgaggacccggacttgtgattacatccccatctggatctctggtgaccacagccagtagcgcccagacctttccaatttcagcacctatgatcgtgtcagcccttccccctggcagccaggcattacaggtggtgccggatctgtccaaaaaagtggcatcgaccttgaccgaagaaggaggtggagggggtgggggtgggggaagcgtggctcccaagcctccacggggtaggaagaaaaaacggatgctggaaagcggcctccccgaaatgaacgacccctacgtcctgtctcctgaagacgatgacgaccaccagaaagacgggaagacctatcggtctgagggtaactgcggtacaggcaacggtcagtctctgggtctcatggactcagtcccagggtccacaacgaatcttctgtgtgaccccggatgccgaatgtgctctctgaccttttacagcaaatccgaaatgcaaattcactccaagtcacatacagaaaccaagcctcacaaatgtccacactgctctaaaacctttgccaactcctcatacttagcgcagcatattcgcatccacagtggggcaaagccatattcatgtaacttctgtgagaaatcattccgccagctttctcatttacaacagcataccagatag

SEQ ID NO: 247607 - DNA, 834 bp, Artificial Sequence
  Description of Artificial Sequence: Synthetic coding sequence
atggaagaatctcattttaatagtaatccatacttctggcccagtatccccacagtgtcaggccagatagaaaataccatgttcataaacaaaatgaaagaccagttactgcccgagaagggctgtggattggcaccccctcattaccctactctgcttaccgtccctgcatcagtgagcttaccaagtggcatatcaatggataccgagtccaagtctgatcagctgacccctcattcacaggccagtgtcacccaaaatatcaccgttgttccagtgccttccacaggtttgatgactgccggacctggattagttataacgagcccgtccggctctctggtgacgactgctagtagcgctcagaccttccccatctccgctccaatgatagttagcgcactgcccccaggaagccaggcgttgcaagtcgtgccagatctgtctaaaaaggtcgcgtctacactgacagaggaggggggaggcggagggggaggcggaggcagtgtagcccctaagcccccacgcggaagaaagaagaaaagaatgctcgaatctgggttgcccgagatgaacgatccgtatgtgctttcacccgaggatgacgacgaccatcagaaagacggcaagacataccggtgccgaatgtgctctctgactttctattcaaagtctgagatgcagatccacagtaaatctcacacagagactaaaccgcataagtgtcctcattgcagcaaaacatttgcaaattcctcatatctggcacaacatataagaattcactcaggcgctaagccatactcgtgcaatttttgtgaaaaatccttttag

SEQ ID NO: 247608 - DNA, 1386 bp, Artificial Sequence
  Description of Artificial Sequence: Synthetic coding sequence
atggaggagagccatttcaactccaatccttatttctggccaagtattcccacagtgtccggccagattgagaataccatgtttatcaacaagatgaaggaccagctgctgccagagaagggatgcgggctggctccgcctcactaccccaccctgctcacagtgcccgcaagcgtgagtcttcctagcggcatctccatggacacggaatcaaaatccgaccagttgacacctcactcgcaggctagtgtcacgcagaatataaccgtcgtacccgtgccctccactggccttatgacagctgctctgcaagtggttcctgacctgtcaaaaaaagtggcctcaacactgacggaggagggtgggggtggaggcggtgggggaggcagcgtggcacctaagccaccaaggggacggaagaagaaacgcatgttggaaagtggcttacctgaaatgaacgatccatatgtgcttagccctgaggatgacgacgaccaccagaaagacggcaaaacttacagatgcaggatgtgctccctcaccttctacagcaaatccgagatgcagatccactcgaagagtcatacagaaaccaaaccacataaatgcccccattgtagcaaaacattcgcaaattcatcttacctcgctcagcacattcggatccattctggggctaagccgtacagttgtaatttctgcgagaagagcttccgtcagctgtcacatctacagcagcacacccggatccacacaggggaccggccatataaatgtgcacaccccggatgtgagaaggcgttcactcaactcagcaatcttcagagccaccgcaggcagcacaataaagacaaaccgtttaaatgccacaattgtcacagggcttatactgatgctgcttcactcgaagtgcatctctccacgcacactgtaaagcatgcaaaggtctacacctgtacaatctgctcacgagcctacacttccgaaacatacctcatgaaacatatgagaaagcacaacccccctgatctgcagcagcaggtgcaagccgcagccgctgccgctgccgtcgcacaggcccaggctcaggcccaggcacaagcacaggcacaggctcaagctcaagcacaggcccaggcctcacaggccagtcagcagcagcaacaacagcaacaacaacaacagcaacagcaacagcagccccctccccatttccaaagccctggtgccgcaccacaaggcggtggaggtggtgactccaatccaaatccaccgcctcagtgctcatttgatctcacaccttacaagaccgcggagcatcacaaggatatatgtttgaccgtaaccacctcaaccattcaagtggagcaccttgcctcatcttag

SEQ ID NO: 247609 - DNA, 1161 bp, Artificial Sequence
  Description of Artificial Sequence: Synthetic coding sequence
atgattctgggatcgctgtcacgcgctggtcctttgcccctgctccggcagcccccaatcatgcaaccacctctggatctcaagcagattctgcctttccccttggaaccagctcccactttggggcttttttctaactacagtaccatggaccccgtccagaaggctgtcctgtcgcacacgttcggcggacccctcttaaaaaccaagaggcctgtaataagttgtaatatctgtcagatcaggttcaacagccagagccaggcagaagcccactataaaggtaatagacacgccaggagagtaaaggggattgaagctgcaaaaacaagagggagagaacctggggtgcgggagcccggagaccccgctccccctggttcaacgcccaccaatggggacggcgtggccccacggccagtgtccatggagaacgggctgggacctgcgcctggatcccctgagaaacagccaggatcgccaagcccgccatctatcccagaaaccggccagggcgtaactaagggagaaggcggaacacctgcccctgccagcctgcccggaggctctaaagaggaggaagagaaagccaagcgtcttctttattgcgccctttgcaaggtcgccgtaaactccctttctcagctagaggctcacaataaagggaccaaacacaaaacgattctggaagccagatcaggcctcgggcctataaaggcttatccccgtctgggccctccgacccctggcgaacccgaggctccggcacaggatcgaacatttcactgtgagatctgtaatgtgaaagttaattccgaggtacagcttaaacaacacatttctagccgcaggcaccgcgacggtgtggcaggaaaaccaaaccccctgctgtctagacacaagaaatcccgtggggcaggagaactggcgggtacacttacgttcagcaaggagctcccaaagtctcttgcaggcggactgctccctagccctctagccgtcgccgctgtgatggctgcagctgctggcagccccttgtccctgcgtccggcaccagctgccccattgcttcagggacctccaataacacaccccttattacaccccgcaccgggacctataaggactgctcatggaccgattctgttttcgccttactag

SEQ ID NO: 247610 - DNA, 918 bp, Artificial Sequence
  Description of Artificial Sequence: Synthetic coding sequence
atgatacttggcagtctgtctcgcgctggtccgctgcctctgctgcgccagccgccaattatgcagccaccactggatcttaagcagatactaccatttcccctggagcctgcccctactttgggattattctcaaactatagtaccatggaccctgttcagaaagctgtgctgtcacacacgttcgggggacccctcctaaaaaccaagcgccctgtgatttcttgtaatatctgtcaaataagattcaatagccagtcccaagccgaagcccactacaaaggcaacagacacgccagacgggtgaaaggtatcgaggccgcaaaaacccgcggacgcgagcccggagtgcgcgaacctggagaccccgcacctcccggaagtacgcctaccaacggagacggagttgccccaagacccggtacaaaacacaagactattcttgaggctcggtcgggcctgggtccaatcaaggcctatcctcgtttgggaccgcctaccccaggcgagcccgaggccccagctcaggaccgtaccttccactgtgagatctgcaatgtgaaggttaactctgaggtgcaattgaagcagcatattagctctagacgacaccgcgacggtgttgcagggaagcccaaccccctactaagcagacacaagaagtcccgtggcgctggggaactcgccggaactctgactttctctaaggaattgcccaaatcccttgccggtggcctgctgccaagccccctggcggtggctgctgtgatggcagcagctgcgggaagtcctctgtcactgcgcccagcccctgccgcacccttgctgcaggggccaccaattacacaccctctgctgcaccccgctcccggacccatcagaaccgcccatggccctattctgttctccccctactag

SEQ ID NO: 247611 - DNA, 1101 bp, Artificial Sequence
  Description of Artificial Sequence: Synthetic coding sequence
atgcagcctcctttggacctgaagcagatcctgccctttcccctggagcccgctcccaccttgggtctgttttccaattactccacaatggacccagtccaaaaggctgtcctgtcacacacattcggaggaccgctgctgaagaccaaacggcctgtaatcagttgcaacatctgccagattcggttcaatagccagtctcaggctgaggctcactacaagggcaaccggcacgccaggcgggtgaaggggatcgaagcagcaaagacgcgtggcagggagccgggtgtgcgagaacccggagatcccgcaccgccaggatccaccccaactaatggggatggcgtggctccaagaccagtgagcatggagaatgggctaggcccagcacctggcagccctgaaaagcaacctggatccccctctcctccgtcaatccctgaaactggtcagggcgtgaccaaaggcgaagggggaactccggcaccagccagtctgcccggaggaagcaaggaagaagaagagaaggccaagagactgctgtattgtgcactctgtaaggtagccgttaattcactctcccaacttgaggctcacaataaagggactaaacacaagacgatcctagaggcacgctctgggttaggacctatcaaggcctatcccaggctgggccctcccactccaggagagcccgaagcccctgcccaggatcgtactttccactgtgagatttgtaacgttaaagtgaatagcgaagttcaactgaagcagcacatcagcagccgtcgccatagagacggagtggccggaaagccaaatccactgctcagcagacacaagaagagcagaggtgcaggtgaacttgccggaacactgactttcagcaaggaactccccaagtcacttgctggtggattgctcccttcccccctggccgtggcggcagtaatggccgcagccgctggctctcccctgtccctacgacctgccccagctgcaccactgcttcagggaccgccaatcacacatcctctgctgcaccctgcaccgggtccaatcagaactgcccacgggcctatcctattctcgccttattag

SEQ ID NO: 247612 - DNA, 699 bp, Artificial Sequence
  Description of Artificial Sequence: Synthetic coding sequence
atgcaacctcctttagacctgaaacaaatcctccccttcccgctggaacctgcgccaactcttggcctgttttcgaactatagcacaatggaccctgtgcagaaagccgtcttgtcgcacaccttcgggggtccactactgaaaacgaagcggcctgtgatatcatgcaacatatgtcagatcagattcaattcgcaatcgcaggcggaagcacactataaaggcaacagacatgctcgccgagtgaagggaatcgaggcagcgaagactagaggacgggagcctggcgtgagggagcccggtgatcctgcgccacccggatccactcctactaatggggacggagttgctccacgacccgtcagcatggagaacggattaggcccagcacctggctcccctgagaaacagcctgggagtcccagccctccctccattccggagacaggtcagggcgtgactaagggggaagggggaacacctgcccctgctagtctgcctgggggttccaaagaagaggaggagaaagcaaagcgcctgctgtactgcgcactgtgtaaggttgccgttaactctctgagccagttagaggcccataataaagggacaaagcacaagacgatcctcgaggcacgctctggcctaggtcctattaaggcatacccgagactgggaccccctacgccgggagagccgtag

SEQ ID NO: 247613 - DNA, 1101 bp, Artificial Sequence
  Description of Artificial Sequence: Synthetic coding sequence
atgcagcctccactggacctgaagcagattcttcctttcccactggaaccagctcccacccttggtctgtttagcaattactctaccatggacccagtgcagaaagccgtgctgagccacacattcggaggaccactgctgaagacaaaaaggcctgtgattagctgcaacatctgccaaattcggttcaactctcaaagtcaagccgaggcccactataagggcaacagacacgccagaagggtcaagggcatcgaagcggcaaagacacgtgggcgtgagccgggtgtgagagagcctggcgaccccgctcctcccggatcaacccctactaatggcgacggtgtcgcccctaggccagtcagcatggaaaacggactggggccagcccctgggtcgccagagaagcagcctggctcacctagcccacctagtatcccagagaccggtcaaggagtgactaagggggaagggggtaccccagccccagcaagcctgccagggggatcgaaggaggaggaagagaaggcaaaaaggctgctgtactgcgcactgtgtaaggttgccgtgaatagcttgtcccaactggaggcgcataataaggggacaaagcacaaaaccatcctagaggccagaagcgggcttgggccaatcaaagcctaccctcgcctggggcctccaacaccaggagaaccagaggcacctgcccaggaccggacttttcactgtgaaatctgcaatgttaaggtgaactcagaagtccaacttaaacaacatatctccagcagacggcaccgtgacggggttgcaggcaagccaaaccccttgcttagcaggcacaagaagagtcgcggagctggggaactagccggtactcttactttcagcaaagagctgccaaagagtctggctgggggtcttctgcccagcccactagcagtcgctgcagttatggcagctgccgcaggatcaccattgtctctgcgccctgcccctgccgctccactgctccaaggacctcccatcacccatcccctcctgcatccagcgccaggcccaattaggactgcccacggccctatcctgttctccccctactag

SEQ ID NO: 247614 - DNA, 498 bp, Artificial Sequence
  Description of Artificial Sequence: Synthetic coding sequence
atgcagcctccgctcgatctgaaacaaatcctgcctttccctcttgagcccgctcctactctcggcctcttctccaattattcaacaatggatcctgtgcaaaaggcagtcttgtcacacactttcggcggtcctctgctgaagaccaagaggcctgtgatcagctgtaatatttgccagattaggttcaactcccaatcgcaggccgaagcccattacaagggcaatcgccacgccaggcgagttaaaggtatagaggctgccaaaacacggggaagagagcccggtgtccgcgagccgggtgatcccgcacctcccggaagtacccccaccaatggcgatggagtggctcccaggcctgtcagtatggagaatggccttgggcctgcccctggcagtccagaaaaacagcctggatctccctctcctccctccatccccgagactggccagggggtgacaaagggcgagggcggtaccccggctcctgccagctag

SEQ ID NO: 247615 - DNA, 438 bp, Artificial Sequence
  Description of Artificial Sequence: Synthetic coding sequence
atgcagcctccgttggacctgaagcaaatcctgccttttcctctggagcccgcaccaacactaggtctgttcagcaactactctaccatggacccagtgcagaaggccgttctgtcccatactttcggcggacccttgttgaaaacaaaacgtcccgttattagttgcaacatttgccaaatacggttcaacagccaatcacaagctgaagctcattacaaaggaaaccgacacgctagaagagtgaagggcatagaggctgcaaagaccagggggcgtgagcccggagttcgagaaccaggcgatccggctcctcctggcagcactccgactaatggcgacggtgtcgctccaagacctgtaagcatggaaaatggattgggacccgcacccggaagtccagagaaacagcccggtagcccatctccaccttcctag

SEQ ID NO: 247616 - DNA, 1101 bp, Artificial Sequence
  Description of Artificial Sequence: Synthetic coding sequence
atgcaacccccactcgatctcaagcagattctgccattcccactggagccagcacccacattagggctcttttctaactactccactatggatccagtgcagaaagcggttttgagtcataccttcggcggtccactgcttaagacaaagagacccgtgatctcatgcaatatctgtcagattcgatttaacagccagtcacaagccgaggctcattataaggggaaccgccatgctcgcagggtcaaggggattgaggccgctaagacgagggggagggaacccggagtgagagaaccgggagaccctgcccctcccggtagcacacctacaaacggggatggggtagccccacggcctgtgagtatggaaaatggcctgggcccagcccctggatcgcctgagaaacagcccggaagccctagcccgccatccatccccgaaaccggacagggcgtcacgaagggcgaaggcggaacccccgctcctgctagtctgccaggcggttcaaaggaggaggaggaaaaggcaaagcgactactttactgcgcactgtgcaaagttgcagttaactctctcagccagctggaggcccacaacaaaggaaccaagcataagaccatattagaggccaggtctggtctggggccaattaaagcttaccctcgtcttggccctcctactcccggtgagccagaggcgcctgcccaggaccgcaccttccattgtgagatctgcaacgttaaagttaatagcgaggtgcagctgaagcagcatatctctagccggaggcatcgtgacggggtcgccggaaaacctaacccgcttctgtcgagacataaaaaatctcggggtgccggagaactcgccggtaccttgaccttttcaaaggaactcccaaagagtctggctgggggattactgcccagccccttggctgtcgcagccgttatggctgcagcagctggaagtcccctgtctttgcggcctgcaccagcagcaccactgctgcaggggccaccaattacccaccctctcttgcatccagcccctgggccaatcagaaccgctcacggaccaatccttttcagcccttactag

SEQ ID NO: 247617 - DNA, 858 bp, Artificial Sequence
  Description of Artificial Sequence: Synthetic coding sequence
atgcagccaccgctagaccttaagcagatactgccttttccacttgagcctgcgcctacactgggattgtttagtaactactcgaccatggaccctgtgcagaaagctgtcctgagccatactttcggaggtcctctactcaagacaaagcgacccgtgataagttgcaatatttgtcaaattaggtttaatagccagagccaggccgaagcccactacaaagggaatcgccacgcacggagagtgaagggcattgaagctgccaaaaccagaggcagagaaccgggagtcagggagccaggcgacccagccccaccagggagtacccccacgaatggagatggtgtggccccaagacccggaaccaaacataaaaccatcctggaagcgagatctggcctgggcccaatcaaagcgtacccccgtctggggccaccaacaccaggggaacctgaagctccagctcaggaccgaacatttcactgcgagatctgcaacgtgaaagtgaacagtgaagttcagttgaagcagcacatatctagcaggcgtcatcgggacggtgtcgccggaaaaccaaatccattgcttagtcgccataagaaaagtagaggcgctggcgaactcgcgggtacacttacgttcagtaaagaactgcccaagtccctggctggcggactcctgccttctccgctggctgttgccgcagtgatggcggcagctgcgggatctccactctcactgcgcccagcccctgctgcaccactcttgcaaggtccgcctattacccatcctctgctccaccctgccccagggcctatccggactgcacacgggccaatcctcttcagcccttactag

SEQ ID NO: 247618 - DNA, 1110 bp, Artificial Sequence
  Description of Artificial Sequence: Synthetic coding sequence
atgatgcagcccagcctggatataaaaccatttatgtctttcccagtggacagctcctccgccgtggggctgttccctaacttcaatactatggaccccgtgcaaaaagctgttatcaaccatacttttggggtgagtattccacctaaaaaaaagcaggtcatctcatgcaacgtatgtcaacttcggttcaacagtgatagccaagcagaggcccattacaaaggttccaaacacgccaaaaaggttaaggccctggacgctactaagaataagcctaagatggtgcctagcaaagattcggctaaggccaatcccagttgcagtataactcccatcactggcaataacagcgacaagtccgaggacaagggaaagttgaaagctagttcatcaagtcagccttccagtagcgaatctggttcattcctgctgaagagtggtactacaccgctccccccaggagcggctacaagccctagcaagtcaacgaatggagcgccaggtaccgtggtggagtcggaggaagagaaggctaaaaaactgctgtactgtagcctatgtaaagtggccgtcaatagtctatctcaactagaggctcacaatactggctcaaaacacaaaacaatggtggaggccaggaatggcgcaggccctataaagtcctaccccagacccggaagtagactcaaaatgcaaaatggaagtaagggctctgggctccagaacaagactttccactgtgagatctgcgacgtgcatgtaaactctgagattcaactgaagcagcatattagcagccgcagacataaagacagggtagccggaaaacctctgaaaccaaaatacagtccgtataataagctgcagagatccccgtctattcttgccgcaaagctggcattccagaaagacatgatgaagcccctcgcacccgcatttctgtcgtcacctttggccgctgcagctgctgtgtccagtgccttatccctgcctccacgcccatcggcctcattattccaggctccggcaatccccccagcgcttcttagacctgggcatggtccaatcagggccactcctgccagcatattattcgccccatactag

SEQ ID NO: 247619 - DNA, 1188 bp, Artificial Sequence
  Description of Artificial Sequence: Synthetic coding sequence
atgtggagcggacttccctctcggggttctacttgccacactacaacgcttcccgctttagtacgtaccccaacacttatgatgcagccctcgctggacatcaagccattcatgtcctttcctgttgacagctcttctgccgtcggtttgttccctaatttcaacacaatggacccggtgcagaaagccgtaataaaccacacgttcggggtatcaattccacctaagaagaagcaggtgattagctgtaatgtctgccagctccgcttcaattctgattctcaagctgaagctcattataaaggttcgaagcacgcaaaaaaagttaaggctttggacgcgacaaagaacaagcccaagatggtcccaagtaaggactccgctaaggccaacccatcttgttcaattactccaattaccggcaataattctgataaatccgaggacaagggcaagctcaaggcatcatcaagttctcaaccctcttcaagcgagagcggtagtttcctcctcaagagcggcacaacccccctaccacctggagccgcaacctccccatcaaagtccactaatggcgctcccggaaccgtagtcgagagcgaggaggagaaggcaaaaaagctcttatattgctcactctgcaaagtcgcagtcaattcgctctcccagttggaggcccacaacactggcagcaagcacaagacaatggtggaagccagaaatggtgccggaccgataaagtcttaccctcgccctgggtctagattgaagatgcagaacggatccaaaggctctgggcttcagaacaagacctttcactgcgagatctgcgacgtgcacgttaactctgagattcagctgaaacagcacatttccagccggcgtcacaaggaccgcgttgcaggtaagcccctcaagccaaagtactccccctataataaactgcaaaggagcccctcaatccttgctgccaaactcgccttccagaaggacatgatgaaaccactggcccctgcctttctttccagtccgttagcagcagctgccgcagtgagttctgctctgagtctgccccctagaccttcagcctcgctgtttcaggctccagctattccacctgcactcttgagaccaggacacggccctatcagagcaacccctgcatcaatcctattcgcaccttattag

SEQ ID NO: 247620 - DNA, 1110 bp, Artificial Sequence
  Description of Artificial Sequence: Synthetic coding sequence
atgatgcagccttcactggatatcaagccgtttatgtcgtttcccgtagactcctccagtgccgtcggcctatttccgaattttaacaccatggatccagtgcagaaggccgtgattaaccatacttttggtgtttctataccaccgaaaaagaagcaggtcatcagttgtaatgtgtgccagttgcgttttaattctgacagtcaagccgaggcccattataaaggcagcaaacacgccaagaaggtcaaggctcttgacgctaccaagaataagcccaaaatggttccttcaaaggactccgcaaaggccaaccctagctgtagtatcaccccgatcacgggcaacaacagtgacaagagcgaggacaaggggaagctcaaagccagcagttccagtcaaccatcttctagtgagagtggtagcttcctgttgaagtccgggaccaccccccttccgcctggggctgctacctccccttctaaatcaaccaatggggctcccggaactgtcgtggaatccgaggaagagaaggcaaaaaagctgctttactgttctctttgtaaggtggctgtgaattctctgtcacaattagaagcacacaatactggttcaaaacataagacaatggttgaagcacggaatggcgctggcccaatcaagtcttatccacggccaggcagcaggctcaagatgcagaacggcagtaaggggagcggactgcaaaacaaaacattccattgcgaaatctgtgatgtgcacgtcaattctgagattcagttgaaacagcacattagctctaggcgacacaaggatagagtggccggtaagcccttgaaacctaaatacagcccgtataacaaactccaaaggagccccagtattctggccgcaaaactggcatttcagaaggatatgatgaaaccactcgctccagcgttcctctctagcccacttgctgccgcagcagccgtgagcagcgccctgagcttgcctcctagaccatctgccagcctcttccaggccccagcaatcccacctgcgctgcttcggccaggacacggtcctataagagcgaccccagcttcgatcctctttgcaccgtactag

SEQ ID NO: 247621 - DNA, 1416 bp, Artificial Sequence
  Description of Artificial Sequence: Synthetic coding sequence
atgaacatggccaacttcctgcgtgggtttgaagaaaaaggaataaaaaacgatagaccggaggatcagctctctaaggagaaaaaaaagattctcttctcgttttgtgaagtgtgtaacattcaacttaacagcgcagcccaggcccaagtgcattccaatggcaaaagccatcggaagagagtgaagcagcttagcgacggacaacctccccctcccgctcaggcgtctccctccagcaacagtagcacaggttcaacctgccacaccacaacacttcccgcattggtgcgcactccaactctaatgatgcaaccttccttggatataaagccgttcatgtcctttcccgtggatagtagcagtgcggtagggctgtttcccaatttcaatactatggatccagtgcagaaagctgttatcaatcataccttcggtgtgtccattcctcccaagaaaaagcaggtaatcagctgcaatgtatgccagttaaggtttaacagtgattcccaggcagaggcccactataaaggaagtaagcatgccaagaaggtgaaggctcttgacgccaccaaaaataagcctaaaatggtgccatctaaagactccgccaaggccaaccctagttgcagcatcactccaattacagggaataactccgataaatccgaagacaaggggaaactcaaggcctccagttcctctcaacccagctcctccgaatccggatcatttctactcaaaagtggtactactcctttacctccgggtgctgctacctctccatctaagtccaccaacggagcccctggcacagtcgtcgaaagcgaggaggagaaagcaaagaaattgctatactgcagtctctgcaaagttgctgttaacagcctctcacagctggaagcgcacaatacaggctccaagcacaagaccatggtagaagctcgaaacggggctgggccaataaagagctaccctcgccctggcagtagacttaagatgcagaatgggagtaagggatccggcttacagaacaaaacgtttcactgtgagatttgcgatgtacacgtcaacagtgaaattcagctcaagcagcatataagttctcgtcgtcacaaggacagggtcgccggaaaacccctgaagcctaagtattcaccatacaacaaactccagcgctcaccctctattttggccgcaaagctggccttccaaaaggatatgatgaagccgctcgcccctgctttcctgagcagcccgttggccgctgcagctgccgtgtcttcagcgctgtctctgccacctcgaccatcagctagtcttttccaggcccctgctataccacctgccctgcttcggccagggcacgggcctataagagctactccggctagtattctcttcgcgccatattag

SEQ ID NO: 247622 - DNA, 96 bp, Artificial Sequence
  Description of Artificial Sequence: Synthetic coding sequence
atgaatatggctaattttctccggggtttcgaagaaaagggtattaagaatgatagacccgaggaccaactgtcgaaagagaaaaagaagatatag

SEQ ID NO: 247623 - DNA, 417 bp, Artificial Sequence
  Description of Artificial Sequence: Synthetic coding sequence
atgcttggtagtacctgtcatacgacaacacttcctgccctcgtgaggacccctacattaatgatgcaaccatctctcgatatcaaaccattcatgagtttcccagtagacagcagcagcgcggttggtcttttccctaactttaatactaagaggagggggctgttcgaaacgaataaattttgccaaatggatccagttcaaaaggccgtgataaatcatacttttggggtgtcgatcccgcctaagaagaagcaggttattagttgcaacgtgtgccagcttcgatttaattctgacagtcaggccgaggcccactataagggtagcaagcatgctaaaaaggtaaaggcgttggacgcaaccaaaaacaaacccaaaatggtgccaagcaaagactctgctaaggccaactag

SEQ ID NO: 247624 - DNA, 228 bp, Artificial Sequence
  Description of Artificial Sequence: Synthetic coding sequence
atgaacatggccaactttctaagggggttcgaagaaaaggggatcaagaacgacagacccgaggaccagctgtccaaagaaaaaaagaaaatcctgttttccttttgtgaggtgtgcaacattcagctgaactcagcagctcaagcacaggtgcattctaacggcaaaagccataggaagcgggtcaagcagctgtccgatggccagccaccaccaccggctcagtag

SEQ ID NO: 247625 - DNA, 792 bp, Artificial Sequence
  Description of Artificial Sequence: Synthetic coding sequence
atgatgcaaccatcactggacataaaaccattcatgagctttccagttgattctagcagcgccgtcggtttattcccgaatttcaataccatggaccctgtgcagaaggctgtcataaaccatacattcggagtgtccattccacccaagaagaaacaagtgatctcatgtaacgtgtgtcagctgcgtttcaactcagattcccaggcagaggcccattataaggggtcgaagcatgccaaaaaggtgaaagcccttgatgccacaaaaaacaagccaaaaatggtcccatctaaggatagcgctaaggccaaccctagttgctctataactcctatcacgggcaacaattcagacaaaagcgaggacaaagggaagctgaaggccagtagttcctcacagccctccagctctgagagtggatcttttttgttgaagagcggcacaacaccgctgccacccggtgcggctacttctccatctaagtccaccaatggtgccccaggcacggttgtagaatctgaagaggaaaaagccaagaagctgctttactgcagcttgtgcaaagtcgccgtgaattctttgtcacagttagaggctcacaataccggctctaagcacaagaccatggtggaagctcggaatggcgcagggcctatcaaaagctaccctcgacccggatcaagactgaaaatgcaaaacgggagtaaaggctcggggctgcagaataagaccttccactgcgaaatctgtgacgtgcacgttaattcagagattcagttgaagcaatag

SEQ ID NO: 247626 - DNA, 1002 bp, Artificial Sequence
  Description of Artificial Sequence: Synthetic coding sequence
atgtcggccaaactaggcaagagcagcagcttactaacccagaccagcgaagagtgcaatggaatacttacagagaagatggaggaggaggagcaaacctgtgaccccgattcatctctccactggtcttcctcatattcaccagaaaccttccgacagcaattcaggcagttcggttatcaggattctcccggaccacacgaagccctgtcccggttgtgggagttatgtcacctgtggttacggcctgaggtgcacaccaaggagcagatcctggagcttcttgtgctcgagcagtttctggctatactacccaaagagctgcaagcgtgggttcagaagcaccatccagagaatggcgaagaaacagtgacaatgctggaggacgtggagagggaattggacggccctaaacagatcttctttggcaggcgaaaggatatgattgcggaaaagcttgcccctagcgagataactgaggagttgccaagtagccagctgatgccagtgaaaaagcagctacaaggggcttcttgggaattgcagtcgctacgcccacatgatgaggatatcaaaaccaccaacgttaaaagcgcttcccggcaaaaaaccagcttgggcattgagctccattgtaatgtgagtaacattctgcatatgaacgggagccaaagctcaacatatcggggaacctacgaacaagatggcagattcgagaagcggcaaggcaacccttcatggaaaaaacagcaaaaatgtgacgagtgtggaaaaatattttcccagtcttctgcactgatcctgcaccagagaatacattctggtaagaagccatacgcttgtgatgagtgcgccaaggccttttccagatccgcaatattgatacagcatagacggactcacacggactccaaatatgagcatgctatagctgaagctcagaagaatatgtactttaagacaaggctgaaatgtcctcgtagtttgtccgggggtcggtag

SEQ ID NO: 247627 - DNA, 1008 bp, Artificial Sequence
  Description of Artificial Sequence: Synthetic coding sequence
atgtccgcgaagctaggcaagtcttcatctctgcttacccagacaagtgaggaatgcaatgggatattgacagagaaaatggaggaagaggaacagacatgtgatccggatagcagcctgcactggagctcttcctacagccccgaaacctttcgccaacagtttcgccagtttggctaccaggatagtcccggtccacacgaagcactttcacggctttgggaactgtgccatctgtggctaaggcccgaagtgcataccaaggaacagatcctggagctgctggttctggagcagtttctcgctatcctgcccaaagagttgcaggcatgggtccagaagcatcatccagagaacggagaggagaccgttaccatgttagaagacgttgagagggaactggacgggcctaaacagatcttcttcggcagacggaaggacatgatcgccgaaaaactggcaccttcagagattaccgaggaactcccttcttcccaactgatgcctgtgaagaagcagttgcaaggagctagctgggaacttcagtcactacgccctcatgatgaagatattaagacaaccaatgtaaagagtgcaagccggcaaaagacttcgttaggaatcgagctccactgtaacgtcagcaacatcctgcatatgaatgggagtcagtcctctacataccgcggtacttatgaacaggatgggaggttcgaaaaacgccaaggcaacccaagttggaagaaacagcagaaatgcgatgagtgtggtaagattttcagccagagctccgccttgatcctccaccagaggatccactctggcaaaaaaccatatgcgtgcgacgaatgtgcgaaggctttcagccggtccgcaattcttattcaacaccgtcggactcatactggcgagaaaccatataagtgccatgattgtggcaaagcctttagccagtcatcaaatctgttccggcatcggaagcggcacatccgcaagaaagttccctag

SEQ ID NO: 247628 - DNA, 828 bp, Artificial Sequence
  Description of Artificial Sequence: Synthetic coding sequence
atggcggttgaatccggcgtaatttccaccctgatcccgcaagaccccccagagcaggagcttattcttgtaaaagtcgaggataacttcagttgggatgagaagttcaagcagaatggttccacccagtcttgtcaggaacttttccggcagcagttcaggaagttttgttaccaggagacaccgggtccccgagaggcgctatctcgactccaggagctctgctaccaatggctcatgcctgagctgcacacaaaagaacaaatattagaactgctggttctggagcagttcctcagtatccttccagaagaattgcagatttgggtgcagcagcataacccggaaagcggcgaggaagctgtaactctgctggaagatcttgagcgggaattcgatgatcccggacagcaggtgccagccagccctcagggacctgcggttccctggaaagaccttacgtgtttgcgcgcaagtcaggaatctaccgacattcacctgcagcctctgaagacgcagctcaaatcttggaagccttgcttatccccaaagtccgactgtgagaatagtgagacagccactaaggagggtatctccgaggagaaaagtcagggcttgccccaggagcccagtttccgaggaataaaacttagcaggccaccgaaagcttcatctgccattcgctgggaatgcgtaagcccgggttcctttcctggagacatcattgcagcggaagccacacattcaaccatctcctgctttgcaattaacacactgcccgcaaccatactccccagcaagaacgtcaataggaagtactttagctag

SEQ ID NO: 247629 - DNA, 1605 bp, Artificial Sequence
  Description of Artificial Sequence: Synthetic coding sequence
atggctgttgagagtggggtgatatcaacactcattccacaggatcccccagagcaggagcttattctagtgaaagtcgaggacaacttctcctgggacgagaaattcaagcagaacgggtccacgcagtcatgccaggaactgttccgtcagcagttccggaagttttgttatcaagagacgccagggcctcgggaggcactctcacgactgcaagaactctgttaccaatggttgatgcctgaattacatacgaaggagcagatcctcgaactgctggtgttagaacagtttctgagtatcctcccagaggaactccaaatctgggtgcaacaacacaatcctgaatcaggtgaagaggccgttacactgctggaggacctggaacgtgagtttgatgatcccggtcagcaagttccggcatctcctcaagggccagcagttccttggaaggatctcacatgccttagggcctcccaggagtccaccgatatacaccttcagccgctgaagacccagttaaagtcttggaagccttgtctatctcctaaatccgactgtgagaacagcgagacagctaccaaagagggcatttcggaagaaaagagtcagggactgcctcaggagccatcctttaggggaatttcagagcacgaatccaatctagtctggaaacaggggtcagccaccggggagaagctgcgctcccctagtcaaggaggatcatttagccaggttattttcactaataagtccctggggaaacgcgacctgtacgacgaggccgagcgatgcctgatcctcactaccgattctatcatgtgtcagaaggtcccgcctgaagagaggccctataggtgtgacgtttgtggacatagttttaagcagcattcgagtttgacccagcatcagcggatccacaccggggagaaaccatataaatgtaaccagtgcggaaaagctttttcactacgcagttacctcatcattcaccagcggatccacagtggcgagaaggcttatgagtgctccgagtgcggaaaagctttcaaccaatcttctgcccttattagacacagaaagatacacaccggagagaaggcctgcaagtgtaacgaatgcgggaaagctttttcgcagtcctcttatctgattatccaccagcgaattcacacaggtgagaagccgtacgagtgcaacgagtgtggcaagacattctctcaaagcagtaagctgatcaggcatcagcgaatacatacaggcgagaggccttatgagtgtaatgagtgtggtaaggcctttcggcagtcttccgaattgatcacacaccagaggatccactccggtgaaaagccatatgaatgctcagagtgtggtaaagcttttagcctcagctccaatttgattaggcatcaacgaatccactcgggggaagaaccctaccagtgcaatgaatgcggaaaaacattcaagcgttcctcagctctggtacagcaccagcggattcatagcggggatgaggcttatatatgcaacgaatgtggaaaggcatttaggcaccggtccgtgttgatgcgccatcagcgagttcacacgataaaatag

SEQ ID NO: 247630 - DNA, 738 bp, Artificial Sequence
  Description of Artificial Sequence: Synthetic coding sequence
atggccgttgagagcggtgtgatctctactctgataccacaggatccaccggaacaggagttaatcttagttaaggtggaggataatttttcctgggacgaaaagttcaagcagaatggatccactcagagttgccaggagctctttagacaacagtttcgcaagttctgttaccaggaaacccccggaccaagggaggccctctctcggctgcaggaactttgctaccagtggcttatgcccgagcttcacaccaaggagcagattctagaactgttagtgcttgaacaattcctgtcaatcttgcccgaagagctccagatctgggttcagcaacacaaccccgagtcgggcgaagaggctgtaacactcctggaagatctggaaagagagttcgacgaccctggacagcaggtgcccgcatcaccacagggacccgctgtgccttggaaggacctgacttgcttgagggcaagccaggaatccaccgacattcatctgcaacccttaaaaacccaactgaagtcttggaaaccttgcctctccccaaaatctgagctgagcaggccacccaaggcatcctctgcaatccgatgggagtgcgtcagcccgggatcctttccaggggatatcatcgcagcagaggcgacacactcaactatcagttgcttcgctattaacactctaccagctaccatccttccttcaaaaaacgtcaatcgcaagtatttttcctag

SEQ ID NO: 247631 - DNA, 2340 bp, Artificial Sequence
  Description of Artificial Sequence: Synthetic coding sequence
atggctgccaacggagattcccctccgtggtcgcctgctcttgctgccgaagggaggggctccagttgtgaggctagcgtgtccttcgaagatgtgaccgtggacttctctaaggaggagtggcagcatctggacccagctcagagacgtctgtactgggacgtgacgctggaaaactacagccacctgctctcggtcggatatcagattcctaaatccgaggcagctttcaagctggagcaaggtgaggggccatggatgctcgaaggggaagccccacatcagagctgcagcggggaagccatcggcaagatgcagcagcaggggataccaggcggaatttttttccactgtgagcgcttcgatcaacccattggcgaagactcactctgcagtatcctcgaagaactttggcaggataacgaccagcttgagcagcgacaagagaatcagaataatcttctgagccatgtgaaagttctgataaaggaacgcggatatgagcataaaaatatcgagaagattatccacgtcaccacgaagctggttccttccataaagcgcctgcataactgtgatacaatattaaagcacacattaaattcccacaaccacaatcgcaattctgccacgaaaaatctgggtaaaatatttggtaacgggaataatttcccacactctccatcttcaacaaagaacgagaacgcaaagacaggggcaaatagttgtgagcatgaccactatgagaaacacctgtcacataaacaggcccctacccaccatcagaagatccatcctgaggaaaaactgtacgtgtgcacagaatgcgtcatggggtttactcagaaaagccacctgttcgagcaccagcggatacatgcaggggaaaagtcccgcgaatgtgataagagcaataaggtgtttcctcagaagcctcaggtagatgtgcatcccagcgtgtacacaggggagaaaccctatctgtgtacacagtgtggcaaggtgttcacactgaagtcaaacctcatcactcaccaaaaaattcatacagggcagaaaccatacaagtgttcagaatgtggcaaagccttctttcaacgctccgatctgttccgacatttacgcatccacacaggcgagaaaccttacgaatgctctgagtgcgggaagggcttctctcagaattctgatcttagcatacatcaaaagactcacactggcgagaagcactacgaatgcaatgagtgcgggaaagcatttacacgaaagtcagcccttaggatgcatcagaggattcacacaggcgaaaagccttatgtgtgtgcggattgcgggaaggccttcatccagaaatcccacttcaacactcaccagcggatacatacgggagagaagccttacgagtgttctgattgcggaaagagttttacgaaaaagtcccagttgcacgtgcatcagcgcattcacacgggggaaaaaccctacatctgtacggagtgtggaaaagtctttacccatagaacaaacctcacgacccatcagaagacacatacaggtgagaaaccctacatgtgcgctgagtgcggtaaggcattcactgaccagtcaaacctgatcaaacatcagaaaacacacaccggagagaaaccatacaagtgtaatgggtgcggcaaggccttcatatggaagagtcggctgaagatccaccagaaatctcatattggggaaaggcactatgaatgcaaggactgtgggaaagcatttattcagaaatcgacactctccgttcatcaaaggattcacacaggggagaaaccttatgtatgccctgagtgcggaaaggctttcatccagaaaagtcacttcatcgcccaccatagaattcacaccggagagaaaccatatgagtgctcagactgcggtaaatgcttcactaagaagtctcagctgcgtgtccatcagaagatccatactggagagaagccgaatatttgtgcagaatgtggcaaggctttcactgataggagtaacctgattacccaccagaagatccatacgcgtgaaaagccttacgagtgcggtgactgcggtaaaacgtttacctggaagtcccggctcaacatccaccagaagtctcacacgggcgagagacactatgagtgctccaaatgcggcaaagcgtttattcaaaaagccactcttagtatgcaccagataatccatacaggcaagaaaccatacgcatgcacagagtgtcagaaggccttcacagaccggtctaacctaatcaaacaccagaagatgcactctggcgaaaagagatacaaggctagtgattag

SEQ ID NO: 247632 - DNA, 2340 bp, Artificial Sequence
  Description of Artificial Sequence: Synthetic coding sequence
atggctgctaatggcgacagcccgccttggagtccggcactggctgccgagggacgaggcagcagctgcgaggcatccgtatcattcgaagatgtcactgtagacttttctaaggaggaatggcaacatcttgatcccgctcagcggcgattatactgggacgtgacactggagaactactcacacctgctgagtgtgggctatcagatccctaagtctgaggccgctttcaaactagaacaaggcgagggaccctggatgctcgagggggaagctccccatcagtcctgtagtggtgaggccataggtaagatgcagcagcagggtatccccggtggaatcttcttccactgcgagcgatttgaccagcccattggcgaggacagcctgtgttctatcttggaggagctctggcaagataatgatcagctggaacagcggcaagagaaccagaataatcttctatcacatgtaaaggtgctcatcaaagagaggggatacgaacacaagaacattgagaagattattcacgtgactactaagttggtgccttcaattaagcgtctccacaactgcgacacgatcctgaaacacaccctgaacagtcataaccataaccgaaatagcgccacgaaaaaccttggcaagattttcggcaacggaaacaacttcccccactcgccgagctcaacaaagaacgagaatgccaagactggcgcaaattcttgcgagcacgatcactacgagaagcacttgtcccacaagcaagcccctactcatcaccagaaaattcacccagaagagaaactgtatgtatgcaccgaatgtgtcatgggcttcactcagaaatcccacctgttcgaacatcagagaatacatgccggtgagaagagccgcgagtgcgataagtctaacaaagtttttcctcaaaaacctcaggtggatgtgcaccctagcgtgtataccggagagaaaccttacctgtgcactcagtgcggaaaagtttttacactgaagtctaacctgataactcatcagaaaattcatactggacagaagccctataagtgtagtgaatgtgggaaagctttctttcagcgatccgatctttttagacacttgcgcatccatactggcgagaagccctatgagtgctccgagtgtggcaagggatttagtcagaacagcgatctttctatccaccaaaaaacccacacaggcgaaaagcactacgaatgtaatgaatgcggcaaggcattcacgcgcaaatctgccctgcgaatgcaccaaagaattcacaccggtgaaaaaccttatgtctgtgccgattgcggcaaggccttcatacagaagtcacactttaacacccatcagaggattcacaccggcgagaaaccttatgagtgcagcgattgtggcaaaagtttcacaaaaaagtctcagctgcatgtccatcaaagaatccacaccggcgaaaagccctatatttgcaccgagtgtggaaaagtctttactcacaggaccaatttaaccacacaccaaaaaacacatactggtgagaagccctatatgtgtgccgagtgcggtaaggcatttacggatcaatctaacctgatcaagcaccagaaaacccataccggcgaaaagccttataagtgcaacggttgcgggaaagcatttatatggaaaagtagacttaagatccatcagaagtcccacatcggcgagaggcactatgagtgcaaggattgcggaaaggccttcatacagaagtctactctgtccgtgcaccagcgcattcataccggtgagaagccctatgtttgtcccgagtgcggaaaagccttcatccagaagagccactttattgcgcaccacagaatccataccggggaaaaaccttacgagtgttcagactgtggaaaatgctttacaaagaaaagccagctgagggtgcatcagaagatccataccggagaaaaacccaatatctgcgccgagtgcggcaaggcttttaccgaccgctcaaacctcatcacacaccagaagattcacactagagaaaaaccttatgagtgtggagactgcggtaagacgttcacgtggaaaagtcggctcaatattcaccagaagagccacaccggcgaaaggcactacgaatgtagtaagtgtgggaaagccttcatccaaaaagccacactgtctatgcatcagatcatccacacaggcaaaaagccctatgcgtgtaccgagtgccagaaagccttcactgatagaagcaatttgatcaagcaccaaaagatgcacagcggcgagaagaggtacaaagcgtctgactag

SEQ ID NO: 247633 - DNA, 2370 bp, Artificial Sequence
  Description of Artificial Sequence: Synthetic coding sequence
atgggcacgctgccccatgggccaagaccatggttgcagcgcgatgtggcggctcacgtctctgccgaccatgctgcgctgaactcgattgtatctctgcaggctagcgtgtcgtttgaagacgtgaccgtggacttttctaaggaagagtggcagcatcttgacccagcccaacgccgattgtattgggacgttacgctggaaaattactcacaccttctgagcgttggctaccagattcccaagtcggaggccgcttttaaacttgagcagggagagggcccatggatgcttgaaggggaagcaccccatcaatcgtgctctggcgaagcgatcggcaagatgcagcagcagggaatccccggaggaatcttcttccattgcgagagattcgatcagccaattggagaggatagtctgtgctcaattctcgaggagttgtggcaggataacgaccagctggaacagcgccaggagaaccagaacaatctcttgagccatgtgaaggtgttaataaaggagagaggttatgagcacaaaaatattgagaagattattcatgttaccacgaagcttgtgccttcaatcaagagactgcataactgcgatacaatcctgaagcatacactaaacagtcataatcacaatcgcaactcagccaccaagaacctgggcaagatattcggcaatggcaacaatttcccccactcaccttcatctaccaagaacgaaaacgctaagaccggtgctaattcctgtgagcatgatcactacgagaagcacctgagtcataagcaagccccaacccatcatcagaagatccatccggaagaaaaactctacgtgtgtaccgaatgtgtaatgggctttacgcagaaatcgcacctgttcgagcatcagcggatccacgccggagagaagtcacgtgaatgtgataagagcaataaagtgttcccgcaaaagccccaggtggatgtccacccaagcgtgtatactggcgagaagccttatctctgtactcaatgcggcaaagtattcactctgaaatccaatctcataacccatcagaaaatacacacagggcaaaagccatacaagtgctcagagtgtggcaaggcattcttccaaagatctgatctgttccgccatctccggattcatacgggtgagaaaccgtacgagtgttctgaatgtgggaagggattctctcaaaatagtgatcttagcattcatcagaaaacgcatactggtgaaaagcattacgagtgcaatgagtgcggcaaggcctttactcggaaatccgcgttgagaatgcaccagagaatccataccggcgagaagccatacgtgtgtgcagattgcggaaaggctttcattcaaaaatcccatttcaatacacaccagaggatccacactggtgagaaaccgtatgaatgctcggactgtggtaaatcattcacaaaaaaatctcaacttcacgttcaccaacgtatccatacaggcgagaagccatacatctgtactgaatgtggtaaagtgttcacacataggactaacctcactactcatcaaaaaacccatacaggagagaaaccttacatgtgcgcagagtgtggtaaggcgtttacggatcaatcaaatttaatcaaacaccagaaaactcacaccggagagaagccttataaatgtaatggttgcggtaaagcatttatctggaagagccgccttaagattcaccagaagtcacacattggcgaacgtcactacgaatgcaaggactgcggcaaggcctttattcaaaaaagcaccctttcagtacatcagaggatccatactggagaaaaaccatatgtctgcccagaatgcggaaaggcgtttatccagaagagccactttattgcccatcaccgcatccacaccggggagaaaccttatgagtgcagtgactgcggaaagtgcttcacaaaaaaatcacagctcagagtgcatcagaagatccatacaggtgagaagccgaacatatgtgcagagtgcggcaaggcgtttacggataggagcaatttgatcactcatcagaagatccacacccgcgaaaaaccctacgaatgtggtgactgtggcaagactttcacatggaagtcaaggttaaacatccaccaaaaaagtcacaccggggaaagacattacgaatgctctaagtgcggtaaggcctttattcagaaggccacccttagcatgcatcagattattcacaccgggaaaaaaccttatgcctgcacagagtgccagaaggcattcactgatcgcagcaacctgataaaacaccaaaagatgcactccggagaaaagcgctacaaagcttccgactag

SEQ ID NO: 247634 - DNA, 537 bp, Artificial Sequence
  Description of Artificial Sequence: Synthetic coding sequence
atggggactttgccacacggacccagaccttggctgcagcgcgacgtggcagcccatgtcagcgcagaccacgcagccctcaactctatcgtctcacttcaggcttccgtgtcattcgaggatgtgaccgtcgacttcagtaaagaggaatggcagcacctggatccagctcagcggcgactgtattgggatgttactctcgagaattactcacatctccttagtgtcggctaccagatcccgaagtctgaggccgcattcaagctcgaacagggagaaggaccatggatgctagagggcgaggcgccacatcagtcttgttccggggaggctattggtaaaatgcagcagcaggggatcccaggcggaatttttttccattgcgagcggttcgatcagcctatcggagaggatagcctgtgctctatcctcgaagaactgtggcaggataacgatcagctcgaacagagacaagagaaccagaacaacttgttgagccacgtgaaggtgctgataaaggagcgtgggtacgagtag

SEQ ID NO: 247635 - DNA, 3855 bp, Artificial Sequence
  Description of Artificial Sequence: Synthetic coding sequence
atgcacaagaaacgcgtggaagagggcgaagccagcgatttctctctggcgtgggacagctcagtgactgctgccggtggcctggagggggaacctgagtgcgaccagaaaacatctcgcgctctcgaggatcgcaactcagtgacgagccaggaggagaggaatgaggacgatgaggacatggaagacgaatctatttatacttgtgaccactgccaacaggatttcgagtccctggctgatctgaccgaccacagagcccaccgctgtcctggtgacggggacgatgacccccaattatcctgggtggctagctccccctcttccaaggatgtggcctctcccacccaaatgattggtgatggctgcgatctcggtctgggcgaggaggaaggcggaacaggactgccctatccctgccagttctgcgacaagtcttttatccgcttgtcttacctaaagaggcatgagcaaatccattccgacaaactgccgttcaaatgcacctactgctccagactcttcaagcataagaggtcaagagaccgtcacattaaattacatactggcgacaaaaagtaccactgccatgaatgcgaagcagccttttcccggagcgatcatcttaaaatccatctcaagacccattccagttctaagccctttaaatgtactgtctgcaagagaggattctcttcaacatctagcttgcagagccatatgcaggctcataagaaaaacaaggaacacctggccaaatccgaaaaggaggcaaagaaagacgactttatgtgcgactattgcgaagataccttcagtcagacagaagagttggagaaacatgttctgactcggcatccccagttgtccgagaaggccgacctgcaatgcattcattgccctgaagtgtttgtggacgaaaatacccttctggcacacatccaccaggctcatgcaaaccagaagcataagtgtccaatgtgtccggagcaattcagctcagtggaaggcgtgtattgtcacctagattcccaccgacagcccgactcctccaaccatagcgtcagccccgaccctgtgctcggatcggtcgcatcaatgtcttcagccacacctgactcctcagcatcggtcgaacgcggatccaccccagacagtactttgaaacccctgcgtggtcaaaagaaaatgcgcgacgacggccagggttggaccaaggttgtgtacagctgcccctattgctctaagcgcgactttaatagtttagctgtgcttgagatccacttgaagactatccacgcagacaaaccccaacagagtcatacctgccagatctgtctggatagtatgcctacactctacaacctgaatgaacacgtcaggaaactgcataaaaaccatgcgtatcctgttatgcagttcggcaacattagcgcttttcactgcaattactgtccggagatgttcgccgatatcaacagcctgcaggagcacatcagagtgtcccactgcggtcccaacgctaatcccagcgatgggaacaatgcatttttctgcaaccagtgctcgatgggcttcttgacagagtcttcactaaccgaacatatacaacaggcccattgtagtgttggcagcgccaagttagagtctccagttgtgcagcccacacaaagcttcatggaggtgtatagctgcccctactgtaccaatagccctattttcggcagcatcctcaagctcaccaagcacataaaggaaaatcacaaaaatatacctctcgcccacagcaaaaagagcaaagctgagcagtcccccgtatcctccgatgtcgaagtgagctctcccaaacgccagagactgtcagcctcggccaattctatctcaaacggtgagtatccatgcaaccagtgtgacctcaaattttctaactttgagagcttccagacacaccttaaattgcatttagagttgctgctgcggaaacaggcatgcccacagtgcaaggaagacttcgactcccaggaatcactactccagcatcttacagttcactacatgactacttccacacattatgtctgtgaaagctgtgacaaacagttttcctcagtcgacgatttgcagaaacatttgctggatatgcatacctttgtcttgtatcattgtaccttgtgccaagaagtattcgactccaaagtttctatccaggttcatttggcagtgaagcatagcaacgagaagaaaatgtatagatgcaccgcttgtaactgggactttcggaaagaggcggacctgcaagtgcacgtgaaacactcacacctaggcaatccggcaaaggcacataagtgtatattttgtggtgagacattttctaccgaagtggagttacagtgccatatcacaacacattccaaaaagtataactgtaagttttgcagcaaggcatttcacgcaattattcttctggaaaagcatctccgggagaagcactgcgtgtttgacgccgctaccgagaatggaactgccaacggtgttccccctatggctactaagaaagccgagccagcagacctgcaggggatgctgctgaagaatccggaggctccaaatagtcacgaagcttctgaggatgatgtggatgccagcgagcccatgtacgggtgtgacatctgtggggctgcgtatacaatggaagttctcttgcaaaaccaccggctcagagaccacaacattcgtcccggtgaggatgacggctctcggaaaaaggccgaatttataaagggcagtcataagtgcaacgtgtgtagtagaacctttttttctgagaatgggttaagagagcacctgcaaacacacagaggtcccgctaagcactacatgtgcccaatctgtggggagcggttcccttcccttctcaccttgactgaacacaaggtgactcattcaaaaagccttgacaccggaacctgtagaatatgcaagatgccccttcaaagcgaagaagagtttatagaacattgccaaatgcatccagacctacggaattccctaaccggttttaggtgtgttgtctgcatgcaaacagtcacctctacactggagctgaagattcacgggacattccacatgcagaagctggctggcagttccgcagcctcttcaccaaacggccaggggttacaaaagctatacaagtgcgcactgtgtctcaaagagtttcgatccaagcaggatcttgtgaagctagatgtgaacgggctgccatatggcctctgtgctgggtgcatggcgcgtagcgccaacggacaggtggggggtctagcccctccagagcccgctgatcggccttgtgcaggacttaggtgccctgaatgctccgtgaaatttgagtctgcggaagatctggagtcgcatatgcaggtggaccaccgggacctgacaccagagaccagcgggccaaggaaaggaacacagactagtccagttcctcggaagaaaacctaccagtgcatcaaatgccagatgacgtttgaaaacgagcgggagatccagatacatgtcgccaatcacatgatcgaggagggtataaaccacgaatgcaagctctgcaaccagatgttcgactctcccgcaaagctgctgtgccaccttatcgagcactcctttgagggcatggggggtacttttaagtgtccagtgtgttttaccgtgtttgtgcaggccaataaactgcagcagcacatcttcgctgtgcatggtcaggaggacaagatttacgactgctcccaatgcccccagaaatttttcttccaaactgagttacaaaaccacaccatgagccagcatgcacagtag

SEQ ID NO: 247636 - DNA, 3504 bp, Artificial Sequence
  Description of Artificial Sequence: Synthetic coding sequence
atgatcggcgacgggtgcgacctcgggctcggcgaagaggagggcggtaccgggttgccatacccttgtcagttctgcgacaagagcttcattcgacttagctatctgaaaaggcacgagcaaattcacagtgacaagctaccgtttaagtgtacgtactgcagccggctcttcaagcataaaagaagccgcgaccgccacataaaactgcacactggggacaagaaataccattgtcatgagtgtgaggcagcattctcaagatctgaccaccttaagatacacttaaaaacccattctagctccaagccctttaagtgtactgtttgcaaacggggtttcagtagcacaagcagcctacagtcacatatgcaggcgcacaagaagaacaaagagcatctggccaaatctgaaaaggaggccaagaaggatgactttatgtgcgattactgtgaggacacattttctcaaactgaggagttggagaagcacgtcctgacacgacacccccaattgtctgaaaaggctgatcttcagtgcatccactgccctgaagtgttcgtggacgaaaatactctcttggcacacattcaccaggctcatgcaaaccagaagcacaagtgcccgatgtgtcccgaacagttctctagcgttgagggtgtgtattgtcatctagattctcaccgccaacctgattccagcaaccactccgtgagccccgacccggtcttagggtccgtcgcctcaatgagttcagcaacgccagactctagtgcctcagtcgaaagaggttcaacaccagacagcaccttgaagccactgagggggcaaaaaaagatgcgtgacgatggtcagggctggactaaagtcgtgtattcatgtccgtactgttctaagcgggactttaacagcttggccgtccttgagattcacctgaagactattcacgcagataagcctcagcagtctcacacctgtcagatctgcctagacagtatgccaaccctctacaacctcaatgaacacgttcgaaagctccacaaaaaccatgcctatcccgtgatgcagtttggcaacattagcgcattccattgtaattactgccctgaaatgtttgccgatattaactctctccaggaacatatcagggtctcgcattgcgggccaaacgcgaatccatctgatgggaataatgccttcttctgtaaccaatgctccatggggtttctaacagagagttctctcacggaacacattcagcaggcccattgtagcgtgggctctgctaagttagaaagccccgtggtccagcctacgcaatcatttatggaagtatatagctgtccctactgtaccaattccccaatttttggctccatactgaagctgacaaaacacatcaaagaaaatcacaagaacattcccttggcccactcaaagaaatccaaggccgagcagagtccagtctcttccgacgtggaggtgagttcccctaagagacaaagactctcagcaagtgcaaactccatatccaacggggagtatccatgtaaccagtgcgatctgaagttcagtaacttcgaaagcttccagacccatctcaaactacacctggagctactgctgcgaaagcaggcatgtccccagtgcaaggaggacttcgactcccaggagagcctgctgcagcatctgaccgtgcactacatgacaactagcactcactatgtgtgcgaatcttgtgacaagcagttcagcagcgtggatgacctccaaaagcatctcttagatatgcataccttcgtgctgtatcactgcactctctgtcaagaagtgtttgacagcaaagtaagtatccaggtgcacttggccgtgaaacacagcaatgagaaaaagatgtaccgctgtacagcctgcaattgggactttcgtaaggaggctgatctgcaggtgcacgtgaagcactctcaccttggaaatcccgcaaaggcccacaagtgcattttctgcggcgaaaccttctctacagaagtcgagctccaatgtcacatcacaacacattcaaagaagtataactgcaaattctgttccaaagcctttcatgccattattctgctggaaaaacacctacgggagaaacactgcgtgtttgatgcggcaacggaaaatggcactgctaatggagtgccgccaatggcaaccaagaaggcagagcccgcagaccttcagggaatgctgctgaaaaaccccgaggccccaaatagtcatgaggcatctgaagacgatgtagacgcctcggagccaatgtacggctgtgacatctgtggcgctgcctatactatggaggtcttgttgcaaaatcatcgactgcgagatcataacattcgcccaggagaagacgacggatctagaaagaaggccgaattcatcaaaggtagtcataagtgcaatgtttgttccagaacgttcttttcggaaaacggactgcgggaacatctacagacacaccggggtcccgcaaagcattacatgtgcccaatatgcggggaacgctttcctagtctgctgacgctgaccgagcataaggttacacattccaagtcccttgacaccggcacttgtcggatctgtaagatgcccctgcagagcgaggaagaattcatcgagcactgtcagatgcatcctgacctcagaaactctctgactggcttcagatgtgtcgtgtgcatgcagacggttacatcaacattggagctcaagatacatgggacattccacatgcagaaattggcagggagctccgccgcttcctccccaaacgggcagggtcttcagaagctttacaagtgtgctctttgcctcaaggagtttaggtcgaagcaggacttggtgaagctagacgtcaacggactgccctatggtctttgcgctgggtgtatggcaaggagtgcgaacgggcaggtgggcggtctggcaccacccgagccggcagaccggccatgcgccggtctgaggtgcccggaatgttccgtcaagttcgaaagtgccgaggacctcgaatcccacatgcaggtcgaccatagagatttaacgcctgagacgtccggccctcgcaaaggtacccaaacctcccccgtacctaggaaaaagacttatcaatgtattaaatgtcagatgacctttgagaatgagcgggaaattcagattcatgtggcgaaccacatgatagaggaaggaataaaccatgaatgtaagctgtgtaatcagatgttcgacagtcccgcaaaattgttgtgtcatctcatcgaacattcctttgaaggcatgggtggcaccttcaaatgtccggtgtgcttcactgtgtttgtccaagcgaacaagttacagcagcacatcttcgctgtacatggacaggaagacaaaatatacgattgtagccagtgtccccagaagttcttcttccaaaccgaactgcagaaccataccatgagccagcacgctcagtag

SEQ ID NO: 247637 - DNA, 3855 bp, Artificial Sequence
  Description of Artificial Sequence: Synthetic coding sequence
atgcataagaaaagggtggaggaaggcgaggcctctgacttttctttggcttgggattcctccgttaccgccgcagggggtctggagggcgagccggaatgcgatcagaagacatctcgagccctggaggataggaacagcgtgacctcccaagaggagcggaatgaggacgatgaggatatggaagacgagtctatttatacatgcgaccattgccaacaggactttgagagcctggcagacttgaccgaccatcgcgctcatcgctgcccgggtgacggagatgatgacccccagctaagttgggtcgcttcctcccctagctctaaggatgtggccagccccacacagatgattggagatggctgcgatctgggtctgggagaggaagaaggagggaccgggctaccctacccttgccagttttgtgacaaaagttttatcagattatcctacctgaagcgacacgagcagatccactccgacaaactcccctttaagtgtacctactgcagcagactgttcaagcacaaaaggtccagagataggcacatcaagttgcacacgggggacaagaagtaccattgtcacgagtgtgaggccgcattcagcaggagcgaccacctgaaaatacaccttaaaacacactcctcctcgaagccttttaagtgcaccgtgtgcaagcggggtttttcaagcactagctccttacagtcccatatgcaagcacataagaagaacaaggaacacttggcgaagagtgagaaagaggctaagaaagacgactttatgtgcgactactgcgaggacacattttcacagacagaagagctcgagaagcacgtccttacaagacacccccaactttctgaaaaggccgatctgcagtgtattcattgccctgaggtattcgtggacgaaaacaccttgctggctcatatccaccaggcacatgcaaaccagaaacacaaatgcccgatgtgtcccgaacagttcagctcagtcgaaggcgtctactgccaccttgatagccataggcaaccggatagcagtaaccattctgtgtcccctgaccccgttcttgggtcagtcgccagcatgagttctgctacacctgactcgtctgccagcgttgaacggggatctacgccggattccactttaaagcctctcagaggccaaaaaaaaatgagagatgatggtcagggctggaccaaggtagtctactcctgcccttactgcagcaaacgggatttcaattcactggcagtgctggaaatccacctgaagaccatccatgctgataagccccagcagagccacacctgtcagatctgcctggactccatgccaacactgtataatcttaatgaacatgtgcgcaagttacacaagaatcacgcgtatcctgtgatgcagttcggcaatatttctgcattccattgtaactattgtcctgagatgttcgctgatataaactccttgcaggaacacatccgtgtctctcactgcgggcctaatgcaaacccttcagacggtaataatgcttttttctgcaaccagtgttccatgggatttctgacagaatcatcccttaccgagcatatccaacaggctcactgttcggtagggtccgccaagttagaatcgcctgtggtgcagcctacacagtcgtttatggaggtgtattcatgtccgtactgcacaaactctcccatttttgggtccatcctgaaacttacgaaacacattaaggaaaatcacaaaaatattccccttgctcactctaagaagagcaaagcagaacagtcaccagtgtcaagtgacgtcgaagtgtctagcccaaagagacaacggttaagtgcttctgctaactccatctccaatggcgaatacccttgcaatcaatgcgacctcaagttctcgaatttcgagtctttccaaacacaccttaaactgcacctcgaacttctgttgcgcaagcaggcctgccctcaatgtaaggaggactttgacagccaagagagcctcctgcagcatctgactgtgcattacatgaccaccagcacccactatgtctgtgagagttgtgataagcagttctctagcgtagacgacctgcagaagcacttgctggatatgcacaccttcgttctgtaccattgcaccctgtgtcaggaggtgttcgattccaaggttagtatccaggtgcacctcgcggtgaaacactctaacgaaaagaagatgtacaggtgcacagcatgcaattgggacttcagaaaggaagccgacctgcaagtgcacgtgaagcattcacacctggggaaccccgctaaagcccacaagtgcatattttgcggagagactttcagtactgaggtcgagctgcagtgtcacatcaccacacattcgaagaaatacaattgcaaattttgtagtaaggcattccatgccatcattctgctagaaaaacatttacgtgagaaacattgcgtgtttgatgccgctaccgaaaacggaacggcaaacggagtgccacccatggccacaaaaaaagccgaacctgccgatctgcagggcatgctcctgaagaacccagaggcaccaaactcccacgaggcatccgaggacgacgtagatgcatcagaaccaatgtacgggtgtgacatctgtggggctgcgtacacaatggaagtgctcctccagaatcatcgcctgcgggatcacaacattcggcctggggaggatgacggctccaggaagaaggccgagttcataaagggctcccacaagtgcaacgtctgcagccggacttttttctcggagaacggcctgcgcgaacacctgcaaacccatcggggtccagccaagcactacatgtgtccgatttgtggtgaaaggtttcctagtctgttgacgttgaccgaacacaaggtcacacactcaaagagccttgacacagggacctgccggatatgcaaaatgcccctccaatccgaggaggaattcatcgaacactgccagatgcatccagacttaaggaactccttgaccggcttcaggtgcgttgtttgcatgcagaccgtcacgtctactctagaactgaagattcatggaacattccacatgcagaaactggctggaagttcagcggcatccagtccaaacggccagggtctgcagaagctctacaagtgcgccttgtgcttgaaagaattcagaagtaagcaagatctggtaaagctggacgtcaatgggcttccttatggcctgtgcgctggctgcatggccaggtccgccaatgggcaggtgggagggctggcccctcctgagcctgcagatcgaccttgcgccggactgcgctgtccagagtgctctgttaagttcgagagcgcagaagacctggaatcccacatgcaggtggaccaccgggatctgactcctgaaacgtctggacctcgcaaaggcacacagacgtccccagtgcctcgcaagaaaacatatcaatgtatcaagtgccagatgacctttgagaatgagagggaaatacaaatccacgtcgccaatcacatgatcgaagagggcattaatcacgagtgcaagctctgcaaccagatgtttgacagcccagctaagctattatgtcacctgatcgaacacagttttgaaggcatgggagggacattcaagtgcccagtgtgtttcacagtcttcgtccaggccaacaaactgcagcagcacatcttcgcagtgcatggccaagaagacaagatttatgactgttctcagtgccctcaaaaattctttttccagactgagctacagaaccacacaatgagccagcacgctcagtag

SEQ ID NO: 247638 - DNA, 2430 bp, Artificial Sequence
  Description of Artificial Sequence: Synthetic coding sequence
atgggccctctcacgttcatggatgtggccatcgaattttgcctggaagaatggcagtgtctggatatcgcccagcaaaacctctaccggaacgtgatgttggaaaattaccggaaccttgtctttctgggaatcgcagtaagcaagcctgatctgattacatgcctggagcaggagaaagaaccttgggagcctatgagaagacatgagatggtggcaaagcctcctgttatgtgtagccactttacgcaggacttctggcccgagcagcatatcaaagacccattccagaaggcaactctcagaagatataaaaattgtgagcataaaaatgttcatttgaagaaggatcacaaatcagtagatgaatgcaaggtccaccgcggaggctataacgggtttaaccagtgcctgcctgcgacccagtcaaagatcttcctgttcgacaagtgtgtcaaagctttccacaaattctcgaattccaatcgtcacaaaattagccatactgagaagaaattgttcaagtgcaaagaatgtggaaagagtttttgcatgttaccccacctggcgcagcataaaatcatccacactcgagtgaacttttgtaagtgtgaaaaatgcgggaaagcatttaactgtccttccattattacgaagcataagcggatcaatacaggtgagaaaccctacacctgtgaagagtgcggcaaggtgtttaattggtcttctagactgactacccataagaagaattatacgcgctacaaattgtacaaatgcgaggagtgtggtaaagcctttaataaaagctctatcctgacaactcacaagatcatacgtacgggggaaaagttctacaagtgcaaagaatgcgcgaaggcatttaaccagagctctaatctgacagagcataagaaaatacatcccggagagaaaccgtacaagtgcgaggaatgtggtaaggcctttaattggccgagtaccctcactaaacataaacggatacacacaggagaaaaaccatatacctgtgaggaatgtgggaaggccttcaaccagtttagcaatttgacgacccacaaacgaatccataccgccgagaagttctataaatgcaccgagtgcggagaagctttttcacggagctccaacttaaccaagcacaagaagatccacacagagaagaaaccgtacaagtgcgaggagtgcgggaaagcttttaagtggagctcaaaattgactgagcacaaactgacacacaccggtgagaagccttacaagtgcgaggaatgcgggaaagctttcaactggcccagcacccttaccaaacacaatcggatccatacgggcgagaagccatacaagtgcgaagtatgcggaaaagcatttaaccagttctccaacctcaccacacataagagaattcacaccgccgagaaaccttataagtgcgaggaatgcggcaaggccttttcacgaagttccaacttgactaaacataaaaagatccacattgaaaagaagccatataaatgtgaggagtgtggtaaagccttcaaatggtcatctaaactcactgaacacaaaatcacccataccggggagaagccatacaaatgcgaggaatgcggaaaagcttttaatcacttcagcatcctgacgaagcataagagaatccatactggagaaaagccctacaaatgtgaggagtgtggcaaggccttcacacagtccagcaacctgaccacccacaagaagatccataccggtgagaagttctacaagtgtgaggaatgtggcaaagcatttacccagtctagcaacctgacaacacacaagaagatacacactggtgggaaaccttacaagtgtgaagaatgcgggaaagctttcaatcagttctcgactctgacaaagcacaagattattcacaccgaagagaagccttacaagtgcgaagaatgcggaaaagccttcaagtggtccagtactttgaccaaacataagatcattcataccggcgagaaaccatataagtgtgaggaatgtggcaaggctttcaaactgagcagcaccctcagtactcataaaattattcatactggggaaaagccatacaagtgcgagaagtgcgggaaagcgtttaaccgttcatccaacttgatcgaacacaagaaaatacatactggggaacagccttataagtgtgaagaatgcggcaaagctttcaattactcttctcacctcaacacgcacaagcggattcataccaaagaacaaccctacaagtgtaaggagtgtggtaaggcgtttaatcaatactcaaatctcacgacccacaacaagatccacaccggcgagaagctatacaagccagaagacgtcaccgtcatcctcacaacaccccagacgttcagcaatatcaaatag

SEQ ID NO: 247639 - DNA, 2427 bp, Artificial Sequence
  Description of Artificial Sequence: Synthetic coding sequence
ggacctctgacgtttatggacgtggctattgaattctgccttgaggaatggcagtgtctggatattgcacagcagaacctttaccgcaacgtgatgctagaaaattaccgtaatctcgtgtttctgggtattgccgttagcaagcctgacctcataacctgtctggaacaggaaaaggagccatgggaaccaatgcgcagacatgaaatggtcgctaagccacctgtcatgtgcagccacttcactcaggacttctggccagagcagcatattaaggatccttttcagaaagccaccttacgcagatacaagaactgcgaacataaaaacgtacacctcaaaaaagatcacaagtccgtggacgagtgtaaggttcacagagggggatacaacgggttcaatcagtgcttaccagccactcagagcaagatcttcttattcgacaagtgtgtgaaggcgtttcacaagttctctaactccaaccgacacaaaatctcccacactgagaagaaattgttcaaatgcaaggagtgcgggaaatccttttgtatgctaccacacctcgcccagcataaaattatccacaccagggtcaacttttgcaaatgcgagaagtgcgggaaagcctttaattgccccagcatcatcacaaaacataagaggattaacaccggcgaaaagccatacacatgcgaggaatgtgggaaggtgttcaattggtcctcgcgcctaacgactcacaagaaaaactatacaaggtacaagctctacaagtgtgaggagtgtggcaaagcatttaataaatcctcaattctcactacgcacaaaattatacgtaccggggaaaagttttataagtgtaaagagtgcgcaaaagcgttcaatcagtcttcaaatctgacagagcataagaagatccaccctggcgaaaagccttataagtgtgaagaatgcggaaaggcctttaactggccgtctactctcacaaagcacaagcgcatacacactggcgagaaaccgtacacttgtgaggaatgtgggaaggctttcaaccagttcagtaacctaaccacccataaacgaatccacacagccgagaagttttacaaatgtacggagtgcggtgaagccttctcccggtcatcgaacttaacaaaacacaagaagatccacacggaaaaaaagccttacaagtgcgaggagtgcggtaaggccttcaagtggtccagtaagcttacagaacataaactgactcatacgggcgaaaaaccctataagtgcgaggagtgcgggaaggccttcaactggccatctacactgaccaagcacaacaggatccatactggggagaagccatataaatgtgaggtgtgtggcaaagccttcaaccagttttccaatttaaccacacacaagcgaatccatactgccgagaaaccctacaaatgcgaggagtgtggcaaggccttctctcggtccagcaacctaacaaagcataagaaaattcatattgagaaaaagccttataaatgtgaggaatgcggcaaagcgttcaagtggtcctcaaaactgactgaacataaaattacccatacgggcgaaaagccctacaaatgcgaggagtgcggtaaagctttcaaccacttcagcatattaaccaagcataaacgcattcatacaggagaaaaaccttacaaatgtgaggagtgcggcaaggcattcacccagagcagtaacttgacaacccacaagaaaatccacaccggcgaaaagttttacaagtgtgaggaatgcggcaaggctttcacccagtcctctaatctcaccacgcataagaaaattcacaccggaggcaaaccttacaagtgtgaggagtgcggcaaagctttcaaccagtttagcactctaaccaaacacaagatcattcataccgaagagaagccatacaagtgtgaggagtgcggaaaggcctttaaatggagctctacactgaccaagcacaagataatccacaccggcgagaagccatacaaatgcgaagagtgtggtaaggccttcaagctgagctctaccctgtctacccacaagatcattcacacgggtgaaaaaccctacaagtgtgagaaatgcggaaaagcctttaacagaagctctaatctcattgaacacaagaagatccacaccggagaacagccatataaatgcgaggagtgcggtaaggccttcaactactcctcccatttaaatacccacaagcgcattcatactaaggagcagccttataagtgtaaggagtgcggcaaggcctttaaccagtactcaaacttgacgactcataataaaattcacactggagaaaagctgtacaaacccgaagatgtgaccgtgattcttaccacgcctcagactttttccaacatcaagtag

SEQ ID NO: 247640 - DNA, 2412 bp, Artificial Sequence
  Description of Artificial Sequence: Synthetic coding sequence
atggatgtggcgatagaattctgtctggaagagtggcagtgcctcgatattgcccaacagaacctgtatcgcaatgtcatgctcgagaattacagaaacttggtctttctgggtatcgcggtttccaaacccgacctgattacctgcctggaacaagaaaaggagccatgggagcctatgaggaggcatgaaatggtcgccaagccacctgtcatgtgcagccatttcactcaagatttttggcctgagcaacatatcaaagatccctttcagaaggctactcttcgtagatacaagaattgtgaacataagaacgtccatctgaagaaggatcacaaaagtgtggatgagtgtaaggtccacaggggaggatataatggctttaaccagtgtctgccggcaacccagtcgaagatcttcctgttcgacaagtgtgtgaaggcatttcataagtttagcaattccaaccggcataagattagtcacactgagaaaaaactgttcaagtgcaaagagtgcgggaagtcattctgtatgctccctcatcttgcccaacacaagattatccacacccgcgtcaatttctgtaaatgtgagaagtgcgggaaggcttttaattgccccagcatcatcacgaaacacaagcggatcaatactggggagaaaccttatacctgcgaagagtgtggcaaagtcttcaattggagcagtcgacttaccactcataagaagaactacacaagatacaagctgtacaaatgcgaagagtgcggcaaggctttcaacaagtcttctatccttaccacccacaaaatcatccgtaccggagagaaattctataagtgtaaggagtgtgctaaagcttttaatcaaagctcaaatctcactgagcataagaaaattcatccaggcgaaaagccatataaatgcgaagagtgcgggaaagcattcaactggccatcaactctgacgaagcataaacgcattcatactggagagaagccgtacacctgtgaagagtgcggtaaagcctttaaccagttttcaaatctgacaactcacaagagaattcatactgccgaaaaattttataagtgtaccgagtgtggcgaggcttttagcagaagctctaacctgacgaagcataagaagattcacaccgaaaagaaaccatacaagtgcgaggagtgcggaaaagcttttaaatggagctccaaactgaccgagcacaagctgacgcacaccggtgagaaaccttacaagtgcgaggaatgcgggaaagctttcaactggcctagtacactgaccaagcataaccgcatacacacaggcgaaaagccctacaaatgcgaggtctgtgggaaggctttcaaccaattctccaaccttaccactcacaagcggatccatacagctgagaagccatacaaatgtgaggaatgcggaaaggccttttcacggtcgtccaacctgactaagcacaagaagattcatatcgaaaaaaagccctacaagtgtgaggagtgcgggaaggctttcaaatggtcgagcaagctgactgagcacaagattacccatacaggcgagaagccttacaagtgcgaggagtgtgggaaagcgtttaaccattttagtatcttgacaaaacacaagcggattcatactggagaaaagccatacaaatgtgaagagtgcggaaaagccttcacgcagtcgtccaatctgactacccacaaaaaaatccatacgggagagaaattctacaagtgcgaagagtgcggtaaggccttcacacagtcatccaatcttacaacacacaaaaagatccatactgggggaaaaccttataaatgcgaagagtgtggtaaggcattcaatcagttttcgaccttgaccaaacacaagataattcacactgaggagaagccctacaagtgtgaggaatgcgggaaggcctttaagtggagcagtacactgaccaagcataagataatccacaccggggaaaagccatacaagtgcgaggaatgcggaaaggcgtttaagctgtcatctacgctcagtacgcacaagatcattcatacaggggaaaagccctataaatgcgaaaaatgtggcaaggcttttaatcgcagcagtaatcttattgagcacaaaaaaatccatactggcgagcagccctataaatgcgaagagtgtggcaaagcatttaactactctagccatctgaacacccataagcgtatccatacaaaggagcagccttacaaatgcaaggagtgcggcaaggccttcaaccagtacagtaacctcacaacacacaacaagattcataccggggaaaagctatacaaacccgaggatgtaactgtgatactaaccacgccccaaactttcagtaacatcaaatag

SEQ ID NO: 247641 - DNA, 1713 bp, Artificial Sequence
  Description of Artificial Sequence: Synthetic coding sequence
atggaaaacttgaagtccggtgtgtatccgctaaaggaagcctccgggtgtcctggagccgatcggaatttgctggtctacagtttttacgaaaaaggcccactgacctttagagacgtggctatagagttcagcctggaagagtggcaatgtctagacaccgcccagcaggacctctatcgcaaagtgatgcttgaaaactacaggaatttggtgttcctggctggcattgccgtgagcaagccggatctgatcacatgcctcgaacaggggaaagaaccatggaatatgaagcggcatgcaatggtggatcagccccctgtcacctactctcattttgcccaagatttatggccagagcaaggaatcaaagactcttttcaggaagtgattctgcggagatacgggaagtgtggccatgaggatcttcaactgcgcacgggctgtaaatccgtcgacgagtgcaacctccataaagagtgttatgacgagctgaaccaatgcctaaccactacacaatcggaaatcttccaatacgataaatacgtgaacgttttttacaagttctccaaccctaacatccagaaaataaggcatacagggaagaagccttttaagtgcaaaaagtgtgacaagagcttttgtatgctgttgcatctcacacagcataagcgcatccacatccgagagaacagctatcaatgtgaggaatgcggtaaggttttcaattggttctctaccctgactcgtcatagaagaattcacactggcgagaagccttacaagtgcgaacagtgcggaaaagcattcaagcagtctagtacactgaccacacacaagattatacacacaggtgagaagccatatcggtgtgaagaatgcggaaagaccttcaatcgaagctctcatcttactacacataagcggattcacactggggaaaagccctatcgctgcgaagagtgcggaagggcctttaaccgcagctcacacctcaccacacataagatcatacatacaggggagaagccctataagtgcgaagaatgtgggaaagctttcaatcaaagcagcacactaaccacccataaaatcattcatgccggagaaaagccttacaagtgcgaggaatgcggaaaggctttctaccggttctcatatctgaccaagcataaaataatacacaccggggaaaaattctacaagtgcgaggagtgcgggaaggggttcaactggagcagcactctaacgaaacataaaagaatccacactggagagaagccctataagtgtgagcagtgtgggaaggctttcaacgagagtagtaacctaaccgcacacaagattattcataccggggaaaaaccttacaagtgcgaagaatgtgggaaagcgttcaatagatctccgaaactgacagcacataaggtcatccatagtggagagaaaccatacaaatgtgaggaatgcgggaaggcttttaatcaattctccaatctcactaaacacaagatcactcacattggcgatactagttataaatatctagaatgcgacaaggcattttctcagagctccaccttaactaagcacaaggtcatacatacaggggaaaagccctacaattgtgaagaatatggcaaggctttcaatcagagttcaaacctcatcgagcagagcaattcttactggagggaaaccctgcagatgtag

SEQ ID NO: 247642 - DNA, 1413 bp, Artificial Sequence
  Description of Artificial Sequence: Synthetic coding sequence
atggctgcaacactgcttatggccggaagtcaggcaccagtcacattcgaagacatggcaatgtaccttacccgagaggaatggcggccattagacgctgcccagagggacctatacagggacgtgatgcaagagaactatggaaacgtggtctctctggatttcgagattaggagcgaaaatgaagttaatcctaagcaggagatcagcgaagacgtgcagttcggcaccacctctgagaggccggcagaaaatgctgaagagaatcctgagtcggaggaaggcttcgaatccggcgaccggagtgaaaggcaatggggggatctaactgcagaagaatgggtgtcctatcctttgcaacccgttaccgatctgcttgtacataaagaggtccacaccggcatccgttatcacatatgtagtcattgtggtaaggccttctcccagatcagtgacctcaaccggcatcaaaaaacgcatactggagacagaccttacaagtgctacgaatgcgggaaggggtttagtcgaagcagccacctgattcaacaccagaggactcataccggagaaaggccatacgattgtaacgaatgcggaaagtcattcggaaggtcttcccacctgatccagcaccagaccattcacaccggagagaagcctcacaaatgtaacgagtgcgggaaatcattctgccggctgtcacacctcatacagcatcaacggacacatagtggtgagaagccatatgagtgcgaagagtgtggcaagtccttctcccggtcttcccatcttgctcagcaccagaggacccacacaggcgagaaaccatatgagtgtaacgagtgcggcaggggattctcagaaagatccgatctgattaagcattaccgcgttcacaccggggaacggccttataagtgtgatgaatgcggaaaaaacttttcacagaacagtgacctggttcgccaccggagggcccacacaggggagaaaccctaccattgtaacgagtgcggcgagaatttcagccgcatcagccacctggtacagcatcagcgcacacataccggagagaagccctatgagtgtaacgcctgcggcaagagtttctcgcgatcttcacacctgattacccaccagaagattcacacaggcgaaaaaccttacgaatgcaacgagtgctggcgtagcttcggcgagcgcagcgacctcatcaagcatcagaggacccacaccggcgagaagccctacgaatgcgtgcagtgcggaaaggggtttacccagtcatccaatctcatcacccaccagcgtgtgcatactggagagaagccctacgagtgcacggaatgtgagaaatccttctctcgctcttctgcactgattaaacacaagcgcgtccacacagactag

SEQ ID NO: 247643 - DNA, 1413 bp, Artificial Sequence
  Description of Artificial Sequence: Synthetic coding sequence
atggccgctaccctcttaatggcgggtagccaggcgccagtgacattcgaagatatggccatgtacttaaccagggaggaatggagacccctggacgccgcacagcgcgatctgtaccgcgatgtgatgcaagagaattatggaaacgtggtgagccttgactttgaaatccggagtgagaacgaggtcaatccaaagcaggaaatttcggaagacgttcagtttgggactacgtcagagcgccctgccgagaatgcagaggaaaatccagaatccgaagaggggtttgagtctggagataggtctgagcgtcagtggggcgatttaaccgccgaagagtgggtctcgtaccctctccaacctgtgaccgatctgctggtccacaaggaggtacacacaggtatcagatatcacatctgctcccattgcggcaaagccttctctcaaatctctgacctcaacaggcatcagaagacacacacaggtgacaggccatacaaatgttatgagtgcggcaagggatttagccgcagcagtcacctgatccaacatcaacggactcacaccggcgaacgcccttatgactgtaacgaatgcggtaaatcttttggtcgaagcagtcacttaattcagcaccagactatccataccggggagaagccccataaatgcaatgagtgcggcaaatctttttgccgtctttctcacctgattcagcatcaaaggacccatagtggggagaagccctatgagtgcgaagagtgtgggaaaagcttctcccgcagttctcacctcgctcagcaccagcgtacccataccggagagaagccttacgaatgtaacgagtgtgggagaggttttagcgaaaggtctgacttaattaagcactatagggtccacacaggagaaagaccgtacaagtgtgatgagtgcggaaaaaacttttcccagaacagcgatctggtgcggcaccgacgcgctcacacaggggaaaaaccttatcattgcaatgagtgcggcgagaactttagtaggatctcgcacctggtacagcaccagcgcacccataccggcgagaaaccttacgagtgcaacgcgtgcgggaagagctttagccgttcatctcatctgattacccatcagaagattcacaccggagagaaaccttatgagtgtaacgaatgctggaggagtttcggagagaggtctgacctgatcaagcatcagcggacacacacaggggagaaaccgtatgagtgcgtacagtgcggtaagggattcacacagtctagtaatctgatcacccaccagcgcgtccataccggtgagaagccttatgagtgtaccgaatgtgagaagagcttttcccggtcctccgcactaatcaaacacaagcgggttcacacagattag

SEQ ID NO: 247644 - DNA, 909 bp, Artificial Sequence
  Description of Artificial Sequence: Synthetic coding sequence
atggcagccactcttcttatggctggctctcaggctcccgtgacttttgaggacatggccatgtatctgacaagggaggagtggagacccctagacgctgcacagcgggatctgtaccgcgacgtgatgcaggagaattacgggaatgttgtgtctctcgacttcgagattcggtcggaaaacgaggtcaacccaaagcaggagattagtgaagacgtgcagtttggaactacttctgaaagacccgctgaaaacgcagaagagaatcctgagtccgaagaaggtttcgaaagtggagacagatccgagcgtcagtggggggatctgacagccgaagaatgggtgagctaccccctgcagcctgtgacggacctcttggtgcataaggaggtccataccggcatccggtaccatatctgctcccattgcgggaaagccttttctcagattagcgaccttaacagacatcagaagacccataccggtgatcggccttataagtgctacgagtgtggcaagggcttctcaaggtcaagccatctgattcaacaccagcggacccacaccggagaaagaccttacgattgcaacgagtgcggcaagtcatttgggaggtcttctcacttgattcaacatcagactatccataccggcgagaagcctcacaagtgtaatgagtgtgggaagtccttttgccgcctgtcacacttgatccagcatcagcgcacacatagcggggaaaagccgtatgagtgcgaggaatgcggcaagagcttctcgcgctccagccatctcgcccaacatcagcggacacataccggggaaaagccttatgagtgtacggagtgtgaaaagtcattttcgcgatctagcgccctcatcaagcataaacgcgttcatactgactag

SEQ ID NO: 247645 - DNA, 1848 bp, Artificial Sequence
  Description of Artificial Sequence: Synthetic coding sequence
atggacagcgtggcattcgaagacgtggctgtgaatttcactcatgaggaatgggccttgcttgggccttcacagaagaatctttatcgcgatgtcatgcgtgagaccatcagaaacctgaactgtattggaatgaagtgggaaaaccagaatatcgatgatcagcatcagaatcttcgaaggaaccctaggtgcgatgtggttgaaaggtttgggaagtcaaaagatggcagccaatgcggggagacactgagtcagattcggaattcaatcgtaaacaaaaacacaccagctcgggtggatgcgtgtggcagctccgttaacggggaggtgataatggggcactcttccctgaactgctatatccgtgttgataccggacataagcatagagagtgccacgaatacgctgagaagtcctatacacataaacaatgcgggaagggcctgtcatacaggcattctttccagacttgcgaaagacctcacactggcaagaagccttatgactgcaaagagtgcggaaagacattctcctctcctggcaacctccgccgacatatggtcgtcaaggggggagacggtccatacaagtgcgagctgtgcggcaaagcgttcttttggcctagcttgttgagaatgcacgaacggactcatacgggggaaaagccttacgagtgcaaacagtgcagtaaagccttcccagtctacagctcttatttgcgccatgagaagattcataccggagagaaaccctatgaatgtaagcagtgctccaaggccttcccggactactcttcctacttgagacatgaacggactcatactggcgagaaaccgtacaagtgtaaacagtgtggaaaagcctttagtgtgagcggatctctgagagtccacgagaggattcacacaggggaaaagccatacacttgcaagcagtgtggcaaggcattctgccacctcggatctttccagcgccacatgattatgcactcaggcgacgggcctcataaatgcaaaatttgtggcaagggcttcgatttcccagggagcgctaggatccatgaaggtacccacacactcgagaaaccgtacgagtgcaaacagtgcggtaagctgttaagtcatagatcgagctttcggcgacatatgatggctcatactggagatggcccacacaagtgcacagtgtgcggcaaagccttcgacagccctagtgtgttccagcgccacgagaggacacacacaggggagaagccctacgaatgcaagcaatgtggaaaagctttcagaactagcagctcactccgtaaacatgagacaacccacacaggagaacagccttacaaatgtaaatgtggcaaggccttctctgatctgttctctttccagagtcacgagacgacccactcggaggaggagccatatgagtgcaaagagtgcgggaaggctttctcatccttcaaatatttctgtagacacgagcgcactcattccgaggagaagagttacgaatgccagatttgtggcaaagcgttctcccgctttagctatctgaaaacccacgagagaacacatactgcggagaagccctacgagtgtaagcaatgccggaaggccttcttctggccttccttcctgctacggcatgagcgaacgcatacaggcgaaaggccctacgagtgcaaacactgtgggaaggccttctctaggtcgtcattttgtagagaacacgagcgcacacatacaggggaaaagccttacgagtgtaaagagtgcgggaaggcattctcctcgctgagctctttcaataggcataagcggacacactggaaagatattctgtag

SEQ ID NO: 247646 - DNA, 1992 bp, Artificial Sequence
  Description of Artificial Sequence: Synthetic coding sequence
atggctctctgctacggaaccttttgggggtacccaaaaatgctagaagctgccaacttaatggaaggtctcgtggacatcggaccgtgggtaactcttcctcgaggccagccagaggtgctcgaatggggacttccaaaagatcaggactcggtggccttcgaagacgtggcagtgaactttacccacgaggagtgggctctccttggtccatctcagaaaaatctgtaccgcgatgtgatgcgcgagactattcgcaatcttaactgtattggaatgaagtgggaaaaccagaacatagatgatcagcaccagaacctgcgtcggaatccccgatgcgacgtggtggagcggtttgggaagagcaaggatggctctcagtgcggggaaaccctgtcccagattcggaacagcattgtcaacaagaacaccccagccagagttgacgcctgtggttcctccgtgaacggggaggttattatgggccattcgtctcttaactgttacattcgcgttgatacagggcataaacatcgtgaatgccatgaatacgctgagaaatcatatacccacaagcagtgtggaaaaggcctgtcttacaggcatagctttcagacatgcgaacgtcctcacacaggtaaaaaaccatatgactgcaaggagtgcgggaaaaccttttcatctccgggtaaccttcgtaggcacatggtcgtcaaagggggagatggaccctacaaatgcgaactgtgtggtaaagctttcttctggcccagccttctgagaatgcatgaacgcacccataccggggagaaaccttacgagtgcaaacagtgctccaaggccttcccagtttactctagctatctcagacatgaaaagatccacacgggagagaaaccctacgagtgcaagcagtgtagcaaggcttttcccgattattccagctatctccggcatgaacggacgcacaccggcgaaaaaccctacaagtgcaaacagtgtggaaaagctttctctgtgtctgggtccttaagggtgcatgagaggatccacaccggagagaaaccttacacgtgtaagcagtgtggtaaagctttttgtcacctgggaagttttcaaaggcacatgattatgcattcgggcgatggaccacataaatgtaagatttgcggtaaaggattcgacttccccggtagcgccagaattcatgagggtacgcacacactcgaaaagccctacgagtgtaaacagtgcggcaagcttctttctcaccggagcagctttaggcgacacatgatggcccacacaggggacggcccacataagtgtactgtctgtggtaaagcctttgacagcccttccgtttttcagagacatgaacgcacccacactggggagaagccttatgagtgcaagcagtgcgggaaagcgtttcgtacgagttctagtttaaggaaacacgagactacgcacaccggagaacagccgtacaagtgcaagtgtggtaaagcctttagtgatctgtttagctttcaaagccatgaaacgacacatagcgaagaagagccatatgagtgcaaagaatgtggcaaggctttcagtagtttcaagtacttttgccggcacgaacgcacacactctgaagaaaaatcctatgaatgtcagatttgcgggaaggccttttctcgcttcagttacttgaaaacccatgaacgtacccacacagccgaaaaaccctatgagtgtaagcaatgtaggaaagcgttcttttggccctcatttcttctgcgccatgaaaggacgcacacaggggaacgcccttacgagtgtaaacattgcggaaaggctttctcaaggtcgtctttctgcagggaacacgagagaacgcacactggtgagaagccgtatgaatgtaaagaatgtggaaaggccttcagctccctgagctcgtttaacagacacaaaagaacccattggaaggacattctatag

SEQ ID NO: 247647 - DNA, 1914 bp, Artificial Sequence
  Description of Artificial Sequence: Synthetic coding sequence
atggccctttgttacggtactttctggggataccctaaaatgttggaggccgctaatctcatggagggcctggtggacattgggccttgggtcaccctgccgcgaggccagccagaggtactcgagtggggccttcctaaggaccaagacagcgtcgccttcgaggatgtggctgttaattttacccatgaagagtgggcgctgcttggaccatcacagaaaaatctttacagggacgtgatgagggagaccattcgtaatctgaattgtatcgggatgaaatgggaaaaccagaacatcgacgatcaacatcagaatctgcggcgtaacccaaggtgcgacgtcgtagagcgtttcgggaaaagcaaggacggcagccagtgcggagaaaccctgagccagataaggaactcaattgttaacaagaatactccggcaagagttgacgcttgtggtagctccgtgaatggtgaggtgatcatgggacattcttcactgaactgttatattcgcgtggataccgggcacaaacaccgggaatgccacgaatatgctgagaagtcttacacccataaacaatgtgggaagggactgtcgtaccgacactcattccagacatgcgagcgccctcatactggaaaaaagccatacgattgtaaggagtgcggcaagaccttctcgagcccaggcaatttgcgacgccacatggtggtaaagggcggagacggaccctacaagtgtgaactctgcgggaaggcattcttttggccttcactgttgcgtatgcacgaaaggacacacacaggtgaaaagccatatgagtgcaaacagtgcagcaaagcctttcctgtgtatagctcttacctgagacatgagaaaattcacactggggaaaaaccttatgaatgcaaacagtgttccaaggccttccccgactattcttcctatctgcgacatgaacgcacacataccggcgagaaaccctacaaatgcaaacaatgcgggaaagccttctctgtatccggttctttgagagttcatgagagaattcatacgggggagaaaccctacacgtgcaaacaatgcggcaaggctttctgccacctaggttccttccaacgccatatgatcatgcactccggtgacggccctcacaagtgcaagatctgtggtaagggattcgattttcccggaagcgctaggatccacgagggcacccatacgcttgagaaaccatacgagtgtaagcagtgcggaaaacttctgtctcatcgctctagttttcggcgacacatgatggcccatacaggagacgggcctcacaagtgtaccgtgtgtggaaaggcattcgactccccaagcgttttccagcgacacgagcggacccataccggcgagaagccatacgaatgtaagcagtgcgggaaagccttccgtacctcttcatcactgagaaagcatgaaactacacatacaggggagcagccatacaaatgtaagtgcggcaaggcgttcagcgatctgtttagcttccaaagccacgagactacacacagcgaggaggagccatatgaatgtaaggagtgtggaaaggcattctcttcgttcaaatatttctgccgccacgagaggacccactctgaggaaaagtcttacgagtgccagatttgcggaaaggcattctctcggttttcatatctgaagactcacgagaggacgcatacagctgagaaaccatacgaatgcaagcaatgtcggaaagcattcttctggccatcatttctgctgagacatgaacgtactcacaccggagaacgaccttacgaatgtaaacactgtggtaaggcgtttagccgcagttcattttgccgtgaacacgaaagaacccataccggggagaaaccatacgaatag

SEQ ID NO: 247648 - DNA, 1770 bp, Artificial Sequence
  Description of Artificial Sequence: Synthetic coding sequence
atggatagcgttgcatttgaagatgtggccgtcaacttcacccacgaggagtgggcactattgggaccttcccagaaaaatctgtaccgggacgtgatgagagaaacgattcgcaatttgaattgcatcggcatgaaatgggaaaatcaaaatattgacgaccaacaccaaaatctgcgaagaaatccacgctgcgatgtcgtggagaggttcggtaagagcaaagatggcagtcagtgtggcgagaccctatcgcagattagaaacagcattgtaaacaagaatacaccagcacgagtcgacgcttgtggctccagtgttaacggggaagtgatcatgggtcatagctcgcttaactgttatatccgggtcgacacggggcataagcaccgggagtgccacgagtatgctgagaaaagttacacacataagcagtgcggaaaggggctgtcatacagacattcctttcagacttgcgaacggccacacactggcaagaaaccctacgattgtaaggagtgcgggaaaactttcagcagcccgggaaatctacgcagacacatggtggtgaagggtggggatggtccttacaaatgcgaactgtgcggtaaggccttcttttggccctccctgttacgaatgcacgaacgtacgcacaccggtgaaaaaccctatgaatgtaaacagtgttctaaggctttccctgtctatagtagctatctgagacacgagaaaatacacacaggcgagaaaccatacgagtgtaagcagtgcagcaaagccttccccgactattcttcatacttacgccatgaacggacacacacaggggagaagccatacaaatgcaagcagtgtggtaaagcattttcagtgtctggcagcctcagagtccatgagcgcatccataccggggaaaaaccatacacttgcaagcaatgcggaaaagctttttgccatcttgggtcctttcagcggcacatgatcatgcacagcggcgacggcccacataaatgtaagatctgcggcaaaggcttcgatttccccggatccgctcggattcatgagggtacacatactctggagaagccttatgaatgtaagcagtgcggtaagcttcttagtcaccggagctcttttagacgacacatgatggcgcacactggcgatggaccccataaatgtacagtctgtggtaaggcgtttgacagtccgtccgtgttccagcggcacgagagaacacataccggcgaaaagccttacgaatgtaagcagtgtggaaaagcctttcggaccagctcttctctgcggaaacacgagaccacacacaccggggaacagccgtataagtgtaagtgcggcaaagcatttagtgatttatttagttttcagagtcatgaaaccactcatagcgaagaggaaccatacgagtgtaaggagtgtggaaaggccttctccagcttcaagtacttctgcagacatgaacgcacgcacagcgaggaaaaaagctacgagtgtcagatatgtgggaaggccttttcccgcttcagctacctcaagacccacgaacgcactcatacagccgagaaaccgtacgaatgtaagcagtgtcgaaaagccttcttttggcctagttttctgctcaggcacgaacggacccatactggcgagcgcccttacgagtgtaagcactgtggcaaggctttctcccggtcttccttctgtagagaacatgagagaactcacacaggcgagaagccctacgaatag

SEQ ID NO: 247649 - DNA, 1623 bp, Artificial Sequence
  Description of Artificial Sequence: Synthetic coding sequence
atgggaatcgtggagaaggcttcctctagctccgactctgtaacatttgaagacgtagccgtaaactttacgcaggaggagtggaccctgttagaccccagccagaagaaactgtacagagatgttatgtgggaaacattcagaaatttggccacaatcggcaccaagcaaaaagaatggaatatcgaggaacagtataaaaatcagggcaggaacctcagaaatcatatggttgaacggctgtgcgaatccaaggaaggctctcacggtggtgaaggcttctcgcagatcgcaaacctgagtcttaacaagaagaccccctccggaggcaaactgtgggaatctagtgtgtgcggcaaggtgcttagccatcattcctccctgaaccgccatattcggtcatataccaggcacaaactgtataagtgtcaggaatatggtgagaaaccttataagtgcaaaaagtgcggaaaacccttcagctacttgcagagcttcaagaaacacaaacggactcattcagctgggatagtgtataagtgcaaagcctgcggaaaagcattttcctgccagagaagcttccagattcacggtcgcacccacactggggataaaccttttaagtgcaaggagtgcggaaaagcgtttcgctaccaccaaagcgcacaaaagcacgagaaggctcacacaggcgaaaaaccttacaagtgcaaggaatgtggcaaaccgtttatttatagacacagcgctcgtgcacacgagaggaatcataccgtgcagaaacgatacgagtgtaaacagtgtggcaaaacgtacatctcctctgtcggcttccaggcccacgagcgcacccacaccggtgagaagccctacgaatgcaagaaatgcggtaaggtcttcgtataccacaatagtgcccagagacacgaaaagacacacactggcgagaaaccctacaaatgcaaggagtgtggcaaagcattctcgtatcattgtacggcccagaagcatgagagaaaccacacggctcagaaacactacgagtgtaaactgtgcggcaagacgtaccttagccctctagggttccaggctcatgaaagcacacacacaggggacaagccctttgaatgcaaaaagtgcggaaaggcctttcgttattactacagtgcgcagcggcacgaaaggactcacaccggagagaaaccttataaatgcaaagagtgtggaaaggccttctattgttgttcatcagcccgacgacacgagaggatgcacactgctaagaaacagtacgaatgcaagaaatgcgggaagacatatatcaccctagccggtttccagatccatgaacggactcatacaggtgaaaaaccttacgagtgtaagcaatgcggaaaagctttcagctctagctcttacatacatatccatgagagaatccataccggggagaagccctacgagtgcaaagagtgtggcaagcctttctcgttcctcactggatttagagtccatatgaggatgcacacaggcgagaaaccctataagtgtaaagattgtggcaatgccttcatctggagagcctccctccagtatcatgttaagaaagtccatgctgagtag

SEQ ID NO: 247650 - DNA, 1848 bp, Artificial Sequence
  Description of Artificial Sequence: Synthetic coding sequence
atggacagtgtggcttttgaagatgtagcggtaaacttcacccatgaagaatgggccctgcttgggccaagccaaaagaacctgtatagagacgtcatgcgggagaccatcagaaatttgaattgtatagggatgaaatgggagaatcaaaacattgacgaccaacatcagaatttgcggagaaatccgagatgtgacgtggtggaaaggttcggaaaatccaaagatggcagtcagtgcggcgagactctgtcacagatcagaaactcaatagttaataaaaatacacccgctagagtcgacgcatgcggatcgagcgttaatggggaagtaatcatgggacactctagtctgaactgctatatccgggtcgatactggtcataagcatcgggaatgccacgagtacgccgaaaaatcctacactcacaaacaatgcggcaagggactgtcttacaggcattcttttcagacatgtgaaagaccccacacgggcaagaaaccctacgactgtaaagaatgcggcaagactttttccagccccggtaatctgcggagacatatggttgttaaaggcggtgatggcccatataagtgtgaactgtgtggtaaggctttcttttggcccagcctcctacgaatgcatgagagaacacacaccggcgaaaagccctatgagtgcaagcagtgttccaaggcgtttccagtctattctagctacttacgtcatgaaaaaatccacacaggcgaaaagccttacgagtgcaagcagtgcagtaaggcattccctgactatagtagctatctcaggcatgagagaacccacacgggcgaaaaaccctacaagtgcaagcaatgtggtaaggccttcagcgtgagcggttccctacgggtgcacgagagaatccataccggcgagaaaccatatacctgcaaacagtgtggaaaggccttttgccacctgggaagtttccagcggcatatgatcatgcattctggtgatggaccccacaagtgcaaaatctgtggcaaggggttcgattttccaggctctgcgcgtatccatgaaggtacccatactttggagaagccctacgagtgcaaacagtgtggaaaactgcttagtcatcggagttccttccggagacatatgatggcacacactggagatggccctcacaagtgcacggtgtgcggcaaggcctttgactctcccagtgtgtttcagcgtcatgaacgtacccacacgggcgagaaaccatatgagtgcaagcagtgcggcaaggcatttaggacatcttcctctctccgcaaacatgaaaccacgcacaccggggagcaaccctacaaatgcaaatgcggcaaagccttttctgatctgttcagtttccaaagtcatgaaacgacccactctgaggaggagccctatgagtgcaaagaatgcgggaaagcattttcctcatttaagtatttctgtagacacgaacggacgcattcagaagaaaaaagctatgagtgccaaatctgtggtaaggcattcagcaggttttcctatttgaaaacgcatgagcgcacacatacagccgaaaagccttacgaatgcaaacaatgtagaaaggcatttttttggcctagctttctcctgaggcatgagaggacacatacaggggagcggccttacgagtgtaaacattgcgggaaggcattttcaaggagcagtttttgccgtgagcacgaacggacacataccggagaaaaaccttatgagtgtaaggaatgcgggaaagctttctcttccctgagcagcttcaatcgccacaagcggactcactggaaggacatcctttag

SEQ ID NO: 247651 - DNA, 984 bp, Artificial Sequence
  Description of Artificial Sequence: Synthetic coding sequence
atggaggtggccgtaccagttaagcaggaggcagagggtctggctctggactcaccctggcataggttcaggaggtttcaccttggtgatgcccctggccctcgggaggccctgggcttactccgcgcactctgtagggattggctacgaccagaagtgcacacaaaggagcagatgctggagcttctggtgctggagcagttcctgagcgcattgccggcagacactcaggcttgggtctgttctcgccaaccccagtcaggagaagaggccgtggccctcctcgaggaattgtgggggccagccgcaagtcccgatggatctagtgcgactagagtaccgcaggacgtcacacaagggccaggcgcaacgggaggcaaagaggactccggcatgatcccgctcgcgggtactgcccctggcgctgaggggcctgccccaggtgattcacaggcggttaggccttataaacaggaaccctcctcccccccattggcccctgggctccccgcattcctggccgcacccggaactaccagctgcccagaatgcggaaagaccagcctcaagcctgcccacttgctacggcacagacagagtcactctggtgaaaagccccacgcgtgcccagagtgtggcaaggccttccgtcggaaggagcacctgcggagacaccgggacacgcaccctgggtcacctggaagtcccggtcccgctctcagacccctacccgcaagggagaagccacatgcctgttgtgagtgtggtaagacattctattggagagagcacttggtgcgacataggaagacccacagcggagccaggcccttcgcttgctgggagtgcggcaaggggttcggcaggcgggaacacgttctaagacatcagaggatccacggccgagccgcagcttccgcccagggagccgtggcccctgggcctgatggcggtggcccattccctccttggcctttgggctag

SEQ ID NO: 247652 - DNA, 1557 bp, Artificial Sequence
  Description of Artificial Sequence: Synthetic coding sequence
atggctgtcgcgctaggttgcgccattcaggcaagcctaaaccagggatccgttttccaggagtacgatactgactgtgaagtattcagacaaagatttaggcagttccagtatagagaagcagcaggaccgcatgaagcatttaacaagttatgggaattgtgttgccagtggctgaagccgaaaatgcgctccaaagaacagatactggagcttttagtgttggagcagtttttaaccatccttccgaccgaaatcgagacatgggtgcgggaacactgccccgagaaccgtgagagagtggttagcttaatcgaggacctacaacgagagctcgagatcccagagcagcaagttgacatgcacgatatgctactggaggagctggccccagtggggaccgctcatattcctcctactatgcaccttgagtccccagccttgcaggttatggggcctgcacaagaggccccagtggccgaggcttggattccacaggcaggccctccggagctgaattacggggctacaggagagtgccaaaattttcttgatcctggctatcctctgcctaagcttgacatgaatttcagccttgagaatcgagaagaaccctgggtaaaggagctccaggactccaaagaaatgaagcagttattggattctaagataggttttgaaatcggcatcgagaacgaagaggacacttccaaacaaaagaagatggagacgatgtatccattcatcgttacactggaggggaacgctctgcaggggccaatcctccagaaagattatgttcagcttgagaatcagtgggaaacaccaccggaagacctgcagaccgatctggcgaagctggtggaccagcagaatccaactctcggcgagacccccgagaattctaacctggaagagccactgaacccaaaaccacacaagaaaaaatcaccgggagaaaaaccgcacaggtgcccacaatgcggcaaatgtttcgctaggaagagccagctgaccgggcatcaaagaatccactccggtgaagagccccacaagtgccccgagtgtgggaaaagatttctgaggagctccgatctgtataggcaccagcggctacataccggtgagaggccttacgaatgtacagtctgcaaaaagaggtttactaggcggtctcacctgattggccaccaacgcacacactctgaggaagagacatataagtgtctggaatgcggtaaaagcttttgtcatgggtcctctcttaaacgccatctgaaaactcacactggagaaaaaccacacaggtgccacaactgcggaaaatccttttcacgcttgactgccctgacgctgcatcagagaacacatacagaagagcgaccatttaagtgtaattactgcggcaagtcattccgacagaggccttccctcgtgatccacctcaggattcacacgggcgagaagccttacaaatgtacccattgctccaagagcttccgccaaagggctgggctgataatgcaccaggttacacactttaggggcttgatttag

SEQ ID NO: 247653 - DNA, 384 bp, Artificial Sequence
  Description of Artificial Sequence: Synthetic coding sequence
atggccgttgctctcggctgcgccatacaggccagcctgaatcaaggatctgtgttccaagaatatgatacagattgcgaggtgtttaggcagaggttccgtcagtttcagtatcgcgaagccgctgggccacatgaggcctttaacaagctctgggaactttgttgtcaatggctgaaaccaaagatgcgaagcaaagaacagatcttagaactgctggttctggaacagttcctcacaatcttgcctactgagatcgagacctgggtaagggagcactgtccagagaaccgggaaagagtggtgtcacttatcgaagatctacagagggagttggagatccccgagcagcagacattcgccgcagagtacagccattattag

SEQ ID NO: 247654 - DNA, 495 bp, Artificial Sequence
  Description of Artificial Sequence: Synthetic coding sequence
atggctgttgcccttggttgcgctattcaagcctctttgaatcaggggtcagtgttccaggagtacgatacggactgtgaggtttttaggcagaggtttcgccaattccagtatcgggaggcagcaggacctcatgaggcctttaacaaactgtgggaactatgctgccagtggttgaagcccaaaatgcgctctaaagagcagattctcgagctgctcgtgctggaacagttcctgaccatcttgcctacagaaattgaaacttgggtgcgtgagcactgccccgagaatagggaaagagttgtgagtcttatcgaagacttgcaacgggaacttgaaatcccagaacagcaggtgcgaaaagagtgcggaatcttcgtgataggcccaaaggaggtagcagaggctgccggtacccggcctcacatctgcttatacgtaatcccacagcctcaggacttctcacgggtactttttctgtttctgttctgctag

SEQ ID NO: 247655 - DNA, 2049 bp, Artificial Sequence
  Description of Artificial Sequence: Synthetic coding sequence
atgactaagtcgaaggaggctgtgaccttcaaagacgtagctgtagtattcagcgaagaggagctccagctgttggaccttgctcagagaaaattatatagggatgtcatgctggagaacttccgaaacgtcgtgtcggtgggccaccagtcaacgccagatggattacctcagctcgaaagagaagagaaattatggatgatgaaaatggctacacagcgggacaacagtagcggcgcaaagaatctgaaggagatggaaaccttgcaggaggtaggcctcagatacctgccgcacgaggagctgttttgttcacagatatggcagcaaattaccagggaactcatcaaataccaggacagcgtcgtgaacattcagaggactggctgtcagctagagaagcgggacgatctgcattacaaggatgagggtttttctaaccagtcatcccatttgcaggttcatagggttcatacaggtgaaaaaccttacaaaggggagcattgtgtcaagagcttcagctggtcctcacacttacagatcaaccagcgagcccatgctggagagaaaccctataagtgtgagaaatgcgataacgccttcagaaggttctcatctcttcaggcccatcagcgggtgcactccagggccaaatcctacaccaacgatgcctcttataggtcattcagtcaaagatcacatctacctcatcaccaaagagtgcccaccggcgagaatccttataagtatgaggaatgcggtcggaacgtaggaaagtctagccattgtcaagcgccacttatcgttcacaccggggagaaaccttacaagtgtgaagaatgcggggtgggtttttctcagagatcttatcttcaagtgcacctgaaggtccacacaggaaagaaaccatacaaatgcgaggagtgcgggaagagtttttcttggagaagccgcctgcaagcccatgagaggattcatacaggagagaagccctacaaatgcaatgcttgcggcaagtcattttcctatagtagtcacctgaacatacactgtagaatccacaccggagaaaagccttacaagtgtgaagagtgtgggaagggcttcagcgtggggtctcacctacaggcccatcagattagccatacaggggagaagccttacaaatgtgaggagtgcggcaaggggttctgtcgcgctagtaacctgttagatcaccagcgaggccacactggcgagaagccctaccagtgcgatgcctgcgggaagggctttagtcgctctagcgattttaatattcactttagggtccacacaggggagaaaccttacaaatgtgaagagtgtggcaaaggcttctcccaggccagtaatttacttgcacatcagagggggcacactggtgagaaaccctataaatgcgggacatgcggcaagggtttctccagatcatcggacctcaacgtgcactgccgtatccacactggagagaaaccgtataagtgcgaaagatgcgggaaggctttctctcagtttagctcacttcaggttcaccagcgggtgcataccggcgagaagccatatcagtgtgcagagtgcggtaagggattttccgtcggctctcagcttcaagcccaccagcgttgccacacaggagagaagccataccagtgtgaggagtgtggcaaaggattctgcagagcaagcaatttcctcgcgcatcgcggagttcatacgggcgaaaaaccctatcggtgcgatgtctgcgggaaacgcttccgccaaaggagttacctgcaggcacatcagcgggtgcacacaggtgagcggccttataaatgtgaggaatgcggcaaagttttttcatggtcaagctacctccaagctcatcagcgcgtgcataccggcgaaaagccctataagtgtgaagagtgcggaaaaggtttttcatggtcctcttctctaattattcaccagcgcgtgcatgctgacgatgaaggggacaaggacttcccttccagcgaagattctcatcgcaagactcgctag

SEQ ID NO: 247656 - DNA, 1617 bp, Artificial Sequence
  Description of Artificial Sequence: Synthetic coding sequence
atgacaaagtccaaggaggccgttacatttaaagatgtcgccgtagtgtttagcgaggaggaactgcagctcctggatctggcccagcggaaactgtacagggatgtgatgctggagaacttccggaacgtggtttccgtgggacaccagtcaacccctgacggcctcccacaattagaaagagaggagaagctctggatgatgaaaatggcgacccagcgggacaactcttcaggggctaagaacctcaaagagatggagacacttcaggaggtcgggttgcgttatctcccacacgaagagctattttgcagccagatctggcagcagatcacaagagagttgatcaagtatcaggatagcgtcgtgaatattcaacgcaccggttgccagctggagaagcgggatgatctgcattacaaagacgagggtttctcaaatcagagctcccacctgcaggtgcaccgcgtgcataccggggagaagccgtataagggtgaacactgtgttaagtcattcagttggtcttctcatctccaaatcaaccagcgtgcccatgcaggagagaaaccgtacaagtgtgagaagtgtgacaatgctttccgacgcttcagttcattgcaggcacaccaaagagttcactcaagagccaagagttataccaacgacgcaagttatcggtcattttcccaacgttcccacctgccccaccaccagcgcgttccgaccggagagaacccgtacaaatacgaagaatgtgggagaaatgtcgggaaatcgtctcactgtcaggcacccctgattgtgcacaccggggagaagccatacaaatgcgaggaatgcggcgtgggattctcccagcgcagttacctccaggtgcacctcaaggttcacacgggaaagaagccgtacaagtgtgaagagtgcggcaaatccttctcttggagatccaggctgcaggcccatgagcgcatccacacaggagagaagccatacaagtgtaacgcttgtggaaagagtttcagctattcaagccacctgaatattcattgtaggatacacactggagaaaaaccctataagtgcgaagagtgtggcaagggcttttcagtggggtcccatttacaagcccatcagattagccacacgggcgagaagccatataagtgcgaggagtgtggcaaaggcttttgccgcgcaagtaatctgctggaccaccagcgcggtcatacgggagagaagccctatcagtgtgacgcttgcggaaaaggcttttctcgctcctccgatttcaacattcacttccgggtgcataccgggaagaatcccatcaacgtaaggtccgtggcaagagcctccgccagaccacagattttttggcccatcaaggaggctacactcgaaaggaatccaaccaacgtcgttcacgtgggtagagctagcgtgggcgcacagatactaatgtacaccgtggaaagtacccaggaacgaaatcccattaatgcaagaggggtggtgcgacctagtgtgagcagtcctgccttccgttgcatcagggagtttacccttgagcggaaccacataagcgttcagtctgtcggcagggcgagtgtgtag

SEQ ID NO: 247657 - DNA, 1689 bp, Artificial Sequence
  Description of Artificial Sequence: Synthetic coding sequence
atggcagccgcttggatggctcctgcccaggagtccgtcacttttgaggacgtggctgtgaccttcactcaggaggagtgggggcagcttgatgtcactcagcgagccctatatgtggaagtgatgctggaaacgtgtggcctgctggttgctttgggggacagcaccaagccggaaacagtagaaccaattccgtcacacctcgctctgcccgaagaagtctcactgcaggaacagttggcccagggagtccccagatactcctatctggggcaagccatggatcaggacggaccctcggaaatgcaggagtactttctgcggccagggactgacccccagtcagagaagctgcacgggaagatgtctctggaacatgagggcctggccactgctgacggtatttgtagcatgatgattcaaaaccaggtcagccccgaggacgctctgtacggcttcgactcctacggaccagtgactgactcactcattcatgaaggcgaaaattcttataaattcgaggaaatgttcaatgaaaattgttttctggtgcaacacgagcagatcctgcccagggtaaagccctatgattgcccagagtgcgggaaagcgtttggcaaatcaaaacatctgcttcagcaccacattatccacacaggagaaaagccttacaagtgcctggagtgcggaaaggattttaaccggaggtcacacctgacaagacatcaaaggactcacaatggggataagccttttgtatgctctgagtgcggaagaaccttcaacagaggatcacatttgacccgacatcagcgggttcatagcggggagaaaccttttgtttgtaatgagtgtggaaaggcgttcacatatagatctaatttcgtgctacacaataaatctcacaacgagaaaaagcctttcgcttgttcggagtgcggcaagggattctacgaaagcaccgctcttattcagcacttcatcattcacacaggcgagaggccattcaagtgcctggagtgcggtaaggcatttaactgcagatcccacctgaaacaacacgagcgcattcacaccggcgagaagccctttgtgtgcagccagtgtggcaaggcttttactcactactctacatatgttttacacgaacgggctcataccggagaaaagccattcgagtgtaaggagtgtggcaaggctttttcaattcgtaaagacctgatccggcattttaacatccatacaggtgagaagccctatgaatgcctccagtgcggaaaagccttcactcgaatgagtgggctgacgagacaccagtggattcacaccggcgagaagccgtacgtgtgcattcagtgcggcaaagcgttttgccgcacaacaaatctgattcgccacttttccatccatacaggagagaagccatatgagtgcgtcgaatgtggcaaagcgttcaaccggagaagccctctgactcggcaccagcggatacacaccgctgagaaaagccacgagcccatccagtcaggcaacgtgtcttgcgagagcacggaccttatccagcattctatcatccacactgagagcagtcccgtgagtgccgtgaacatggagaccccgtcaatagcagcgcactcaagttcccttgacatcaacggcttcatagtggaagagaccctgcccctgtag

SEQ ID NO: 247658 - DNA, 1566 bp, Artificial Sequence
  Description of Artificial Sequence: Synthetic coding sequence
atgttagagacttgtggccttctcgtggcactgggagattctacaaagcctgaaacggttgagccgatccccagccacctagccctgcccgaggaggtctcgcttcaggaacagctggcccaaggagtaccccgatactcttacctgggtcaggccatggaccaggacggacctagtgagatgcaagagtattttcttcgccctggtacggatccccaatcagagaagctgcatgggaaaatgtctctggagcatgaggggctggctactgctgatgggatctgctccatgatgattcaaaatcaggtttcgcctgaagacgcactttatggtttcgatagttacgggcctgttaccgattctctgatccacgaaggcgaaaactcctacaagttcgaggagatgttcaacgagaactgtttcctagtccagcatgagcagatactcccaagggtcaaaccttacgactgcccggagtgtgggaaagcattcggtaaatccaaacatcttctgcaacaccatatcatccacacaggagaaaaaccttataaatgtctcgagtgcggtaaagactttaatcgcagaagccatttgacaagacatcaacgcacccataacggagataaaccattcgtttgctccgagtgcgggagaacattcaacaggggctctcaccttacgcgccaccaaagagtccatagtggtgagaagcccttcgtgtgcaatgagtgtggcaaggcttttacatatcgcagtaactttgtgctgcacaacaaatctcacaacgagaaaaagccttttgcgtgctccgaatgtggcaagggcttttacgagtccacagcactgattcagcactttatcatccataccggggaacgtcctttcaagtgtctggagtgcggcaaagccttcaactgtaggtcgcatctcaagcaacatgagcggattcacacaggcgaaaaacccttcgtgtgtagccaatgcgggaaagcctttactcattactctacatacgtactacatgaacgcgctcacacaggcgaaaagcccttcgagtgcaaggaatgcggcaaggcgttctccatccgcaaggacctgatcaggcatttcaacatccatacgggggagaagccctacgaatgcctgcaatgcggtaaggcattcactagaatgtccggattgacccgccaccagtggatacacacaggggagaagccttacgtgtgtatccagtgcggcaaagccttttgcaggactacgaacctgattcgtcatttttccatccacacaggcgagaagccatacgaatgtgttgaatgtggtaaagcctttaatcggaggagccctctaactagacaccagaggatccacaccgccgaaaaatcccacgagcctatccagagcgggaatgttagctgcgagtccactgaccttatacagcattctattatacacaccgaatcttctccagttagcgcagtgaatatggaaaccccatcaattgcagcgcattcaagctcccttgacatcaacggctttattgttgaggaaactctccccctctag

SEQ ID NO: 247659 - DNA, 1623 bp, Artificial Sequence
  Description of Artificial Sequence: Synthetic coding sequence
atggcacatgaactcgtaatgtttcgcgacgtggcgatcgacgtgagccaggaagagtgggaatgtttgaacccagcacagcgcaacctgtacaaagaggtcatgctggagaactatagcaatctcgtgtcgttaggtctgagcgtaagcaaacctgcggtgatcagcagcctagaacagggcaaggagccctggatggtggtgcgcgaggagaccggcaggtggtgccccgacctggcctcccgtgatgagcctcagaaactgtccccaaagcgagacatctacgagactgagcttagccagtgggttaacatggaggagttcaagagtcactccccagagcgcagcatattctctgccatttgggagggcaattgccactttgagcagcaccaggggcaggaagaaggctattttagacagcttatgatcaaccacgagaacatgccaatcttttcgcagcacacgctgcttacccaggaattttatgaccgtgagaagatttccgaatgtaagaaatgccgtaagatcttctcctaccacctgtttttttcacatcacaagaggacccactctaaggaactgtcagagtgtaaggaatgcaccgagattgttaacacaccttgtctgttcaagcagcagacgatccagaacggggacaaatgtaacgaatgtaaggaatgttggaaggctttcgtgcattgcagtcagttgaaacacctgagaatccataacggcgagaagcggtacgagtgcaatgaatgtggaaaggcattcaactacggttccgaactgacacttcatcaacgcatccatacgggcgagaaaccctacgagtgcaaggaatgtggcaaggcattcagacagcggtctcagctcacacagcatcaaaggttgcataccggagagaagccttacgagtgcaagcagtgtggcaaggctttcatccggggattccaactcactgaacacctgcgcctccacaccggtgagaaaccctatgagtgtaaggagtgtggtaagactttccgtcacagatctcatctgacaatccatcagcggattcacaccggcgaaaagccctacgaatgtagggaatgcggaaaggctttcagctatcactctagttttagccatcaccaaaagatccatagcggtaagaaaccatatgagtgtcacgagtgtggtaaggctttctgcgacggactgcagctgacacttcatcaacggattcatacgggggagaagccttacgagtgtaaagaatgtggcaaaacatttagacagtgcagccacctgaagaggcatcaacggatacacaccggggaaaagccccacgaatgtatgatctgcggcaaggcctttcgcctacactcccacctgattcaacatcagcggatacacactggcgaaaaaccctatgaatgtaaagagtgcgggaaggcattcagctaccattccagcttctcgcatcaccagcggatacacagtggcaagaagccatatcagtgtggtaaggccttcaatcaccggctccagttgaatttacatcaaacactacacacaggcgagaaaccagtaagattcccacttctgccaccacacccctccttggcctcgtag

SEQ ID NO: 247660 - DNA, 741 bp, Artificial Sequence
  Description of Artificial Sequence: Synthetic coding sequence
atggtcgtgagggaagaaactggaaggtggtgtccaggcacatggaagacctggggattccacaacaattttctggataacaacgaagcaacagacatcaacgcagatctcgcctcccgtgacgaaccccagaaactcagccccaagcgagacatctacgaaaccgaactgagccagtgggtgaacatggaagaatttaaatcccattctccggagagatcaattttttccgctatctgggagggtaattgtcattttgagcaacaccaaggccaggaagaaggttactttcggcagctcatgatcaatcacgaaaacatgcccattttctcgcaacacaccctgctgactcaagagttctatgacagggagaagatcagtgaatgcaagaaatgccgtaaaattttcagttaccacctgtttttttctcaccacaaatgcagccatctcaaaaggcaccagcggatccataccggcgaaaagccgcacgagtgtatgatatgtggcaaggcattcaggctgcactctcatttgattcagcaccagcggatccacacaggggagaaaccttatgagtgtaaagagtgcggtaaggccttctcctaccatagctcgtttagtcatcaccagaggatccactccggaaagaagccatatcagtgcgggaaggctttcaaccaccgactgcaactcaatctgcaccaaacactccatactggagagaagcccgtaagattttag

SEQ ID NO: 247661 - DNA, 1692 bp, Artificial Sequence
  Description of Artificial Sequence: Synthetic coding sequence
atggctcatgaacttgtcatgtttagggacgttgcaattgatgtgtcacaggaagaatgggaatgcctcaatcccgcacagcgtaacttatacaaggaggtgatgttagaaaactacagtaatctggtcagcctcggccttagtgtgtctaagccagcagttattagttctctggagcagggaaaggagccatggatggtagtgcgggaagaaactggcaggtggtgcccgggaacctggaaaacttgggggttccataataatttccttgacaataacgaagctactgatataaacgctgatcttgccagtcgggacgagccacagaagctttctccaaaaagggacatttatgagacagagctgagccagtgggtcaatatggaggaattcaagtctcactctcccgaaagatccattttcagcgccatttgggagggtaactgccattttgagcagcatcagggccaagaagagggttacttcagacagctgatgattaaccatgaaaacatgcccatctttagtcagcacactctgttgacccaggagttttatgacagggaaaaaatttctgagtgcaaaaaatgcagaaagatcttctcttatcatctgtttttcagtcaccataaaaggacgcattccaaggagctgagtgagtgcaaggaatgtacagagatcgtgaacacgccctgtttgtttaaacagcagacaatccaaaacggcgacaaatgcaatgagtgtaaagaatgctggaaggccttcgtgcattgttcgcagctcaaacatcttagaattcacaatggtgagaagcgctatgagtgtaacgagtgcggcaaggctttcaactatggctcggagctgactctgcaccagcgtatccacaccggagaaaagccatatgaatgtaaggagtgtggaaaagcctttcgacaacgatcacagctcacgcagcatcaaaggttacataccggggagaaaccctatgagtgtaaacagtgcggaaaggcgtttatccgagggtttcagctgacagagcacctgagactacatacgggagagaagccctacgaatgtaaggagtgcggaaaaacattcaggcataggtctcacttaacaatacaccaacgtattcataccggtgaaaagccctatgaatgcagagaatgtggtaaagcgttttcgtaccattcttcattcagtcaccaccaaaaaatacacagcggtaagaagccttacgaatgtcacgaatgtggcaaagctttctgcgacggactccagctcaccttacaccaaaggatacataccggagaaaagccgtacgagtgcaaagagtgcgggaaaacattccgccagtgtagtcatttaaagcggcatcaacggatccacaccggtgagaagccgcacgaatgtatgatttgcggaaaggcttttaggctgcacagccacttgatccagcaccagaggatccacacaggtgagaaaccctatgaatgtaaagagtgcggcaaggcattctcttaccatagcagtttctctcatcaccagcgcatccattccggcaagaagccctatcagtgcggcaaagctttcaatcatcgattacagcttaatctccaccaaacactgcataccggcgagaagcccgtccgtttcccactcttacctccgcacccctctctggctagctag

SEQ ID NO: 247662 - DNA, 777 bp, Artificial Sequence
  Description of Artificial Sequence: Synthetic coding sequence
gaaaagcgttacgagtgcaacgagtgcggtaaagcattcaactacgggagcgagcttacattacatcagaggatacacacaggtgagaagccgtatgaatgcaaagaatgtgggaaggcttttaggcaaagatctcagctgactcagcaccagcggctgcacacgggagaaaagccttatgagtgcaaacaatgcggaaaagcattcattcggggattccagctgacagaacatctgcggctccacacaggtgaaaaaccttacgagtgcaaggaatgtggtaaaacttttcgacatcgttcccaccttactatccatcagcgtatccatacgggcgaaaagccatatgagtgccgggaatgtggaaaggccttctcctaccattcgagcttttcccaccatcagaaaattcacagcggcaaaaagccttacgaatgccacgagtgcggcaaggcattttgtgacggcttgcagcttacactgcatcagcgaatacatactggggaaaagccctacgagtgcaaggagtgcggcaagacttttaggcaatgctcgcacctaaagaggcatcagcgcatacatactggcgaaaaacctcatgaatgtatgatatgcggcaaggcattcagattacactcacacctgatccagcatcagcggatccacacaggcgagaaaccatatgagtgcaaagaatgcgggaaagccttctcataccattcgtccttcagccatcatcaaaggattcacagcgacgctaccacagccattagctag

SEQ ID NO: 247663 - DNA, 1311 bp, Artificial Sequence
  Description of Artificial Sequence: Synthetic coding sequence
atggaagagtttaaatcgcactctcctgagcgatccattttttcggccatttgggaagggaactgtcactttgaacagcaccagggccaggaagagggttattttcgccagctgatgattaatcacgaaaacatgcctatcttttcccagcatactctcctgacacaggaattctacgatcgagaaaagatctccgaatgcaagaaatgccggaagatcttctcttaccacttattcttctcccaccacaaacggacacacagcaaggaactaagcgagtgcaaggagtgtactgagattgtgaacaccccatgtctgttcaagcagcagaccatccagaacggcgataagtgcaatgagtgcaaagaatgttggaaggctttcgtccactgcagtcagctcaagcatttaagaattcacaatggagagaagagatacgagtgcaacgagtgcggcaaagcatttaactacggaagcgaactgactttgcatcagcggattcatacaggtgagaaaccctatgagtgtaaggagtgtgggaaagcttttagacagagatcacagctcacacagcaccagaggctgcataccggcgaaaaaccatatgagtgcaaacaatgcggaaaggcctttatcaggggattccagctgacagaacacctgcggctgcatactggcgagaaaccctacgagtgtaaagaatgcggcaagactttccggcatcgctcacacctgactatccatcagaggatccacacaggagagaagccctacgagtgccgtgaatgtggaaaggccttctcttatcatagctctttctcacaccaccagaagatccactctggaaagaagccatacgaatgtcatgagtgtggtaaggctttctgtgatgggctgcaactgaccttgcaccagagaattcatactggagaaaaaccctacgagtgcaaggagtgcggaaagacatttcggcagtgtagtcatctgaaacgtcaccagcggatccacaccggcgagaaaccacacgaatgcatgatctgtggcaaagcctttcgcctgcacagccaccttatccagcaccagcgcatccatactggcgagaagccttacgaatgcaaggaatgtggcaaggcctttagctaccattcatccttcagtcatcaccaacggatacattcgggaaagaaaccttatcagtgcggtaaagccttcaaccaccgcctgcagctgaacctacaccagactctgcataccggggaaaagcccgtaaggtttccattattgccccctcacccctctctggcaagctag

SEQ ID NO: 247664 - DNA, 1692 bp, Artificial Sequence
  Description of Artificial Sequence: Synthetic coding sequence
atggctcacgagcttgtgatgtttagagatgtggccattgacgtgtcgcaagaggaatgggaatgtctgaaccccgctcagagaaacttatataaggaagtgatgttagagaattactcgaacctggtctctctcggcctcagtgtgtccaagcccgcagtgatctcatctttagagcaaggcaaggagccctggatggtagtgcgggaggagaccgggagatggtgtccaggaacatggaaaacctgggggttccataacaatttcctggataataacgaggctaccgacatcaacgcggacttagccagcagagatgagccgcaaaaactgtcgccgaaacgggacatatatgaaacagagctgtcccagtgggtgaacatggaagaattcaaaagccactcccctgaaaggtcgattttctcagccatttgggagggcaattgccactttgaacagcaccagggccaggaggaggggtatttcagacagctaatgattaaccatgagaacatgccaatattctcccagcacacgctgctgacccaggaattctatgatcgcgaaaagatttccgagtgcaagaaatgcaggaagattttcagctaccacctcttcttctctcaccataaacgcacccacagtaaagagttgagtgagtgcaaggagtgcaccgagattgtaaatactccttgtctttttaaacaacagaccatccaaaatggcgacaagtgcaacgagtgcaaggagtgttggaaggcattcgtgcactgctcccaattaaagcatctccgtattcacaacggggaaaagcggtacgaatgcaacgaatgcggcaaggcatttaattacggatccgagcttacgctccatcaacgtatccacacaggcgaaaaaccctacgagtgcaaggaatgcggcaaggctttcaggcagaggagccagctgactcaacatcagcgactgcacacaggagagaaaccctatgagtgcaaacagtgcggaaaagccttcattcgtggtttccagctgaccgagcatctgaggctccacactggcgaaaagccctacgaatgtaaggagtgcggcaagacttttagacatcgaagccatcttactatacatcagaggatccatacaggtgaaaaaccctatgagtgccgggagtgtgggaaagccttttcgtaccattctagcttcagccaccaccagaaaatccattccggaaaaaaaccttacgagtgtcatgaatgtgggaaagctttttgcgacggtctgcagctaactctccatcagcggattcacactggtgagaagccttatgagtgcaaagaatgcggcaaaacctttcgccagtgctctcacttgaagaggcatcagagaattcacaccggtgaaaaaccgcacgaatgcatgatctgcgggaaggctttccgcctgcattcacacttgattcagcaccagcgcattcacaccggcgagaagccctacgagtgcaaggagtgcggcaaggctttctcgtatcatagctctttcagtcaccatcagaggattcacagcggcaagaagccttatcaatgcggcaaggcattcaaccatcgcctgcagttaaatctccaccaaacactgcataccggggagaagcccgtgcgctttccgctcctaccacctcacccctccttagccagctag

SEQ ID NO: 247665 - DNA, 1788 bp, Artificial Sequence
  Description of Artificial Sequence: Synthetic coding sequence
atgagggaaacacttgaagctcttagcagtcttggtttttccgttggacaacccgagatggcgcctcagagcgagccacgagaagggagccataacgcccaggagcagatgtccagtagtagagaagagagggcccttggtgtctgttcgggccatgaggcccctaccccagaggaaggcgcacacaccgaacaagccgaagccccttgcagggggcaggcttgctctgcccagaaagcgcagccagttgggacctgtcctggcgaggagtggatgatcaggaaggtgaaggtggaggacgaggaccaggaagctgaagaagaagtggagtggcctcagcatcttagcctgttaccatcgcctttccctgctcccgatctgggtcacttagctgccgcatacaagttagagcccggtgccccaggagcactcagcggtctagccttaagtggatggggcccaatgccagaaaagccgtatgggtgtggcgaatgtgagcgcagattccgggatcagctcaccctgcgcttacaccaacgcctgcaccggggtgaaggtccttgcgcctgcccggactgtggtcgctcattcacccagcgtgcccacatgctgctccatcagagatcacatcgaggcgagaggccctttccttgctccgagtgcgataagagattcagcaagaaggcccacctgacgcggcacttaaggacgcatacaggcgaaagaccctacccctgtgcagagtgcggcaagcgcttttctcaaaaaatacacttaggctctcaccaaaagactcacacaggagagcgtcctttcccttgtaccgagtgcgagaaaagattcagaaaaaaaactcaccttattcgccaccagcgcatccatacaggcgagagaccctatcaatgcgcccagtgcgcacgttcctttactcacaagcaacacctggtgcgccaccagagagtgcaccagacggccggtcctgccaggcctagtcctgactcctcagccagccctcacagcaccgcaccttctccgaccccctcctttcccggaccaaagccctttgcctgctccgattgtggtctttctttcgggtggaaaaagaaccttgcgacccatcaatgtcttcaccggagtgagggaaggccatttggatgcgatgagtgtgcactgggcgctacagtcgacgccccagctgctaaaccactggctagcgctcctggcggacctggctgtggtcccggatcagatcctgtggttcctcagagagctccaagcggcgagaggagctttttctgccccgactgcggcaggggcttttctcacggccaacacctggcacgtcacccgcgagtgcacacaggagaacgacctttcgcatgcacgcagtgtgaccggaggtttggcagtcgacctaatctggtggctcactcccgtgcccactcaggggcacgccctttcgcctgcgcacagtgcgggcgaaggttcagcagaaaaagccaccttgggcgtcatcaggctgtgcacacaggatcccgtccccatgcctgcgcggtgtgtgcacggtctttttctagtaaaacgaacctggtgcggcaccaggccatacacacagggagtaggccattttcgtgtccccaatgtggcaaaagtttttcccggaagacacacttggtccgccaccagttgattcacggcgaagcggcacatgcagctcctgacgccgcactggccgcacccgcatggtctgctccacccgaagtggcgccaccccctctcttcttctag

SEQ ID NO: 247666 - DNA, 11778 bp, Artificial Sequence
  Description of Artificial Sequence: Synthetic coding sequence
atgccgggtgaacgcccacgcggagctccaccccctactatgaccggggacctccagccacgccaggtggcaagctcccccggtcatccaagtcagccgcctcttgaagataacacccccgctactcgtacaacaaagggggctagagaagctggtggccaagcccaggcaatggagctcccggaagcacagccacggcaggctcgtgatggagagctgaaacctccatcacttcgcggacaggccccttccagtacacctggcaagcggggaagtccgcagacaccacccggtagaagcccactgcaggctcctagcagactcgccggaagagccgaggggtcgccccctcagaggtatatcctaggaattgcgtcttctaggactaagcccacactggatgagacacctgagaacccacaactagaagccgctcagctgcccgaggtggacacaccccaggggcctggcaccggtgcacccctccggcctgggctgccacgcaccgaagcccagccagccgcagaggaactgggtttccatcgctgttttcaagagcctccatccagtttcacctcaaccaactatacgtcaccttcagcaacaccaaggccccctgcccctgggccaccgcagtcacgtggaacatccccccttcagccagggtcttaccccgaatatcaggcctccggggcagactcctggccacctgccgctgagaatagctttcccggtgcaaacttcggcgttcccccagccgagcccgagcctataccaaagggcagtcgcccaggtgggagcccccgaggtgttagttttcagtttccctttcccgcattacacggcgctagcaccaaacctttcccagccgacgtggccggacacgctttcaccaacggacccttagtattcgcattccaccagccccagggggcttggcccgaggaagcagtggggaccggacctgcctatcctctccctactcaacccgctccaagccccttgccttgctaccaggggcaaccaggcggtctgaataggcacagcgacctcagtggagccctttcttctccaggcgcagcacactctgccccaaggcctttttccgatagtttacacaagtcactgacaaaaattctaccagaacggcctccctctgcccaggatgggctgggctctaccaggggtcccccaagttctctgcctcagcgccacttcccagggcaggcctatagagcaagcggcgtcgatacaagtccaggacccccagataccgagctcgctgccccaggtccccctcccgctcgtctgccacagctatgggatcccaccgctgcgccttatcccacacccccaggaggtcccctggcagccacaaggagcatgtttttcaacggccaaccctccccaggccagcgactgtgtctcccgcaaagcgctcccctgccctggcctcaggtgcttccgaccgcccgaccttcgccacatggtatggagatgctatcacggctgcctttcccagccggagggcctgaatggcaaggcggatctcagggcgcattaggcaccgctggcaagacccccggtccaagggagaagctgccggcagtgcgctcaagccaaggtggcagcccagccctgttcacctataatgggatgaccgaccccggtgcgcagcccctgtttttcggcgtcgcccagcctcaagtgtctccacacggtaccccatctttgccgcctccacgggtcgtgggagcgtccccgtccgagagcccactccccagtcctgcgaccaatacagctgggagcacctgctccagcctcagccctatgtccagctctcctgccaatccttcctcggaggaatcgcaactccctgggccactgggaccctctgccttctttcatccacccacccatccccaggaaaccgggtcccctttcccgtcccccgagcctcctcattctctcccaacccattaccagcctgagcctgcgaaagcatttccttttcctgcggatgggctgggtgcagaaggagccttccagtgcctagaagaaacgcccttcccccacgagggacccgaggtggggagaggcggtctgcaggggtttccaagagccccaccgccttatcccactcaccatttcagtctctcttccgcatctctggaccagctcgacgtactgctgacgtgtcggcagtgtgatcggaactatagcagtctcgcagccttcctggctcacagacagttttgcggccttctgctggccagagccaaagacggtcaccagaggtcccctgggccaccaggactgccttcccctcccgctgctcctagggtccccgctgatgcccatgccggtttactgagccacgcaaagacattccttctagccggtgatgctcaggccgaaggcaaagatgaccccctcagaaccggctttcttccttcattggcggctactccatttcctctgcctgccagcgatctcgacatggaggacgacgctaagctggactcactcattacagaggccctgaacgggatggaatatcaaagcgacaatccggaaatcgactcgtcattcattgatgtgttcgctgatgaagagccgtctggcccacgagggccatcttccgggcatccgcttaaatctaaggccggagtcacaccagagtccaaggctccaccacccctccctgccgctaccccagacccccaaacccctcgcccaggcgacagggggtgccctgcacgcggtcgtcccaagactcggtctctaggtttagctcctacggaggctgacgcaccaagccagggccgacagcagcgcagaggcaaacagctgaagctgtttcggaaggacctcgacagtggaggtgccgcagagggcagcgggtctgggggtggcggacgggcatcagggctgagacccaggagaaacgacggtctgggggaaagaccgcctccaagaccgaggagacctagaacccaggcccctggatctcgcgctgaccctgcccctagggttcccagagccgctgctctccccgaagagacccggtcaagccggagaaggcgcctcccccctcgtaaagatccgaggaaacggaaagcacggggaggcgcttgggggaaggaactgatcctcaagattgttcagcagaagaaccggctgcgggagtatgattttgcttcagagtctgaggaagatgaacagccaccaccgaggggcccaggtttccggggacgcagagggcgtggagaaaagcgtaaggaagtggagctaacacaaggcccaagggaggacgagccgcagaaacctagaaaggcggcacgtcaagaggcaggcggagacggggctcctgctaatcccgaggagcccggaggatcaagaccgggacccggacgatcacctcaggcacgaggaccttctcggagtttggaaacgggcgcagcagcccgtgaaggcggtcccaagtgtgcggatagaccctccgtggcccctaaagatcctttacaagtgcccactaacaccgagaccagcgaggaaaccagaccatcgctggactttccacaggaggcaaaggaaccggaaacggctgaggagtctgcccctgatagtactgaattcactgaggcactgagatcccccccagcagcctgtgcgggtgaaatgggagcctctccaggccttttaatcccagaacagccccctccatctagacacgacactgggacccccaagccctctggatcactcgcgaacaccgctccccacggttcttcccctaccccgggagtagggtctcttctgggcggtcccggaggaacccaagcacctgtttcccacaactctaaggacccgccagcacgacagcctggcgaatttttggcacctgtggccaatccgagcagtacagcatgtcctaagcccagtgtgctgtcctccaaaattagctctttcggttgtgatcctgccggatttaacagagatcccctgggagttccagttgccaaaaaaggacctcagccgtacagttctccccacagcgaactgtttctcggtccaaaggacctggctggttgctttctcgaggaactacaccccaaaccctccgccagggacgctccccctgcgtctagctcttgcctttgccaggacggtgaggatgccggaagtcttgaacctcaactcccccgatcccctcctggcaccgctgagaccgagccaggcagggcggctagcccacccacccttgagtcatctagcctgtttccagatctgccagtggaccgctttgatcctcctctttatggatcactctccgcaaatagggattcgggcctcccattcgcgtgcgctgatcccccacagaagacagtcccaagcgatcccccataccccagctttttgctgttggaggaagtctcccctatgctaccaagtcacttccccgatctgtctggaggaaaagtcctcagcaaaacgtgccctccggagagaaccgtggtaccaggcgctgcgccttcattaccgggtaaagggagcgggtgcagtgttgccctgatgtcacacctgtccgaagacgaattagaaatccagaaactcgtcactgagcttgagtcccaactgcagcggtccaaagacacccgcggagcacctcgggagctggccgaggctgagtccgttgggagagttgaactcggtaccggaaccgaaccaccatctcagcgaaggacctgccaggcaaccgtcccacacgaagacactttcagcgcggctgatctgactcgggttggagagagcaccgctcatcgcgaaggggcagaatccgcggtagcgaccgtggaagccgtccaagggaggccaggtggtacctggccatgtcccgcttcattccatcccggacacgcagcccttctgccatgcgctcaggaggacttagttagcggcgcaccctttagcccccgaggcgcaaatttccacttccagccagtccagaaagctggagcttccaaaactggcctgtgccaggcggagggcgacagccgaccaccacaggacgtctgtttgccagaaccctctaaacaaccagggccacagctggacgcgggttccctggccaagtgttcaccagaccaagagctctcttttccgaaaaataaagaagccgcaagtagccaagaatctgaagatagccttcggctgctcccatgcgagcagcggggtggctttctgccagaaccagggaccgctgaccagccgcatcgtggggctccagctcccgaagcctttgggtcaccagccgtgcacctcgcccctgatctcgcatttcaaggtgatggtgcgccacctcttgatgctacgtggccttttggtgccagtcccagtcatgctgcccagggccattctgctggcagagcaggcggtcacttgcatcccaccgcaggtcgccctggattcgaaggtaatgaatttgccccagccggagccagcagcttgaccgcgcctcgtggtcgtgaggcttggttagtgccagttccgagtccagcttgcgtcagcaacacccacccaagtagaaggtctcaggatccagcgctctcacccccaattagacagttacaactcccaggccctggcgtcgccaaaagtaaggacggtatcttgggactgcaggagctgacaccggcagcccagtcacccccacgggtcaacccttctggcctggagggcggtacagtagaggggggtaaagtcgcttgcggccctgctcaaggctcccctgggggagtgcaggtgacgactctgcccgcagtggccggacaccagcttggcttggaagcagacgggcactggggccttctgggccaagctgagaagacgcagggccagggaactgcaaatcagctgcaaccagaaaacggagtttcgccgggtggcaccgataatcacgcatccgttaatgcttcccctaagacggccctgacagggcctaccgaaggagccgtgctgctcgagaagtgcaagggttccagggctgccatgtctctgcaagaggaagcagagcctacaccctcgcccccatcccctaatcgcgagtccctagcactcgccctcacagcggcacactcaagatcagggtctgagggacgcacccccgagagagcctcaagcccaggtttgaacaaacccctgctcgccacgggtgatagtccagccccttccgtcggggatctcgccgcatgcgctcccagccccacgtcggccgcacacatgccctgtagtcttggccctctgccccgagaggatccacttaccagtccctcccgagctcaaggagggttaggcggtcagctcccagcctctcccagctgcagggacccacctggaccacaacagctcctagcatgttctcctgcctgggctcctctggaagaagcggacggggtccaggcgaccactgacacaggagctgaggattccccagtcgcccctcctagtctgacgacttccccatgcgacccgaaagaagctctcgccggttgcctcctgcagggggagggatctccgctggaagacccgagtagctggccccctggcagcgtgtccgcagtcacttgcacacatagcggtgacacccctaaggacagcaccctgagaatccctgaagattctcgcaaggagaagctgtgggaaagcccgggacgggctactagtcccccactggctggcgctgtgtcaccgtccgtggccgtgcgggctaccggcctgtcctcgacgcctacaggcgacgaggcacaagccggtcgcggactgcccggacctgacccccagagcagaggagcccctcctcacacgaatccagatagaatgccacggggtcattcgagctattctccttccaacacggctaggttgggacatagggagggacaggccgtaacagctgtgcctacagaaccacctacactgcaaggggctggccctgatagcccagcgtgcttggaaggcgagatggggactagttctaaggagccggaggatccagggacccctgagaccggacgctccggtgccacaaagatgcctcgcgttacctgtccaagtacagggctggggctcgggagaactactgccccatcgtctactgcctctgatttccaaagcgattctccacagagccacaggaacgcgagccaccaaacccctcagggcgatccattgggaccacaagacctcaaacaacgctcccggggttacaaaaagaagcctgccagcactgaaaacgggcagtggaagggccaggctccacacgggcctgtcacctgcgaggtttgtgccgcttcgtttcggtcgggtcccggtttaagtcggcacaaggctaggaaacacagacctcatcccggagccccagccgaaccatcaccagccgcattgcctgcacagcagccactggaaccattggcacagaagtgccagccgcctcgcaagaagagtcaccgcgttagtggaaaggaaaggcccaaccactcaagaggggacccctcgcatgttacacagccgcctcccgctcaggggtccaaggaggtcctccgggctcccggttcccctcactcacaacaattgcatccgccatcaccaacagaacacgaagtggacgtgaaaacccccgctagcaaacctaggcctgaccaagccagagaggacgagctgcaccctaaacaggcagagaaaagggaaggcagacggtggagacgggagcctaccgtggacagccctagccactccgaagggaaatctaacaaaaagcgcggaaaactgcggggtaggagactgcgggaggagtccattttgcccgtctccgccgacgttataagtgacggcagaggaagccgcccatctccagccatggcctcctatgccgcatctccgagtcattgcctgagcgtggaagggggtccagaggccgatggggaacagcctcctagattagctactttgggcccaggggtcatggaaggagcagctgaaacagaccaggaagctttgtgcgccggtgagaccggagctcagaaaccccctggagaccggatgttgtgccctggcaggatggatggcgctgcgctcggggaacaaccaacaggtcagaagggtgcttccgccagggggttttggggtcctcgggagaccaaggcactcggcgtgtgtaaagaaagcggtagtgagcccgctgaggactcatctagggcccatagtcggtcggaggaaggtgtgtgggaagaaaataccccgcctctgggccctttgggttttcccgaaacgtcctcttccccagcggacagtacaactagcagctgtctccaggggctccctgacaatccggatacccaaggcggagtgcagggtccagaaggtccaacaccagacgcttctgggtcaagcgcaaaagatccacccagcctcttcgacgatgaagtttccttcagccagctgttccctccaggaggtcgcctgacacgaaaaagaaatccccatgtttatggaaagcgctgtgaaaaaccagttttaccactcccaactcagccctctttcgaagaaggtggcgacccgaccttgggtcccgcacgtttgccaacagatctttctgactccagttccttgtgtttgtgccatgaagatccctgggaggacgaggatccagccggattgccagagagtttcctgctggatggattcctgaactcccgcgtgcccggtattgacccatgggcaccgggtttatcgctttgggccctggaaccttcaagggaagccggagccgaaaaactgcctagccactgcccggaggatgatagacctgaggccattccagagttgcacatggttcccgctgcctggagaggcctggagatgccggcaccggcagacgactcatcctccagcttaggcgatgtgagtcctgaaccacccagtctggagcgagagcgatgcgatggtggcctgccaggcaatacacacctgttgccgctccgcgcaaccgatttcgaagtcttgagcactaaattcgagatgcaggatctttgctttttaggacctttcgaggacccggtgggcctgcctgggccatctttcctggacttcgagggcaccgcctcgtcacagggtccgcagtcacggcgtacagaagaggctgccggtgctgggagagcgcagggcaggggccgtccagcaaaggggaggcgcgcttcatataaatgcaaagtgtgtttccagagattcagaagtctcggtgagctggatctgcacaaactcgcacatacccctgcgccaccccctacatgctacatgtgtgtggagcgaagattcggttcacgcgagcttctgcgcggtcacctgcaagagcgccatgcccagagcaaggctggcccatgggcatgcgggatgtgccttaaggaagtggccgacgtatggatgtataacgagcatcttcgagagcacgccgtgagattcgccaggcggggtcaagcccgtaggtcattgggggacttgcctggcggacttgagggtagtagtgccgtagctcaccttctgaattccatcacagaaccggctcccaagcaccaccggggaaaacgaagcgctgggaaagctgctggtagtccaggcgatccttgggggcaggagggagaggctaaaaaggattctcctggagaacgtgccaaaccaagagcacggtccactccaagcaatccagatggcgcagccacacctgacagtgcctcagcaaccgcgttggccgacgctggttctccaggccctccccgaaccactccctccccatctccagatccttgggctggcggagaaccgctgctgcaagcgaccccagtgcacgaggcctgcaaggacccttctcgggattgtcatcactgtgggaaacgcttccctaagccctttaagctgcaacgccacctagccgtgcatagtccccagagggtttatctttgtccgaggtgcccgcgtgtttacccagaacacggcgaacttctggcccatcttggaggcgctcatggcctgttggagagacctgaacttcagcacacacccctgtacgcctgcgagctttgcgctaccgtcatgagaataatcaagaaatcttttgcctgcagttcctgtaattacacttttgctaagaaggagcaatttgatagacacatgaacaaacatctaaggggagggaggcaaccatttgctttccggggagtgcgcaggccaggagccccaggccaaaaggcccgagcgttggaggggacactgccttctaagcgcagaagggtcgcaatgccaggcagtgcacccggtcccggtgaggaccgcccacccccaagaggcagcagtccaatactttctgaagggtcactgcccgctttgttacacctgtgttccgaggtggccccaagcacaactaagggctggcccgagactttggagaggcccgtcgaccccgtcactcacccaattagggggtgcgagctgccctcgaaccatcaggaatgtcccccacctagcctgagtcctttccccgcagctctagccgatgggaggggtgattgtgcacttgatggcgcactggaaagacccgagaacgaggcttcccctgggtcgcctggtcctctattgcagcaggcccttcctttaggagccagtttgccgagacccggagccaggggacaggacgccgagggaaagcgagctccccttgtattttccggtaagaggcgcgctccgggagctcggggtaggtgcgctccggaccacttccaagaggatcaccttctccaaaaagagaaggaagtatcctctagccacatggtgtctgagggtggccctcgaggcaccttccacaagggatctgccactaagccggctggatgccagtcctcatcaaaggaccgctctgctgcctccacaccttccaaagctctgaagttcccagttcaccctcggaaagccgtgggatcactagcccctggtgaactggccagaggaactgaaaacggtatgaagcctgccaccccaaaagcgaaacccggacccagcagtcagggttcaggaagccccaggcccggaacaaagacaggcggtggctcacaaccacagccggcatctggacagcttcagtcagagaccgcaaccactccggctaaaccatcatttccctcccgcagccccgctcccgagaggctacctgcccgagcgcaggccaagtcctgtaccaaaggccctagagaagctggcgaacagggaccgcacggctctctcggccctaaagaaaagggcgagagtagtaccaagaggaagaaaggacaggtcccagggcctgctcgtagcgagtcagttggcagcttcgggagggctccaagcgcacctgataaacccccacgtactccgagaaagcaggccacacccagtcgcgtgttgcccacaaagccgaaaccgaacagtcagaataagcccagacccccaccaagtgagcaaagaaaggcagagccgggacatacgcagcgcaaagaccgccttggaaaagcatttccacaagggaggcctctgctcaggcccccaaaacgcggaaccgccgttcatggggcagagcccgcagagccgcatacacaccggacggctgaagcacagagcgatctgctgtcgcaactgtttgggcagcgcttgactggcttcaagatacccctcaaaaaagatgcttcggaataa

SEQ ID NO: 247667 - DNA, 1479 bp, Artificial Sequence
  Description of Artificial Sequence: Synthetic coding sequence
atgctgtgtgatgaaaaagcgcaaaaacggagaaaaagaaaagcaaaggaaagtggcatggctctgccccagggccacctcacttttcgtgacgtggcgattgagttctcacaggccgagtggaaatgtctggaccccgctcagagggctctgtataaggatgtgatgctcgaaaactatagaaacctggtgtcgttgggatcctcctacgcattgggttctaacgccgaagacaaacctattaagaagcagctaggagttagcttccatctccacctctctgaattggagctttttcctgatgaacgcgtgattaacggctgcaatcaggtggagaattttataaatcactcctcttctgtttcctgcctgcaggagatgagtagtagtgtgaaaactccgattttcaacagaaacgattttgatgactcttctttccttccacaggagcagaaggtacacctgcgagagaaaccctatgaatgcaatgaacactcaaaggtgtttcgcgtatccagctccctgacaaagcaccaagtcattcacacggtggaaaaaccctataagtgcaatagctgtggcaaggtgttttcaagaaattctcacctggcagagcattgtcgaatccacaccggcgagaagccatataaatgcaacgtgtgcggcaaagtgtttagctacaatagcaactttgctcgtcaccagaggatacatacgcgcgaaaaaccatatgaatgcaatgagtgcggaaaggtgtttagtaacaatagttacctggcgcgacaccagagaatccatgccgaggaaaagccgtataagtgtaatgaatgtggaaaagggttctcacacaagagttctttagccaatcattggcggatttacacgggggagaagccctataaatgtgacgaatgtggcaaggccttctatcgtatcgcgttactggtgcgtcaccagaagatccataccggcgagaagccttacaagtgtaacgaatgcgggaaggtctttattcagaattctcatctggcccagcattggagaatacacacaggcgaaaaaccctacaagtgtaatgagtgcgggaaagtgtttaatcaattgtccaacttggccagacatagacgaatccatacgggcgaaaaaccctacaagtgtaacgagtgtggtaaagcattcagcgaatattcaggactgagcgcccatctggtgattcacactggtgagaaaccctacaaatgtagcgagtgcggtaaggcattccgccataagctttctctgaccaaccaccagcggatacatactggcgaaaggccctataaatgcaacgaatgtgggaaggttttcaataggattgcacatctggctaggcatcggaaaatccatacaggagaaaaaccatacaagtgcaacgaatgcggaaaagcttttagccggatatcttacctagcgcagcactggacaatacacatgggatag

SEQ ID NO: 247668 - DNA, 1377 bp, Artificial Sequence
  Description of Artificial Sequence: Synthetic coding sequence
atgctcgagcagcgccgtgagccatggtccggcgaaagcgaggtgaagattgctaagaactctgatgggagggaatgcatcaagggagttaatactggatctagttacgcactgggatccaatgccgaggacaaaccaattaaaaaacagttaggcgttagctttcatctgcatctctccgagttggaactatttcctgacgagcgggtgattaatggctgtaaccaagtcgagaattttatcaatcattcttcctctgtgtcctgtctgcaagagatgagcagttccgtgaaaacgcccatttttaatagaaatgactttgatgactcttcgttcctccctcaggaacagaaagtccacctacgtgagaagccatacgaatgcaacgagcactccaaggtcttccgcgtgagcagcagtcttaccaagcaccaagttatacacactgtcgaaaagccttacaagtgcaattcctgtggaaaggtgttctctagaaacagccacttagccgagcattgccgtatccacaccggagagaaaccctacaaatgtaacgtctgtgggaaggtgttttcatacaatagcaactttgcacgtcaccagcgtatacacacacgcgaaaagccatacgagtgcaatgagtgtgggaaggttttctcaaacaattcgtacctcgcacgacatcaacggattcatgcggaggagaaaccttataagtgcaatgagtgtggtaaaggcttctcacacaagtcttccctcgctaatcattggaggatttacaccggtgaaaaaccatataagtgtgacgagtgcggcaaggcgttttaccgtatagcactgctggtgaggcatcagaaaattcacacaggggaaaaaccatacaagtgcaatgaatgtggaaaggtctttatccagaatagtcacctggctcaacattggcgaatccatacaggagagaagccttacaagtgtaatgagtgtggcaaagtgtttaaccagctctctaacctggccagacacaggaggattcacaccggcgagaagccttacaagtgtaatgaatgtggaaaagcctttagtgaatacagcggcttaagcgcccacctggtgattcacaccggagagaagccctataagtgctcagagtgcggcaaagccttcaggcataagttgtccctgactaaccatcagaggatacacaccggggagcgcccttataaatgcaatgagtgcggcaaagtctttaacagaattgcccatctggccaggcataggaagattcatactggcgaaaagccatataaatgcaacgaatgcggtaaagcattcagcagaatttcttatttggcccagcactggacaatacacatggggtag

SEQ ID NO: 247669 - DNA, 537 bp, Artificial Sequence
  Description of Artificial Sequence: Synthetic coding sequence
ttcccccagacgaggaaaaggatcgcatggtcagaaggccacgcagccgctcggctgaccagtaaagaaagctgctgtgagaaggctcagaaacgcagaaaaaggaaagcaaaggaatctggcatggccctgccgcagggccatctaacctttcgcgacgttgctatcgagttttctcaagccgagtggaagtgcttagacccagcgcagcgcgctctttacaaggatgtcatgctcgaaaattatagaaatcttgtctccctcggcatctccttacccgacttgaatataaactctatgctcgaacagaggcgggagccctggtctggcgaaagcgaggtcaaaatcgctaagaattctgatgggagagagtgcatcaagggggtaaataccgggagtagttacgcacttgggtccaatgctgaagataaacctatcaaaaagcaactcggcgtcagcttccatctgcatttatctgagctggagctattccccgacgagcgggtgattaatggttgtaaccaggttgagaactag

SEQ ID NO: 247670 - DNA, 1608 bp, Artificial Sequence
  Description of Artificial Sequence: Synthetic coding sequence
atgctgtgtgatgagaaggcacagaaacggaggaaacgaaaagccaaggaatccggcatggccctgccacagggtcacctgactttcagggatgtggctattgaattttctcaggcagaatggaagtgtcttgatccagcacaaagagccctttacaaagacgtgatgctcgagaactaccgcaatctcgtctcactggggatttctctccctgacttaaacatcaattccatgttagagcagcgacgtgaaccatggagcggggagtctgaggtgaagatagccaaaaacagcgatggaagggagtgtattaaaggcgtaaatacagggtcatcctacgcactgggtagcaacgccgaggataaaccaattaagaagcagctcggggtgtcttttcacctccatttgagtgaactggagctcttccctgatgagagagtgataaacgggtgtaatcaggttgagaacttcatcaatcattcatccagtgtgagttgcttgcaggagatgtccagttccgtgaagaccccaatcttcaacagaaacgatttcgatgactcatccttcctcccacaggagcaaaaagtacacttgcgcgagaagccctacgagtgcaacgagcactctaaagtatttagggtttctagtagtctcactaaacaccaggtgattcacacagtggaaaagccatacaagtgcaattcttgcggcaaagttttctcccggaattcgcacctggccgagcattgtcgtatccacacaggcgaaaagccatacaagtgcaacgtgtgcggtaaggtgttcagctataacagtaactttgccagacaccagagaatccacactcgggaaaagccttatgaatgcaatgaatgcggcaaggtgttctcaaataacagttaccttgcacgccatcagagaattcatgctgaggagaaaccgtacaagtgtaatgaatgcggcaaaggatttagccataaatccagcctcgctaaccactggaggatatataccggtgagaaaccatacaagtgtgacgagtgtggaaaagccttctacagaatcgcccttctcgtgcgtcatcagaagatccacactggagagaaaccctacaagtgcaatgaatgtgggaaagtgttcatacagaacagccacctagcacagcattggaggatccacacaggtgagaagccatacaaatgcaatgagtgcgggaaggtcttcaaccagctcagtaacctggctagacatagacgtattcatactggcgaaaagccatacaagtgcaatgagtgcgggaaggccttctccgagtactcaggactatccgcccacctcgtgatccacaccggcgaaaaaccatataagtgctcagagtgcggaaaagcgttcaggcataaactgtctcttacaaatcaccagagaatccacactggcgagcgcccttataagtgtaatgagtgcggaaaagtgttcaatcgcattgctcatctggcaaggcaccgcaagatacatacgggagagaaaccatacaaatgcaatgagtgtggtaaggccttttctagaatctcttaccttgctcagcactggaccattcatatgggatag

SEQ ID NO: 247671 - DNA, 1608 bp, Artificial Sequence
  Description of Artificial Sequence: Synthetic coding sequence
atgttatgcgacgagaaagcccaaaagcgaagaaagagaaaggcaaaggagtcaggtatggcccttcctcagggtcacctcaccttccgcgatgtagctatcgaattcagtcaggctgagtggaagtgcctggatccggcacagagagccctgtataaagacgtcatgttggaaaactacagaaatttagtgtcgctcggcattagtttacctgatctaaatattaattcaatgcttgaacagagaagggaaccttggagcggcgaaagcgaagtaaagatcgccaagaattctgacggcagagagtgtatcaagggggtgaacactggtagctcgtacgccctgggctccaatgccgaggataaacctattaagaaacagcttggagtgtcttttcacctccatttgagcgaactggagcttttccctgacgagagggtaatcaacggttgtaatcaggtggaaaatttcattaaccactcaagctcagtctcctgcttacaggagatgagctcctccgtgaaaactcccatcttcaataggaatgacttcgacgacagctccttcctaccacaagaacagaaggtccatctccgtgagaaaccctatgaatgcaatgaacactccaaagtgttcagggtctcctcaagtctgactaaacaccaggtgattcataccgtggagaagccatacaagtgtaattcttgtggcaaagtgttctcccgcaactcccacctggctgagcattgtcgcatccataccggcgagaaaccatataaatgtaatgtttgtggaaaggtgttctcgtataactctaatttcgcgaggcatcaaagaatacatactcgtgaaaagccctacgagtgtaatgaatgtggcaaggtattcagcaacaattcatacttggccaggcatcaaaggatccatgctgaagaaaagccttacaaatgcaacgagtgcggcaagggattctcacacaagagttcgctcgctaatcactggcgaatctacacaggcgagaagccttacaagtgtgacgagtgcgggaaggctttctaccgcattgccctgttggtcaggcaccagaaaatccacactggcgagaaaccctacaaatgcaatgagtgcggtaaagtgtttatccagaattcccatctcgcccagcactggcgaattcacacaggcgagaaaccgtacaagtgcaatgaatgtgggaaagtcttcaaccagctgtctaacctggcccgtcacaggcgcatacataccggggaaaagccttacaagtgcaatgaatgtgggaaggccttttcggagtatagtgggttgagcgctcaccttgtgatacacacaggtgaaaaaccctacaaatgcagtgagtgcggcaaggcgttcagacataagttgagcctgactaaccatcagcgaatccatactggagagcgcccttacaaatgcaacgagtgcggcaaagtttttaaccggatcgcccatttagctcgccatcggaaaatccatactggcgaaaaaccttacaagtgtaatgagtgcggtaaggccttctcccgaatctcataccttgcgcagcattggacaattcatatgggatag

SEQ ID NO: 247672 - DNA, 1764 bp, Artificial Sequence
  Description of Artificial Sequence: Synthetic coding sequence
atgccaaccgccttatgcccacgggtgctcgcacccaaggaatccgaggagccacgcaagatgaggagccccccaggggaaaacccttcacctcagggagagctccctagcccagaatcaagtcgcaggctattccgcaggttccgataccaggaggctgccggaccacgcgaggcgttgcagcgcctgtgggacctttgtgggggatggcttcgacctgagaggcacacgaaggaacagatcttggagctactcgtgcttgagcagttcctggcaatcctgccgagggaaattcagagttgggtgagggcccaggaacctgagtcaggcgagcaggccgtcgccgctgttgaagcacttgagcgggagcccggacgcccttggcagtggttaaagcactgtgaagaccccgttgtcattgatgacggggatagcccactggatcaggaacaggagcagctgccagttgaacctcactccgatttggccaagaatcaggatgcccagcctattacccttgcccagtgcctcggtctgccatcccggcctcccagccaacttagcggcgaccccgtacttcaggacgcattcctgcttcaggaggagaacgtgagagatactcagcaagtaaccaccttgcagcttccgccatctagggttagtcctttcaaggatatgatcctgtgcttttccgaggaagactggtccctgcttgaccctgcacagaccggcttttacggggagtttataatcggcgaggattacggagtgtctatgcctcccaacgacctggcagcccagccagacctctcccaaggcgaagagaacgaaccgagagttccagagctgcaagatctccagggtaaggaggttccacaggttagctacctcgactcaccttccctgcagcccttccaggtagaagaaaggcgtaagagggaggaactccaggtgcctgaattccaagcgtgtcctcagactgtcgtcccccagaacacttatcctgcaggaggtaaccccaggtccttagaaaattctctggacgaggaagttacaattgaaattgtcctgagttcttctggcgacgaagactctcagcacggaccatactgcacggaggagcttggctccccaaccgagaagcagaggagtttacccgcatcccaccggtctagcaccgaggcaggcggagaagtccagacgagcaagaagtcttacgtgtgccccaactgcggcaaaattttcaggtggagggtcaacttcatcagacacctgaggtcgcgcagagagcaagagaagcctcacgagtgtagcgtatgcggggagttgttcagcgattctgaagacctcgacggacatcttgagtcccacgaggcccagaaaccctacagatgcggagcttgcggaaagtccttcaggctgaatagccatctgctctcccatagacgcatccacctccagcccgatagactgcagcccgtggaaaagcgagagcaggccgcttctgaagatgctgataagggtccaaaagaacctttagaaaacggaaaggctaaactatccttccagtgttgcgagtgcggtaaggccttccagcgccatgatcacctggctaggcatcgaagccacttccacctcaaagacaaggcaaggccatttcagtgtcggtattgcgtcaaatcattcactcaaaactatgacctccttaggcacgagcggctccacatgaagagaaggagcaagcaggcactcaattcttattag

SEQ ID NO: 247673 - DNA, 1872 bp, Artificial Sequence
  Description of Artificial Sequence: Synthetic coding sequence
atgcctactgcactttgccccagggtcctggctcctaaggagagcgaagagccccgaaaaatgagatccccaccaggcgagaacccatcaccgcagggggagttgccgtctcccgagtccagcaggcgcctgtttaggagattccgctatcaggaagcagctgggcctcgcgaggccctccagcggttgtgggacctgtgtggcggttggctgcgcccagagaggcatactaaggagcagatcctcgagctgctggttctggagcagttcctagccattctccctcgtgagattcagagttgggtaagagcccaggagcctgaaagtggagagcaggctgtagctgcagtggaggcactggagcgtgagccaggaagaccctggcagtggctgaaacactgcgaggatccggtggtcattgacgacggcgactcgccactggaccaggagcaggagcagctccctgtggaaccccatagcgatctggccaagaaccaggacgcccagccaattaccttggctcaatgcctgggacttccctcaagaccaccctcacagctgtccggggaccccgttctccaggacgcattcctgctacaggaggagaatgtgagagacacccaacaggtcacgaccttgcaactcccccctaggatttttcaatttaacaatcatcggtcgaatgggtatatccttgagatgctgggcagtggcggaaagaaggcacagatcatttcagttcttagccaaatttacgtctcccgggtttcaccattcaaagacatgatcctgtgcttcagcgaagaggactggagcctgctcgatcctgcacagaccggcttctacggcgaatttattataggcgaagactacggtgtgtcgatgcctcctaatgacctggctgcccagcctgatttaagccagggggaggaaaacgagcctcgcgtgcccgagctgcaggatcttcagggtaaggaagtccctcaggtttcttatcttgacagcccgagcctgcagccatttcaggttgaagagagacggaaaagagaggagctgcaggtacctgagtttcaggcctgtccgcagaccgtggtcccccagaacacctaccctgccggaggaaaccctcgaagtctcgaaaacagcctcgacgaggaggtcactatcgaaattgtcttgtccagctcaggcgacgaggatagccaacacggaccttactgcaccgaagaactgggttctccaaccgagaaacagcgttctctcccagcaagtcaccggtcatccaccgaggccggtggagaggtacaaacttccaaaaagagttacgtctgcccaaattgtgggaagatctttaggtggagggtgaactttatcagacatctgagatcgcgacgcgaacaggagaagccacacgaatgcagcgtgtgtggcgagctgttttcggacagtgaagatctcgacggacacctcgagagccacgaggctcagaagccgtaccggtgcggagcctgcgggaaaagttttagacttaatagtcacttactgtcacatagacgaattcacttgcagccagataggctgcagcccgtcgagaagcgcgagcaggcagcctcagaggacgccgacaagggtcccaaggaacccttggaaaatggaaaggccaagctgagttttcagtgttgcgaatgcggtaaggccttccaacggcacgaccatctcgctaggcaccggtcacacttccatttaaaagacaaagctcgacccttccaatgcagatactgtgtcaaatccttcacacagaactatgatctgttgcgacatgaacggctgcacatgaagcggagaagcaaacaagctttaaacagttactag

SEQ ID NO: 247674 - DNA, 1830 bp, Artificial Sequence
  Description of Artificial Sequence: Synthetic coding sequence
atgtcaaccgcaccctctttatctgcgttgcgctcatcaaagcatagcggagggggaggcggaggaggcggaggcggtggagcggaccctgcttggacttcagccctctccggcaatagtagcggccctggacctggctcatctccagcaggctcaacgaagcccttcgtgcatgccgtgccaccctccgacccgctacgccaagctaacaggttgccaataaaggtattgaaaatgctgacagcccgtactggacacattctccatccagagtatctccagcccttgccctccacccccgtctccccaattgagctggacgccaaaaagagtcctttagctctactggcgcagacctgttctcagatcggaaagccagatcccagccctagtagcaagctgtctagcgtcgctagcaatggcggtggagcgggtggagccggaggtggcgctgctggtgataaagacacgaaatctggcccactgaagctctcggatataggcgtagaagataaatccagcttcaagccatactcaaagccaggctctgacaaaaaggagccgggtggcggaggcggaggtgggggtggaggcggaggaggcggaggcggagtctcatccgaaaagtctggattcagagtgccttcagctacttgccagccctttactccgcgtactggcagcccctccagttctgctagtgccgagggcggaccaacaggcctcgcccacggccgtatctcttgcggcggaggaattaacgtcgacgtcaatcagcatccggacggcggtcctgggggtaaggcgctcgggagtgactgtggcggatcaagtgggtcgtcatcaggatctggtcctagtgcgccaaccagttcatcagtgctcgggagcggactggtcgcaccggtatctccttacaagccaggccagactgtgttccccctacctcccgctggcatgacctacccaggctctctggccggtgcatatgcaggctacccccctcaatttctaccacacggcgtggctctggatccgacaaagcccggaagcttggttggagcacagcttgctgccgctgcagcaggttccttgggatgttcaaagcccgctggctcaagccctctggcaggcgcatctccaccatccgtgatgactgcatcattgtgtagggacccctattgcttatcctatcactgcgcgtctcaccttgccggtgccgctgcagcctccgcttcgtgtgctcacgaccctgctgcggcagccgctgccttgaaaagcggctatccactcgtctatcccactcaccctttacatggagttcactcctccctgacggccgctgccgcagccggagctacaccaccgtccctggccggtcacccactatacccatatgggtttatgctaccaaacgacccactgccacatatctgcaattgggtgtctgccaacggcccatgcgataaacgcttcgccaccagcgaggaactacttagccatctgcgtacgcacactgctttcccaggcacggataaactattgtcaggttacccttccagttcctccctagcatcagcagctgcggcagccatggcctgccacatgcacatccctacttccggggctcctggcagcccaggtaccctggcccttcgatcaccgcaccatgcgttgggactgtctagccggtaccatccctacagcaaatccccactgccaacacctggagcccctgttcctgtgcccgctgcaactggtccttattactctccttatgctctatatggtcagagactcaccaccgcctccgcccttggataccagtag

SEQ ID NO: 247675 - DNA, 1941 bp, Artificial Sequence
  Description of Artificial Sequence: Synthetic coding sequence
atgtctaccgcaccctctctgagcgctctcaggtctagcaaacacagtggtggtggaggcggaggcggaggaggaggcggagcggatccagcctggaccagcgccctgagcgggaactcaagcgggcctggacctgggtcctcaccggctggtagcaccaagccattcgtacatgccgttcctcctagcgatccgctgaggcaggccaataggctgcctataaaagtgctgaagatgttaaccgctaggaccgggcacatacttcaccctgaatatttacaaccacttccctcaactccagtttcccccatcgagctggatgccaagaaaagcccgttggcgcttttggctcagacatgctcacaaatagggaagccagacccatccccttccagcaaactgagttcagtagcctcgaacggcggaggagcaggtggcgcaggaggaggcgcagcaggcgacaaagataccaaatctgggccactgaagctgtccgatatcggcgtcgaggacaagagtagcttcaagccatactcaaagcccggtagcgataagaaggagccaggcggaggcggtggagggggtggcggtgggggtggaggaggcggaggtgtctcatcagagaagagtggcttccgtgttccctctgccacatgccagccatttacaccacgaacagggtctcctagtagcagtgcttccgcttgttcaccgggtggaatgttgtcatctgccggtggggctccagagggcaaggatgataaaaaggacactgacgtgggcggtggcggtaaaggaacggggggagccagtgcagaagggggtcctacgggtttagcacacgggcgtattagctgtggaggcggaattaacgtcgatgtgaatcagcatccggacggaggccctggcggaaaagccctgggtagcgattgcggcggatcatcaggttcgagttcggggagcggcccatctgcccctacatccagcagcgtgctaggatccggactcgtcgcccctgtgagtccttacaagccaggtcagaccgtgtttccgttacctcctgccggaatgacttacccagggagcctggctggggcttacgcgggttaccccccacaattcttgccccacggcgtggctttggacccaacaaaaccagggtcgctggtcggagctcaactcgccgctgccgcagccggatctctgggatgctccaagcccgcaggttccagcccgttagccggagcaagccccccttctgtaatgaccgcttcgctgtgccgggacccatattgcctgtcctatcactgtgcctctcacctggcgggagccgctgccgcatccgcttcctgtgctcatgatccagccgctgccgctgcagcccttaaatccggctacccactggtttaccccactcacccactgcacggggtacactcctcactaacagctgcagccgctgcgggagccaccccaccctccctcgcgggtcatccgctgtacccatatggcttcatgctgcctaacgacccattgccacatatatgtaactgggtgtccgctaacggcccttgtgacaaacggttcgctacttctgaggaacttttgtcgcatctgcggacacacacagcgtttcctggaacggataagctactgagtggatacccgtcctccagtagtctggcatctgctgccgctgctgcgatggcctgtcatatgcatattcccacctctggcgcacctggctcgccaggcacgctggcactccgcagcccacaccacgccctgggcctgtctagtaggtatcacccatactccaaatcccctcttccaactccaggggctcccgtgcccgtaccggcagcaaccggcccatactactctccctatgcactttatggacagagactaactaccgccagcgctttagggtaccagtag

SEQ ID NO: 247676 - DNA, 1941 bp, Artificial Sequence
  Description of Artificial Sequence: Synthetic coding sequence
atgagcacggccccaagtctgtccgctctgagatcttcaaaacatagcggaggcggaggaggcggtggtgggggaggcggtgctgatccagcatggacctccgccctgagcggaaactcatccgggccagggccaggatcttcacccgcaggttcaaccaagccctttgtgcacgcagtcccaccctccgacccactcaggcaggcaaatcgattgcctatcaaggtattgaaaatgctgacagccaggaccggccatatacttcaccctgagtacctgcagcctttaccttccactccagtgtcacccattgagctggacgccaagaagagccccctggctctgctagctcagacctgtagtcagatcggtaaaccagatccgtccccttcctcaaagctttccagtgttgctagcaacggcggaggagccggaggggcaggcggtggcgctgctggggacaaagatactaaatctggccctctcaaactgtccgatatcggagttgaggacaaatcctctttcaagccttactccaagccagggagcgataaaaaagagcccggaggcggaggtggtgggggaggcggaggcggaggcggaggcggaggggtcagctccgagaagtccggctttagagttccaagtgctacctgccagcctttcactcctcgcacgggtagccctagttcatctgcttccgcttgtagtccaggcggaatgctgtcatccgccggaggcgctcctgagggcaaggacgataagaaggacacagacgtgggtggtgggggtaagggaactgggggagcctctgccgaaggcggacctaccgggttagcccacggcaggatttcttgcggtgggggtataaacgtggatgtcaatcagcacccagacggtggtcccggagggaaggctctaggctctgattgtgggggatcaagcggcagctcttcggggtccggcccttccgccccaacatcaagctcagtgttgggaagcggcttggtagcccctgtttctccgtataagccaggacaaacagtatttcccctccctcctgctgggatgacctaccctggctctcttgcaggtgcctacgcaggatatccaccacagtttctgccacacggcgtggccctggatcccaccaagcccggaagcttggtcggggctcagctcgctgccgctgcggctgggagcctcggctgttccaaacctgctggctcctctccgctggcgggtgcgtctcctcctagcgtaatgacagcgagcctgtgtcgcgatccttactgtctcagctatcactgcgcgtctcacctggccggagccgcagccgcttccgcatcgtgtgcccacgatcctgcagcggcagctgcggctttgaaatccggctatccccttgtgtatcctactcacccactccacggggtacattcatctctaaccgccgctgcagccgctggcgcaactcccccttccctagcaggccatccactgtacccctacggcttcatgctgccaaacgacccattgccacacatatgtaactgggtatccgccaacggaccttgtgacaagagattcgccacctctgaagaactcctgagtcatttgaggacccacacggcgttccccggaacagataagctcttatccgggtatccaagcagctcttccttggcctcagccgcagccgctgccatggcatgtcatatgcacatccccacgtccggagcaccgggatcaccaggcactctcgcattacgcagcccacaccacgcccttggactatcaagccggtatcatccgtactccaagtcgcctctcccaactccaggtgcaccagtcccggtccccgcagccacaggaccctattattcaccttacgcactctatggtcagaggttgactacagctagtgctttgggttaccagtag

SEQ ID NO: 247677 - DNA, 1626 bp, Artificial Sequence
  Description of Artificial Sequence: Synthetic coding sequence
atgcctcgtagaaaacagagtcatccccagccagttaaatgtgagggagttaaggttgacaccgaggacagtctcgatgaaggaccgggagccctggtgctggagtctgatttattactcggacaggatctggagtttgaggaggaagaggaagaagaggagggcgatggaaactcagatcaactcatgggctttgaacgggactccgagggcgatagtctgggtgctcgccctgggctcccctacggactgtctgacgacgagtccggcggaggtcgcgctctctctgctgagtctgaagtggaggaacctgctcgaggacccggagaggcacgtggtgaaagacccggacctgcatgtcagctgtgtggcggaccgacaggagaaggcccatgctgcggcgcaggaggaccaggagggggtcccctgctcccgcctcgcctgttgtatagttgccgattatgcacatttgtcagccactactccagccacctgaaacgccatatgcagacacactccggtgagaagccattcagatgcgggagatgcccttacgcctctgctcagctggttaatctcacccggcatactaggacacatacgggcgagaaaccctaccggtgcccacactgcccctttgcctgtagtagcctgggaaacctccggagacaccagaggacacacgctggtcctccaactcctccatgtcccacctgcgggttccggtgttgcacgccccgtccggctaggccaccgtcgccaaccgagcaagaaggggcagtcccgagacggccagaggacgcactgcttctccctgacctgtcattgcatgtgccaccgggtggagcatcttttctccccgattgcgggcagctgcggggagagggggagggactgtgcggcaccggctcagagccgctgccagagctcttgttcccatggacatgcaggggttgcggccaagagctcgaggagggggagggctctaggctcggggctgccatgtgcggaagatgtatgagaggcgaggctggtggaggtgcttcagggggaccgcaggggccatcagataaaggttttgcctgctcgttatgtcctttcgccacccattaccctaatcatctggcaagacatatgaaaacccattctggggaaaaaccttttaggtgtgcaagatgcccttatgcatctgcccaccttgacaacctaaaacgtcaccagagggtacatactggagagaagccgtacaagtgtcccctgtgcccctacgcctgcggaaacttggccaatctgaaaaggcatggacgaatccattccggagataaaccctttcggtgctcgctctgtaattacagctgtaaccagagtatgaacttgaagcgccacatgttacgtcacaccggcgagaagccattccggtgtgccacctgcgcctacacgactggtcactgggacaactacaaaaggcaccagaaagtgcacgggcatggcggtgctggcggacctggactgagcgcgtccgagggctgggcccctcctcactcgcccccatccgtactctcttcccgcggaccccctgctttaggaaccgcaggctcacgcgctgttcacactgactcaagttag

SEQ ID NO: 247678 - DNA, 1440 bp, Artificial Sequence
  Description of Artificial Sequence: Synthetic coding sequence
atgggatttgaaagggactctgaaggcgacagcttaggtgcccgacctggcttaccctatgggctgagcgatgacgaatctggcggtggaagagcacttagtgctgaaagtgaggtagaggaacccgctcggggacctggcgaggccaggggtgagagaccgggacccgcatgtcagctgtgtgggggtcccacaggggaaggcccatgctgtggagctggcggaccaggcggtggacctcttttgcctccacgacttctctacagttgtaggctatgtacttttgtctcacactattcatcacaccttaaaagacatatgcaaactcacagtggcgaaaagccattcagatgcggcagatgtccctatgcctccgcccaactcgttaacctgactaggcatacgcgcactcataccggggagaaaccctacagatgccctcactgtcccttcgcctgttcctccttagggaatctgcggcgacaccaacggactcatgcaggccctccaacacccccttgccctacctgcggttttcgatgctgcaccccacgtccggcaaggccaccaagcccaaccgagcaggagggggcagtgccacgtagaccagaagacgcactattgttacccgacctcagtttgcatgtgcctcccggtggggctagcttcctacccgactgtggtcagctgagaggcgagggggagggattgtgtggcaccggcagcgaacctttgcctgaacttttgttcccctggacctgcaggggttgcggacaggagcttgaggagggtgagggctccagattaggggcagccatgtgcggtcgctgtatgagaggagaagccggaggaggggcttctggtggcccacaggggccatccgataaagggtttgcctgttccctttgcccttttgcaacccactaccctaaccatttggcccgacacatgaagactcacagtggcgaaaaaccgttccggtgtgctagatgcccctacgcctcagctcacctcgataatctcaaaaggcaccagcgggtccacacaggggagaaaccttataagtgtcctctgtgcccttacgcctgtggtaacttggctaatctcaagaggcatggcagaatccatagtggggataagccctttagatgtagcctttgtaattacagctgcaaccaatcgatgaacctgaaacgccacatgttgagacatactggagagaagccatttaggtgtgcaacctgcgcatacaccaccgggcactgggataactataagagacatcaaaaggtgcatgggcacggtggggctgggggaccaggattatcggcttccgagggatgggcccctcctcattcacccccaagcgtgctgtcatcccgtggcccacccgctttgggcactgcaggctcaagggctgtgcacacggactcatcctag

SEQ ID NO: 247679 - DNA, 3936 bp, Artificial Sequence
  Description of Artificial Sequence: Synthetic coding sequence
atgagtcgacgcaagcaggccaaacccagatccctgaaagacccaaactgtaagctggaagacaagactgaagacggagaggcactagactgcaagaagcgccctgaggacggcgaggagctggaagatgaggccgtccactcatgtgatagttgtctccaggtattcgaatcattgagcgatataactgagcataagattaatcagtgccagttaactgatggggtggacgttgaggacgatcccacgtgcagctggccggcaagctcacccagctcaaaggaccagacttccccctcacatggcgagggctgcgattttggggaagaggagggcggacctggccttccttacccctgccagttttgtgataagagcttcagccggctgagctacctgaaacaccacgaacagagccatagcgataagctgccttttaaatgcacctactgttcgcgcctgttcaaacacaaaagatcaagggatcggcacatcaagctgcataccggagataaaaagtatcactgctccgaatgtgacgccgctttctcccgctccgaccaccttaagattcatctcaagacacatacgtctaataagccttataaatgtgccatctgtaggcggggttttctgtcaagttccagcctgcatggccacatgcaggtgcacgaaagaaataaagatggatcacagagtggcagtaggatggaggattggaagatgaaggacacccagaagtgcagtcaatgcgaggaaggtttcgactttcccgaagatctgcagaaacacatagccgagtgccaccctgaatgttctccgaacgaagatagggccgcactacagtgtgtttattgtcatgagctgttcgtagaagagacgtctcttatgaatcacatggagcaggtccactccggcgagaaaaagaactcatgcagcatctgctcagaaagttttcacactgtggaagaactctactcccacatggacagtcaccaacagcccgagagctgcaatcactctaatagtccttccctagtgactgtggggtacacctctgtgtccagcactacgcccgatagcaatctgagcgtggactcttctactatggtggaagcggctccaccaatccccaagtccaggggcaggaagcgcgcagcccaacagacacccgatatgacaggacccagctccaaacaggctaaagtcacatatagctgcatttactgcaataagcaactctttagcagcctggcagttctgcagattcatctcaagactatgcatttagacaaaccggagcaggcccacatatgtcagtactgtctggaggtcctcccttcactttacaacctcaacgaacacctgaaacaggtgcacgaggcccaggacccaggactgatcgtgagcgctatgcctgccattgtctaccagtgtaacttctgttcggaagtggtgaacgacctgaacacactccaggagcacatacggtgtagtcacggttttgctaaccccgctgcaaaggattcaaacgcatttttttgtccgcattgctacatgggcttcctgaccgactcatcacttgaggagcatatcagacaggttcattgcgacttaagcgggtcgcgcttcggttcacctgtcctcggaacacctaaggagcctgtggtggaagtctattcatgcagttactgcacgaattcccctattttcaacagtgtcctgaagctgaacaagcacattaaagagaaccataagaacattcctctggcacttaattatattcacaatggcaaaaagtcaagagcattgtcgcctctgagccccgtggcaatcgagcagacttccctaaagatgatgcaggccgtgggaggagcccctgcaagacctacaggcgaatacatctgcaaccagtgtggtgctaagtacactagcctggactcattccagacccatttaaagactcaccttgacacggttctgccaaagttgacctgcccacagtgtaacaaggagttccccaaccaggagtccctgctaaaacacgtgacaattcatttcatgatcacatccacctattatatctgtgagtcctgtgataaacaattcacctcagtggatgatctgcagaaacaccttctggatatgcatactttcgtgttttttaggtgtacgttgtgtcaagaagtgtttgactccaaggtcagcatccaactgcatctcgcagtgaagcattccaatgagaagaaggtctacaggtgcaccagctgtaattgggatttcaggaacgagaccgacctccagctccatgtgaagcacaaccacctcgagaatcagggaaaggttcataaatgtatcttctgtggcgaatcattcggcaccgaggtggagctgcagtgccacatcactacccattctaagaagtacaactgcaaattctgcagtaaggcttttcacgccatcatcctactcgagaagcacctgcgcgaaaagcattgtgttttcgagaccaagacaccaaactgcggcaccaacggggctagtgagcaggtccaaaaagaggaggtggaactgcagacactgctcaccaactcacaggagagtcacaactctcatgatggatctgaggaagacgtggacactagtgaacctatgtacggctgcgatatttgcggtgccgcatacacaatggaaacactactgcaaaaccatcagctgcgagatcacaatatccgacctggggaatcagctattgttaagaagaaagcagagctgattaagggtaactataagtgcaatgtctgctctcggaccttctttagtgagaatgggctaagagagcacatgcagacccaccttggcccagttaaacattatatgtgtcctatctgcggtgaacgcttcccctcattattgacactcacagaacataaagtcacacacagtaagagtcttgatactggcaattgcaggatttgcaagatgcccctgcagtctgaggaggagtttttagaacactgccagatgcatcctgatctacgaaactccctgacgggtttcaggtgtgttgtgtgtatgcagacagttaccagcacacttgagcttaagattcacggaacgttccatatgcagaagacaggaaacggcagtgctgtgcagaccaccgggcgagggcagcacgtccagaagctgtacaagtgcgcgtcctgcctgaaggaattccgcagcaagcaggatctggtgaaactagatattaatgggcttccctatggactgtgcgccggttgtgtcaacctctccaagagtgcgtcaccagggatcaacgtgcccccaggcacaaacaggccaggattgggccagaatgagaacctgtccgccatagagggtaaggggaaggtgggtggactgaaaacgaggtgctcttcttgcaatgtcaagttcgagagcgagagcgagctgcagaaccatatacagactatacaccgtgagctggtcccggattctaattccacacagcttaaaacccctcaggtgagtcctatgcctaggatttccccatctcagagcgatgagaagaagacctatcaatgtataaagtgtcagatggtgttttataacgagtgggatattcaagtccacgtcgccaatcatatgattgacgagggcctcaaccacgaatgcaaactgtgctctcaaacatttgatagcccagccaaactgcagtgtcacctgatcgaacattcatttgagggaatggggggaacatttaagtgcccagtgtgctttacggtgttcgtgcaggccaacaaattgcagcagcacatcttcagtgctcacgggcaggaggacaagatatatgattgcactcagtgtccgcagaagttctttttccagacagagttacagaaccatacgatgactcagcattcctcctag

SEQ ID NO: 247680 - DNA, 3936 bp, Artificial Sequence
  Description of Artificial Sequence: Synthetic coding sequence
atctcacgggctcagaaagcccagacacggagattgaacgaccccaactgtaagctcgaggataagactgaggacggagaagctttagactgcaagaaacgtcctgaggatggggaagagttggaagatgaagccgtgcactcctgtgactcctgcctgcaggtgttcgagtcactgtctgacattacggaacataagatcaatcagtgtcagctgacggacggagtcgatgttgaggatgatccaacatgttcctggcccgcatcctcaccctcatcaaaggaccagactagccctagccacggggaaggctgcgacttcggagaggaggaggggggacctggactgccctatccatgccagttctgtgataagtccttttcgcgactgagctacctgaagcaccacgagcagtctcattcagacaaactgccttttaaatgcacctactgtagccgcctgttcaaacacaagaggagtcgggacaggcacattaagctccacacaggtgataagaaataccattgtagtgagtgtgacgcggcattctccagaagtgaccatttaaaaatccacctaaagacccacacgtctaacaaaccttataaatgcgctatttgtcggagagggttcttatcctccagctctttacatggccatatgcaggtgcacgagcgcaacaaggacggttcccaaagcggcagccggatggaagactggaaaatgaaggacacccagaaatgcagtcagtgcgaagaagggtttgactttcctgaagatctacagaagcatattgctgagtgtcatcccgagtgcagccctaacgaagatcgcgcagccctccaatgcgtgtactgccacgaactgtttgttgaagaaacatccctgatgaatcatatggagcaggttcattctggtgagaagaagaacagctgttcaatttgctctgagtctttccacacagtggaggaattgtattctcatatggactcccaccaacaaccggagagctgcaaccattcaaactctccttcacttgtgactgttggctacactagcgtgtccagcacaacccctgatagcaacctgtctgttgactccagcactatggtggaggctgccccacccatccctaaatctcgtggcaggaagagagcggctcagcagactcctgacatgacaggtccgtcctctaaacaggctaaggtgacatattcttgcatctactgtaacaaacagttgttttcctcactggcagtattgcaaatccatcttaagacaatgcatttggataaacccgagcaggcccacatttgccagtactgcctggaagtgctgcccagtctctacaatctcaatgaacatctgaaacaggtccatgaagcccaggaccccggtttgatcgtaagcgctatgccagctattgtttaccagtgcaacttctgtagtgaagtagtaaacgatttaaacactctccaggaacacataaggtgtagtcacggatttgctaatccagccgcaaaggactccaacgccttcttttgcccacactgttatatgggctttctgactgattcctccctagaagagcatatccgtcaggtgcattgtgacctgtctgggagtcgcttcggctcgccagtgctaggcacccccaaagaaccagtagtggaagtgtattcctgttcatactgcaccaactcacccatttttaactctgtgttgaagctgaataaacacatcaaagagaatcataagaatatcccacttgcactaaactatatacataatgggaagaaatcaagagccttatcccctctgagccccgttgccatagaacagacgtcactgaagatgatgcaggccgtggggggtgcccctgcacggcctaccggcgagtatatctgcaatcagtgtggcgcaaaatatacatcattggatagcttccaaacccatctcaagacacacctagacaccgtgctacccaaacttacatgccctcagtgtaacaaggaatttccaaatcaagagtctcttctgaagcatgtcaccatccatttcatgattacctctacgtactacatatgcgagtcatgtgacaagcagtttacttcagtggacgatttgcagaagcatctgctagacatgcatacatttgtttttttccgctgcacactgtgccaggaggtctttgacagtaaagtgtcaattcagctgcacttagccgtaaaacattctaacgaaaaaaaggtgtaccggtgtacatcttgcaactgggatttccgcaacgagacagacctgcagcttcacgtcaagcacaatcacctggagaatcaaggcaaggtgcacaaatgtatattttgtggagagtcgttcgggaccgaggtggagctgcaatgtcatatcactacacactccaagaaatacaactgcaagttctgttcaaaagcgttccacgcaattatactgctcgaaaaacatctgcgggaaaagcactgcgttttcgagactaagacacctaattgcggcactaacggagctagtgaacaggtgcaaaaggaggaagtggagcttcagacgttgctgacaaactcacaggagtcccacaactcacacgatggtagcgaagaggacgtggatacttccgagccaatgtacggctgcgacatttgcggagctgcatatacaatggagacgctgctccagaatcatcaactgagagatcataatataagacccggagagagcgcgatcgtgaaaaagaaagcggaactgatcaaaggcaattacaaatgcaatgtgtgtagccgcacctttttttcagagaacggcttgagagagcacatgcagacacatctgggccctgtaaaacactacatgtgccctatatgtggtgagcggttccccagtttactgacactcacagagcataaagttacccactcgaagagcctggataccggaaattgccggatttgcaaaatgcctcttcaatcagaagaggagtttctggagcactgccagatgcacccggacttaagaaatagtctaactggcttccgctgtgtagtatgtatgcagaccgtgacatccaccttggagctgaagatacacggaacctttcacatgcagaagacgggcaacggttccgctgtgcagacgacaggccgtggacaacacgttcagaagctttacaagtgcgcatcctgtcttaaggaattccggtcaaaacaggatttagtgaaactggacatcaacggacttccctacggcctttgcgctggatgtgtcaatttatcaaagagcgcatctccagggatcaacgtcccgcctgggacaaaccgacctggattgggtcagaacgaaaacctctctgccatcgagggaaaaggcaaggtcggagggctgaaaactcgatgctcatcctgtaacgtcaaattcgagtcagaaagtgaactacaaaaccacatccaaactatccacagagaactggtgcctgactcaaacagtactcaattgaagacgcctcaggtgagtccaatgccccgaatctctccttctcagtctgatgagaaaaagacgtaccagtgtattaaatgtcagatggtcttctacaatgaatgggatatccaagtgcatgtggccaaccacatgattgacgaggggctaaatcacgaatgtaagctttgcagccagacctttgactcacctgccaaactgcaatgtcacctgatcgaacactccttcgaagggatggggggtacctttaagtgtccggtttgctttacggtttttgtgcaagctaacaaactgcaacagcacattttttcagcacatggtcaagaagacaaaatttacgattgcacccagtgcccgcagaaattctttttccagaccgagttacaagtccacaccgccactccgagacagagctag

SEQ ID NO: 247681 - DNA, 4038 bp, Artificial Sequence
  Description of Artificial Sequence: Synthetic coding sequence
ttcctctctgactacgtgcagtcagaatcactaagagttcgaggccctttatggagtcacccggacggatttgggggtctggcttccatctttcattactatgtcgattataggtcagactcagctgtgcaggacctcgccgatccaaattgtaaactggaagataagaccgaagatggcgaagccctggactgcaagaagcggccagaggatggtgaagaacttgaggatgaagccgtgcacagttgtgattcatgcttgcaggtgtttgaatctctgagtgatattaccgaacacaagattaaccaatgtcaactcacagatggagtcgatgtggaagatgaccctacatgctcatggccagcttccagcccctctagtaaggaccagacaagcccttcccacggcgaaggatgcgatttcggggaagaggagggcggaccaggtctgccatacccctgccagttctgtgacaagagcttctcacgcctgtcatatcttaagcaccatgagcagtcccatagcgacaagttgccatttaagtgcacctactgctcaagactattcaaacataagcgttccagggacaggcatattaagctccatacaggagataagaaataccattgcagtgaatgtgatgcggcatttagccgttccgatcacctcaagatccacctcaagacgcatacttccaataagccctataaatgcgccatatgtagaaggggcttcctctcatcttctagcctgcatgggcacatgcaggtccacgaaaggaacaaagatggcagccagtctggttccaggatggaggattggaagatgaaggacacccagaagtgttcccagtgcgaggaaggctttgactttcccgaagacctgcagaagcacatcgcagagtgccatcccgaatgttcccccaacgaggacagggccgctctgcagtgtgtctattgccatgagctgttcgtagaggagacatcattgatgaaccatatggaacaggtgcactccggagaaaaaaaaaattcctgctccatctgttcagagtcttttcacaccgttgaagagctttacagccacatggacagccaccagcagccagaatcctgcaatcattccaacagtcccagcctggtcaccgtaggctacacgagcgtgtccagcaccactcccgactccaacctcagtgttgattcttctacgatggtcgaggcagcacccccaattcctaagtctagaggcagaaaacgagctgcccagcagactcctgatatgaccgggccatcctccaaacaggcaaaagtgacctatagttgtatttactgcaataagcagctttttagctctttggcggttctccagatccatttgaaaactatgcacctggacaaacccgaacaagcgcacatttgccagtattgcctggaagtgctaccctccctgtataatctcaacgagcaccttaaacaggtgcacgaggcccaagaccccggactcattgtcagcgctatgcctgctatcgtgtatcagtgcaacttctgttccgaagttgtgaacgatcttaacacactccaagagcacatcagatgcagccatggcttcgccaatcctgccgcaaaggactctaacgcttttttttgccctcactgttacatgggcttcttgacagatagcagccttgaagagcacatcagacaggtccattgtgacttatcaggaagccggttcggaagtcccgtcctgggcaccccaaaggagcccgtcgtcgaagtgtattcatgctcttattgtaccaacagccccatatttaattccgtcctcaagctgaacaagcatataaaagaaaaccacaagaacatcccgctcgctcttaactacatccacaacggcaagaagagcagagcgctttcccccctctcacctgtggccatcgagcagacatctttgaaaatgatgcaggcagtgggaggggcaccggctagacctaccggcgagtacatctgtaaccagtgcggcgcaaaatatactagcctggattcttttcaaactcaccttaagacccaccttgatacggtactgcctaaactgacctgtcctcagtgtaacaaagagtttcccaaccaagagtcgctgctgaagcatgtgactattcactttatgataacatcaacatactacatctgtgaatcgtgcgacaaacaattcacaagtgtcgacgacctgcaaaaacatcttctggacatgcacacttttgtgtttttcaggtgcacgctgtgtcaggaagtctttgactccaaggtgtccattcagctgcatctcgctgtgaagcactcaaatgagaagaaggtgtataggtgtacctcttgcaactgggatttccggaacgaaactgatctgcagctgcacgtcaagcataatcacctggagaatcagggaaaggttcacaaatgtattttttgtggcgaatccttcggtaccgaggtggagctgcagtgtcacattactacccactcgaaaaaatacaattgtaagttctgttccaaggcctttcatgccatcatcttgctggagaagcatctgcgagagaagcattgcgtattcgagacaaagactcctaactgcggcacgaacggagcgtccgaacaggtgcaaaaggaggaagtcgagcttcaaaccctgttgaccaattctcaggaaagccacaactcccacgatggatctgaggaggacgtagacactagcgaacccatgtatggctgtgacatttgtggtgctgcgtataccatggagacattgctgcagaatcatcagcttagagatcataacatcagaccgggagagtccgctattgttaagaaaaaagccgaattgatcaaaggaaactataaatgcaatgtgtgctcacggacttttttcagcgagaacggactgcgtgaacacatgcagacccacttgggtcctgttaagcactacatgtgcccaatctgtggggaacggttccccagtctgctgactctgaccgagcacaaagtcacccactccaaaagtctggacaccggcaactgtcggatctgcaagatgccccttcagtcagaagaagagttcctcgagcattgtcagatgcatcccgacctgaggaatagtctgacaggcttccgttgtgtcgtgtgtatgcagaccgtgacttccacgctcgaattaaagattcatggaacttttcacatgcaaaagactggaaacggatcggcagtccaaacaaccggccgaggacagcatgtgcaaaaactgtataagtgcgcctcctgcttaaaggagttcagaagcaagcaggatctcgtaaagctcgacatcaatggcctgccatacggcctatgtgccggatgtgtgaacctcagcaagagcgcctctcccggaatcaacgtcccgcctggtacgaataggccaggcctgggccagaatgaaaatctttcggcgatagaggggaagggcaaagtgggtggtttgaagactagatgtagttcttgcaatgtcaaattcgaatctgaatcagagttgcaaaatcacattcagaccattcacagagaattagtgccggactcaaactctacacagctgaaaacgcctcaagtttcaccgatgccccgaatctctccaagccaatctgatgagaagaaaacctatcagtgtatcaaatgccagatggtcttttataatgagtgggatatccaggtacacgtggccaaccatatgatcgacgagggacttaatcatgagtgcaagttatgttcccagacgttcgattcacccgctaagctgcagtgtcacctgatcgaacattcgttcgagggcatgggcggtacattcaaatgtccagtgtgtttcacggtctttgtccaggcaaacaaattgcagcaacatattttcagtgcgcatggccaggaggataagatctatgactgtactcaatgcccacagaaattcttcttccagactgagttacaggttcacaccgcgactcctaggcagagttag

SEQ ID NO: 247682 - DNA, 2013 bp, Artificial Sequence
  Description of Artificial Sequence: Synthetic coding sequence
atggccgaggtggtggctgaagtggccgaaatgccaacgcaaatgtcccccggagcggtagaaatgagcacccctatgtcggcagaaatgatggaaatgtccaccgaagtcacagaaatgacccctggggaggccctggcatcctccttgttctttcagcaccatcaattcatgtgctccgagtgtggcagcctgtacaacaccctggaagaagtattatcgcatcaggagcagcatatgctcgccgtgtccgaggaggaggccctgaccacacaaaacgtgggcctggagcccgagctggtaccaggcgctgaggggccatttcagtgtggggagtgcagccagcttatactgtccccaggcgagcttttggcccatcaggatgcccacctcagggagtctgctaatcagatacaataccagtgctgggattgtcaagaactctttccatctcccgagctttgggtggcccacagaaaagcccagcatctgagcgcaaccgttgccgagcctcctgtgccccctcccctgccccctcctactcctttacccccaccgagtcctccttctgaagtcaagatggaaccctatgagtgtcccgagtgcagcacactttgcgccaccccggaggagttccttgaacaccaggggacccatttcgacagcctggaaaaggaggaacgaaatggcctggaggaagaggaggaggatgatgaggaagatgaggaggatgacgaggagatggaagacgaagaggccatggcggaggtaggagacgatgccgttggaggggatgagagcacggctggatgggcacagggatgcggcgactgtcctcagcaccagccttctgctggggcacggaggcagcatcgtcggaccgcccacagccccgcatctgcgacacacccattccactgcagtcagtgtcagcggtccttcagctccgccaacaggctgcaagctcatggcagagcccatgtgggcggaacacatgagtgcaccacctgtagcaaggtatttaagaaggccgcaagcctcgaacagcacttgcgccttcaccgcggagaggccagatatttgtgtgttgattgtggcagaggattcgggactgagctcacgttggtggcacacaggcgcgctcacactgcaaacccccttcaccggtgccgctgcggaaaaactttctcgaacatgaccaaattcctgtaccaccgcaggacacacgcaggaaaatcaggcgctccccctacaggagcgaccgcaccacccgctcctgccgaacccactcctcctccgccaccccctgccccaccggcacagcttccctgcccgcagtgctccaagtcttttgcatccgctagtcgtctaagccggcaccggagggccgtgcacggaccacctgaacgacggcatcgctgcggggtttgtggcaaggggtttaagaaactgatacatgtgaggaatcatctgcgtactcataccggggagaggccctttcaatgtcacagttgtgggaagacgtttgcctcactggctaacttgtcgaggcatcaactgactcatactggcgcacgtccctaccagtgcttggactgtggaaaacgattcacacagagcagcaatctgcagcagcaccgtaggttacatctgcggccagtggcctttgctcgagcgccacgactgcccatcacgggcctgtacaataaaagcccgtactactgcggaacgtgcggccgttggttccgggcaatggcagggctcaggctgcaccaacgagttcacgcacgggcacgaacgttaacactacagccgcctaggtcccctagccccgcacctcccccacctccggagccgcagcagacaattatgtgcactgaactgggggaaacaattgctataattgagacatcacagccgttggcactggaagacacgctgcagttgtgtcaggcagcactgggggcatccgaagccggaggattgcttcagctggacacagcctttgtttag

SEQ ID NO: 247683 - DNA, 1581 bp, Artificial Sequence
  Description of Artificial Sequence: Synthetic coding sequence
atggctgaagttgtagccgaggttgctgagatgcccactcagatgagccccggtgctgttgagatgagtaccccgatgtctgcagagatgatggaaatgtcaacagaggtgacggaaatgactccctcccccccaagtgaggtcaaaatggaaccttacgagtgtccggagtgctcaaccctgtgcgccactcccgaggaattccttgagcaccaaggcacccacttcgatagtctggagaaagaagagcggaacggcctggaggaggaggaggaggacgacgaggaggacgaggaggatgacgaagaaatggaagatgaagaagccatggcagaagtgggtgacgacgccgtcggaggggatgaatctaccgctggttgggctcaaggatgcggtgactgcccccaacaccagcccagcgctggggcacggagacagcacaggagaaccgcacactcacctgcttcagccacccacccctttcactgctcccagtgtcagcgatctttctcgtccgcaaaccgactccaagcccatggtagggcccatgtgggcggtactcatgaatgcactacttgctccaaagtgttcaagaaggcggcaagcttagagcagcatctaagacttcaccgcggagaggccaggtacttgtgcgtagactgtgggaggggctttggaacagagcttacacttgtggcccatcgcagggcgcatacagcgaaccccctgcacaggtgtaggtgtggaaagacattcagtaacatgacaaagttcttgtaccatcgcaggactcacgcagggaaaagcggtgctccgcctactggggctacagccccaccagcacccgctgagcctaccccccctcccccaccgccagctcctccagctcagcttccctgtccccaatgctccaaatcttttgcaagcgcttctagactgagtaggcataggagggctgtccacggccctcctgaaaggagacatcgctgcggagtgtgtggaaagggcttcaagaagctaatccatgtgcgcaatcatctgcggacgcacaccggcgagcggcctttccagtgccacagctgtggcaagacatttgctagtctagcgaaccttagtcgacatcaactgacccataccggagccaggccatatcagtgtctggactgcgggaagcgtttcacccagtcctcaaacctccaacagcatcgacgacttcacctgcggcctgttgctttcgcaagagctcccaggctgccaataacgggactgtataataaatctccctattattgcggcacatgcgggaggtggtttcgcgcaatggctgggctgcgcctgcaccagagggtgcatgctcgagctagaaccctgactcttcaacccccacggtcccccagccctgccccacctccaccccctgagccgcaacagacaattatgtgtaccgagctcggcgagaccatcgctatcattgagacttcgcagccactggcactggaggatacactccagctctgccaagccgcacttggcgctagcgaggcgggaggtctgctgcagctcgacacagccttcgtctag

SEQ ID NO: 247684 - DNA, 1983 bp, Artificial Sequence
  Description of Artificial Sequence: Synthetic coding sequence
atggcacacgcactagtgacatttagagacgtcgctatcgacttttcacagaaggaatgggaatgccttgacaccacacagagaaaactgtaccgcgatgtaatgctggaaaattacaacaatctggtttctctcgggtacagcggtagcaaacccgatgtgattacactgttggaacaaggtaaagaaccttgtgtcgttgccagggatgtcactggccgacaatgccccggacttctttcccgtcacaagacaaagaagcttagtagcgagaaagacatccatgaaataagtctgtcaaaggaatcgatcatcgagaagtcaaagaccttgaggctgaagggaagcatcttcagaaatgaatggcagaataagtctgaattcgaggggcagcaggggctgaaggagcgaagcatatctcagaaaaagattgtgtccaagaagatgtccacggataggaaacgcccatccttcaccctcaaccagagaatccacaacagcgagaagtcatgtgacagccatctcgtacagcatggaaagatcgacagtgacgttaagcacgattgtaaggagtgtggatctactttcaacaatgtctaccagcttaccctccaccaaaagatccacaccggggaaaagtcttgtaagtgtgagaaatgcgggaaggtgttctcacattcctatcagctgacgctccatcagaggtttcataccggggagaaaccgtatgaatgccaagaatgtggtaaaacattcaccctctaccctcagttaaatagacaccagaagatccacaccggcaagaaaccctacatgtgtaagaaatgtgataaagggtttttcagcaggctggagctcacgcagcataagcggattcatactggaaaaaagtcgtatgagtgcaaagagtgcggaaaggtcttccagctgattttttacttcaaagagcatgagagaattcataccggaaaaaagccttatgagtgtaaagagtgtgggaaagcattttctgtgtgcggccagttaacaaggcatcaaaagatccacaccggtgtgaaaccttatgagtgcaaggaatgcggtaaaaccttccgcctatccttttatctgaccgagcatcgccgaacccatgcaggtaaaaaaccttatgagtgtaaggaatgcggaaagagtttcaacgtaaggggtcagctgaatcggcacaagaccattcacaccgggattaagccttttgcctgcaaagtgtgtgagaaggccttttcgtattcaggggacctgcgagtgcattcccgaatccataccggggaaaagccttatgagtgcaaggaatgtggaaaggcattcatgctgagatccgtgctgaccgaacaccagagactgcataccggagtcaagccttatgagtgcaaagagtgcggaaagacgtttcgcgtgagatcacagattagcctccataaaaagattcacactgacgtgaaaccctataaatgcgtgcggtgtggcaagacttttaggtttggcttctatcttactgagcaccagcgcatccataccggcgaaaaaccttacaagtgcaaagaatgcggaaaggctttcattcggagaggcaatctgaaggagcaccttaaaatacactctgggctgaaaccctacgattgtaaggagtgtgggaagtctttttccagacgaggccagtttaccgagcaccagaagatccatacaggtgtgaagccgtataaatgtaaggaatgtgggaaagccttctcgcgtagtgtggacctcaggattcatcagagaatccacacaggggagaaaccatacgaatgcaaacagtgcggaaaggcatttcgacttaattcacatcttactgaacaccagagaatccatacaggagagaaaccttatgaatgcaaggtttgccgcaaagccttccgacagtacagccatctctatcagcaccagaaaactcacaacgtgatttag

SEQ ID NO: 247685 - DNA, 1887 bp, Artificial Sequence
  Description of Artificial Sequence: Synthetic coding sequence
atggcccacgccctggtgacgttccgagacgtggccatcgatttcagccagaaggaatgggaatgtcttgacacgacccaaagaaagctgtatagggacgtgatgttggaaaattacaataatctggtgtccctaggactgctgtcgagacacaagactaaaaaattgtcctctgaaaaagatatccacgagatctccttgagcaaagagagcatcatagagaagtcgaagacgttacggctaaaagggtcaattttcagaaatgaatggcagaacaaatccgagttcgagggacagcagggacttaaggagcgcagtatctcccagaagaaaatcgtgtcaaaaaagatgtctacagatagaaagcggccaagcttcaccctaaaccagcgcatccacaacagtgagaaaagctgtgactcccacttagttcagcacgggaaaatagactctgacgttaagcacgactgtaaggagtgtggatcgacattcaacaatgtctaccaattgaccctccaccagaaaatccacactggagagaagtcctgcaaatgtgaaaaatgtgggaaagtcttcagtcattcttaccagttaaccctccatcagagatttcatacaggcgaaaagccttatgaatgtcaagagtgtggaaaaacttttactctgtacccccagcttaaccggcaccagaagattcatacgggcaaaaaaccttacatgtgcaagaagtgtgacaaaggctttttcagtcggctcgaactgactcagcacaaacgtatacacactggtaagaaaagttacgaatgcaaggagtgcgggaaagtcttccagctgattttctatttcaaggagcatgagcgaatccacaccgggaaaaagccctatgaatgcaaagagtgtggtaaagccttttctgtctgcggccaactcacccgccatcaaaagatccatactggcgtgaagccctacgagtgcaaggaatgtggcaaaaccttccgtctctcattctatctgaccgaacaccggagaacccatgcaggcaaaaaaccttatgagtgcaaggagtgcggcaaatcctttaacgtgcggggacagctgaaccgtcataagaccatacataccggaatcaaaccctttgcctgcaaagtgtgtgagaaggccttctcatactccggcgatcttagggtgcactcgcgaattcacacaggcgagaaaccctatgaatgcaaggaatgcgggaaagcatttatgctccgtagtgtccttacagaacaccaaagactccacacgggagtcaagccatacgaatgcaaggagtgcggcaaaacctttcgagtaaggtcacagatttcacttcacaaaaagattcacaccgatgtaaagccctacaagtgcgtgaggtgtggtaaaacatttcgctttgggttttacttgacagagcatcaacggattcacaccggagaaaaaccttacaaatgcaaggagtgcggcaaggcgttcatccgcaggggcaatctgaaagagcatctgaaaatccattccgggctgaagccgtatgactgtaaggaatgtggaaagtccttctcccggagaggacagtttacagaacaccagaagattcatactggggtaaagccgtataaatgcaaggagtgtggaaaagccttcagccggtccgtggacctcagaatacaccagcgtatccatactggagagaagccctacgaatgcaaacagtgcggcaaagctttccgtctgaacagccatttgacagagcaccagcgtatccacactggagagaagccatatgaatgtaaggtatgcaggaaagctttcaggcagtacagccacctgtaccagcatcaaaaaactcataacgtaatctag

SEQ ID NO: 247686 - DNA, 1887 bp, Artificial Sequence
  Description of Artificial Sequence: Synthetic coding sequence
atggctcatgccttagtcactttccgagacgtcgcaatcgatttttcacagaaagagtgggaatgcctggataccacacagcggaagctataccgcgatgtcatgttggagaactacaataacctggtgtctttagggctcctgagcagacataaaaccaagaagctctcatcagagaaggacatacatgagatttcgctcagtaaggagtccataattgagaagtctaagacgctgcgtctgaaggggtccatctttcgtaacgagtggcagaacaaatctgaatttgagggacagcaggggttgaaagaaagaagtatatcccagaagaagatcgtgtctaagaagatgtccaccgatcggaaacggcctagcttcaccctgaatcagaggatccataatagtgaaaaatcttgcgactctcatctggtccagcatgggaagatcgattcagacgtgaaacatgactgtaaagagtgcggatctacattcaataatgtctaccagctgaccctacatcagaagatacatacgggtgaaaagtcctgtaagtgtgagaaatgtgggaaagtcttttcccatagctaccagctgacgcttcaccagagattccataccggagagaaaccttatgaatgccaagagtgtggcaagactttcactctgtatccacaactcaatcggcaccaaaagatacacacaggtaagaagccttatatgtgcaagaagtgtgacaagggtttttttagtcggctggaactgacacagcataaacggatccacaccggtaagaagagctacgagtgtaaggaatgcggtaaggttttccagttaatattttactttaaagagcatgagcgtattcacacgggcaaaaagccttatgaatgtaaagagtgtggcaaggccttctcagtttgcggacagctcacgcgccatcaaaagatacatacaggcgtcaagccatacgagtgcaaggagtgcggaaagaccttccggctttccttttatctgaccgagcacaggaggacccacgcgggaaaaaaaccctacgaatgcaaggaatgcggaaagagctttaacgtgcggggtcagctgaatcgtcataagacgattcataccggcattaagcccttcgcttgcaaggtgtgcgagaaggctttcagctacagcggcgatctacgggttcacagccggattcacactggcgaaaagccatacgagtgtaaagagtgcggcaaggcctttatgctgaggagtgtcctaaccgagcaccagcggctgcacacaggtgttaagccgtacgagtgcaaggagtgtggaaaaaccttccgggtgcggtcacagatcagtctccacaaaaagatacacaccgacgtgaagccttacaaatgcgtgcgttgcgggaaaaccttccggtttgggttctacctaaccgagcatcaacggatacacaccggcgaaaagccctacaagtgtaaagagtgcggaaaagcctttatcagacggggaaatcttaaggagcacctcaagattcattcaggtctgaagccctacgactgcaaggaatgcggcaagtcgtttagcaggcgaggacagtttaccgaacatcagaaaattcacacaggcgtcaagccttataagtgtaaggaatgcggcaaggccttctcacggagcgtggaccttcggatccatcagaggatccatacaggtgaaaaaccctatgaatgtaaacagtgcggaaaggcctttcgactcaacagtcatcttaccgaacatcagaggattcacaccggtgagaagccatatgagtgcaaagtatgcagaaaagcctttcgccagtactctcacctctatcagcaccaaaagacccacaacgttatctag

SEQ ID NO: 247687 - DNA, 1983 bp, Artificial Sequence
  Description of Artificial Sequence: Synthetic coding sequence
atggctcacgcccttgttaccttcagagatgtggcgatcgatttctcccagaaagagtgggaatgtttagatactacccagcgcaaactgtatagagacgtcatgctggagaattataacaacctagtgtcactgggttatagtggcagcaagccagacgtgatcacactgttggagcaaggtaaagagccctgtgtcgtcgcgagagatgttaccgggcgtcagtgccctggtttactgtccaggcacaagaccaagaaactgagcagcgagaaagacattcatgaaatatccctgtcaaaagagtctattattgaaaagtcgaagacgctgaggcttaagggtagcatcttccgaaacgagtggcagaataaatccgagtttgagggccaacagggcctgaaagaacgatctatcagccagaaaaaaatagtgtccaagaaaatgagcaccgacaggaagcggccatcctttactttgaatcagaggatccacaattctgagaaatcttgcgatagccaccttgtgcaacacggaaaaatcgacagtgacgtgaagcatgattgtaaggagtgcggatccacatttaacaatgtgtatcaattaactttacaccagaaaattcatacaggggaaaagtcatgcaaatgtgaaaaatgcggcaaagtgttcagccattcctaccaactgactctgcatcagagattccacactggagagaagccttacgagtgccaggaatgcggcaaaacatttacgctgtatccgcagctcaacaggcaccagaagatacacactggtaagaaaccctacatgtgcaagaaatgcgacaaaggattcttcagccgacttgaattgacccagcacaagcgcatacacacagggaaaaaaagttatgagtgtaaagagtgcggaaaggtgtttcagctgatcttttattttaaggagcacgagaggatccacacaggaaaaaagccatacgagtgcaaagaatgcggaaaggcttttagcgtctgcggccagctcacccggcatcagaaaattcacacaggagtcaagccatatgaatgtaaagaatgtgggaagacgtttaggctgagtttttacttgacagagcaccgccgaacccacgctggaaaaaagccgtacgaatgtaaggaatgtggcaagagtttcaatgtgcggggacagttaaacaggcacaagacgatccatacaggaattaaacccttcgcctgtaaggtgtgcgagaaggcctttagctattccggcgatctgcgagtgcactctcgtattcacaccggggagaagccatatgaatgtaaggaatgtggtaaagcctttatgctacggagcgtgctgacagagcaccaaaggctccacactggggtgaagccttacgagtgcaaggaatgtggaaagacctttagggtccgatcccaaatttccctgcataagaaaatccatacagacgttaaaccctacaagtgcgtgagatgtggcaagacctttaggtttgggttctatttgaccgagcatcagcgcatccatacaggcgaaaaaccttataaatgcaaggaatgcgggaaggccttcatcaggagagggaacttgaaggaacacctcaagatccactcaggattaaagccatacgattgcaaagaatgtgggaaatcctttagtcggcgaggacagttcacagaacaccaaaagatccatacgggcgtgaagccttataagtgtaaggaatgcggcaaggccttcagtcgatccgtggacctgcgcattcaccagaggattcacactggtgagaaaccatatgagtgcaaacaatgcggtaaagcattccggctgaactcccacttgactgaacatcagcggatacatacgggggagaaaccgtacgagtgtaaagtgtgccgaaaggcttttcgccagtactctcacctgtatcagcaccaaaaaactcacaatgtgatttag

SEQ ID NO: 247688 - DNA, 1500 bp, Artificial Sequence
  Description of Artificial Sequence: Synthetic coding sequence
atggcacaagggctggtgacatttcgggacgtagccattgagttctctctcgaagagtggaagtgtttagagcctgctcaaagggacctgtatcgcgaagtcacgcttgagaacttcgggcacttggcttctttggggctgtccataagcaagccagatgtggtttcacttcttgaacaaggcaaagagccatggatgatcgccaacgatgtcactggcccttggtgcccagacttagagtcgagatgtgaaaagtttctgcagaaagacatcttcgaaatcggcgcatttaattgggagatcatggaatctttgaagtgcagcgatcttgaaggaagtgattttagggctgattgggagtgcgaaggtcagttcgagaggcaggttaatgaggaatgctacttcaaacaggtgaacgtgacatatggacacatgcccgtttttcagcaccacacctctcacaccgtaaggcagtcacgtgaaactggggagaagctgatggagtgccatgagtgtggcaaggctttttctaggggttcacatttaattcagcaccagaaaatacatacgggcgagaaaccttttggttgtaaggaatgcggtaaggcctttagccgagcttcacacctggtacagcatcagcgcattcacaccggcgagaagccatatgattgtaaagactgcggcaaggcatttggcagaaccagcgagttgatacttcaccaacgtctgcacacaggcgtaaagccatatgagtgtaaggaatgcgggaaaacattccggcagcacagccaactgattctgcaccagcggacacacacaggcgaaaagccatatgtctgtaaagactgcggaaaagccttcattagaggctcacagctgaccgtacacaggcgaatccatacaggtgcgaggccgtatgagtgtaaagaatgcggcaaggcatttaggcaacactcccagctcaccgttcaccagcggatccacaccggtgaaaagccttacgagtgtaaggagtgtggaaaaggatttatacattcatccgaagttacccggcaccagcgaatccactccggcgagaagccctacgagtgcaaagagtgtggcaaagcttttcgccaacacgcccagctgacccgacatcaaagggttcacaccggggatagaccttacgagtgcaaagactgtgggaaggccttttcaaggtccagctacctcattcagcaccagaggattcatactggagacaagccctacgaatgcaaggaatgtggtaaagcattcatccgtgtgtcgcagttaacccaccatcagcggatccacacttgcgagaaaccctatgagtgtagagagtgcgggatggcattcatcagatccagccaattaacagagcaccaaagaatccatcccggaatcaaaccttatgagtgtcgcgagtgtggccaagctttcatcctgggaagtcagctcatcgagcattacagaatccacactggatag

SEQ ID NO: 247689 - DNA, 1620 bp, Artificial Sequence
  Description of Artificial Sequence: Synthetic coding sequence
atgcgcagaggcccatgggagcgctggagcctggctagccacagactggatgcgggattgtgcacatgcccgagggaagaatcccgggaaattagagccggacagattgtgctgaaggctatggcccagggccttgtaacctttagggatgttgcaatcgagttctcgctggaggagtggaagtgcttggagcccgctcagagggatctgtacagggaagtaacactggaaaactttggtcatttagcatcactcggactgtcaatatctaaacctgacgtcgtgtccctgctcgaacaggggaaggaaccgtggatgatcgcaaacgacgtgaccgggccatggtgccctgatctagagagccgatgtgaaaagtttctccagaaagatatattcgaaatcggcgcatttaactgggaaatcatggaaagcctcaagtgctccgatttagagggatcagactttagggccgactgggagtgcgaggggcaattcgagagacaagtgaacgaggagtgttatttcaagcaggtaaatgttacctacggccacatgccagtgttccaacaccacacaagccacacagtccggcaatccagagaaacaggagaaaaattgatggagtgtcacgaatgcggtaaggcattttctcgcggttcccatctgatccagcaccaaaagattcacacgggagagaagccatttgggtgtaaagaatgtggaaaggccttttcccgagcctctcacttagtgcaacaccaaagaatacatacgggcgagaagccatacgattgtaaggattgcggcaaagctttcggtcggacatccgaactcatcttgcatcagcgcctgcataccggggttaagccatatgaatgtaaggagtgcgggaagacctttaggcagcactctcagctgatactgcaccagcgcacccacaccggagagaaaccttatgtgtgcaaggactgcggtaaagcatttatcagaggatctcaactgaccgtccacaggaggatccacaccggcgctcgcccatacgagtgcaaggaatgcggaaaggcctttcggcaacattcccagctgacggttcaccagcgtatacacactggcgagaaaccctatgaatgcaaggagtgcggaaaaggttttatccatagcagtgaagtgactaggcatcagagaattcatagtggggaaaagccttatgagtgtaaggagtgcgggaaggccttccgacaacacgcccagctgacgcgccaccaacgcgttcacactggtgaccgaccttacgagtgcaaggattgtggcaaagccttctctcgttcttcctatctgatccagcaccagcgcattcacaccggggacaagccctacgagtgcaaagagtgcggcaaggcattcatccgcgtgtcacagcttacacatcaccaaaggattcacacctgcgagaaaccatatgaatgccgcgagtgcggtatggcgttcatcagatcctctcagttaaccgagcaccagcggatccaccccggaattaagccttacgagtgtcgagaatgcggtcaggcttttattctgggaagccagctgatagagcactatcggattcataccgggtag

SEQ ID NO: 247690 - DNA, 1500 bp, Artificial Sequence
  Description of Artificial Sequence: Synthetic coding sequence
atggcccagggcctggttacatttagggatgtggccatcgaattttctctagaggagtggaaatgcctcgagccggctcaaagagacctgtaccgtgaggttaccctggaaaacttcggccatttggcgtctctaggcctgagtatcagcaaaccggacgtcgtgtcactgctggagcagggaaaagaaccttggatgatcgcaaatgacgtgactgggccatggtgtccagacttggagagcaggtgcgaaaaatttctacagaaagacatcttcgagattggagcgtttaactgggagatcatggagtccctaaaatgttcagacctggagggaagcgattttagagccgattgggagtgcgagggacagtttgagcgtcaagtcaacgaggagtgttacttcaagcaggtaaatgtgacatatggccacatgccagtatttcaacatcatacatcccacaccgtgcgtcagtcacgggaaactggggagaaactcatggagtgtcacgagtgcggtaaagctttctcgcgagggtctcatttgattcagcatcagaagatacatactggcgagaaaccttttgggtgcaaggagtgtgggaaagctttctcaagggcctcacatctcgtgcagcatcagagaatacataccggggagaagccttacgactgcaaggattgtgggaaggctttcgggagaacgtctgaactgattctgcatcagcgccttcacaccggggtaaagccatatgagtgtaaagagtgtggcaaaacctttcgccagcattcacagttgattctccaccaaagaactcacaccggggagaaaccgtatgtgtgtaaagattgcggaaaggccttcatccgagggtcacagctgactgtgcatcgaaggatacataccggagctagaccgtatgaatgtaaggaatgcggcaaagctttcagacagcatagtcagttgacagtccaccagaggatccacacaggcgaaaagccatacgagtgtaaggagtgtggaaaaggcttcatccattcctctgaggttaccaggcatcagcggatccacagcggcgagaagccatacgagtgtaaggagtgcggaaaagccttccggcaacacgcgcaactaacacggcaccagagggtgcacaccggggatagaccgtacgaatgcaaggactgtggtaaagccttcagtcgatcctcctacctgattcagcaccagcggatccatacgggcgacaagccctacgagtgcaaggaatgtgggaaggccttcataagggtgtctcagcttacacaccaccaaagaatccacacgtgcgaaaaaccctacgaatgtagagagtgcggcatggctttcatccgatcatctcagctgacagagcatcaacgaattcatccaggtattaagccctatgagtgtagggagtgcggtcaggcattcattctaggttctcagttgattgagcactaccggattcacactggctag

SEQ ID NO: 247691 - DNA, 2061 bp, Artificial Sequence
  Description of Artificial Sequence: Synthetic coding sequence
atgacagagagtcagggcacagtgacttttaaggatgtggctattgactttactcaggaggagtggaaaagattggatcctgcccaacggaagctctaccggaatgtaatgctggaaaactataacaacttgatcactgtgggttaccccttcacaaaaccggatgttattttcaagctggaacaagaagaggagccttgggtcatggaggaggaggttcttcgtcggcattggcagggcgaaatttggggggtagatgagcaccagaagaaccaggataggctcttacgccaggtagaggtgaagttccagaagaccctgaccgaagagaaagggaacgagtgccaaaaaaagtttgctaacgtgttccccctgaacagcgacttttttccaagccggcacaacctgtacgagtacgacctattcgggaaatgtctggaacacaactttgattgtcataataacgttaagtgtctcatgcggaaagaacattgtgagtataatgagcccgttaaatcatacggaaatagctcaagtcacttcgttattaccccattcaagtgtaatcattgtggaaagggcttcaatcagacactggatctgatccggcacctacgcatccacacaggagagaagccatacgagtgtagcaactgccgcaaggcctttagccataaggaaaaactcatcaagcattacaagattcactcccgcgaacagtcatataaatgtaatgagtgtggtaaagcctttattaaaatgagcaacctgattcgccatcaacgcattcacactggcgagaagccctacgcatgtaaggaatgcgaaaagtcattcagccagaagtctaaccttattgaccatgaaaaaatacataccggagaaaagccttatgagtgtaacgagtgtggcaaggcatttagtcagaaacagagtcttatcgcccaccagaaagtgcacacaggcgagaagccctacgcatgcaatgagtgtggaaaagcttttcccagaatcgcgtccctagctttgcatatgcgaagtcacaccggagagaagccgtacaagtgtgataaatgtggtaaggccttttcccagttcagcatgctgatcatccacgtacggatccataccggcgaaaagccgtacgagtgtaacgagtgcggcaaagctttttcccagtccagtgctctcaccgttcatatgagaagccatacaggggagaaaccgtatgagtgtaaagagtgcagaaaagctttcagccacaaaaagaacttcatcacacatcaaaagatacatactcgcgaaaagccctatgagtgtaatgagtgtggcaaggcatttattcagatgtcaaatcttgtgagacatcagagaatccatactggtgaaaaaccatacatctgcaaggagtgtggtaaggcattcagccagaaaagtaatcttatcgcacacgagaaaattcacagtggcgaaaaaccatacgagtgtaacgagtgtggaaaggcctttagtcaaaaacagaactttatcacccatcagaaagtgcacaccggagaaaagccatacgattgcaacgaatgtggaaaggctttcagccagattgcatccctaacattacatcttcgcagtcacaccggtgagaaaccatacgagtgtgataagtgcggtaaggcttttagccagtgtagtctactgaatctccacatgagatctcacacgggggaaaaaccttacgtctgcaacgagtgtggcaaggcgttctcacagcggacatcactgatagtccacatgagaggccacacgggcgagaagccatacgaatgtaacaaatgcggcaaagctttcagccagtcaagttccctgacaatccatatcagaggacacaccggcgagaaaccattcgactgttccaaatgcggcaaggccttctcacagatcagctctcttacacttcacatgaggaagcacaccggcgaaaagccctaccactgtatcgagtgtggtaaagccttctctcagaagagccatttggtgcggcaccaaagaattcatacccactag

SEQ ID NO: 247692 - DNA, 1029 bp, Artificial Sequence
  Description of Artificial Sequence: Synthetic coding sequence
atgaggagccatacaggagagaaaccatataaatgtgacaaatgtggcaaagccttcagtcagttttcgatgctaattatccatgtgcgcatccataccggtgaaaaaccttatgagtgcaacgagtgcgggaaagccttttcacagtccagtgcacttacagtacacatgaggtcccatacaggggagaagccgtatgagtgcaaggaatgcaggaaggccttctctcacaagaagaactttattacccaccagaagattcacacacgagaaaagccctatgagtgcaacgaatgtgggaaggcatttatccagatgagtaacctcgtgcgccatcagcggatccatactggagagaaaccatacatatgcaaagagtgcggtaaggccttttcacagaagagtaacttaatcgcacatgaaaagattcattccggggaaaaaccctacgagtgcaatgaatgcggcaaggcttttagtcagaaacagaacttcatcacacaccagaaggtgcacactggcgagaagccctacgactgcaacgagtgcggcaaggccttcagtcagattgcatcattaacattgcacttgagatcacacactggtgagaaaccctatgaatgtgataagtgcgggaaggcgttctcccaatgcagcctgctgaacctgcacatgcggagccataccggggaaaaaccgtacgtttgtaacgaatgcggtaaggctttttctcagaggacatccctaattgtacacatgagaggccacactggggagaagccttacgaatgtaataaatgcgggaaagcgtttagtcaatctagctcactgactatccacatccgcggtcataccggcgagaagccctttgattgcagcaaatgtgggaaggcattctctcaaatcagcagcctaacgctgcatatgaggaaacatacaggtgaaaaaccctatcactgtattgaatgcggcaaggccttttcgcaaaagtcccatctggtccggcaccagcgaattcatacccactag

SEQ ID NO: 247693 - DNA, 1584 bp, Artificial Sequence
  Description of Artificial Sequence: Synthetic coding sequence
atgaggaaggagcattgcgagtacaacgagccagtaaaaagctacggcaactcatcctcacacttcgtcataactccatttaaatgcaaccactgcggcaaagggtttaatcagactttggatttgatccgtcacttgaggatccacacaggagaaaagccctatgaatgctcaaactgtcgcaaggctttcagccacaaagaaaaactgatcaagcattataagatacactcccgagaacaatcatacaaatgtaatgagtgtgggaaggcattcatcaagatgtctaacctgattcggcaccagcgcatccatacaggagagaaaccttacgcttgtaaggaatgtgagaaatcttttagccagaaatccaacctgatcgatcatgaaaaaatacatacgggtgaaaagccttatgaatgcaatgagtgcgggaaagcattcagtcagaagcagtccctgattgcccaccaaaaagtgcatacaggggaaaaaccttatgcgtgcaatgagtgtggaaaagcctttccccgaattgcatctcttgcccttcatatgaggagccataccggcgagaagccatataaatgtgataaatgtggtaaagccttttcccagttcagcatgctcatcatccatgtccgaatccacactggtgaaaaaccctatgagtgtaatgaatgcggaaaggccttctctcagtcttccgccctgacggtgcatatgcgatcacacaccggagagaagccttatgaatgcaaggaatgtcggaaggccttctctcacaaaaagaatttcataacccaccagaaaatccatacccgcgagaaaccatacgagtgcaacgaatgcggcaaggccttcatccagatgagcaacttagttagacaccagcgaatacacactggtgagaagccatacatttgtaaagaatgcggcaaagccttttctcaaaagagtaatctgattgcacacgagaaaattcactccggcgaaaagccctatgaatgtaatgagtgtggcaaggctttttcccagaagcagaatttcattacacatcaaaaggtccacacaggcgagaaaccatatgattgtaatgagtgcgggaaagccttctcccagattgcgtcactgacactacacttgagaagccataccggagaaaagccttatgaatgcgataagtgcggcaaggcgttctctcaatgttctctcctgaacctgcacatgcggtcccacacaggagagaagccttacgtttgtaatgagtgtggaaaagcattcagtcagcgaaccagcctcatcgtccacatgagaggccacacaggagaaaaaccatacgagtgcaacaaatgcggaaaagcatttagtcagagctcatcactcacgatccatatccgcggtcataccggtgaaaagccattcgattgtagtaagtgtgggaaggccttttcacaaatctcttctttgacgctgcacatgaggaaacacaccggagaaaagccctaccattgcatcgagtgtggcaaggcctttagccagaaaagccacttggtgaggcaccagcgaatccatactcattag

SEQ ID NO: 247694 - DNA, 1551 bp, Artificial Sequence
  Description of Artificial Sequence: Synthetic coding sequence
atgttcgagcagcttaaacctatcgaacccagagactgttggcgtgaggcaagagtgaaaaagaaacccgtgacattcgaggacgttgcagtgaactttacgcaagaagaatgggactgtctggatgcatcccaacgagtactgtaccaggatgttatgtcggagacctttaagaatctgacaagtgtcgcccgaatctttctccataaaccggagctcattaccaagctcgagcaagaggaagagcaatggcgggagttcgtacacctgccgaataccgagggcctctcagaaggtaagaaaaaagagctgcgggagcagcatccttctctcagagacgaaggcacttcagatgacaaggttttcctggcttgccgcggtgccggacagtgccctctgtcggcccctgccggaacaatggaccgtacgcgcgtgcttcaagcaagtcaggcaggaccgccattcttttgttacacctgcggtaagtgcttcagccgccgatcctacttgtactctcaccagttcgtgcataatcccaaactcacaaatagctgcagccagtgcggaaagctcttccgttccccgaaaagcctgtcttaccatagacgcatgcacctgggagaacgcccattttgctgcaccctctgcgacaaaacctactgtgacgcctctggcctgtcaagacaccgacgagtgcacttagggtaccgccctcattcctgttcagtctgcggaaagagtttccgcgaccagtccgagctgaaacggcatcagaaaatccatcagaatcaggagcctgttgatgggaatcaggaatgtaccctgcgcattccaggtacccaagcggagtttcagacgccaatagcacgaagtcagcggagcatacagggcttgctcgatgtcaaccatgcccctgttgccagaagccaagaacccatattccggacagagggcccaatggcacaaaatcaggcctctgtgctgaagaaccaggctccggttacacgaacccaggctccaattactggtactctctgtcaggatgcaagatcaaatagccaccctgttaaaccgtccagactcaacgtgttctgctgtccccattgctctctaactttttcgaagaaatcctacctgagccgccaccagaaagcccacctaaccgagccgccaaattactgcttccactgctccaagtctttttcatccttcagccgactggtccggcaccaacagacgcattggaaacaaaaaagttacctctgtcccatctgtgatttgtcatttggtgaaaaggagggcttaatggaccattggaggggctacaagggcaaagatctctgccaatccagccaccataagtgtagagtgatcttagggcagtggctgggcttctcccacgatgtaccaaccatggctggggaggaatggaaacacgggggagaccaatctcctcccagaattcacacgccaaggcgccgaggcctgagagaaaaggcttgcaagggcgacaagacaaaagaagcagtgtcgatccttaaacacaagtag

SEQ ID NO: 247695 - DNA, 1551 bp, Artificial Sequence
  Description of Artificial Sequence: Synthetic coding sequence
atgtttgagcaactgaaaccgattgaaccacgcgattgctggagggaggctcgagtgaaaaaaaagcctgtcaccttcgaggatgtggccgtcaattttacacaggaagagtgggattgtctcgacgcctcacaaagggtcttgtatcaggatgtcatgtctgaaacattcaagaacctcaccagtgtggcacgaatctttcttcataaaccagagttgatcacaaaactcgaacaggaggaagagcagtggagagaatttgtgcacctgccaaacaccgaaggcctaagcgaaggcaaaaagaaagagttacgcgagcagcacccatccctcagggacgagggaacttcagacgacaaagtcttcctcgcgtgccgaggtgctgggcagtgtcccttatccgcacccgctggaaccatggatagaacgcgcgtcctccaagcatcccaagccggtccccctttcttctgttatacgtgtgggaagtgtttcagtaggcgatcatacctgtattctcaccagttcgttcacaatccaaagctgacaaatagctgttctcagtgcgggaaattattccggtcacccaaaagcctcagctatcacaggcgcatgcatctgggagaacgcccattttgctgtaccctgtgtgataaaacctactgtgacgcctctggcctatctagacatcgacgcgttcatcttgggtacaggcctcacagttgctcggtgtgcggtaaatctttccgggatcaaagtgagctaaagagacaccaaaagatccaccagaatcaagagccagtggatgggaaccaggagtgcactctgagaattcctggaactcaagctgagtttcagacccctattgcaagaagccaacgctcgatccaggggcttcttgacgtcaatcatgccccagttgcaaggtcacaagagcctattttccgcactgagggtccgatggcacagaaccaagcttcagtcctgaagaaccaggccccagtgacgcgaacacaagcccctatcaccggcacactctgccaggatgccaggtccaactcccaccctgttaaacctagtcgcttgaacgtgttttgttgcccacactgcagccttacatttagcaagaagagttatctaagcagacaccagaaagctcacttgactgagccacccaattactgctttcactgtagtaaatcatttagcagtttcagtaggctggtgcgacaccagcagacccactggaaacagaagtcctatctctgtcccatttgcgatttgtcctttggtgaaaaagaagggttgatggatcactggcggggatataagggcaaagatctgtgccaaagctcccaccataaatgccgggtgattctcggacagtggctcggctttagccatgacgtccccactatggcaggcgaagagtggaaacacggcggagatcagtctccaccccgaattcacactccccgtagaagaggacttcgcgagaaggcctgtaaaggagacaagaccaaggaagccgtctccatcctgaagcacaaatag

SEQ ID NO: 247696 - DNA, 1551 bp, Artificial Sequence
  Description of Artificial Sequence: Synthetic coding sequence
atgttcgagcagctcaagccaatagaaccccgagattgttggcgggaagcgagagttaaaaagaaacctgttaccttcgaggatgtcgcggtcaactttacccaagaggaatgggactgcctggatgcatctcagcgcgtgctctaccaagacgtcatgagcgagacatttaaaaacctgactagcgtggctagaatctttctgcataaacccgaattgatcacaaaactcgagcaggaggaggaacagtggcgggaattcgtccacctccctaacactgaagggctttctgaaggcaaaaagaaagagttgcgagagcagcatccctctctccgcgatgaggggacttcagacgacaaagtgttcctggcttgccggggtgccggacagtgtccgctgtctgcccctgctggcaccatggaccgtacacgtgttcttcaggcctctcaagctgggcctccctttttttgctacacatgcggtaaatgtttctccagacgttcgtatttgtacagtcaccagtttgtgcacaatcctaagcttaccaacagctgttctcaatgtgggaaacttttccgctcaccaaaatcccttagttatcacaggcgaatgcacttaggtgagcggcctttctgttgcaccctgtgcgacaagacatactgcgacgccagcggactgagcagacacaggcgggtgcatctcggctaccggcctcactcttgctctgtgtgcggcaagtcctttagagaccagagtgagctaaaacggcatcaaaaaattcaccagaaccaagaacccgtcgacgggaatcaagagtgcacactaagaattcccggaacccaggccgaattccagacaccaattgcacgcagtcagcgctcaatccagggccttttggatgttaaccatgccccagtagccaggagtcaggagcccatattccgtactgagggaccaatggcacaaaaccaggctagcgtccttaagaaccaagctcctgtcacaaggacccaggcccctatcacgggcacgctgtgtcaggatgcccgttctaatagccatccagtgaagccctcaagacttaatgtgttttgttgtccccactgctctctcaccttttctaagaaaagctacttaagtagacaccagaaggcacatctgacagagcccccaaactactgcttccattgctcgaagtcttttagtagtttttctcggctcgtgagacaccagcagacccattggaagcagaagtcttacttatgccccatctgtgatctcagtttcggagagaaggagggactgatggatcactggcggggatacaaagggaaggatttgtgccagtcatcacatcataaatgccgcgtgatattaggccagtggctgggatttagccacgatgttcccactatggccggagaagagtggaagcatggcggagaccagagtccacccagaattcacaccccccgtcgcagaggtctgagggaaaaggcatgcaaaggtgataaaaccaaagaagcggtatctattctcaagcacaaatag

SEQ ID NO: 247697 - DNA, 1551 bp, Artificial Sequence
  Description of Artificial Sequence: Synthetic coding sequence
atgttcgaacagctgaaacctatcgagcccagggactgctggagagaagcgagggtgaaaaagaagcccgttaccttcgaggatgtggccgtgaatttcacccaggaagagtgggattgcctcgatgcgtctcagagggttttgtaccaggacgttatgtcggaaacatttaaaaatctgacgagcgtcgccagaatcttcctccataagccggaattaattaccaagcttgagcaggaggaggaacagtggcgggaattcgtgcatctcccaaataccgagggcctgagcgagggaaagaagaaggagcttcgggagcagcatccatcgctgcgggacgaaggtacttctgacgataaggtctttctcgcctgtcggggagccggacagtgtcctctatccgcacccgctgggactatggatcggactcgagtgctgcaggccagccaagctgggccacccttcttttgttacacctgcggcaaatgcttcagccggcgaagctacctctattcccatcagttcgtgcataacccgaaactgacaaattcctgctcacagtgtggaaagctgtttcgtagcccgaagagccttagctaccataggcgcatgcatttaggtgaacggcctttctgttgcacgctgtgtgacaagacatattgcgatgcatccggattaagtaggcaccgcagagttcacttggggtatagaccacactcatgctctgtctgcggcaaatccttccgcgaccagtctgaacttaaaagacaccagaaaatccatcagaatcaggagcctgtggacggaaatcaggagtgtacgctgagaattcccggaacacaggcagagtttcaaacccccatcgcacgcagtcaaaggtccatccaggggttgctggatgtgaaccacgctccagtggcccgtagccaggaacccatcttcaggaccgaggggccaatggcccaaaaccaggcttctgtattgaaaaatcaggcccctgttacaaggactcaggcccctatcacaggaacactctgccaagacgccaggagcaattcccatccagtgaaacctagccgtctcaatgtcttctgttgccctcattgttctctcaccttttcaaaaaagtcctacctttcccgccaccaaaaagctcacttgacggaacctcccaactactgctttcactgcagtaagtctttcagttcattctcaaggctggtgagacatcagcagacgcactggaaacaaaaatcatatttgtgccccatatgtgacttgtcattcggggaaaaagaggggctcatggaccattggagaggatataagggcaaggatctttgtcagtcttcacaccataaatgcagggtcatcttgggccaatggctcggcttctctcatgacgtgccaacaatggctggtgaggagtggaaacatggcggagaccaatcgccccctagaatccatacgccccgacgcagaggccttcgggagaaggcgtgtaaaggagacaagacaaaggaggcagtgtccatactcaaacacaaatag

SEQ ID NO: 247698 - DNA, 636 bp, Artificial Sequence
  Description of Artificial Sequence: Synthetic coding sequence
tgagcaaggagccaggagccgatattcaggacggaaggcccaatggcccagaaccaagcatccgtgctgaagaaccaggcccctgtgactaggacccaagcacctattaccggcaccctgtgccaggacgcgaggagcaattcacatccagtaaaaccatcacggcttaatgtcttctgttgccctcactgttcactcacttttagtaagaaaagttatctgtctagacatcagaaagctcacttgaccgagccccctaattattgtttccattgtagtaaatctttctcctcgttctcaagactggttcggcatcagcagactcactggaagcaaaagtcttatttatgccctatttgcgacctgtccttcggcgaaaaagagggtctcatggaccactggcgtggatacaagggcaaagatctgtgtcaatcttcccaccacaaatgtcgtgtgatcctcgggcaatggttaggatttagtcatgacgtaccaacaatggccggtgaagagtggaagcatgggggtgaccagagtccacctcgtatccacacccctaggcggaggggactgagggaaaaggcgtgtaagggcgataaaacgaaggaggcagtgagcattctgaaacacaagtag

SEQ ID NO: 247699 - DNA, 1551 bp, Artificial Sequence
  Description of Artificial Sequence: Synthetic coding sequence
atgtttgagcagcttaagcccattgaacctcgggattgctggcgagaggctcgagttaagaagaaacccgtgacgttcgaagatgtcgcggtcaactttactcaggaggagtgggattgccttgacgctagtcaaagggtactgtaccaggatgtgatgagcgaaacattcaagaatctgactagcgtagcacggatcttccttcataagcctgagctcataacaaaactggaacaggaagaagagcagtggcgggaattcgtccacctccccaataccgagggtctatcagagggcaagaagaaggagctgcgggaacagcacccaagtctgcgggatgagggcaccagcgatgacaaagttttcctggcctgtcgaggcgcagggcagtgtcccctgtccgcccctgccggaacaatggaccgaacgagagtgcttcaggcctcccaagctggacctccctttttctgttatacctgcggtaagtgttttagcaggagatcctacctgtactcccaccagtttgtgcataatcccaagctcaccaattcatgttctcagtgcggtaaactttttaggtccccaaaaagcctctcataccatcgcagaatgcacctgggagagcgacctttctgctgtaccttatgtgataaaacttactgcgatgcttctgggctgtctcgccatcgtcgagttcatttaggctataggcctcattcatgttctgtctgtggaaaatcctttcgcgaccagagtgaattgaaaagacaccagaagatacatcagaaccaggagcccgtggacgggaaccaggaatgcacgctgcgtattcccggtacgcaggccgaattccaaacaccgattgcgagatcacagcgatctattcagggcttgctggacgtgaatcacgctcctgtcgcccgtagccaagagccaatcttcaggacagaaggaccgatggctcagaatcaggctagtgtgcttaaaaaccaggctccagttacacggacccaggcccctatcactgggacactgtgtcaggatgctcgaagcaattctcatccagtgaaaccctcacgtttgaatgtgttttgttgcccacattgcagtctcacattcagcaaaaagtcatatctaagtaggcaccaaaaggcccacctaactgagccaccaaactactgcttccactgctccaaaagcttcagctccttttccaggctcgtgcggcatcagcagactcattggaagcaaaaaagctacctgtgtcccatatgtgacctgtctttcggcgagaaagaagggctgatggaccattggcgcggatacaaaggcaaagatctgtgtcaatcctcacaccacaaatgtcgtgtcattctgggtcaatggttgggattttcccacgacgtcccaactatggccggtgaggaatggaagcatggaggagatcagagccctccacgtattcacactcctcggaggaggggtttgagggaaaaggcttgcaagggcgataaaactaaagaggccgtaagtatcctcaaacacaaatag

SEQ ID NO: 247700 - DNA, 1551 bp, Artificial Sequence
  Description of Artificial Sequence: Synthetic coding sequence
atgttcgaacagctgaagcccattgagccccgtgactgttggagagaggcacgagtaaagaagaaacctgtgacttttgaggatgttgctgttaacttcacacaagaggaatgggattgcttggacgcctctcagagagtcctataccaggatgttatgtcagagaccttcaaaaacctcacatcggtagctagaatcttccttcacaaacccgaactcatcaccaaactggaacaggaagaggagcaatggagagagtttgtccatcttcctaacactgaaggcctgagcgaaggcaagaaaaaggagctgagggaacaacaccctagcctcagggatgagggcacatcagacgataaagtttttctggcctgtcgtggcgcagggcagtgtccgctgtcagctcctgcaggcactatggaccgcactcgagtgttacaggcaagtcaggctggacccccattcttttgttacacttgtggtaaatgcttttctcggcgttcctatctatacagccatcaattcgttcacaatccaaagctgacgaactcttgctctcagtgtggcaaactgtttcggtcaccgaagtccctgtcttaccatcggcgaatgcacttgggcgagagaccattttgctgcaccctctgtgacaagacctattgcgatgcttccggcttgtcccgccaccgcagggtccacctgggttatagaccccactcttgcagcgtatgcggaaaatcattccgggaccagagcgaactgaaacggcatcaaaagatccaccaaaaccaagaacctgtggatggaaatcaggaatgcaccttacgtatcccgggaactcaggctgagtttcagaccccaatagcaaggagccagcggagcatccaggggctgctggatgtgaaccacgccccagtcgccagatcacaggagcccattttccgtaccgaaggcccaatggcccagaatcaggctagcgttctcaaaaatcaggcccctgtgacaagaacacaggcccctattaccggcacgctatgccaggacgcaaggtccaactcacaccctgtgaagcctagcagactgaacgtattctgttgtccccattgctccctgacattctcaaagaagagttacctctccagacaccagaaggcccacctgacggaaccgccaaattattgttttcattgttccaaatccttctcctccttctcgcggctggtccggcaccagcaaacgcattggaagcaaaaatcttatctgtgcccgatctgtgacttgagctttggagaaaaagaagggcttatggaccattggagagggtataaagggaaggatctctgtcagtccagccaccacaagtgtagagtgattttgggacagtggctaggtttctctcacgacgtgccgaccatggcgggagaggaatggaagcacgggggagaccaatccccccctcggatacacacgccgagaaggcgcggattgcgggaaaaggcctgtaaaggtgacaagacaaaagaagctgtatctatattgaagcataaatag

SEQ ID NO: 247701 - DNA, 1551 bp, Artificial Sequence
  Description of Artificial Sequence: Synthetic coding sequence
atgttcgagcagcttaagcccatcgagccacgggactgttggcgggaggctcgggtaaagaaaaaacccgtgacctttgaagacgtagccgtaaactttacccaagaagaatgggactgtctcgacgcttcccagagagtcctttatcaagacgttatgagtgagacttttaaaaacctaacgtccgtcgccagaatatttctgcacaaaccagagctcataaccaagttggaacaagaagaagagcaatggcgtgaattcgtgcatctaccgaacaccgagggcttgtccgagggtaaaaagaaagagctgcgagagcagcacccaagcctaagggacgagggcacctctgacgacaaggtcttcctggcatgtaggggtgccggtcagtgtcccttatccgccccagccggtaccatggatcggacacgggttttacaagcgtctcaggctggacctcccttcttttgctatacttgcgggaagtgtttcagccgacgctcgtatctctacagccaccaattcgtgcacaacccaaaacttaccaatagctgcagtcagtgcggcaagctgtttcgctcacctaagtccctctcctatcatagacgcatgcatctcggcgagcgcccattttgctgcactctgtgtgacaaaacgtactgcgacgcctctggcctgtcaagacacaggcgcgtgcacttgggttaccgcccacacagctgcagcgtttgcgggaaatcattccgcgatcagtcggagctgaagaggcaccagaaaattcaccagaatcaggaaccagttgatgggaaccaggagtgcacactcaggataccgggaacacaggctgagttccagaccccaattgccagatcgcagcgcagtattcagggcctgctcgacgtaaaccatgctcctgtcgccaggagtcaggagccaatctttcgcacagagggcccaatggcacagaaccaagcttcagtgttaaagaatcaagccccagtgaccagaactcaggcccctattactggaacactatgtcaggacgccaggtcaaactcacaccctgtgaaacctagccgcctgaatgtgttttgttgcccccactgttcattgaccttcagcaaaaagagctacttgagtcgccatcaaaaggcccacctcaccgaaccccctaattattgctttcattgctcaaagagcttttcgagtttctcacgccttgttcgccaccagcagacccattggaagcaaaaatcatatctgtgtccgatttgtgatctatcttttggggaaaaggagggcctgatggaccattggagagggtacaagggtaaggatctgtgtcagagctcccaccacaaatgccgcgtgattctgggccagtggcttggattcagccatgacgtacccactatggccggtgaggagtggaagcatggaggtgatcagagccccccacggattcacacaccgaggaggagaggccttagggaaaaagcctgcaaaggcgataagacaaaagaggcagtgtccattttgaagcacaagtag

SEQ ID NO: 247702 - DNA, 1551 bp, Artificial Sequence
  Description of Artificial Sequence: Synthetic coding sequence
atgtttgaacaactgaaacccattgagcctagggactgctggagagaagcacgagtaaagaagaaacctgtgaccttcgaggatgtagccgtaaactttacacaggaggaatgggactgccttgatgcatctcaacgcgttctgtatcaggacgtcatgtccgaaacttttaagaacctcactagcgttgcccgtatctttctgcacaagcccgagctgattacaaaacttgagcaggaagaggagcagtggcgcgagttcgtccacttgcctaataccgagggactgagcgagggaaaaaagaaagagctccgtgagcagcacccctctctccgagacgaagggacttcagatgataaggtgtttttggcctgcaggggcgctgggcagtgtccactgagcgcaccagctgggaccatggatcgcacccgcgtgctgcaggcctcccaggccggtccacccttcttttgttatacatgtggcaagtgcttcagccgtcgatcctacctttattcgcatcagtttgtgcacaaccccaagctcaccaattcttgctctcagtgtggaaaattgtttagaagcccaaagtccttgtcctatcaccgcagaatgcacctgggggagcgacccttctgttgtacgctctgtgataagacttactgtgatgccagcggactatctaggcatagaagggtgcacctcggctataggccacattcctgttccgtctgcggcaaatcctttagggaccagagcgagctgaaaaggcatcagaagatacatcagaaccaagagcccgtggacggtaatcaagagtgtaccctccgcatcccaggcactcaggccgaatttcagacccctattgccaggtcgcagcgcagtattcagggactactggacgtgaaccatgccccagtcgcacgatcccaggaacccatattcaggacagaaggccctatggcacagaatcaagcgagcgtgctgaagaaccaggctccggttactcgaacacaggctcccatcacagggactctgtgccaggatgcgcgaagtaactcccatccagtgaagccctcccggcttaacgtgttctgctgtccccactgttccctgacctttagcaagaagtcatatctgtcaaggcatcaaaaggcacatcttactgagcctccaaactattgtttccattgcagtaagtcctttagtagcttttctcggcttgtgcgccatcaacaaacccattggaagcagaagtcctacttatgccccatctgcgatctgtcattcggagagaaggagggcctaatggaccattggagagggtataagggcaaggacctgtgccagtcctcacatcacaaatgtcgcgttatcttagggcagtggctaggcttctctcatgatgtgcctactatggcaggcgaggagtggaagcatggaggggatcagagccctccacgcattcatacacccagacggaggggcctccgtgaaaaagcgtgcaagggagataaaactaaggaagccgtgtccatcctgaaacataaatag

SEQ ID NO: 247703 - DNA, 1611 bp, Artificial Sequence
  Description of Artificial Sequence: Synthetic coding sequence
atgtttgagcagctgaagcccatcgagcccgtgcagaagacactgccttgggtcggcgaagtcgcagcaactcttcaggaggccatgaaaagggactgttggcgggaggcaagagtcaagaaaaagccagtgactttcgaagacgtagccgtgaatttcactcaagaggagtgggactgcttggatgcttcccagagggtgctgtatcaagacgttatgtccgagacttttaaaaacttaactagcgtggccagaatttttctgcataagcctgaactaatcacgaaattggagcaagaagaagagcaatggcgggagttcgtgcatctgcctaacaccgaagggctgtccgaaggtaaaaaaaaggaactccgggagcagcacccatccttgcgggatgagggcacctcagacgataaagtcttcctcgcatgccggggagcgggtcagtgtccattaagtgctccagccggaaccatggaccggacacgggtgttacaggcatcacaagctggtccaccattcttttgttatacgtgtggaaagtgttttagtcgcaggagctacctatacagtcaccagtttgtgcataatcccaagctgacaaactcttgcagtcaatgcggtaaactattccgctcgccaaaatcgctgagttaccatcgacggatgcacctcggggaacgacccttctgctgcactctgtgcgacaagacgtactgcgacgcgagtggcctgtctaggcatcggagggtgcatttaggatataggccccacagctgctccgtctgcggaaaatcttttagggaccagtccgagttaaagcggcaccagaagatccatcagaatcaagaacctgttgacggaaatcaggagtgtacgcttaggatacccggaactcaggcggaattccagactccaattgccagatcccagagaagcatccagggattgctggatgtaaaccacgcacctgtagccagaagccaggagccaatttttcggacggaaggcccaatggctcaaaatcaagcatccgtgcttaaaaaccaagccccagtcacaaggactcaggcccctattactgggacgctctgtcaggatgcacgctctaactcacaccctgtgaaacctagtcggttaaacgtattctgttgtcctcattgtagccttacattctccaaaaaatcctacctctcccggcaccaaaaagcccacttgaccgaacctcctaattattgtttccactgtagtaaaagcttctcatcctttagccgcctggttagacaccagcagacccactggaagcagaagagctacctgtgcccgatctgcgacctttccttcggggagaaggaaggtctcatggaccactggagggggtataaaggcaaggacctctgtcaatcttcacatcacaagtgtcgagtgatcctgggccagtggctgggcttcagtcatgatgtgccaaccatggccggagaggaatggaagcacggcggagatcaatctccgccacgcatccatactccaaggaggcgcggactgagagagaaggcctgtaagggtgataagacaaaagaagccgtgagtattttgaaacacaagtag

SEQ ID NO: 247704 - DNA, 1551 bp, Artificial Sequence
  Description of Artificial Sequence: Synthetic coding sequence
atgttcgaacagttgaaacccatcgaacctagggattgctggagggaggctcgggttaaaaagaagccggtcacattcgaagacgtcgccgtgaattttacccaggaggagtgggactgcctggatgcctcacagcgagtactgtaccaagacgtcatgtctgagacgttcaagaatctgacctcagtcgcgcgaatctttctccataaacccgagctgataaccaagctcgagcaggaggaggagcaatggagggaattcgttcacctccccaacactgaaggacttagcgagggaaaaaagaaagaattacgagaacagcacccatccctgcgtgacgagggtacgagcgacgacaaagtgttcttggcatgcagaggtgcgggtcagtgccccttgtccgctccagccggaactatggaccgtactagagtacttcaagcttcgcaggcaggacctcccttcttttgttacacttgtggcaaatgtttttccaggagatcttatttgtacagccaccagtttgtgcataatcccaaactgacgaactcatgcagccagtgcggaaagctgtttcgatcgccgaagtccctctcttaccatcgccgaatgcacttgggcgaaaggcccttttgttgcactctatgcgataaaacctactgtgatgccagcgggctgagtagacaccgcagggtccatctgggatatcggccacatagttgtagcgtgtgtggcaaaagcttcagggaccagtccgagctgaaaaggcatcagaaaatccatcagaatcaggaacccgtggacgggaaccaggaatgcactctgaggatccctggaacgcaggccgaatttcagacccccattgctagatctcaacgcagtatacagggactcctggatgtgaatcacgcccctgtggctaggtcacaagagccaatctttcggacggaaggacctatggcgcagaaccaggcatccgtgctgaagaaccaagcaccagtcactcgaacacaggcaccaattacaggcacactgtgccaagacgcacgatccaattcacaccccgtgaagcctagccggctgaatgtcttctgctgccctcactgcagcctgacattttccaagaaatcctacctgagtagacaccaaaaagcccacctaactgaacctccaaactattgtttccattgtagcaagagcttctcatcctttagccggttggtgagacatcagcagacacactggaaacagaaatcctacctgtgtcctatctgtgacctgtcatttggtgagaaagagggcctgatggatcattggcggggatacaaagggaaagacttgtgtcagagtagccatcataagtgtagagtaattttaggacagtggctcggattcagtcacgacgtgcccacaatggctggggaggagtggaagcatggaggtgaccagagccccccaagaattcacacaccgcgaagacgtggcctaagggagaaggcctgcaagggcgataagaccaaagaggcagtttcgatacttaaacacaagtag

SEQ ID NO: 247705 - DNA, 1356 bp, Artificial Sequence
  Description of Artificial Sequence: Synthetic coding sequence
gccggtggatcaccggagagcctcctgttttttcaaaagcctgttacctttgaggacgttgcagttaattttactcaggaggaatgggactgcctggatgcatcccaaagagtgctgtatcaggatgtcatgagtgaaacattcaaaaatctgacatcagttgcacggattttcctgcataaacccgagctgataacaaagttagaacaggaagaggagcagtggcgggaaacacgtgttctccaagcttcacaggctggccctcccttcttctgttatacatgcggtaaatgcttctcaaggcgatcgtacctttattcccaccaattcgtccataatcccaagctgaccaactcatgtagccagtgcggaaaactctttagatcacctaaatccctatcctatcaccggaggatgcacctaggtgaacgccctttttgctgtactctgtgcgacaagacatactgcgatgcatcaggcctaagcagacatcgaagggttcacttgggatatcgtccacattcatgcagtgtgtgcggaaagtcattccgagatcaatccgaactcaagcgccaccagaaaattcatcaaaatcaggaacccgtggacggtaaccaggaatgcactctaaggataccgggtacccaggctgagttccagaccccaattgctcgtagccagaggtccatacaaggtttactggatgtgaatcatgccccagtggctagatcccaggagcctatcttccgaaccgagggccctatggcccagaatcaagccagtgttttgaaaaatcaagcccctgtaacgaggacccaggccccaataacaggaacactgtgccaagatgcacggtcaaactcgcatcccgtgaagcccagccggctgaatgttttctgctgcccacactgctccctgaccttttctaaaaaatcttacctgtcgcgtcatcagaaagctcatctgacagaaccgccaaattactgctttcattgcagcaaatcctttagcagcttcagcaggttagtgcgtcaccagcagacgcattggaaacaaaagagttacctttgtcctatctgcgacctgtccttcggggagaaggaagggttgatggaccattggcgtggttataaaggaaaagacctctgccagagttcccaccacaagtgcagagtgatcttggggcagtggttgggcttttctcatgatgtccccacaatggctggtgaggaatggaaacacgggggtgaccagtctcccccacggatccacactccccgtcggcgaggcctgagagaaaaggcttgcaaaggtgacaagaccaaagaggccgtgagtatcctgaagcataaatag

SEQ ID NO: 247706 - DNA, 1551 bp, Artificial Sequence
  Description of Artificial Sequence: Synthetic coding sequence
atgttcgaacagctgaaacccattgaacccagggattgctggcgagaggccagagtaaaaaagaagccagtgacctttgaggatgtcgccgtgaacttcacacaggaggaatgggactgcctagatgccagccagcgcgtcttgtatcaggacgtgatgtccgagaccttcaagaacctgacatcagtagctaggatattcttacataagccggagctcattaccaagctcgagcaggaggaagagcagtggcgcgagtttgtacacttgccaaacacagaggggctatccgaaggcaagaagaaagaactgagggagcagcatccatctctgcgagatgaaggcaccagtgacgataaagtattcttagcttgtagaggcgcaggtcaatgtccgctcagcgccccagccggaaccatggaccgcactagggtgctacaggcttcccaggccggaccgccattcttctgttatacatgcggaaagtgcttttccagaaggtcttacctttatagccatcagtttgtccacaacccaaaactgaccaacagctgttcacaatgcggcaagctcttccgatctcccaaatccctgtcttaccacaggcgtatgcacctcggcgaaaggccattctgttgcacactgtgtgataagacatactgtgatgccagtgggctctcaaggcacagaagggtccaccttggatacagaccccactcatgttcagtgtgtgggaagtctttccgagatcaatccgaactcaagcgacaccagaagattcaccagaatcaagagcctgtggacgggaatcaggaatgcaccctgcgcatccccggtacacaagccgaatttcaaacgccgattgcgcgatcgcagcgctcaattcaaggcctgctagacgttaaccatgccccagtggctcgatcacaagagccaatctttaggaccgagggtccaatggcccagaaccaggcctctgtcctgaagaatcaagccccagttactcgcacacaggctccaatcaccggaaccctctgccaggacgcccgtagcaactcacacccagtcaagccttctaggctgaatgtgttttgctgtccacattgctcactcaccttctccaagaaaagctacctcagcagacaccagaaagcccacctcacagagcctccaaactattgctttcactgttctaaaagcttcagttccttctcacgtctcgttaggcaccagcagacccattggaagcagaagtcatacttgtgccctatatgtgatctgtccttcggtgagaaagagggccttatggatcactggcggggatataagggaaaagatctgtgccaatcaagtcaccacaagtgccgcgtaatcttgggtcagtggctggggttttcccacgatgtccctactatggctggcgaagagtggaaacatggcggagatcagagcccacctcgcatccacacccctcgtcggagggggctgagggagaaagcctgcaaaggcgataaaacaaaggaggcggtctcgatcctgaaacataagtag

SEQ ID NO: 247707 - DNA, 1611 bp, Artificial Sequence
  Description of Artificial Sequence: Synthetic coding sequence
atgtttgaacaactgaagcccatagagcccgtacagaaaacattgccttgggtgggcgaggtggccgctactctgcaggaggccatgaaaagggactgctggagagaggcaagggttaagaaaaaaccagtgacattcgaagacgtggccgtcaactttacccaggaagaatgggactgcctagatgctagtcagagagtgctctatcaggatgtgatgtctgaaactttcaagaatttgacgtccgttgctcgaattttcctgcacaaaccggagctgataaccaagctcgaacaggaagaggaacagtggagagagttcgtccacctgccaaacacagaaggcctctccgaggggaaaaagaaggaattgcgggaacagcacccttcacttcgcgatgagggcacctccgacgacaaggtgttcctcgcttgtcgaggcgctgggcagtgtccactctcagccccagctggtaccatggatcgcacccgggtgctgcaagcgtcccaggccggaccacctttcttttgttacacctgtggcaagtgcttctcccggcgtagttatctctatagccatcagtttgtccacaatcctaaactgacgaatagctgctcacagtgtggcaaactttttcgctctccaaaaagtttgtcatatcacagaaggatgcatcttggtgagagacctttctgctgcacactctgcgataaaacgtattgcgacgcttccggactgtcccgtcacaggcgcgtccacctgggatacagaccacactcttgctctgtgtgtggaaagagttttcgggatcagtccgagctgaagagacaccagaaaatccaccagaatcaagagcctgtggatgggaaccaggagtgtacactgcgtatccccggtacgcaagctgaattccagactccgatcgctcgatcccagaggagtatacagggccttctggacgtcaatcacgcccctgtggcccgatcccaggaacccatttttaggactgaggggccaatggctcagaatcaggctagcgtcttgaaaaatcaggcgcctgtgacccggactcaagcacctatcactggaacactgtgtcaggacgccaggtctaattcacacccagtaaagccatccagacttaatgtgttctgttgccctcattgctctttaacgttcagtaaaaagtcgtatctctctcgccatcaaaaagctcatcttactgagccacctaactactgctttcactgcagcaagtctttctcctcttttagccggctggtcaggcatcagcaaacacactggaaacaaaaatcctatctgtgccctatctgtgacctaagctttggtgagaaggaagggttgatggatcactggagagggtacaaaggtaaagacctgtgtcagagtagtcaccataaatgcagagtgattctcgggcagtggctggggttcagtcacgatgtcccaacaatggcgggagaagagtggaaacacgggggagatcagtcccctcccagaatccacactccccgaaggagagggctgcgcgaaaaggcttgcaagggtgataagactaaggaagccgtctctatcctgaagcacaagtag

SEQ ID NO: 247708 - DNA, 1611 bp, Artificial Sequence
  Description of Artificial Sequence: Synthetic coding sequence
atgtttgagcaactcaaacccattgagcccgtacagaaaactttaccttgggttggtgaagtagccgcaacactccaggaagcaatgaaacgggactgctggcgggaggcacgggtgaagaagaagccagtgactttcgaggatgtcgccgttaacttcacacaggaagagtgggactgcttggacgcctcgcaaagagttttgtaccaagacgtcatgagcgagaccttcaaaaacctcacctccgtggcccgtatcttcttgcacaagcccgaactgataacaaagctggaacaggaagaggaacagtggcgggaattcgtccacctgccaaacacagagggcctgagcgaagggaagaagaaggaactccgtgagcagcatcctagcttaagggacgaaggcacttctgacgataaagtcttcctggcgtgccgaggcgctggtcagtgtcctctatctgcgcctgccggaaccatggacaggacacgcgtgctgcaggcatcccaagccggaccccctttcttctgttacacctgcgggaagtgcttcagccgtaggagttatctatactctcatcaatttgtgcataacccaaagctgactaacagctgctctcagtgtggaaaactgtttcgctcgcccaaatccttgtcctaccataggagaatgcaccttggagagagacccttttgctgtaccttgtgcgataaaacctattgcgacgcatcgggtctgagcagacaccgccgagttcacctcggctatcgaccccacagttgctctgtctgcggaaagtcgttcagagatcagagcgagttaaagagacatcagaagattcatcaaaatcaggagccagtcgatggaaatcaggaatgcaccctccgaatccccggaacccaggccgaattccaaacacctatcgccagatcacagcgcagtatccagggattgcttgacgtcaaccacgctcccgtggcacgttcccaggaacctatcttccgcaccgagggaccaatggcccagaatcaggcatccgtgttgaagaaccaggcaccagttacacgcactcaggccccaattactggaaccctatgccaggatgccagatctaatagtcatcctgtgaaaccatcacggcttaacgtattttgctgcccacactgctcattgacttttagcaaaaagtcatacctaagtcggcatcagaaggcccatctgacagagcctccgaattattgtttccactgttccaaaagttttagcagcttctctagattagtcagacaccagcagactcattggaagcagaaatcatacctgtgcccaatctgtgacctgtccttcggcgagaaagaaggactgatggatcactggcgcggatacaagggcaaagacttatgccagtcctctcaccataaatgccgcgtcattcttggccagtggttggggttttctcatgacgtccctaccatggcaggagaggagtggaaacacggaggggatcagtcccctccccgaatccatacccccagaaggcggggattgcgcgagaaggcgtgtaaaggcgataagaccaaagaggctgtgagcattctcaaacataagtag

SEQ ID NO: 247709 - DNA, 1611 bp, Artificial Sequence
  Description of Artificial Sequence: Synthetic coding sequence
atgtttgaacagctgaagcccatcgagcccgttcagaaaacacttccatgggtgggcgaggtggccgcaacactccaggaagctatgaagagggattgttggcgcgaagcacgagtgaagaaaaaacccgtcacgttcgaagatgtcgctgttaactttacgcaagaggagtgggactgcctcgacgcgtcacagcgagtcctataccaagatgtcatgagtgaaactttcaaaaacctgaccagtgtagcgaggatattccttcacaagccagaattaattacaaagctggagcaggaagaggaacaatggagggagttcgtacacctccctaatactgagggactctccgaagggaagaagaaggagctgagagaacagcatccctccctgagggatgaggggaccagtgatgacaaggtctttctggcatgccgcggtgcagggcagtgccccctatccgcacccgcaggtactatggatcgtacccgggtgctgcaggcatctcaggcgggtccaccttttttttgttacacatgtgggaagtgctttagcaggcggagctacctgtacagccatcagtttgtccataacccaaagcttacaaacagctgcagccagtgcggcaagctgttccggagtcctaagtcactgtcataccaccggaggatgcacctgggtgagaggccattctgctgtaccctgtgcgataagacctactgtgacgcctctggactgtcacgccacaggcgagtgcatttgggataccgtccccatagctgcagcgtgtgcggcaagtcctttcgcgatcagtccgaattgaagcggcaccagaagatccatcagaatcaagaaccagtggacggcaatcaagaatgtactctaagaatccccggaactcaagccgagttccaaactccaattgctagatcccaaaggagtatccagggcttgctcgacgtaaaccatgcacccgttgctcgctcccaggagcccatcttcagaaccgaggggccaatggctcagaaccaggcgtcggtgctaaaaaatcaagcccctgttactcgcactcaggcacctatcacaggaactctttgccaggatgctcgctccaatagccaccccgtgaagccatctcgccttaacgtcttttgttgcccccactgtagccttacatttagtaaaaaatcctacctatctcggcaccagaaagctcatctgaccgaaccaccgaattattgctttcactgcagtaaatccttttcatcatttagccgtctcgttcgtcatcaacagacacactggaaacagaagtcttacctttgccccatctgcgacctcagtttcggggaaaaggagggtctgatggaccattggcgcggatacaagggcaaggacttgtgccagagcagccaccacaaatgccgagtgatccttgggcagtggttaggattctctcatgatgtgcctaccatggccggagaggagtggaaacacggcggtgatcaaagtccccctcgtatccacaccccccgtcgacgcggactaagggaaaaggcctgcaaaggtgataagaccaaagaggccgtgagcattctgaagcataagtag

SEQ ID NO: 247710 - DNA, 1611 bp, Artificial Sequence
  Description of Artificial Sequence: Synthetic coding sequence
atgttcgagcagctcaaaccaattgagcccgtgcagaagacactcccttgggtcggagaggtggccgcaacactccaggaggccatgaagcgcgactgttggcgagaggcgagggttaagaaaaagccagtcacttttgaggacgtagctgtgaatttcacacaggaggagtgggactgcttagatgcctctcaacgggttttgtatcaagatgtgatgagcgaaaccttcaaaaatcttacctccgtcgcacggatcttcctgcataaaccagagctgatcaccaaactggaacaagaggaagaacagtggcgggagtttgtgcacttaccaaataccgaaggcctcagcgaagggaaaaaaaaggaattacgcgagcagcacccgtctctgcgggacgaaggaacatccgatgacaaagtgtttctggcttgtcggggagccggacagtgccctctgagcgccccagcgggtaccatggacagaacccgggtgctgcaagcaagccaagcaggtccgccattcttctgttacacctgcggtaagtgtttctctaggcgctcttatttgtactcccaccagttcgtgcacaaccccaagttgactaactcatgtagtcagtgcggcaaactcttcaggtccccaaagtcactcagctaccaccggagaatgcatcttggtgagagaccattctgctgcacgctctgtgacaaaacatactgcgacgcaagcgggctaagcagacacagacgagttcacctgggatataggccccatagctgctctgtgtgcggcaaatcctttagagaccaaagcgaactaaagaggcatcaaaaaattcaccagaaccaagaaccagtagatggcaatcaagagtgcacgctgagaatcccgggtacacaggcagagttccagacccctattgctcggagccagcgcagcattcagggactgctcgacgtgaaccacgcgccagtcgcaagatcacaggaacccatcttcaggactgagggcccaatggcacaaaaccaagcctcagtccttaaaaaccaggccccagtgacccggacgcaggcaccaataacaggcacgctatgtcaggatgcaaggtctaactcccacccagtgaagccctctagacttaacgttttttgctgtccgcactgttccctgaccttttcgaagaaaagttatctgagccgtcatcagaaggcccatcttacagagccgccaaactactgttttcactgtagcaaatcgttctcgtcgttttcccgtctggtgcgacaccaacagactcactggaaacaaaaaagctacctgtgtccaatttgcgacctgtcttttggagaaaaggaaggattaatggatcactggagaggctacaagggcaaagatctgtgtcagagcagtcaccataagtgtcgcgttattctgggacagtggctgggattcagtcacgacgtccccactatggctggagaggagtggaaacatgggggagaccaatctccgcctaggattcataccccgagaagacggggtctgcgtgaaaaggcctgcaagggcgacaagactaaagaagcggtgagtatattgaagcacaagtag

SEQ ID NO: 247711 - DNA, 1551 bp, Artificial Sequence
  Description of Artificial Sequence: Synthetic coding sequence
atgttcgaacagcttaagccaatagaacccagggactgctggagagaggcccgtgtcaagaagaaacccgtgaccttcgaggacgtggctgttaatttcacccaggaggagtgggactgcctagatgcttcccaaagagtgctgtaccaggacgtaatgagcgagactttcaaaaatctgacatctgttgcgaggatatttctgcacaaaccagaattaattactaaactcgagcaagaggaagagcagtggagagagtttgtgcacctgcctaatacagagggcctgtctgaagggaagaagaaagaactgagagagcagcacccgagcctcagggacgaaggcacctcagacgacaaggtgttcctcgcatgccgcggtgcgggacagtgccccctctccgcacccgctggtaccatggatagaacacgcgttttgcaagcatcccaagcaggtccaccctttttttgttatacgtgcggaaagtgttttagccgacggagctatctgtatagccatcagtttgtgcacaatcctaagctcacgaattcatgcagccaatgcggaaagttgttccgatctcccaagtctctgagctaccataggagaatgcacctgggggagaggccgttttgctgtaccctatgtgataagacctactgtgacgcttccggtctatcaaggcacagacgagtgcacctgggctataggccacatagctgtagcgtgtgcggtaagtcatttagggatcagtctgagttgaagagacaccagaaaatacaccagaaccaggagccagtcgatggtaaccaggaatgcactttgcggatccccggaacacaggctgagtttcagacccccatcgccaggagtcagcggtccatccaaggccttctggacgtgaaccacgcccctgtagccaggagccaggagcccatcttccggaccgagggccctatggcgcaaaatcaagccagcgtgctgaaaaatcaggccccagtgaccaggacacaagcaccaatcaccggaactttgtgtcaggacgccaggagtaattcccatcccgttaaaccaagcaggcttaatgtcttctgctgtcctcattgctccctgactttttccaaaaagtcatacctctctcgacatcagaaagcccacctgaccgagcccccaaactactgtttccactgttctaaaagctttagcagcttcagtagactggtgcgacaccagcagacacattggaagcagaagtcatacctctgtccgatatgcgacttgagtttcggagagaaggagggtctgatggatcactggcggggatacaagggaaaagacctgtgccagtcttcccatcacaagtgccgcgtgatattgggccagtggctcggcttctcacatgacgtacccactatggccggagaggaatggaaacatggtggcgaccaatcaccgcctcgcatccacactcctcggagacgtggactgagggaaaaggcgtgcaagggcgacaagacgaaggaggcagtgagtatcctcaaacataaatag

SEQ ID NO: 247712 - DNA, 1551 bp, Artificial Sequence
  Description of Artificial Sequence: Synthetic coding sequence
atgtttgagcaattgaaaccaatcgagccacgcgattgctggcgggaggctcgggtgaagaagaagccagtgaccttcgaagacgttgctgtcaacttcacacaagaggaatgggattgcctggacgcctctcaacgggtgttataccaggatgtaatgtcggaaacatttaaaaacttgacctctgtggccagaatcttcctacacaaaccagagcttataaccaaactggaacaggaagaggagcaatggcgggaatttgtgcacctaccgaacaccgagggtctctcagaaggtaagaagaaggagctcagagagcagcacccttccctgcgtgacgagggcaccagtgatgacaaggtattcctcgcctgtcgaggcgcaggccagtgtccactcagcgcccctgcgggaacaatggatcgtacccgagtacttcaggcttcacaagcagggccaccgttcttttgttacacatgcggaaagtgttttagccgcaggagttacctctactcccaccagtttgtccacaatcctaaactgaccaacagttgtagtcagtgtggcaagcttttccggagtccaaaatctctgtcataccatcgacgaatgcatctgggagagagaccgttctgctgtactctgtgcgataagacgtattgtgatgctagcggactatcccgtcatagacgagtgcacctgggataccgaccccattcctgctctgtgtgcggtaagtccttccgggatcagtccgaattaaagcgtcaccagaaaatccatcaaaatcaggagcccgtggatggcaaccaagaatgcactttgcgtatccctggcacccaggccgagtttcaaactccaatcgccagatcccagaggtctatccaggggctcctggatgtgaaccatgcacccgttgccaggtcgcaggagccgatatttcgcactgagggtcccatggcacagaatcaggcttccgtgctaaaaaaccaggcgccagtgactcggacccaagctccgatcactgggacattatgccaagatgctaggtcgaactctcaccctgtgaagccatctcgtcttaatgtgttttgctgtccccactgcagtttgacttttagcaaaaaatcttacttatctaggcaccagaaggcgcacctgactgagccgccaaactactgttttcattgcagtaagagcttctcttcgttctcccgcttagttaggcaccaacagacccactggaagcagaagagctacctttgccccatctgcgacctgtcttttggcgaaaaggaaggcctgatggatcattggaggggatacaaagggaaggacctgtgccaatcatctcatcataaatgtcgagtcattcttggccagtggttgggctttagccacgatgtccctacaatggccggagaagaatggaagcacggaggcgaccagtcaccacccaggatacataccccacgcaggcgaggactgcgcgaaaaggcttgtaagggcgataaaactaaggaggcggtatccattctgaagcataaatag

SEQ ID NO: 247713 - DNA, 1611 bp, Artificial Sequence
  Description of Artificial Sequence: Synthetic coding sequence
atgttcgaacagctgaaaccgatagaaccggttcagaagactctcccctgggtcggtgaagttgctgcaaccctccaggaggccatgaaaagagattgctggcgagaggcacgagttaagaaaaaacctgtgacattcgaggacgtggctgtgaacttcacgcaggaggagtgggactgtctcgatgccagtcagcgtgttctctaccaggatgtcatgtccgaaactttcaaaaatcttacttcggtggcaagaatctttcttcacaaaccggagttgataactaagctcgagcaggaggaggaacagtggcgggagttcgttcatcttccgaatacggagggactgtccgaggggaaaaagaaggagcttcgagaacagcacccaagcctgcgtgatgaaggtacaagcgacgacaaagtgttcctggcttgtaggggcgcaggacaatgtccactcagtgccccagccggtaccatggaccgcactagagtgctacaggcctcccaggcaggcccaccttttttttgttacacctgtgggaagtgttttagccggcgatcttatctttactcccatcagttcgtccataaccctaaattgactaacagctgttcacaatgtggtaagcttttcagatccccaaagagtctttcctaccacaggcggatgcatctgggggagcggccattttgttgcacattgtgtgataaaacctactgcgatgcgagcggtctgagccgccaccggagggtgcatctaggatatcgaccacactcctgcagcgtctgtggcaaatcttttagggaccagtccgagcttaagcggcaccagaagattcaccagaaccaggagcctgtggatggaaatcaggagtgtacgcttcggatccctggcacacaggccgagtttcaaacgccaatcgcacggtctcagcgcagcatccagggactgctggatgtgaatcacgcccctgtggcgaggagccaagaacccattttcaggacagagggacccatggctcagaatcaggcctccgtgctgaagaatcaggccccagtgactcggactcaggcaccaataacgggcactctgtgccaagacgctagatccaactcccaccccgtgaagccctcacggttgaacgtcttctgttgcccacactgcagcctgaccttctctaaaaagagctacctctccagacaccagaaagcccatctgaccgaaccgcctaactactgttttcactgttccaaaagtttctctagcttctcacgcctggtgcggcaccagcagacgcattggaaacagaagagctatctgtgcccgatttgcgacctgtcattcggtgaaaaggaagggctgatggaccattggcgcggttacaaagggaaggacctctgccaatcatctcaccataaatgtcgggtgattctcggccagtggctgggcttctcccatgatgttcctacaatggccggagaagaatggaaacacgggggagatcagtccccgcctagaattcacactccaaggcggcgaggattgcgcgagaaagcatgcaagggcgacaagactaaggaagctgtgagcattctgaaacacaaatag

SEQ ID NO: 247714 - DNA, 1551 bp, Artificial Sequence
  Description of Artificial Sequence: Synthetic coding sequence
atgtttgagcagttgaaacccatcgagccgagggactgctggagggaggcaagagtgaagaaaaagccggtgactttcgaagatgttgctgtaaactttacgcaggaggagtgggactgcttggacgcatcacagcgcgtgctgtaccaggacgttatgtccgagacctttaaaaacctgaccagtgtcgctcggatttttctccataaaccagagctcatcacaaaactggaacaagaagaagagcagtggagggaatttgttcacttgccgaatacggaaggattgtccgaggggaaaaaaaaagagctgcgcgagcagcatccttctctccgggacgaagggactagcgacgacaaagtgtttcttgcctgtcggggagcgggtcagtgccccctcagcgccccagctggcacgatggatcggactcgcgttctgcaggcttcacaggcaggcccaccattcttttgctacacatgtggcaagtgcttcagtcgacgctcatatctctactctcaccagtttgttcacaacccaaagttgacgaattcctgttcacagtgcggcaaactgtttcgatcccccaaatcattgtcctaccacagacgcatgcacctgggtgagcgccctttttgctgcacgctgtgcgataagacatactgtgacgcaagcgggctgtctcggcatcggagggtccatcttggttacagacctcacagctgcagcgtctgtggcaaaagttttcgagaccagtctgagctcaagcgccaccagaaaatacaccagaatcaggagccggttgatggcaaccaggaatgcacacttaggattcctgggacccaggctgaatttcagacccccatcgcacgaagtcagaggagtattcaaggactcctcgatgtcaaccatgctccagtggctcgttctcaggagccgatattcagaactgagggtcctatggcgcagaaccaagcatctgtgctcaagaatcaggcgcctgtgacgaggacccaggcccctatcacggggactctgtgtcaggacgccagatcaaatagtcaccctgtcaagccatcccggctcaatgtgttttgctgcccccactgctctctcactttctcgaaaaagtcatatctgtcacggcaccaaaaggcgcaccttacagagccacctaactattgctttcattgcagcaagtcatttagtagcttcagcagactcgtgaggcaccaacagacacactggaagcagaagtcctatttgtgccctatttgtgacctgtcgttcggcgagaaggaaggcttaatggatcactggcggggttacaaagggaaggacctatgccagtcatcacatcacaagtgccgcgttatactcggccaatggttggggttctctcatgacgtcccaacaatggccggagaagaatggaaacacggcggagatcagagccctccgcgtatccatacaccaaggagaagagggcttagagaaaaagcctgcaagggcgacaaaactaaggaagctgtgagcatccttaaacacaagtag

SEQ ID NO: 247715 - DNA, 1551 bp, Artificial Sequence
  Description of Artificial Sequence: Synthetic coding sequence
atgttcgaacagctgaagcccatcgaaccacgcgattgctggcgcgaggccagagtaaaaaaaaagcctgttacctttgaggacgttgccgtgaactttacccaggaagagtgggattgtctggacgcaagccagcgcgtactgtatcaggatgtcatgtctgagacatttaagaatctcacatccgtggcccgaatctttttacacaagcccgagctcattactaaactggagcaagaggaggagcagtggagagaattcgtgcatttgcctaatactgaagggctgtcggaaggtaagaagaaggagttgcgcgagcagcatccctctctgcgtgacgagggcacctctgatgataaagtgttcctcgcttgccgcggagccggtcagtgtcctctgagtgccccagccggaacaatggaccgcacacgcgtgctgcaggccagccaggcgggtccaccctttttctgctacacctgtgggaaatgcttctccaggcggtcttatctgtattcacatcagttcgtccacaatcccaaacttactaacagctgttcacaatgtgggaagctatttaggtcccctaagagcctttcctaccatcggaggatgcacttgggtgaaagaccgttttgctgtaccctctgtgacaaaacttattgcgacgctagcggattgtctcgacacaggagggttcatctggggtatcgaccccattcttgtagtgtttgcggaaaatcattcagggaccaatctgagcttaagcggcaccagaagatccatcagaatcaggaacctgtcgacggcaatcaggaatgtactttaagaatccctgggacccaggcagaattccagaccccaatcgcccgatctcagaggagtatccagggtcttctagatgtaaatcacgccccagtggcaaggtctcaagaacccatatttcgaaccgagggccctatggcccaaaatcaggccagcgtcctaaagaatcaagcccctgtgacgagaactcaggcccctataactggaaccctgtgccaggatgctaggtctaacagtcacccagtgaagccatctaggctcaatgtattctgctgccctcactgctcactcaccttttcgaaaaagagctacctgtcccgacaccaaaaggcacatctaactgaacctccaaattattgttttcactgtagcaagtctttctcttccttctcacggctggttaggcatcagcagactcactggaagcagaagagctacctgtgtcccatctgcgacctgagttttggggaaaaagagggtctcatggaccattggaggggctataagggcaaagacctgtgccagagttcacatcataagtgtagggttatattgggtcaatggttggggttctcgcacgatgtgcctactatggccggagaggaatggaagcacggtggcgatcagtcacctcccaggattcacacccccaggcggagaggcctgcgcgagaaagcttgtaagggggataagacaaaggaggcagtgagcatccttaagcataaatag

SEQ ID NO: 247716 - DNA, 1611 bp, Artificial Sequence
  Description of Artificial Sequence: Synthetic coding sequence
atgttcgagcagttaaaacccattgagccggtacagaaaacgttgccatgggtcggtgaggtggcagccacgctgcaagaagccatgaaaagggactgttggagagaagctcgagtaaaaaagaaacctgtcacttttgaggacgtggctgtcaactttacccaagaggagtgggattgcttagatgcctcacagagagtgctataccaagacgtaatgtccgaaaccttcaagaatctcaccagcgtggccaggatcttcctgcataaacccgagttgatcaccaaactggagcaggaggaagaacagtggcgggaattcgtgcatttgccaaacacagaggggctatccgaggggaagaagaaggaattacgagaacaacatccgagcttaagagacgaaggtacttcagacgacaaggtgttcttagcctgtcgaggggcaggacagtgccctctatcagctcccgctggcaccatggatagaacccgagtgcttcaggcctcccaagcaggaccgcctttcttctgttacacctgtggaaagtgttttagccgaagatcctacctgtattcccaccagttcgttcacaatcccaaactcacaaactcctgcagccagtgcggaaaacttttccgctctcctaagtctcttagctatcaccggcgtatgcatctgggtgaacggcctttttgttgcacactgtgcgacaaaacatattgcgatgctagcggactttccaggcacagacgtgttcacctgggatacagaccacattcctgcagcgtgtgcggcaaatcatttagggatcagtctgagcttaaaagacaccagaagattcaccagaaccaggagcccgtagacggcaaccaagagtgtactctccggatccccggtacacaggcagagttccagacccctatcgctcgctctcagcgcagcattcaggggctgttggatgtgaaccacgcgcctgttgctcggtcccaggagcctatcttccgtaccgaggggccaatggcccaaaatcaggcaagtgtcctcaagaatcaagccccagtaacacggacccaggcccctataacgggtacactgtgccaggatgctaggagcaattctcaccccgttaaacctagcaggcttaacgtcttttgttgcccccactgctcactgaccttttcaaaaaagagttacttatcccgtcatcagaaggcccacctgaccgagccacccaactattgtttccattgctcaaagtccttttctagcttttctcgtttggtcaggcaccagcagacgcactggaagcagaaatcatacctctgtcctatctgcgatctctccttcggcgagaaagagggattaatggaccactggcggggatacaagggcaaagatctttgtcagagcagccatcacaagtgccgggtgattttaggccagtggcttggattttcacacgatgtacccactatggcaggtgaagaatggaaacacggaggagatcagtcgccccctagaatccacacaccccgtaggcgcggattgagagagaaagcttgcaagggcgataaaactaaggaggccgtgtccatcctgaagcacaaatag

SEQ ID NO: 247717 - DNA, 1725 bp, Artificial Sequence
  Description of Artificial Sequence: Synthetic coding sequence
atggccgctgcagtgcccagaagacccacgcagggcacggtgactttcgaagatgtcgcggttaatttctcccaggaagaatggtgtcttctgtccgaggcccaacgctgtctttacagagacgttatgctggagaacttggccctgatttcatcactggggtgttggtgtggatcaaaggatgaggaggcaccatgtaagcagcgaatcagcgtccaacgcgagtctcagagtaggacccctcgggcaggggtgagccccaagaaagctcacccctgcgagatgtgtggcctaattctggaagatgtgtttcactttgctgaccatcaggagacacatcacaagcagaagctgaacaggtcaggcgcttgcggcaagaacctcgacgataccgcctatctccatcaacaccagaagcagcacatcggcgagaaattctaccggaaaagcgtgagggaagcctcctttgtgaagaagcggaagctgagagtctctcaggagcccttcgtgttcagagagtttgggaaggacgtactaccttccagcgggctctgccaggaagaagccgcagtcgaaaagacggattcggagaccatgcatggacccccatttcaggagggtaaaacgaattacagttgtgggaaacgcacgaaagcctttagtacaaaacattccgtcattccccatcagaagctttttacacgcgatggctgttatgtttgtagcgactgcggaaagagttttagtcgttacgtctctttctctaaccaccagagggaccacactgcgaagggtccatatgattgtggagagtgtggaaaaagctactccaggaagtcctccctcatacaacaccagcgggtgcacaccggacagaccgcttacccgtgtgaagaatgcggcaagagtttctcccagaaaggaagtttgatctcacatcaactggtccacacaggtgaaggcccttatgaatgcagagagtgcggcaagagcttcgggcagaaggggaatctgatccagcaccagcagggacacacaggtgagagagcgtaccactgtggcgaatgcggtaagagtttccggcagaaattctgtttcatcaaccaccagcgggtgcacaccggcgaacgaccgtataagtgcggcgagtgcggaaagtctttcggccagaaggggaaccttgtgcaccaccagagaggccacactggggagcggccatacgaatgcaaagaatgcggtaaaagctttcgctatcggagccatctgacagaacatcagcggcttcacaccggcgaacgcccttataactgccgggaatgtgggaagctgttcaaccgcaagtatcacctgctggtgcacgagagggtgcacactggcgagaggccatatgcatgcgaagtttgcggcaagctttttggcaataagcattctgtcaccattcaccagcgaatccatactggtgagcggccttatgagtgtagcgaatgcgggaagtcctttcttagcagttccgccctgcacgtgcataaaagggtacatagtggacaaaagccctataaatgttcagagtgtggcaagtccttttcagagtgttcttccctgattaaacacaggcggatccatacaggggagaggccatatgagtgtaccaaatgtgggaaaacgttccagaggtcgagtacgctgctgcatcaccagagttctcataggaggaaagcactgtag

SEQ ID NO: 247718 - DNA, 3804 bp, Artificial Sequence
  Description of Artificial Sequence: Synthetic coding sequence
atgggcgatatgaaaacacctgacttcgacgatttgttggccgctttcgatattcccgacccaacttcactggacgcgaaagaggcgatccaaacccctagcgaagagaacgaaagcccactcaagccccctggtatttgcatggatgaaagcgtgtccctgagtcatagcggttcagcaccggacgtcccggcagtgagtgtgatcgtgaagaacaccagtagacaggaaagctttgaagccgagaaggaccacattactccgtcactcttgcataatggtttcaggggctctgacttgccccctgacccacataactgcggaaagttcgactccactttcatgaacggtgactccgcaagaagcttccccggaaaactggagccaccaaaaagcgagccactgccaacttttaatcaatttagcccgatcagtagcccagagccagaggaccccattaaggataatggatttggcattaagcccaagcactctgacagctactttcctcctccattggggtgtggagccgttgggggacctgtcttggaagcgctggctaaatttccggtgcctgagctgcatatgttcgatcacttctgtaaaaaggaacccaaacccgagccattaccacttggatcccagcaggagcatgaacagagcggacagaataccgtagaaccccacaaagaccctgatgctactaggttctttggggaggccttagaattcaactcccacccatccaactccatcggggaatctaagggtctcgcccgtgaactggggacctgctcatccgtgcccccacgacaacggcttaaacctgcgcacagcaaactgagtagctgtgttgcggctctagtggcactgcaggcgaagagagttgcctccgtcaccaaagaagatcaacccggacataccaaggacctgtctggccctacaaaggaaagttccaaaggaagccctaaaatgccaaagagtcctaaaagtcccagaagcccgctggaggccacacgcaagtctatcaaaccttcagacagtccacgttccatctgctctgattccagttctaagggctcacccagtgtggccgcatctagcccacccgctattcctaaggtcaggataaaaaccatcaaaacaagctctggtgagataaagcggaccgtgactaggattctcccagacccagatgacccctcgaagagccccgtcggatctcccctcggcagcgccatcgcagaggcaccaagtgaaatgccgggagatgaagtaccagtggaggaacactttccagaggcaggcacaaactccggctccccgcagggagcgcgaaaaggagatgaaagcatgacaaaggcctccgactcctcaagcccctcttgttcctccggtcccagagtgcctaagggcgctgcgccagggtcccagacaggcaagaagcaacagagcactgcactgcaggcatctacactcgctccggctaatttgctgccgaaggcagtgcacttagctaacttgaatttagtgccccattccgtagcagctagcgtgaccgccaagagttcagtacagcggagaagccagcctcagctgactcagatgtccgtgcctctcgtgcatcaggtcaaaaaggctgctccattaatcgtggaagtgtttaacaaagtcctgcactcaagtaatcccgtgccgttgtatgctcctaacctctcccctcccgctgatagcagaattcacgtaccagcctccggatattgttgcctggagtgtggtgatgccttcgcgctggagaaatccctgtctcagcattatgggaggcgaagcgtccatatcgaagtcttgtgcaccctctgctcgaagacgttactcttctttaacaagtgttctctcttgagacatgcacgagaccacaaatctaagggcctggtcatgcagtgtagtcaattgttggtaaagccaatctccgccgaccagatgttcgtcagcgccccagtaaacagcactgcccctgccgctcccgcaccgtcttcttcccccaagcacgggctgacgagcgggtcagcttctccacctcctccggcactgcctctatatcccgaccccgttcggttgattaggtactcaattaagtgtctcgagtgccacaagcagatgagagactacatggtgctggccgcacactttcaaagaaccacagaggagactgaggggctgacttgccaagtctgccaaatgctcctgcccaaccagtgtagcttctgcgcgcaccagcgcatccacgcccataagagtccatattgttgtcccgaatgcggagttctgtgccggtctgcatatttccagacacacgtcaaggaaaactgcctccactatgcccgaaaagtcggctatcggtgtattcattgcggggtggtgcacttgaccctagccctgcttaaaagccacatccaagagaggcactgtcaggtgtttcacaagtgtgccttttgccctatggccttcaaaaccgccagcagtaccgcagatcactcagccacgcagcatccaacacaaccccaccggccttctcagttgatttacaaatgctcctgtgagatggtgttcaataaaaagcgtcacatccagcagcacttttaccagaacgtctctaagactcaggtcggagtattcaaatgtcccgaatgcccactgttattcgtccagaagcccgagctgatgcagcatgtgaaaagcacccacggagttcctcgtaatgttgatgaactttcatcacttcagtcttcagctgatacttcgagtagcaggccagggtccagggtgccaactgaacctcctgctacatcggtggccgctcgaagctcttctcttccctctggacgatggggacgaccggaagctcacaggcgggttgaagccagaccgagattaagaaacaccggttggacatgccaggagtgtcaggagtgggtgccagatcgggaatcatatgtctcccacatgaaaaagtcacatggacgcactctgaaaaggtacccatgtcgccagtgtgagcagtctttccatactccaaattcgctgcggaagcacatccggaataatcacgacactgtgaagaagttctacacttgcggatactgcacggaggattctcctagcttcccacgccctagcttgctggagagtcacatatccttgatgcacgggattcggaatcctgatcttagtcagacaagtaaagtcaaacctccgggtggccactctcctcaggttaatcatttgaagcgaccagtgtcgggcgtcggagacgcacctggaacttccaatggcgctacggtcagtagcacgaagcgccataagagtctattccaatgcgcgaaatgttcttttgccacagattccgggcttgagtttcagtcccatatcccgcagcaccaggtggattcatccacagcccagtgcttactgtgcgggttgtgttatacgagtgcctcctcattgagccggcacctgttcatagttcataaggtaagagatcaggaggaagaagaggaggaggaagcggcagccgcagagatggcagtggaagttgccgagcccgaagaagggagtggcgaggaagtgcctatggagacgagagagaatgggctcgaggagtgtgccggtgaacctctgtcggccgacccagaggctagacgccttctgggaccagcaccagaggacgatggcggacacaacgaccacagtcagccccaagcgtcacaagatcaagatagtcataccctttcgccccaggtctag

SEQ ID NO: 247719 - DNA, 3804 bp, Artificial Sequence
  Description of Artificial Sequence: Synthetic coding sequence
atgggggatatgaagacacctgattttgacgacctgctggccgcttttgacatacctgaccctacctcactcgatgccaaagaggcaatccaaaccccttcagaagaaaacgagagtccccttaaacccccaggcatatgcatggacgagagcgtatccttgtcacacagtggcagcgctcctgacgtgcccgctgtgagcgtcatcgtcaaaaataccagccggcaggagagtttcgaagctgaaaaagatcacatcacaccgagcctactgcacaatggctttcggggttcggacctgcctccggatccacacaactgtggcaagttcgactcaaccttcatgaacggggacagcgccaggtctttccctggcaagctcgaaccacccaaatccgagcctctcccaacctttaaccagttctcaccaatttcctctcctgagcctgaggaccccattaaggataacggctttggtatcaaacccaaacactccgattcttatttcccacccccactgggatgcggggctgtaggtggtcctgtactggaggcgctggctaaattccccgtgcctgagctgcacatgtttgatcacttctgtaaaaaagagcccaaacctgagccgctcccactgggcagccagcaggaacatgaacagtccgggcaaaacacagtggagcctcataaggatccagatgctacccggtttttcggagaagccttggagtttaatagccatccctccaatagcattggtgagtctaagggcctcgctcgggagctggggacttgcagtagtgtgcctcctcggcagaggttaaagcctgcacattccaagcttagcagttgcgtggccgctctggtggccttacaggccaaaagagtggctagcgtaaccaaggaggatcagcctggacacaccaaagatctgtccggtcctaccaaggaatccagcaagggctctccaaaaatgccaaagagccctaagtcccctagatcaccactggaggccacgaggaagagcataaagccctcggactctcccagatccatctgctccgactcatcctcaaagggatcaccctctgtggcagctagttctccccctgccatccctaaggtgagaattaaaactatcaagacatcatcaggcgagatcaaaagaaccgtgacccggatcttgccagaccctgatgaccctagcaagtccccagtgggcagccccctcgggagcgcaatcgccgaggcaccctcggagatgcctggcgacgaggtcccagtagaagagcactttcctgaggctgggaccaattctggatccccgcagggagccaggaagggcgacgagagcatgacaaaggcaagcgattcgtcctccccttcttgcagcagtggcccacgtgttcccaaaggagccgcacctggttctcagaccggaaaaaaacagcagtccacagcacttcaggcttctactctcgctcccgcaaatttgctccccaaggctgtgcacctggcaaatttgaacctggtccctcatagtgtagccgcaagtgtgactgcgaaaagttctgtccagcgtagatcccaaccgcaacttacccaaatgagcgtccctctggtgcatcaggtgaagaaggcagcaccattaatcgtcgaggtgtttaataaggtgctgcatagcagtaacccagtgcctttgtacgctccgaatctaagtcctcccgcagatagcagaatacacgtgcccgcttcagggtactgctgcttggaatgcggtgatgcctttgccctggaaaaaagtctgtcccagcactacggacggcgaagcgttcatatcgaagttctttgtacgttatgttccaagacactcctcttcttcaacaaatgttcgcttctacggcatgcacgagatcacaaatcaaaagggctcgtaatgcagtgttcacagctgcttgtgaagcccatctccgcagaccagatgttcgtgtcagcccctgtgaactccactgcccctgctgcaccggcaccgagtagcagcccgaaacatggcctgacgagtgggagcgcttcccctccccctccggctctcccgttataccctgacccagttcgactcattcggtattcaataaagtgcctcgaatgccataaacagatgcgcgactacatggtgctcgctgctcacttccagcgcaccacagaagagactgagggtctaacctgccaggtgtgccagatgctccttcctaaccaatgttccttttgcgcccatcagaggatacacgctcacaagtcaccatactgttgccccgagtgtggagtgttatgcagaagcgcttacttccagactcacgtcaaagaaaactgtctacactacgctaggaaagtcggatacagatgtattcactgtggtgtggtgcatctcacactggcacttctaaagtcacatattcaagagagacactgccaagtatttcacaagtgcgccttttgtccaatggcgttcaagaccgcgagcagcactgctgaccacagcgcaacacagcaccctacccaacctcacaggccctctcagctaatctacaaatgtagttgcgagatggtcttcaacaaaaagaggcacatacaacaacatttctaccaaaacgtcagcaaaacccaggtcggggttttcaagtgccccgagtgccccttgctgttcgtgcagaagccggaattaatgcagcacgtaaaatccactcacggagtgccaaggaacgtggatgagttatccagcctgcagagctccgcagacacaagcagctcccgcccagggtccagagtgccaaccgagcctcccgcaacaagcgttgcagctcggagctcctctttgccgtccggccgatggggtaggccagaagcccatagaagagtggaagcccgaccgagactaaggaatactggatggacctgccaggagtgccaggagtgggttcctgaccgagagagctatgtgtcacacatgaagaaatcacatggccgaacactcaagcgttacccttgccggcagtgtgagcagtcttttcatacccccaactccctcaggaaacatattcgtaataatcacgatacggtaaagaagttctatacctgcggatactgtaccgaggactcaccatctttcccgcgacccagcctcttagagtcgcacatctcactaatgcacggcatccgcaatccagacctgtcccaaaccagcaaagtgaaacccccaggcggacactctccacaggtcaaccatctcaagcggccagtaagcggggtgggcgacgctcctgggacatctaatggagcgaccgtctcgtctactaagcgtcataagagcctgttccagtgcgcgaagtgttcttttgccacagactcaggtcttgagttccagagccacatccctcagcatcaggtcgatagttcaactgctcagtgtctcctgtgcggtctctgttacacttcggcctctagtctttcaaggcatctgtttattgtccacaaagtgcgcgatcaggaagaggaggaggaggaggaagccgcagcagcagagatggcagtcgaggtggcagagccagaagaaggctctggcgaggaggtgccaatggagactagagaaaacggactggaagaatgcgccggagagcccctttcagctgatcctgaggcgagacgcctgcttggccctgccccagaggatgacggaggacacaatgaccattctcagccccaggccagccaggaccaagatagtcacaccctaagcccccaagtgtag

SEQ ID NO: 247720 - DNA, 2379 bp, Artificial Sequence
  Description of Artificial Sequence: Synthetic coding sequence
atggcagcgattaacccttgggccagctggggcgctctgaccgaccaatcatggggcatgacagcagtcgacccttgggcttcgtgggccctctgccctcaatatccagcatggcatgtggagggcagtctggaggagggccgtagggccactgggctccccgcagcccaggtgcaggaaccagtgacttttaaagatgtggcggtggactttactcaagaggagtggggccagttggatttggtccagcggacgctgtaccgcgacgtgatgctcgagacctacggccatttgctgtccgtcggcaaccaaatcgcgaaaccagaggtgatctctttgttggagcaaggcgaggagccatggtccgttgagcaggcctgcccccaaagaacctgccctgagtgggtaagaaacctggaatccaaggccttgataccagcccagtcaattttcgaagaggagcagtctcacggcatgaagttggagagatatatttgggacgatccgtggttcagcaggcttgaggttctggggtgcaaggaccagctagagatgtaccacatgaaccagtcaacagccatgaggcagatggtcttcatgcagaaacaggtcctgagccaacgttcctctgagttctgcgggcttggtgcagaatttagccagaatctgaatttcgttccatctcagcgtgttagtcagatcgagcatttctacaagcccgatactcacgcccagagctggcgatgcgacagcgctattatgtacgccgacaaagtgacctgcgagaacaacgactacgacaaaacagtataccagagcatccaacctatctaccccgctcggatccagaccggggacaatctgttcaagtgtaccgatgctgtcaagagttttaaccacattattcactttggcgatcataagggcatccacaccggcgagaagctctatgagtacaaagagtgtcaccaaatctttaatcaatcaccatcattcaacgaacatccacggctgcacgtcggagagaaccaatacaactataaggaatacgagaacatcttctattttagcagttttatggagcatcagaagattggtaccgtggaaaaggcctataagtacaatgagtgggagaaagttttcggctatgattccttcctaacgcagcacactagcacttacacagccgaaaagccttatgactataatgaatgcggaacttcatttatttggtctagctacctgatccaacataaaaagacccacaccggggagaagccttacgaatgcgataaatgtggcaaagtgtttaggaataggagcgccctcaccaaacacgaacgcacccatacagggattaaaccctacgagtgcaataaatgtggcaaggccttctcatggaactcccatctcatcgtacacaaaaggattcacacaggagaaaaaccttacgtctgcaacgagtgtgggaagtcctttaactggaactcccacttgatcgggcatcaaagaactcatactggagaaaagccttttgaatgcactgagtgcggcaagtctttcagctggtccagtcacctgatcgcccatatgcggatgcacactggggagaagccgtttaaatgtgatgagtgtgaaaaggccttcagggattactccgcattgagtaagcacgagaggacacacagtggggctaaaccctacaagtgcacagaatgtggaaagtctttctcatggtcatcccacctgatagctcaccagcgcacgcataccggagagaagccatacaactgtcaagaatgcggtaaagctttcagagagcgttccgccctcactaagcacgagatcatccactccgggatcaagccttatgaatgcaataagtgcggaaagtcatgctcccagatggcccatttggttagacaccagagaacccatactggagaaaagccctatgagtgtaataagtgtgggaaatctttttcccagtcctgtcacctggtggcccatcgccgaattcataccggagagaaaccatacaagtgtaaccagtgtgagagatcgtttaactgctcgtcacacctaattgcccataggcgcacacacaccggcgagaagccttacagatgtaatgaatgcgggaaggcatttaacgagtcttcgagcctcatcgtgcacctgaggaaccatacgggagaaaaaccctataagtgtaaccactgcgaaaaggccttttgcaagaatagtagccttattattcaccagcggatgcactctggtgaaaagagatttatatgctcggagtgtgggaaggctttttccggtcactcagctctattgcagcaccagagaaatcactcagaggaaaagcttaactag

SEQ ID NO: 247721 - DNA, 2109 bp, Artificial Sequence
  Description of Artificial Sequence: Synthetic coding sequence
atgctggagacatacggccatctcctatccgttggaaaccagatcgccaaacccgaagtgatctcactcctcgagcagggtgaggagccgtggagcgtggaacaggcatgtccacagcgaacttgtcccgagtgggttcgtaacctcgagagcaaagccctgatcccggctcagtcgatcttcgaggaggaacagtcccacgggatgaaactggaacgctacatttgggacgatccatggtttagtaggctggaggtcctgggctgtaaggaccagctggagatgtatcatatgaatcaatcaactgccatgaggcagatggttttcatgcagaagcaggtattatcccagcgttcttctgaattctgtggcttaggcgctgaattttcacagaatctcaacttcgtaccgtctcagagagtctctcagatagaacacttctataaaccggatacccacgcgcagtcctggcgctgcgattccgccatcatgtacgccgacaaagttacctgtgaaaacaacgactacgataagacggtgtaccagtcaatccagcccatctaccctgccagaatccagaccggtgataacttgtttaagtgcacagatgccgttaagagttttaaccacatcattcacttcggtgaccacaagggtatccacacaggagaaaagttatacgagtacaaagagtgtcatcagatatttaaccaatcaccaagcttcaatgaacatccaagactgcacgttggagaaaaccaatacaattacaaggaatacgagaacattttttacttcagtagtttcatggaacaccaaaaaatagggaccgtggaaaaggcgtataaatacaacgaatgggaaaaggtgttcgggtatgattcatttttgactcagcacacttctacctacaccgctgagaagccgtatgactacaatgagtgtggcacaagcttcatatggagttcataccttatccagcacaagaagacacacactggcgagaagccttacgagtgtgacaaatgcggcaaagtttttcgaaatcggagtgccctcactaaacatgagaggacccatactggaatcaaaccatatgagtgcaataaatgcggaaaggcctttagctggaattcccacctcatagttcacaaaagaattcacactggggagaaaccctacgtgtgcaacgaatgtgggaaaagttttaattggaatagtcaccttatcgggcaccagcgcacccataccggcgagaaaccttttgagtgtacggaatgtggtaaaagcttctcttggagctcccatcttattgcacatatgcggatgcatactggcgagaaaccgttcaaatgtgacgagtgcgaaaaggcgttccgagactacagtgctctgtccaagcacgagcgcacccatagtggcgctaagccctataaatgtactgagtgcggaaaaagtttcagttggtcgtctcacctcattgcccaccaaagaacacacaccggcgaaaaaccttacaattgtcaagagtgtggtaaagctttcagagaaaggtccgcgctgacaaagcatgaaataattcactcaggcattaagccctacgaatgtaataaatgcgggaagtcgtgctctcagatggctcacctggtgcggcatcaacgtacccatacgggtgagaaaccttatgaatgcaacaagtgcggtaagagctttagccagagctgccacctcgtagcccaccgcagaatccataccggcgaaaaaccatacaagtgtaaccagtgcgaaaggtcttttaattgtagctcacatctgatagctcataggagaacgcatacaggggagaagccttaccgttgcaatgaatgcggcaaagcttttaatgagagctcgagcctcatcgtgcaccttcgcaaccacaccggagagaagccttataaatgtaaccactgtgagaaggccttctgcaagaattcatctctgatcatccaccagcgcatgcattctggtgaaaagagatttatatgcagcgagtgcggtaaagccttctccggccattctgccctcctccagcatcagagaaatcattctgaggagaagctgaactag

SEQ ID NO: 247722 - DNA, 1527 bp, Artificial Sequence
  Description of Artificial Sequence: Synthetic coding sequence
atggccgctattaatccttgggcctcatggggcgctttgaccgaccaaagctggggcatgaccgcagtggatccgtgggcctcatgggcactgtgtccccagtaccctgcttggcacgtggaagggagccttgaggagggacgcagggccactggtcttcctgctgcacaggttcaggagcctgtgaccttcaaggatgtggcagtcgatttcacccaagaggagtggggccaattagatttggtgcaacgtaccctgtatcgcgacgtcatgctcgaaacgtacgggcacctgctgtctgtgggcaatcagattgcaaagcccgaagttatatccttgctggagcagggggaggagccgtggtctgttgaacaggcttgcccacagagaacatgtcctgagtgggtgcgcaatttagaatccaaggcattaattcccgctcagtctatcttcgaggaagaacagtcccatgggatgaagctggagcgctatatctgggatgacccttggttttctaggttggaggtcctgggctgtaaagaccagcttgaaatgtaccatatgaatcagtctactgccatgagacaaatggtgtttatgcagaagcaggttcttagtcagcgctcgtccgaattttgcgggctgggggcagagtttagtcagaatttaaacttcgtaccatctcagcgcgtctcccaaatcgagcatttctacaaacccgacacccacgcacagtcatggagatgtgacagcgccatcatgtatgcagacaaagttacctgcgagaataacgattatgacaagactgtttatcagtccattcaaccaatttaccctgcacgtatccaaactggggacaacctcttcaagtgtaccgacgccgtaaaatcatttaatcatatcatacattttggcgaccataagggaatccacacaggcgaaaagctatacgagtataaggagtgccatcaaatcttcaatcaaagtcccagtttcaacgagcatcctcgcctccatgtgggcgaaaaccagtacaattataaggaatacgaaaacatcttttacttcagctcttttatggaacatcagaagataggaaccgtggagaaagcctataagtacaacgagtgggagaaagtttttgggtacgactccttcctaacccagcacacctccacctacacagccgaaaagccttacgactacaatgaatgtgggacttcctttatctggtcatcttaccttattcagcacaaaaagactcataccggagagaagccctacgagtgtgacaaatgtggaaaagtcttccggaacagatccgcactcactaaacatgagagaacacacaccgggattaagccttatgagtgcaataagtgtggaaaagcctttagctggaacagtcatctgatcgtacataaacggatacacacaggtgaaaaaccctacgtatgtaacgagtgtggcaaatcatttaattggaactctcatttgatcggacaccaaagaacgcacactgggtag

SEQ ID NO: 247723 - DNA, 2523 bp, Artificial Sequence
  Description of Artificial Sequence: Synthetic coding sequence
atgaaagaggataaatcctccatacgagaggcaatctctaaagcaaaatcaaccgccaatattaagaccgaacaggagggagaggcttcagaaaagtcactccacctaagcccacagcacatcacacaccagactatgccaatcggacagcggggttccgagcagggtaagcgggtagagaacattaacgggactagttatccaagcctgcagcaaaaaaccaacgccgtgaaaaaactgcataagtgcgatgaatgcggaaaatccttcaagtacaactctaggctcgtccagcataagatcatgcacacaggggaaaaaagatacgaatgcgacgactgcgggggtacctttcgctcttctagcagtctgcgggtgcataagcgaatccacacaggcgaaaaaccatacaagtgcgaggagtgtggtaaggcatacatgtcgtactcctcactcatcaatcataagtctacgcacagcggcgagaagaactgcaaatgcgacgaatgtggcaaaagtttcaactattcatccgtgttggatcaacataaacgcatccacaccggcgaaaagccatatgaatgcggagaatgcggtaaggcatttcgcaattcttccgggcttagagtgcacaaacgcatacacacaggcgaaaaaccatatgaatgtgacatctgtgggaaaaccttcagtaacagttcaggactgagagtgcacaaaagaatccacaccggggaaaagccatatgaatgcgacgagtgcggcaaggcattcatcacatgtaggaccttactgaatcacaagagcattcactttggcgacaaaccctacaagtgtgacgaatgtgaaaagagtttcaactactccagtttgctgatccagcataaagtcatacacactggcgaaaaaccttacgaatgtgatgagtgcggtaaagcatttaggaattcatctggcctgattgtccataagcgtattcacaccggtgaaaagccttataagtgtgatgtctgcgggaaagccttctcttacagctccggcttggctgttcataagtcaattcacccaggcaaaaaggctcatgagtgcaaggaatgtggcaagagtttttcctataattccctgctgctgcagcaccggaccatacataccggcgagcgcccatatgtgtgtgatgtctgtggcaagactttccgtaataatgcaggcctgaaggtccaccgcagactccacacaggcgagaagccatacaaatgtgacgtttgcggcaaagcttatatttcccggagtagcctgaaaaaccataaaggcatacacctgggtgagaagccctataagtgctcgtactgcgagaagtcctttaactactcatcagctctggaacagcacaaaagaattcacacacgcgagaaaccatttggatgcgacgaatgtgggaaggctttccgcaataattctggtctgaaggtgcataaacgaatacacacaggcgagagaccctacaaatgcgaggaatgtggtaaagcttacatttccctttcatccctaattaaccacaagtccgtgcaccccggagaaaaaccctttaaatgcgacgagtgtgagaaggctttcatcacctatcgcacattgacaaaccataaaaaggtgcacctaggagaaaaaccatataagtgcgacgtatgtgaaaaatctttcaattatacatcactcctatctcagcacagacgcgtgcacactcgcgagaaaccctatgaatgtgatcgctgtgagaaagtgtttagaaataactcctccctcaaggtgcacaagaggatccacaccggcgaaaggccatatgaatgtgatgtctgcggaaaagcgtatatctctcatagtagtctaattaatcataagtccacccaccccggacgcacccctcatacgtgcgacgagtgcggcaaggcgtttttttcttctcgaacattaataagccacaagagagtgcacctgggcgagaagccgtttaagtgtgtggagtgcgggaaaagtttcagttattcctccctactgagtcagcacaagcgtattcacacaggagaaaaaccttacgtctgtgatcggtgtggaaaagcttttcgcaattcttctggcctaaccgtccacaaaagaatccacacaggggaaaaaccatacgaatgtgacgaatgcggcaaggcatacatctcgcactcttctctcataaaccataagtccgtgcatcagggcaaacaaccctacaattgcgaatgtggtaagagttttaactataggtctgtgctagatcagcataaaaggatccatacaggcaaaaagccctacaggtgcaacgaatgtgggaaagctttcaacatccgcagtaatctgacaaaacacaaaaggacccacacaggggaagagagcctgaacgtgatctacgtgggatcctactccggaacctctcagaaaagaacctatgagggcggaaatgctcttgacggtgggagaatgaggatgcccttatag

SEQ ID NO: 247724 - DNA, 1497 bp, Artificial Sequence
  Description of Artificial Sequence: Synthetic coding sequence
atgtcatactcctctctgatcaatcacaagtccactcatagcggcgaaaaaaattgcaaatgtgatgaatgtggcaagtccttcaactactcatcagtccttgatcagcacaaacgtatccatacgggagaaaaaccttacgaatgcggggagtgtggtaaagcgtttcgcaacagttccgggctgcgggtacataagcgcatacataccggtgaaaagccatatgagtgtgacatctgtggcaaaacattctcaaattcgtccggattgcgggtgcacaaacggatccatacgggtgagaagccatatgaatgcgacgaatgcggaaaagctttcattacgtgtagaaccctcttgaatcataaatcgattcacttcggggataagccctacaaatgtgatgagtgcgggaaggcatttagaaataactctgggctgaaggtccataagcgcatccacactggcgagagaccttataagtgcgaggagtgtggcaaggcctatatatctctgtctagtctgattaatcacaagtctgtgcaccctggcgagaaacctttcaaatgtgatgagtgcgagaaagcatttataacataccgcactctaacgaatcacaagaaagtgcatctcggcgagaagccttacaaatgtgatgtgtgtgagaaatcatttaactacaccagtcttctgtcccagcacagaagggtacacacccgggaaaaaccctatgagtgtgatcgctgtgagaaggtgttccgcaacaattcaagcctcaaggttcacaaaaggattcacacgggggagaggccatacgaatgtgacgtgtgtggcaaggcctacatctctcattcatccctcattaaccataaaagtacgcatccaggcagaaccccccacacttgcgacgagtgcggcaaagcattcttctcctcgaggactctgatatcacacaagagggtgcatctcggggagaaacctttcaaatgcgtcgaatgtggaaaatcattcagttatagttcactgctctctcagcacaaaaggatccacacaggcgaaaagccctacgtgtgtgacaggtgcggtaaagcattccgcaacagctctggtttgacagttcataagcggatccacactggtgagaaaccatacgagtgcgatgaatgcggaaaggcttatatctcacattcctcactcataaaccataagagcgttcaccaggggaagcagccatacaattgcgaatgtggaaagtcgttcaactaccggtcagtactcgaccagcacaaacgcattcacactggcaagaaaccttaccggtgcaatgagtgtggtaaggccttcaatattaggagtaatcttacaaagcataaacggacacataccggagaggagtccctaaatgttatctacgtgggctcttattccggtacatcccagaagaggacatacgagggcggtaatgcccttgatgggggacggatgcggatgcccctctag

SEQ ID NO: 247725 - DNA, 2703 bp, Artificial Sequence
  Description of Artificial Sequence: Synthetic coding sequence
atgtcacacctgaagacaagtacagaggacgaggagcccaccgaagaatacgagaacgtgggcaatgctgcatccaaatggcctaaagttgaggacccaatgcccgaatccaaagttggggatacttgtgtgtgggactcgaaggtggaaaaccagcagaagaaacccgtcgaaaacaggatgaaagaggacaagagcagcataagggaggcaatatccaaagctaaatcgaccgccaatatcaaaaccgaacaggaaggcgaggccagcgagaaaagcctgcatctcagtccacagcacattacccatcagaccatgcctatcggtcaacggggttccgagcaaggtaagagagtggagaatatcaatggcaccagttatccgagcctgcagcagaaaacaaacgcggtgaagaagctgcataagtgtgatgagtgtgggaaatcctttaagtacaactcccggcttgtgcagcacaagatcatgcatactggcgagaagaggtatgagtgtgacgactgcggagggacatttagatcttctagcagtctccgcgtccacaagcggatccataccggcgaaaagccctacaaatgcgaggaatgtggaaaggcttatatgagctacagttccttgatcaatcacaagagtactcactcaggcgagaagaattgtaagtgcgacgagtgcggcaaaagtttcaattattcctcggtgctcgaccagcataagagaattcacacgggtgagaagccctacgaatgtggagagtgcggaaaagcgttcaggaactcttcgggtctgagggtccacaagagaattcacacaggggagaaaccctatgaatgcgatatctgtgggaaaaccttctccaacagctccgggcttagggttcacaagcgtatccacacaggggaaaagccatatgagtgcgatgagtgcggaaaagcattcatcacgtgccgtaccctcctgaaccacaagtctatccactttggggacaagccctacaagtgcgatgagtgtgaaaaatccttcaactatagttccctgctgatccagcataaggtcatccacaccggtgagaaaccttacgagtgcgacgagtgcggcaaagctttccgaaattcatctggattgattgtgcacaagagaattcataccggagaaaaaccttacaaatgtgatgtgtgtggcaaagcctttagctactcttcaggactggccgtacacaaaagcatccaccctgggaaaaaggcccatgagtgcaaagaatgcgggaaatccttcagttataacagcttgttgctgcagcacaggacaatacataccggcgaaaggccctacgtgtgcgatgtttgtgggaagaccttccgcaacaacgcagggttaaaggtacaccgtcgcttgcacacgggggaaaagccatataagtgtgacgtttgtggaaaggcttacatctccaggtcttctttgaagaaccataagggtatccatctcggggagaagccttataagtgctcttattgcgaaaaatcttttaattattcctccgctctggagcagcataagaggatccacactcgagagaaaccatttggatgcgacgaatgtggtaaggcattcaggaacaactcgggtctcaaggtccacaagcgaatccatacaggagagcgcccatataagtgcgaagaatgtggaaaggcgtacatcagcctcagtagcctgattaatcataagtctgtgcaccctggagagaagccgttcaaatgcgacgaatgcgaaaaagcctttattacttatcgcactttaacaaatcacaaaaaagtgcatttgggggagaagccgtacaagtgcgatgtttgcgaaaagagctttaactacacatcactgcttagccaacataggagagtccacacgagagaaaaaccttacgagtgcgataggtgtgagaaggtgttccgtaacaattcatcccttaaggttcacaagaggattcacaccggggagagaccctacgaatgtgacgtctgtggcaaagcttacatcagtcactcttccttaatcaatcacaaaagcacccatcccggtagaacaccccatacctgtgatgagtgcggaaaagcctttttcagttctaggactctcattagccataaacgagtgcatttgggcgagaagcctttcaagtgtgttgagtgcggaaagagcttttcctatagtagccttttgtcgcagcataagaggatccacactggagagaagccttatgtttgcgatcggtgcggcaaggccttcaggaattccagtgggttaactgtgcacaagaggatccacactggggagaaaccttacgaatgcgacgaatgcggcaaggcttacatctcgcattcctctctcatcaaccacaagagcgtacaccagggtaagcaaccctacaattgtgaatgcggtaagagcttcaactataggagtgtcctggaccagcacaaaaggattcacactggcaagaaaccatacagatgcaacgaatgtgggaaagccttcaatatccgcagcaatctgaccaaacacaaacggacccacactggcgaagaatctcttaatgtgatttatgtgggctcatacagtgggacatctcagaaacgcacttacgaaggcggtaacgccctggatggcggaaggatgagaatgcctctgtag

SEQ ID NO: 247726 - DNA, 483 bp, Artificial Sequence
  Description of Artificial Sequence: Synthetic coding sequence
atgcctgaaagcaaggttggggatacatgtgtgtgggattcaaaagtggaaaatcagcaaaagaagcctgttgagaacaggatgaaagaagacaagtcttccatacgggaagctattagtaaagccaaatctacagcgaacataaagaccgagcaggagggtgaggccagcgaaaagtctctgcacctgtctccacagcatatcacacaccagaccatgcctattggtcagagagggagtgaacagggcaagcgtgtggaaaacattaatgggacctcatacccgtctttgcagcagaagacaaacgccgttaagaagctccataagtgcgacgaatgcggtaagtcatttaaatataattctagactggttcagcacaaaatcatgcatacgggcgaaaagcggtacgagtgtgacgattgtggaggcacctttagatccagctcaagtcttagggtgcacaaacgtattcatactgggtag

SEQ ID NO: 247727 - DNA, 315 bp, Artificial Sequence
  Description of Artificial Sequence: Synthetic coding sequence
atgcctgaatctaaagtaggagatacctgtgtgtgggactccaaggtagagaatcaacagaagaagcctgtggaaaatagaatgaaggaagacaagtctagcattagggaagcgatctccaaagctaagtccacagctaatattaagaccgagcaggaaggggaggcatcagagaagtcccttcacctctccccccaacatatcacccatcagaccatgcccattgggcagcgcggatctgagcagggtaaaagggttgaaaacattaatggtactagttatccatcactacagcagaaaaccaacgccgtgtag

SEQ ID NO: 247728 - DNA, 237 bp, Artificial Sequence
  Description of Artificial Sequence: Synthetic coding sequence
atgccggagtctaaggtaggagatacatgcgtctgggatagcaaagtggaaaaccaacagaaaaaacctgttgaaaacaggatgaaagaagataaatctagtattcgagaagccatctctaaggctaagagcacagccaacatcaaaactgagcaggaaggcgaggcctccgaaaaaagtctgcacttgtcaccccaacatatcacgcaccagactatgcctatcgggcagcggtag

SEQ ID NO: 247729 - DNA, 2604 bp, Artificial Sequence
  Description of Artificial Sequence: Synthetic coding sequence
atgccagaaagcaaggtcggggacacctgcgtgtgggactctaaggttgagaaccaacagaaaaaaccggtggagaacagaatgaaagaagataagagcagcattagagaggccataagcaaggcaaaatccactgcaaatatcaagaccgagcaggaaggtgaggcctcagaaaagagtctgcacctgtcacctcagcacattacccaccagactatgccaatcggccagcgtggaagtgagcagggaaaaagagtggaaaatattaatggtacctcttatccatccctgcagcagaagaccaatgcggtgaagaagttacacaagtgtgacgagtgtggcaaatccttcaagtataactcacggctcgttcagcataagattatgcacacgggggagaaaaggtacgagtgcgatgattgtgggggaacctttcgctcctcttcatctctgcgcgtccataaaagaatacacaccggcgagaagccatacaaatgcgaggaatgcggcaaagcctatatgagctactcctccctcatcaaccacaagagcacgcatagcggggagaagaactgtaaatgcgacgagtgtggtaaatcctttaactattcatcagttctcgatcagcacaagaggattcacacaggcgagaagccttacgagtgtggcgagtgtggaaaggccttccgcaactcttccggactcagggtgcataagagaattcatacgggagagaaaccctacgaatgcgacatatgcggtaagaccttcagcaattcatccggcctgagagtgcacaagcgcatccataccggggagaaaccgtatgaatgcgacgagtgtggtaaagcttttatcacctgtaggacactcctgaatcacaaatccatccacttcggagacaaaccttataagtgtgacgagtgtgaaaaaagcttcaattatagcagcctgctgattcaacacaaggtcattcatacaggggaaaaaccctatgagtgtgatgaatgcgggaaggcttttcgcaacagctctggtctgatcgtacataagaggattcatactggagaaaaaccatacaagtgtgatgtctgcggtaaggccttttcttactcgtccgggcttgctgtgcacaagagtatccatccaggtaaaaaggcccacgagtgcaaagaatgcggcaagtccttctcttataattccctactcctgcagcaccggactatacacactggcgaaagaccatacgtgtgtgacgtatgtggcaaaaccttccggaacaacgcaggcttgaaagtgcaccgaagacttcatacaggtgagaagccgtataagtgtgacgtgtgcggaaaggcttacatctcacggtcttccctcaagaaccataagggaatccatctgggcgaaaaaccttataaatgctcctattgtgaaaaatccttcaactatagttcagccctggaacaacacaaacgtatccacacccgcgaaaaaccctttggttgcgatgagtgtggcaaagccttcaggaataactccggcctcaaggtgcacaaaaggattcacacaggagaacggccttataagtgcgaagagtgcggaaaagcctacatttcacttagctcacttatcaaccacaaatccgtgcatcctggggagaagccattcaaatgcgacgagtgtgagaaagccttcataacgtatcgcacgctgacaaatcacaagaaggttcacctgggagagaaaccctacaagtgcgacgtttgcgagaagtccttcaactatacctccctgttatcgcagcaccggagggtccatacccgcgaaaagccttacgaatgcgatcggtgtgagaaagtgtttcgaaacaactccagtctcaaggtgcataagaggattcataccggggagaggccatatgaatgcgatgtttgcggcaaagcctacatcagtcactcctccttaatcaatcataaatctactcaccctggccgaacgcctcatacatgcgatgaatgcggcaaagcattcttttctagtagaacactgatttcgcacaagcgggttcacttgggggaaaagccctttaagtgtgtggagtgcgggaagagcttctcatattcttctttgctgtcacagcacaaaaggatacacacaggtgaaaagccctatgtgtgtgacagatgtggtaaggcgttcaggaactcgagcgggttaaccgttcataagagaattcacaccggtgaaaaaccctacgagtgtgatgagtgtggtaaggcttatataagtcactctagtctcattaaccacaagagtgtgcatcagggcaaacagccatacaactgcgaatgcggcaaaagcttcaattacagatccgtgctcgaccagcataaaaggatccacacagggaaaaaaccttatcgctgtaatgagtgtgggaaggcttttaatatccgttcaaacctcacaaagcacaagagaacacacaccggagaagagtctctgaatgttatatacgtgggcagttactcggggacctcccaaaagaggacatacgagggcggtaatgcattggatgggggacggatgcgcatgcctttgtag

SEQ ID NO: 247730 - DNA, 1386 bp, Artificial Sequence
  Description of Artificial Sequence: Synthetic coding sequence
atggacagcgtggcatttgaagacgtcgccgtgaactttactctggaggagtgggccctccttgaccccagtcagaaaaacctctacagggacgttatgagagaaactttccggaatctggcgagcgtggggaagcaatgggaggaccagaacatcgaagaccctttcaagatcccccgaagaaatatttcccatatccctgaaaggttgtgtgagtccaaggaaggtggccagggagaggagacattctcccagatccctgatggaatcttgaataaaaagacccccggagtgaagccgtgtgaaagctccgtctgcggggaggtgggcatggggcctagtagtctgaatcgacatatccgcgaccacaccggcagggagcccaatgagtaccaggagtatggcaagaagagctacaccagaaatcaatgtggcagggccctgagctatcacaggagcttccctgtacgcgagagaacccatcctgggggaaagccgtacgactgtaaggagtgcggagaaacatttatcagtctcgtgtctatcagaaggcatatgctgactcacaggggcggtgttccctacaagtgtaaggtgtgtgggaaggcctttgattatccctcattattcagaatacacgagcggtcacacacaggtgaaaagccctatgaatgtaagcagtgtgggaaggcatttagctgtagctcttacatccggattcacgagagaacacacacaggagataagccttacgagtgcaagcagtgtggaaaagctttcagctgttctaaatacattcgcattcacgaacgcacacatacaggcgagaagccatatgaatgcaagcaatgtgggaaggctttccggtgcgcttcctcggtgcggtctcacgaacggacccatacaggggagaaactgttcgaatgcaaggagtgtggaaaagcactgacctgtctggcatccgtaagacgacacatgattaaacatacaggtaacggcccttacaagtgcaaggtgtgcgggaaagcctttgatttcccgtcaagctttaggattcatgaacgcacccacaccggggaaaagccctacgattgcaagcagtgcggaaaggcgttttcttgcagctctagctttaggaaacatgagaggattcacactggagagaagccctataagtgtacgaagtgtgggaaagctttttccaggtcatcatactttcgcattcacgaacggacacacacgggggaaaaaccctatgagtgtaagcagtgtgggaaagcattctctcgaagcacctatttccgcgtacatgaaaagatccacactggcgagaagccatatgaaaatcccaatccgaacgcgtcggtcgtaccagtcctgtcatag

SEQ ID NO: 247731 - DNA, 3168 bp, Artificial Sequence
  Description of Artificial Sequence: Synthetic coding sequence
atggtcgggagccacgcagacatggcccctgcctccaccgccgagggggctggggagaagccaggcccagccgctcctgcccctgccgcacagtacgaatgcggtgaatgcggaaaatctttcagatggagttcgcgcttgctgcaccaccagcgtactcatactggagaacggccatacaaatgtcccgactgtccaaaggccttcaaggggtcatccgctctcctgtatcaccagcggggtcacactggcgagcgcccttatcagtgtcccgattgccccaaggctttcaagaggagcagccttctgcagatccaccgatccgttcacaccggactcagggctttcatctgtggccaatgcggactggcctttaagtggtcgtcccattatcaatatcaccttcggcagcacaccggggagagaccttacccatgtccggattgccctaaggcctttaagaactcaagtagcctaagaaggcatcgccacgtgcatactggggagcgaccatacacgtgtggggtctgcgggaagagcttcacacagtccaccaatctgaggcaacatcagagagtccatacaggggagagaccattccgatgccctttgtgcccaaaaacttttactcacagctctaatttactcttgcatcagcgaacgcacggcgctgcgccagcccctgggacggcctctgccgcaccgccaccccagagtagggaacccggtaaagtgttcgtttgtgatgcctacctacaacgccaccttcagccccatagtcctcctgcaccacccgcaccacctccaccaccacctcccgtggtgccggagctcttccttgcagctgcagaaacaactgttgagctggtgtacaggtgcgacgggtgcgagcagggcttttctagcgaagaactactgttggagcaccaaccctgcccgggtcctgacgcggctccacagccgcaggaggctcccgcagaggcgccaaaagcggatcaacccccaagccctctaccccaacccccaccaccggcagctgctcctgcaccaggattcgcctgtttgccctgtggcaaatcattccgaacagtcgctggactgtcccgccaccagcactcccacggggcagccggtggtcaggcatttcggtgcgggtcctgtgacggtagcttcccccagctcgcctctctgctagcacaccagcagtgccacgttgaggaggcagccgctggcagaccaccaccccaagctgaggcggctgaagtcacatgtccccaggagcccttggctcctgctgccccagtccctccgccacccccatcagctcctgccagcgccgagcggccatataaatgcgctgagtgtggaaagagttttaagggatcatctggtctgagataccacctaagggatcacacaggagaacgaccataccaatgtggggagtgcgggaaggcattcaaaagatccagcctgctggcaatccaccagcgcgttcatacaggactccgggcttttacatgtggacaatgcggacttacgtttaaatggtctagccactaccagtatcacctgcggctccatagtggagagcggccatacgcctgcggcgaatgcggtaaagcttttcgaaatacatcgtgtctgaggaggcaccggcacgtgcacaccggcgagcggccacacgcttgtggcgtgtgcggcaagtcatttgcccaaacctccaatcttagacagcaccaaagagtccatacaggcgagaggccattcaggtgtccactctgtccaaagactttcactcattcctccaatttgttgctccatcagcgcacgcattcagcagagcggccattcacatgccctatttgtgggagaggctttgtgatggccgcatacctacagcggcatcttcgcacacacgcccctgcaaacaccccaccttctaccacggcaccggctgccggaccacaacctcctgcgcctttggctgccgctcgcgcacctcccgctacgcaggatgtccacgtgttgccacacctccaggccactttatcccttgaggtggctgggggaactgcccaggcccctagcctggggcctgcagcccctaactcccagacattcctgctcgtgcaaaccgctcaaggccttcaactaatccctagcagtgtgcagcctcccacacctccgcctcctccagctcccccaaaactgatcctgcttccttctagtagtgcgggtgccggaggtggtcgggcacggcagggcccaagggccgtcggaaaggccggtcaaggagccggtgtggtgtggttaccgggtcctggaggtctcggtgttcagggagctgcatctgccggagctagcggtaccggccagagcctgattgtgctgcaaaatgtgggcggtggcgaggctggaccccaggaaatgtccggggtgcagctccaaccacttaggccagcccctgaggttaccactgtgcagttacagcctgcccaggaggtgaccaccgtgcaactgcaaccagcccaagaggtgactacagtccagctgcagcctgctcaggaggtgaccacagtgcagctacagcccgtggcgggtcagctgtccaacagctccggcggagctgtggcaactgaagcccctaatcttctggtcgtacaatccggcgctgcagaagaactcctgactggacccggtcctggggaggcaggagatggagaggctagtactggcgtcgttcaagatgtgctttttgaaaccctccaaaccgacgaaggattacagagtgtgttggtcctttctggagctgacggggaacagacgcggctgtgtgtccaagaggtggaaactctcccacccggactgactgaacccccagccacggggcctcccggacagaagcttctgattataagatctgctccagcaaccgaactgttggactcttcaaacaccggagggggaacagctaccttacagctcctggcccctcccccaagcgggcctgctagtgggcctgctggtctcccgggtgccccagcgagtcaaatggttcaggtggtccccgctggcgctggtcctggggtgatgacaccacagggccttccatcgattcagattgtccagactcttcccgctgttcagctcgttcacacattttag

SEQ ID NO: 247732 - DNA, 1602 bp, Artificial Sequence
  Description of Artificial Sequence: Synthetic coding sequence
atggatagataccagggaaaccaagatagagtgctccggcaggtgactgtcatatctagagaaactctaacagacgagatggggagtaagtattccgcattcgggaaaatgttcaaccgctgcaccgaccttgcccctctgtcccagaaattccataaattcgacagttgcgaaaatagtctaaaatccaacagtgacctgctgaactataaccgaagctatgcacgcaaaaacccaacgaagcgctttaggtgtggacgcccacccaagtataacgcgtcatgcagcgtgccagagaaagagggattcatccacaccggaatggagccctacggcgattcacagtgtgagaaagtactgtctcataagcaggcacatgtccagtataaaaaatttcaggcccgagagaaaccgaatgtttgtagcatgtgtggaaaggcctttatcaaaaaaagtcaactgatcatccatcagaggattcataccggtgagaagccctacgtctgcggggactgcagaaaagccttctccgaaaagagccacctgattgttcaccagcggatccacacaggagaaaaaccctacgaatgtacgaaatatgggagagcgttttcccgcaagagccccttcactgttcatcagagagttcacaccggcgaaaaaccctacgaatgtttcgagtgccccaaggcattctcccagaagtcccaccttatcatacatcagcgggtacatactcgcgaaaagcctttcgaatgtagtgagtgcaggaaagcattctgtgagatgagtcacctgttcatccaccagatcacacataccggcaagaaaccttacgaatgcaccgagtgtggaaagacttttccccgaaaaacccagttgatcatccaccaacgtactcataccggagagaaaccttacaaatgtggcgaatgtggcaagactttttgccagcagtcacacttgatcggacaccagaggattcatacaggtgagaagccgtacgtttgtactgattgcggcaaggccttctcgcagaagagccacctcactggccatcaaaggttgcacacaggagaaaagccgtatatgtgcactgagtgcggcaaatccttcagccaaaaatcgcctttgatcatacaccagaggatccatactggggaaaagccctaccagtgtggcgagtgcggcaaaacctttagtcaaaagtcactgctgatcatccacttacgagttcacacaggtgaaaagccttatgagtgcaccgagtgtggtcgtgcattttctctcaagtctcatctaattctgcaccagcgcggacataccggggagaagccttatgagtgttctgaatgcggcaaagctttttgcgggaagagcccccttatcattcatcagaagactcaccccagagagaagacccccgagtgcgcagaatcaggtatgacgttcttttggaagagtcagatgattacctaccagcgccgtcacaccggagagaagcctagtaggtgtagcgactgcggcaaagccttctgccaacacgtgtatttcacggggcatcagaatccctaccgcaaggacactctctacatttgctag

SEQ ID NO: 247733 - DNA, 1974 bp, Artificial Sequence
  Description of Artificial Sequence: Synthetic coding sequence
atgattgagtcacaagaaccagtgacattcgaagatgtggccgtggatttcacccaagaagaatggcagcagcttaaccctgcacagaagacgttacaccgcgacgtgatgctggagacgtataatcacctcgtgtctgtcggctgtagtggcataaaacccgatgtaatattcaagctcgagcacggcaaggacccttggatcatcgagagcgagctcagtcggtggatctaccccgacagggtgaaggggcttgaatctagtcagcaaataatcagtggtgagttgctcttccagagggagattctcgagagggcacccaaagataattccctgtattcggtcctgaagatttggcacattgacaaccaaatggaccggtaccaggggaatcaagaccgggttctccggcaggtgaccgttatcagtcgcgagacactgactgacgagatggggtccaagtacagcgcctttggaaagatgtttaaccgatgcactgatctggcgccactgtcccagaaattccacaagtttgatagttgtgaaaactctctgaagagtaactcggacttgctaaattataataggtcctatgctagaaagaacccaacaaagagattccgttgtggaaggcccccaaagtataacgcgagctgctctgtgccagagaaggagggattcatccacaccggcatggagccatatggggacagtcagtgtgaaaaggtgctctcccataagcaggcacacgtgcagtataagaagtttcaggccagagaaaagccaaacgtctgcagtatgtgcgggaaggccttcattaagaagtctcagcttatcattcatcaaagaattcatacgggagagaagccttacgtgtgcggcgattgccggaaggccttttccgagaagtcacatttgattgtgcaccagcgcattcataccggcgagaaaccttatgagtgcacaaagtatgggcgagccttcagcaggaagtcacctttcaccgtgcaccagagagtgcacacaggcgaaaaaccttacgagtgcttcgaatgtccaaaggcctttagccagaagtctcatctcatcatccaccagagggtgcatacccgcgaaaaaccattcgagtgtagcgagtgcaggaaggctttctgcgagatgtcccacctttttatacaccagatcacccacacagggaagaaaccctacgagtgcacagagtgtggaaagacattcccacggaaaacacagctgataattcatcagcgcacccacactggtgagaagccctataaatgcggggagtgcgggaagacattctgccagcaatcccacttgataggccatcagcgaatacacacgggggagaagccgtacgtgtgtactgactgtggcaaggctttctcacagaagtctcatttgactggtcaccagcggcttcataccggggaaaaaccatatatgtgtaccgagtgcggcaaatctttcagccaaaagagccctctgatcatccaccagcggatccacacaggagagaaaccgtaccagtgcggggaatgcgggaagacattctctcaaaaatctctcttgatcattcacctgagggtgcacacaggggaaaaaccatacgagtgcaccgaatgcgggagggccttcagtttgaagagccacctcatcctgcaccagagagggcacacaggcgaaaaaccctacgaatgctctgagtgcgggaaggccttctgcggcaaatcccctctgatcattcaccaaaaaactcatccgcgagagaaaacgccggaatgtgctgaaagtggtatgacctttttctggaagagccagatgattacctatcagcgcagacacactggtgagaaacctagcaggtgttccgactgtggaaaggccttttgccagcatgtgtatttcacaggtcatcagaacccttataggaaggacacgttgtatatttgttag

SEQ ID NO: 247734 - DNA, 645 bp, Artificial Sequence
  Description of Artificial Sequence: Synthetic coding sequence
atgattgaatctcaggagcccgtgacctttgaagatgtcgccgtggacttcacccaggaagaatggcaacagctcaaccccgcacagaaaacactgcaccgggatgtgatgctcgagacatataatcatctggtcagtgtggggtgttcaggcattaagccagatgttatcttcaaactagagcacgggaaggacccttggatcatcgaatctgagctgagcagatggatctaccccgaccgggttaaagggcttgaatccagccagcagatcataagcggagaactgctatttcagcgtgagattctcgagagagccccaaaagacaactctctttatagtgtgctgaagatctggcacatagataatcagatggaccgataccagggcaatcaggatagagtgcttcgacaagtcactgtcatttcccgggagaccttgaccgacgaaatgggatctaagtactctgctttcggaaaaatgttcaatcgatgtactgacctcgcccctctttctcagaaattccataagttcgatagttgcgagaactcactgaaatccaactctgatcttctgaactacaacagaagctatgctagaaaaaaccccacgaagaggttcagatgtggccgtccccctaaatag

SEQ ID NO: 247735 - DNA, 1932 bp, Artificial Sequence
  Description of Artificial Sequence: Synthetic coding sequence
atgatagagagtcaagaggagtggcagcagcttaatccagcccagaagaccctgcatagagacgtgatgctggaaacttacaatcatctggtgtccgttggatgcagtggaatcaaacccgatgtaatcttcaaactggagcacggaaaagacccttggattatcgagagcgagctttctaggtggatctatcctgatagggtgaagggcctggagagcagccagcagattatttctggagagcttctgtttcagcgtgaaatcttggaaagggccccaaaggacaattcgctgtactctgttctgaagatctggcatatcgataaccagatggatcgttatcaagggaatcaggacagggttctcaggcaggtcacagtgatctcaagggagactctgacagacgaaatggggtcaaagtattccgcgttcggtaaaatgtttaatcggtgtactgatcttgctccccttagtcagaaattccataagtttgatagctgtgagaatagcctgaaatcaaactccgacttactgaactataaccggtcgtatgcgaggaaaaaccctactaaacgctttcgatgtggccgtccacctaagtataacgccagctgctccgtacccgagaaggaaggcttcattcacaccgggatggaaccgtatggcgactcccagtgcgagaaagtgctgagccacaagcaagcgcatgtgcagtacaagaagttccaagctcgagagaagccaaatgtgtgctccatgtgtggaaaggcctttatcaagaagtctcaacttataatccatcaaaggatccatacaggcgaaaagccttacgtctgtggtgactgcaggaaagcgttctccgagaaatcacatctgatcgttcaccagcgcattcacacgggcgagaagccatacgagtgtaccaaatatggtcgtgcgtttagtaggaaaagtccattcaccgtgcatcagcgtgtccatacgggagaaaagccctacgagtgcttcgaatgccctaaggcattcagtcaaaaatcgcatctcatcatacatcagcgtgtgcacacacgagaaaaaccattcgaatgcagcgaatgccgcaaggccttctgcgaaatgtctcatctgttcattcaccagatcacacacaccggaaaaaagccttatgagtgtacagagtgcggtaaaaccttcccccgtaagacccaactaatcatccatcagaggacgcatacgggcgaaaaaccctacaagtgtggcgaatgcgggaaaacattttgccaacaatctcacctgattggccaccaaagaatccataccggggaaaaaccgtatgtgtgtacagactgcgggaaagcattcagccaaaaaagccacctcactggccatcagagacttcacaccggcgagaaaccttacatgtgcacagagtgtggcaagtcctttagtcaaaagagcccattaatcattcatcaaaggattcacactggggaaaaaccttaccaatgcggtgaatgcggaaagacattttcgcagaaatctctgctgatcatccatcttcgggtgcatacaggggagaagccttacgagtgcacagagtgtggacgcgctttcagcttgaagagccacctaatcctccaccagcgcggacatacaggggagaagccctatgagtgttctgaatgtgggaaggctttttgtggtaagagccctctgatcatccaccagaagacccaccctcgggaaaagacaccagagtgcgctgagtccggcatgacatttttctggaagtcccagatgattacatatcaacgaagacatacaggagaaaagccttccagatgttctgactgcgggaaagccttttgtcaacacgtttattttacaggacaccagaacccctatcggaaggacacgttatacatttgttag

SEQ ID NO: 247736 - DNA, 5936 bp, Artificial Sequence
  Description of Artificial Sequence: Synthetic coding sequence
atgagcaggccacgatttaacccccgaggagacttcccacttcagagacccagggctcctaacccgtctggaatgcggccacctggaccttttatgcgcccaggtagcatgggcctcccccgattttacccagcgggaagggcgagagggataccccacagattcgcaggccatgagtcgtatcagaatatgggaccgcagagaatgaacgtccaagtgactcagcaccgtacggaccccagactgaccaaagaaaagctggattttcacgaagcccaacaaaagaagggaaagcctcacggctctcggtgggacgatgaaccacacatcagcgcctccgtggcggttaaacagtccagtgtcacgcaagtcactgagcagagccccaaagtccagagccggtacactaaggagtctgcctcgtccattctggcgagcttcgggctcagcaatgaagaccttgaggaactgagcaggtatcccgatgaacagctgacgccagagaacatgccactaatcctgagagacatcaggatgcgcaagatggggcgaagattaccgaacttaccctcacagtcaaggaacaaagagaccctggggtctgaagctgtctcttccaatgtgattgactacggccacgcctccaagtacgggtataccgaggacccactcgaggttagaatctatgaccctgaaatcccgaccgacgaggtggagaatgagttccagagccagcagaatatcagcgctagtgtccctaacccaaatgtgatatgtaactctatgttccctgtggaagacgtctttaggcagatggactttcccggagagtcttcgaataaccgaagcttcttttccgtcgaatcaggaacaaaaatgagcgggctgcatatttccggcggacagagtgtgctcgagcccatcaagtcagtcaatcagtccatcaatcagaccgtgagccaaacaatgtctcagtctcttatcccacccagtatgaatcagcagcccttttcctctgagcttatctcctccgtaagccagcaggagaggatcccgcacgaacccgtgattaattccagcaatgtgcatgttggctcacgaggatccaagaaaaactaccagtcccaagctgacatacccatccggagtccgtttggaattgtcaaggccagttggttgccgaagttttctcatgcagatgcccaaaagatgaaaaggctgcccactcctagtatgatgaacgattattacgcagcaagcccccgtattttcccacatctatgctctctctgcaacgtagaatgttctcacctgaaagactggatccagcaccagaacacttccactcacatcgagtcctgtcgacagctgagacaacaatatccggactggaaccccgaaattttgccatccagacgcaatgagggtaaccggaaagagaatgagactccacgcagaagatctcacagcccatccccacggagatctagacggagtagttccagccacagatttaggcgctccagaagtccaatgcactacatgtacagacctaggtcaaggtctccaaggatctgtcacagattcatcagtcgctatcgaagtcgcagccgctcccgcagcccatatagaataaggaatcccttcagaggcagtcctaagtgttttcgctccgtctccccagaacgcatgtctcgtaggtcggtgaggtcgtctgacaggaaaaaggccttggaggacgtggtccaacgcagcggccatggaacggaatttaataagcagaagcatctggaggccgctgataaaggtcactcgcctgcccagaaacctaaaacaagctccggcaccaagccctccgttaaacctaccagtgctaccaaatcagactcgaatcttggtggacacagcatacgctgtaaaagtaagaatctggaggatgacactctaagcgagtgtaaacaggtcagtgataaggccgtatcgctccagcggaaactccggaaagagcagtctctacattacgggagtgtgttgctgatcaccgaactccctgaagacggatgcactgaggaagacgttaggaaactttttcagccgttcgggaaagtcaatgacgtgctgattgtgccgtaccgcaaggaagcttatcttgagatggaatttaaggaagctatcactgccatcatgaagtacatcgaaactacaccactcaccattaagggcaaatccgtcaaaatctgcgtcccagggaaaaaaaaggcccagaacaaagaagtcaagaaaaaaaccctcgaaagcaagaaagtcagtgcaagcaccctgaaaagagacgctgatgccagtaaagcagtggaaattgttacatccactagtgctgctaaaacaggccaggccaaagcatctgtggccaaagtcaataagagcactggcaagagcgcgtcctcagttaaaagcgtcgtcactgtggctgtaaaaggtaataaggcaagcatcaagactgcaaagtcgggcggtaaaaaaagtttagaagctaagaagacaggtaacgtgaaaaacaaagacagcaataagcccgttactatcccagagaattccgagataaaaactagcatcgaggtgaaagccactgagaattgtgccaaggaggccatctctgatgcagccttagaagccaccgaaaatgagcccttaaacaaagagaccgaagagatgtgtgtgatgctggtaagcaatctgccaaacaaggggtacagcgtcgaggaggtgtatgacctcgctaagccatttggtggccttaaggatatcctgattctcagtagccataagaaagcctacatcgaaataaaccgcaaggctgctgagagcatggtgaagttctacacttgttttccagtgcttatggatgggaaccagctgtctatatctatggctcctgagaatatgaacattaaagacgaggaggccatcttcatcactcttgtgaaggaaaacgatccagaggccaatatcgatactatttacgatagatttgtgcatcttgataatcttcccgaggatggcctgcaatgtgtgctgtgcgttggtctccagttcggcaaggtcgatcatcacgtcttcatctcaaaccgcaacaaagccattctgcagctggattcgccagagtccgcccagtcaatgtatagtttcttaaagcagaacccgcaaaacatcggtgaccatatgttaacgtgttcactcagccccaagatagacctgcccgaggttcagatcgagcacgatccagagctggagaaggaatcaccgggattaaagaattccccaattgacgagtcagaggtacagactgctactgactctccctccgttaagcccaacgagctagaggaggagtccacacccagtatccagacagaaaccctggtgcaacaggaagagccttgtgaagaggaggccgaaaaagctacttgcgactcagattttgccgtcgagacactggagctggaaacacagggggaggaggtcaaggaagaaatcccgctcgttgccagcgctagtgtgagcattgagcagtttactgaaaacgctgaggaatgtgccttgaatcagcagatgtttaactccgatctggaaaagaagggcgcagaaattatcaaccctaaaaccgcacttctgccctcagactccgtgttcgctgaggaacgaaaccttaaaggcatcttagaagagtctccgtctgaggcagaggattttatcagcggcatcactcaaaccatggtggaagctgtagcagaggtggagaaaaacgaaactgtgtctgaaattttgccaagtacatgcattgtgactctcgtgcccggtattcccacaggcgacgagaaaactgtcgataaaaagaacatatcagaaaagaaggggaacatggacgagaaagaggaaaaggaattcaacacaaaagaaactcgaatggacttgcagattggcaccgagaaagcagaaaagaatgaaggtagaatggacgcagaaaaggtggagaagatggccgctatgaaggaaaagcctgctgaaaatacactctttaaggcttaccccaataaaggggtgggacaggcaaacaaacccgatgagacctctaaaacctccatactggctgtttctgacgtctcttctagcaaaccctctataaaagctgttatcgtgtcctcacccaaggctaaggctaccgttagtaaaacagaaaatcaaaagtctttccctaagtccgttcccagagaccaaatcaatgccgagaaaaaactctccgccaaggagttcggccttctgaagccgaccagtgctcgatctggcctcgccgagtcatccagcaagtttaagccaactcaatccagcctgacccgtggagggagcggccgaatttccgctctgcaggggaagctctccaagctggattatagagacatcaccaagcagtcacaggaaacagaagctaggcctagtatcatgaagcgagatgattccaataacaagaccctcgctgagcaaaacactaaaaaccccaagtcaacgaccggaagaagttctaagagtaaggaggaacctttgtttccctttaaccttgatgaatttgtcactgtggatgaggttatcgaggaggtgaacccgtcccaggcgaaacagaatccactgaagggtaaacggaaagagaccctaaagaatgtacccttttccgagctcaacctgaaaaagaaaaaggggaagacgtctactccccgtggcgtggaaggggaactgtcatttgttacactggatgaaatcggcgaggaagaagacgcagccgctcatctcgcacaggccctggtgaccgtcgacgaagtgattgacgaggaagagctgaatatggaggagatggtgaaaaatagtaatagtttgttcaccctcgacgagctgatagaccaggacgattgtatcagtcattccgaacccaaagacgtcacggttctgtctgtggccgaagaacaggatttactaaaacaagaacgccttgtgacggtggatgagataggagaggtcgaagagctccccctgaatgagagcgctgacattacatttgcaaccttgaatactaaggggaacgagggcgataccgtacgcgattctataggcttcatttctagtcaggtgcctgaggacccctcaactctcgtcacagtggatgagatccaggatgactcaagtgatctgcacctggtgaccctggatgaagtcactgaggaggatgaagactcattggcagactttaataacctcaaagaagaacttaattttgtgactgtggacgaagtaggggaggaagaagacggcgataacgacttgaaagtggaactggctcagagcaaaaatgatcatcctacggacaagaagggcaatagaaagaagagagcagttgataccaagaaaaccaaactggaatcgctgtctcaggttgggcctgtgaacgaaaacgtcatggaagaggacctgaaaaccatgattgaaagacatttaactgccaagaccccgaccaaacgtgtgcggattgggaaaaccttaccttccgagaaagccgtggtgaccgagccagccaagggagaagaggccttccaaatgtccgaagtcgacgaagagagcggactgaaagatagcgagcctgaacggaagcgtaaaaagacggaagactcttcctcggggaagagcgtcgcttcagacgttcccgaggaactggactttctggtgcctaaggccggttttttttgccctatttgtagtctcttctacagtggggagaaagctatgactaatcattgtaaatcaactaggcacaaacagaacaccgagaagtttatggctaagcagcgcaaggaaaaggagcagaatgaggctgaggaacgttctagcagata

SEQ ID NO: 247737 - DNA, 3420 bp, Artificial Sequence
  Description of Artificial Sequence: Synthetic coding sequence
atgtcccgccctaggtttaatcccagaggcgacttccccttgcagcgtccacgggcacctaatccgagtggcatgaggcctcccggtcctttcatgaggccgggatccatgggactgccccgattctatcccgcaggaagggctcggggaattccccaccggtttgcaggccacgaatcataccagaacatgggtccacagagaatgaacgtccaagtgacccagcataggaccgatcccaggcttacaaaagaaaaactggacttccatgaagcacagcaaaaaaaggggaagcctcacgggtccagatgggatgacgagccgcacatctcagcttcagtggccgtaaagcagtcctccgtaacccaggtgacagagcagagccctaaagtgcagtctcgctacacaaaggagtcagcttcatctatcttggcatcatttgggctgtcaaacgaagatctggaagagttgtccagatacccagatgagcagttgacacccgaaaacatgccattgatccttcgcgatatccgtatgcgaaaaatgggtagacgactccccaacttgccttctcagagccggaacaaggagacactgggatctgaagctgtgtcttccaatgttattgattatggacacgcaagcaagtacggatacacagaggaccccctggaggtccggatttatgaccctgagattcccactgacgaggtggagaatgaatttcagtctcagcaaaacatttcagcgagtgttcccaaccccaacgttatatgtaactcgatgtttccagtcgaagacgtttttagacagatggatttcccaggcgaatcctccaacaaccggtctttcttcagcgtagagagcggcacaaaaatgtccggcctgcatattagcgggggacagagcgtgctggagccaatcaaaagcgtaaatcagtccataaaccagactgtgtcacaaactatgtctcagagcctgatccccccatccatgaatcagcaacctttttcaagcgaactaattagctctgtgtctcagcaggagcgcatcccccacgagcctgtaataaattcctctaatgtccacgtgggcagccgaggctccaagaaaaactatcagtcccaggcggacataccgatacgctcccctttcggaattgtgaaagctagctggcttcccaaattttcacacgctgacgctcaaaagatgaagcgcttgccaaccccctccatgatgaacgattactatgccgctagcccacgtatctttcctcatctctgcagcttgtgtaacgtggaatgttctcatctgaaggattggatacagcatcagaatacctccacccatattgagtcctgtcggcagctcagacaacagtaccctgactggaatccagagatcctgccaagccggaggaatgaggggaataggaaagagaacgaaacccctcgccgacgttctcactccccctctcctcgaagatcgagacggagctcctctagccaccgatttaggagatccaggtcgcctatgcattacatgtaccggccacggtcacgttccccccgaatttgccaccgctttatcagcagatatagatccagatcacgctctcgctctccgtacaggatcaggaaccctttccgcggatccccaaagtgctttaggagtgtatcaccagagaggatgagcagacggagcgtccgatcctccgatagaaagaaggctctcgaagatgtcgtgcagcggagcggccatggaaccgaatttaacaaacagaagcatctcgaggcagccgacaaaggacactctcctgctcagaaaccaaagaccagcagtggtactaagcctagtgtgaagcccactagcgcgaccaaatccgattcaaatttagggggacatagcatccgatgtaaatctaagaatctagaagatgacacactttccgagtgtaagcaggtgagtgacaaagccgtatctttacaaaggaagttacgcaaggagcaaagtttgcactatggctcagtcctcctgataacagaattgcccgaagacgggtgcacagaggaagatgttagaaagctattccagcccttcgggaaggttaacgacgttctgatcgtaccgtatcgcaaggaagcatacctggagatggagttcaaggaggccattactgccattatgaagtatatcgagacaacacctctcacaatcaaggggaaatcagtcaagatctgcgtacctggtaaaaagaaagctcaaaacaaagaggtcaagaaaaagactttggagtcaaaaaaggtgtctgcatcgacactaaaaagagatgcagatgcaagtaaggcagttgaaattgtcacttctacctccgccgctaaaaccggccaagcgaaggccagcgtcgctaaagtgaataagagtacaggaaagtcggctagttccgtgaagagtgtggtgacagttgctgtgaaaggtaataaggcctccatcaaaaccgcaaagtccggtgggaagaagtccctcgaagcaaaaaagacaggcaatgtgaaaaataaagactccaataagccagtaaccattcccgaaaatagcgagatcaagacaagtattgaggtgaaggctaccgagaactgcgccaaggaggctatcagcgacgccgcactggaggcaaccgagaatgaacccctgaacaaggaaaccgaggagatgtgcgtaatgctggtcagcaatcttccgaataaagggtacagcgtcgaggaggtgtatgacctggccaagccctttgggggactgaaagacatcttaatcttgtcatcgcacaagaaggcttacattgaaattaacagaaaagcagctgagagcatggtgaaattctatacctgttttccggtcctcatggacgggaatcaactctccatcagtatggccccagagaacatgaatattaaggacgaggaagccatattcatcactcttgttaaggagaatgatcccgaggcaaacattgatactatttatgatcgcttcgtgcaccttgataatctacccgaagatggcctccagtgtgtactatgtgttggcctccagtttggcaaggtcgaccatcacgtattcatatccaatcggaataaagccatcctgcagctggattcaccagagtctgcccagtctatgtattccttcctgaagcagaacccccagaacataggagatcacatgcttacctgttccctgtcacccaaaatagatcttcccgaagtccagattgagcacgatccagagctcgagaaagaacgtttgtggctgtcgaagacccttagaattcttaaggcactattggtagaagtgcctaacttgaaacgctctcattacttccacctgatctggatgaatctgctcttatggatgagactctag

SEQ ID NO: 247738 - DNA, 2445 bp, Artificial Sequence
  Description of Artificial Sequence: Synthetic coding sequence
atgagtcgacctagatttaaccctagaggagactttccgctgcagaggccacgcgctcctaacccaagcggcatgcggcctcctggaccgttcatgaggccaggcagtatgggactgccacgattttacccagccggacgggctaggggcataccacataggtttgcgggacatgagtcttatcagaatatgggccctcaacggatgaatgtgcaggttacacagcacaggactgatccgcgtctgactaaagaaaagctggacttccatgaagctcagcagaagaaaggcaaacctcacggtagtcggtgggacgatgagcctcacatctcagcatctgtggctgtcaaacagtcatcagttacacaggtcaccgaacagagtcccaaagttcagtcacggtacactaaagagagtgcctctagcattctggccagtttcgggctgtcgaacgaagacttggaggagctgtcacggtaccctgacgaacagcttacgcctgaaaatatgcctctcatacttcgagacatccgaatgcgaaaaatgggtaggaggcttccaaatctgccatctcagagcaggaacaaagaaactcttggctccgaggcggtttctagcaacgtcatagattacggtcacgcaagcaagtacgggtacacagaggatcccttagaagtccggatttatgacccggaaattcctaccgatgaggtcgagaatgagtttcagtcccagcagaacatatccgcctctgttcctaatccgaacgtcatctgcaactcaatgttcccagtggaagacgtctttaggcaaatggacttccccggagaaagttccaacaatcggtctttctttagtgtagagtccggcactaagatgagcggcttgcatatatccggtggacagtctgtgttggagcccattaaatcagtcaaccagagtataaatcaaacagtatctcaaacgatgtcgcagagcctcatccctccttccatgaatcagcagcctttctccagcgaactgataagcagtgtgagccagcaagagagaataccacatgaacccgttattaatagctcgaacgtgcatgtaggcagccgcggatctaaaaaaaactaccagtcccaggccgacataccaatcagaagtccctttggcatagtgaaggcatcctggctcccaaagttttcgcacgccgatgctcagaaaatgaagcgcttgcctacaccatccatgatgaatgactactatgcggcatcgccccgtatcttccctcacctatgttctctctgcaacgttgaatgttcccacttaaaggattggatccaacatcagaacacctcgacgcacattgagtcttgcaggcagctgagacaacagtatcctgactggaatccagagatcttgccaagcagacgtaatgaaggtaatagaaaagagaatgagacaccccgacggaggtctcattccccttccccgagacgatccaggcgcagcagctccagccatcgattccggaggtcgcgctctcccatgcattatatgtatcgccctagatcacggtcccctcggatctgccaccggtttatcagcagatatagaagtcgctcccggagccgcagcccgtataggatcagaaatccttttcgcggatcaccgaagtgtttcaggtcagttagtccagagaggatgtcccgacgcagtgtgagatcatcggataggaaaaaggccttggaggacgtagtccagaggtctggccacggaacagagtttaataagcaaaaacacctcgaggctgccgataagggtcactcaccggcacagaaacccaaaaccagctctggtaccaaaccttctgtcaagccaactagcgcaacaaagagcgattccaatctggggggtcactctatccgctgtaagagtaagaacctggaagacgacaccctgtctgagtgtaaacaagtgtctgataaagctgtttccctgcagaggaagctgcgaaaagagcagtctctccattacggatccgtgctcctcatcactgaactgcccgaggacgggtgtacggaagaagacgtgcgaaaactgttccaaccttttggtaaggtgaacgacgtcctaatcgtcccctatcgcaaggaagcttacctagaaatggagttcaaagaagccatcactgcgattatgaaatatatagagactacccctctgacaattaaaggcaaaagcgtgaagatatgcgttccaggcaagaagaaagcacaaaacaaggaggtgaaaaagaagacattggagtcgaagaaagtgtcggctagcaccctcaagagagatgctgacgcaagcaaagctgtggagattgtcacatctacctctgccggtctgcttccaaccgggggaggcaacaactacccccagattgtcctagctcctggtctgtgtcattag

SEQ ID NO: 247739 - DNA, 2643 bp, Artificial Sequence
  Description of Artificial Sequence: Synthetic coding sequence
atgccgagagatggtgtcccagccggaaacacaaccccagccgcagcccaagctgcagctcagtcccccgatagcgctaccgccggtgcacctcaagtcctggactctctcaaaaggtaccccgactggaaccccgagattctgcctagtcggaggaatgaggggaatcgtaaggagaatgaaacgccccgaaggagaagccattcccctagtcccaggcgctcacggagatcctcgagctctcatagatttcgcaggagcaggagtcctatgcactatatgtatagaccgcgaagcaggagcccaagaatttgtcacagatttatctcgcggtaccgcagtagatcccggagtcgatccccctacaggatccgtaatccgtttagaggctccccaaagtgcttccgctccgtctctccggagcggatgtctcgccgatctgtgcgcagctcagatcgaaaaaaggcactcgaagatgtcgtgcagcgctctggccatggcacagagttcaataaacagaagcatctggaggctgccgacaaagggcacagtcccgctcagaaaccaaaaacctccagcgggacgaaaccaagcgtcaagcctacgagtgccaccaaatctgactctaatctcgggggacacagcatcagatgcaagagtaagaatctggaggacgataccctgagtgagtgtaaacaggtctccgacaaggccgtctctcttcagagaaagttgagaaaggaacagtctttgcactatggatctgtgctgctgattaccgaactgcctgaggatggttgtactgaggaagatgtgaggaaactgtttcagccttttgggaaggttaacgatgtgctaattgtcccctaccgcaaggaagcctacctggagatggaatttaaggaagccatcaccgcaatcatgaaatacatcgagaccacacctcttacaattaagggcaagagcgtcaagatctgcgtgccaggaaaaaagaaagctcaaaacaaggaagtcaagaaaaagactctcgagtcaaaaaaggtgtctgccagtaccctaaaacgtgacgctgatgcttctaaggccgtagagatagtcacaagcacctcagctgccaagactggacaggcaaaagccagcgtcgccaaggtgaataaaagcacaggaaagagtgcctcttccgtcaagtcagtggtaactgtcgctgtgaagggaaacaaggcatcaatcaaaaccgcgaagtcaggaggcaaaaaaagcttggaagccaagaagactggcaatgtgaaaaacaaagattctaataagcccgtgaccattccagagaattcagagataaagacgtcaattgaggtcaaagccacagaaaattgcgcaaaggaggcaatttctgacgcagctctggaggccaccgagaatgaacccctgaataaggagacggaggagatgtgcgtgatgctcgtgtcaaatcttcctaacaaaggatattccgtggaggaggtctatgatctcgctaaacccttcggcggactaaaagatatcctgattttgtccagccacaaaaaagcgtatatcgaaatcaaccgcaaggccgcagaaagtatggtgaaattctacacttgttttcctgtgttaatggatggaaaccagctgtctatcagtatggctccagagaatatgaacataaaggatgaggaggccatttttataacacttgtaaaggaaaatgatccagaggcaaatatcgatacaatttacgacaggttcgtgcaccttgacaacttgccagaagacgggctgcagtgtgtcttgtgcgtgggcctccagttcggcaaagtagatcatcacgttttcatttctaaccggaataaagctatcctgcagcttgactccccggaaagtgctcagtcgatgtattcgtttctcaagcaaaaccctcagaatataggagaccacatgttgacatgctcgcttagccccaaaatcgacttacctgaggtccagattgaacatgatccagagctggagaaggaatccccaggactgaaaaatagccctatcgacgagtcggaagtgcaaacagcaactgactcaccatctgtaaagcccaatgaactcgaagaagaatccacaccaagtatacagactgagactctggtgcaacaggaagagccgtgcgaagaggaggctgaaaaagccacgtgtgattccgattttgccgtggaaaccttagagttagaaactcaaggagaggaagtgaaggaagagatcccactggtcgcgtccgcctcagtgtccatcgagcagtttactgagaatgctgaggaatgtgctctcaaccagcaaatgttcaattccgatcttgagaaaaagggggctgaaattatcaacccaaaaaccgccctccttccaagtgacagcgtttttgctgaggaaagaaaccttaaaggcattctggaagagtccccttctgaggcggaagactttatcagtggcattacccaaacaatggtagaggcagtggcagaagtggaaaagaacgagactgtgtccgagattctaccctcaacctgcattgtgaccctcgtaccgggaattcctaccggggatgagaagaccgtggataaaaaaaatatcagctag

SEQ ID NO: 247740 - DNA, 2757 bp, Artificial Sequence
  Description of Artificial Sequence: Synthetic coding sequence
atggattcccctccattgaaggctcttaactctaatagcatctatttcttactgttgttccactgcatgctcatctccgaggtacagatcgagcatgaccctgagctggaaaaagagagtcctggccttaaaaactctcccatcgatgaatctgaggttcagaccgccaccgatagtccttcagtcaagcctaacgaactcgaggaggagagtactcccagtatccagactgaaaccctcgttcagcaggaagaaccatgcgaggaagaggccgagaaagccacttgcgactctgacttcgctgtggagaccctggagctggagacacaaggcgaggaggtgaaagaagagattcctctggttgcctcagcttctgtgtccattgagcagttcacagaaaatgctgaagagtgtgctctgaaccagcagatgttcaactctgatctggagaaaaagggagcggaaataatcaatccaaagaccgcactattgccttcagactctgtgtttgcagaagagaggaatctgaaggggatcttagaagagagtccaagcgaggcagaggatttcattagcggaattacacaaaccatggtggaggcggttgccgaagtggagaaaaacgagaccgtgtcggagattctgccttccacttgcattgtgacacttgtccccggaatcccaactggcgacgagaaaacagttgacaagaaaaatatcagcgagaaaaaaggaaatatggacgaaaaagaagagaaagaattcaatactaaggagacgcggatggatcttcagatcgggaccgagaaagcggaaaagaacgaaggacgcatggatgccgagaaggtggagaagatggcagccatgaaagagaaaccagcggagaatacactgttcaaggcttacccgaataaaggtgtgggccaggccaacaaacccgatgagacgagcaaaacctctatcttagcagtgagtgatgtgagtagctcaaaaccgtccatcaaggccgtgatagtctcctcaccaaaagctaaggccaccgtgagcaagacagaaaatcagaagagcttccccaagtcagtgcctagagatcagataaacgctgagaagaagctctccgctaaggagtttggactcctcaagcccacaagcgctcggtccggcctcgcagagtcgagttcaaagtttaaacccactcagagttcacttacacgcggaggttctgggagaatcagcgctcttcaggggaaactgtcaaagttggattaccgcgatattactaagcagtcgcaagagactgaggccagaccctccattatgaaaagggacgatagcaacaacaaaacactagctgaacagaacacgaagaatcccaaatcgactaccggtaggtcctcaaaaagcaaggaagaacctctgtttcccttcaatctggatgagtttgttactgtcgacgaggtgatcgaggaagtcaacccttcacaggccaagcaaaacccccttaagggcaagagaaaggagaccttaaagaatgttcccttctctgagttgaatctaaagaaaaaaaaaggcaaaacgagcacccccaggggagtcgaaggggagctgtcgttcgttacacttgatgagatcggcgaagaggaagatgctgcagcacaccttgcccaagccttagtgacagttgatgaagtgatcgacgaggaggaattgaacatggaagaaatggtaaaaaattcaaattctttgtttactctcgatgaattaattgaccaggacgactgcatatctcatagcgaacctaaggacgtgacggttctcagtgtcgcagaggagcaggatctacttaagcaggagaggttagtaactgtggacgagattggagaagttgaggagttgcctttgaatgagagcgcagatatcacgtttgcaaccctgaacaccaaggggaacgaaggggacacggtcagggattctatcggctttatctcttctcaggtgcccgaggatccctcgactctggtgaccgtggacgaaatccaagacgactcatccgatctgcacctcgtgacgctcgacgaggtgactgaagaggacgaggactccctcgctgacttcaataatctgaaagaggagctgaattttgtgacggtcgatgaagttggtgaggaggaggacggcgataacgatttaaaagtcgaattggcccagtctaaaaatgaccatccaactgataaaaaagggaatcgcaaaaaaagagctgtggataccaaaaaaaccaaacttgagagtttgagtcaggtaggtcccgtgaatgagaatgtgatggaggaggatttaaagacgatgattgagagacatttgactgcaaagacccccactaaacgggtaaggatcggcaaaaccttgccttcggaaaaggccgtagtcaccgagccagccaagggcgaagaagctttccagatgagcgaagttgatgaggagtctggactcaaagacagtgaacccgagcggaaaaggaaaaagactgaagattcgagcagcgggaagagtgtggcaagcgatgtgccggaagaacttgattttttagtccctaaagcgggatttttctgcccgatttgttccttgttttactctggtgaaaaggctatgactaaccattgcaagtccacacgacacaaacaaaacacagagaagttcatggccaaacagcgaaaagaaaaagagcagaacgaagccgaagagcgctccagccggtag

SEQ ID NO: 247741 - DNA, 5936 bp, Artificial Sequence
  Description of Artificial Sequence: Synthetic coding sequence
atgtctcgacctcggttcaatccaaggggtgactttcccctgcagagacctagggcccctaacccgtcagggatgaggccgccagggccatttatgcgcccaggatcaatggggctgcctcgtttctaccctgccggaagagctagagggatcccacatcggtttgctggtcatgaaagctaccagaatatggggccacaacgcatgaatgttcaggtgacacagcacaggaccgaccctagactgacaaaggagaagttggatttccacgaagctcagcagaagaagggaaagcctcatggctcccggtgggacgacgaaccccacatttccgctagtgtagctgtcaagcagagctcggtgacacaggtgactgagcagtcgcccaaggtccagtcccgctacaccaaagagtcagcgtccagtattttagcctctttcggcctgagtaacgaggatctagaggagctgtcccgctaccctgatgagcagctgactcccgaaaacatgcccctgattttgagggatatccgcatgaggaagatggggcgtagactgcccaacctgccatcgcagagtcgcaataaagaaacgctggggtcagaggccgtttccagcaatgtcattgattatgggcatgcgtctaaatacgggtatacagaggaccctcttgaggtccgcatttacgatcctgagatccctacagacgaagttgagaacgagtttcagtcacagcagaacatttctgcctctgtgccaaaccctaatgtgatctgcaatagtatgtttcctgttgaggatgtcttccgtcagatggacttccctggggagagttcgaacaatcggtctttcttctcagttgaatcagggaccaagatgtctggacttcacatctcaggcggacagtccgtgctcgaacctataaaaagtgtgaatcagtctatcaaccagacagtgagccagaccatgtcccagtctctcattcccccaagcatgaaccagcagcctttcagctctgaactgattagtagcgtctctcagcaggagagaataccgcacgaaccagttattaattcatctaacgttcacgttggcagtcggggaagcaagaagaactaccagtcccaggccgacataccaattcggtcaccattcggtattgtgaaagcgtcctggctccctaagttctctcacgccgatgcccagaaaatgaagagactgcctacgccatccatgatgaacgattattacgccgcttccccccgtatcttcccccatttgtgctctttgtgcaacgtcgagtgcagccacctcaaggactggatccagcaccaaaatacctccacgcacatcgaaagctgccgccaacttagacagcagtacccagactggaaccctgagattttgccctccagacggaacgagggaaatcggaaagagaatgagacacccagaaggcgttcgcactcccccagccctaggcgaagccgcaggtcctcgagtagtcaccggtttcggaggtcacggtcccctatgcattacatgtatcgtcctaggtcccggtcaccaagaatctgccacagattcatatctcggtaccggtctcggtcccggtctcggtccccctaccgcatcaggaatccgttcagaggctcgccaaaatgtttccgctctgtctcccctgagagaatgagccgtcgtagtgtgaggagcagcgatagaaagaaagcccttgaggatgtagttcagcggagcgggcacggcaccgaatttaacaagcaaaagcatctcgaggctgcagacaaggggcactctccggcacagaaaccgaagaccagcagcggaacgaaaccatccgtgaagccgacttctgctaccaaaagtgattccaatctggggggacactcaatacgctgcaagagcaaaaatttggaagatgacactctgtccgaatgtaagcaggtctcagataaagctgtgagtctgcagcgcaaactgagaaaggagcagtctcttcactacggcagcgttcttctcatcacggagcttccagaggacggatgtacagaagaagacgtccgcaagctctttcagccattcggcaaagtcaacgacgtgcttatcgttccctaccgcaaagaggcttacctggagatggagtttaaagaagccattactgctattatgaaatatatcgagacaactccgctcactatcaaggggaagagtgtgaaaatctgcgtgcccggaaagaaaaaggctcagaacaaggaagtcaagaagaaaaccctggaaagcaaaaaggtgagtgcctctacattaaagcgggacgctgatgcgtcaaaggcagtagaaatagttaccagtacgtctgcagcaaaaaccggacaagcgaaagcgtccgtggcaaaagttaacaagtctaccggcaaatccgcttcgtcggtcaaatcggttgtaactgtcgccgtgaaaggcaataaagcatccattaagactgcgaaatctggaggcaaaaaatctctcgaagccaaaaaaaccgggaacgtaaaaaataaagattccaataagcctgttaccatccccgagaactcggagatcaagacttctattgaggtgaaggccactgagaattgcgcgaaggaagctatcagcgatgccgctctggaagcaactgaaaatgaaccactgaacaaggagaccgaggaaatgtgtgtcatgttggtcagcaacctcccaaataaggggtacagcgtggaggaagtgtacgatctggcaaaaccgttcgggggattgaaggatattttaatcctcagcagccacaagaaagcctacatcgagattaataggaaggcagccgagagcatggttaagttttatacatgtttccccgttttaatggacggcaatcagctgagcatctctatggcacctgagaacatgaatattaaggatgaggaagcgatattcatcaccctggtgaaggaaaatgacccagaggctaatatcgacaccatttatgacagatttgtgcatctggataacctgcctgaagatggcctgcagtgcgtcctgtgtgtcggcctgcaatttgggaaggtggatcaccacgtattcatttccaatagaaataaggctatccttcagcttgactcacccgaatcagcacagtcaatgtactcatttctgaaacagaatccgcaaaacatcggggaccatatgctgacttgctccttgtcccctaaaatcgatctgcccgaagtgcagattgaacatgatccagaactggagaaggagtcccccggattgaaaaattcacccatcgatgagtctgaggtgcagaccgctaccgattctccctcggtcaagccaaatgaactggaggaggaatctacccctagtattcaaacagagactctcgtccaacaggaagagccatgcgaggaggaagccgagaaagcaacctgcgatagcgacttcgctgtcgagaccctggagctggaaacacagggagaggaggtcaaagaggagattcctctcgttgccagcgcatccgtgagcatcgagcagttcactgaaaacgccgaggaatgtgccttaaaccagcagatgttcaattccgacctggaaaaaaagggggctgagatcatcaaccctaagaccgcgctgctgccaagtgattctgtcttcgccgaagagcggaacctcaaaggtattttggaagagagcccctctgaagcggaagacttcatcagtggaattacccaaacgatggtcgaggccgtcgctgaggtggagaagaatgagaccgttagcgagatcttgccatccacttgtatcgtcaccttggtgcctggaatccctacaggagacgagaaaactgtggataagaagaacatcagtgagaaaaaggggaatatggatgagaaggaagagaaggaatttaacaccaaagagactcgaatggacttgcagattgggactgaaaaggctgaaaaaaatgagggaagaatggatgcagaaaaggttgaaaagatggccgctatgaaagagaagccagccgagaatacactcttcaaagcttaccccaacaaaggggtgggacaagcaaataaacccgacgagacctccaagacaagtatcctcgccgtaagtgacgtgagcagcagcaagcccagtataaaagccgtcattgtgtccagcccaaaggcgaaggcaaccgtaagcaaaactgagaaccagaaatccttcccaaaatccgtgcccagagatcagatcaacgctgaaaagaagctcagtgccaaggaattcggcttactcaagccgacttcggctcggtccggattggcagagtcgtcatctaaattcaagcccacccagtcgtctttaaccaggggcggttccggacgcatctctgcattgcaggggaaactgagtaagctggattacagagatatcacaaagcagtcccaggaaactgaggcaagaccctcaatcatgaagcgcgatgacagcaataataagacccttgctgagcagaacacaaaaaatcctaagagcaccactgggaggtcgtctaaaagcaaagaagaacccttgttccctttcaacttggatgagtttgtcaccgtcgatgaggtcatcgaggaagtgaacccatcccaggcaaaacagaaccctctcaaaggcaaacggaaagagacacttaagaacgtgccctttagcgagctgaacctgaaaaaaaagaagggtaaaacctccacacccagaggagttgagggcgaactgagcttcgtgacacttgacgagatcggcgaagaggaggacgcggcagctcacctggcccaggccttggtgactgttgatgaggtgatagatgaagaggagctgaacatggaggagatggttaagaactctaattctctgttcacgctggacgagcttattgatcaggatgactgcattagccatagtgaaccgaaggatgtgaccgtactcagcgtcgcggaggaacaggacctgttgaaacaagaacgcctcgttacggtcgacgagattggagaggtcgaagagttaccgctcaacgaaagcgccgatataaccttcgccaccctaaatactaagggcaatgaaggggacaccgttcgggacagcattggattcattagtagccaggtccccgaggacccatcaacgctcgtgaccgtggacgagattcaggatgatagttccgatctgcacctcgtcacactggacgaggtaacagaggaggacgaggactctctggctgatttcaacaatcttaaggaggagttaaattttgtgaccgtggatgaagtgggagaggaagaagacggcgataacgatttgaaggtggagctggcccagtctaaaaacgatcatccaaccgataaaaaggggaatcgcaaaaaacgggcagtggataccaaaaaaacaaaactagaatcgctaagtcaggtgggcccagtgaacgagaatgtgatggaggaagacctcaaaaccatgatcgaacgacatctaaccgctaaaaccccaactaaaagagttagaataggtaaaaccttgccatctgagaaggctgtcgtgactgaacctgctaagggcgaagaggcatttcagatgagtgaagtcgacgaggagtcgggactcaaggattcagagcctgagaggaaacgcaaaaaaaccgaagacagctcatcaggcaagagcgttgccagtgatgtacccgaagaactggactttctcgtgcccaaagccggtttcttctgcccaatttgtagtctattctactctggggagaaggcaatgactaaccactgcaagagtacaaggcacaagcagaatactgaaaaattcatggctaaacagcgcaaggaaaaagagcagaacgaggctgaagaacgctcttcccgata

SEQ ID NO: 247742 - DNA, 90 bp, Artificial Sequence
  Description of Artificial Sequence: Synthetic coding sequence
atgagtaggccaagattcaatcccaggggagactttcccctccagaggccacgggcacctaatcccagcggaatgcgtccacccggttag

SEQ ID NO: 247743 - DNA, 594 bp, Artificial Sequence
  Description of Artificial Sequence: Synthetic coding sequence
atgtcccggccaaggttcaatccgcgtggcgatttccctctccaaagacctagggctcccaacccaagcggaatgcggccacccggacccttcatgagaccgggatctatgggtttgcctcggttttatcccgcaggtcgagctcgcggaattccacaccgttttgccggacacgagtcctaccagaacatgggaccacagcgaatgaacgtccaagtcacccagcaccggacagatccacggctcacaaaagagaaactagactttcacgaggcccagcaaaagaaaggtaagcctcatggctcaagatgggacgatgagcctcacatatctgcatctgtggccgtgaaacaaagttccgttacccaggtcaccgaacagagtcctaaggtgcagtcccgatacaccaaggagtctgcctcctcaattcttgcgagcttcggcctttcaaacgaggacctggaagagctgagccgttacccagacgaacagttgactccagagaacatgcccctaattctgcgagatatccgtatgaggaagatgggcagacgattaccaaacctgccaagccagtcccgcaataaggagtag

SEQ ID NO: 247744 - DNA, 111 bp, Artificial Sequence
  Description of Artificial Sequence: Synthetic coding sequence
atgtcacgccctcggttcaatcctaggggagattttcctcttcagcgacctcgagcacctaacccatcgggtatgcgaccgcctggaccatttatgcgtcccggttcttag

SEQ ID NO: 247745 - DNA, 189 bp, Artificial Sequence
  Description of Artificial Sequence: Synthetic coding sequence
atgagcagaccaaggttcaatccccgtggagactttccgctccaaagacccagggcccctaacccgagcgggatgcgacccccagggccttttatgcgaccgggttcaatgggtctgccacggttttatcctgccggacgcgcacgtggcattccccatagatttgcgggacacgaaagctaccagtag

SEQ ID NO: 247746 - DNA, 189 bp, Artificial Sequence
  Description of Artificial Sequence: Synthetic coding sequence
atgtccagaccgcgtttcaacccgaggggggattttcccctccaaagacccagggctccgaatccgtcaggcatgagaccacccggaccctttatgcgtcctggatctatgggactgcccagattttatcccgctgggcgtgcaaggggaatcccccatcggttcgcaggccatgaatcttaccagtag

SEQ ID NO: 247747 - DNA, 1758 bp, Artificial Sequence
  Description of Artificial Sequence: Synthetic coding sequence
atggatagcccacctctgaaagcactcaatagcaacagtatttactttctgctgctgtttcattgtatgctgatcagtgaagtgcagatagaacatgatcctgagctcgaaaaagaatccccaggtctaaagaatagtcccatcgacgagtctgaagtgcaaactgctaccgattctcctagtgttaagcctaatgagttagaggaggagagcaccccctctatacagaccgagacactggtacagcaggaggaaccttgtgaggaggaagctgagaaggccacatgcgactccgatttcgccgtggaaactctggagctagaaacacagggcgaagaggtcaaagaggaaattccgttggtggcaagtgcttctgtgtcaatcgagcagtttacggagaacgccgaggagtgcgcgctaaatcaacagatgtttaattccgatcttgagaaaaagggcgcagaaatcattaacccaaaaacagctctgttgcccagtgattccgtgtttgccgaagagcggaacctgaaaggtatcctggaagagagtccatccgaggccgaagattttatcagcggcattacccaaaccatggtagaggctgtggcagaggttgaaaaaaatgaaaccgtgtccgaaatcctgccttcgacatgtatcgtgaccctggtgccagggatccctaccggagacgagaagaccgtcgacaagaaaaacatctcagagaagaagggcaatatggacgaaaaggaagagaaggaattcaatactaaagagacaagaatggacctgcagataggtaccgagaaagcggagaagaacgagggtaggatggacgcagaaaaagttgaaaaaatggccgcaatgaaagaaaaaccagcagagaacactttgtttaaggcctatcctaacaagggagtgggccaggcaaataaacccgacgagaccagtaagacatccatactggccgtgtctgacgtgagttctagcaaaccgtcgattaaagcagttatagtttctagcccaaaagcaaaggccaccgttagcaaaacggagaaccagaaatcctttccaaaatcagttccgagagatcaaatcaacgcagagaaaaagctgtctgctaaagagttcggcctgctgaagcctaccagcgccagatcgggcctggctgaaagctcctcaaaatttaaacccacccagtcaagcttgactaggggcggatctggtagaatctccgctctgcagggcaagctgtccaaattagactatagggatatcacaaaacagagtcaggagacagaggcgagacccagcattatgaagcgtgatgatagcaacaataaaactctggcggagcagaacactaagaaccctaagagcaccactggccgatcttctaaatcaaaggaggaacccctctttcccttcaacctggacgagttcgtgactgtagacgaggttattgaagaggtgaatcctagccaggccaagcaaaaccccttgaaagggaaacgaaaagagaccctgaaaaatgtgcccttcagtgagctgaacttgaaaaagaagaaaggtaaaacatccaccccaagaggggttgaaggtgagctctcattcgtcacacttgacgagattggggaggaagaggacgctgccgcacacctcgcccaggctcttgttactgtcgacgaagtgattgatgaagaggaactcaatatggaagagatggtcaaatttaaatttacgttctatatcagatag

SEQ ID NO: 247748 - DNA, 3075 bp, Artificial Sequence
  Description of Artificial Sequence: Synthetic coding sequence
atgcctagggatggggttccggcaggtaacactacacccgctgcagcccaggccgcagcacaaagtcctgactctgccaccgcaggggctccacaggttctggatagcctcaaacgctttgtgctttttctcgagaacttcgcccctttggtgaatagcttgaaccttggaatcgcgaacccccttctcctaggaccttcacccttgcattttgcgcagataaagacccagttggccctgcagcaactgaacgctgttgcctcgcacgggagcacgcccccatacacgttactgaaccaagcctttttaaaaatagccatgagtcgtcctcgcttcaatccaagaggggacttccccttgcagcggcctcgtgccccaaacccgtccggaatgcggccacccggaccctttatgaggccaggaagtatggggctccccaggttttacccagccggacgggctcgcggaatcccacatcggtttgccggtcacgaaagctatcagaacatgggccctcagagaatgaatgtacaggttactcaacaccgaaccgacccaagactcactaaggagaaacttgacttccatgaggcccagcaaaaaaaagggaagccgcatgggagccggtgggatgatgaacctcacatctctgcttccgttgccgttaagcaatcttccgtcacacaggtgacagagcagtctcccaaggtgcagtcacgctataccaaggaaagcgctagctccatcctggcctccttcgggctgtctaatgaagatctcgaggaacttagcaggtatccggatgagcaattgacaccagagaacatgcctttaattcttcgggatattagaatgcggaaaatgggtagacgcttgccaaatttaccctcacagagtcgcaataaggagaccctcgggtctgaagccgtcagctctaacgtgatcgattacggccatgcgtctaagtacggatacactgaagaccctctcgaagtgcgtatctatgatccagagatcccgactgatgaggttgagaatgaattccagagtcagcagaatatttcagcttcagtgccgaacccgaatgtgatttgcaattctatgtttcctgttgaggacgtctttcgacaaatggactttcctggggagagttcaaataaccgctctttcttttccgtggagtctgggaccaagatgtctgggttgcatatttctgggggacagagcgtcctggagcctattaagagtgtcaatcagtccatcaatcagacagtttcacagacaatgagccagagtctgatccctccttctatgaaccagcaaccattctcttctgaactaatttccagcgtaagtcagcaagagcgcatcccacatgaaccagtgatcaattcgtccaacgtccatgtcggatctcgtggaagcaaaaaaaactaccaatcacaggctgatattcccatcagatctccatttggaatcgtaaaggcctcttggttgccaaagttttcacacgccgatgcgcagaagatgaagagactgccaactccctctatgatgaacgactattacgccgctagcccgcgtatcttcccccacttatgtagcctgtgcaacgtggagtgctcacacctgaaagactggatccagcatcagaatacaagtactcacatcgaatcatgcagacagctcaggcagcagtacccggattggaatccagaaatcctacctagccgtagaaatgagggcaatcgaaaagaaaacgaaacaccacgcagacgaagccactccccctcccctaggcgctcccgaagatccagtagcagtcatcgtttccgccgtagtcggagtcctatgcactatatgtacaggcctcgctccagaagcccacggatttgccacaggttcattagcaggtacagaagccgcagtcggagtcggtccccgtaccgaatccgtaatcccttccgaggcagccccaagtgctttcggtccgtgtccccggagaggatgtctcgtaggtccgtacgatcctccgacagaaaaaaagctctcgaggacgtcgtgcagcggagtgggcacggaacagaattcaacaagcagaagcacctggaagccgctgataaaggacacagcccagcacagaagcccaagacctctagtggcaccaagccatccgtgaaacctacctcagcaacaaagtcagacagtaacctcgggggtcacagtataagatgtaagtctaagaacctcgaagacgacaccctgagtgaatgcaaacaggtcagcgacaaggcggtctctctgcaaaggaaactccgaaaagaacagtccctccactatggcagcgtcttgctgattaccgagctccccgaggatggttgtacagaggaagatgtgcgaaaactattccagccctttggcaaggtaaacgatgtgctgattgtcccttaccgaaaggaggcttatcttgagatggaatttaaggaggcaattactgctatcatgaagtacatcgaaactaccccactaactattaaagggaagagcgtcaaaatttgtgtgcctggcaagaaaaaggcgcagaataaggaggtcaagaagaagactttagaaagcaaaaaagtctctgcttccactctcaagagggacgccgacgcctctaaagccgtggagatcgtcacatctacctccgcggagagtgtggaccagacacagcagctggttcccctcgtaaggaatactgctagggaccacgatggcactccagagaacgagggtgaggagaccgttcaatctgccctcttcggattccagtatgacgcttccgatcatactatggcttggttagggcctaacactgtgccggaagtgaaggagatgatactgcaggatccccaactccagaccacgcaactacctcaaaccacacaggcgccagatatcacatggggcatgttgaagaaaacaacctacaaagccgaacaaatactattacaaactcagaagccatttaccccagataatcttttccttgctctcctaagtggcgatgctaagcctgagtacgaacaatag

SEQ ID NO: 247749 - DNA, 1317 bp, Artificial Sequence
  Description of Artificial Sequence: Synthetic coding sequence
atgcaagctgaggatagatcccaattcggctccgccgcagaaatgttgagtgaacagacggccgcattggggactggctgggaaagtatgaacgtacagctcgacggcgctgagccccaggtggaaaggggatcccaggaggaaaggccttggcgcaccgttccaggcccacttgaacatctgtgctgcgatctagaggaagaaccacagtcgctgcaggaaaaggcccagtcagctccatgggtccccgcaattcctcaggaagggaacaccggggattgggagatggccgcagcgctcctggcagcgggttcacaaggtttagtcaccattaaagatgtgtccctgtgtttctctcaggaggaatggagatccctcgacccaagccaaaccgatttttacggtgagtacgtgatgcaggagaactgcggtattgtggtcagcctgcggttccctatacccaagctcgacatgcttagccaattagaaggcggagaggagcagtgggtgccagacccacaagacttggaagagcgggatattctgagggtgacctacacaggagatggtagcgaacacgaaggcgacacaccggagctggaggctgaaccccctcgcatgctctcgagcgttagcgaagacaccgtgctttggaaccctgagcatgatgagtcgtgggattcaatgccatcatccagtcgcggtatgttgctagggcctcccttcttacaagaggattctttttctaatttgctgtgctccaccgaaatggactccctcttaagacctcatacctgtccacagtgtgggaaacagttcgtatgggggtcccacctcgccagacaccagcagacccatacaggagagcggccatactcatgcctcaagtgcgagaagacttttgggaggcgacaccatttgatcaggcaccagaagactcacctgcatgataagacctcacgctgcagcgaatgcgggaagaatttcaggtgtaattcccacctggctagccaccagagagtccacgcggaagggaagagctgcaaaggccaggaggtaggggagtctcctgggacacgtaaaaggcagcgagctcccccagtgccgaagtgccatgtttgtacagagtgcggtaagtcattcggtcggaggcatcacctggtgcgccattggctgacccacaccggggaaaaaccatttcaatgcccacgctgtgagaagtcttttggacgcaaacaccacctggatcggcacctactcactcaccagggacaatctcccaggaactcatgggaccgcggtacctctgtcttctag

SEQ ID NO: 247750 - DNA, 1248 bp, Artificial Sequence
  Description of Artificial Sequence: Synthetic coding sequence
atgctcagcgagcaaactgccgcactcggcacaggctgggaaagcatgaacgtacaactcgatggtgcggagccccaggtggaacgtggctcccaggaggaaaggccttggagaacggtgccaggcccactagagcacctttgttgcgatcttgaggaggaacctcagtccctgcaagaaaaggcacaaagtgccccttgggttcctgcaattcctcaagagggcaataccggcgactgggagatggctgccgcattactggccgctggcagccaggtgtcatcagcctcgctgggagtgtcatgcggaccgatcactgccgcatttgtgctgctgtcccatcagcccatcgacgaactggcacacatgattattaacggtttcccgattcctaagcttgacatgctcagtcagctggaaggaggcgaagagcagtgggtgcctgacccacaggacctcgaggagagggatattctgcgcgtcacttacaccggggacggtagtgagcatgaaggcgataccccggaattagaggctgagcccccacggatgctgtcaagcgtatccgaggataccgttctttggaatcctgagcacgatgaatcctgggactccatgccgtcgagctcaagaggcatgctgctcggtcctccattcttgcaggaggacagcttttccaacctgctgtgctctacagaaatggacagcctgcttaggccacacacctgtccccagtgcggcaagcaatttgtatggggaagtcatttggccagacatcaacagacccacacaggcgagcgcccttactcctgcttaaaatgtgaaaagacatttgggaggagacatcatttgatcaggcaccagaagacacatctccatgacaagactagcaggtgttcagagtgcggaaagaattttcggtgtaacagccacttggccagtcatcagcgggttcacgccgaagggaagagctgtaagggtcaggaagtgggggaaagccctggaactagaaagcgacagcgcgcaccaccggtaccaaaatgtcacgtgtgcacagagtgtggtaaatcctttggaaggcgccaccatttagtgaggcactggttaacacataccggcgagaagcctttccagtgccctcgttgtgaaaagagtttcggcaggaagcaccacctggatcgccacctcctgactcaccaaggccagtcgcccagaaattcatgggatcggggtacgtctgtgttttag

SEQ ID NO: 247751 - DNA, 1317 bp, Artificial Sequence
  Description of Artificial Sequence: Synthetic coding sequence
atgcaggcagaagatcggagccagttcggctctgctgcagaaatgctatcggagcagaccgctgcgctgggcactgggtgggagagcatgaacgtccagctcgatggcgcagagccccaggtcgagagaggcagccaggaggaacggccttggcgcaccgtgcctggccctctggaacacctttgttgtgatctggaggaggaaccccaatcgctccaggagaaagctcagtcagccccatgggttcccgctattccgcaggaaggcaatacaggcgattgggagatggctgcagcactgttggccgcagggtcccaaggcctggttactataaaggatgtaagtctgtgcttttcccaggaagaatggcggtctctcgacccgagccagacagacttctacggagagtatgtaatgcaggaaaattgcggaatagttgtgtcacttcggttcccaatacctaaattagacatgctgtctcagctggagggaggggaggaacagtgggttcccgatccccaggatttagaggagcgcgatatattaagggtgacttataccggagacgggagcgaacacgagggcgacactcccgagctggaagctgagcctccaagaatgctttcatcagtgagcgaggatacagtcctgtggaatcccgagcatgatgagtcctgggacagcatgcccagttcctcacgcggaatgctgctcggcccaccttttctgcaagaggatagctttagcaacctactgtgctctaccgagatggatagtctgcttaggcctcatacatgtcctcagtgtggaaagcagtttgtttgggggtcccatctggcacgtcaccagcaaacacataccggcgaaaggccttattcctgtctcaaatgcgagaaaaccttcgggagaagacaccatctgattcggcatcagaaaacacaccttcacgataagaccagccggtgttcagaatgtggaaaaaactttagatgtaacagtcatctagccagccaccagcgtgtccacgcagagggcaagagctgcaaaggccaggaagtgggtgagagccctggcacaaggaaacgccaaagggctcctcctgttccaaaatgtcatgtgtgcactgagtgtggaaaatcattcggtcggaggcaccatctggttcggcactggctaacccacacaggggagaagccatttcagtgtcccaggtgtgagaagagcttcgggagaaagcaccacctggaccgccacttgctgacccaccagggacagtctcccaggaattcatgggatcgcggaacaagcgtgttttag

SEQ ID NO: 247752 - DNA, 1275 bp, Artificial Sequence
  Description of Artificial Sequence: Synthetic coding sequence
atgctcagtgagcagacagctgcccttggcacaggctgggagtctatgaatgtacagttggacggtgctgaacctcaggtggaacggggaagccaggaggaaaggccttggcggaccgtgccagggccacttgagcacctgtgttgcgacttagaagaagaacctcagagtttacaagaaaaggcccagtctgctccttgggttcctgccatcccccaggagggcaacacaggggactgggaaatggccgcagcccttctcgccgctgggagtcaaggactcgtgaccattaaggacgtatcactctgcttcagccaggaagaatggcggtccctggacccaagtcagacagatttctacggagaatacgttatgcaggagaattgtggaatcgttgtgagtttgcgcttcccaatccccaaactggacatgctgagtcaactcgaaggaggagaggaacagtgggttcccgatccccaggacctcgaagagcgcgatatccttcgggtcacctatacgggagatggctcagagcacgaaggagatactccagaactggaagccgaaccgccacggatgctgtcatccgtgtctgaggacacagtcctctggaatccagagcacgacgagtcatgggatagcatgccatcctctagtaggggaatgctcctgggacctcccttcctccaagaagactcattcagtaatttactctgttccacagaaatggactctctcctcagaccgcatacctgcccccaatgcggcaagcaattcgtttggggatcccacctggctagacatcagcagacccatacaggagagaggccctacagttgtttaaagtgcgaaaaaacattcgggcgtcgccatcatctcatccggcaccaaaaaactcacctgcatgataaaacctccagatgcagcgagtgcggcaagaactttcgctgtaactcccacctggcatctcatcaacgcgtacacgctgaggggaagtcgtgcaaaggtcaggaagtgggggagagtcctggaacacggaaacggcaacgcgctccccctgtacccaagtgtcacgtgtgtacagagtgtgggaaaagctttggacgtcgtcatcacctagtacggcattggctgacacacacgggtgagaaaccgtttcagtgcccaagatgcgagaaatctttcggtcgaaaacatcacctagaccgtcacctgctaactcaccaggggcagagccctagaaattcatgggaccggggaacctctgtgttttag

SEQ ID NO: 247753 - DNA, 411 bp, Artificial Sequence
  Description of Artificial Sequence: Synthetic coding sequence
atgcaggctgaagacagatctcagtttggctcagcggctgagatgctgtccgagcaaaccgccgctcttggcacggggtgggaatctatgaacgtgcagcttgacggagccgagccgcaggtcgaacgcggatcacaggaggaaaggccttggcggaccgtgccaggaccattggagcacctgtgctgtgatctagaggaggaacctcagtcattgcaagagaaagctcagagcgccccatgggttccggctatacctcaggagggaaatacaggggactgggagatggcagcggctctgcttgccgcaggttcacaagggttggtgaccatcaaggacgtctcactctgcttctctcaagaagaatggcgctctctggacccttcccaaacagatttctacggcgaatag

SEQ ID NO: 247754 - DNA, 324 bp, Artificial Sequence
  Description of Artificial Sequence: Synthetic coding sequence
atgctgtcagagcagaccgccgctctggggactggctgggagtcgatgaatgttcagctggatggagccgagccccaggtagaacggggttcacaagaagaacggccatggcggacagtgcccggtccattagagcacctttgctgtgaccttgaggaggagcctcagagccttcaggagaaggcccagagtgcaccctgggtaccagccattccacaggaagggaatacaggggactgggaaatggccgcagctctcctcgctgctggctcacagggcctagttactatcaaggacgtctccctgtgcttttcccaggagtag

SEQ ID NO: 247755 - DNA, 234 bp, Artificial Sequence
  Description of Artificial Sequence: Synthetic coding sequence
atgctctctgagcagacagctgccctgggcacaggctgggagtccatgaatgtacagctggatggtgctgagccacaggtcgagaggggatctcaggaggaacgcccatggaggaccgtcccgggtccactggagcacctgtgttgtgaccttgaagaagaacctcaatctttacaagagaaggcccaaagcgccccttgggtgcccgctattcctcaagaaggtaacacttag

SEQ ID NO: 247756 - DNA, 3984 bp, Artificial Sequence
  Description of Artificial Sequence: Synthetic coding sequence
atgagatccttcctgcagcaggacgtcaacaagacaaaatcccgcctcaatgtgctcaacggactggccaacaatatggacgacctaaagatcaataccgacataaccggagctaaagaagagctgctggacgacaacaacttcatctctgacaaagaaagcggagtgcacaagccaaaagactgtcaaacaagcttccagaaaaacaacacgctgacactgcctgaagaattatccaaagacaagtcagaaaatgccctttccgggggtcagagttcccttttcatacacgccggtgctcctacagtgtcaagtgagaatttcattctgccaaaaggcgcagcagtgaatggacctgttagtcacagctcactcacaaaaacctcaaatatgaataagggttctgtgtctctgacaacaggccagccagtggatcagccaaccaccgaatcttgcagtacacttaaagtcgctgctgacctccaactttcgaccccgcaaaaagcctctcagcaccaggtcctgtttcttctgagcgacgtcgcccacgcgaagaacccgactcattccaacaaaaaacttcctacctctgcttctgtgggatgcgatattcaaaatagcgtgggatcgaacatcaagtctgacggaactctgattaatcaagtggaagtcggggaggatggcgaagacctgttggtgaaagatgactgcgtgaacactgtgacaggcatctcttccggcactgacggcttcaggtcggagaacgataccaactgggatcctcagaaagagtttatccagttcctcatgacaaatgaagagaccgtcgataaggcaccgcctcactccaaaattgggttggagaagaaaagaaagcggaagatggacgtgtcgaagataactaggtatactgaagactgttttagcgacagcaactgcgtgcctaacaagtcgaagatgcaggaggtggactttctggagcagaatgaggaactgcaagcagttgattcccagaagtacgctctttcgaaggtgaagccggagtccaccgacgaagatctggagagtgtggacgcctttcagcacctgatttataatcccgacaaatgcggcgaggaatccagtcctgtgcacacctctacattcttaagcaacacccttaagaagaaatgcgaagaaagcgatagcgaatctccagcaaccttctccacggaggagccctcattttacccatgtacaaaatgtaatgtgaattttcgagagaaaaaacatctgcaccgacatatgatgtaccatttggatggcaacagccactttagacacctgaacgtgcctaggccatacgcctgtcgggagtgtggccgtacgtttagggaccgaaactctctgcttaaacatatgatcatccatcaggagagacgccaaaagctgatggaggaaatccgagaactgaaagagctgcaggacgaggggcgtagtgcacgcctgcaatgtccccagtgtgtgtttggaaccaactgtcctaaaacgttcgtccagcacgccaagacacatgagaaagataagagatattattgttgtgaagagtgcaacttcatggcagtgaccgaaaatgagctagaatgccacaggggcattgctcatggagccgtcgtcaagtgccctatggtcaccagtgatatcgctcagagaaagacccagaagaaaacctttatgaaagattctgtcgtgggaagctctaagaagtctgccacctatatctgtaaaatgtgcccctttaccacatctgccaagagtgtgcttaagaagcatacggaatatctacattcatcttcatgcgtcgacagcttcggctcacccctaggattagataaacgaaagaacgacatcttagaggagcccgtcgattctgattctacaaagacactgactaagcagcagtcaaccacgtttcctaagaattccgccctgaagcaagatgtaaagcggacttttggaagcacttcccaaagctcgagctttagtaaaatccacaaacgccctcaccgcatccagaaggctaggaagtcaattgcacagagtggcgtgaacatgtgtaaccaaaactctagcccacacaaaaatgtgacgatcaagagctctgtcgatcagaaacccaagtattttcatcaggccgctaaggaaaagtctaatgcaaaggcaaactcacactatctgtaccgccataagtatgagaattatagaatgattaaaaaaagcggtgagagctaccctgttcactttaaaaaggaggaagcctcatctcttaattcccttcacctcttctcctcctcatctaattctcacaacaacttcatcagcgatccacacaaaccagacgcaaagagaccagaatcttttaaggaccaccgaagagtggcggtgaaacgggtgatcaaggagtcaaagaaagaaagctcagtgggaggtgaggaccttgattcctatcctgattttctgcacaagatgaccgtcgtggtgctccagaagcttaattccgccgagaagaaggatagctacgagacagaggatgagagttcatgggacaatgtggagctgggggattataccacacaggccatcgaggacgagacgtacagcgacattaaccaagaacacgtgaatttgttccctctgttcaagtcaaaggttgagggccaggagcccggagagaacgccaccctctcatatgaccagaacgatggcttctattttgaatactacgaggacacaggaagcaacaatttcctccatgagatccatgacccccaacatctggagacggcggacgcatccctgtcaaagcactcatctgtcttccactggactgacctgtccttagagaagaaatcttgcccatactgtccggctacattcgaaacaggcgttggactgtcgaatcatgtaagagggcacctacatcgtgcgggtctgagctatgaggcacgacacgtggtgtctcccgagcagattgccacaagcgataagatgcagcacttcaaacggacaggaaccggtacaccagtcaaacgggtaagaaaggccattgagaagagtgaaaccacatctgaacatacgtgtcaactctgcggaggatggtttgatacaaagatagggttatccaaccacgtgcgagggcatctgaagcgactggggaagactaagtgggacgcccacaaatctcctatatgtgttcttaacgaaatgatgcaaaacgaggagaaatacgagaaaattctcaaagcattgaattccagacggattatacctcggccttttgtggcgcagaaacttgcctcaagtgatgatttcatatctcaaaacgttattcccttagaggcttacaggaatggccttaagaccgaggctctcagcgtgtctgctagtgaagaggaggggttgaattttctcaacgaatatgacgagaccaaacctgagctaccatcagggaagaaaaaccagagcttaacactcatagaattgctcaagaataagcgcatgggggaagaacggaatagtgccattagcccacaaaagatccataaccagacagccaggaaacgatttgtgcagaaatgcgtgctgcctctgaacgaagactccccgctaatgtaccagcctcagaaaatggatttgacaatgcactcagctctcgactgtaagcagaaaaaatcaaggtccaggtccgggagcaaaaaaaaaatgctcacattgccccacggtgcagacgaagtgtacatcctgcgctgtcgtttctgcggtctcgtgtttagaggccctctcagcgtgcaggaggactggatcaagcacttgcagcggcatattgttaacgccaatttgccgagaaccggcgcaggaatggtggaggtgacttctctcctgaagaagcccgcttcgattaccgagacgagtttttcattactgatggccgaggcggctagctag

SEQ ID NO: 247757 - DNA, 318 bp, Artificial Sequence
  Description of Artificial Sequence: Synthetic coding sequence
atgcttattcgtcagaatctcgctttagattgcaagcagaaaaagtctaggtctcgatcaggatctaaaaaaaaaatgctgactctgcctcatggcgctgatgaggtctacattctaagatgtcggttttgtggtctggtctttcggggaccactgagcgttcaggaggactggatcaaacacctccagcggcacattgttaatgctaacctccctcggactggtgctggaatggttgaggtaacaagcctgctcaagaaaccggcatcaattaccgagaccagcttttccctactgatggccgaagctgccagttag

SEQ ID NO: 247758 - DNA, 318 bp, Artificial Sequence
  Description of Artificial Sequence: Synthetic coding sequence
atgctgatccggcagaatctggccctggattgtaagcagaagaagagtcggtctcgatccggcagcaagaaaaaaatgctgacactcccccacggagcagacgaagtttacattttacgatgtaggttttgcgggttagttttccggggtcctttgagtgtgcaggaggactggataaagcatctccagcgccacattgtcaatgctaatctgcctcggaccggcgctggcatggtcgaagttacatcgcttctgaagaagccggcttcaatcacagaaaccagcttcagcctgctcatggccgaggctgcgtcgtag

SEQ ID NO: 247759 - DNA, 3984 bp, Artificial Sequence
  Description of Artificial Sequence: Synthetic coding sequence
atgcgatccttcctccagcaggacgtgaacaaaacaaaatctcggctcaatgtgttaaacggcttagctaacaatatggatgatctgaagatcaacacagacattacaggcgctaaggaagaactcctcgacgacaacaatttcattagtgacaaggaaagcggcgttcacaaaccaaaagattgtcagacctctttccaaaagaacaacacactgacactacctgaagagctgagcaaagacaagtccgagaatgcattatcggggggacagtccagcctcttcattcacgcaggagccccaaccgtgagctctgagaacttcattcttcctaaaggtgcagccgtaaatggcccagtgtctcactcgagtctcaccaaaacgagcaacatgaacaagggttccgtatctctaacgaccggacagccagtggatcaaccgacgaccgaatcatgttccaccctcaaggtagccgcagatttacagctgagtacaccacaaaaggcgagccagcatcaggtcctattcctcctgagcgacgtcgcacacgcgaaaaatcccacgcattcgaacaagaagctacctacctccgccagtgtggggtgcgatatccagaatagcgtcgggagcaatattaagtcagatgggacacttattaaccaggtggaagttggagaagatggtgaggacctgctagtcaaggacgattgcgtcaacacagtgacgggtatttcctcgggaacagatggtttccgcagcgagaacgacacgaattgggaccctcagaaggaattcattcagttcttgatgaccaacgaagagactgtggacaaagcaccacctcatagcaagattggccttgagaaaaagaggaagagaaaaatggatgttagcaagatcacgcgttataccgaagactgttttagcgattcaaattgtgtgcccaacaagtctaagatgcaagaggtggactttttagagcagaacgaagaacttcaggctgttgactcgcagaagtacgctctcagcaaggtaaaacccgagagcactgacgaagatctggagagcgtcgatgcatttcagcatctgatatataatccagataagtgtggcgaagagagtagccctgttcatactagcacttttctgagtaatacactgaagaaaaaatgtgaggagtctgactcggagtcacccgctacctttagcactgaggaaccctccttttacccctgcacaaagtgcaatgtgaacttcagagaaaagaagcacctacaccggcatatgatgtaccacctagatggtaactcccattttaggcacttgaacgtcccgcgaccttatgcttgccgagagtgtgggcgaacctttcgggaccggaactctcttctaaagcatatgattatccaccaagaaaggagacagaagcttatggaagaaattagggagctcaaggaactacaagatgaggggagaagtgctcggctgcagtgcccacagtgcgtcttcggcactaactgtcccaaaacctttgtccaacacgcaaagacacacgagaaagataagcgctattactgctgtgaagagtgtaacttcatggctgttacggaaaacgaactggaatgccaccgcggtattgcgcacggcgctgtcgtgaagtgccctatggtgacctcagatatagcccagcgtaagacacagaagaagacattcatgaaagatagtgtggtggggagctcgaagaaatccgctacctacatctgtaagatgtgcccatttacaacttccgctaaaagcgttttgaaaaagcatacagagtatctgcatagcagcagctgtgtggactcatttggaagcccacttggcttagataaaagaaagaacgacattttggaggagcctgtggactctgattcaacaaagactcttacaaagcagcagagcacaactttccctaagaacagtgccttgaagcaagacgtcaagaggaccttcggtagcacttcacagtccagttctttttccaagattcacaaacggccacacaggatccagaaagccagaaaaagtattgcccagagcggggtgaacatgtgcaaccagaattctagcccgcataagaacgtgaccattaaaagcagtgtggatcagaagccgaaatattttcaccaggccgcaaaagaaaaatctaacgctaaagctaattcacactatttgtaccgtcacaagtatgagaactacagaatgatcaaaaagtctggcgagtcttatccggtccacttcaaaaaagaggaggcatcgtccttgaactcacttcacctcttttcaagtagcagcaactcgcacaacaatttcatcagcgacccacacaaaccggatgcaaaaagacccgaatctttcaaggatcatcggcgagtggcagtcaagagagttatcaaagagtctaagaaggaaagctccgtaggcggagaagatttggatagctaccctgacttccttcacaagatgaccgtcgtagtcctgcagaagctgaattctgctgagaaaaaggactcttacgaaactgaggatgagagcagttgggataacgtagagcttggggattacactactcaggcaatcgaggatgagacctacagcgatattaaccaggagcatgtgaatctgttcccactcttcaagtcaaaggtggaggggcaggagcccggtgaaaatgctaccctgagctatgatcagaatgacggtttctactttgaatattatgaagacacggggagcaataatttcttgcatgagatccatgaccctcagcatttggagactgctgacgcctctttaagcaaacattcaagtgtcttccactggacggatctcagcttggagaagaagagctgtccttactgccccgctacttttgaaaccggtgttggtctctctaaccacgttcgcggtcatttgcatagagccggtttgtcgtacgaagccaggcatgtcgtctctccagagcagattgcgaccagcgataagatgcaacactttaagaggactggaactgggacccccgtaaaacgcgtgaggaaggccatcgagaagtctgaaaccaccagcgagcacacctgccagctctgcgggggttggttcgacaccaaaattggactgagtaatcacgtgagaggccatctgaagagactcggcaagacaaagtgggacgcacacaaatcaccaatctgcgtgctgaacgagatgatgcaaaacgaggagaagtatgagaaaattcttaaggccctgaatagtagaagaattatcccgagaccatttgttgcacagaagctagcgagtagcgacgacttcatttcccagaatgtcatccctttagaagcttatcgtaatggcctgaagacggaggctttatccgtgtcggcctcagaggaagaaggcctgaactttcttaatgaatatgacgagacaaagcccgagctgccatccgggaagaagaatcagagcttgactctcattgaactgttaaaaaacaagaggatgggggaggagagaaatagtgctattagcccccagaagatacacaaccagactgctcgtaagcggttcgtgcagaagtgtgtgctccctctgaatgaagacagccccctcatgtatcagccccagaagatggacctcaccatgcattccgcattagattgtaagcagaaaaagagccgcagccgttcaggatcaaagaagaaaatgctgaccttgcctcatggggctgacgaagtatatatcctcaggtgtagattctgcgggctggttttcagaggtcccctctccgtgcaggaagattggattaagcatctgcagcggcacattgtgaacgccaacctgccccgtaccggcgcaggaatggtcgaagtgacaagcctcctcaaaaaaccagccagtattaccgagacatctttttccctcctcatggccgaggctgcatcatag

SEQ ID NO: 247760 - DNA, 1953 bp, Artificial Sequence
  Description of Artificial Sequence: Synthetic coding sequence
atgatgtaccaccttgatgggaactctcactttcgccatctgaatgttccaaggccatatgcttgtagggaatgtggccgaaccttccgagatagaaattccctgttaaagcacatgatcatccaccaggagaggcggcagaagttaatggaagaaatcagagagttgaaagaactacaagatgaaggacggagcgcacgccttcagtgtccgcagtgcgtttttggtaccaattgcccaaagacctttgtgcaacacgccaaaactcacgagaaggacaaacgttactactgctgtgaagagtgcaactttatggctgtgacagagaacgagctggagtgtcatcgcggtattgcgcatggggctgtggtaaaatgtcccatggtgacgagcgatattgcacagcggaaaactcagaagaagacctttatgaaggatagcgtcgtgggaagtagcaaaaagtccgcaacttacatctgtaaaatgtgcccatttacaacatcagccaaaagtgtcctcaagaagcacactgagtacttgcattctagcagctgtgtcgactcctttgggtctccacttggtctcgataaacgaaaaaatgatattctggaagagcccgtcgacagtgatagtaccaagactctcactaagcagcagtctaccacattccccaagaatagcgccttgaaacaagacgtgaaaagaaccttcggctccacttcacagagttcctctttttcaaagattcataaacgtccacataggattcagaaggctcgcaaatccatcgcccagtccggggtcaatatgtgcaatcagaactcttctccccataaaaatgtgaccatcaaatctagcgtggaccaaaaaccaaaatatttccaccaggcagccaaagagaagtctaacgcgaaagctaatagccattatctttatcggcacaagtatgaaaactatcgaatgatcaagaagagtggggagagttacccggtccacttcaaaaaggaagaggcaagttctctcaatagcctccacctttttagttcatcctccaatagccataataattttatttccgatccacacaaacccgacgccaagagacccgagagctttaaagaccatcggcgagtagcggtgaagcgcgtgatcaaagagtctaagaaggaaagcagcgttggaggcgaggacctggatagctatcccgattttctccacaaaatgacagtggtggttttgcagaagctgaactcggcagagaaaaaggatagctacgagaccgaagatgaaagtagctgggataacgtggagctcggcgattacaccacccaggccattgaggacgaaacttactccgacatcaaccaggagcacgttaacctgtttccattatttaagtcaaaagtagaaggccaagaaccaggagaaaatgcgaccctttcctacgatcaaaacgacggcttctacttcgaatactacgaagacaccgggtccaataactttctgcatgagattcacgacccccaacaccttgaaacagctgatgctagcctgtctaaacattcctctgtctttcattggacagatcttagcctggagaaaaagagttgtccttattgcccggctactttcgaaaccggcgtgggattgagcaatcatgttagggggcatctacaccgagcaggcctgtcttatgaggcccgacacgttgttagcccagagcaaatcgctacttccgataagatgcagcacttcaagcggacaggtactggaactccagtgaagcgcgttcgtaaggcgatcgaaaaaagcgagacaacaagcgagcacacctgccagctctgcggcggttggttcgatacgaagatagggctctcgaatcacgtgagggggcaccttaagaggctagggaaaactaaatgggacgcccataagagtcccatatgcgtctag

SEQ ID NO: 247761 - DNA, 924 bp, Artificial Sequence
  Description of Artificial Sequence: Synthetic coding sequence
atgagaagcttcttgcaacaggatgtcaataagaccaagtcccgcctgaacgtcttaaacggattagccaataatatggatgacctaaagataaacacagatatcacaggagctaaggaagagctcttggacgataacaattttatctccgataaggagtccggagtgcataagcccaaggactgtcaaacatctttccagaagaacaacaccctgaccctgccggaagagttaagcaaagacaaatctgaaaatgccttaagcggtggccaatccagccttttcatccatgctggtgcaccgactgtgagcagcgaaaatttcatactccctaagggggcagcagtgaacgggcctgtgtctcactcatccttaaccaagacctcaaatatgaataaaggtagcgtgagcctaactacggggcagcccgtcgatcagccgactaccgaatcatgctccaccttgaaggtggccgctgacctgcagttgtctaccccccagaaggcttcccagcatcaggttcttttcttgctaagcgacgtggcacacgcaaagaatccgacccatagcaacaagaaactgccaacatcagcatccgtgggctgtgacatacagaattctgtgggctctaatatcaaaagtgacggcacactcatcaaccaagttgaggtgggggaagatggcgaggacctgctggtgaaagatgactgcgtgaacaccgtgactgggatctcctcaggcactgatggttttcgtagcgaaaacgataccaactgggatcctcagaaggaattcattcagttcctcatgacaaatgaggaaacagtcgacaaagcgcctccccacagtaagatagggctggaaaaaaaaaaggccaaaaatggctgtaaacaggacaactctttatatcgtgggctgctgtag

SEQ ID NO: 247762 - DNA, 1518 bp, Artificial Sequence
  Description of Artificial Sequence: Synthetic coding sequence
atgactaaggcccaggagtccctgacattagaggatgtagccgttgactttacctgggaggagtggcagtttctgagccccgctcagaaggacctctatcgtgacgtaatgctcgaaaactactctaatctggtgtcagtgggataccaggctgggaagcctgatgctcttaccaagctggaacagggggaaccactttggaccttggaagatgagatccatagtcctgctcaccctgagatcgagaaagcagacgatcatcttcagcagcccctgcagaaccagaagattcttaagagaacggggcagagatacgaacatggacgtaccctgaaaagctacctgggactcaccaatcagtctcgaagatataatcggaaagaacccgcagagttcaatggcgatggagcatttctgcacgataatcacgaacaaatgcctaccgagattgagttccccgagtcccgtaaacccatcagcacaaagagccagttcctcaaacaccagcagacacataatattgagaaggcccacgaatgcacagattgtggaaaagcttttctgaaaaaatcccagctgaccgagcacaaacgaatccataccggcaagaagccccacgtttgctccctttgtgggaaggcattctacaaaaagtaccgcctaactgagcacgagagagcacaccgcggtgaaaaacctcacggctgttccctgtgcggcaaagccttttataagagatacagacttaccgagcacgaacgggcacataaaggggagaaaccttatgggtgttccgagtgcggaaaagccttccccaggaagtcggaactcacagaacatcaaaggattcacactggaataaagcctcaccagtgctctgagtgtgggcgagctttttcaagaaaaagtctgctggttgtgcaccagaggacccacacgggcgaaaagccccatacatgctctgagtgtggaaaagggttcatccagaagggtaacctcaatatccaccaacgcactcacaccggagagaaaccctacggatgtatcgactgtggcaaagccttctcacagaagtcttgcctcgtggcacaccagaggtatcatactggcaaaactccctttgtctgcccagagtgcggacaaccctgcagtcaaaagagtggtctgatcaggcaccagaagatccacagtggtgagaagccttacaaatgcagcgactgcgggaaggccttcttaacgaagacaatgttgattgtccatcaccgcacacatacaggggagagaccatatgggtgtgatgaatgcgaaaaagcatatttctacatgagctgcctcgtgaagcacaaacgtatccatagccgggaaaagcgaggagattctgtgaaggttgagaaccccagtaccgcttcccattccctcagcccttccgagcacgttcagggaaaatcaccagtaaatatggtcacggtcgcaatggttgccggacaatgcgaattcgctcacatcctgcacagctag

SEQ ID NO: 247763 - DNA, 1833 bp, Artificial Sequence
  Description of Artificial Sequence: Synthetic coding sequence
atgcctagcgccaggggaaaaagcaagagcaaggccccaatcacttttggtgatctggcgatctattttagccaagaggagtgggaatggctgagtcctatccagaaggatctgtacgaggatgtaatgctggaaaattacaggaacctggtttctcttggcttgtcattccgcaggccaaatgtgataactctgctcgagaaaggcaaggcaccctggatggtggagcctgtccggaggagaagggcacccgacagtggatctaagtgcgaaaccaagaagttgccacccaatcagtgtaataaaagcggtcagtctatttgccagaaattagtatccgcgcagcaaaaggctcctaccaggaagagtggatgtaataagaattcagtgctggtgaagcctaagaagggacatagcggcaagaagcccttaaagtgtaacgactgcggtaagacgttctctagaagcttctcacttaaacttcaccagaacatacatactggagaaaaaccgttcgagtgttcaaactgtcgaaaggctttcagacagattagtagcatactgctgcaccagcggattcactcaggtaagaagtcccatgaatgcaacaagtgcggggagtcttttaaccagcgaacaacactcatcctccacatgagaattcatgatggcaaagagatcctagattgcggcaaggccctcagccagtgtcaatctttcaacattcatcagaaaattcacgtagtcggcaacgtttgccaatgtaggaaatgtggcaaagccttcaatcagatgagctctttacttctgcacaagaaaattcacaatggcaagaagacacacaagtacaataagtgtggacggggtttcaagaaaaaatctgtttttgtggtgcacaagcgcattcacgccggtgagaagattccggagaatgccaaagcgctgtcacagtccctgcaacagcgatcccaccacctcgaaaatcccttcaagtgcagaaaatgtggaaaactctttaatcgaatctctcccctcatgttacatcagagaatccataccagtgagaagccatacaaatgcgataagtgcgataagttcttcagacgactctccaccctaattctgcacttgaggatacacaacggagagaagttataccgatgtaataaatgcgaaaaggtgtgcaaccggcactcctctctgatccagcatcagaaggtccacacgaagaagaagaagctgttcgaatgcaaagagtgtggcaaaatgttctcgggaaccgctaacctgaagatccaccagaacatccactcagaagaaaagcccttcaaatgtaacaagtgcagcaaagtgttcgggaggcagtcattcctgatcgaacaccaacgcattcatactggtgaaaagccctaccagtgcgaggagtgtggtaaggcgttttcacataggatctccttgacccgccacaaacggatccatacagaggatcgcccatatgagtgcgatcaatgtggaaaggctttctctcaatctgcccatctcgcacagcacgagcggatccatactggcgagaagccttacacctgcaaaacgtgcggtaaggcctttagccagcgcacatccctgatcttgcatgaaaggagtcacacgggcgagaagccttatgagtgcaatgaatgcgggaaagctttctcatccgggtccgatctcattcgacatcagcgcagtcattcctcggagaaaccctatgagtgcagcaagtgtgggaaggcatactcccggtccagcagtctaatacgccaccaaaacacacactcggaagagaaagcctag

SEQ ID NO: 247764 - DNA, 2217 bp, Artificial Sequence
  Description of Artificial Sequence: Synthetic coding sequence
atgcggaccctggtaaacgccctctccgggggtgggcaggagattaagccagaaggcaagtgcgcccataacggaatgtgctttcggtgcgaagaggtggctcctgatacttgcgaagcttacccttaccccggactggtcgtcagcgttgcgggaaaggaaggacccaatccagatcacaaacgcggatttcttgatctggctcaggagggtattcaggctttgccataccagttatccgcccatctgtctgtgtggaccctgaaaggagaggagcgcatgccatcagcgagaggaaagagtaaaagtaaagcaccaatcactttcggcgacctcgcaatttacttttcccaggaggaatgggagtggttgagccccattcagaaggacctctacgaggacgttatgcttgagaactacagaaatcttgtgtcccttggcctgtcctttcgcaggccaaatgtgatcacactcctcgagaagggcaaagccccatggatggtggagcctgtgagacggaggagggctcctgagttggtgactgtagccctattttcaagtttcggagaggtgatgttcagcagaatggtactcatgctaatggatgtgtgtcagtatttagttatcgacgagcttgatagcggctccaagtgcgagactaagaagctccctccaaaccagtgcaacaagtcaggacagtctatttgccagaaattagtatctgcacagcagaaggcccctactagaaaaagtggatgtaataaaaatagcgtgctcgtaaaacctaagaagggacactctggcaagaagcccctaaagtgcaacgactgcggtaagacctttagtcggtcgttctcgctgaaattacatcagaatattcacacaggcgagaaaccctttgaatgcagtaactgtcgaaaggcgttccgccagatttcgtcgatactgctgcatcagagaatccattcaggtaaaaaaagccacgagtgtaacaagtgcggagaatctttcaaccaacgcacgacgctcatcctccatatgagaatacacgatggaaaggaaattctggactgcggcaaggcgttatctcagtgccaatcctttaacattcaccaaaagatacacgtggtagggaacgtgtgccaatgccgaaaatgtggaaaagcattcaatcagatgagttctttgctgttgcacaagaagatccataacgggaagaaaacccataagtataataagtgtggtcgaggattcaagaaaaaatctgtcttcgtagtccacaagcgcattcacgctggggaaaagatccctgaaaacgccaaggccctatcccagtcactgcagcaaaggtcacaccatctggagaatcctttcaaatgccgcaaatgcggaaagcttttcaatcggatttcacctctgatgttacaccagagaatacataccagtgaaaaaccatacaagtgtgataagtgtgataagttcttccgtaggctgagtacactgatcctgcatctccggatccataatggcgaaaagctgtatcgatgtaataagtgtgagaaagtgtgcaacaggcatagcagcctcatccagcatcagaaggtgcatactaagaagaaaaaactgtttgaatgtaaggaatgcgggaaaatgttttccggcacagccaatttgaaaatccaccagaatattcattccgaggaaaagcctttcaagtgcaacaagtgtagcaaggtgtttggtaggcaatcattcttgatcgaacaccagcgtatccatacaggggaaaagccttaccagtgcgaagaatgcggaaaggcatttagtcatcgaatttctctcacccgacacaagcgaattcacactgaagaccgtccgtatgagtgtgatcagtgtggtaaggccttcagccagagcgcgcaccttgcgcaacacgaacgcatccatacaggtgagaaaccatacacgtgtaaaacctgtggtaaagcctttagccagcggacatcacttatcctacatgagaggtctcatacaggcgagaagccgtacgaatgcaacgagtgcggaaaggcattcagcagtgggagtgacctgatcaggcaccagcggtcacactcaagcgagaagccttatgagtgctccaaatgcggaaaggcttattccaggtcctccagcttgataagacatcagaatactcactctgaggaaaaggcctag

SEQ ID NO: 247765 - DNA, 975 bp, Artificial Sequence
  Description of Artificial Sequence: Synthetic coding sequence
aaaaattctgtgttagtcaagccaaagaagggtcacagtggaaagaaacccttgaagtgcaacgattgcgggaagaccttctccaggtcattctccctcaaattgcaccagaacatccatactggtgagaaacctttcgagtgttcaaattgcaggaaggcttttcggcagatttcctcaatactattgcatcagaggattcactcaggcaaaaagtcacacgagtgcaacaaatgtggagagtccttcaaccagagaactacattgattctgcacatgcggatccatgatgggaagaaccccttcaagtgtagaaagtgcggcaagctgtttaataggattagtccactgatgctgcatcagaggattcatacctccgagaagccttacaagtgcgaggagtgtggcaaaatgttcagtggcactgccaatctgaagatccatcagaacatacactcagaagagaagcctttcaagtgcaacaagtgtagcaaggtcttcggccgtcaatcttttttaatagagcatcagcgcatccacacgggcgagaagccgtaccagtgcgaggagtgtggtaaggcgttcagtcacaggatatccttgaccagacacaaacgtatccatactgaggaccgaccttacgagtgcgaccagtgtggtaaggcgttttcccagtccgcccacctagcacaacacgagcgaatacacacaggggagaagccctatacctgtaagacatgcggaaaggccttttcgcaaaggacgtccctgatcctgcatgagaggagtcatactggagaaaagccgtacgaatgtaacgaatgtgggaaggcgttcagctccggctctgatctaattcggcatcagagatcacatagcagtgagaagccatatgagtgctcaaagtgtggtaaggcctattccaggtcatcatcactgatcaggcatcagaatactcattccgaggaaaagtag

SEQ ID NO: 247766 - DNA, 1179 bp, Artificial Sequence
  Description of Artificial Sequence: Synthetic coding sequence
atgcggattcatgatggcaaagagattctggattgcggcaaggccctgtcccagtgtcagtctttcaatatacaccagaagatccacgttgtgggtaacgtgtgccagtgtagaaagtgtggaaaggctttcaatcaaatgtcttctctgctgctgcacaaaaaaattcacaatggcaagaaaactcacaagtataacaaatgcggaagaggcttcaaaaaaaaaagtgtgttcgtcgtgcataagcgaatccatgccggtgagaaaattccggagaatgccaaagccctttctcagtctctgcaacagagatcccaccacttggaaaatccttttaaatgtaggaaatgtggtaagctcttcaacagaatctctcctcttatgctgcatcaacgcattcataccagtgagaagccgtacaaatgcgataaatgcgacaaattctttagacggctgagcacactgattctccacctcagaatccataacggggaaaagctgtaccggtgcaacaagtgtgagaaggtttgcaatagacactcttcattgatccagcatcaaaaggtgcatacaaagaagaagaagctctttgagtgtaaggagtgcggcaaaatgttcagtggcactgctaatctgaaaatccatcagaatatccacagtgaagaaaagccgtttaaatgtaataaatgctctaaggtgttcggtagacagagcttcctgatagaacaccagagaatacatactggggagaaaccctaccaatgtgaggagtgcggtaaggcattctcccatcgcataagtctgacaaggcataaaaggatacatactgaggatcggccatacgagtgcgaccaatgtggtaaagctttttcacaatccgcccacctggcccagcacgagaggatccacactggggaaaagccctatacatgcaagacttgtggaaaggctttttcccagcggactagcttgattctccacgaaaggtcccacacaggcgagaaaccctacgaatgcaacgaatgcggaaaggcattcagcagcgggagtgaccttattaggcatcagaggtcgcactcttctgagaagccatatgaatgcagcaagtgcggcaaagcatatagccgaagctcctcacttattcgccatcaaaatacacatagtgaggagaaagcatag

SEQ ID NO: 247767 - DNA, 1833 bp, Artificial Sequence
  Description of Artificial Sequence: Synthetic coding sequence
atgccctctgcccgagggaagtcaaagtcaaaggcccctatcaccttcggcgacctggctatctacttctctcaagaggagtgggagtggcttagccctatccagaaagatctatacgaagacgtgatgctagagaactacaggaatctggtgagccttggcctgtctttccggagacctaatgtcattaccttactagaaaagggcaaggcgccttggatggttgagccagtgagacgacgtcgcgctcccgattctgggagtaaatgtgagacgaagaaactgccacccaaccaatgcaataaaagtgggcagagcatatgccagaagctggtgagtgcccagcaaaaagcacccacaaggaagtccggctgcaacaagaacagcgtcctagttaagcccaaaaaaggccatagtggtaagaagccgctgaagtgcaacgattgtggcaagacattttcccgatcttttagcctgaaactacatcaaaatatacatactggcgagaagcctttcgagtgctctaactgccggaaagcattcaggcagatctcgtccatactcctgcaccaacggatacattccggtaagaagtcacacgagtgcaacaaatgcggagagagctttaaccagcgcactacgctgatcctgcatatgcgaattcacgacggcaaagaaattctggactgtgggaaagcgttgagccaatgtcaaagctttaacatccatcagaagatccacgtagtgggaaacgtttgccagtgtcgcaaatgcggcaaggcctttaatcagatgagttccctgttactgcacaagaaaattcacaacggaaaaaaaacccataaatataacaagtgcgggagggggttcaagaagaaaagtgttttcgtggtgcataaacgcatccatgcaggtgagaagataccagagaacgcgaaggccctctcccagtccctgcagcagagatcccatcatctggaaaaccccttcaaatgtcgaaaatgtggcaagttattcaatcgcatttctccgttgatgctgcatcagcgcatccacacttccgaaaaaccatacaagtgcgataaatgcgataaattttttcgccgactatcgactttgattctacacctgcggatccataacggggaaaaattgtataggtgcaacaagtgtgaaaaggtctgtaaccggcattctagtctgatccaacaccaaaaggtccacactaaaaagaagaagctcttcgaatgtaaggaatgcggtaagatgttttcaggaacagccaacctgaagatccatcagaacattcatagtgaagaaaagccttttaagtgcaataaatgtagtaaggtgttcggccgtcagtcatttctgattgagcaccagagaatccacacaggagagaagccgtaccagtgtgaggagtgcggaaaggcattcagccatagaatttcactgaccaggcataaaaggattcacactgaggaccggccttatgagtgtgaccagtgcggtaaggcctttagccaatccgcacacctggctcagcatgagcggattcatactggggagaaaccatacacctgcaagacatgcggtaaggccttttctcagcggacttctctgattcttcacgaacgcagccacaccggagagaagccttatgagtgcaacgaatgcggcaaggccttctcatcaggcagcgacttaataagacaccagcggagccattcatctgaaaaaccatatgaatgcagcaaatgcgggaaagcctacagtagatcatcttcactgatcaggcaccagaacacccattcggaggagaaggcatag

SEQ ID NO: 247768 - DNA, 1728 bp, Artificial Sequence
  Description of Artificial Sequence: Synthetic coding sequence
atggcaatgagtcaggaatcactgaccttcaaggacgtctttgtcgacttcacactcgaggagtggcagcaactggactctgcccaaaaaaatctgtacagggacgtgatgctggagaattacagccaccttgtttcagtcggacacctagtgggcaaacctgacgtcatcttcagactcggacccggagacgagtcatggatggcagatggaggcacaccggtgagaacgtgtgccgtgtgggaagtggacgagcagattgaccattacaaggagtctcaggacaaattcttgtggcaggccgctttcatcggcaaagaaacacttaaagacgagtccggacaggagtgtaaaatctgccgcaaaatcatatacctaaacactgacttcgtgagcgtgaagcagcgcctaccaaagtattattcctgggagcgctgctccaagcatcacctgaactttctcggacagaacaggtcttacgttaggaagaaggacgatggatgtaaggcatattggaaggtttgtctgcattataatttgcacaaggcccagcccgctgagaggttctttgatcctaatcaaaggggcaaagcgctacaccagaagcaggccctgcgcaagtcccagcgatcgcagacaggagagaaactgtacaagtgcactgagtgtggcaaggtctttatccagaaggcaaatttggtggtacatcagcggacccatacaggcgaaaaaccctatgaatgctgtgagtgtgccaaggctttcagccagaagagtacactgattgcccaccagaggacgcataccggtgaaaagccttatgaatgttccgaatgcgggaaaacattcattcaaaagagcacattaattaagcaccagcggacacacacgggtgaaaagccatttgtgtgcgacaagtgcccaaaggcattcaaaagctcatatcatttaatccgacacgagaaaacccatattcgacaagctttttataagggtattaaatgcaccaccagctctctgatataccagaggatacacacgtcagagaagccccagtgtagtgaacacggaaaggcatccgatgagaaacctagccctactaagcattggagaacccacaccaaagagaacatttacgagtgctccaagtgtggtaaatcatttcgaggtaagagtcacctaagcgttcatcagagaattcacaccggagagaagccatacgaatgttctatctgtggcaaaacatttagcggtaaatcccacctgtcagtccaccaccgaacccatacgggcgagaaaccttatgagtgtcgcagatgcggcaaagccttcggagaaaagagcacgctgatcgtccaccagcggatgcatacaggagaaaagccatacaaatgcaacgagtgcggcaaagcattcagcgagaagagccccctcatcaaacatcagcgcattcataccggtgagcgtccatatgagtgcacagattgcaagaaagcattctctcggaaatcaaccctgattaagcatcagaggatccacaccggagaaaagccttataaatgcagtgagtgtgggaaggccttctcggttaagtccacgctgatagtgcatcataggacccacacgggcgaaaaaccctacgaatgcagagactgtggaaaagcttttagtggtaagagtacgcttattaagcaccagagatctcacacaggtgataagaacctgtag

SEQ ID NO: 247769 - DNA, 1746 bp, Artificial Sequence
  Description of Artificial Sequence: Synthetic coding sequence
atggccatgagccaagagtcattaacatttaaagacgtgttcgttgatttcaccctcgaggaatggcagcagcttgacagtgcccagaaaaacctttatagagacgtcatgctggagaattactcccatttagtgagcgtgggacatctggtggggaagcccgacgtgatcttcaggttgggacccggagatgagagctggatggcagatggcggaacccctgtcagaacgtgtgcgggagaggatagacccgaggtgtgggaggtggatgaacaaattgaccattataaagaaagtcaagacaaattcctgtggcaagctgctttcattggaaaggaaacgctgaaggacgaaagtggtcaggaatgcaaaatttgcagaaagattatctatctcaataccgatttcgttagtgtgaaacagcgacttccaaaatactatagctgggagcgctgcagcaagcaccacctcaactttttgggacaaaatagatcttatgtgcggaagaaagacgatggatgcaaagcgtattggaaagtttgtctgcattataacctgcacaaggcacaaccagctgagaggttcttcgacccgaaccaacgcggaaaagccctccatcagaaacaggccctgaggaaatctcagcggagtcaaactggtgaaaaactgtacaaatgtacagaatgtggtaaggtgttcatccagaaggcaaatttggttgtccaccagagaacccatacgggggagaaaccttatgagtgttgcgagtgcgctaaggcctttagccagaaaagcactctgatcgcccaccagcggacccatactggcgagaagccatatgagtgctccgagtgtggcaaaacattcattcagaagtcaactctcattaagcatcaacgcactcatacaggagaaaaaccttttgtgtgtgacaaatgtcctaaagcctttaaaagttcttatcatttaatccgtcatgaaaagacccatattcgacaggcattttataagggaatcaaatgcactaccagtagcttgatatatcaacgcatccacacatccgaaaagcctcagtgcagcgaacacggcaaagcatcagatgagaaaccgtcacctacgaaacactggcgcacccacactaaagaaaacatctacgaatgttcgaagtgcggtaagagttttcgaggcaaatcccacctgtctgtgcatcagagaatccacacaggggagaagccctacgagtgcagtatttgcggcaaaaccttctctggaaaatctcatttgtccgtccatcatcgtacccacacaggcgaaaaaccttacgaatgtcgacgctgcggaaaggcatttggggagaagtctacgttgattgtccaccagagaatgcatacaggtgaaaagccgtataagtgcaacgaatgcggaaaagctttctccgaaaagtctcccctgattaagcaccagcgaatccatacaggtgagagaccctacgagtgcaccgactgcaagaaggctttttctagaaagagcactctaattaagcaccagagaattcacactggtgagaaaccatacaagtgttcagaatgcgggaaggcatttagcgtgaagagcactcttatcgtgcatcaccggacccacaccggtgagaagccatacgaatgtcgggattgcgggaaagccttttctggaaaatctaccctgatcaaacatcagcgctcccacactggtgataaaaatttatag

SEQ ID NO: 247770 - DNA, 3714 bp, Artificial Sequence
  Description of Artificial Sequence: Synthetic coding sequence
atgggcgacatgaaaacccccgacttcgatgacctactcgctgccttcgatattccagacatcgacgctaatgaagcaatccatagcggacctgaggaaaacgaagggcctggcggacctgggaaacccgagcctggagtcggcagcgaaagcgaagatacggccgcagcgagcgccggagatggtcctggggtgccagcccaggcttctgaccacggcctccctccacccgatataagcgtggtgagcgttatcgtcaagaatacggtgtgcccagagcagtctgaggccctagctgggggatcagccggagacggggctcaggccgctggtgtgaccaaagagggccctgtgggcccacatcgcatgcagaacggctttggctcccctgagccctctttaccaggcaccccccatagccccgcaccccctagcggtggcacttggaaagagaaggggatggagggaaaaactcccctggatttgtttgctcatttcggtcctgaaccaggagatcactctgacccactgccaccttcagccccaagtcccacacgggaaggggcactcacccccccaccctttccaagcagcttcgaactggcgcaggaaaatggacccggaatgcagccccctgtgtcttccccacctctgggagcgctgaagcaggaaagctgttcccctcatcatccacaagtcctcgctcagcaaggctcaggaagctcgccgaaggctacagatattcccgcttcagccagccctccaccggtcgcgggagtaccattctttaagcagtcccccggtcaccagtcacctctggcttctcccaaagttccagtgtgtcagccccttaaggaggaagatgacgatgaaggcccagtcgacaaatccagccccggtagtccccaaagcccatcatctggcgctgaggccgctgacgaggactccaacgatagtccagcgtcatcctccagcaggcctttaaaggtaaggattaagactatcaagacatcctgtggcaatatcaccagaactgttacacaggtccctagcgaccctgaccccccagctcccctagctgagggcgcttttctggctgaagccagcctgctgaaattgagcccagcgactccgacatccgaggggcctaaggtcgtgagtgtgcaactaggcgacggcactagactaaaagggacagtgctaccagtggcgaccatccagaacgcttctaccgccatgcttatggccgctagcgttgcacgaaaggctgtagtgctgcccggtggtaccgcaacatcacccaagatgatcgctaaaaatgtcctgggtctagttcctcaggctctgcctaaggctgacggacgcgctggcctgggaacagggggacagaaagtgaatggggcttctgttgttatggtccagccctctaagacggcaactggcccttcaacagggggaggcacggttatcagtagaactcagagttctctcgtggaggccttcaacaagatattgaatagcaagaatctgctacctgcttataggcccaacctgtcccctccagcggaagcgggattggctctccctccaacaggctataggtgtcttgagtgcggggatgcgtttagtctcgagaaaagcttggcccgtcattatgataggagatcaatgagaattgaagtaacttgtaatcactgtgctagacgcctggtgttttttaacaaatgttctttactgctacacgccagggaacacaaagataaggggctggtgatgcagtgtagccacttggtcatgagacctgtggcgctcgaccagatggtcggacagcctgatattacaccgttgctgccggtcgctgtcccccctgtcagcggtccattagccttgcctgccctcgggaagggtgaaggagccattactagctcagccattactaccgtagctgctgaggcgcctgtgttaccactgagcaccgagccacccgcagcccctgctacgtccgcctatacctgctttcgctgccttgagtgtaaagaacagtgccgcgataaggcagggatggctgcacatttccagcagttaggaccaccagcgccaggggcaacaagcaatgtgtgtcctacgtgtcctatgatgcttcccaatagatgtagcttctcagctcaccagcgtatgcacaaaaatcggcctccgcacgtctgccctgagtgcgggggtaattttctacaagcaaacttccagacccatctccgcgaggcatgcctccacgtcagtaggagggttgggtatagatgtccgtcctgttcagttgtcttcggaggtgttaattccatcaagtctcacatacagaccagtcattgtgaggtgtttcacaaatgccccatttgccccatggcctttaagtcggggccaagcgcacatgcccacctgtacagccagcatccaagcttccagacccaacaggccaagttgatctacaagtgcgctatgtgtgacactgtctttacacataaacccttgttatcttcccattttgaccagcacctgttgcctcagagagtctctgttttcaaatgcccaagttgtcctcttctgttcgcccagaaaaggacaatgcttgagcacctcaagaacacacaccagagtggcagacttgaagaaaccgccggaaaaggcgcaggcggtgccctgttaacccctaaaactgagccagaggagctggccgtgagccagggtggagctgcacctgctacagaggagtcctctagcagctcagaagaggaagaggtaccttcctcccctgagccccctagacccgctaagcggccacggcgagaacttgggagtaagggcttgaagggaggcggagggggtccaggcggttggacttgcgggctctgccactcttggttccccgagcgggacgagtacgtggcacatatgaagaaggagcatgggaaaagtgtcaaaaagtttccttgcaggctgtgtgagcgctcattttgctcagcacccagccttcgccgacacgtaagagtgaatcatgagggcatcaagagagtctacccctgtcgttattgcactgagggaaagcgaacattctcctcaagattgatcctcgaaaaacatgtgcaggtaagacatgggcttcagttgggcgctcagtctccagggagaggtactactctggcaagggggtcttcggctagagctcagggaccaggtcgtaagcgacgtcagtcttccgactcatgctctgaagagccagactcgactaccccgccagctaagagcccacgcggaggcccaggctccgggggacacggacctctgaggtataggagctcttctagcactgagcagtccctcatgatggggctgagagtggaggatggagcacagcagtgtttggattgcggcctgtgtttcgcttctcctggctccctcagtcggcataggtttatatctcacaagaaacggaggggcgtcggtaaagcctccgctctggggttaggagatggagaggaggaggcaccacccagtcgcagcgaccctgacggcggtgatagccctctgccagcatcgggtggaccattaacctgcaaggtctgtggtaagagctgcgacagcccactgaacttgaagacgcatttccgcacacatgggatggccttcatccgcgcacggcagggtgcagtaggcgacaactag

SEQ ID NO: 247771 - DNA, 3714 bp, Artificial Sequence
  Description of Artificial Sequence: Synthetic coding sequence
atgggcgacatgaagacaccagattttgacgatctgcttgctgcgtttgacattccagacattgacgccaatgaagccattcacagtgggcctgaggagaacgagggacccggagggccaggcaagcccgagccaggtgtgggatcggagtctgaggacacagccgctgccagcgccggagatggaccgggagtgccggcacaagcgagtgatcacggtctcccaccacctgatatctcggtggtctctgtaatcgttaaaaacaccgtttgcccagaacagtccgaagccctggccggtgggtctgctggtgatggagcccaggccgctggagtgactaaggaggggcctgtggggcctcacaggatgcaaaatggattcggatcacccgaaccttctctacctggtactccacacagtcctgctccccctagtgggggaacctggaaggagaaaggcatggaggggaaaactccattagacttgttcgcacattttgggccagaacctggcgaccacagtgatcccctgcccccaagtgccccatcaccaactagagaaggtgctctgactcccccacccttcccctcttctttcgaactggctcaagaaaatggaccaggcatgcaaccaccagtttcttctcctccactgggagccctcaaacaggaatcttgttctcctcatcatccgcaggtcctggctcagcagggcagtggctcaagcccaaaggctacagatatccctgccagtgcatcgcctccacccgtagctggtgttccgttcttcaaacagtccccaggccatcaatcaccactcgcgtccccaaaggtccccgtttgtcaacctctaaaggaagaagacgatgacgagggccctgtggataagtcttcaccaggatccccccaatcccccagctcaggggcagaagccgctgatgaagacagtaatgatagccccgctagcagtagctcaagaccccttaaagttcgcattaagactattaagacctcttgtggaaacattacgagaacagtcactcaggtacctagcgacccagacccacccgctccgctcgccgagggtgccttcctagccgaggcctccttgctgaagctctcacccgctaccccaacttcagaagggcctaaagtcgtgtctgtgcaactgggcgatggaacccgccttaaggggactgtcttacccgttgccaccatacaaaacgcgagcaccgccatgctgatggccgcatccgttgcaaggaaggctgtggtcctgcccggtggaaccgcgacttcgcctaagatgatcgcgaaaaatgttctggggctggtgccgcaagccctacccaaagcagatgggagagctgggctgggcacagggggacagaaggtgaacggtgcttccgttgtgatggtgcagccatctaaaacagcaaccggtccttccacagggggaggaacagtcatctctagaacccaaagcagcttagtcgaagcttttaacaaaatcttgaattcaaagaacctcttgcccgcatatcgcccaaatctgtccccaccagccgaggccggactggctctaccacccactgggtaccggtgcctcgaatgcggcgacgcgttctcattggagaagtcactcgcacgacattatgatcggaggtctatgcgcattgaggttacctgtaatcactgtgccaggcgtctagtgttcttcaataagtgctccctgctgttgcatgcacgtgagcacaaggataaggggctggtaatgcagtgcagccatttggtgatgaggcctgttgctctggatcagatggtggggcagccagacatcacaccgcttctgcctgtggccgtgccccctgtaagcgggccattggccctcccggctcttggtaagggcgaaggcgctataaccagcagcgccatcacgaccgtcgccgctgaggctcctgtgctgcccctctccactgaaccccctgctgcccctgcgactagcgcctacacctgcttcagatgtcttgaatgtaaggaacagtgtagagacaaagcgggaatggctgcccacttccaacagctcggcccaccagctccgggagccacctcaaacgtgtgtcccacgtgcccaatgatgctgcctaataggtgctctttttccgcccaccaacgcatgcataagaaccgaccgcctcatgtatgcccagaatgcgggggtaacttcctccaggcgaatttccaaacacacttgcgtgaagcatgtcttcatgtcagtcgcagggtggggtatcgctgtcccagttgtagcgtcgtttttggcggagtcaactcaattaagagtcatattcagaccagccattgtgaagtgttccataaatgcccgatatgtcccatggccttcaaatcaggaccgtctgcacacgcccacttatattctcagcatcctagcttccagacacagcaagccaagctgatctataagtgcgccatgtgcgataccgtcttcacccacaagcctctgctcagctcccactttgatcagcatttgcttccacaacgtgtttccgtattcaaatgtccatcgtgccccttgctctttgcccaaaaacggacaatgctcgagcaccttaagaatactcaccagtcaggcaggcttgaggaaaccgcgggaaagggtgccggaggggctctgcttacccctaagacggagccagaggaactcgctgtttcgcaaggaggggcagccccagctacagaggaaagcagctcctctagcgaggaagaggaggtcccaagcagtcccgagcctcctcggccagccaagcggcctagaagggagctgggctcaaaagggctgaagggtggagggggaggaccagggggatggacctgcggcctgtgtcatagttggtttcctgaaagagatgagtatgtggctcacatgaagaaagagcacggtaagtctgttaagaagtttccctgtaggctttgcgagcgaagcttttgctcagccccttccctgagaagacacgtgcgtgtgaaccatgaggggatcaaacgcgtgtatccttgcagatattgtacagagggcaagagaactttctccagccgcctgatcctggaaaagcatgtacaggtgcgtcacggacttcagctgggcgcacaatctcctggacggggaacaacactggctcgagggagctcagctcgggcacagggtcccggtaggaagagacgccagtcgtcagatagttgtagcgaggagcccgacagcaccactcctcccgctaagagccctcgtgggggtccgggttctggtggccatggacctctacgctatagatcctcaagcagcaccgagcagtcacttatgatggggctacgggtggaagatggagcgcagcagtgtctcgactgcggcttgtgcttcgcttctcctggctcactctctcggcaccgctttatatcgcacaagaagcgaagaggtgtgggaaaagcgtcagcactgggtttgggggatggcgaggaggaagccccaccgagtcgatccgacccagatggcggagactctcctctacccgcaagtggaggacccctgacctgtaaagtatgtggaaagagttgtgacagccctctgaaccttaagactcacttcaggacccatggcatggcatttattcgcgcacgacagggcgctgtgggtgataattag

SEQ ID NO: 247772 - DNA, 3312 bp, Artificial Sequence
  Description of Artificial Sequence: Synthetic coding sequence
atgggtgacatgaagactccagatttcgacgaccttctggcagcatttgatatccccgatattgatgcaaatgaagccatacattctggcccagaagaaaacgagggtcctggtgggcctggcaagcccgagcccggtgtcggctccgagtccgaggacaccgcagctgccagcgccggagacggcccaggggtccctgcgcaggccagcgatcacgggctcccaccgcctgatatttccgtggtctccgtgatagtgaaaaataccgtgtgtccagaacagagcgaggccttggcaggtgggtctgctggagatggggctcaggccgcaggcgtcacaaaggagggacccgtggggccacaccggatgcagaacggcttcggcagtccagagccgtctcttccaggcacgcctcattcaccagccccacctagcggcggaacttggaaggaaaaggggatggaggggaaaacacctcttgatctctttgcgcacttcggaccagagcctggggaccacagcgacccacttccgccttcggccccttccccaaccagggaaggggcactgacccctcctccgtttccgagctcctttgagttggcacaggagaatgggcctggcatgcagccccctgtctcctcaccacccctgggcgctctgaaacaggagagctgctcaccacatcaccctcaagtgctggcccagcagggatccggctcaagtccaaaagccaccgacattccagctagcgcatccccaccacctgtcgctggtgttccatttttcaaacaaagccccggtcaccagtccccgttagcttccccgaaagtccctgtctgccagcccttgaaggaggaggacgacgatgagggaccagttgataaaagtagtcccggatctccacaaagccccagctcgggcgcagaggcagcagatgaagactccaacgactcaccagctagctctagctccaggcccctcaaggttaggataaaaaccataaaaaccagctgtggcaatattacaagaacagtgacccaggttccttctgaccccgacccgccagctcctctggccgagggtgctttccttgcggaagcatctttactgaaactgtcccccgctacccctacctcagaaggccctaaagtggtgtcagtccaactgggggatgggactcggcttaagggcactgtgctgcccgtggccaccattcaaaacgcttctactgctatgttaatggctgccagcgtcgctcggaaggcagtggtgttaccaggcggtacagccacatcacctaagatgatcgcaaaaaacgtgctgggactggttccacaggcattgcctaaggcagatggacgggcagggctcggcacaggaggccagaaagtaaatggagccagcgttgtcatggtccagccaagtaagaccgccacaggtccatccaccggaggtggcaccgtgatctcacgtactcagagtagcctagtcgaagctttcaacaagatcctgaattctaaaaacctacttccagcttaccggcctaacctgagcccgccagccgaggctgggcttgcattacccccaacagggtaccggtgcctggaatgtggggatgccttctccctggaaaaatccctggcccgtcactatgaccggaggtcaatgcgtattgaggtgacatgcaaccattgcgctcgcaggttggtcttttttaataagtgtagcctactgctccacgcaagggaacataaggacaagggactggtcatgcaatgctctcaccttgtcatgcgacccgtggcgctggaccagatggtaggccagcctgacattacaccactcctgcctgtggccgtgccacccgtttcaggcccactggcactgcctgctctaggcaaaggcgagggcgcaatcacgagctccgccatcactacggttgctgctgaggcccctgtgctgcctttatcgactgagccccctgcagccccagccacttcggcttacacttgctttcgttgtctcgaatgcaaggagcagtgtagggacaaggccggaatggccgcacattttcaacagttgggtccccctgcccctggggcaacgtccaacgtttgtccgacctgtccaatgatgctgcctaacaggtgctctttcagcgcacaccaaaggatgcataaaaatagacctccccatgtgtgccccgagtgcgggggtaattttctgcaggccaattttcagactcatctgcgtgaagcctgcctacacgttagtagacgggttggctaccgttgcccctcatgcagtgtggtattcgggggtgtaaacagcatcaaatcccacatacaaacctcgcattgtgaagtgtttcataagtgcccgatctgtccgatggccttcaaaagcggaccttctgcacatgcgcacctgtattcgcagcatccttctttccaaacccagcaggccaaactcatttacaaatgcgccatgtgcgacaccgtttttacccataaaccacttttaagctcccacttcgatcagcatctcctgccacagcgtgtgtctgtttttaaatgcccgtcctgccccctgctctttgctcaaaagcggactatgttggagcaccttaaaaacactcatcagtcaggccgacttgaggagaccgcgggtaagggggcaggaggggcactgttgaccccaaagaccgaaccggaggagctggccgtttcacaaggcggagctgcacctgctacagaagaatcaagcagcagctccgaggaagaagaggtaccgtccagtcccgaaccccctcggcctgcaaaaaggccaagacgcgagcttggcagcaaagggctgaagggcggagggggtggccctggcggatggacgtgcggactttgtcactcttggttcccagagcgcgatgagtacgtcgcgcatatgaagaaggaacatggaaagagtgtcaagaagttcccttgccggctgtgtgagagatcgttctgttccgctccatcactaaggcgtcacgttcgggtaaatcatgagggcatcaaacgggtctatccttgccgcagtaaaggtccaggactgcgagcagtgcccttacttccctcttgtcctctaccattccaggtgttgcaccggggaaagacccatctgcagcagccaccagacccacgcgaaacctgtcccggacccgctagattggcagcctgggggcctgtgccctggcccggagaccatcttggctctggattccaatgtcaaagcccaggcgctagatctgagacgcctcccgtgttttag

SEQ ID NO: 247773 - DNA, 2121 bp, Artificial Sequence
  Description of Artificial Sequence: Synthetic coding sequence
tgaactgtgttgccagtagccaccattcagaatgcttccacagccatgttgatggcggcttccgtggcgagaaaggctgtcgtcctaccaggcggaaccgcaacatctcccaagatgatcgccaaaaacgtacttggcctagttcctcaagcattacccaaagccgacgggagagccggactcggcacaggtgggcagaaagtaaacggcgcttccgtggtcatggttcaacctagtaagaccgcaaccggacctagtaccggcggtggcacagtaatcagcagaacccagtcctccctcgtcgaagccttcaacaaaatccttaacagcaagaatcttctgcccgcatatcgacccaacttaagtccacccgctgaagccggacttgcactaccacccacagggtacagatgcctggagtgcggcgacgccttcagtcttgagaagtctctggctcggcattacgatcgcaggtcaatgcgcattgaagtgacctgcaatcactgtgccaggcgacttgtatttttcaacaaatgctccctgttgttgcatgcgagggagcacaaggacaagggattagtcatgcagtgcagccacttagtcatgcgccctgtggctctcgatcaaatggtgggccagccagacattacgcccttgcttcctgttgccgtaccacccgtatccggaccattagcactaccggcactcggaaagggcgagggcgctatcacaagctctgccatcactacagtagcagcggaagcccctgtgctgcctttgtcaacagagccaccggctgcccctgcaacatccgcctacacatgcttccggtgccttgagtgtaaagagcagtgcagagataaggccggaatggcagctcattttcaacagttgggcccacccgcaccgggagcaacttcaaacgtgtgccccacgtgtcccatgatgctgcccaatagatgctctttttccgctcatcagcggatgcacaagaaccgaccgccacacgtatgccccgagtgcggaggcaactttctgcaggcgaactttcaaactcatctgcgcgaggcctgtttacatgtgtccagaagggtaggctacaggtgcccatcgtgtagtgtcgtttttggaggcgttaattccattaaatctcatattcaaaccagccattgtgaggtctttcacaaatgtcccatttgcccaatggcttttaaaagcgggccttccgcacacgcccacctgtacagccagcatcctagctttcaaacccaacaagcgaagctgatttacaagtgcgcaatgtgtgatacagttttcacccacaaacccttgttgtccagccattttgatcagcacctattaccgcagcgagtttcagttttcaaatgtccctcgtgcccactgctatttgcacagaaaaggacaatgctggagcacctcaagaacactcatcagtctggtagacttgaggagacagccggtaagggcgctgggggagccctgttaacacctaagacggaacccgaggaactggccgtctctcagggaggtgctgcgccagctaccgaggaatcttcttccagttctgaggaggaggaagtcccatcctcgcccgaacccccaaggcccgcaaaaaggccgagaagagaactgggcagtaaggggttaaaaggtggaggcggaggacccggtggatggacatgcggcctgtgtcattcctggttcccagagcgcgacgagtacgttgcacatatgaaaaaggaacacggaaaatctgtgaagaagttcccttgccgcctgtgtgagcgctcattctgctccgcacccagtctgcgcaggcacgtgagagtcaaccacgagggaattaagcgcgtatatccctgtcgaagtaagggcccagggttgagagccgtgccccttctccccagttgcccactgccattccaggttcttcatagggggaagactcaccttcagcagccgccagatcccagagaaacctgtcccggtccagcgagacttgcggcttgggggccagtaccctggccaggcgatcatctcggtagcgggttccagtgccagagccccggagccaggagcgaaacccctcctgtgttttag

SEQ ID NO: 247774 - DNA, 450 bp, Artificial Sequence
  Description of Artificial Sequence: Synthetic coding sequence
atgccttgttgctctcatcgcaggtgtcgggaggatccaggaacctccgagtcacaggagatggaagagtgggctctgcttgatatcagtcagcgaaagttatataaggaggttatgttggaaacctttcgtaatctcacatctgtgggaaagtcatggaaggaccagaacatagagtacgaatatcaaaatcccaggagaaactttcgttcactcattgagaaaaaggtcaacgaaatcaaggacgatagtcattgcggcgagactttcacacaggtgcccgacgacagattaaacttccaagaaaagaaagcgtctcccgaaatcaaaagctgtgactccttcgtgtgcggtgaggtggggctgggcaactcctcgtttaacatgaatattaggggagacatcgggcacaaggcctatgagtaccaggaatatggcccaaaaccatag

SEQ ID NO: 247775 - DNA, 1701 bp, Artificial Sequence
  Description of Artificial Sequence: Synthetic coding sequence
atgccctgctgcagccaccggagatgcagagaagatcccggaacatccgagagccaggagatggaccctgtggcctttgatgacgtggccgtaaatttcacccaagaagaatgggctttgctggacataagccagcggaagctgtacaaggaggtaatgttggagaccttccggaatcttaccagcgtcggtaagagctggaaagaccagaatattgagtacgaataccagaacccgaggcggaattttagaagccttattgagaagaaagtgaatgaaattaaagatgattctcactgtggcgagacgtttactcaggtacctgatgaccggctcaattttcaggagaaaaaggcctctccagagattaagtcctgcgatagctttgtgtgcggcgaagtcggccttggtaattcttcctttaatatgaatattcgcggagatataggccacaaagcatacgaataccaggaatatggtccaaagccctgcaaatgtcaacagcccaaaaaggcatttcggtaccacccaagctttcgtacaccacaacgtgatcatacaggggaaaagccatatgcctgcaaagaatgcggcaaaacatttatttcgcatagttcaattcagcggcatgtggtgatgcattcgggggacgggccttataaatgtaaattttgtggtaaagctttccactgcctgagtctgtacctgatccatgagcgcatccacaccggtgaaaagccttacgagtgcaaacagtgtggcaaaagcttcagctactccgcaaccctgcgtatccacgaaagaacccatacaggcgaaaagccgtacgaatgtcagcagtgcgggaaggctttccattctccaaggtgctatcggcgtcacgagcgaatccacacgggagaaaaagcgtatcaatgcaaggagtgcggaaaggcattcacctgccctcaatacgtgaggattcacgagcgcactcatagtaggaaaaagccctacgagtgtacccagtgtggaaaagccctctcgtctcttacatcctttcagacacatatccgcatgcactccggagagagaccgtacgagtgcaaaatctgtgggaaaggcttttgctccgctaactccttccaacgacacgagaaaacgcactcgggcgagaagccctacaagtgcaaacaatgcggcaaagcgtttattcatagctctagcttaaggtatcatgaaaggatccatacaggtgagaagccttatgagtgcaagcagtgtggaaaagccttccgaagcagctcacatctgcagctccacgggagaacccatacaggcgaaaaaccctacgaatgtcaggaatgtggtaaggccttcaggagtatgaagaacctgcagagccacgaacggacacagacacacgtgcgcattcatagcggcgagaggccctacaagtgcaagctatgcgggaaaggattttactgtcccaaaagtctacagcgacatgagaagacccacactggtgagaagctgtatgagtgcaaacagtgcggggaagcatttagttcttcgagcagctttcgatatcacgagaggactcacacgggtgagaagccatataagtgcaaacaatgtggaaaagcatttcgggctgccagtgtcctgaggatgcacggcaggactcacccagaggataaaccttatgagtgcaaacaatag

SEQ ID NO: 247776 - DNA, 2061 bp, Artificial Sequence
  Description of Artificial Sequence: Synthetic coding sequence
atggaagtagtcacattcggcgatgttgctgttcacttttctagagaggagtggcagtgcctggatcccggacagagggctctctatagagaggtaatgctggagaaccactcctctgtggccggtttagccggtttcctcgtatttaaacctgagctcatttcgaggcttgagcagggagaggaaccatgggtcctggatctgcagggtgcagagggcactgaggcccctcggacatcaaagacagacagtacaatccgcactgaaaacgagcaggcatgcgaggacatggatatcctgaagagtgagtcctacggcactgtggttaggatcagtccccaggatttcccacagaacccgggatttggcgacgtgagtgacagcgaagtgtggctagacagtcacttaggctcaccgggtttgaaggtcactggattcacattccagaataactgcctcaatgaggaaaccgtggtcccaaagaccttcaccaaagacgctccccagggatgcaaggagctggggtcctctggcctggattgccagccactcgagtcccagggcgagagtgccgaaggtatgagccaacggtgtgaggaatgtggtaaaggaataagagcaactagcgacatcgccctgcattgggaaatcaatacccaaaagatctccagatgtcaggaatgccagaaaaagctgtctgactgcctccaaggcaagcataccaataattgtcatggggagaaaccttacgagtgtgctgagtgtggcaaagtgtttaggctatgctcgcagctgaatcagcaccagagaattcatactggcgaaaaaccttttaagtgcacagaatgcggaaaggcatttcgcctgtcctccaagctgattcagcatcaaaggattcacaccggcgaaaagccctaccgttgtgaagaatgcggcaaggccttcggccagtctagctcattgatccaccatcagaggatccatactggggaacgaccctacggctgtcgcgaatgtggtaaggcattctcacaacaatcacagctggtgcgccatcagagaacgcacactggcgagcgaccatatccatgcaaagagtgtggtaaggcattttcccagtccagtaccttggctcagcaccagcggatgcataccggcgaaaaggcacaaatcttaaaagcaagtgattcaccatcactggtggcccaccagaggatccacgccgtggaaaaaccttttaagtgcgacgagtgtggaaaggcatttcgctggatttcgagattgagccagcatcagctgattcacacaggtgaaaagccttataagtgcaataagtgtaccaaggcctttggatgctcttcgaggttgattagacaccagcggactcacactggcgagaagccctttaagtgcgacgaatgtggtaagggatttgtccagggaagccatttaattcagcatcagcgtatccataccggtgaaaagccttacgtttgtaacgattgcgggaaggccttctcgcagtctagttctctcatctatcaccagcggatccataagggagaaaagccttacgagtgcctacagtgtgggaaagccttctcgatgtctacacagctcacgattcaccagcgcgtccacacaggggagagaccttataagtgtaatgagtgtggcaaggccttttcacagaactccaccctcttccaacaccaaatcatccatgcaggggtgaaaccttacgagtgcagcgagtgtggcaaagctttttcacgcagtagctatttaatcgaacatcagaggatccatacgcgggcacagtggttttacgaatacggtaatgctctcgaagggtccactttcgttagccggaagaaggtgaacactatcaagaagctccatcagtgtgaggactgcgagaaaatcttccgctggcgaagccatctcatcattcatcaaaggatacatacaggtgaaaagccttataagtgtaatgattgtggtaaagcgtttaatcgtagttccagattaactcaacatcagaagatccatatgggatag

SEQ ID NO: 247777 - DNA, 2094 bp, Artificial Sequence
  Description of Artificial Sequence: Synthetic coding sequence
atgggttttctcgggtgctggtgcgtatccttccaggaggtggtgaccttcggcgacgtggcagtgcactttagccgcgaggaatggcagtgcctcgatccgggacagcgggctttgtatagggaagtcatgcttgagaaccattcatcagtggctggcctcgccggtttcctggtgtttaaacccgagctcatttcacggctcgagcaaggggaggaaccttgggtgctggatctgcagggtgcggagggaacggaagcacccagaacatcgaagaccgactccacaataaggactgagaatgaacaggcctgtgaagacatggatatactcaaaagcgaaagttacgggaccgtggtcaggattagtccacaggactttccacaaaatccaggctttggcgacgtgagcgactccgaggtttggctggactctcaccttgggagccctggcttgaaggtcaccgggttcacctttcagaataactgcctgaacgaagagactgtggtgcccaaaacattcactaaggatgccccacagggatgtaaagagctcggcagctccggcctggattgccagcccctcgaatctcagggcgagtctgccgaggggatgtcacagagatgcgaagagtgtgggaagggcattcgagccaccagcgatattgcccttcactgggaaatcaatacgcagaagattagtcgttgccaggaatgtcagaaaaagctgagcgattgcctccagggcaaacacaccaataactgtcatggtgagaagccgtatgagtgtgccgagtgcggaaaggtgttcagactgtgtagccagctcaaccagcatcagcgcattcacactggagagaagccatttaagtgcacagagtgcggtaaggctttccggttgtcttctaagctaatacaacaccagcgcatacatactggagagaaaccctaccggtgcgaggagtgcggaaaagctttcgggcagtcatcctccctgatccaccaccagcggatccacaccggcgaacggccttatggatgccgagaatgtggaaaggcctttagtcagcagtcacagctcgtgcgccatcaaaggacccacacaggagagcggccatatccctgtaaagagtgcggaaaagctttttctcagtccagtacactggcccagcatcagcgaatgcacactggggaaaaggcgcagatactcaaggctagcgattctccatcactggtggcacatcagcggatccatgcagtagagaaaccgttcaaatgcgatgagtgcggaaaggcatttcgctggatatcccggttgtcccaacaccagttaatccacacaggcgaaaagccttacaagtgcaacaaatgcacgaaggctttcggctgttccagcagactgatccgacaccaaagaacccataccggtgagaagcccttcaaatgcgatgagtgcggcaagggcttcgtgcagggctcccacttgatccagcatcagcgaatccataccggggaaaaaccttacgtgtgtaacgattgcggaaaggccttctctcaatcctcctcactgatctatcaccagaggatccacaagggagaaaaaccctacgagtgtctgcaatgtggaaaagccttcagcatgtccacacaactgacaattcaccagcgggtgcacactggcgagcggccatacaagtgtaacgaatgtggcaaagctttcagccagaattctacactcttccagcaccagataatccacgctggtgtgaagccttatgaatgttctgaatgcgggaaggcatttagccgatcatcataccttatcgaacaccagaggatccatacgcgagctcagtggttttacgaatacggcaatgctttagaaggctccactttcgtgtcccgcaaaaaggtcaataccatcaaaaagctccatcagtgcgaagactgcgagaaaatcttccgctggcggagtcacctgatcattcaccagcgcattcacactggtgagaagccatacaagtgtaatgactgcgggaaggcctttaaccggtcatctcgtctgacccagcaccagaaaatccacatgggatag

SEQ ID NO: 247778 - DNA, 447 bp, Artificial Sequence
  Description of Artificial Sequence: Synthetic coding sequence
atggaagtggtgacctttggagatgttgccgtccacttttcccgtgaggagtggcagtgcctggatcccggacagagagctctgtaccgcgaggttatgttggaaaatcacagcagcgtcgcgggtctcgctggttttctggtgttcaaaccagaactcatttcccgcctagagcagggagaggaaccatgggttctggacctccagggcgctgaaggcacggaggcacctagaactagcaaaaccggattcctgggacgaccgaccatggggcaggaaccacggcacccgcacgcccctccagccaccccagttcctgggctgcccaagcattgtagtcagcggctaaccttaccaccgccaggtctgtcctcctcgccactgggccacttcttagtgcacgatcaggatagaagacgagggacaagcgcaatttggatggtgtag

SEQ ID NO: 247779 - DNA, 2061 bp, Artificial Sequence
  Description of Artificial Sequence: Synthetic coding sequence
atggaggtggtgaccttcggagatgtcgcagtacactttagtcgggaggaatggcagtgtcttgatccaggccagagggcactgtaccgggaagtcatgctggaaaaccacagctcagtcgccggactggctgggtttctcgtttttaaaccagagttaataagtcgattggaacaaggcgaggagccctgggttttagacttgcagggcgctgaggggactgaggccccaaggacttctaaaacagactccactattcgcacagagaacgaacaggcttgcgaggacatggatattctcaagtccgaatcatacggcactgttgttcgaatatctccacaagactttccccagaatcccggatttggagatgtgagcgatagcgaagtctggctggacagtcacttgggttctcccggactcaaggtgacaggctttacttttcagaataactgcctcaatgaggagacagtggtgcctaaaaccttcaccaaggatgcgccacagggttgtaaggagctcggtagcagtggattggattgtcagcccctggagtcccagggagagagcgccgaaggaatgagccagagatgtgaggaatgtggaaaagggataagagcgacctccgatatcgccctgcattgggaaatcaatacccagaagatttccagatgccaagaatgccagaagaagctgtctgactgcttacagggtaaacacaccaacaactgccacggtgaaaagccttacgagtgcgcagagtgtggaaaggtttttagactgtgctcacaactgaatcagcatcaaagaatacacacaggcgagaagcccttcaagtgtacggaatgcggcaaggccttcagactttcaagcaagcttatccaacatcaaagaattcacactggtgaaaagccataccggtgtgaagaatgtggcaaagcattcggacagagctcatccctgatccaccaccagaggattcacaccggcgagcgcccatacggatgcagggaatgcggaaaggccttcagccagcagtctcaactagtgaggcatcagcgaacacatacaggggaacgaccctatccgtgtaaagagtgtggcaaagccttcagccaaagcagcacattggcccaacatcaaagaatgcacaccggggaaaaggctcagatactcaaagcatcagattcaccttccctggtggcacaccaacgaattcacgccgtggagaagccttttaagtgcgacgagtgtgggaaagcttttagatggatctctcgtctctctcagcaccagcttatccatacaggcgaaaagccctataagtgtaataagtgcacaaaagcctttgggtgttcatccaggcttattaggcatcagcggactcatactggagaaaagccttttaagtgcgacgagtgtggcaagggtttcgtccaggggagtcacttaatccagcatcagagaattcatacaggggaaaagccatatgtgtgtaacgattgtggcaaagcgttcagccagtcaagtagcttgatatatcaccagcgcatccataaaggagagaagccgtatgaatgcctccagtgcggcaaagcgttctccatgagcacccagttgacgattcaccagagagtccacacaggggagcgcccttataagtgtaatgagtgtggtaaagcctttagccagaacagcactctttttcagcaccagattattcatgcaggggtcaagccttacgaatgcagcgagtgtgggaaggctttctcaagatctagctacctgattgagcaccagcggatccacacacgggcacagtggttttatgaatatggaaacgcattggaggggtcaaccttcgtgtctaggaagaaggtgaatactatcaaaaagttgcatcagtgtgaagactgtgaaaagatctttaggtggcgaagtcatttgatcatccaccagcgcatccacaccggcgaaaagccatataagtgcaacgattgcggcaaggcattcaaccggtccagccgtctcacacaacatcaaaagatccacatggggtag

SEQ ID NO: 247780 - DNA, 1773 bp, Artificial Sequence
  Description of Artificial Sequence: Synthetic coding sequence
atggatattctaaaatcagagtcctacggaacagtcgttcgcatttcaccccaagactttcctcaaaatccaggattcggcgacgtctcggatagcgaagtgtggctggactcccacctgggatcaccgggtctgaaggtgaccggatttacatttcagaacaactgcctgaacgaggaaactgtcgtgcccaaaacctttactaaagatgcaccgcaaggttgcaaggaactcggaagctctggcctggattgccaacctctggaaagtcagggcgagtccgccgaaggtatgagccagcggtgtgaggaatgtggcaaaggtatacgagccacctccgatattgcgctccattgggagataaatacccagaagatcagccggtgtcaggagtgccagaaaaagctgagtgattgcctgcagggcaaacacactaacaattgtcacggcgagaaaccatacgagtgtgccgagtgcgggaaggtctttaggctctgctcccagctgaaccagcatcaaagaattcacacgggggaaaaaccattcaagtgcacggagtgtggaaaagccttcagattatcttccaaattgattcagcatcagaggatacataccggagaaaagccgtacagatgtgaagaatgcggcaaggctttcggccagtcctccagtctcatccatcatcagcgcatccatactggcgaaagaccctatggatgcagggaatgtggaaaggccttttcgcagcagtctcagttggtaagacatcaaagaacacatactggcgaacgcccttatccttgcaaggaatgcggcaaggctttcagtcagagcagtactctggcacagcaccagaggatgcacactggcgagaaggcccagattctgaaagcctcagatagtcccagcctcgtggcgcatcagcgaattcacgctgtagaaaaaccatttaaatgcgatgagtgcggcaaggcgttcagatggatctctcgcctgtcccaacaccagctcatccacactggagaaaagccgtacaaatgtaacaaatgcactaaggccttcggctgctcctctcggctaatacggcaccagcgaacacataccggcgaaaagccattcaaatgtgacgaatgcgggaaaggttttgtgcagggttcccatctgattcagcatcagaggatacacaccggagaaaagccctatgtgtgcaacgattgtgggaaggcctttagtcagagctcctcacttatctaccaccaacgcatacacaaaggtgagaagccctatgagtgccttcaatgtggaaaggccttctccatgtccacacagttaaccatccaccaacgggtccacaccggtgagaggccttataagtgtaacgaatgcggaaaggccttttctcaaaacagtacactgttccagcaccagatcatccacgcgggagtgaagccctatgagtgctctgagtgcgggaaagctttctccaggtcctcctatcttatcgagcaccagaggattcacacgagagcgcaatggttttacgagtacgggaacgccttagaaggcagcacatttgtcagcagaaaaaaagtgaacacaatcaagaagctgcaccagtgtgaggattgcgagaagattttcaggtggagatcacacttaattatccaccagaggattcacactggagagaagccatacaaatgcaacgactgcggcaaggcatttaatagatcgtctcggctgactcagcaccagaaaatccacatgggctag

SEQ ID NO: 247781 - DNA, 1470 bp, Artificial Sequence
  Description of Artificial Sequence: Synthetic coding sequence
atgaaggagctagaccctaaaaacgacatttcggaagacaagttgagcgttgtcggggaggccacagggggaccaacccggaatggggctcgcggtcctggctcagagggggtgtgggaaccaggctcctggccagaacgccctaggggagacgcaggagctgagtgggagccactggggatcccccaggggaacaagctgctcggcggttccgtgcctgcgtgtcatgaactgaaagcattcgcaaatcagggctgcgtattggtgcctccacggctggatgatcctaccgaaaagggtgcatgtcctcccgttcgaaggggcaaaaatttctcctccaccagtgacttgagcaaacccccaatgccgtgtgaggagaaaaagacctatgattgcagtgaatgtggcaaagcctttagtcggagctctagcctgatcaagcaccagagaattcacactggggagaagcccttcgaatgcgatacgtgcggaaagcatttcatcgagcgatcttccctgactattcatcagcgcgttcataccggagaaaagccctacgcctgtggcgattgcgggaaggcattctcccagcgaatgaacctgactgtgcaccagcgaactcacacaggagagaaaccgtatgtttgtgacgtgtgcggaaaggcttttcgcaaaactagtagcctgacccagcatgagcgaatacacacaggcgagaaaccctacgcctgcggagactgcggaaaggctttcagtcaaaatatgcatcttattgtgcaccagagaacacacaccggcgaaaaaccttacgtttgccctgaatgcgggagagcgtttagccagaacatgcatctaaccgaacatcaacgtacacatactggagagaagccctacgcttgtaaggagtgcggcaaagctttcaataaatccagctccttgacactgcatcaacggaatcatacgggggaaaaaccctacgtgtgtggcgaatgtggaaaggccttttcccagagcagctatctgatccagcaccagaggttccatattggagtgaagcccttcgaatgttctgaatgcggcaaggccttctcaaagaatagttccctcacacagcaccagcggatccataccggcgagaagccttacgagtgttacatctgcaagaagcacttcactggtcgcagttctctgatagttcatcaaatcgtgcatacaggcgagaagccatatgtctgtggcgagtgtggaaaagcttttagtcagtcggcgtacctgatcgaacaccagcgaatccacacgggggagaagccctatcggtgtggacagtgtggaaagtcattcattaagaactcgtctctaacggtccaccagaggatccacacgggagagaaaccctataggtgtggtgagtgcggcaaaaccttctcaaggaataccaacttgaccaggcatctgagaatacatacgtag

SEQ ID NO: 247782 - DNA, 2286 bp, Artificial Sequence
  Description of Artificial Sequence: Synthetic coding sequence
atggattcgggaggaggtagtctgggcctacacacccctgatagccggatggcccacacaatgataatgcaggactttgtagcgggaatggctgggactgcccacatagatggcgaccatatcgtcgtatcagtgcccgaggcggtccttgtgagtgatgttgtgacggacgacggcattacactggaccatggcctagcagccgaagttgtgcacggcccagacattatcacagaaactgacgttgttacagagggcgtaatcgtgcccgaggccgtcctcgaggctgacgttgctatcgaggaggatctagaggaggacgacggggatcacatcctaactagcgagctcattaccgaaactgtccgggtgcctgaacaggtgtttgtcgccgacctcgtgacaggaccaaatggtcacttagaacatgtagtgcaagactgtgtatctggcgttgattccccaacaatggtgtcagaggaggtcctcgttaccaatagcgacacggagacagttatccaggctgccggaggggtgccaggaagcaccgtgacgattaaaaccgaagacgacgatgacgacgacgttaaaagtacatctgaggattacctcatgatcagtctggacgatgtcggagaaaaactggaacatatgggcaacaccccactgaagatcggttccgatggaagccaggaagacgccaaggaagacgggtttggcagtgaagtgattaaagtgtatatctttaaagctgaagccgaggacgacgtggaaatcggcggtaccgaaatcgtgaccgaatccgaatatacctcaggacacagcgtcgcgggtgtcctggatcagagcagaatgcagagggagaagatggtgtatatggcagtgaaagatagtagccaagaggaggacgatatccgcgatgaacggcgtgtgtcaaggaggtacgaggactgtcaggctagcgggaatacactggactctgctttagaaagcagatcaagtacagctgcccagtacctgcagatttgcgatgggatcaataccaacaaggtccttaagcagaaagctaaaaaacgaaggcgaggagaaaccaggcaatggcagaccgcagtcatcatcggtcctgatggccagccactgactgtctatccctgtcatatatgtactaagaagttcaaatcacgaggttttctgaaacggcacatgaagaaccatccggaccatctgatgcggaagaagtaccagtgcaccgactgcgatttcacaaccaataagaaggtttccttccataatcatctggaatctcataagctaataaacaaggtggataagactcacgagtttaccgaatacactcgcagatatcgcgaagcatcccccttaagttctaataagttaatcttgcgggacaaagaaccgaagatgcataagtgtaagtactgtgattatgaaaccgctgaacagggattgttgaatcgacacctgctggccgtgcatagcaaaaactttccacatgtgtgtgtcgaatgtgggaaggggtttagacaccctagtgagctgaagaaacacatgagaacacatacgggggaaaagccctatcaatgccaatattgcattttcaggtgcgccgaccagagcaacctgaaaacgcatatcaaatcgaagcacggaaacaatctaccgtataagtgtgaacactgccctcaggcgtttggagacgagcgagagttgcagaggcacctcgatctgtttcaaggccacaagactcaccaatgccctcattgcgaccacaagtccaccaattcttctgacctgaaacgtcacattatttcagtgcatactaaggactttccccacaagtgcgaagtgtgtgacaaaggctttcaccggccatcagagttaaaaaagcattccgacatccataaggggaggaaaatccaccagtgcagacactgtgacttcaagacaagtgaccccttcatcctgtctggacacattctctctgtacacaccaaggatcagcccttaaaatgcaagcgttgtaagagaggatttcgccagcagaacgagttgaaaaagcatatgaagacccatactggccgtaagatctaccagtgcgagtactgtgagtactccactactgacgcctctgggttcaaaaggcacgtcataagtatacacacaaaagactacccccaccgctgtgaattttgcaagaaaggttttcggcgacccagcgagaagaaccaacacattatgagacaccataaagaggctctgatgtag

SEQ ID NO: 247783 - DNA, 2286 bp, Artificial Sequence
  Description of Artificial Sequence: Synthetic coding sequence
atggacagtgggggaggatcactgggcctccatacgccagacagtagaatggcgcatacaatgataatgcaagattttgtagccggaatggccggtaccgcacacatagacggggatcatatcgtcgtttccgtacctgaggctgtgttggtgagcgatgtggttacagatgatggcatcacactagatcacgggttggccgcagaggtcgtgcacggtcctgacatcatcaccgaaactgatgtggtgactgaaggcgtaattgtacctgaggctgtcctcgaagccgacgtggccatcgaggaggacctcgaggaggatgatggcgaccatatactgaccagtgaacttatcaccgagacggtgagagtgcctgagcaggtgttcgtcgctgaccttgtgaccggccctaatggccacctcgagcatgttgttcaagattgtgttagcggggtggactctcctactatggtgtccgaggaagtgctcgtaactaattctgataccgagacagtgatccaagccgcagggggagtgccgggatctactgtgaccatcaaaaccgaagatgacgacgacgatgatgtaaaatctacatctgaagactatcttatgatctctctggatgatgtgggagagaagctggaacacatgggcaatactcccctcaagatcggatcggatggaagccaagaggatgctaaggaagacggctttggatctgaggttattaaggtgtatatcttcaaggccgaggccgaagacgatgtcgaaataggcggaactgagattgtgacagagagcgaatacacttcaggtcactcagtcgcaggagtcctagatcagtcccggatgcagcgagagaagatggtctatatggccgtgaaagactcttcacaggaagaagacgatattcgggatgaacgacgtgtgtccagacgatatgaggactgccaagccagcggaaatacactggactccgcattagagagcaggagctcgactgccgcacagtatctccagatttgcgacggcattaacactaataaagtccttaaacaaaaggccaagaagcggagaagaggagaaacaaggcagtggcagacagccgtgattatcggccctgacggacaaccgctgaccgtgtacccttgccatatttgcactaagaagtttaagtcccgcggtttcctgaagcgacacatgaagaaccaccccgaccacctgatgcgcaagaagtatcagtgcacagattgtgatttcacaacaaacaaaaaagttagctttcataatcacctcgaaagccacaagctaattaataaggtcgacaagacccacgagtttactgagtatactaggcggtatagggaagccagtccactgtccagcaacaaacttatcctacgtgataaggagcctaaaatgcacaagtgcaagtattgcgattatgaaaccgcggagcagggtctgctgaacagacacctcttagccgttcacagcaagaatttcccacatgtgtgtgtggagtgtggcaaaggcttccgccatccttctgaactgaaaaaacacatgcgcacacacactggagagaagccataccaatgtcagtactgcattttcaggtgtgccgatcagtcgaacctgaagacgcacatcaagtccaagcacggtaataatctgccttacaaatgcgagcactgccctcaagcctttggagatgagcgggagctgcagcgccacttggatcttttccaaggacataagacccatcaatgtccacactgtgatcacaagtctacgaactcctcagatctgaagcgccacattattagtgtgcatacaaaggattttcctcacaaatgcgaagtctgtgacaagggcttccaccgtccatcagagttgaagaagcactccgacatacacaagggacgtaagattcatcaatgtaggcactgtgattttaaaacaagcgacccatttattttaagcggccacattctatccgtacatactaaagaccagccactgaagtgcaaacgttgtaaaagagggttccgtcagcaaaacgagttgaagaagcatatgaagacacatacgggacgcaagatctatcagtgtgagtactgtgagtatagcaccactgatgcctcagggttcaagaggcacgtgatttccattcatacaaaggactatccgcaccgctgtgaattttgtaagaaagggttccgaaggccaagtgaaaagaaccagcacattatgcggcaccacaaagaagccctaatgtag

SEQ ID NO: 247784 - DNA, 2310 bp, Artificial Sequence
  Description of Artificial Sequence: Synthetic coding sequence
atgcaagattttgtagctggcatggcaggcacagcacacatcgatggcgatcatatagtggtgagtgtacctgaagccgtgctggtttccgacgtggtaactgatgatggaatcaccctagaccacggtctagccgctgaagttgtgcacggtcccgacatcataaccgaaaccgacgtcgtgaccgagggtgtgatagtgccagaggctgtgctcgaggctgacgtcgcgattgaggaagatttagaagaggatgatggcgaccatatactgacaagcgaattaatcaccgagacggtcagagtccccgagcaggtcttcgtggccgacctggtaaccggtcccaatggccacttagagcacgtcgttcaggactgtgtgagcggggtggattcgccaactatggtatcagaggaggtgctcgtcactaactccgatacagagacggtaatccaggcagctggtggagttcccggttccaccgttactattaaaactgaggatgacgacgatgatgacgttaagagcactagtgaagattacctgatgatcagcctcgacgatgtgggcgagaagctggagcatatgggaaatactcctttaaaaatcgggtcggacggcagccaggaagatgctaaggaagatgggttcggctccgaggtgatcaaagtatatatatttaaggcggaggccgaggacgatgtcgaaatcgggggaaccgaaatagtgactgagtccgagtataccagcgggcactctgtggctggcgtgctcgaccaaagccgaatgcaacgggaaaagatggtgtacatggctgtgaaagactctagtcaagaggaggatgacatttcctgcgcagagattgcagacgaggtgtacatggaggtaattgtgggagaagaggaggggacttccttgcccgagattcagcttgaggattccgacgtcaataaaacagtggtccccgtcgtgtgggctgccgcttatgggaacaccctggactccgcactggagtctaggtctagcacagcagcccagtatctccagatctgtgacggaattaacacgaataaggtgctgaagcagaaggcaaagaaaaggaggcgcggagagacccggcaatggcagactgctgttattattgggcctgacggccagcccttgaccgtgtatccttgccacatctgcacaaaaaagtttaagtcccggggatttttaaaacggcacatgaagaaccaccctgatcacctgatgagaaaaaagtatcagtgcacagattgtgacttcaccacaaataagaaggtgtcatttcacaaccacttggaatcccataaactgataaacaaagtggacaagactcatgagtttacagaatacactcgccgttaccgggaagcctcccctctttcttccaacaaactgatactccgggataaggagcccaaaatgcacaaatgtaagtactgcgactacgagactgccgagcaagggctgctgaatcggcacctgttagccgtgcactcaaaaaactttcctcacgtgtgtgtggaatgcggtaagggatttcgacacccaagtgagttgaaaaagcatatgcggacccataccggcgagaagccgtaccagtgccagtactgcatattcagatgcgcagatcagtctaatcttaaaactcacatcaagagcaagcatggcaacaatttgccttacaagtgtgagcattgtccacaggcgtttggagacgagcgagagctgcagcgtcacctagatttatttcagggccacaaaacccaccagtgtccccattgcgaccacaagtccacaaactcttccgatctcaagcgacacatcatatctgttcataccaaggattttccgcataaatgcgaagtctgtgataagggatttcaccgcccttctgaacttaaaaagcattcagacatacacaaaggcaggaagattcaccagtgtcgtcattgtgactttaagacttctgacccgtttatcctgagtggacatattctgagcgtccatacgaaagatcaacctctgaagtgcaaacgatgcaagagaggctttcggcaacagaacgagctaaaaaagcatatgaagactcatacaggtcgaaaaatttaccagtgtgagtattgcgagtattccaccactgacgctagtgggtttaagagacatgtcatttcgattcacactaaagattaccctcaccgatgtgagttttgtaagaaaggattccggaggccttccgaaaagaaccagcacataatgcgtcatcacaaagaggctttgatgtag

SEQ ID NO: 247785 - DNA, 1812 bp, Artificial Sequence
  Description of Artificial Sequence: Synthetic coding sequence
atgatatccctcgatgatgtcggagagaaactggagcacatgggaaatacaccactgaagatcgggtcagacggaagccaggaggatgctaaagaagatggttttggatctgaagttatcaaagtttacatctttaaggcggaagcagaggatgatgttgaaatagggggtacagagatcgtcaccgaatctgagtatacatcaggccattcagtggccggagtgctcgaccagtcaagaatgcagagagaaaagatggtctacatggctgtgaaggattcatcccaggaagaggatgatatctcttgcgccgagattgcagatgaagtatacatggaggtaatcgtgggcgaggaggaggggacatcattgccggagatccaactcgaggatagcgatgtgaataagactgtggtccccgtggtttgggccgctgcatacggcgatgagcggagggtctcacggcgatacgaggactgtcaggcctccgggaacacactggactcagcgctggaaagtcggtcttcaactgcagcccaatatctgcagatctgcgatggcatcaacaccaataaagtcttgaagcagaaagcaaaaaaaagaagaaggggagaaaccagacagtggcaaacagctgtcataatcggtcctgacgggcagcccctgacagtttatccctgtcacatttgtactaaaaagtttaagagccgcggatttttgaagcgacatatgaagaatcatccggaccacctgatgcgcaaaaagtaccagtgcactgactgcgacttcactaccaataaaaaggtgtcctttcataaccaccttgaatctcacaagctgattaacaaagttgacaaaacacacgaatttaccgagtataccagaaggtatagagaggcgtccccactgagcagcaataaactaattcttcgggataaagagccgaagatgcataaatgtaaatactgcgactacgagacagctgagcaaggactgcttaacaggcatctgttagcggtacactccaagaattttccccatgtgtgtgtggagtgcggtaaaggattcaggcatccttcagaactcaagaagcacatgaggacccacaccggagagaaaccttatcagtgccagtactgtatttttagatgtgccgaccaaagcaacctgaaaactcatattaaatccaagcacggcaataatcttccatataaatgtgagcattgccctcaggcctttggggatgagagggagctgcagagacacctggatctgtttcagggacacaaaactcaccagtgcccgcattgcgaccataagagcactaacagcagtgacctgaaacgccacatcatctctgtccacacgaaagatttcccacataagtgtgaagtctgtgataagggattccaccggccatcagaactcaaaaaacactctgatatacataaaggacggaagatccatcagtgccgccattgtgacttcaagacctcggacccttttattttatcaggccatatcctgtctgtacacacaaaggatcagcccctgaagtgcaaacggtgtaaaagggggtttagacaacagaacgaattaaaaaagcacatgaagacgcatacgggtagaaaaatctaccagtgcgaatattgtgagtacagcactaccgatgcttcaggtttcaaacggcacgtgatctcgatccacaccaaggactacccccaccggtgcgagttttgtaaaaagggattccgccgaccctccgagaagaatcagcatataatgaggcatcacaaagaagctttgatgtag

SEQ ID NO: 247786 - DNA, 1611 bp, Artificial Sequence
  Description of Artificial Sequence: Synthetic coding sequence
atgggccctcttcagtttagggatgttgccatagagttctcactcgaggagtggcactgcctggacaccgctcagaggaacctctatcgcaatgttatgctggagaattatagaaatttagtgttcttgggcatcgtggtgagcaaaccagatttgatcacatgtctggagcaaggaaagaaaccactgactatgaaaaaacacgagatggtggcaaaccccagcgtgacttgtagtcatttcgccagagatctatggccagagcagtccatcaaggatagtttccaaaaagtgacccttcgtagatacgaaaactatggtcacgacaatttgcagttcaagaaaggatgtgaatccgtagacgagtgtaaggtccacaagagggggtataacgggctaaatcagtacctcacaacaacacagtctaaaatttttcaatgcgacaaatacgtcaaggttattcacaagtttagtaacagtaataggcataagatccgccacactggcaaaaaaccgttcaagtgtattgaatgcgggaaagcgttcaatcagagttctacactcaccactcataaaaaaatccacacaggcgagaaacccttcaaatgtgaggagtgcggaaaagcttttaattggtcctcccatctgacaacacacaaacgtatccacacaggggagaaacgttacaagtgtgaagactgcgggaaggcgttctcccgatttagttatctgacggcacacaagataattcattccggtgagaagccatacaaatgcgaggagtgcggaaaggctttcaaacggagctccaatttgacaacacacaagatcatccatactggtgagaaaccgtacaagtgtgaggaatgtggtaaggccttcaagagatctagtatcctcacagcacacaaaatcatccacagcggagaaaagccatataagtgtgaggagtgtggaaaggcattcaagcacccatctgtgctgacaacccataaacgcatccacacaggcgagaagccatataagtgtgaggagtgtggaagagcattcaagtacttcagtagccttaccacccataagattatccattcaggggaaaagccttataagtgtgaggagtgtggtaaggcgttcaattggtcctcgcacctgaccacccataagaggatccacaccggggagaagccatataagtgcgaagaatgcggagaagcattcaagtatagctctagcctgaccacccacaagatcatccacaccggacagcaaccgtttaagtgtgaggaatgcggcaaggcatttaagtgtttctctatcctgaccacacacaagcggatccacaccggcgagaagccatataaatgtgaggaatgtggcaaggcttttaattcctccagtcatttaacagctcataaacggatccataccggtgagaagccttataagtgcgagcgttgcggaaaggcttttaagcggagcttcatcctaactcgccacaaacgcattcacaccggcgaaaaaccgtacaaatgcgaggaatgcggaaagggctttaagtgtccctccactctgacaacacacaaagttattcatacaggcgaaaagttatag

SEQ ID NO: 247787 - DNA, 1935 bp, Artificial Sequence
  Description of Artificial Sequence: Synthetic coding sequence
atggagattcctgcaccagagccagaaaagacagccctgtcaagccaggatcctgcccttagtctgaaagagaacctggaagacatcagtgggtgggggctacctgaagccaggtcaaaagaatccgtgagcttcaaggatgtggctgtcgactttactcaggaggagtgggggcagctggacagtcctcagcgggctttgtatagagacgtgatgctggagaattatcagaatttgcttgccctggggcctcctttgcacaagccagacgtcatttctcatcttgagcgaggggaggagccatggagcatgcagagagaagtcccccgtggtccctgtccagaatgggagcttaaggccgtgccctcccagcaacagggcatatgcaaggaggaacccgcacaggaacccattatggagcggccactcggcggagctcaggcttggggcagacaggcgggagccctccagagatctcaagccgctccatgggctccggctccagcgatggtctgggacgtgcccgtggaggaatttcccctcaggtgccctctgtttgctcagcagagagtgcctgagggtggcccattgttagatactcggaagaacgtccaggcaacagaaggaagaacaaaggctcccgcacgcctttgtgcaggggagaatgccagcactccttctgagcctgaaaaattcccgcaagtacgtaggcagcggggagctggtgctggggaaggggagtttgtctgtggtgaatgcggcaaggcttttagacagtcttcgtcactaacactgcaccggcgttggcatagtcgagaaaaggcctacaaatgcgatgagtgcgggaaggctttcacatggagcactaatctcctggagcatcgcagaatccacactggggagaagccgtttttttgcggggaatgcggtaaagcctttagttgccacagttccctaaatgtgcaccaaagaatacataccggcgaaagaccttataagtgctcagcgtgcgagaaggccttcagctgttcatccctcctgtctatgcatctgagagtgcacaccggcgaaaagccatacaggtgcggcgaatgtggcaaggctttcaaccagaggacgcacctcacgagacatcacagaattcatacaggcgaaaaaccctaccaatgtggctcctgcggaaaggctttcacatgccatagttctcttactgtccatgagaagatccattctggagacaaacccttcaaatgttcagattgcgaaaaagcttttaactcacggagccgcctgacgctccaccagcgtactcacaccggcgagaaaccttttaaatgcgctgattgcgggaagggtttctcatgccacgcttacctgctcgtgcatcgtaggatccactccggcgaaaagccattcaagtgtaatgaatgcggaaaagctttctcctcccatgcttacctgatcgtccaccggaggatccataccggggaaaagcccttcgactgttcacagtgttggaaggcctttagctgtcatagcagtctcatagtccaccagcggattcacactggagaaaagccgtacaagtgctctgagtgtggaagagctttctcccagaaccattgcctgatcaagcatcagaaaatccactctggtgaaaagtccttcaagtgtgagaagtgcggagaaatgttcaactggtcaagccatctgaccgagcaccagaggttacactcagagggaaaacccctggccattcaatttaacaaacatctactttccacctattacgttcccggaagccttttgggggctggagacgcaggccttcgggatgtggatcccatcgatgcattggatgtggccaagcttctctgcgtggttccacccagggctgggaggaacttctcacttggttcaaagccccgaaactag

SEQ ID NO: 247788 - DNA, 1935 bp, Artificial Sequence
  Description of Artificial Sequence: Synthetic coding sequence
atggagattcctgcccctgagcccgagaagactgccctaagttctcaggatcccgctctctcgctcaaagaaaacctcgaggatatcagtggatggggactacccgaagcacggtcgaaagaaagcgtgtcttttaaggatgtggcagtggattttacacaggaggagtgggggcaactggactcaccccagagagcgttgtaccgagatgtcatgcttgaaaactaccagaacctgctggccttgggtccccctttgcacaagcccgatgtgatctcccacttagagcggggtgaggagccctggtcgatgcagagggaggtgccacgcggaccatgccctgaatgggagctgaaagctgttcctagccagcagcaggggatctgtaaagaagaacccgcacaagagcctattatggagaggccccttgggggagcccaggcctggggacgacaggcaggggcactgcagagatcgcaggcagccccatgggcccctgcccctgctatggtctgggacgtgcccgtggaggaattccccctaagatgcccactcttcgcccagcagcgcgtgcctgaaggtggaccattgttggacactagaaagaacgttcaggccaccgaagggaggactaaagcccctgcgcgtctttgtgcaggcgaaaacgccagtacaccctcagagcctgagaaattcccccaagttcggcgtcaaagaggagccggagcaggtgaaggtgagtttgtgtgcggtgagtgcgggaaggcattcagacaatcctcctcactcaccctgcacaggcgctggcactcaagagagaaggcgtataaatgtgatgagtgtggcaaggctttcacctggtctaccaacctgttggaacaccgacgtattcatacaggtgagaaaccatttttctgcggagaatgcggaaaagccttttcttgccactcctcactgaacgtacaccaacgtatccataccggcgagcgtccctataagtgtagtgcctgcgaaaaggctttttcctgctcatctctcctctctatgcacttgcgggtgcatacgggcgaaaagccctaccgatgtggggaatgcggaaaagcttttaaccagcgcactcaccttacacgccatcacagaattcacactggggaaaagccgtatcaatgcggatcctgcggcaaggcattcacctgtcactcgtctctgaccgtccatgaaaagatccactcaggcgacaagcccttcaagtgtagtgattgcgagaaggcctttaactcccggtcgagactcactctccaccaacgaacccacactggcgagaagccctttaaatgcgccgattgtgggaagggtttttcttgccacgcatacctcctcgttcataggagaatccactctggcgagaaacctttcaaatgtaatgagtgcggaaaggcattcagttcccatgcatatctgattgtgcaccggagaatccacaccggagagaagcctttcgactgctcccagtgctggaaggcctttagttgccactcctccctgattgtgcatcagcgtattcacactggcgaaaagccatataagtgctcggagtgtgggcgtgccttttctcaaaaccactgtctgataaaacaccagaagattcatagcggagaaaagtccttcaaatgcgaaaaatgcggagagatgttcaactggagctctcatcttacagagcatcagcgcctccactctgaaggaaagccactggcaatccagtttaataaacacctcctgtctacctactacgtccctggctccctgctgggcgctggcgatgctggattaagggatgtcgatccgatcgacgcattagatgtcgcgaaacttctttgtgtggttcccccacgcgctgggaggaacttctccctgggctcgaagcctagaaactag

SEQ ID NO: 247789 - DNA, 1839 bp, Artificial Sequence
  Description of Artificial Sequence: Synthetic coding sequence
atggagatccccgctcctgagcctgaaaaaaccgcgctatcgtcgcaggacccggcactctcactcaaggaaaatttggaagacattagcggctggggacttccggaagctaggagcaaagagtcagtgtcattcaaagacgtggctgtggattttactcaagaagaatggggtcagctcgattccccccagcgcgctctgtatagggatgtgatgctggaaaactatcaaaatctgctggccttagagtgggaactcaaggcagtaccgtcgcaacagcagggcatttgtaaagaagagcctgcgcaggagcccatcatggagagaccacttggtggcgctcaagcatggggccgtcaggcaggggctctgcaacgctcacaggcagccccatgggcacccgcaccagcaatggtgtgggatgtgccagttgaggaatttccgctgcgatgccccctgtttgcccaacagcgggtgccagaaggaggtccgctattggatactcgaaagaacgtccaggcaaccgaaggacgcacaaaagcacctgccaggctgtgcgccggagaaaacgcctcgactccttcggagcccgagaagtttccgcaggtacgcaggcagcgcggagccggtgcaggtgagggcgaatttgtctgcggcgaatgtggtaaagccttcaggcaaagctctagcctcactttgcacaggcggtggcacagccgcgagaaggcctacaagtgtgacgagtgtggcaaagccttcacttggtctacgaatttgttggagcatcgaaggatccacaccggggaaaaacccttcttttgtggcgagtgcggaaaagctttctcgtgtcatagctctttgaacgtgcaccagcgtattcatactggagaaagaccctataaatgctcagcttgcgaaaaggctttcagttgctcgagcctgctgtctatgcatctgcgggtgcacaccggagagaagccttacagatgcggcgagtgtggaaaagcgttcaaccagcggacccacttgacacggcaccaccgcatacatacaggggagaaaccctatcagtgcggatcttgcgggaaagccttcacctgccattcatcactgaccgtccacgagaaaatccacagcggtgacaagccattcaagtgcagcgactgtgagaaggccttcaactctcgctcacggttaacattgcaccagcgcacacacacaggagaaaaaccgttcaaatgcgccgattgcggcaaagggtttagctgtcacgcctacctcttagttcatcgacgtatccacagtggcgaaaaaccgttcaagtgcaacgaatgcggcaaagcctttagctcccatgcgtacttgatcgtgcaccggaggatccacaccggcgagaagcccttcgactgttctcagtgttggaaagctttctcgtgtcactcctccttgatcgtgcatcagcggattcacaccggggagaagccttacaagtgttctgagtgtggaagagcgttctcccagaatcactgtctaatcaagcaccagaagattcatagcggagaaaaatcctttaaatgcgaaaagtgcggtgagatgtttaattggtcaagccacctgacggaacatcaacggctgcactctgaaggcaagccactggctatacagttcaacaaacatctattgagtacatactacgttccaggatccctcctaggcgctggtgatgccggtctcagggacgtcgatcccattgacgccttagacgttgccaaactgttgtgcgtcgtcccaccaagggcgggtagaaatttttcgctcgggtccaaaccacgcaactag

SEQ ID NO: 247790 - DNA, 210 bp, Artificial Sequence
  Description of Artificial Sequence: Synthetic coding sequence
atggagatccccgctccagagcctgaaaagacagccctttcttcccaagaccctgcgctgtccttaaaggaaaatctggaagacattagtggttggggtcttccagaagcgagatccaagagtctcgccctcgtaacccaggcaggtgtgcagtggaggaatttgggatctcttcagccacctcctctcgggtttaagcaattttcatag

SEQ ID NO: 247791 - DNA, 1935 bp, Artificial Sequence
  Description of Artificial Sequence: Synthetic coding sequence
atggccgaggccgtggctgctccgatctctccctggactatggctgctaccatccaggccatggaacggaagattgagtcacaagccgctcgcctgctgtccctcgaaggccgaactgggatggctgagaagaagttagccgattgtgaaaagacagcagttgagtttgggaatcaactggaaggtaagtgggccgttctggggaccctgctgcaagagtacgggctcctgcagcggagactggaaaacgtcgaaaatctcctgcgtaaccgcaacttttggatcctgagattgccacctgggtccaaaggggagagcccgaaggagtgggggaaactggaggactggcaaaaggaactctacaagcacgtgatgcgcggaaactatgaaacccttgtgtcactcgactatgcaataagcaaacctgaagttctgtctcagattgaacaggggaaggaaccatgcaactggcggagacctggacccaagattccagatgtgcccgtggatcctagtcccggaagtggtcctcccgtgcccgcacccgacctgctcatgcagattaagcaagaaggggaactccaacttcaggagcagcaagcccttggggttgaggcttgggcagcgggacaacccgacatcggtgaagagccatggggcctgagccaactggattcaggagctggggacatcagtaccgacgcaacttccggcgttcactccaacttctccaccactattccaccaaccagctggcagacagatctgcctcctcatcatccctcctcagcatgttcagacggaacactgaaactgaatactgccgcttcaacagaggatgtcaaaattgtgattaagactgaagtccaggaggaggaggtggtggccacccccgtgcaccccacagacctagaagcgcacggtaccttatttggccctgggcaggctactcgatttttcccatccccggctcaagaaggggcttgggagtcacagggcagctcatttccatcccaggaccccgttcttgggctgagagaacctgcacgacccgagcgagatatgggcgagctgtctcccgctgtggctcaggaagaaacaccgcctggtgattggcttttcggtggcgttcgttggggttggaatttccggtgtaaaccacctgtagggttgaatcccaggaccggacctgaaggactgccatatagcagtccagacaatggagaggcaattctcgatccaagccaagctccacgtccttttaacgagccgtgcaagtaccccggacggacaaagggcttcggccacaaacccggtctcaaaaaacatcccgctgccccacccggtggcagaccattcacttgtgccacatgcggaaaatccttccagttacaagttagcctaagcgctcaccagcgatcctgcggagctcccgacgggtctggccctgggaccggcggaggcggatcagggtcagggggaggtggtggtggtagcgggggtggctccgccagagatggctccgctcttcggtgtggcgagtgtggaagatgcttcacaaggccggcacacctcatccgacatcggatgctgcacactggtgagcgacctttcccctgcacagagtgtgaaaagaggttcaccgagaggtccaagttaattgaccactatcgtacacacactggtgtgcggccttttacatgcacagtgtgtggaaagtctttcatcagaaaggaccatctgaggaagcatcaaagaaaccacgccgctggagctaagaccccagcacggggtcagccattgccgacgcccccagccccaccagatcccttcaaatcgccagcgtcaaaagggcctctggcttctactgacctggtgacggactggacttgtggactgagtgtcctcgggcctaccgacggaggcgacatgtag

SEQ ID NO: 247792 - DNA, 1938 bp, Artificial Sequence
  Description of Artificial Sequence: Synthetic coding sequence
atggctgaggccgttgctgccccaatctccccctggacaatggcggctaccatacaggccatggagcgcaagatcgaatctcaggctgcaaggctgctgtcactggaagggagaaccggcatggcggagaagaagctcgcggactgtgaaaaaaccgcagtggagtttgggaatcagcttgagggtaagtgggccgttctgggcactctgctgcaggagtatggcctgttgcagcggaggcttgaaaacgttgaaaaccttctgcggaacaggaacttttggattttgagactcccaccgggaagcaaaggcgagagtcctaaagaatggggaaaactggaagattggcagaaggaactgtacaagcatgtgatgcgaggaaactacgagaccctggtctctctcgactatgccataagtaagcccgaagtactgagccagatcgagcaggggaaggagccttgcaactggagacgacccggtcccaagatcccggatgtgccagtggacccctcccctgggagcggaccccctgtgcctgctccagatctgcttatgcagataaagcaggagggcgagcttcagctgcaagaacaacaggccctcggagtggaagcatgggccgcaggacagcccgacatcggcgaagagccgtggggactatcccagttagacagcggggcaggcgatatatctaccgacgctaccagtggggttcacagcaatttctctactaccattccacccacctcttggcagaccgatttgccaccacaccacccttcaagtgcgtgttctgatgggacgcttaagctaaatacagctgcctcaaccgaggcggatgtcaaaatagtcattaagaccgaagtgcaagaagaagaggtggttgccacccctgtacatccaacagaccttgaggcacacggcacactcttcggaccagggcaggctaccagattcttcccctccccggctcaggaaggagcctgggaaagccaaggaagcagcttcccttctcaggatccggtcctggggctgagagagcctgcacgtcccgagcgggatatgggggaactttcacctgctgtcgctcaggaggaaaccccccctggagactggttgtttggaggggtacgctggggctggaactttcggtgcaaacctccagtgggtctgaatccacgcaccggccctgagggcctcccctattcttcaccagacaatggcgaagccattctcgatccctcacaagcgccacgtccttttaacgaaccatgtaaatatccagggaggaccaagggcttcggacataaaccaggactcaaaaagcacccagcggcacctcctggcggaagacctttcacctgtgccacctgcggcaagtccttccagctccaggtgtccttaagtgcacatcagcggagttgcggcgcaccagatgggagtggcccaggaaccgggggaggtgggtctggcagcggcggagggggaggaggctcaggcggaggctccgctcgtgatggatctgctcttagatgcggggaatgcggccgttgcttcacccggccagctcacctgattcggcaccgaatgctccacactggagagagaccattcccctgcactgaatgtgagaagaggttcaccgaaagatccaagctcatcgatcattatcggacccataccggagtgcgaccatttacctgcacggtgtgcggtaagagttttatccgcaaggaccatcttcggaaacaccaaagaaaccacgccgctggcgcaaaaacacctgcaagagggcagccactaccaactcctcctgcccctccagatcctttcaaatctccagccagcaagggcccactggctagtaccgacctggtgactgactggacatgcggcctgtcagtactgggacccaccgacggcggtgacatgtag

SEQ ID NO: 247793 - DNA, 2172 bp, Artificial Sequence
  Description of Artificial Sequence: Synthetic coding sequence
atgtctttgctgaaagagcgaaaaccgaagaagcctcactatatcccccgacctccaggcaaaccttttaagtacaaatgttttcagtgtcctttcacatgcaacgaaaagtcccacctgtttaaccatatgaagtatggactgtgcaagaactcaatcactcttgtgtccgagcaggatcgagtccccaaatgtcctaaaagcaactcacttgacccgaagcagactaatcagcccgacgccacagcgaaacctgcttcctctaagtctgtggctaacggactgagtgcatttgactccaaactccaacactcaagcgccagggaggacattaaggaaaatctggagctgcaggcgagaggcactcaccggtgcctaggacagaagcctgccctacaccgagcctctccttgtaaatcaccggcacctgaggcagctctgggcgcacaacctgcgctagagggcgctgctcgaccgagcgcctttgtacccgtgggggaacacagacttaagggtcctgacaatgcggaagctcccgaaaccctcgctctccacaacccaacggcaaaggcagtcagctttcacacgaaaagtgcctttcatacaccaggctacccgtggaaggctggtagtccattcctgcctcctgagtttccgcacaaaatctcttcaacaaaggggttgggcgcaatctcgccctatatgcatccgaccattcccgagtatccccctcacttttataccgaacacggcttggccaccatctacagcccatacctgttggcaggctctagccccgagtgcgatgctccactcttatcagtgtatggcacgcaagatccgaggcattttcttccgcaccctgggccaatccccaagcaccttgcgccttcgcctgccacctacgaccactacagatttttccagcagtaccctagcaatctgcccattccttatggtttttacaggcccgagagcgctttcagctcttatggcctcaggctgccccctgttactggcctaaccagggaccagtctagtcacctgctggaagaagcaacgttagtctaccccgcaagctctccatcccgtctgaacccttcagacccaaacagaaagcatgttgagttcgaatccccaattccagaggccaaagatagctcaaaagctgggcagagagacaccgaaggcagcaaaatgtctccccgagccggtagcgcggcaactgggtctcctggtaggccctctccaacggacttcatgcagacttcccagacttgcgaaggactctatgatctgagcaataaggctgcgagttctgctctgggcagactgtatccccctgaacagtctctgaccgccttcagaccagtaaagaagtcaacggagtgtctccccgcacaagctgctgaaacaactgccgagtcaccggtgagcctgaacgtggtgaatggagaccctcctgctccgaccgggagcgcctccctggtgagtgaggcggcaccaagcagccccgatgattcatcaggcatgggtcctctcaatctgtctaaaaaatcagaaatcaacctagctgccacacacgagcccacatatcaaggatcccctcaggctgagactgctagcttctccgaattgcaagacctacccttgaatctgagtgtgaaagatccctgcaatactcaagctccgagacctgccttcccgggtagacctagagccgcagagcctgccgctgcggtcccacagaagaccggtacagagggctcggaggatggcccatcacatccggagactaagcccggttctctcgacggagatggagcgcctcctaccggccctggggaagaagcccctgatgcctgcgcagtagactcctcagaggagcaaaagcaaaccgccgctgtggccctatgtcagctggccgcttatagcccgcgaaatattcgcgtgggagatggtgacgccgcagcgccagaacccgcatgtcgtcaggatacgcccacactttcatccatggaatctcaggaggcacagtgtgatttgcggcctaaaggccagaagcggaccagcctgagagacgccggaaagtctcagcagggagctaagaaggcaaaactgcaggacactgctcgcgtgttcacactgcgacgcagggccagagtctcctag

SEQ ID NO: 247794 - DNA, 951 bp, Artificial Sequence
  Description of Artificial Sequence: Synthetic coding sequence
atgagcccgcgagcgggttctgccgctacggggagccctggccgtccgagtcctactgactttatgcagacatctcagacttgtgagggcctgtacgatttgagcaacaaggctgcttcatctgcacttgggcgtctgtacccaccggaacaaagtctgacggcttttcgccctgtgaagaagtccaccgaatgcttgcccgcacaggctgcagaaaccaccgccgaatctccagtgtctttaaacgttgtgaatggtgaccctcccgcaccgacaggcagtgcgtccctagtaagcgaagctgctccctcctccccagacgactcttctggtaagtctgagatcaacttggccgctacgcacgagccaacctaccagggatctcctcaggccgaaactgccagcttctccgagctccaggacttaccactgaacctatccgttaaagacccttgcaatactcaagccccaagaccagctttcccaggtcgcccaagagccgcagagccagccgcagctgtcccacagaagacaggcaccgaggggagtgaagatggtccctcccaccctgaaacaaagcctggctccctcgacggggacggcgctccacctactggccctggagaggaagctcctgacgcttgtgccgtggattcgagtgaagagcagaagcagaccgctgccgtcgccttgtgccagttggctgcctatagcccgcgaaacattcgtgtcggtgacggggatgccgctgcgcctgaacctgcctgcagacaggataccccgaccctctcgtctatggaaagccaggaggctcagtgcgacctgcggccaaaaggacagaagagaaccagtctgcgagacgctggcaaatcccagcagggcgctaagaaagctaaactccaagataccgcacgtgtgtttactctccggagacgcgcacgcgtttcttag

SEQ ID NO: 247795 - DNA, 891 bp, Artificial Sequence
  Description of Artificial Sequence: Synthetic coding sequence
atgtatttttcacaggaggagtgggagttgctcgatccgacccagaaggcattgtacaatgatgtaatgcaggagaactatgagaccgtaatctcattggctctttttgttctgcccaaacccaaagttattagctgcttagaacagggtgaagaaccttgggttcaggtttccccagaattcaaggatagcgctggcaagtccccgactggcctaaaactcaagaatgatactgagaatcaccagcccgtgtccctctcagacttggagattcaagcttccgctggcgtaatctccaagaaggcaaaagtgaaggtcccccagaagaccgccggtaaagagaaccactttgacatgcatagagtaggaaagtggcaccaggattttcctgtaaaaaaacggaaaaagctttccacttggaaacaggagttactaaaattgatggaccggcacaaaaaggactgcgcccgagagaaaccctttaagtgccaagagtgcgggaaaacgtttcgcgtcagttctgacctgataaagcatcaaagaatacacaccgaggagaagccttacaaatgtcaacagtgcgacaaacgatttaggtggtcgagcgacctgaataagcatctgactacccaccagggcataaaaccatataagtgtagctggtgcggaaagtccttctcccagaacaccaacctacacacacaccagaggacccacacgggggagaagcccttcacttgtcatgagtgcgggaaaaagtttagccaaaatagccatctgataaagcaccgcagaacccacaccggcgaacaaccttacacttgctctatttgtagacgcaactttagccgtaggtcaagcttgctgcgtcatcagaagctacacctgtag

SEQ ID NO: 247796 - DNA, 891 bp, Artificial Sequence
  Description of Artificial Sequence: Synthetic coding sequence
atgtacttttcccaggaggagtgggaattattggacccaacccagaaggccctgtataacgacgtcatgcaggagaattacgagacagttatcagcctagctcttttcgtcctgcctaagcctaaggttatttcttgcctcgagcaaggagaagaaccgtgggtacaggtgtcccccgagttcaaggacagcgccggaaagtctcctacagggcttaaactgaaaaatgacaccgagaatcatcaaccagtcagcttgagtgatttggaaatacaggcttccgcaggagtgatatctaaaaaggctaaggtcaaagtacctcagaaaaccgcgggaaaagaaaaccacttcgacatgcatcgggttgggaagtggcaccaggactttccagtaaagaagagaaagaaactgagcacctggaagcaggagctcctgaaattgatggaccgccacaagaaagattgcgctcgagagaagcccttcaaatgccaggaatgcggtaagactttcagagtttccagcgacctgatcaaacatcagcgcatacatacagaggaaaagccttacaaatgccagcagtgcgacaaaagattccgctggtcaagcgacctgaataagcatctaaccacccaccagggcatcaaaccttataagtgctcctggtgcggtaaaagtttctcccaaaacaccaacctccacacccatcagagaacccatactggggaaaagcctttcacatgtcacgagtgtggcaaaaagttttctcagaatagtcacctgatcaaacatagaagaacacataccggagaacagccatacacatgctccatctgcaggcgtaactttagtcgcaggagctcactgctacgacaccagaagctccatttatag

SEQ ID NO: 247797 - DNA, 1248 bp, Artificial Sequence
  Description of Artificial Sequence: Synthetic coding sequence
atggctatgagagaacttaatgccgactcatgctcctctcctcagatgggagcaatgtgggaaacctctggttctgtcaaagagaatagctcccagtctaaaaaatattctacaaagattgaaaacctgggacccgagagtgcatgcaggcacttctggtcctttcgctatcatgaggcaaccggccctctcgaaactatatcacagctacagaagctttgccaccagtggctcaggccagagatacactccaaagaacaaattctggagatgctggtgctggagcagtttctgagcatcctgcccaaagagacccagaactgggtgcaaaaacaccaccctcagaatgttaaacaggcactcgtcctggtggaatttctacaaagggaacctgatgggactaaaaatgagtcactcttgacctttgaggacgtcgcagtttacttcagtgaggaggagtggcagctgctgaacccattagagaagacactgtacaacgatgtgatgcaagacatttatgaaactgtgatctcacttggacttaaacttaaaaatgacacaggaaacgaccatcccatctccgtgagcacgagcgagatccagacctcaggctgcgaggtcagcaagaaaacacgcatgaaaatagctcaaaaaactatgggtagagaaaatccgggtgacacccacagcgtccagaaatggcatagagcctttcctagaaagaagcgcaaaaaaccagctacctgtaagcaggaactgccaaagcttatggatctgcatggtaaagggccaacaggggaaaagcccttcaagtgtcaggagtgcggtaaatcatttagagtgagttccgatctgatcaaacatcaccgaattcatacgggggaaaagccctacaaatgtcagcagtgcgacaggcgctttagatggagcagtgaccttaataagcatttcatgactcaccagggcatcaagccatatcgctgcagctggtgtggcaagtcctttagccacaatactaacctccacacacatcaaaggatccatacaggggaaaaacctttcaaatgcgacgagtgcggtaagaggttcatccagaattctcatctgatcaaacaccagcgcactcacacgggcgaacagccttatacctgttctctgtgcaagagaaacttctcgagaaggtcctcgctcctccgccaccagaaactccaccgcagacgcgaagcatgtttggtcagtcctaactag

SEQ ID NO: 247798 - DNA, 1533 bp, Artificial Sequence
  Description of Artificial Sequence: Synthetic coding sequence
atggccatgagggagcttaatgcggactcttgtagctcaccccaaatgggggctatgtgggagacgagtggctccgttaaagagaacagcagtcagagtaagaagtatagcacgaagatcgagaacttgggcccagagagtgcttgtcggcacttctggtctttccgatatcatgaagctaccgggccacttgagaccatttcccagctgcagaaattgtgtcaccagtggctccgacctgaaatacacagtaaggaacaaattttagaaatgctggtgttggaacaatttttgtccattctgcctaaggagacccagaattgggtgcagaaacaccatccccagaacgtcaaacaggccttggtgttagttgagtttctgcagagagagccagacggcacaaagaacgaagtgaccgctcatgagctgggaaaggaggccgtgcttctgggcggtaccgcagttgcccctggttttaaatggaagcccgcagagccacagccaatgggtgtcttccaaaaggaatactggaacacatacagagtgctgcaagagcagttaggctggaacacccataaggagactcagccggtgtatgagcgggcagtgcatgaccagcagatgctagcactcagtgagcagaaacgcatcaagcactggaagatggctagcaaactgatcttgcccgaaagtctgtctttactgacatttgaagatgtcgcggtctacttcagtgaagaggaatggcagctcctaaatccactggagaaaacgctgtataacgacgtcatgcaggacatttacgaaacagtaatctctctgggactgaagcttaagaacgacaccgggaacgatcaccctataagcgtgagcacgagcgagatacagacctcaggatgcgaggttagcaagaagactcggatgaagatcgcccaaaaaaccatggggagggagaatcctggagatacacattctgtgcaaaaatggcaccgggcttttccgaggaagaagaggaaaaaacctgccacctgtaaacaggagctccccaagcttatggaccttcacggcaaagggcctacaggcgagaaacccttcaagtgccaggaatgcggcaaatcctttcgggtgagttctgatctgattaagcaccacagaattcacacaggagaaaagccatataagtgtcaacagtgtgatagacggtttcggtggtcgagcgaccttaacaaacattttatgacccatcagggcatcaagccttaccgctgctcctggtgcggaaagtcgttcagccataacactaatttgcacacacaccaaaggatccacacgggggagaagccttttaaatgtgacgaatgcggtaaacgatttattcagaactcacatctgattaagcatcagcgcacacatactggggagcaaccatacacatgctctctatgtaagaggaatttttcacgacgatcaagtctcctgaggcaccagaaacttcatcgcagaagggaggcgtgcctggtttcaccaaattag

SEQ ID NO: 247799 - DNA, 1548 bp, Artificial Sequence
  Description of Artificial Sequence: Synthetic coding sequence
atggagtctctggggcttcatactgtgacactcagcgacggaacgacagcctatgttcagcaggccgtaaaaggcgaaaagctgttggaggggcaggtgatacaactggaggacggcactactgcgtatattcatcaagtcaccgttcaaaaggaggccctgtcttttgaagacggccaaccggtgcagcttgaagacgggtccatggcttacatccatcgtacacccagggagggctatgatccttctaccctcgaggccgtacaattagaagatggatctaccgcatacatccatcatccagtggctgtcccctcagaatctactattctggcagtccagacagaagttggcttggaagatctcgccgcagaagatgacgaggggttcagtgcagacgctgtggtcgctttggagcagtacgcgagtaaagtgttacacgacagccagataccccgaaatggcaaggggcaacaagtcggcgatcgagcttttcgctgcggctataaaggttgcggaaggctgtacacaactgcccaccacttgaaggtgcatgaaagggcccacacaggcgatcgcccttaccgctgtgacttccccagctgcggcaaggcatttgctacgggctacggattgaaatctcacgttcgcactcacaccggcgaaaaaccatacaaatgcccagaggagttgtgcagcaaggcctttaaaacttccggcgacctgcagaagcatgtgcggacccacactggcgagaggccgtttcagtgtccgtttgaaggctgcggcaggtccttcaccaccagcaacatccgcaaagttcacgtacggacccatacgggtgagaggccctatacatgccctgaacctcattgcgggcgaggattcacttctgctaccaactataagaatcacgtgcgtattcatactggcgagaagccatatgtctgcacagtgccaggctgtggaaaacggttcacagagtattcttcactttacaagcaccacgttgtccacactcactgtaagccatacacttgtagcacatgcggtaaaacgtataggcagactagtaccctggccatgcacaaaaggtcggcccatggcgagctggaagcaacagaggagtcagagcaagcactctacgagcagcagcagctggaagctgcttcagcagccgaggagagcccacccccaaagcggccacgcatagcctacctctctgaggtcaaggaagagcgcgacgatataccagctcaggttgctatggtgaccgaagaagatggagccccacaggtggctctgatcacacaggatggggctcaacaagtcacaatcatcacatccggcgctgtggtggctgaggattcatctgtcgctagcttgcgccatcagcaggtggcgcttctggccacagccaatggcactcatattgctgtacagttagaggaacagcagactctggaagaagccatcaatgtggcgaccgccgctatgcaacaaggcgcagttacgctagagaccaccgtgtctgagtctggatgttag

SEQ ID NO: 247800 - DNA, 1713 bp, Artificial Sequence
  Description of Artificial Sequence: Synthetic coding sequence
atggaatcactgggtctgcacacagttacgctgtccgatggaacaaccgcttacgttcaacaggccgtgaaaggtgagaagcttctggaaggccaggtcattcagcttgaggacggcacgaccgcatatattcaccaggttactgtgcagaaggaggctctgtcgttcgaagacgggcagcctgtgcaattagaggatggcagcatggcttacattcaccgaacacccagagaaggttacgatccaagcacgctggaggctgtgcaattggaggatggatccactgcttatatccaccaccctgttgccgttccctccgagtccactatcctggctgtgcagactgaggtcggcctggaggatctcgcggcagaggatgatgaaggattctccgcagatgctgtagtcgccctggagcagtatgcatccaaggtgctccatgattcccagattccacgaaacggcaaggggcaacaggtgggcgatagagcatttcgttgtggctacaaaggatgcggccgattgtacacaacagcccatcacctgaaagtccacgagcgggctcacaccggtgatcggccatatcggtgtgacttcccctcttgcggtaaggccttcgcaacagggtatgggctgaagagccacgttagaactcataccggagagaaaccgtacaagtgccctgaggagctgtgctcaaaagcctttaaaacaagcggagacttgcaaaagcacgtgagaacccacactggcgagcgccctttccaatgccctttcgagggatgcggacggagcttcactacgagcaacatcaggaaggtgcatgtgaggacccataccggtgagcggccatacacctgtcccgagccgcattgtggcagagggttcacttctgcaactaattacaagaaccatgtccgaatacacactggcgagaagccctatgtgtgtacagtgcccggatgcggaaagcggtttacagagtatagctctctgtacaaacatcacgtggtgcacacacactgcaaaccctacacatgctcaacctgtggcaaaacgtacagacagacaagcaccttggcaatgcataagaggagcgcccacggagagctcgaggccaccgaggaatccgaacaggctctgtacgaacaacaacaactcgaggccgcaagcgcagcagaggaatctcctccacccaaaagacccaggatagcctacctgtcggaagtgaaagaggagcgggacgacatacccgctcaggtggcaatggttaccgaagaagacggcgcaccccaggtcgccctgattacccaggacggagcacagcaagtatccctgagtcccgaagatttgcaagcccttggatctgcaatttctatggtcacacagcatggctctacaaccctgaccatcccttcccccgacgcggaccttgccacatcaggcacgcatactgttaccatggtctcggctgatggaactcagacccaaccggtgactatcattacttccggcgcagtcgttgccgaagacagttccgtagcatccctcagacatcaacaggttgctctgctggcaacggcaaacggcactcatattgcagtccagctggaagagcaacaaaccctcgaggaagcgatcaatgttgccacagctgctatgcagcagggggcagttaccttagagactaccgtatccgagagcggctgttag

SEQ ID NO: 247801 - DNA, 1287 bp, Artificial Sequence
  Description of Artificial Sequence: Synthetic coding sequence
atggagtccttgggacttcatactgttactttatcagacggaactaccgcgtatgtccagcaggcagtaaaaggagaaaaactcctggaggggcaggttattcagctggaagatgggacaacggcgtatatacatcaggtcaccgtacagaaagaggccctctcttttgaagatgggcagccagtccagctcgaggacggttccatggcatatatacatcgtactcctcgagaaggatatgacccgtctaccctggaagccgtgcaactagaagatggcagtaccgcctatatacatcatccagtcgcagtcccttcggagtccaccatcctcgcagtacagactgaggtgggcctcgaagatctggcagcagaggacgacgaggggttttccgccgatgctgtggtggctctggagcagtatgccagcaaggtactgcacgacagccagattcctcggaacggtaagggacaacaagtaggcgaccgggcttttaggtgtggctataagggttgtggaaggctctataccacggcccaccatctaaaagtccacgaacgagcccacaccggggaccgcccttataggtgtgactttccatcgtgcggcaaagcattcgcaaccggctacggcctcaaaagtcacgtgcggacccacaccggcgagaagccgtacaagtgtccagaagagctgtgctccaaagcattcaaaacttccggtgacctacaaaagcacgtgcggactcatacgggcgagagaccatttcagtgtccttttgaaggttgcggtcgcagtttcacaaccagtaacatccggaaggttcacgtacgcacacacactggggagcggccatatacttgtccagaaccacactgtggcaggggcttcacctctgccactaattacaagaaccacgtcagaattcatacaggagaaaagccctacgtctgtacagtgcctgggtgtggcaaacgttttactgagtactccagtctgtacaagcaccacgtagtgcacacgcactgcaagccctacacctgttccacgtgcggcaagacctacagacagactagtaccttggccatgcataagaggagtggtcactgcgggcacgctgccaggggttgtgaccccggagataactccgtcggcgaatggttgttgtctccaaggggactgggccctacaccctgctggaggaagtgccacttgcacggccattcatgtccccagggccctcgtctctggcttactcacagacggtggccccatcgctcccttgggtag

SEQ ID NO: 247802 - DNA, 1635 bp, Artificial Sequence
  Description of Artificial Sequence: Synthetic coding sequence
atggagtccttgggactccacaccgtgaccctttcagatggtactacagcctacgtgcagcaagccgtcaagggggagaaattactcgaaggtcaggttatccaactggaagatggtacaacagcgtatatccatcaggttaccgtgcagaaggaaggttatgacccatctaccctcgaagcagttcagctcgaggacggatccacagcatacattcatcaccccgtagctgttcccagtgagtcgacgatcctggctgtccagacagaggtcggtctggaggacctggcggcagaagatgatgaaggattctccgctgatgcggtcgtggctttggagcaatacgcaagcaaagtgctgcatgacagtcagatcccacgcaatggaaaggggcagcaagtgggggatcgggctttcaggtgtggctacaaaggttgcggccgtttgtatactaccgcgcaccatctgaaggttcatgagcgtgctcacacaggcgacaggccatatcgatgtgattttcctagttgcggcaaggctttcgcgactggctacggactgaaatctcatgttagaacacacacaggagaaaagccctacaagtgtccagaggaactgtgctccaaggccttcaagacctctggggaccttcagaagcatgtcagaacccacaccggggaaaggccctttcaatgcccttttgaggggtgcgggcgttccttcacaacatctaacatcagaaaagtccatgtgaggacccacacgggggaacgcccatatacttgccccgaaccccattgcggcaggggtttcacttctgccacaaactacaagaatcacgttcggatccataccggagagaaaccttacgtgtgcactgtgccaggatgtggtaaacgctttaccgagtactctagcctttacaagcatcatgttgtacatacccactgtaagccatacacttgcagtacgtgcggcaagacataccggcagacctctaccctggctatgcacaagagaagtgcacatggggaactggaagcaaccgaggagtccgagcaggctctttatgaacagcagcagctggaagctgcgagtgctgcggaggaaagcccaccacctaagcgaccgaggatcgcttacctgtccgaggttaaggaggaacgcgatgacattcccgcacaggtggcaatggtgacagaggaagatggggctccccaggttgctctgatcacacaggacggtgcccagcaagtgtccctcagccctgaggacctgcaggcactaggctctgctatttctatggtgacacagcacggaagtactactctgaccatcccaagtcccgatgccgacctggctacgtccggcacccataccgttacaatggttagcgcagacgggactcagacccagccagttaccattattacctcgggcgcagtcgtagcggaggacagcagcgtcgctagtttacggcaccaacaggtagcactcttggccactgccaatggaacgcacatcgcagtgcagctagaggagcagcagacgttagaggaggccattaacgttgcaactgctgcaatgcagcagggagccgtgacccttgaaactacagtgtcagagtcgggatgttag

SEQ ID NO: 247803 - DNA, 1209 bp, Artificial Sequence
  Description of Artificial Sequence: Synthetic coding sequence
atggagagcctgggcctccataccgtgaccctttcagacggtactactgcctacgtgcagcaggccgttaagggggagaagctcctggagggacaggtgatacagctggaggacggaacaactgcttatatccaccaggtgactgtgcagaaggaggccctctcattcgaagatggccagcccgtgcagttggaggacggatcgatggcttatatccataggacccccagagaagggtacgacccaagcacgttggaggctgtgcagctggaagacggaagcacagcttatatccaccatcccgtggccgtgccatcggaatctaccatactggcagttcagacagaggtgggactcgaggatctggctgccgaggatgacgagggtttcagcgccgacgcggtagtggctctggagcagtatgcctcaaaagtcctgcatgatagccaaatccccaggaacggtaagggacagcaggtgggcgaccgtgccttccggtgtggatacaagggatgcggccgactctatacaaccgcccaccatcttaaagtgcatgagcgggcacatactggggacagaccgtaccgctgcgattttccatcctgcggcaaggcttttgccaccgggtatgggctgaagagccacgtgcgcacgcataccggcgagaaaccttacaaatgcccagaggaactttgcagcaaggcctttaagacaagcggtgacctgcaaaagcacgttaggacgcatacaggcgagcgtcccttccaatgcccattcgaaggatgtggccgttcatttacaaccagcaacatccggaaagtgcatgtcaggacccacacaggagagagaccctacacctgccccgaaccacactgcggcagggggttcaccagcgcaacaaattacaagaatcacgtcaggatccacaccggcgagaagccgtacgtatgtactgtgcctggttgtggaaaaagatttacagaatactcatcactttacaaacatcacgtcgtgcacactcaccattgcggccatgcagcaagggggtgtgatcctggtgacaattcagttggagagtggcttctcagccctagagggctgggccctacaccctgttggcgaaagtgtcacttgcacggtcactcgtgtccccaaggccctaggctctggctgactcatcgcaggtggccacatcgtagcctagggtag

SEQ ID NO: 247804 - DNA, 1023 bp, Artificial Sequence
  Description of Artificial Sequence: Synthetic coding sequence
atggaatcgttaggcctacacacagtgaccctctctgatggtacaacagcttacgtgcagcaagctgtcaaaggagaaaagctgctggaagggcaggtaatccaactggaagatgggacaacagcctacattcatcaggtgactgtgcaaaaggaagccttatctttcgaggatggtcagcccgtccagcttgaggatggcagcatggcctatattcatcgcactcctagggagggctacgacccaagcacgctggaggctgttcagctcgaggatggatcaacagcctatatccaccatcccgtcgccgtgccctctgagtcaaccatcctggcagtgcagactgaggtaggactggaagatctagcagccgaagatgatgagggcttttctgctgacgctgtggtcgcactggagcagtacgctagtaaggtcctgcacgattcacagatcccaagaaacgggaagggtcagcaggtgggggatcgggctttccgctgtggttacaagggctgcggcagactgtataccaccgctcaccatctgaaggtccacgagcgggctcatacaggcgatagaccttatcgatgcgacttcccatcctgtgggaaagccttcgccacaggatatggcctgaagtctcacgtccgcacccatacgggggaaaagccttacaaatgccccgaagagctctgctctaaagcttttaagactagtggtgatcttcagaaacatgtcaggacccacactggcgaaagaccttttcagtgccccttcgagggctgtgggcgttcctttaccacctccaacatcaggaaggtccacgtgcggacgcataccggggagagaccctacacctgtccagaacctcactgtgggaggggcttcacgtccgcgactaactataaaaaccatgttagaatacataccggagaaaaaccatatgtgtgtacagttccaggatgtgggaagcgctttaccgagtactcgtcgctatataagcatcatgtggtgcatacatag

SEQ ID NO: 247805 - DNA, 1638 bp, Artificial Sequence
  Description of Artificial Sequence: Synthetic coding sequence
atggactgcgtcatattcgaggaagtggccgttaattttacacccgaagagtgggccctcctcgatcacgcacagcgttctctctacagggatgtcatgcttgagacttgccgcaacttagcctccctggactgctatatttacgttagaacgagtggcagttcctctcagcgggacgtgtttgggaacgggatctcgaatgacgaggagatcgtgaagtttaccggcagcgactcgtggtctatctttggagaaaattggcgcttcgataacactggtgaccagcaccaaatcccccagcgccacctgaggagccagcttgggaggttgtgcgaaagcaatgaaggccaccagtgtggcgagactttgtcacagacagctaacttgctggttcacaagtcttatcctacggaggcgaaacccagtgagtgtactaagtgtgggaaggcatttgagaaccggcagcggtcacacactggccagcgcccttgtaaagagtgcggacaggcttgtagctgcctgagctgccaatcaccgccaatgaaaacccagacggtggagaaaccctgtaactgccaggactccagaaccgcctcagttacctacgtaaaatccctctctagcaaaaaatcttatgaatgccagaagtgcggaaaagccttcatctgcccatcttcgtttcggggacatgtaaacagtcaccacggccagaagactcacgcatgtaaagtgtgtggaaaaaccttcatgtattacagctacctgacacggcacgtacgcacgcatactggcgagaaaccttatgagtgcaaggaatgtggcaaagccttctcttgcccctcttacttccgcgagcatgtcagaacccatactggggagaagccctacgagtgtaagcattgcggaaaaagcttctcttgttattctagcttccgagaccacgtcaggacacatactggtgaaaagccctgtcagtgcaagcattgcggaaaggcctttacatgctattcctcccttcgggagcacggacgaacccacagcggggagaaaccatatgagtgcaaggaatgcgggaaagccttccgctacccctcatccctccgggctcatatgagaatgcatactggagagaagccctacgtgtgcaagcagtgcggcaaagcctttgggtgccctacctacttccggagacatgttaagactcacagcggagtgaaaccctaccaatgcaaagagtgtggcaaagcgtactcattctccagctctcttcgaatccacgtccggacacatacgggagaaaagcctttcgagtgcaagcactgtggaaaagctttctcctgccactccagcctccgtgagcatgtcagaacccacagcggcgagaagccctatgaatgtaaccagtgtggaaaagctttttcgcacgctcagtattttcaaaaacatgtgaggtcgcattccggggttaaaccctatgagtgtacggagtgcggaaaagcatactcttgcagttcttctctgcgagttcatgttagaacgcatacgggagaacggccatacgaatgcaaacagtgcggaaagaccttccgctatcttgcgtcgctgcaagcccacgtacgaacccatgcgggagcttag

SEQ ID NO: 247806 - DNA, 1308 bp, Artificial Sequence
  Description of Artificial Sequence: Synthetic coding sequence
cggctctgtgaatctaatgagggccaccagtgcggggagaccctgagtcagactgccaatttacttgtgcataaatcgtaccccacagaagcaaagcccagcgagtgtaccaagtgcggcaaaacctttatgtactatagctatctcacccgccatgtgcggacacacaccggagagaagccatatgaatgcaaagaatgtgggaaggccttcagctgcccgagttacttccgggagcatgttcggacacacactggcgagaagccttacgagtgcaagcactgcgggaagtccttctcatgttactcatcgtttcgcgaccacgtcaggacacacacaggagagaagccatgccaatgtaaacactgcgggaaggcctttacttgctactcgagtctgagggaacacggtcgtacccattccggggagaagccctacgaatgtaaggagtgcgggaaagcgtttcgatatccttctagcctaagggcccatatgcggatgcatactggcgagaaaccatacgtgtgtaaacagtgtggaaaggctttcggatgcccgacttactttcggaggcacgtcaagacccatagtggggtgaagccataccagtgtaaggagtgtggcaaggcctattctttctcgagctccctgaggatacacgtccggacacacacaggtgaaaaacccttcgaatgtaagcattgtggaaaggccttctcatgtcacagctccctccgggaacatgtgcgcacacacagcggggagaagccttacgaatgcaaccaatgtggaaaagcctttagccacgcccaatattttcagaaacatgttcgatcccacagtggtgtcaaaccctatgaatgtacagagtgcgggaaagcctattcctgttcttcatctctgagggtgcatgtacgaacgcacactggggaaaggccttatgagtgcaagcagtgcgggaagaccttcagctggccttctgacctgagagtccatatgcgaactcatagcggcgaaaagcgatgcgggtgcaagcagtgtggcaaaagctttagcagcccatcttcctttaaaggacacatcaggacccacacaggggagaaattatacacctgccgggagtgtggtaaggtattttcctctcccagttattttagaacccaggttcgaattcatatcggtgaaaaaccctacgtgtgtgagcaaagaggaaaagtgttttcttggtctagttcatttcggggacatttgaggacacatagtagagaaaaaccctatgaatgcaaagagtgtactaaagctttctag

SEQ ID NO: 247807 - DNA, 1497 bp, Artificial Sequence
  Description of Artificial Sequence: Synthetic coding sequence
atgttagaggaaggagtgctgccaagtcctggtccagccctgccccaggaggaaaataccggagaagaggggatggcagcgggtctgctgaccgccggacccagggggagcaccttttttagttcagttacggtggcgttcgcacaggagcgttggcgttgtctggtgtctaccccccgtgacaggttcaaggaaggtatccccggtaagagccggtctcttgtactgctgggcctgccagtgagccagcctggcatgaactcccagctggaacagagggagggagcatggatgttggagggagaagacctccggtcacccagtcccggatggaagatcatttctgggagcccccctgagcaagcccttagtgaagcatcctttcaagacccctgtgtggagatgcctcctggcgactccgatcacgggacgagtgacctggaaaagagctttaacctgagacctgtgctgagcccccagcagcgagttcctgtcgaagccagacctagaaagtgtgagactcatacagagtcatttaagaacagtgagatacttaagcctcaccgcgctaagccatacgcctgtaacgagtgcggtaaagcatttagctactgttcctcactgtctcagcatcagaaaagccacacaggagaaaagccctatgagtgctctgagtgcgggaaggccttcagccagtcatcatccttgatccagcatcagcgcattcacaccggggaaaagccatacaaatgttccgagtgtgggagggcattttcccaaaacgcgaaccttaccaaacaccagcgaacccacactggggaaaaaccctaccggtgtagcgagtgcgagaaggcattctccgattgcagcgccctcgtccaacaccaacgtatccataccggggagaagccgtacgaatgtagcgactgtggtaaggccttccgccattccgccaacctgacgaaccaccagcgtacacatactggtgagaaaccctacaaatgcagtgagtgcggcaaggctttctcctattgtgcagcctttattcaacatcagaggatccacaccggcgagaagccctataggtgcgccgcttgtgggaaggcattcagtcagagtgcaaatctcacaaaccatcagaggacccacaccggtgagaagccctacaagtgcagcgaatgtggtaaagcctttagtcagtccacgaatcttattatccatcagaagacgcatacgggtgagaagccttacaagtgtaatgaatgtgggaaatttttttctgagtcttctgctctgattcgccatcatatcattcacactggagaaaagccctacgagtgtaacgagtgcgggaaagccttcaaccagagctcttcccttagccagcatcaacgaatccacactggagtcaaaccttatgagtgttcagagtgcggaaaagcattccggtgtagctccgctttcgtgcgccatcagagactgcatgctggagaatag

SEQ ID NO: 247808 - DNA, 1425 bp, Artificial Sequence
  Description of Artificial Sequence: Synthetic coding sequence
atggccgcaggcctcctgacagccggacctaggggatctactttcttttctagcgtcacggtggcattcgctcaagaacggtggcggtgtctggtgtctacgccacgagaccgcttcaaggagggtattcctggaaaaagccgttcgctggtcctgctgggactaccagtgtcccaacccggaatgaactctcagctcgaacagagagagggagcatggatgttggaaggagaggatctgaggtcaccgtcaccaggttggaagataatatctggatctcccccagaacaggctctgtctgaggccagcttccaggatccttgcgtcgaaatgccccctggtgactctgatcacggtacatcagacctcgagaagtctttcaacctcaggcctgtgctctccccccaacagagggtgcccgtggaggcaagaccaagaaagtgtgagacgcacaccgagtcattcaagaactctgagatcctgaaaccccacagagctaagccctatgcttgtaacgaatgcgggaaggcttttagctattgcagctcgttgtcccagcaccagaagtcgcatacaggcgaaaaaccctacgaatgctccgaatgcggaaaggccttctcccaaagcagctcactcatacaacaccagcgcatccataccggggagaagccttacaagtgcagcgagtgcgggagagccttcagtcagaacgccaacctgaccaagcatcagcgcacacacacaggagagaagccatacaggtgttcagagtgcgagaaggccttcagcgattgctctgcacttgtgcagcaccagcgtatccacacaggcgaaaagccttacgagtgctctgactgcggcaaggctttcagacattctgccaatctgactaatcaccagcgaactcatactggcgaaaagccatataagtgtagtgagtgcggcaaggctttttcttattgcgccgcttttatccaacatcagagaatccacaccggggagaagccttacaggtgtgcagcctgcgggaaagccttctctcagtccgccaacctgactaaccaccaaaggacccacacaggtgagaagccttacaaatgctcagagtgtggcaaggccttttctcagtcaactaacctgataatacaccaaaaaacacacactggggagaaaccctataagtgtaacgagtgtgggaagtttttctctgagtccagcgcactcatacggcaccacatcattcatactggcgaaaaaccatatgagtgcaacgagtgtggcaaggcttttaaccaatcatcttctctgagccaacaccaacgcatacacaccggcgtcaagccctatgaatgttcagagtgtgggaaagcattcaggtgctctagcgcgtttgtccggcaccagcgtcttcacgcaggcgagtag

SEQ ID NO: 247809 - DNA, 1728 bp, Artificial Sequence
  Description of Artificial Sequence: Synthetic coding sequence
atggatcccgaagacgaaggcgtcgccggtgtcatgtcagtcggccctcccgctgccagactgcaggagcctgttactttccgggatgtggccgtcgacttcacacaagaggagtggggccagctggatcctacacagaggattctgtatcgggacgttatgctggaaacatttggccatctcctgtcgattgggcctgaactgcctaaacctgaagtgatatcccaattagaacagggtacagaactctgggtggcggaaaggggcacaacccagggttgccacccagcttgggagcctcggtccgagtcccaggcgagtcgcaaagaagagggactgcccgaagaagagccaagtcatgtgaccgggagggagggcttccctaccgatgccccatatccaacaaccctcggtaaggatcgggagtgccagtctcagagtcttgccctgaaggagcagaataacctgaagcaactggagtttggattgaaagaggcaccagtgcaggatcagggctacaagaccctccgcctgcgcgaaaactgcgttctgagttcaagccctaacccctttccagagatttctaggggagagtatctctacacatacgattctcagattactgattctgagcataactccagcctggtgtctcagcagaccggatctcctggaaaacagccaggcgagaactcagattgtcatcgagattcatctcaagccatacccataacagaacttaccaaatctcaggtgcaggataagccctacaaatgtacagactgcggaaaatcatttaaccacaatgcgcatctgactgtgcataagagaatacacacgggagagcgcccttatatgtgtaaagagtgcggcaaggctttttcccagaattccagcctagtccagcatgagagaatccataccggggacaagccgtacaaatgtgctgagtgtggcaagagtttttgtcacagtacccacctgacggtccatcgtaggattcataccggggaaaaaccctacgaatgtcaggactgcggtagggcattcaaccagaactcttcactcggcagacataagcggacacacaccggggagaaaccttatacttgctcggtgtgtggcaagtcctttagtcgcacaacatgtctgttcttacacctcagaactcatacagaggaacgaccctacgaatgcaatcattgtggaaaaggatttcgacacagtagttccctcgctcagcatcagaggaaacacgctggtgagaagccctttgagtgcagacagcgactcatttttgagcagactcccgctcttacaaagcatgagtggacggaggcactgggatgcgaccccccactgagccaggatgaacgcacgcaccgtagcgacaggcccttcaagtgcaatcagtgcggcaagtgtttcattcagtccagtcaccttatcagacaccaaatcacacataccagggaggaacagcctcacgggagaagtcggcgtagagaacaatccagttctagaaactctcacctggtgcagcaccaacaccccaatagccgcaagagctcggccggaggcgctaaagccggacagcctgaaagcagagcgcttgcactgttcgacattcaaaaaattatgcaagaaaaaaatccagttcacgtgatcggggtggaagagcccagcgttggggcatccatgctgttcgacatccgagaatcgacctag

SEQ ID NO: 247810 - DNA, 519 bp, Artificial Sequence
  Description of Artificial Sequence: Synthetic coding sequence
atggacccagaagatgaaggtgttgctggagtcatgtctgtgggacccccagctgcacgcctacaggtgacaatcaccaccataacgacagctgctggaagtggccaagctagcccagcacagaccgaccctttcacaagtcgcagggacgaatccggcaccgcagttaacgcgctggacacatgggggaactctgatgcgggacgaggagtggttacagtgctggctggccagcgcggaggacgcgatagtaaccaagccccaggacctcgtatgaggatgctccatgccgctctatcctcaccagcgccacgctctccttgtccaggcgcttgggctcagccactcggcggtaatgacggatccccaagaactgaatgcgatgaatctgaccaccagggaaggcccctgcgagactgcggcaggactgcggttcaaggagggcagtgtctccaaggccatttggcaatacgcgcacctctgtccaggcaaagtggctgtggcctctgttcaccatag

SEQ ID NO: 247811 - DNA, 873 bp, Artificial Sequence
  Description of Artificial Sequence: Synthetic coding sequence
atgtgcaaggaatgcggaaaggcatttagtcaaaacagtagtcttgtgcagcatgagaggattcatactggagataaaccttataaatgcgccgagtgcggcaagagcttctgtcatagtacgcacttgactgtccatagaaggattcacacaggtgaaaaaccttatgaatgtcaggattgcggaagagcatttaatcagaactcgagtctaggacggcacaagcgaacgcacacgggagagaagccgtacacgtgctctgtgtgcggcaagagcttctcacgaacgacctgcctgttcctgcacttaaggacccacacagaagagaggccttatgagtgcaaccactgcgggaaggggtttcggcatagctcctccctggcccagcaccaacggaagcatgcaggcgaaaagcctttcgagtgccgccagcgcctgatttttgagcagacgccagcactcacaaagcatgagtggacagaagctctcggctgcgaccctcccttgtcacaggacgagaggacccataggagcgacagacctttcaaatgcaatcagtgtggcaaatgcttcattcagagcagccatctcatccgacatcaaataactcatactcgagaggagcagccacacggccgttcaagacggagggaacagtcctcctccaggaacagccacttagtgcagcaccagcatccaaattccaggaaaagtagtgcaggcggtgccaaggccggtcagcccgagtcccgtgcactggcactgttcgatattcaaaaaattatgcaggaaaaaaatcccgttcacgttatcggcgtggaagagccttccgtgggagcaagcatgttatttgatatcagagaatcaacttag

SEQ ID NO: 247812 - DNA, 822 bp, Artificial Sequence
  Description of Artificial Sequence: Synthetic coding sequence
atgagccctaagcgggatggactcgggaccggcgacggccttcactcccaggtgctgcaagagcaggttagtactggcgataatctgcatgaatgcgactctcaaggaccaagtaaggacactctcgtgcgtgagggaaagacttataaatgcaaagaatgtgggtcagtgtttaataagaattcactgttggttcgacaccagcagatccacaccggagtgaagccttacgaatgccaggaatgcggcaaggcgttccccgaaaaagtggatttcgtccgtccaatgagaattcacactggagagaaaccctgcaaatgtgtcgagtgtggcaaagtttttaacagaaggagccacttgctctgttatagacagatacacaccggcgaaaaaccatacgaatgcagcgaatgtggaaaaacgttctcatatcactcagtctttattcaacatagagtgacccatactggcgaaaagctcttcggctgtaaagaatgtggcaaaactttttattacaacagctctctgacccgtcacatgaagatccacactggcgaaaaaccatgcaaatgctctgaatgtggaaagacttttacctataggagcgttttttttcgccatagtatgacacacaccgcaggaaagccttacgaatgcaaagagtgcggcaaagggttttactattcatactccttgactcgacataccaggtcccacaccggagagaagccttatgagtgtcttgaacataggaaggattttggctaccattcagccttcgcccagcaatccaagattcattccgggggaaagaacctttag

SEQ ID NO: 247813 - DNA, 822 bp, Artificial Sequence
  Description of Artificial Sequence: Synthetic coding sequence
atgtctccaaaaagagacggactcggcaccggagacggcttacatagtcaagtactgcaagagcaggtgtctactggagataacctgcatgaatgtgacagccagggcccatcaaaagacactcttgtcagagaaggaaagacctataaatgtaaagagtgtgggagcgtgtttaacaaaaatagcctgctggttaggcaccagcagattcatacaggcgtgaagccttatgagtgccaagagtgcgggaaggcctttcccgaaaaagttgacttcgtgaggccgatgcgcatccataccggagaaaaaccctgcaaatgtgtcgaatgtggcaaggtcttcaaccggagatcccatttgctctgttatcgacagatacacacgggggagaaaccctacgagtgcagcgagtgtggaaagacattttcttatcattcagtgtttattcagcatcgggtgactcacaccggcgagaagctcttcggctgcaaagaatgcggaaagacattttactataattcttcgctaacccgacatatgaaaatccataccggcgagaagccttgcaaatgttccgaatgcggtaagactttcacctataggtcagtcttttttagacattctatgacccatacagccggtaaaccttatgagtgtaaagagtgcggcaagggattctactacagttatagcctgaccagacacacacgatcacatacaggagagaaaccatatgaatgtttggagcaccgcaaagactttgggtaccactctgcgttcgcacagcagagcaagatccatagcgggggaaaaaacctgtag

SEQ ID NO: 247814 - DNA, 3630 bp, Artificial Sequence
  Description of Artificial Sequence: Synthetic coding sequence
atggagtgctattacattgtgattagttctacacacctgtcgaatggccacttccggaacattaaaggagtgtttcgcggtccacttagtaaaaatggtaacaaaacgctcgattatgcggagaaggagaatactatagcgaaagcactggaagacctgaaagccaacttttattgtgaactgtgcgacaaacagtattataaacaccaagagttcgacaatcacatcaatagctacgaccatgctcacaagcaaaggctgaaagagctgaaacagcgggagttcgctcggaacgttgcgagcaagagtcgaaaggatgaacgcaaacaagaaaaagcgctgcaaagacttcacaaacttgccgagctgagaaaagaaacggtctgcgctccaggatctgggccaatgtttaagtcaaccacagtgactgtccgcgaaaactgcaatgaaatatcccaaagagtggtcgtggactccgtcaacaatcagcaggacttcaagtacactttaatccactccgaggagaacacaaaggatgccaccaccgtcgccgaagaccctgaatccgccaacaactataccgctaaaaataatcaggtaggtgatcaagcccaggggatccataggcacaaaatcgggttttcttttgctttccccaaaaaagctagcgtaaaactggagagtagtgctgccgctttttccgagtactcggatgacgcatccgtgggcaaaggctttagccgcaaatccaggttcgtgccatctgcctgccacctgcagcaaagctctccgacggatgtgcttctgagctctgaagagaagaccaattcatttcacccccctgaggccatgtgtcgggataaggagaccgtgcagactcaggagattaaagaggttagtagcgagaaagatgcactccttttgccctccttctgtaagtttcaactgcagctgagctccgacgcagataactgccagaattcagtgcccctggctgaccagatccccttggagtccgtcgtgattaatgaggatatccctgtgtccggaaactctttcgagctgctgggtaataaatccacggtgctggatatgagtaatgattgtattagcgtacaggcaaccacggaggaaaacgtgaagcataatgaagccagcaccaccgaagtagagaacaagaatggccctgaaacgttggccccatctaacaccgaggaggtgaatataacaatacataaaaagacaaacttctgtaaacgccaatgcgagccttttgtcccagtgctcaataaacaccggtctacggttctccagtggccgtccgagatgttggtttacactaccactaagccaagtataagctacagctgtaatccactgtgctttgacttcaaatcaacaaaagtcaataataacttagataaaaataaacccgatctcaaagatctatgctctcagcaaaagcaagaggatatttgtatgggcccactgagcgactacaaagacgtctctaccgagggtctgaccgactacgaaatcggctcctcaaagaacaaatgctcacaagtaacgccactgctggccgacgatatcctgtcgagttcgtgcgattctgggaagaatgagaacacaggtcagagatacaagaatatcagttgcaagattagagagaccgaaaagtataactttacaaagtcacagatcaagcaggacacattggacgagaagtacaacaagatccgccttaaagagactcacgaatattggttccataagtcccggagaaaaaagaagcggaagaagttgtgccaacatcatcacatggagaaaacaaaggaatctgaaacacgatgcaaaatggaagccgagaattcctacactgagaacgccggaaaatatctgctggagccgattagcgaaaagcaatatctggcagccgagcaactgttagactctcaccagttactggataaacggccaaagtctgaaagcatctctctttccgacaatgaagagatgtgcaaaacctggaataccgagtacaatacgtacgacacaatctccagcaaaaatcactgtaaaaaaaatactattctgctcaatggccagagtaacgccactatgatccattcagggaaacacaacctgacctacagtaggacctattgctgctggaagactaagatgagcagctgctcgcaggatcaccgcagcttggttcttcagaatgatatgaagcatatgtcccaaaaccaggctgttaaacggggatataactccgtcatgaatgagagcgagcgcttttatcgtaagagaagacagcattctcattcttattcgtctgacgaaagcttgaaccggcagaaccacctgcccgaagagttcctgcgtcctccgtcaacatccgtggccccttgtaagcctaaaaaaaaacgtcgacgtaagaggggccgttttcacccaggctttgagaccctcgagctcaaagagaacaccgattaccccgtgaaagacaacagttcccttaaccccctagatcgattgatttcagaagacaaaaaagaaaaaatgaagcctcaagaagtagccaaaattgagcggaattcggaacagaccaaccaactgcgaaataaacttagtttccatcctaataacctgctgccaagcgaaactaatggcgagacagaacaccttgaaatggaaaccacaagtggcgaactctcagatgtgtccaatgacccaaccacctctgtgtgcgttgcctccgcgccaactaaagaagccatcgacaatacgctcctggagcacaaggaacgcagcgaaaacatcaatctgaacgagaaacagatcccattccaagtgccgaatatagagcgcaattttcgtcagagtcaaccaaagagttatctctgtcactatgagctggccgaagccctacctcagggaaagatgaatgagactccaaccgagtggctccgttataactctggcattctgaatacccagccgccacttccattcaaggaggcacatgtgtctggacacacgtttgtcacggctgagcagattcttgctcccctagccttacctgaacaggccctcctgattcccctggagaaccacgacaaattcaaaaatgtgccatgtgaggtgtaccagcacatcctgcagcccaatatgctggccaataaggtcaagtttaccttccccccagccgctctgccacctccgagtacacctctgcagccactcccactgcaacaaagcctttgcagcacaagcgtcactactattcaccatacggtgctccaacagcacgccgcagctgccgctgctgcggcagccgctgccgctgccggtacatttaaagtgctccagccacaccagcaattcctcagccagatccctgctctgaccagaactagcctccctcagttgagtgtgggcccagtggggccacgcctctgtccaggtaatcagccaaccttcgtggccccaccccagatgccaattatccccgcttcggtgctccatccatcccatcttgcctttccttctttaccgcatgctttatttcctagtctgctgagcccccaccctaccgtgatccccctgcagcctcttttttag

SEQ ID NO: 247815 - DNA, 210 bp, Artificial Sequence
  Description of Artificial Sequence: Synthetic coding sequence
atgcccgcaaacgaggatgcccctcaaccaggtgagcatgggagcgcttgcgaggtgtccgtgtcttttgaggacgtaacagtcgatttcagccgcgaggagtggcagcaactcgactccacccagcgacgcctctaccaggacgtgatgctcgaaaactacagccacctgctcagtgtcggcaaagataaccacccagtgaagctgtag

SEQ ID NO: 247816 - DNA, 1986 bp, Artificial Sequence
  Description of Artificial Sequence: Synthetic coding sequence
atgccggctaacgaggacgcaccccagcccggtgaacatggctctgcttgtgaggttagtgtgtctttcgaagatgtcactgtagacttcagccgggaagaatggcagcagcttgacagcacacagagaagattgtaccaagacgtgatgctggaaaactactcccatcttctctctgtgggcttcgaggtacctaagccagaggtaattttcaaacttgagcaaggggaagggccttggacactggaaggggaggctcctcatcagtcgtgctcagatggcaagttcgggatcaagccgtcccaaagaaggatcagcggcaagtctacttttcattcggagatggaaggcgaggacacgagggatgattctctgtactccatcctggaagagctgtggcaagatgccgaacagatcaaacgatgtcaggagaagcacaacaaactcctgtccaggactacttttctcaacaagaagattctcaataccgaatgggattatgaatacaaggatttcggcaaattcgtccatccttctccaaacctgattctctctcagaaaaggcctcataaacgcgacagcttcgggaaaagcttcaagcacaacctggatctccacatacataacaagagtaatgcagctaaaaatctcgacaaaactatcggtcacggtcaggtgtttacccaaaactcctcctattctcatcatgaaaacactcatactggcgtgaagttttgcgagagaaaccagtgcggcaaggtgcttagccttaagcattccctgtcccagaacgttaagtttcctataggcgagaaggctaacacatgcactgaatttggcaagatcttcacacagcggtctcacttctttgctccacagaagatacacactgtggaaaaacctcacgagctctccaagtgcgtgaatgtgtttacgcagaaaccactactctcgatttatctgcgggtgcacagagacgaaaagctgtatatctgcaccaagtgtggtaaggcatttatccaaaattccgaactgattatgcacgagaaaacccacacccgtgagaaaccgtacaaatgcaatgagtgcggtaagagtttcttccaggtgtcatccttgctgagacatcagacgacacacacaggggagaagctctttgagtgttcagagtgcgggaagggttttagcctgaactctgccctcaatattcaccaaaaaattcatacaggagaacgccaccataaatgttccgagtgcgggaaggcttttacgcaaaagagtaccctgcggatgcaccaacggatccatactggggagagatcctatatatgcactcaatgcggtcaggccttcattcaaaaggcccatttgattgctcaccagagaatccacaccggcgagaaaccttacgagtgctcagattgtggaaagagctttccctccaagagccagttgcagatgcataagaggattcacaccggagagaagccatacatctgtacagaatgcggaaaggccttcacgaaccgcagtaacctgaatacacaccagaagtcacacaccggagaaaagtcttatatctgcgctgagtgtggcaaggcatttactgacaggtccaatttcaacaaacaccaaacaatccatactggggagaagccttatgtttgcgccgactgcgggcgagccttcatccagaaatctgaacttattacgcaccagaggatacataccacagaaaagccctacaaatgtccagattgtgaaaaaagcttctcgaaaaagccccatctaaaagtgcaccagcgcatccacaccggtgaaaagccctatatatgcgccgagtgtggaaaagcatttaccgacaggtcgaattttaataagcaccagaccatccatacaggagacaagccatataagtgctcggattgtggcaaaggctttacccaaaaaagtgtcctgtccatgcatagaaacatccacacatag

SEQ ID NO: 247817 - DNA, 312 bp, Artificial Sequence
  Description of Artificial Sequence: Synthetic coding sequence
atgccagcaaacgaggatgcaccccagcctggggagcatggaagcgcttgtgaggtgtccgtgtccttcgaggacgtgaccgtggacttcagtagagaggaatggcagcagcttgatagcacacagcgtaggctataccaggacgtgatgctcgaaaactactctcacctgcttagcgtgggctttgaagtccctaagccagaggtgattttcaagctcgagcagggagagggaccatggactctcgaaggggaggcccctcaccaaagctgctccggtatttcaacctatttcgtcacatctacagtgtag

SEQ ID NO: 247818 - DNA, 1986 bp, Artificial Sequence
  Description of Artificial Sequence: Synthetic coding sequence
atgcctgctaatgaagacgcgccacaacccggtgagcacggatccgcatgcgaggtgagcgtgagcttcgaggatgttacagttgacttcagtagagaggagtggcagcagctcgactccacgcaacgcaggttataccaggatgtgatgttagagaattactcccacttattgtccgtagggtttgaggttccgaaacccgaggtcatcttcaaacttgagcagggcgaaggcccttggacattggagggggaagcccctcatcagagctgtagcgatggaaaatttggcatcaaaccaagccagcgccgaatctcaggaaagagcacgtttcactcagagatggagggcgaagatactcgtgacgattccctctacagtattttggaagagttgtggcaagacgctgaacagattaaacgatgccaggagaaacataataagctgctgtctcgcaccacttttttgaataaaaagatcctgaacacagaatgggactacgagtataaggacttcggaaagtttgtccacccctctcctaatctgatcctgtctcagaagagaccccataagcgcgatagtttcgggaagtcatttaagcataatctggacctgcacattcacaacaagtctaacgctgctaagaacctggacaaaactatcgggcatgggcaagttttcacccagaatagttcctacagtcaccatgagaatacacacaccggcgtgaagttctgcgaaaggaaccagtgcgggaaggtgttatccctcaagcactctttgagtcagaatgtgaagtttcctataggggaaaaggccaacacctgtaccgagtttgggaagatctttacacagcggagtcacttctttgccccacaaaaaatccataccgtcgaaaaacctcatgagctttccaagtgtgtaaatgtattcacacagaaacccctgctctcaatttatctcagagtgcatagagatgaaaaactgtatatctgtactaagtgcgggaaggcctttatccagaattcagagttaataatgcacgagaagacgcacacccgcgagaagccttacaagtgcaacgagtgtgggaagagtttttttcaagtgtcctcactgctccggcatcagacaacacacacgggagagaagctgttcgagtgctccgagtgcggcaagggcttcagcttgaattcagcactgaatattcatcagaaaattcatacgggtgagagacaccataagtgcagtgagtgcggaaaagcattcacccagaaatcgactttgcgcatgcatcagaggattcacacgggggagagaagttatatctgcactcagtgcggccaagcctttattcagaaagcccatttaatcgctcaccagcgcatccacaccggggaaaagccctatgagtgctcagattgcggcaaaagcttcccatccaagtcccagctgcagatgcacaaacggatccatactggagagaagccttatatttgcactgagtgcggcaaagcttttactaacaggtccaatctgaatacccaccaaaagtctcacacgggtgagaaatcttatatttgtgcggaatgcgggaaagctttcactgaccggtctaactttaacaagcaccagaccattcacaccggtgaaaagccttatgtatgcgcggactgcggccgtgcattcatccaaaagtccgagctgattactcaccagcggatccatactactgaaaagccctataaatgccccgattgtgaaaagtcatttagcaagaaaccacacctgaaagtccaccagagaatccatacaggcgagaagccctacatttgcgcggagtgtggtaaagcatttactgatcggagcaattttaataaacatcagaccatccacaccggagacaagccttacaagtgctctgactgcggcaagggcttcactcagaagagcgtcctctccatgcacagaaatatccatacttag

SEQ ID NO: 247819 - DNA, 369 bp, Artificial Sequence
  Description of Artificial Sequence: Synthetic coding sequence
atgcccgctaacgaggacgctccacaacctggtgagcacggtagcgcatgcgaggtcagcgtgtcgtttgaggacgtgaccgttgatttctcgcgggaagaatggcagcagctagactccactcagagacgcctgtatcaggacgtaatgctcgagaactactcccatttattgtcggtcggattcgaggttccaaagcctgaagtaatctttaaacttgaacagggagaaggaccatggaccttggaaggcgaggcgccacaccaaagctgttccgacggtaagtttggaatcaagccttcccaaagaagaatatctgggaagtcgacattccactcagaaatggagggagaggacacactttgttag

SEQ ID NO: 247820 - DNA, 1551 bp, Artificial Sequence
  Description of Artificial Sequence: Synthetic coding sequence
atgcatggtcggaaggacgatgcacagaagcagccggtgaaaaaccaactcggcctgaatccccagagccacctccccgagttgcagctgtttcaggcagagggaaaaatctataagtatgatcacatggagaaaagcgtgaactcttcatccctggtttcccccccacagcggatttctagtacagtcaagactcacatatcccatacttatgaatgtaatttcgtggacagtctctttacacagaaagaaaaagcaaatattggcacagaacactataaatgctctgaacggggtaaggcgtttcatcaaggcctacacttcacaattcatcagatcatccacactaaggaaacacagttcaagtgcgatatctgtgggaagatttttaataaaaagtccaacctggcctcccaccagcggatccataccggggaaaagccatacaaatgcaatgagtgtggtaaagtgttccacaacatgagtcacctggctcaacatcggaggatccataccggggaaaaaccctacaaatgcaacgagtgcggcaaagtttttaatcagatctcccatttggcgcagcaccaacggatacacaccggcgagaagccttataagtgtaacgaatgcggaaaagtcttccaccagatctctcacctcgcacagcataggactatccacacaggggagaaaccttatgaatgcaataagtgtggcaaggtattctccagaaacagctacctcgtgcagcatctgattattcacacgggagagaaaccttatcgttgcaacgtgtgtggcaaagtgttccatcatatctctcacctggcgcaacatcagagaatccacaccggcgaaaaaccatataagtgtaatgagtgcggcaaggtgttctctcataaaagctccctcgtgaaccattggaggattcacacaggggagaagccttacaaatgcaatgaatgtggaaaagtgttctctcataaatcttccctggtgaatcactggcggatccacactggagaaaagccatataaatgtaacgaatgtggcaaggtattctcccgaaattcctacctcgctcaacaccttattattcatgccggtgagaaaccttataagtgcgatgagtgtgataaggcattctctcagaattcacatctagtccaacaccatcgcattcacacaggagagaagccctataaatgcgatgagtgcggcaaagtattctcccagaatagctacttggcctaccactggaggattcacactggggaaaaggcctacaagtgcaatgaatgcggaaaagtgttcgggctcaactcaagtcttgcgcatcacagaaaaatacacacgggagagaagccattcaagtgtaacgagtgtggaaaagccttcagcatgagatcttcgcttactaaccatcacgctattcatactggcgagaaacatttcaagtgcaatgaatgtggcaagctgttccgggacaatagttacctcgtgcgtcatcagcgattccacgccggaaagaagtccaacacttgtaactag

SEQ ID NO: 247821 - DNA, 1467 bp, Artificial Sequence
  Description of Artificial Sequence: Synthetic coding sequence
atgcatgggagaaaggatgatgctcagaagcagccagtcaagaatcaactaggcctgaatccgcagagccacttgccagaactacagctgttccaagccgaaggtaagatctacaagtacgaccacatggaaaaatcagtgaactccagctctctcgtgagtcccccacagaggataagctccacagtgaaaactcacatctctcacacttatgaatgtaactttgtggatagtctgtttacccagaaggagaaggccaacatcggaacggaacactacaagtgtagtgaaaggggtaaggcctttcatcaagggctgcactttacgattcaccagatcatccatacgaaagagactcagttcaagtgtgacatatgtggtaaaatctttaataaaaagtcaaatcttgcgagccaccagaggatccatacaggcgaaaaaccttataaatgtaatgagtgtgggaaggtgtttcacaatatgtcccatcttgcacagcaccggaggatacacaccggagagaagccatataaatgcaacgagtgcgggaaagtcttcaaccaaatctcccacctagcgcagcatcagaggatacacaccggcgagaaaccatataagtgtaatgagtgcggcaaggtcttccaccaaatctcacacctggcccagcatcgcacaatccacacgggagaaaaaccttatgaatgtaacaagtgcggaaaggttttcagcagaaatagttacctcgtccagcacctgataatccacaccggcgagaaaccttatcggtgcaatgtatgcggaaaggtgttcagccataagagcagcctagtgaaccactggcgcatacacactggggagaagccatacaaatgtaacgagtgcgggaaggtgttctctcataagtcttccttggttaatcattggcggattcatactggcgagaaaccatacaagtgcaatgagtgtggcaaggtcttttctcgcaacagctatctcgcccagcatttaattattcatgccggtgaaaaaccctacaagtgtgacgagtgtgacaaagctttttcccagaatagtcatctagtccaacaccacaggatccatactggggagaaaccatacaaatgcgatgaatgcgggaaggtgttctcccagaacagttatttggcctaccactggagaatccacaccggcgagaaggcttataagtgcaatgaatgcggtaaggtcttcgggctcaactcatctttagcgcaccatcgcaaaattcacactggagagaagccctttaagtgtaatgagtgtgggaaagcattcagcatgcgctccagcttgacaaaccaccacgcaatccacaccggtgagaagcatttcaagtgcaacgagtgtggcaagctgttcagggacaactcctacttagttcggcatcagagatttcacgcagggaaaaagtccaacacatgtaattag

SEQ ID NO: 247822 - DNA, 1467 bp, Artificial Sequence
  Description of Artificial Sequence: Synthetic coding sequence
atgcatgggaggaaagatgatgcacagaagcagccggtcaagaaccaactcggactgaaccctcagagccatctcccggagcttcaactgtttcaggccgaaggtaagatctacaaatatgaccatatggaaaaaagcgtgaattcatctagcctggtcagcccccctcagaggattagcagcacagtgaaaactcacatctcccatacctacgaatgtaatttcgttgatagtctcttcacacaaaaggagaaagccaatatcggcacggaacattataagtgttccgagaggggcaaagcctttcaccaagggctgcatttcacaatccaccaaattatacacactaaggagacccagtttaaatgcgacatatgcggtaagatcttcaataagaaatctaatttagcaagccaccagagaatccacacgggcgagaaaccttacaaatgtaacgagtgcggaaaagttttccataacatgagccatttagcacagcaccggagaatccatactggagaaaaaccatataagtgcaacgaatgtggaaaggtgttcaaccaaatctctcaccttgctcagcatcaaagaattcacaccggggagaaaccatataagtgcaatgagtgtgggaaggttttccaccagatctcacacctggcccagcatcgcacgatacacactggggaaaaaccctacgaatgcaacaaatgcgggaaggtgttttcacgcaatagctaccttgttcagcacctaattatccataccggagagaagccctaccgatgtaacgtgtgcggaaaggtgttttcccataagtcctctttagtcaaccactggcggatccacactggggagaagccgtacaaatgcaacgaatgcgggaaagtcttttcacataaaagctctctggtcaaccattggcggatacacacaggcgagaaaccgtacaagtgtaacgagtgcggtaaggttttctcaagaaactcttacttagcccagcatctgataatacacgccggagaaaagccctataagtgcgacgagtgtgacaaggcatttagccaaaactcccacttggttcagcaccatagaatccatacgggggagaagccgtacaaatgcgacgaatgcggtaaggtgttctctcagaacagctacctcgcctatcactggcggatccatacgggagagaaagcctacaagtgtaacgagtgtggtaaggtgtttggtctgaacagcagcctggcacatcacagaaagatccatacaggggagaaaccgtttaagtgtaacgagtgtggaaaagccttttccatgcgtagctctctaaccaatcatcacgcaatccatacaggcgagaagcacttcaaatgcaatgagtgtgggaaattgtttcgcgataattcttatctggttcggcatcaacgctttcacgcgggaaagaaaagcaatacatgcaattag

SEQ ID NO: 247823 - DNA, 1551 bp, Artificial Sequence
  Description of Artificial Sequence: Synthetic coding sequence
atgcacggacgtaaggatgacgcacagaaacagccggtgaaaaaccagctcggtttgaacccccagtcccacctgcctgaattgcagttgttccaggctgaggggaaaatctacaagtacgatcacatggagaagtcagtcaactcgagctctcttgtcagccctccacagaggatttcttccaccgtcaaaacccatatttcacacacctacgagtgcaattttgtggattctctttttacgcagaaagagaaggcaaatattggcaccgagcactataaatgttcagagagagggaaagcgttccatcaaggactccattttactattcaccaaatcatacacaccaaggagacccagtttaagtgcgacatctgcgggaagatcttcaacaagaaaagtaacctggcttctcatcagcgaatccatacaggtgagaagccatacaaatgcaatgagtgtggaaaggtgttccacaacatgagccacctggcccagcaccgccgtatccatactggagagaagccttacaagtgcaatgaatgcgggaaggtttttaatcaaattagccaccttgcccagcatcaaagaattcatacaggcgagaagccctacaagtgcaacgagtgcggtaaagtgttccaccagattagccacctggcacagcaccggaccatccacaccggcgagaaaccttacgagtgcaacaaatgtggaaaggtctttagccggaatagctaccttgtgcagcaccttatcattcacacgggggagaaaccctaccggtgtaacgtatgtggtaaagttttccaccacatctctcacctggctcagcatcagcggatacatactggcgaaaaaccctataagtgcaatgagtgtggcaaggtgttcagccacaaatcttccctggttaaccactggcgcattcatacaggcgagaagccctataagtgtaacgagtgtggcaaagttttcagccacaaaagctctttggttaatcactggagaatccacacaggggagaaaccttataagtgcaatgaatgcggaaaggtgttcagccgcaacagctacttggctcagcacctgatcatccatgcaggtgagaagccctataagtgtgatgaatgtgataaagctttttcccagaactcacatctggtgcagcatcataggatccacacaggggaaaaaccgtacaaatgtgacgaatgcggaaaggtgttttctcagaacagctacctggcctaccactggcggattcatactggggaaaaggcctataaatgtaacgagtgcggtaaggttttcggtctgaattcctctctggcccatcatcggaagatacacaccggtgagaagcctttcaaatgcaacgaatgcgggaaggctttcagcatgcgctcttcactaacaaaccatcatgctatccatactggcgaaaagcacttcaagtgtaacgagtgcggtaagctgttcagggacaatagctatttggtgcgtcatcagaggtttcacgcagggaaaaaaagcaacacttgtaactag

SEQ ID NO: 247824 - DNA, 1551 bp, Artificial Sequence
  Description of Artificial Sequence: Synthetic coding sequence
atgcatggacgcaaagatgatgcccaaaaacagcctgtgaaaaaccagctaggcctaaacccccagagtcacctcccggagctccaactttttcaggccgaaggtaaaatttataagtatgaccacatggagaaatccgtcaactcttcaagcctagtcagcccgccacagcggatcagcagcacggtgaaaacacatatatcgcacacttacgagtgtaactttgtggacagcttgttcacacagaaggagaaggctaatattggcactgagcactataaatgttcagaaagaggaaaagccttccatcagggcctgcattttacaatccatcagatcatccacacgaaggaaacccaatttaaatgcgatatttgcggtaagattttcaataaaaagtccaacctcgcctcacaccaacgcatccacaccggggagaagccctataaatgtaacgagtgcggcaaggtgtttcacaatatgagtcatctcgcccagcatcggaggattcacacgggtgaaaagccttacaagtgcaacgagtgcggtaaagtgtttaaccagatcagtcacctggcccagcatcaaaggatccataccggggagaagccatataagtgcaatgagtgcggcaaggtctttcaccaaataagtcacctcgcccagcaccgaacaatccatactggggaaaaaccatatgaatgtaataagtgtgggaaagtgttcagccgcaacagttatcttgtccagcacctcataattcacacaggcgagaagccatatagatgcaacgtgtgcggaaaggtattccaccatatatcccatttggcacagcatcagagaatccataccggggagaaaccttacaagtgtaatgaatgtggcaaagtattttcccacaagtcttccctcgtcaatcactggagaattcacacaggcgaaaaaccttataagtgtaacgagtgtgggaaggtgttctcacacaagagcagcctggtaaaccattggaggattcatacgggggaaaagccctataagtgcaatgagtgcggtaaggtgttttcccgaaatagctatctggctcaacacctcattattcatgccggagaaaagccctacaagtgtgacgaatgtgacaaagctttcagtcagaactcacatttagtgcaacatcaccgaatccacacaggagagaaaccctacaagtgtgatgagtgtggcaaagtcttcagtcagaactcttacctggcataccattggaggatacacactggggaaaaagcctataagtgcaacgaatgtgggaaggtatttggcttaaatagcagccttgcgcatcaccggaagatacacaccggcgagaaaccattcaagtgcaacgagtgcggtaaggctttctcaatgcgctcctccctaaccaaccaccacgctattcacaccggcgaaaaacacttcaagtgtaacgaatgtggaaagctgtttagagataatagttacctggttagacaccagcgattccacgcaggcaagaaaagtaatacctgtaattag

SEQ ID NO: 247825 - DNA, 1551 bp, Artificial Sequence
  Description of Artificial Sequence: Synthetic coding sequence
atgcatggcaggaaagatgacgctcagaagcagcctgtcaaaaatcaactggggttaaatcctcaatcccatttgccagaactgcagctgttccaggccgagggaaagatttataagtacgatcacatggaaaaatctgttaactcatcctcgctcgtaagtccacctcagcggatttccagtactgtcaaaacacacatctcacacacatatgaatgtaacttcgtggacagtctgttcacgcaaaaagagaaggctaacattggtactgagcattacaagtgttctgagcggggaaaagcatttcaccaaggcctgcacttcacaattcaccagattatccatacaaaggaaactcaatttaaatgtgatatctgtgggaagattttcaataagaagtccaacctggccagtcatcagaggattcatacaggagagaagccatacaagtgcaacgaatgcggaaaggtcttccacaacatgtctcacctagcacagcatcgtaggattcacacgggggaaaaaccgtataagtgtaacgaatgtggtaaagtattcaaccagatttcgcatttagcccagcaccagagaatccacacaggtgagaaaccttacaagtgtaatgaatgcgggaaagtcttccaccagatctcacatctggctcagcatcgcacaatccacaccggagagaagccttacgaatgtaacaagtgtggcaaggtgttttcacggaattcgtatttagtgcagcatctgatcatccataccggagaaaagccttatcgctgcaacgtgtgtgggaaagtgtttcaccacatctctcacctggcacagcaccagcggatccacaccggagaaaaaccttataaatgtaacgagtgcggcaaggtgtttagccacaagagttctttggttaaccattggcgtattcacaccggtgagaagccatacaaatgcaatgagtgtggtaaggtcttttctcacaagtcttcactcgtgaaccattggcggatccatactggcgaaaagccgtataaatgcaatgagtgtggcaaagtttttagcaggaacagctacctggcacagcatttaatcatacacgccggtgagaagccttacaagtgcgatgaatgcgataaggctttcagccagaattcccacctggtgcagcatcacaggatacacactggtgagaagccctataaatgtgatgaatgtggcaaggttttttcacagaacagttatctggcataccactggagaattcatactggagagaaagcttataagtgcaacgagtgcggaaaagtgttcggtctgaatagctctctggcccaccaccgtaaaatacacaccggggagaagccatttaagtgtaatgagtgtggcaaggcattttccatgcgttcgtctctcaccaaccaccatgccatccatacaggggagaagcattttaagtgtaatgaatgtggcaaattgttccgggataacagttacctggttcgccatcagagatttcacgccggaaaaaagtcaaacacatgcaactag

SEQ ID NO: 247826 - DNA, 1551 bp, Artificial Sequence
  Description of Artificial Sequence: Synthetic coding sequence
atgcacggcagaaaagatgacgcgcagaaacagccagtgaagaatcagctgggcctgaatccccagagccaccttcccgagctgcagctcttccaggcagaggggaaaatatataagtatgatcacatggaaaagagtgtgaattcaagcagcttggtcagcccccctcagcggatcagtagtaccgtgaaaactcacatcagccatacttacgaatgtaacttcgtggatagcttattcactcagaaggaaaaggctaacattggaaccgaacactacaaatgctctgaacgtggcaaggcctttcatcaggggcttcattttaccatccatcagatcatccatactaaagaaacgcagtttaagtgcgacatttgtgggaagatattcaataagaaaagtaacttagctagccaccaaaggatccacaccggcgagaagccatacaagtgtaatgaatgtggcaaagtcttccataatatgagccacctcgcccagcatagacgtattcacaccggcgaaaagccttataaatgcaatgagtgcggaaaggtgttcaatcaaatttcccacctggcccaacatcaaagaatccacaccggagagaaaccatataaatgtaatgagtgcgggaaggttttccaccaaatcagccatctcgctcaacacagaaccatccacactggcgagaagccctatgagtgtaacaaatgcggaaaggtattttcaagaaactcatacctagtccaacacctcataatccataccggagaaaaaccttataggtgtaacgtgtgtggcaaggtgttccaccatatctctcacttggcgcagcatcagcggatccacaccggagaaaaaccgtacaagtgtaacgagtgtggcaaggtcttctcacacaaaagttcattagtgaatcattggagaatacataccggggaaaagccatataagtgcaacgaatgtggcaaggtattcagccacaagtccagcttggtcaaccactggcggattcacaccggtgagaagccgtacaaatgcaatgagtgcggcaaagtttttagcagaaatagctacctcgctcagcatctaataattcacgccggagagaaaccttacaagtgtgacgagtgtgacaaggccttcagtcagaattcccatctggtgcagcaccacaggatccacacaggcgagaagccatacaaatgtgatgagtgcggcaaggttttcagccagaactcttatctggcttaccactggaggatccacactggcgaaaaggcctataaatgcaatgaatgtggcaaagttttcgggctgaatagctcactagcccatcatcgaaaaatacataccggggagaagccattcaagtgtaacgaatgcgggaaagccttcagcatgcgatcctctctcactaatcaccacgctattcacacgggggaaaaacattttaagtgcaacgagtgcggaaagctgtttcgagataattcctacctggtgagacaccagagatttcatgcaggtaagaagtctaacacatgtaactag

SEQ ID NO: 247827 - DNA, 5033 bp, Artificial Sequence
  Description of Artificial Sequence: Synthetic coding sequence
atggaagtgcccgaaccaacttgccccgctcctcctgcccgagaccaaccagccccaacacccggaccgccaggggctccgggaggacaggcgagtccccaccttacccttggtcctgtgctgctgcctcctgagcaaggcctagccccacccacagtctttctaaaagcccttccaataccactctaccacaccgttccccctgggggactgcagcctagggctcccctggtgacgggttctctggacggaggtaatgtgccttttattctctccccagtgttgcagccagaggggcctggacctacacaggttggtaagccagctgccccaacattaacagtgaacatcgtgggtaccctccccgtgctgtctccgggactgggcccaaccttgggcagtcctggcaaggtgcgtaacgccggaaaatacctctgcccccattgtggtcgggattgtcttaagccaagtgtcctggaaaagcacataagaagccatactggagagaggccctttccgtgtgctacatgcggtattgcttttaagacccagtccaatttatataaacaccgacgcacacagactcaccttaacaacagccggctgagctctgaatccgagggagccggagggggtttgctcgaagagggtgataaagccggtgagccaccaaggcccgagggacgaggagagtcccggtgccagggaatgcacgagggagctagtgaaagacctctgagtccaggagcgcacgtgcctctgcttgctaagaacctcgacgtccgtactgaggccgcaccttgccccggaagcgccttcgctgacagggaagccccatgggattctgccccaatggcgagtccgggactgccagcggcatctacccagccctggagaaaactgcccgaacaaaaatcaccaacagctggtaaaccttgcgcactgcagcgtcaacaggccacagcggctgaaaagccctgggacgctaaagctcccgaggggagacttcgcaaatgcgaaagtacggactctggctacctgtctcgcagcgactctgctgaacagccccacgcaccttgctcccctttacatagcctatcagagcactcggccgagtcagaaggcgagggaggacctgggccaggccctggcgttgctggggcagaacctggggcacgggaggccggtttagagctggagaagaagcgactggaggagcgaatcgcacagttaatctctcataaccaggcagtggtagatgacgcccagttggacaatgtgcgcccacggaaaaccggactctcaaagcagggctcaattgaccttccaactccttacacttataaggatagcttccattttgacatacgcgcactcgaacctggacggcgaagagctccagggccagtgagaagtacctggaccccgccagataagagccgaccacttttcttccactcagtgcctacacagctcagcacaactgtcgagtgcgtgccggtgactagaagtaactctctgccttttgtggaagggtctcgcacatggctggagccaagagaaccccgtgatccttggtcccgaacacaaaaacccctgagccctcgaccagggcctgcccgtctagggtgccgtagcggtctgtcaagcacggacgttcccagcggtcaccctcgcgcactggtgcgacaagccgcagttgaggacctgccaggcaccccgatcggcgacgctttagtaccggctgaggataccgatgcaaagagaacggcggctcgggaggctatggccggaaaaggcagagctgggggaagaaaatgtggacaacgcagattgaaaatgtttagccaggagaaatggcaagtgtacggggacgaaacctttaaacggatctaccaaaagatgaaagcgtctccacatggcggaaagaaagctagggaggtggggatgggttccggagctgagcttggatttccgttacagaaagaggccgcaggctctagcggcaccgtgcccacacaggatcgcaggaccccggtgcatgaagatattagtgccggagccaccccagagccctggggcaatccacctgcactcgaagcatccctggtaaccgaacctactaagcatggtgaaactgtcgcccgacgaggagattcagacaggcctagagtcgaagaggcagtttcttcaccggctcttggagggcgagatagcccatgcagcggatccaggagccccctggtgagcccaaacggacgtttagagctgggatggcagatgcctccggctccaggtcccttgaaaggcggagatgtcgaggcccctcgcccagtttggcccgatcccaaactggaaggaggcgcaagaggagttggggacgtccaggaaacctgtctctgggcacagaccgtcctgcggtggcccagccggggatcaggcgaagacaagttgccttcagagcgcaaaaaacttaaagtggaggacctgcattcctggaagcagcccgaacccgtatctgcagagacgccaggagggcctacccagcccgcttcactttcaagccagaagcaggacgccgatcccggagaagtaccaggtggctcaaaggaaagcgctcgacaggtgggagaaccactggagagtagcggggctagtctagccgcagcgtccgtcgcactgaaacgcgtcgggccaagggataaggctacacctctgcatccagcagcaccagcaccggcagagcacccctccctggccactccgcctcaggcccctcgggttctgtccgccctcgccgacaatgccttttcaccaaagtatctcttgcgactaccccaggctgagacccctcttcccctgcctataccctggggacccagacactcccaagattctctgtgctctagcggctggcctgaagaacgggcttcattcgtgggctctggtctggggaccccacttagtcctagtccagccagtggcccaagtcccggagaagcagacagtatacttgaggacccttcatgcagccgacctcaggacgggaggaaaggagcgcagcttgggggagacaagggcgaccgcatggcgacgtccagacccgctgctcgggaacttccgatctctgccccaggcgctccaagggaggccactagttcccctcctactccgacatgcgaagctcatctagttcaggacatggagggggattcacaccggatacaccggttgtgcatgggatcaaccctggctcgggctcggctttctggggatgtgctgaacccttgggtacccaactgggaattgggtgagccacccggtaatgccccagaggatcctagcagcggtcccctggtaggccctgatccctgcagccccctgcaacctggtagcttcctgaccgcattgacccgaccacagggagtgccccctggctggccagaacttgctttgtcctcacactctggcactagccgtagtcacagcacacgctccccccacagcacacagaacccatttcccagcctgaaggcagagccccgactgacgtggtgttgtctgtcaaggtccgtgcctcttcctgcagaacagaaagccaaagcagcaagtgtgtatctggccgtccattttccagggtcctctctgagggatgagggacctaacgggccaccaggtagtaatggcggatggacttggacaagccctggggagggaggaccagcacagatgtcaaagttttcctatcccaccgtgcctggtgttatgccacagcatcaagtaagcgaacccgaatggaaaaaaggactaccctggcgagccaagatgtcccgcggaaacagtaagcagcgcaaactgaaaatcaacccgaaaaggtataaggggaactttctgcagagctgtgtgcagctccgggcttccagattaagaactcctacatgggtgcgacggaggtcacggcatccccctgctctagaaggtctgaaaccttgtcgcacgcccggacagacatccagtgagatcgctgggctgaatcttcaagaggaaccaagttgcgctacatcagagagccccccatgctgcgggaaggaagagaagaaggagggtgactgcaggcagactttaggtacacttagcctagggacgagttctcgaatcgtaagagagatggataaacgcaccgtgaaagatatttccccaagcgccggagaacacggagattgcacgactcattcgacagctgctacctcaggccttagcctgcagagcgatacttgtcttgctgttgttaacgacgtcccactgcctcccggaaaggggcttgatctggggcttcttgagacacaactgcttgcgagccaagactccgtaagtacagatcccaagccttacatattctctgatgctcagcgcccatctagtttcggatcgaaagggacctttccccaccacgacattgcaacctcagtcgccgcagtgtgtatatccttgcccgtgcgcaccgaccatatcgcccaggagatccatagcgcagagtcccgagaccactcccaaaccgcagggcgtacccttacctcgtcttctcctgatagtaaagtgaccgaggaggggcgagcccagaccctgctcccagggcgtccctcttctggacagaggatcagcgatagcgtgccattggagagcaccgagaaaacacacctggaaatacctgcaagcggaccgtcttcagctagctctcaccacaaggagggtcgacacaaaactttctttccctcgcgtggccagtatggatgcggggaaatgaccgtcccatgtccaagcctggggagcgatggacgtaagcgacaggtgagcggactcataacaagaaaagattcagtcgtgccaagtaagcccgagcagcccatagaaatccccgaagctccatcaaagagtctgaaaaagcgctccttggagggcatgcggaaacagacacgggtggaattttctgatacaagcagcgatgatgaagacaggcttgttatagagatcta

SEQ ID NO: 247828 - DNA, 264 bp, Artificial Sequence
  Description of Artificial Sequence: Synthetic coding sequence
atgggaccccttaccttccgagacgtggccattgaatttagcctcaaagagtggcagtgcctcgatacagctcaaaggaatctttaccggaatgttatgctggaaaattaccgcaacctggtgtttctcggtattacagtcagcaaaccggacctgataacctgtctagaacagggcaaagaggcatggtcgatgaagcggcacgaaataatggtggccaaaccgaccgaatcttatagtgtgacccagagtggaatgcagtag

SEQ ID NO: 247829 - DNA, 1788 bp, Artificial Sequence
  Description of Artificial Sequence: Synthetic coding sequence
atgggtcctcttaccttcagggatgtagccatcgagttctctttgaaggaatggcagtgtctagacactgctcagaggaatctttatcgcaatgttatgctagaaaattatcgcaatttggtattcctgggcatcaccgtgtccaagcctgatcttatcacctgtctggagcagggaaaagaggcctggtccatgaagagacacgaaatcatggtggccaaaccaactgtgatgtgttcccactttgcccaagatttgtggccggagcagaacatcaaggatagttttcaaaaggtgacgcttaagcgttacggcaagtgtagacatgagaatttgcctttgaggaaaggatgtgagtcaatggatgagtgcaaaatgcataaaggcggatgcaatggtctgaatcagtgtctgaccgccacccagtcaaaaatctttcaatgcgacaagtacgttaaagttgcccacaaatttagtaattccaatcgacacgaaatccgacataccaaaaaaaagccattcaagtgcaccaaatgtggtaaatcgtttggaatgatttcgtgcttgacagaacattcccgcatccatactcgggtaaacttctacaagtgtgaggaatgtggtaaagccttcaactggagctccaccctgactaaacacaagcggatccacactggagaaaaaccttataaatgcgaagaatgtggcaaggcctttaaccagtcgagtaatctaatcaaacacaaaaagattcacacaggcgagaagccctataaatgcgaagagtgtggaaagacattcaatagattcagcacattgacaacccacaaaattattcacaccggggagaaaccttataaatgtaaagaatgtggcaaagcctttaaccgttccagcacactcacaacacatcgcaaaatacacaccggcgagaagccatacaagtgtgaggaatgtggcaaggcctttaagcagtcatccaatttaactacacataagattattcacaccggagagaaaccttataagtgcaagaagtgtggtaaagccttcaatcagagcgctcatctgactactcacgaggtcattcatactggagaaaaaccatataaatgtgagaaatgtggcaaagctttcaatcactttagccacctgacgacccataaaataattcataccggtgagaaaccttacaagtgtaaggaatgcggaaaggcatttaaacacagtagtaccctgactaaacacaaaattatccataccggagaaaaaccatacaagtgtaaagagtgcgaaaaggcgtttaaccagtcctccaagctgaccgagcataagaagattcacactggcgaaaaaccttacgagtgcgagaaatgcggcaaggccttcaaccagtccagcaatttgactagacataagaagtcccatacagaagaaaaaccctacaagtgcgaggagtgtggaaaagggtttaaatggccctccactctgacaattcataagatcatccacaccggagaaaaaccttataagtgcgaagaatgtggcaaggcttttaaccagagttctaagctgaccaagcacaaaaaaattcacactggagagaagccgtacacttgcgaggagtgtggcaaggcttttaaccagagttccaacctgacgaagcataagcggatccatacaggagaaaagccgtataagtgcgaagagtgtgacaaggcttttaagtggagttccgtgcttactaaacacaaaattattcatactggggagaagttacagatctag

SEQ ID NO: 247830 - DNA, 1689 bp, Artificial Sequence
  Description of Artificial Sequence: Synthetic coding sequence
atgggaccactgaccttcagagatgtagctatcgagttctcgctgaaagaatggcagtgtctggacacagcacagcgaaatctttaccgcaacgtcatgctggagaattatcgcaatctcgtattcctggtgatgtgttctcacttcgcccaggacctttggcctgaacaaaatataaaggactccttccagaaggtgaccctaaaacgttacggaaagtgccggcacgaaaatctgccattacgaaagggctgcgagagtatggacgagtgtaaaatgcacaaagggggatgcaacggtctcaaccagtgtctaacagcaactcagagcaagattttccagtgtgataaatacgtcaaggtcgctcataaattcagtaatagcaataggcacgaaattaggcacacaaagaagaagcccttcaaatgcaccaaatgtggcaagagttttggaatgatttcctgccttactgaacactctagaatccacaccagggtgaatttttacaagtgcgaagagtgtggcaaagccttcaactggtcgtccactttgacgaaacacaagagaatccacaccggcgagaaaccatacaagtgcgaagagtgtggtaaggcattcaatcaatccagcaaccttatcaagcacaagaagattcacacaggtgagaagccctacaaatgcgaggagtgcggtaagaccttcaatcggttctctactctaaccactcacaaaataattcatacaggtgagaaaccatataaatgtaaagagtgtgggaaagccttcaatagatctagtacgctgaccactcacaggaaaatccacacaggcgagaaaccctataagtgtgaggaatgcggtaaagcgttcaaacagtccagtaatctgactacacacaaaattatccacactggtgagaagccctacaaatgcaagaagtgcggcaaagcttttaatcagagcgcccacctcacaactcacgaagtgatccacactggcgagaaaccctataaatgtgaaaaatgtgggaaggctttcaaccatttctcccacttgacaactcacaaaatcatacacacaggcgagaagccatacaaatgcaaggaatgtggaaaagccttcaagcacagctccactctgacgaaacataaaataatccacaccggcgagaaaccttataagtgcaaagaatgcgaaaaagcctttaatcagagtagtaagctcacggagcacaagaaaatacacacaggggagaaaccctacgaatgtgagaagtgcggtaaggccttcaaccagtcctctaacctgacccggcataaaaaatctcataccgaggagaaaccttacaaatgcgaggagtgtgggaaggggtttaaatggccttcaacacttaccatccacaaaatcattcacacaggcgaaaaaccctacaagtgcgaagaatgtggcaaggctttcaaccaatcctcaaagttgaccaagcacaagaagatacacacaggcgagaaaccctacacgtgcgaagagtgcgggaaagcctttaatcaaagcagtaacctcactaagcacaagcgcatccatactggagagaagccctacaagtgcgaggaatgcgacaaagctttcaaatggtcctcagtgctgacaaagcacaagattatccacacaggagaaaagctgcagatatag

SEQ ID NO: 247831 - DNA, 1413 bp, Artificial Sequence
  Description of Artificial Sequence: Synthetic coding sequence
atgcataaaggagggtgcaatggactcaaccagtgcctcaccgccacacaaagcaaaatattccagtgcgacaagtatgtgaaggttgctcacaaatttagcaattcaaatcgacacgagattaggcacacgaagaagaaaccttttaagtgcacaaagtgtggaaaatcattcgggatgatctcatgtctgaccgaacactcaaggatccatactagggtcaacttctacaagtgtgaagagtgtggcaaagcttttaattggtcctcgaccctcacgaaacacaaaagaatccacacaggagagaagccgtataagtgcgaagagtgcggtaaggcgttcaatcagagttcaaacctcattaagcacaaaaaaattcacacaggggagaagccttacaaatgtgaggaatgtgggaaaactttcaaccggttttcaacgctgacaacacataagattatccacacgggcgagaagccttacaagtgtaaggagtgtggcaaagcattcaatagaagctcaaccttaaccacacatagaaagatccacaccggcgaaaagccttacaagtgcgaagagtgtggtaaagcctttaagcaatcgtccaatctgactactcacaagatcatccacaccggtgagaaaccctataaatgtaagaagtgcggtaaggcatttaaccagtcggctcacctgaccactcatgaagttatacatactggtgaaaaaccttataagtgtgaaaaatgcggtaaagcatttaaccatttctctcatttgaccactcacaagatcatccataccggcgagaagccttataagtgtaaggagtgtggaaaggcattcaaacacagcagtactctgactaagcacaaaatcatccatacaggggagaagccatacaagtgtaaggagtgtgagaaggcctttaatcagtctagcaaactcaccgaacacaaaaaaatccataccggcgaaaaaccgtacgagtgtgaaaaatgcggaaaggccttcaaccagagcagcaatcttactcgtcacaaaaagagtcatacggaagaaaaaccgtacaaatgcgaagaatgtggcaagggcttcaaatggccatcgaccctaaccattcataagatcatccacacaggtgagaagccctataaatgtgaagaatgcggaaaggcctttaatcaaagttccaagctgaccaaacataaaaagattcacacgggagaaaaaccttacacatgtgaggagtgtgggaaggccttcaaccagtcctctaaccttacaaagcacaagagaatccacacaggagaaaagccctacaagtgtgaagagtgcgacaaagctttcaagtggtcaagcgtcctgacgaaacataaaattatacacacaggcgaaaaactccaaatatag

SEQ ID NO: 247832 - DNA, 1806 bp, Artificial Sequence
  Description of Artificial Sequence: Synthetic coding sequence
atgggtcctttagagttccgggacgttgccattgagttctccctggaggaatggcactgtctcgacactgcccagcaaaacctctaccgggacgttatgctggaaaattataggcatctggtttttcttggcatcgtagtgacgaagcccgaccttatcacttgccttgaacagggcaaaaagccctttacggtgaaaaggcatgagatgattgcgaagagcccagtgatgtgcttccattttgcgcaagacctgtgccctgaacagtctctaaaggacagtttccagaaggtcatcgtgaccagatatgagaagagagagtatggaaatttggagctgaagaaggggtgcgagtctgtggacgaaggcaaggtccacaaaagggggtacaacggacttaaccagtgcctgaccgcaacccagtccaaagtgtttcagtgtgatacttacgtgaaggtttctcacatcttcagcaattctaacagacacaaaattagggataccggcaaaaagccattcaagtgtatcgaatgcggcaaggcattcaaccagagctctacactggcaacacataagaagattcacaccggcgagattacgtgcaagtgtgaggagtgcggcaaagcctttaaccgctcaagccatcttacaagccacaaacgcattcacacaggagaaaaaagatacaaatgtgaggattgtggcaaagaactgaagtactcctcaacgctcactgcacacaaacgcattcacacaggggaaaaacggtataagtgtgaggactgcgggaaagagctgaaatactcttctacactcactgcccacaaacgcatccataccggcgaaaagccctacaagtgtgacaaatgtggccgagcttttatctcttcttctattctgtatgtgcacaagatttctcacacagaggagaaaccttacaaatgcgaggagtgcgggaaagcatttaagctcagctccatcctatcaacacacaagcgaatccacacgggcgaaaagccatacaagtgcgaggaatgcggcaaagcttttaggaggagcctggtgcttaggacgcataaacgtattcataccggagaaaaaccatataagtgtgacaaatgtgggaaagctttcatttcgagcagtctgctgtacaagcataaaatttcacactccgaaaaaaagccctacaagtgcgaggaatgtggaaaggcttttaaacgatcttcaaccctgaccatccacaaaatttctcacaccgaggagaagccctacaagtgtcaggagtgcgataaggtgttcaaaagatcttctgctttgtctactcacaagatcatccatagtggcgagaaaccatacaaatgcgaagagtgcggaaaggcgtttaagagatcttcaaatctgacgacccacaagattagccataccgaggagaagttgtacaaatgtcaagaatgcgataaagcctttaaatactcttcagccctgagtacgcacaagattatccactcaggcgagaacccttacaaatgcgaagaatgtggaaaagcctttaaaagatccagtgtgttaagtaaacacaagattatccacaccggggctaaaccgtacaagtgcgaagagtgcggaaaagcctttaaaagaagcagccagcttacaagccacaagatttcacacacaggggagaagccatacaagtgtgaggagtgtggcaaggccttcaatctatccagtgatctgaacacacacaaacgcattcacatagggcaaaaagcctacatcgtaaagaacatggccaatctttag

SEQ ID NO: 247833 - DNA, 369 bp, Artificial Sequence
  Description of Artificial Sequence: Synthetic coding sequence
atgaggaagcacatcaaggagcgcgagctgtcactgatggagcaaattaaggaatttatcctggagagaaataccatgaacgtaccaacagtcggtaagccattcagtggaagacactccttgctgtccatccgtgaatttactttggggagatcacccatgaatgtgatgaatgtgggcgaaccgagtgaaaagaagccgacttgcatgatcatccgagagttcatccttgaaaaaaaccctattctggttcgcaatgtcggaaaaacctctgccgaagtgcagctgctgctgaacacccgagagttcattctcgaaatcaacagcagaaatcgggagatcaaagaattcgccgagtgtttttcatag

SEQ ID NO: 247834 - DNA, 1911 bp, Artificial Sequence
  Description of Artificial Sequence: Synthetic coding sequence
atggctccaaggccccctactgctgcaccccaggaatccgtgacctttaaggacgttagcgtagatttcacgcaagaagaatggtaccacgtcgatcctgcacaacgaagcctttatcgcgacgtcatgctggagaattactcccatcttgtctctctaggctaccaggtaagcaagccagaggtcatctttaagctggagcagggagaggaaccctggatttctgaaggcgagattcagcgtcccttctatcccgattggaagactaggcctgaagtcaaaagttcgcacctgcagcaggatgtttctgaagtctctcattgcactcatgacctgctgcatgccaccctcgaagactcatgggatgtgtctagccagcttgatcgacagcaagagaattggaagcgccacctggggagtgaagcgtctacccagaaaaaaattataacaccacaggaaaatttcgagcaaaacaagttcggagagaactccagattgaatacaaacctggtgacacagctcaacatccccgctaggattagacctagtgaatgtgagactctgggatccaatctgggccataatgctgatctactgaatgagaataatatcctcgccaaaaagaaaccctacaagtgtgataagtgcagaaaggccttcatccatagaagcagtttgaccaaacatgagaagacccacaaaggagaaggcgcatttcccaatgggacagatcagggtatatatcccggaaaaaagcaccatgagtgcaccgactgcgggaaaacattcttgtggaagacccagttaaccgagcaccagagaatccacactggggagaagcctttcgagtgtaatgtgtgcggcaaagcatttaggcacagctccagtctgggacagcatgaaaacgcccacaccggcgaaaaaccttaccagtgttcactgtgtgggaaggcctttcaacgtagctcttccttagttcagcaccagcgcatccacactggggaaaagccttaccgatgtaatctctgcggtcggtctttcaggcacggcaccagtctgacccaacacgaagttacacatagcggggaaaagcccttccagtgcaaggagtgtggaaaggcgtttagccgatgctcttcccttgtacaacacgagaggacccacactggagaaaaaccatttgagtgtagcatctgcggccgtgcattcgggcagagcccctcattatataaacacatgaggatccacaagaggggcaaaccttaccagtccagcaattatagcatagactttaagcattcaacatccctgacacaagacgaatctacccttacagaggtgaagagttaccactgtaacgattgcggagaagatttttcacacattacagatttcactgatcatcagcggatccacacagccgaaaacccctacgattgtgaacaggcttttagccagcaggcgatcagtcatcccggagagaaaccctaccagtgcaatgtttgtggaaaagccttcaagcgcagcaccagttttatcgaacatcatagaattcacacaggtgagaagccctacgagtgcaacgaatgcggggaagccttcagtcggcgaagttcattaacgcagcacgagagaacacatactggggaaaagccatatgagtgtatagactgcggcaaggcattctcgcagtctagctcacttattcagcatgagagaacacataccggagagaagccttacgagtgcaacgaatgtggaagggcgttccgtaagaaaaccaatttgcacgaccatcagaggattcatacaggagagaaaccctactcgtgtaaagagtgcggaaaaaatttcagtaggtcatctgccctgacaaagcatcaaaggattcatactagaaataagctctag

SEQ ID NO: 247835 - DNA, 3576 bp, Artificial Sequence
  Description of Artificial Sequence: Synthetic coding sequence
atgcccggtacacctggctccctggagatgggcctgctgacattcagggatgtcgccattgaatttagcccggaggagtggcagtgtctcgacactgcccagcagaatctttaccgaaacgttatgctcgagaactataggaatctcgccttcttgggcattgctctcagtaagcccgatctgatcacatacctcgagcagggtaaggagccatggaatatgaagcagcatgaaatggtcgacgaacctaccgggatatgcccacatttcccccaggatttctggcctgagcagtctatggaggattcattccagaaggtgttgttaagaaagtacgagaaatgtggtcatgaaaacctccagctacgcaagggctgtaagtccgtggatgagtgtaaggtgcacaaagagggctacaataagctcaaccaatgcttgacaaccgcccagtcaaaagtgttccaatgtggcaagtatttgaaggtgttctacaaattcctcaattcaaatcgtcacaccatacgacataccggaaagaagtgcttcaagtgtaagaagtgtgtaaagagcttttgtattcggctgcataagactcagcataagtgcgtttatatcacagaaaaaagctgcaagtgcaaggaatgtgagaagacctttcactggtcttcaactctcaccaaccacaaggagatacacaccgaagacaagccctacaaatgcgaggagtgcggaaaagctttcaagcagctttccacactcaccacccataaaatcatctgcgccaaagaaaaaatatacaagtgcgaggagtgcggtaaagccttcctgtggtctagtaccttgacgaggcacaaacggatccatactggggaaaagccgtacaagtgcgaggaatgtgggaaagcatttagtcatagctcgactttggctaaacacaagcggattcacactggcgagaaaccctacaaatgcgaggagtgcggtaaagcttttagtaggtcgagtactctggccaagcataagaggatccatacaggagagaagccctataaatgtaaggagtgcggaaaggctttctcaaattccagtaccctcgccaatcacaaaataacccatactgaggagaagccatataaatgcaaggagtgcgacaaagcgttcaaaaggttgtcgactctgaccaagcacaaaatcattcatgccggagagaagctttataagtgcgaagaatgtggcaaggcttttaacaggtcttctaatctcaccatccacaaatttatacacactggagagaaaccttacaagtgtgaggaatgtggtaaggccttcaattggagctctagtttgacaaagcataagcgtttccacacacgtgagaagccctttaagtgtaaggaatgcggcaaggcgttcatttggagttccactttaacccgccataaaaggattcacacaggcgaaaaaccgtacaagtgtgaggaatgcggcaaggctttcaggcagagttcgactttaactaagcacaagatcattcataccggggaaaagccatacaagtttgaagagtgcggtaaggccttccgtcaatcactgaccctgaataagcacaaaatcatccattcacgagaaaaaccttataaatgtaaagaatgcgggaaggcctttaagcagttctctacactcacgacccacaaaatcattcatgctggaaagaagctgtacaagtgcgaagaatgtgggaaagccttcaaccattcatcaagccttagcacccacaagatcattcatactggggagaagagctacaagtgcgaggagtgcgggaaggcctttttatggtcctcaaccctccgtcgtcacaagagaatccataccggtgagaagccatacaagtgtgaggagtgcggcaaggcattttcccactcttctgctttggctaagcacaagcggatacacactggggagaaaccttacaaatgcaaggaatgcggtaaggctttcagcaattcctctaccttggctaaccacaaaatcactcacacagaagagaagccctataaatgtaaggagtgtgataagaccttcaaaagactgtctaccctaacgaagcataaaattattcacgcaggcgagaagctctataaatgtgaagagtgtggaaaagccttcaaccggtccagtaatctcaccatccataaatttatccatacaggggaaaaaccttacaagtgtgaggagtgtgggaaagctttcaattggtcatcctctcttacaaaacacaaacggatccacactcgtgaaaaacctttcaaatgcaaggagtgcggcaaagcttttatttggagctccacactgacacgccataagcgcattcataccggcgagaagccttacaagtgtgaagagtgtggcaaagctttttccaggagttccacgcttactaaacataagacaatccacaccggcgagaaaccttacaagtgcaaggagtgcgggaaagcattcaagcattcttcggcactggccaagcacaagatcatacacgctggcgagaaactgtacaaatgcgaggagtgcgggaaggctttcaatcaaagttctaacttaaccacacacaaaatcattcacaccaaggagaaaccctccaaatcggaggagtgcgacaaggcattcatctggtcaagcactctgactgagcacaaacgcatccacacaagagagaagacgtacaagtgcgaggagtgcggtaaagccttctctcagccctcccacttgactacccacaagcgaatgcacactggtgagaagccttataagtgcgaggagtgcggaaaagctttctcccagagtagcacactcactacccacaagatcatccacacgggcgagaagccatacaagtgcgaagagtgcggtaaggcatttaggaagagctctacactgactgaacataagattatccacaccggggagaaaccatacaagtgtgaagaatgtggcaaggcctttagtcaatcgtccaccttaacccgccacacacggatgcacacaggggagaagccatacaagtgtgaggagtgcgggaaagcctttaatcgcagttctaagctcacaacacataagattattcacacgggggaaaagccctataagtgcgaagaatgcgggaaggcttttatttccagctcaaccttgaacggccataagagaattcacactagggaaaagccgtacaagtgcgaggaatgcgggaaggccttctcacagagtagcacacttactcggcataagaggttacataccggagaaaaaccgtacaaatgcggggaatgtgggaaggcgttcaaggaaagcagtgccctgactaagcataaaatcattcatactggggaaaagccctataaatgcgaaaaatgtggcaaggcattcaaccagtcctcaattctgacgaatcacaagaaaatacacacaatcacccccgttattccactgctttgggaagcagaggccggtggaagcagaggacaagagatggagaccatcctggccaatacggtgaagcccctgctgtactag

SEQ ID NO: 247836 - DNA, 3480 bp, Artificial Sequence
  Description of Artificial Sequence: Synthetic coding sequence
atgccaggaactccaggtagcctggaaatggggctgttaacgttccgcgatgtggccatagaattcagtccagaggagtggcagtgccttgacaccgcccagcaaaatctttatcggaacgtaatgctggagaattatcgcaatttagcattcctcgggatttgtccccatttcccccaagacttttggccggagcaatccatggaagacagctttcaaaaggtccttctgagaaagtacgaaaaatgtgggcatgaaaatcttcaacttcgtaagggctgtaagtccgttgacgaatgcaaggtgcacaaggagggatataacaaactgaaccagtgcttgactaccgctcaaagcaaagtcttccagtgcggtaagtatctaaaggttttctacaaatttttaaactctaacagacatacaatacgccacaccggtaagaagtgcttcaagtgcaaaaaatgcgtcaaatctttttgcatcaggctgcataaaacccagcataagtgtgtgtacatcacagaaaaatcctgtaagtgcaaggagtgcgagaagacatttcactggtcaagcacactcacaaatcacaaagagattcatactgaggataagccttacaagtgtgaagagtgcgggaaggccttcaaacagctatctacccttaccacacataaaatcatttgcgcgaaggagaagatttacaaatgtgaagagtgtggaaaggccttcttgtggtcaagcacccttactcggcacaaaaggatccacaccggggaaaagccctataaatgcgaagaatgcggaaaagctttctcccactcgagcaccttagcgaagcataagcggatccacacgggcgagaaaccttacaagtgtgaagagtgcgggaaggcattcagtagatcaagcacacttgcgaagcacaagaggattcacacaggggaaaaaccctacaagtgcaaggaatgtggaaaggctttctccaactcatccacgctcgccaatcataagatcacacacacagaggagaagccctacaagtgcaaagagtgcgataaggcatttaaacggttgagcacgctgacaaagcataagatcattcatgccggtgagaagctatacaaatgtgaagagtgtggcaaggcatttaaccgtagtagcaatctaacaattcacaagtttatacacacaggtgaaaagccatacaagtgtgaagaatgtggcaaagcattcaattggtccagcagcctcactaagcacaaacggttccatactcgcgagaagccgttcaaatgtaaggagtgtggaaaggcttttatctggtcatccacactgaccagacacaaacgaattcacaccggcgagaagccgtacaagtgtgaagagtgcggaaaagcattccgacaaagctctacactgacaaaacacaaaatcatccacactggcgaaaagccctacaaatttgaggagtgcgggaaggcttttaggcagtctctgacattgaataagcacaagatcatccactccagagagaaaccctataaatgcaaggaatgcgggaaggcctttaagcagttcagcactctgaccacccacaaaatcattcacgcgggaaaaaaactgtacaagtgcgaggaatgtgggaaagcctttaatcactcctctagcctgagcacacacaaaatcatccataccggagagaagagctataaatgcgaggagtgcggcaaggctttcctgtggtcctcaacactgaggcgccataaacgtattcatactggcgagaaaccatacaaatgcgaggaatgtggaaaagctttcagtcatagctccgccctggccaagcacaaacgaatccacaccggggaaaagccctataagtgcaaggaatgcggcaaagcttttagtaacagctcaacactggccaatcataaaattactcacacagaggaaaagccatataagtgtaaggagtgtgataaaacatttaaaaggctcagcacccttacaaagcacaaaataatccacgctggtgaaaaactatataagtgtgaggagtgcggaaaggccttcaatagatccagtaatctcaccatccacaaatttatacatacaggcgaaaagccttataaatgcgaggagtgcggcaaagcattcaactggagcagctcactgaccaagcacaagcgaattcacacacgcgagaagcctttcaaatgcaaagagtgcggaaaagcctttatatggtcaagcaccttaacaagacataaaaggattcataccggagaaaagccctacaagtgtgaggagtgtggtaaggctttcagccggagctcgactctgaccaaacataagacgatccacacaggcgaaaagccatataaatgtaaggagtgtggaaaggcctttaaacattcatccgctctcgctaaacataaaattatacacgccggagagaaactctacaagtgcgaagaatgtggcaaagcgttcaatcaatcctccaatttgaccacacacaaaattatccatactaaagagaagccaagcaaaagcgaagaatgtgacaaagccttcatttggtctagcacccttacggaacacaaaaggatccatacacgcgagaagacgtacaagtgtgaggagtgcgggaaggcattcagccagccaagccaccttaccacacataagaggatgcacactggcgaaaaaccatacaagtgcgaagaatgcggcaaggctttctctcagtcaagcacacttactactcacaaaatcatccacactggggagaagccctataagtgcgaggagtgtggcaaggcgttccggaaatcgtccacattaacagagcacaaaattattcatactggggagaagccttataagtgtgaggagtgcgggaaagctttcagtcagtcctctactttaaccaggcacactagaatgcacaccggcgaaaagccatacaaatgcgaggaatgtggcaaggcttttaacagaagtagcaaattgacgacccacaaaattatccatacaggagaaaaaccttataaatgcgaagagtgtggaaaggcctttattagttctagtactctgaacgggcataaaaggatccacacaagggaaaaaccttacaaatgtgaggagtgcgggaaagcattttcacagtcttcgactcttaccagacacaagaggctgcacacaggagagaagccctacaaatgcggcgagtgtggaaaggctttcaaggaatctagcgcgctgaccaaacacaagattatccacactggcgaaaaaccatacaaatgtgaaaaatgcggcaaggcctttaatcagtccagtatcctcacaaaccacaagaaaatccacaccattacacccgtgattccgctcctctgggaggccgaagctgggggatcgcgagggcaggaaatggaaactatcttggctaacactgtcaagcctcttctttattag

SEQ ID NO: 247837 - DNA, 1761 bp, Artificial Sequence
  Description of Artificial Sequence: Synthetic coding sequence
atgggaccactcacattccgggacgttaaaattgagttctccctcgaagagtggcaatgcctggatactgcacagcgtaatttgtatagagacgttatgttggaaaactatcgtaacctagttttcctcgggattgccgtcagtaagcccgacctgattacctggctggagcagggaaaggagccttggaatctaaagagacacgaaatggtcgataagacccctgtgatgtgctctcactttgctcaggatgtttggcccgagcattcgatcaaggatagttttcagaaggttatcctgcggacatatggaaaatacggccatgagaacctgcaactgaggaaggatcataagtccgtcgatgcttgtaaggtgtacaaagggggttataatggtcttaatcagtgtctgactacaactgactctaaaatatttcagtgcgacaagtatgttaaggtctttcataagttcccaaatgtcaacaggaacaagatccggcatactggtaagaaacctttcaaatgtaagaaccggggtaaatcattttgcatgttgagtcagctgacacagcacaagaagatccatacaagagagtatagctataaatgcgaagaatgtggaaaggcatttaactggtcatccacccttaccaagcataagattattcataccggagagaagccttacaagtgcgaggagtgcggtaaagctttcaataggagctcaaatctcaccaagcataagatcatccacacaggggaaaagccatacaagtgcgaggaatgcggaaaggcatttaatcgatcttcaactctgacaaaacataagcgtattcataccgaggaaaaaccttataaatgcgaagagtgcggaaaagccttcaaccagttttctatcctgaacaagcacaaacggatccacatggaagacaaaccttataaatgcgaagagtgcggcaaggcattcagggtattttctatcctgaaaaagcacaagattatacacacaggggagaaaccatacaagtgtgaagagtgtggcaaggccttcaaccagtttagtaatctaaccaagcataagattatccatacaggagagaagccatataagtgtgatgagtgtggaaaagcttttaatcaatcgagcactctgacaaagcacaaaaggattcacactggagaaaagccttacaaatgtgaggagtgtggtaaagctttcaaacaaagttctaccttgactgaacataaaatcatccatacgggcgagaagccctataagtgcgagaagtgcggtaaagcattctcttggagctccgcgtttacgaagcacaagaggaaccatatggaagacaagccctacaagtgtgaagagtgcggcaaagccttttctgtgtttagcaccctcaccaagcataagatcatccacactcgcgaaaaaccctacaaatgcgaagagtgcggtaaggcgttcaaccaatcctccatttttaccaaacataaaatcatccataccgagggtaaatcgtacaagtgcgagaagtgcggcaacgccttcaatcagagctcgaatttgacagcacgcaagatcatctataccggggagaagccctataaatatgaggagtgcgataaagcatttaataagttctctactttgattacccaccaaattatttacacaggcgagaagccttgtaaacatgaatgcggcagagcctttaataaaagcagtaactacaccaaagagaagcttcagacttag

SEQ ID NO: 247838 - DNA, 1665 bp, Artificial Sequence
  Description of Artificial Sequence: Synthetic coding sequence
atgggacccttgacatttcgggatgtaaagattgaatttagtctggaggagtggcagtgtctggatacagcacagcggaacctgtacagagacgtgatgctggagaattatcgcaatttggtattcctggtcatgtgcagccatttcgctcaggatgtttggcctgagcattcgatcaaggattcttttcagaaggtaatcttgagaacctacgggaagtacggacacgaaaacctgcagctcaggaaagaccacaaaagcgttgacgcctgcaaggtttacaagggcggatacaacggactcaatcagtgtttgacaaccaccgatagcaagatcttccagtgcgataagtatgtcaaggtgttccacaaatttcccaacgtgaacaggaacaagatccgccacactgggaagaaacctttcaaatgcaagaaccggggaaaatctttttgcatgctgagtcagttaacacagcacaaaaagatccacactagagagtacagttataaatgcgaggagtgcggcaaggccttcaattggtcttcaaccctcacgaagcataagattattcatactggagaaaagccctataaatgcgaagagtgcgggaaggctttcaacaggagttctaacctgactaagcacaaaatcatccacaccggagagaagccatacaagtgcgaggaatgcgggaaagcttttaataggtcctcaacgctgactaagcataagaggatccacaccgaggaaaagccctacaaatgcgaggagtgtgggaaggcttttaaccagttcagcatacttaataagcacaaacgtattcatatggaggacaaaccatataagtgcgaagaatgtggaaaggccttcagggtcttttctatattaaagaaacataaaatcatacacaccggggagaagccttataagtgcgaggagtgtggtaaggcatttaaccagttctcaaatttgacgaaacacaagattatccacacaggagaaaagccatacaagtgcgacgagtgcggaaaggcctttaaccaatcttcaacactcacgaaacataaacgaatccacactggcgagaaaccttacaagtgtgaagaatgcggtaaagcatttaaacagtccagcacgctgacggagcataaaataatccacactggggagaaaccttacaagtgcgaaaagtgtgggaaggctttttcttggtcatcagctttcacgaagcataaacgaaaccacatggaggataagccttataagtgcgaagagtgcggtaaggcttttagtgtgttcagtacattgaccaagcacaagatcattcacactagggagaaaccatacaagtgtgaggaatgtggaaaggcttttaatcagagctctatctttaccaaacacaaaatcattcacactgaaggaaaaagttataagtgtgagaaatgcggtaacgccttcaatcagtccagcaatctcaccgcccgaaaaatcatatacaccggtgagaaaccttacaagtacgaggaatgtgacaaagcattcaataaattttctaccttgataactcaccagatcatctacacgggcgaaaagccttgtaagcatgagtgcgggagagcctttaacaagtctagtaattacactaaggaaaagctgcagacctag

SEQ ID NO: 247839 - DNA, 1554 bp, Artificial Sequence
  Description of Artificial Sequence: Synthetic coding sequence
atggtggacaagacacccgtaatgtgtagtcacttcgctcaggacgtttggccagagcacagcataaaagattcctttcagaaagtaatcctcaggacatacggtaagtatggtcacgaaaacctccagctaagaaaggaccacaagagtgtggatgcctgcaaagtttacaagggcggttataatggactgaaccagtgtctgactaccactgattctaaaatctttcagtgcgacaaatacgtcaaggtgtttcataagttccccaatgtcaaccggaacaaaattcggcacactggaaagaaacccttcaaatgcaagaatcggggaaaaagcttttgtatgctgtctcagctgacacagcataagaagatccatacaagggaatatagctacaagtgtgaggagtgcgggaaagcatttaattggtcgagtactttgaccaaacataaaattatacacacaggagagaaaccatataaatgtgaagaatgcggcaaagcattcaaccggtccagtaaccttactaaacacaagataattcacacaggcgagaagccctataagtgtgaggagtgcggtaaggccttcaatcgctctagcacactgacaaaacataagcgtattcatacagaggagaagccatacaagtgcgaagagtgcggcaaggctttcaatcaatttagcatattgaacaagcacaaacgtatccatatggaagataagccctataagtgcgaagaatgtggaaaggcatttagagttttttctattttgaagaagcataaaattatacatacaggagagaaaccctacaagtgcgaggagtgcggaaaggcatttaatcaattcagcaacctcaccaagcacaagataattcacaccggggaaaaaccctacaagtgcgacgagtgtggcaaagcgtttaatcagtcaagcaccctgacgaaacataagagaatccataccggagagaaaccgtataaatgcgaggagtgcgggaaagcttttaaacagagcagcaccttgaccgagcacaagatcatacatacaggtgaaaagccctataagtgcgaaaaatgcgggaaagccttttcctggagctccgcttttaccaagcataagcggaaccacatggaggataagccctataagtgtgaagagtgcggcaaagccttttccgtcttttctactctgacaaagcataaaataatccacacacgagagaaaccatacaagtgcgaggaatgtggcaaagcattcaaccagtcctccatttttacgaagcacaagatcatccacaccgagggaaagagttacaagtgcgagaagtgtggcaacgcgtttaatcagagctctaacctgactgctcggaagataatttataccggagagaagccttataagtacgaagagtgtgataaggccttcaataagttctcaacactgattacacatcagatcatttatacaggagaaaaaccctgcaagcacgaatgcgggcgagcgtttaataagagctctaattatacaaaagagaaactccaaacttag

SEQ ID NO: 247840 - DNA, 1863 bp, Artificial Sequence
  Description of Artificial Sequence: Synthetic coding sequence
atggggcctttgcagtttagggacgtcgccattgaattttcactagaggagtggcactgcctcgatacggcccagagaaatttgtacagaaatgtgatgctcgagaactactcgaacctggtgtttcttggaattgtggtgtccaaacccgatctaattgcgcatctggagcaggggaagaaaccattgaccatgaagcggcacgaaatggtggccaaccccagcgttatctgttcacattttgcccaggatctgtggcctgagcagaatatcaaggactctttccagaaggtgattctgcgtcggtacgaaaagaggggccatggtaatctacagctaataaagcgctgtgagtctgtcgatgaatgcaaagttcacaccgggggttacaacggcttgaaccaatgctccacaactactcagtcaaaagtttttcagtgtgacaagtatggaaaggtgttccataaattctctaacagcaatcgtcacaacatcagacataccgagaagaagccatttaagtgtattgaatgcggcaaagccttcaaccagttcagtactctcattacacataagaagatccacacaggagaaaagccctatatttgcgaggaatgcgggaaagcttttaagtacagcagtgccctgaacacccataagcgaattcacacaggcgagaagccttacaaatgcgataaatgcgataaggcgttcatcgcgtcatccacactttccaagcacgaaataatccacactggcaagaaaccgtataagtgtgaggagtgtggaaaagccttcaatcagtcctccactctcactaaacacaaaaaaattcatacgggggagaaaccttacaagtgtgaggaatgtggcaaggctttcaaccagagctccacccttactaaacataaaaagatccatacgggtgagaaaccatatgtgtgtgaggagtgcggaaaagcctttaagtattctcggatactgactacgcataagcgcattcataccggagagaagccctacaaatgcaacaagtgcggaaaggcgtttatcgcttcgagtactctgagtaggcacgaattcattcatatgggtaaaaagcactacaagtgcgaagagtgtgggaaggcatttatctggtcctctgttctaacccgtcacaagcgggtgcacactggcgaaaagccctacaaatgcgaagagtgtgggaaggcatttaagtacagttccactttgagtagccataagcggtcacacaccggagagaagccatacaagtgcgaggaatgtggtaaggcctttgtggcttcaagcactttgtcgaaacacgaaattatacacactgggaagaagccctacaaatgcgaagagtgtggcaaagctttcaatcagagctctagccttacaaaacacaagaagatccatacaggggaaaaaccttacaagtgcgaagaatgtggcaaggccttcaaccaaagctccagtctgactaagcacaaaaaaattcacacaggtgagaaaccttacaaatgcgaagaatgtggtaaggcctttaatcagtcctctaccctcattaaacataagaaaatacacactagagagaagccctataagtgcgaggagtgcggaaaagcatttcatctgtctacacatttaaccacccataagatcttgcacactggggaaaagccttatagatgtagggaatgcggcaaggcatttaaccactcggctaccctgtcaagccacaaaaaaattcacagcggggagaagccttatgaatgtgacaagtgtgggaaggcttttatctcccccagttccttgagtagacacgagataattcacactggtgagaagccatag

SEQ ID NO: 247841 - DNA, 1779 bp, Artificial Sequence
  Description of Artificial Sequence: Synthetic coding sequence
atgggccctctgcaatttcgcgatgtggctattgagttttcattggaggaatggcactgcctcgataccgcccagagaaacctttaccggaacgtgatgctcgaaaactactcgaatttggtattcctagggattgtcgtgagcaaacccgatctgatcgctcaccttgagcagggaaagaaacctcttactatgaaaagacacgagatggtggctaacccgagcgttatctgcagtcactttgcccaagatctctggccggagcagaacataaaagactcattccagaaggtgattctccgacggtacgagaagagaggccatggcaacctccagctgattaaaaggtgtgagagcgtggacgagtgcaaggttcacaccggtggttacaatggcctcaatcaatgcagcaccaccactcaatctaaagttttccagtgcgacaagtacggcaaagtattccataagttttctaacagtaaccgccataatatcaggcataccgaaaagaagccatttaaatgcatcgagtgcggcaaagccttcaaccaattctccaccctgatcactcacaaaaaaattcacaccggggaaaaaccttatatctgtgaggaatgtggaaaggccttcaaatattcttcagccttgaacacccacaagcggatccacacgggagagaaaccatacaagtgtgacaagtgcgacaaggccttcattgcctcctctacattgtcgaagcacgaaatcatccatacaggcaaaaaaccttacaagtgcgaggagtgcgggaaggccttcaaccaatcctcaactctgacaaaacataaaaaaatccatacaggagaaaagccttacaagtgcgaggaatgtggaaaggcctttaatcagagttccaccttgacaaagcataagaagattcacaccggagaaaaaccttacgtgtgtgaggagtgcggaaaggcatttaaatacagtcggatactcaccacacataagcgcatccacactggtgagaagccctacaaatgtaacaagtgcgggaaggcctttatagcctcatcaacgctgtcacgtcacgagtttatccacatgggaaagaagcactacaaatgcgaggaatgcgggaaggctttcatatggtcatccgtgcttacgaggcacaagagagtccatacaggcgagaagccttacaagtgtgaggaatgtggcaaggcattcgttgcctcatcaacactgtccaagcacgagattattcacactggcaaaaagccatataagtgcgaggagtgcggtaaagcattcaatcagtcatcctctctgacaaaacacaagaaaatccacaccggggagaaaccgtacaagtgcgaggaatgcggtaaagcatttaatcagagttcatccttgaccaaacacaaaaagatccatacaggcgaaaaaccatataaatgcgaagaatgcgggaaggcctttaatcaatcctccacactcatcaagcataagaaaattcacacacgagaaaaaccctataagtgcgaggagtgcggcaaagcctttcatttgagtactcatttgactactcataaaattctccatacaggagagaaaccctacaggtgtcgagaatgcggcaaggcctttaaccattccgcaacgctgagtagtcataaaaagattcattctggcgaaaaaccgtacgaatgtgacaaatgcggcaaggccttcatatctccttcgagcttgtcacgtcatgagatcatccatactggcgagaagccatag

SEQ ID NO: 247842 - DNA, 183 bp, Artificial Sequence
  Description of Artificial Sequence: Synthetic coding sequence
atggttgccaatccttcagtgatctgtagtcatttcgctcaggatctatggccagagcaaaacatcaaggacagttttcaaaaggtgattctccgcagatacgagaagcgagggcacggaaatcttcagctcatcaaacgttgcgaatctacaccctctgaaaaagaaaagaagaaaaagtag

SEQ ID NO: 247843 - DNA, 1719 bp, Artificial Sequence
  Description of Artificial Sequence: Synthetic coding sequence
atgccgggacccttgggctccctggagatgggagtgttgaccttccgggatgtagctctcgagttctcgctggaagaatggcaatgtctggacactgcccaacaaaatctctatcgcaacgtgatgctcgagaactacagaaacttagtgtttgttgggattgcagcttccaaacctgacttgatcacctgcctcgagcagggcaaagaaccttggaacgttaaacgccatgaaatggtaacagaacccccagttgtctactcctacttcgctcaggatctctggcccaagcagggaaaaaaaaattatttccagaaggtgatcctgcgcacctacaaaaagtgtggcagggagaatcttcagctgcgaaagtattgtaagtccatggatgagtgtaaagttcataaggaatgctataacggcctaaaccagtgcctgactaccacacagaataagatatttcagtatgacaaatacgtaaaagtgttccataaattcagcaattctaataggcataaaatagggcatactggaaagaaatcgttcaaatgcaaggaatgtgaaaaatcgttctgtatgctcagccatctggctcaacataagcgcatccatagcggtgagaagccctataagtgtaaggaatgtggcaaggcttacaatgaagccagcaacctctcgacacacaagagaattcatactggtaaaaagccttataaatgcgaggagtgcggtaaggccttcaatcgcctgagccacctgacgacacacaaaattattcacaccgggaaaaaaccctataagtgcgaagagtgtggcaaagccttcaaccaatcagcaaacctgacaacacacaaacgtattcacactggggagaaaccctataagtgtgaggaatgcggcagagcattttcgcagtcctctacactgaccgctcataagatcattcatgccggagagaagccttataagtgcgaagaatgcggcaaggccttcagccagtcctctactctaactacccataagatcatccatactggcgagaaattctacaaatgcgaggaatgtgggaaagccttctccagattatctcatctgactacgcataagcggattcactcaggagagaagccgtataaatgtgaggagtgcggaaaggcgtttaaacagtcttctaccctgaccacgcacaagcgtattcacgccggtgagaagttttataagtgtgaagtgtgcagcaaggccttctcccgattcagtcatcttaccacacataagcgtatccataccggggaaaagccttataagtgcgaggaatgcggcaaggccttcaacctaagctcccagctgaccactcacaaaattatccacacaggcgagaagccttataagtgcgaagaatgcggaaaagcattcaatcagtcttcaacactaagtaagcacaaggttatccacacaggcgaaaagccatataagtgcgaagaatgcgggaaagccttcaatcaaagtagccatctaactacccacaagatgatccacaccggtgaaaaaccttacaaatgtgaagagtgcggtaaggcttttaataactcaagcattctgaacaggcacaagatgatacacaccggagagaaactctataaaccggaatcttgcaacaacgcctgcgataatatagccaagatttccaaatacaagcggaattgcgccggtgaaaaatag

SEQ ID NO: 247844 - DNA, 3114 bp, Artificial Sequence
  Description of Artificial Sequence: Synthetic coding sequence
atgtctttctggtccgagaagtgtaccaggctgattctgtatgacctaaagattgcactcaaaaatggtagtttaactttttgggatgttaccattgagtttgcactcgaggaatggcagtgcttagatatggcccaacaaaacctttacaggaacgttatgctggagaattaccgtaatttggtttttttaggaatcgcagtaagcaagctggacctcattacctgtctgaaacagggaaaagagccatggaatatgaagagacatgagatggtgaccaagccccctgtcatttcaagtcactttacccaggacttttggcccgaccagagtatcaaggattctttccaagaaatcatcctcagaacctatgcacggtgcggacataaaaacctccgcctgagaaaggattgcgagtccgtcaacgaaggaaagatgcacgaagaagcctacaacaaactgaaccagtgctggaccaccacgcagggaaaaatattccagtgcaacaagtacgtaaaggtttttcacaaatattccaatagcaataggtataaaatcattcacaccggcaaaaagccgtataaatgcgaggaatgcggaaaggccttcaagcagagttctcacctgactagacacaaagccatacatacaggggagaagccctacaaatgcgaagagtgtggtaaggcctttaatcatttttctgcccttcggaagcaccagatcatacacacaggcaaaaaaccctacaaatgtgaagagtgcgggaaggcctttagccagagttccaccctgaggaaacacgagataattcatactgaggagaagccctacaaatacgaggaatgtggcaaggcattttccaaccttagcgccctgcggaagcacgagattattcataccgggcagaaaccctataaatgtgaagagtgcggaaaagcctttaaatggtcttccaagctgaccgttcacaaggtgatacataccgctgaaaagccctgcaaatgtgaggaatgtggcaaagcctttaaacgcttttccgccctgcgaaaacacaaaatcatccatacaggaaagcaaccatataaatgtgaagaatgtagcaaggccttctccaatttctccgctctgcgcaaacatgagatcatacacaccggtgaaaaaccgtataagtgtgaggaatgcgggaaagcctttaagtggagcagcaagctaacagtgcacaaggttatccatatggaagagaaaccttgcaaatgcgaggaatgtggtaaggcctttaagcattttagcgcgcttaggaagcacaaaatcattcatactggaaagaagccgtacaaatgtgaggaatgcggaaaagcgtttaacaatagctccactctgatgaagcataagattatccatacaggcaaaaaaccctacaagtgtgaggaatgtggaaaagcattcaagcaatcaagccacctcacgcggcacaaagcaattcatactggagaaaagccctacaaatgcgaggaatgtggcaaagccttcaaccacttctccgccctgcgcaagcatcagattattcatactggtaagaagccctacaagtgtgaggagtgcggaaaagctttctctcagtcctcgacactgagaaagcatgagataattcacacgggcgagaaaccttataagtgtgaggaatgcggaaaggctttcaagtggagctcccacctgactcggcacaaggtaattcataccgaagagaagccctataagtgcgaagaatgtgggaaagcattcaaccacttctccgctctgagaaagcacaaaattatccacacagggaaaaaaccatacaagtgcgaggagtgcgggaaggccttcagccagagctcaactctgcggaaacatgaaattatccacacaggcgagaagccttacaagtgcgaggaatgcgggaaagccttcaagtggtcaagtaagttgacagttcataaggtcatccacacagcagagaagccgtgtaaatgtgaagagtgcggaaaggcctttaaacatttctccgcgctcaggaaacacaaaataatccacaccggaaaaaaaccctacaagtgcgaggagtgtgggaaggcttttaacaactcctccactttgcgcaaacatgagatcatccacaccggggagaaaagctataaatgtgaagagtgcgcccttcgcaagcacgagattattcacacaggaaaaaagccatacaaatgtgaggaatgtgggaaggctttcaacaatagctccacacttcggaaacacaaaataatttatactggaaaaaaaccatacaagtgcgaagaatgtggaaaagcattcaaacagtcctcacacctcacccgacacaaagccgtgcatactggcgagaagccatacaaatgtggggaatgcggcaaggcttttaacaactccagcactctgaaaaagcacaagctgatacacactagggaaaagagttacaaatgcgaggagtgcgggaaggcattttctaacttttctgccctgcgcaagcacaagatcatccacacaggggagaagccttataagtgtgaggagtgcgaatgcgggaaggcatttaataatagtagcactctgatgaagcacaaaattatccatactggagagaagccttataagtgcgaggagtgtgggaaaggcttcaataatttctcaaccttgatgaagcacaagatcattcacacaggcgagaaaccttataagtgtgaagagtgcggtaaagcttttaagcaatcttcacatttaactaaacacaagtccatccataccggtgagaaaccatataagtgcgaagagcgtggcaaggccttctcccacttcagtaggctgacaaaacaccggatcatccatactggcaagaagccatacaagtgcgaggaatgtggggagaaaccgtacaaatgtgaggaatgcggtaaggccttcaaccagtctagccaccttacacagcataaaaccatacatacgggcggtaaaacctataaatgtgaagaatgtgggaaagcttttaaccacctgtctgctctcactaaacataaaattatccatacaggcgaaaagccctag

SEQ ID NO: 247845 - DNA, 3021 bp, Artificial Sequence
  Description of Artificial Sequence: Synthetic coding sequence
atgagccgtcgcaagcagtccaatccgcgtcagattaagagaagcctgggggacatggaggcccgagaagaagtgcagctcgtgggtgccagtcacatggaacagaaggccaccgccccagaggcaccctcaccgccatctgccgatgtgaactcacctcccccactgccccctcctacctcccctggtgggcctaaggagttggaaggacaggagcctgagccaaggccaactgaagaggagccgggaagtccctggtctggaccagatgagctcgaacctgtagtgcaggatggccaaagacggatcagggcccgactgagtttagctaccggactgtcttggggccctttccacgggagcgtccagacaagggcctctagcccaagacaggcagagcctagccccgctctgaccctactccttgtggacgaggcttgctggctccgaactctcccccaggcccttactgaggccgaggctaatacagagatccacagaaaggatgatgccctgtggtgccgggtaaccaaaccagtccccgctgggggactcttgagtgtgttactgacagcggagccgcatagtacaccagggcatccagtaaaaaaggaacccgcagagcccacatgtcccgcaccagcgcatgatcttcaactcctgccgcagcaggccggaatggcttctatcctcgcaacagccgtgattaacaaggacgtgttcccctgtaaagactgcggaatctggtatcggtcagagcgcaacctacaagcccatctgctctactactgtgccagccgacagggaactggatctccagccgctgccgcaaccgacgagaaacctaaggagacatacccaaacgaacgcgtctgcccttttcctcaatgtcgtaagagctgtccctctgcttcatcccttgaaatccacatgcgctcacattccggcgagcgtccattcgtatgtctgatctgcctctccgcctttacgaccaaggcaaattgtgagagacacctgaaggtgcacacagatacgttatcaggcgtgtgccacagctgtggattcattagcacaacgagagatatcctgtactctcaccttgtgacaaatcatatggtttgtcagccgggttccaaaggcgagatttactctccaggagcgggtcaccccgcaacgaagttaccgcctgattcattgggctcctttcaacagcagcacaccgctctccaggggccactcgcatccgcagacttgggactggccccaaccccatcccctggtctcgaccgaaaagcacttgccgaggctacaaacggtgaagcccgagctgaaccgctggctcagaatggcggatcctcagagccgcctgcggctccaagaagcattaaggtggaagcggtggaggaacccgaagcagcccctatcctgggcccaggcgagcccggtccacaggctccatctcgtacaccgtcccctagatcacccgctcctgccagggtgaaggctgaactctccagccccactcctggcagcagcccggtgcctggcgagctgggccttgccggagccctcttcctgccgcagtatgtttttggacccgatgcggctcctcctgcaagcgagattctcgctaaaatgagcgagctcgttcattcgcgcctgcagcagggggcaggcgcaggcgcaggcggagcccagactggcctgtttcctggggcacccaagggcgctacttgcttcgagtgtgagatcaccttttcgaatgtcaataactactacgtccataagagactctactgttccgggaggagagcccctgaagatgcacctgcggctcgtaggccaaaggcccctcccggacccgctcgtgcccctcctgggcaacccgcagaacctgatgccccacggagcagcccaggtcctggtgcaagagaagagggcgctggtggggctgctactcctgaagatggcgcaggaggacggggatctgagggaagccagagcccgggttcatctgtcgatgacgcagaggatgatcctagtcggacactgtgcgaggcgtgtaatattagattctcccgtcacgagacatacacagtacacaaaaggtattactgtgcgtcaagacacgatcctcccccaagaagacccgcagctcccccaggacccccagggccagcagcacctcctgcaccgtctcccgctgcgccagtgcgaactcgtaggagaaggaaactctacgaactgcatgccgctggggctcctcctcctccccctcctgggcatgcccctgcccctgaatcccctagaccaggttccggttcgggatccggccctggcctagcacccgcaagatccccgggaccagctgctgatgggccaattgatctgtctaaaaagcctcggcgtcccctgcctggggctcctgctccggctctcgccgactaccatgaatgtactgcctgccgtgtgtccttccattcactggaggcataccttgcacacaaaaaatatagctgcccagcagccccacctccaggcgctctgggcctacctgccgctgcgtgcccttattgccctccaaacggcccagtgagaggcgatctgcttgagcattttcgcctggctcatgggctgctgctgggagcaccattagccggaccaggggtggaggcccgtacaccagccgatcgtggcccatcacctgccccagctcctgccgcaagtcctcagcccggatcacgcggtccacgggacgggttgggaccggagccacaggagcctccccctggacccccaccaagtcccgcagctgcaccagaagcggtgcctccgccacccgctccaccaagctatagcgataagggcgttcaaacacccagcaagggtacccctgccccactgcccaacggaaatcataggtattgcaggctctgtaatattaagtttagcagtctgtctactttcattgcccataagaaatattactgctcaagtcatgctgccgagcatgtcaaatag

SEQ ID NO: 247846 - DNA, 2649 bp, Artificial Sequence
  Description of Artificial Sequence: Synthetic coding sequence
atgtactactgtagcggtaggcagagggaggcggctccagtttccgaagaaaacgaagattctgctcaccaaattagctccctgtgtcccttccctcagtgtacaaaaagtttcagcaacgctagggccttagagatgcacctgaacagtcactctggagtaaagatggaggagttcttaccaccaggcgcaagtttgaaatgtaccgtgtgttcttacactgccgactctgtgattaattttcaccagcacttatttagccatttgacccaggctgcctttaggtgtaatcactgtcacttcggcttccaaactcaacgggagctacttcaacaccaggagcttcacgtgccgagcggtaaactgcctagagagagtgacatggagcacagtccttcagccaccgaagacagcctgcagcctgcaaccgacctgctgaccagatcagagcttccacagtctcagaaggccatgcagacgaaggatgcatcatctgacacagagctggataagtgtgagaaaaagacccagctgttcctgactaaccagcggccagagatccagcccacgaccaataagcagtccttctcctacacaaaaataaaaagtgagccctccagccctagacttgcttcttctcctgttcagcctaacattggcccatcatttcccgtcggcccttttctttctcagttcagttttcctcaggatattacaatggtgccccaggccagtgaaatcctcgccaaaatgagtgagctagtgcaccgccgactacgacatggctcgtcttcctatccaccagttatatacagtcccttaatgcctaagggtgctacctgttttgagtgcaatattacatttaacaatctggataactatctggtgcacaaaaagcactattgttcaagtcggtggcagcagatggcgaagagtccagaatttccatccgtaagcgaaaagatgccagaagctctgagcccgaacacaggtcagacctcgattaatctgctgaatcctgctgcccactcagctgaccccgagaatccactgttacaaacgtcttgcataaactccagtaccgtgctggatctgattggacccaacggaaagggccacgataaggatttcagcacccagactaaaaaattatcaacaagttcaaataacgatgataaaatcaacggaaagcccgtggatgtcaaaaacccaagcgtgccactagtcgatggcgagtctgatcctaataagaccacctgtgaggcctgcaatatcaccttctcacggcatgaaacatacatggttcacaaacaatattattgcgcaacaaggcatgatccgccactgaaacggtcggccagcaataaggttccagcgatgcagagaactatgcggacccggaaacgcaggaagatgtatgagatgtgcctgcctgaacaagaacagcgccctccactggtacaacagagattcctggacgtcgccaatctcaataacccatgtacctctacccaggaaccgaccgagggtcttggggaatgttatcatccacgatgcgatatttttccaggtatcgtgtccaagcatttggaaacatccctgactatcaataaatgtgtgcccgtgtctaaatgtgatacaacacattcttcagtctcttgcttggagatggatgtgccaattgacctgagtaagaagtgtctcagccagtcagagcgcacaaccacgagcccaaagaggctgctggactaccatgaatgtactgtgtgtaagatctcattcaacaaagttgagaactatctcgcccacaaacagaatttttgccccgtcactgcccaccagaggaacgacttaggccagctggatgggaaagtgttccccaatcccgaatcagagcgcaactctcctgacgtgagttatgagcgatccatcattaagtgcgaaaagaacggcaaccttaagcaaccgtctcctaacgggaacctcttcagttctcatctggccactctgcagggtctcaaggtattctctgaggccgctcagctcatcgccactaaagaagaaaaccgccatctctttctgccgcagtgtttgtatccaggtgccatcaagaaggccaaaggcgcagatcagctgtcaccttattacggaatcaagccttccgactatatttccggatctctggtgatccacaatactgatatagagcagagcagaaatgccgagaatgagtccccaaaaggccaagcatccagtaacgggtgcgccgcattaaagaaagattcgctccctctgctgcctaagaaccgcggtatggtgatagtgaacgggggactcaagcaggacgagagacccgcagctaacccccagcaagaaaacataagtcaaaatcctcagcatgaggacgaccacaaatcaccgtcttggatatctgaaaatccactggccgctaatgagaacgtgtccccaggtattccctctgccgaggaacaactcagctccatagcaaagggcgtgaacggatcaagccaggcgccaacatccgggaagtattgcaggctgtgcgacattcagtttaataatctctccaactttatcacacacaaaaaattctactgctccagccatgctgctgaacatgtcaagtag
